United States Patent 9,828,416 (MODIFIED POLYNUCLEOTIDES FOR THE PRODUCTION OF SECRETED PROTEINS) - sequence listing, part 6

SEQ ID NO: 11550 - DNA, 2862 bp, Artificial Sequence
  Description of Artificial Sequence: Synthetic coding sequence
tagcaactctgctggctgcctctcttagctcccctgttattactcaggcctcctggagtgcagagcgcgggacccattagagcgttcgtggtgcctcactcacatatggacgtaggctgggtgtacactgtacaggagagcatgcgcgcttacgccgcaaatgtatacacaagtgtggtggaggagcttgcccgtggccagcagagaaggtttattgccgtcgagcaggagttttttcgactctggtgggacggagtagcaagtgaccaacagaagtaccaggtacgacagctgctggaggaaggcaggctcgagtttgtgattggaggtcaggttatgcatgatgaggccgtaactcacctcgacgaccagattctacaattgaccgaagggcatggcttcttgtacgagacattcggaattcggcctcagttttcttggcacgtggatccctttggagctagtgcaacgaccccgactctgtttgcattagccggattcaatgcacatctcggctcacgcatagattacgacctgaaggccgcaatgcaggaggcacgcggtttgcagttcgtctggagggggtcacccagtttaagcgagcggcaagaaatttttactcacatcatggaccaatactcttattgtactccaagccacatcccattcagcaatcggtccggcttttactggaacggagtcgctgtcttcccaaagccaccccaggacggggtgtatcctaatatgtcagagccagtgacccctgcaaacattaatctgtacgcagaagcacttgttgctaacgtcaaacagcgggctgcatggttccgaacacctcacgtgctgtggccctggggttgcgataaacagttcttcaatgcctcggtgcaatttgccaacatggaccccttgctggaccatataaattcacacgcagccgaacttggagtgtcagtacagtacgcgactttaggtgattacttccgggcactccatgccctgaatgtcacatggcgggtcagagatcaccatgattttctcccatacagtactgaacctttccaggcttggacgggcttttacacatccaggtcgagcctgaagggtttagcacgtcgggcttctgctctgctgtacgctggggaatctatgtttaccaggtacctgtggccagcgccaagagggcacctcgatcctacatgggcacttcagcagctacaacagctgcggtgggctgtaagtgaggtgcagcatcacgatgctattactggtaccgagagccctaaagtaagagatatgtatgcaacccacctggctagcggcatgctgggcatgcgaaagctgatggccagtatcgtgctggacgagctgcagccacaagcccctatggcagcaagcagtgacgccggaccagctggtcactttgcatctgtctataatccactggcatggaccgtcaccacgattgtcaccctcactgtagggttccctggcgtacgcgtgaccgacgaagccggacaccccgtgccatctcagatccagaatagcacagagacaccaagcgcatatgatcttctgattctcaccacaatcccaggcctttcgtaccgacactacaatatccgccctactgccggagcgcaggaggggacacaagaacctgctgcgacagttgcaagcacactccagtttggtaggcgcctaaggcggaggaccagtcatgcagggaggtacctggtccccgtggccaacgactgctatatagtgttgctggatcaggacacgaatttaatgcactccatctgggagcgtcagagtaacaggacagtgagagtcactcaggaattcctggagtaccatgtcaacggagacgtgaaacagggccctatttcggataattaccttttcactccaggaaaagcagctgttcccgcttgggaagctgtcgaaatggaaatcgtcgcgggacagcttgtgactgagattagacaatatttctaccgcaacatgaccgcacaaaactacacctacgctatcagatctaggcttacgcacgtcccccagggccacgacggtgaactcctgtgtcatcggatcgagcaagaataccaggccggacctctggagctcaatagagaagctgtgctccggacctctacaaaccttaacagccaacaggtaatttacagcgacaacaacggatatcagatgcagaggcgaccctatgtgtcttacgttaataactccatcgccaggaattactacccaatggttcagagcgctttcatggaggacgggaaaagtcggttggtactcttgagcgaaagggctcatggtattagctcccagggtaatgggcaggtcgaagtcatgctgcacagaaggctgtggaacaacttcgactgggatttaggctacaaccttacccttaatgacacatctgtggtccatcccgtgttgtggctcttactcggcagctggtcactgactacagccttgcgacagaggtctgccctggcactccagcaccgacctgtggttctattcggcgatttggccggaacagcacccaagctgcccggtccccagcagcaggaggctgtcaccctacctccgaatttacatctccagattcttagcattcctggatggagatacagttctaatcacacggaacactcacaaaatctacgtaaggggcatcggggagaagcccaggccgacttgagacgggtgctgctgagactgtatcatctgtacgaggtaggcgaggatccagttctgtcccaacccgtaaccgtcaatctggaggttaactttcctactcccatccaaactattagtcagggatctaaaccatag

SEQ ID NO: 11551 - DNA, 459 bp, Artificial Sequence
  Description of Artificial Sequence: Synthetic coding sequence
atgcggtttaaaacgacggccaaagatggcctcctgctgtggcggggtgatagcccaatgcgcccaaattcggactttatctctctgggtctgagggatggtgccctagtgtttagctacaaccttggtagcggcgtcgcaagtattatggtcaacgggtcttttaacgacgggcgatggcacagggttaaggcggtcagagatggtcagtccgggaagattacagtggatgactacggtgccagaacaggtaagagccctggcatgatgagacaacttaacattaatggtgctctttacgtgggcggaatgaaggagatcgccctacatactaatcgacagtacatgagagggctggtcggatgtatctcacacttcactctttctaccgattatcatatttctctggtggaggacgccgtcgatggcaagaatatcaacacctgcggcgcaaagtag

SEQ ID NO: 11552 - DNA, 1701 bp, Artificial Sequence
  Description of Artificial Sequence: Synthetic coding sequence
atggacttcttactggcgctcgtcttggtctcatctctatacttgcaggccgcagctgaattcgatggccgatggcctcggcagattgtatctagcataggtctctgtagatacggcggaagaatagattgttgctggggttgggctaggcagagctgggggcagtgccagcccgtctgtcagccaagatgtaagcatggcgaatgtataggaccaaacaaatgcaaatgtcatccaggctacgcaggtaagacttgtaaccaagacgagcacatcccagcccctctggatcagggaagcgagcagccgctgttccaaccactggaccaccaggccacaagcctgccctccagggacttgaatgaatgcggcttgaaaccacgcccatgtaagcacaggtgcatgaatacatacgggtcctataagtgctattgtttaaacgggtacatgctgatgccagatggctcctgctcctccgcccttacatgcagtatggccaactgccaatacggctgcgatgttgtcaaaggacagataaggtgtcagtgtccttcaccgggactgcagctggcccctgatgggagaacctgcgtggacgtagacgagtgcgcaaccggaagagctagttgcccaagatttcgacaatgcgtcaacaccttcggatcatatatctgcaagtgtcacaaaggttttgacctcatgtacatcggcggtaaatatcagtgccacgacatcgacgaatgcagccttgggcagtatcaatgcagtagcttcgcgagatgctacaatattaggggatcatataagtgtaagtgcaaggaaggataccagggtgacggcctcacttgtgtttacatcccaaaagttatgatcgagcctagcggtcccatccatgtgccaaaagggaatggaaccatcttgaagggagatacgggcaataacaactggatccctgacgtcggatctacttggtggcctccaaagacgccatatatccccccaataataactaaccgccctacttcgaaaccaactacccgccctactccaaagcccactcctattcccactccaccaccacctccccctctgcctacggagttgcgcacacccttaccccctactacgccagagcggcctaccaccggacttaccaccatcgcacctgccgctagcacaccccctggcggtattaccgtagataacagggtccagactgacccacaaaaaccgagaggagacgtgttttctgtgcttgtgcatagctgcaatttcgaccatgggctttgcggctggatacgggagaaagataacgatttgcactgggaacccatccgagatccggcagggggacagtacctgactgtttctgccgcaaaggctcctggaggtaaagccgctcggcttgtcctacccctgggccgattgatgcatagtggcgacctgtgcctgagcttccgccataaagttactggcttacatagcgggacattgcaggtttttgtgcggaaacatggcgcacatggagccgcattgtgggggaggaatggcggacacggatggaggcagactcagattactttgagaggggctgacattaagtcagttgttttcaaaggggaaaagcgcagggggcacacgggcgaaatcgggttagacgatgttagtttgaagaaagggcattgttcggaggagcggtag

SEQ ID NO: 11553 - DNA, 213 bp, Artificial Sequence
  Description of Artificial Sequence: Synthetic coding sequence
atggggcctgaggccttgtcctcgctgctgcttctccttttagtggcaagcggagacgcagacatgaaaggacacttcgacccagctaagtgccgttatgctctgggcatgcaagatcgcacaatccccgatagcgacatcagcgcaagctccagttggagcgacagcactgcagctagacatagcagattggagtcatccgacggtgattag

SEQ ID NO: 11554 - DNA, 237 bp, Artificial Sequence
  Description of Artificial Sequence: Synthetic coding sequence
atgggcccagaggccctgtcaagccttctgctgctgcttctagtcgcatccggcgacgcagatatgaagggccactttgacccagccaaatgtcgttacgctttgggcatgcaagaccggacaatacccgattctgacatatctgccagctcttcctggtctgacagcaccgctgccaggcactctaggctggagtcctccgatggagacggtgcatggtgccccgcaggaagctag

SEQ ID NO: 11555 - DNA, 339 bp, Artificial Sequence
  Description of Artificial Sequence: Synthetic coding sequence
atgcggttcaagacgactgcgaaggatggccttttactgtggcgcggagactcccccatgagacccaatagtgatttcatcagtttggggctccgggacggcgctctcgttttctcatataatctcggctcgggggtggctagcattatggtgaacggttcgtttaacgacggcaggtggcaccgcgttaaggcagtaagagatgggcagtccgggaagataactgtggatgattacggagccaggacaggcaagagtcctggaatgatgagacagctaaacattaacggggctctctatgtggggggaatgaaggagatagcactccacacgaactag

SEQ ID NO: 11556 - DNA, 2685 bp, Artificial Sequence
  Description of Artificial Sequence: Synthetic coding sequence
atgtcgctgcccagatgctgtccacacccactccgtccggagggtagcggggcaatgggaccggaggctctgagctctctcttgctgctgctcctggtggcctcaggggatgccgacatgaaagggcactttgaccctgccaagtgccgctacgcactcggaatgcaggacaggaccattccagacagtgacatttctgctagtagctcatggagtgattccactgcagcacgccattctcggctggagtcctctgacggagacggggcttggtgcccagctggatctgtatttccaaaagaggaggagtatctgcaagtggacctgcagagactgcacctggtcgcactggtgggaactcaggggaggcatgccggtgggctgggaaaagaattcagccggtcttatcgactgaggtactcccgggacggcagacgatggatgggatggaaggataggtggggacaagaggtgattagcggcaacgaagatcctgagggcgtggtcctgaaagaccttgggccacctatggtggcccgactggttcggttttaccctagggccgatagggtgatgagtgtgtgcctaagggttgagctgtacgggtgtctgtggagggatggcctgctgagctatacagcccctgtcgggcagactatgtatctgtcagaagccgtgtacctgaatgacagcacatatgatggccacacagtggggggactgcaatacgggggactggggcaactggctgacggagttgtgggactggatgactttcgaaagtcacaagaactcagggtgtggccaggctatgattacgtaggctggtctaatcacagtttcagctccggatacgtggaaatggagtttgaatttgaccgcctgcgcgcttttcaggccatgcaagtacattgcaacaacatgcatacattaggcgcaaggttgccagggggtgttgaatgcaggtttcggagagggccagcaatggcttgggaaggagaacccatgcggcataatcttgggggaaacctgggagatcctcgagccagagccgtgagtgtgccactgggcggacgggttgctaggtttctccaatgtcgctttttattcgcaggaccctggcttctcttctcagagatatcttttatctctgatgtagtcaataattcttcacctgcccttgggggtacattcccacctgcaccctggtggccccctgggcctccgccaaccaactttagctctctcgagcttgaaccgagggggcagcagcccgtggctaaggctgagggatcccccaccgccatcctcatcggatgtcttgtcgctattatccttctcctcctgttgatcatagcactcatgctttggaggctgcattggcgccgattactgtccaaagcagagcggagggtgttggaggaagaactgactgtccacctctcagtccctggggatacaattctgatcaataaccgtccgggtcccagggagccccctccataccaggaacccaggcctcgtggcaatccaccacattccgccccatgcgtgcccaacggttcagcatactctggtgactacatggagcccgagaagcctggggcacccctgcttcccccacccccacaaaactcagttccacattacgcggaggctgatatcgtcaccttacagggcgtgaccggagggaacacttatgcagtcccggcactgcctccaggtgctgtgggtgacggaccccctcgggtggactttcccaggtcccggttacggtttaaggagaaactgggggagggtcaatttggcgaggtgcacctgtgtgaagtcgactcaccccaggacttggtgtccttagatttcccacttaatgttcggaagggccaccctctgctggtggcagtgaaaattctccgtcccgatgcaactaagaacgcgcgaaacgattttctgaaggaggttaagatcatgtcaaggttaaaggaccccaatatcatccgccttctgggagtgtgcgtccaggatgatccattgtgtatgataacagactatatggaaaatggtgacctcaaccagttcttatcagctcatcagctggaggataaggccgcagagggcgcacccggtgatggacaggctgctcaaggaccaacgatttcttaccccatgctgctgcacgtagcagctcagatagcctcagggatgcgctatttggctaccttaaatttcgtgcaccgggatctagcgactaggaactgtctcgtgggggagaactttaccatcaagattgctgatttcggcatgagcaggaacctgtatgctggggattattaccgcgtccaaggtcgggcagttctgccaattcgctggatggcttgggagtgcatcttgatgggaaagttcacaactgcatctgacgtttgggcctttggggtgaccctctgggaggtcctaatgctttgccgcgctcagccatttggccagctcaccgatgaacaggttattgagaacgcaggcgagttcttccgggaccagggacgccaggtgtacttaagcagaccccctgcttgcccacaaggactttacgagctcatgctgaggtgttggagtcgcgaatccgaacagcggcctccctttagccagctacaccgtttcctggccgaggatgccctcaataccgtgtag

SEQ ID NO: 11557 - DNA, 384 bp, Artificial Sequence
  Description of Artificial Sequence: Synthetic coding sequence
atgggcccagaggcactcagttcgttgctcctgctgctgctggttgcatctggagacgccgatatgaagggccatttcgatccggcaaaatgtaggtacgctctgggcatgcaggaccgaactatcccagattctgacatcagcgcatcaagcagctggtctgacagtacggcagcgcgtcacagccggttggaaagtagtgatggagacggagcctggtgtcctgccggtagtgtcttccccaaagaggaggagtacctgcaggtggaccttcagagactgcacctcgttgccttagtgggaacgcaggggaggcatgctggtggtctggggaaggaatttagccgcagttataggctgcgttacagcagggacggcagatag

SEQ ID NO: 11558 - DNA, 1113 bp, Artificial Sequence
  Description of Artificial Sequence: Synthetic coding sequence
atgaagaaggacgagcccccactagacttccccgataccctagagggcttcgagtatgcctttaatgaaaagggtcagctgcggcatatcaaaaccggagagcctttcgtcttcaactacagggaggacttgcaccgttggaaccagaaacgctatgaagccctcggcgaaatcatcaccaagtacgtgtacgaactgctggagaaggactgtaacctcaaaaaagtgtccattcctgtggacgccaccgagagcgaaccaaaaagtttcatctttatgtcagaagacgctctgacaaatccacagaaattaatggtactaattcacggcagtggtgtggtccgcgctggccagtgggcaagacgtttgattataaacgaggacttggattccggtacgcaaatccctttcatcaaacgggctgtagctgagggctacggggtcattgtgcttaatcccaacgagaattatatagaggtggagaaacctaaaatccatgtccagagtagcagcgactccagtgacgagcctgccgagaaaagggaacgtaaagacaaagtctccaaggaaaccaaaaagcggcgagatttttatgagaaatataggaacccccagcgtgaaaaagagatgatgcaactgtacatccgcgagaatggctctccagaggaacacgcaatctatgtttgggaccatttcatcgcccaggctgctgcagagaatgtattctttgttgcacattcatatgggggtctggcattcgttgagctcatgatccagcgcgaagctgatgttaaaaacaaggtgacagctgttgctctgaccgacagtgtgcataacgtgtggcaccaggaggctggcaagaccattagagaatggatgagggagaattgttgtaattgggtttcatccagtgagccactagacactagcgtggaaagcatgctccctgactgtccaagggtctctgcaggcacggatcggcacgaactgacgagttggaagagttttccctctatcttcaaattttttacagaagcgtcagaagcaaaaacctcctcactcaagcccgctgtaacacggagatctcatcgtataaaacatgaagagttatag

SEQ ID NO: 11559 - DNA, 435 bp, Artificial Sequence
  Description of Artificial Sequence: Synthetic coding sequence
atgaagacaggattattttttctctgtctgctaggtaccgctgcagcaattcccacgaacgctcgtctgctttcagatcattcaaagcccaccgcagagaccgttgcccctgacaacacagcgattccttccctaagagcagaggcagaggagaatgagaaagagaccgccgtaagcacagaggatgattcccatcataaggccgagaagtccagtgttttgaagtcgaaagaagagtcacatgagcaaagtgcagaacaggggaagtcttcgtcccaggaacttgggctcaaagaccaggaggactctgatgggcacttatcagtgaatcttgaatatgcacctactgaaggtacactcgacatcaaagaggacatgtctgagccacaagaaaagaaattgagcgagaatacggattttctggcacccggttag

SEQ ID NO: 11560 - DNA, 1341 bp, Artificial Sequence
  Description of Artificial Sequence: Synthetic coding sequence
ctgaccttacatagcttgacatgctacgaggacctcgtgaccttcctccagcagtcaatacatcaatttgaggtgggaccgtacggatgtattctcctcaccctgtccgccattctgagccgcagtactgaacttattaggcaagactttgacgtgccgacttcccacctgatcggcgctcacggctactgcacacaagagctggtgaatctcttgctgaccggaaaggccgtgtcgaacgtgttcaatgatgttgtggagctcgattctggcgatggtaacatcaccctccttagaggcatcgcagctcgatctgacatcggatttctcagcttatttgagcattacaatatgtgccaggttgggtgcttcttgaaaaccccgaggtttcccatttgggtggtgtgttccgagtctcacttttcaattttattttccctgcagcctggcctactgagggactggcgaacagagcggctgttcgacctgtactactacgacgggctggccaaccagcaggagcagatcagactcacaattgacactacacagaccatcagtgaggatacagataacgacttggtccccccattggagctgtgtattagaaccaacatcggcagtgcactgggctttaagtacccggttggaaacaatcagacagcagtgcaggacaacgttaaagtctctctggctttcggactgtccatcgctacactggctcaatccgtcgggcatatttcgggcgctcacctcaatcccgcagtgaccctcggcctgctcctgtcatgtcagatcagcatattccgagcattaatgtatattattgcccaatgtgttggcgcaatcgtggcaaccgctatacttagcggaatcacttccagcttgacaggcaatagcctgggtagaaatgatttggcggatggcgtcaatagtggccaggggctgggcattgagatcatcggcactcttcagctggtgttgtgcgtccttgccactaccgaccgccgaagacgcgacctgggaggcagtgcgcctctggcaatagggctgtcggtggccctcgggcacctgctggccatcgattacactggctgtgggatcaaccccgctaggtccttcggaagcgcggttatcacgcacaacttctctaaccattggatcttttgggtgggccctttcatcggcggagcactggcagtattaatctacgacttcatcctggctccaagaagctccgacctgacggacagagtgaaggtgtggacaagcggccaagttgaagagtacgatctggatgccgacgatattaattcaagggtggaaatgaaacctaaatag

SEQ ID NO: 11561 - DNA, 81 bp, Artificial Sequence
  Description of Artificial Sequence: Synthetic coding sequence
atgaaactgctgctgtgggcttgtatcgtctgtgtcgccttcgcccgtaagaatgcaggactgggattcctctggctctag

SEQ ID NO: 11562 - DNA, 348 bp, Artificial Sequence
  Description of Artificial Sequence: Synthetic coding sequence
atgggccctgaggctctgtccagcctgttgttactcctcctggttgcctcgggagatgcagacatgaaagggcacttcgaccccgctaagtgccggtatgcccttggcatgcaggacaggacaatccctgattccgatatttctgctagctcatcttggtcagattctacagctgcgagacactctagactagagtcaagcgacggggacggcgcttggtgtccagcaggctccgttttccctaaggaagaagagtacctccaggttgacctccagagactccatctcgtggctctagtcggcacccaaggtcgtcacgccggaggcctcgggaaggagtttagttag

SEQ ID NO: 11563 - DNA, 165 bp, Artificial Sequence
  Description of Artificial Sequence: Synthetic coding sequence
atgtacattccactggaccccgattataatgccgattgccctaacgtaactgcccctgtgtgcgcttccaacggccacactttccagaatgagtgttttttttgcgttgagcaaagagaattccattacaggatcaagtttgagaaatatgggaaatgcgattag

SEQ ID NO: 11564 - DNA, 351 bp, Artificial Sequence
  Description of Artificial Sequence: Synthetic coding sequence
atggtacttctgcattggtgtcttctctggctactgtttccgttgtcgtcccggacccaaaaactccccactagggacgaagagttatttcagatgcagatccgggacaaggccttctttcatgatagctcagtgatccctgacggcgctgagattagcagctatctcttccgagatacaccaaaacgctatttctttgttgtcgaggaagacaataccccacttagcgtgactgttaccccgtgtgatgcacctcttgagtggaaactgagcttgcaggagttaccggaagaccggtccggcgagggcagcggtgacttggagcccctggaacagcagaagcagcaatag

SEQ ID NO: 11565 - DNA, 432 bp, Artificial Sequence
  Description of Artificial Sequence: Synthetic coding sequence
atggggcctgaggctctctcatctctgctcctgctgcttttggtcgccagcggggacgctgacatgaaggggcatttcgatcccgctaagtgcagatacgctctgggaatgcaggatcgcaccatccctgattctgatataagtgcctcatctagttggtccgacagcaccgcagcccgacattctcggctagagtcctcagacggggacggagcttggtgcccagctggatcagtatttcccaaggaagaagagtatctgcaagtggacttgcagcgattgcacctagttgctctggtgggaactcaaggccgtcatgccggaggactgggaaaggagtttagtcgctcctatagattgcgatatagtcgggatggccgtcgatggatgggatggaaggatcgatggggccaggaggtgatcagtggctag

SEQ ID NO: 11566 - DNA, 747 bp, Artificial Sequence
  Description of Artificial Sequence: Synthetic coding sequence
atggagctgctccaagtcaccattttattcctccttcctagcatctgctcatccaattccacaggggtgctggaggcagccaacaacagcctggtcgtaactaccaccaaaccctctattactaccccaaacacagagagccttcagaagaatgtagtcactccaactaccgggaccactcccaaaggaacaataacgaacgagctcctaaagatgagcctcatgtctaccgcaaccttcctgacgagtaaggatgagggcctcaaagcaacgactaccgacgttaggaagaatgactctattatttcaaatgtcaccgtcacttccgtgacattgccaaacgccgtgtctacgttacaaagctccaaacccaagtcgtcggtactgcaacctgacgcttcccccagtaagacgggcacccttaccagtattcccgtcactattccggagaataccagccagtcccaggtgatcggcaccgagggtggtaaaaatgcaagtactagtgcaacatcgcggagctactcaagcatcatcctgccggttgttatcgccctgatagttatcacattgtccgtgtttgtccttgttggactgtaccgaatgtgctggaaggccgaccccggtacacccgaaaacgggaacgatcagccgcagtccgacaaggaaagcgtcaaactactgacggtgaaaactatctctcatgagtcaggggaacattcagcccagggtaagaccaaaaactag

SEQ ID NO: 11567 - DNA, 363 bp, Artificial Sequence
  Description of Artificial Sequence: Synthetic coding sequence
atgaagacagggctgttttttctgtgtctgttgggcacagcggctgctatacccacaaacgctcggctactatccgatcatagtaaacccacagccgagaccgtagcacccgataatacggcaattccctccctgagagctgaagcagaagagaacgagaaggaaactgccgtgagcaccgaggacgatagccatcacaaagctgaaaagagttcggtactgaagagcaaagaagaatcgcacgaacagtccgcagagcaggggaagtctagtagtcaagaactgggcctgaaggaccaggaagacagtgatggccacctgtctgtgaatctggagtacgcccctacagaagggacactgtag

SEQ ID NO: 11568 - DNA, 339 bp, Artificial Sequence
  Description of Artificial Sequence: Synthetic coding sequence
atgggaccagaggcgctctcttccctgctcctgcttctgctcgtggcttctggagacgcagacatgaaaggacatttcgatcctgcgaaatgccgctacgctctggggatgcaggacaggaccattccggacagtgacatctcagcatccagttcctggagcgatagcaccgccgcaagacactccaggctggagtccagtgacggagatggcgcttggtgtcccgctggctcggtctttcctaaagaagaggagtaccttcaggtggacttgcagcggctacatcttgtggctttggtgggcacccagggacgccacgccggtggactgggaaagtag

SEQ ID NO: 11569 - DNA, 513 bp, Artificial Sequence
  Description of Artificial Sequence: Synthetic coding sequence
atgggaccggaggcactatcctctctgctgctgttgctgctagtcgccagcggagacgcagacatgaaaggtcactttgaccccgctaaatgtcggtatgcccttggcatgcaggacaggactattcctgacagtgacatctcagccagttccagctggtccgatagtaccgcagcacgtcacagtcgcttagaatcgtccgacggcgatggagcatggtgccccgcaggtagcgtcttccctaaagaagaggaatacttacaggttgacctgcagcggcttcatcttgtggctcttgtgggcacacaaggtaggcacgccggaggcctgggcaaagagttcagccggtcatacaggctccgctattccagagatggccgtcgttggatgggctggaaggacagatggggtcaggaggttattagcggcaatgaggaccccgagggcgtcgtcctaaaagatctcgggccacccatggtggctaggctggttcgcttctaccctcgagcttag

SEQ ID NO: 11570 - DNA, 417 bp, Artificial Sequence
  Description of Artificial Sequence: Synthetic coding sequence
atggggcctgaagccctaagttctctgctgctcctgctattggtcgccagcggtgatgcagacatgaaaggccacttcgatccagccaagtgcagatacgcactgggaatgcaagatcgaaccatccctgatagcgacatcagtgcctcaagcagttggagtgactctaccgctgctcggcattctagacttgagtcttccgatggagacggggcatggtgccccgctggctcagtttttcctaaagaggaggagtacctccaggtcgatttgcagaggctccacttggtagcactcgtgggtacccaggggaggcatgcaggagggctgggtaaggagttcagccgaagttatagacttcggtactcccgagacgggcgaagatggatgggctggaaagaccggtgggggcagtag

SEQ ID NO: 11571 - DNA, 285 bp, Artificial Sequence
  Description of Artificial Sequence: Synthetic coding sequence
atggcggctttcccccacaagattatcttctttctggtttgttctaccctgacccacgtggccttctctggaatctttaataagcgtgatttcactagatggcctaagccgaggtgtaaaatgtacataccgctggacccagactacaacgctgactgccctaacgtcactgctcctgtgtgtgcgtctaacggccatacctttcagaatgagtgtttcttctgtgtcgaacaacgagagtttcactataggattaagttcgaaaagtatggtaagtgcgattag

SEQ ID NO: 11572 - DNA, 156 bp, Artificial Sequence
  Description of Artificial Sequence: Synthetic coding sequence
atgggcccagaggctctgagttcattactactgcttcttctggtagcgagtggggatgctgacatgaagggtcatttcgaccccgctaaatgccgatatgccctggggatgcaggatcgcaccatcccagactctgacatcagcgcaagttcttag

SEQ ID NO: 11573 - DNA, 2760 bp, Artificial Sequence
  Description of Artificial Sequence: Synthetic coding sequence
atgggaccggaggcgttgtccagccttttgttactgcttttagtggcttcaggtgatgctgatatgaaaggtcactttgacccagcaaagtgtcgttatgccttgggtatgcaggacagaacgattccggattctgacataagtgcgtcatcatcttggagcgatagcacggccgcacggcattctcggctggagagttcagacggggatggtgcatggtgccccgcaggtagcgtgtttcctaaagaggaggagtatctgcaggttgatctacagaggttacacctggtcgcccttgtagggactcagggacggcacgccggagggttaggtaaagagttctccagatcttatagattgcgatatagcagagatggtaggcggtggatggggtggaaagacagatggggacaggaagtgatcagcgggaacgaagatcctgaaggcgttgtgctgaaggatctcggacccccaatggtggcccgattagtcagattttaccctagggcagacagggtaatgtccgtgtgcctccgtgttgaactgtatgggtgtctctggagagacggattgctgagctacacagccccagtgggacagaccatgtacttgtctgaggcggtctatctgaacgattcgacctacgacggacatacggttgggggattgcagtacggcggactgggacagttggctgatggcgttgtgggtctggatgatttcaggaaaagccaggaactgagagtatggcccggttacgattatgtcggttggagcaatcactcattctccagcggctatgtcgaaatggagttcgaatttgaccgcctgagggcttttcaagcgatgcaggtgcattgtaacaatatgcacaccctgggcgctcggctccccggaggtgttgaatgtagattcaggagagggcctgccatggcttgggagggggagcccatgaggcacaatctgggcggtaatctcggagaccctcgcgcacgtgccgtttcagtacccttgggcggtagagtggccaggtttctccagtgccggtttttgttcgccggaccatggctactgttctcagaaatctcctttatcagcgatgtagtgaacaatagctctcccgctttgggaggtaccttcccgcctgccccatggtggcctcccggtccgccaccaactaatttttcgtccctggagcttgaaccgagggggcagcaaccggtggctaaagctgagggcagtcctaccgctattcttatcgggtgtctcgtggccatcatccttttgttgctgctgatcattgcgttgatgctgtggagactccactggaggcgattactgtccaaggctgagcggagggtcctggaggaggagctcaccgttcacctgagtgtccctggcgatacaattctgattaacaaccggccagggccacgagaacccccaccctaccaggagccccgaccaagagggaacccacctcatagcgccccttgcgtgccaaacggctccgctctcttactttctaaccccgcttatagactcctcctggccacctatgctcgcccaccacggggtcccggaccaccgactcctgcctgggctaagcccacaaatactcaggcctactctggggattatatggaacccgaaaagcctggcgctcctctcctgccacccccacctcaaaactccgtcccgcactatgctgaggcagacattgtaacactgcagggagtgaccggcggaaacacttacgctgtgcctgctcttcctcccggagcagtgggggatgggccaccacgtgtcgattttcctcggtccaggctgagattcaaggaaaaattgggagagggccaattcggcgaagtgcacctttgtgaagtggacagtcctcaggatctggtgagtctagatttccctctgaacgtgcgcaagggtcatcccttattggtggctgtaaaaattctgaggccagatgcaactaaaaatgccagtttttcccttttctcaagaaacgacttcctgaaggaggtgaagattatgtcaagactcaaagaccctaacattattagattgcttggggtatgcgtgcaggacgaccccctctgtatgattaccgactatatggagaatggagatttaaaccagttcctgtctgcccaccagctggaggataaagcagccgagggcgcacccggtgatggccaggctgcccagggtccaaccatatcttaccctatgttactacacgtggcagctcagatagctagcggtatgcggtatcttgccacgctgaactttgtgcacagagatctggctactagaaattgtttagtcggcgagaacttcacgattaagatcgccgattttggcatgagccggaacttatacgccggagactactatcgggtgcagggacgagcagtcctccccattcggtggatggcgtgggaatgcatactcatggggaaattcacaactgcttctgacgtgtgggcttttggggtgaccctctgggaagtactgatgctctgtcgcgcacagcctttcggccaactgaccgatgagcaggtaatcgaaaatgccggagagtttttccgggaccaaggcaggcaggtgtaccttagccggccacctgcttgtccccaagggctttacgagctgatgctccggtgttggagcagggagtcggagcagagacctccattctctcagttgcaccgttttctggcggaagatgctttaaacactgtctag

SEQ ID NO: 11574 - DNA, 318 bp, Artificial Sequence
  Description of Artificial Sequence: Synthetic coding sequence
atgggagtatctaaactagatatactctacagacgactgctgctgacaaagttgttcatacgaggctggggtcgtcccgaggatctgaaaagactctttgaatttcggaaaatgattgggaatagggaacggtgtcagaatctagtctcaagcgattatccagtgcacatcgacaagatcgaagaacagtctgactgtaaaattctcgacggccacttcgtgagcccaatggcacattacgtgcccgacatcatgcctatcgagagtgtcattgccagatttcagttcattgtccccaaagagtggaattcaaaatag

SEQ ID NO: 11575 - DNA, 126 bp, Artificial Sequence
  Description of Artificial Sequence: Synthetic coding sequence
atgaaactgagcggaatgtttctgctgctctctctcgcactcttctgcttccttactggagtttttagccagggaggtcaggttgactgcggcgaattccaggatcccaaggtgtactgtacatag

SEQ ID NO: 11576 - DNA, 459 bp, Artificial Sequence
  Description of Artificial Sequence: Synthetic coding sequence
atgagatttaaaaccactgctaaggatgggctgctgctgtggaggggggactccccaatgcggcctaattcagattttatctcccttggcctccgggatggggctttggtctttagttataatctcggatccggggtcgccagcattatggttaatgggagctttaacgatggccgttggcaccgggtgaaggcagtgagagacggccagtcaggcaaaattaccgtcgacgattatggggctcgtactggtaagtcccccggaatgatgcgccagcttaacattaatggagctctttacgttggcggaatgaaggagattgccctacacacaaaccgccagtatatgcgagggctggtagggtgtatcagccacttcacactgtctaccgattatcatatcagcctcgtggaggacgccgtcgacggtaagaacattaatacatgtggcgctaaatag

SEQ ID NO: 11577 - DNA, 1611 bp, Artificial Sequence
  Description of Artificial Sequence: Synthetic coding sequence
atggatttccttctcgccttagtactcgtcagctctctgtacttgcaggccgctgccgaattcgatggcaggtggcccagacagatcgtttcctccattggactctgtcgatacggcggacgtatcgactgttgttggggctgggcgagacagagctggggccagtgccagcctgtgtgtcagccgcgttgtaagcacggagagtgcatagggccaaataaatgcaagtgtcaccctggctatgctggcaaaacctgcaaccaggacctgaacgagtgcggcttaaaaccaagaccctgcaaacatcggtgcatgaatacttatggctcgtataagtgctattgccttaatggctatatgctgatgcctgacgggagttgttcctctgcactgacctgcagcatggccaactgccagtacggatgcgacgtcgtgaaaggacagataaggtgtcagtgtccttcccctggcctacagctcgcacccgatggcaggacctgtgtggacgtggacgaatgtgccaccggacgggcttcttgtccgaggtttcggcaatgtgtgaatacattcgggagctacatttgtaagtgtcacaagggttttgatctcatgtacattggtggaaagtaccaatgtcacgacatcgatgagtgctcactcggacaataccagtgcagctcattcgccagatgttataatatccggggttcctacaagtgcaaatgtaaggaaggctaccagggagacggcctgacgtgtgtttacatccctaaggtgatgatcgagccaagtggtcccattcatgtgccaaagggtaatgggacaattctgaagggcgacactgggaacaataattggatcccggacgtcggatccacatggtggccccctaaaacaccctacatccctcctatcattaccaaccggcctacctctaaaccaacgacgcgtcccactccgaaaccaacacctattccgactccacctcctccaccccctctgccaaccgaattgcggacaccgctccctccaacaacgcctgagcggcctacgaccgggctcactaccatcgctcctgctgcttcaactccccctggaggtatcaccgttgacaaccgcgtgcagaccgaccctcaaaagccacgaggtgacgtgttctccgtgctcgtgcacagctgcaatttcgatcatggactgtgcgggtggatccgcgagaaagacaacgatctacattgggaaccgatccgggatccagcaggaggacagtacctgactgtgtctgcggctaaagccccaggcggtaaagcagcgcgactcgttctgccactgggacgtctcatgcactcaggagatttatgcttatcgtttcgacacaaagtaaccggactgcatagcgggacattgcaagtgttcgtgaggaagcacggggcacatggcgctgctttgtgggggagaaacggagggcacgggtggcggcaaacccagattactttacgaggggctgacataaaaagtgtcgtatttaagggcgaaaaacggcgtggtcacacgggagagatcggccttgatgacgtgtcactcaagaaaggacattgttctgaggagagatag

SEQ ID NO: 11578 - DNA, 288 bp, Artificial Sequence
  Description of Artificial Sequence: Synthetic coding sequence
atgttgttccgaaatcggtttcttctgttactagcgctggctgccctcctggccttcgtgtccctttcactgcagttctttcatctgattcccgtatctacccccaaaaatgggatgtcctctaagtctagaaagaggataatgcctgatcctgtgaccgagccaccagttacagatccagtttatgaagctcttctgtactgcaatatccctagcgttgctgaacgctccatggagggccatgcgcctcatcattttaaactggtgtctgttcacgtgtttatttag

SEQ ID NO: 11579 - DNA, 213 bp, Artificial Sequence
  Description of Artificial Sequence: Synthetic coding sequence
atggcctccgatttgataagaacaatcctggcagtagccctgatcagtaaattaggcaccgctgtggacgctgagctgatgccttcaggcgcaatccttcagaacaaacgcgagaaccttccaagagtgtgtcatgccctggccttccttggcatggcgagatgccaggatctattcctcgtacggctacagggctggaagctggggacatag

SEQ ID NO: 11580 - DNA, 417 bp, Artificial Sequence
  Description of Artificial Sequence: Synthetic coding sequence
atggggcctgaagccctgtcttcccttctattgttgctgcttgtcgcaagcggggatgcggatatgaagggacatttcgaccccgctaaatgtcgctacgccctgggtatgcaggacaggaccattccggactctgatataagcgctagtagtagttggtccgactcaaccgctgcacgccatagccggctggaatcatcagacggcgacggcgcttggtgcccggcagggagcgttttccccaaggaggaagagtacctccaggtggatcttcagaggctgcacctagtggccttggtcgggactcaggggaggcacgccggaggactcgggaaagagttctctagaagttacagacttcggtattcccgcgatggcagacgctggatgggctggaaggaccggtgggggcagtag

SEQ ID NO: 11581 - DNA, 219 bp, Artificial Sequence
  Description of Artificial Sequence: Synthetic coding sequence
atggcagtgtctgtgctccgcctgacggtcgtgctcggccttctggtccttttccttacctgttacgcagatgacaagcctgataaacccgatgataaacccgatgattcgggcaaggacccgaagcctgacttccctaagttcttatctctcctcggaacagaaattattgagaacgcagtggaattcattctgaggagtatgagccgttctacgtag

SEQ ID NO: 11582 - DNA, 438 bp, Artificial Sequence
  Description of Artificial Sequence: Synthetic coding sequence
atggtgctgctgcactggtgtttgctgtggctgctgtttcccctcagtagtcggacgcagaagctccctactcgggatgaggaactgtttcagatgcagatccgagacaaggctttcttccacgatagcagtgtgattccagatggtgctgaaatctcatcatacttattccgtgacaccccgaaacgatactttttcgttgttgaggaggataatacccctttgtcagttactgtaaccccttgcgatgccccactggagtggaaactctcccttcaagagttgcctgaggacagatctggggagggttctggtgatctcgaaccccttgaacaacagaaacagcagattataaacgaggagggtacagagctgttcagttacaaggggaacgatgttgaatacttcatttccagttcatccccatcaggcttgtag

SEQ ID NO: 11583 - DNA, 258 bp, Artificial Sequence
  Description of Artificial Sequence: Synthetic coding sequence
atgggacccgaagcattgtcttccctgctgttgctcctgttggtggcttcaggggacgctgatatgaagggccactttgaccccgctaaatgtagatatgcattgggcatgcaggaccggacgatccccgacagtgacatttccgcgagtagtagctggagcgatagtacagccgcacggcacagtcgcctggagtcatcagatggtgacggggcttggtgtccggcaggttcagtgtttcctaaggaagaggagtag

SEQ ID NO: 11584 - DNA, 1410 bp, Artificial Sequence
  Description of Artificial Sequence: Synthetic coding sequence
atgcttaaggtgcattaccctaagttcggggtgtctgaagactgtctgtatcttaatatctatgccccagcccatgcagacaccggctccaaattaccggtgctcgtgtggtttcccggaggagcgttcaagaccggttcagccagcatcttcgacggttcagctctcgccgcttatgaggatgtgctggtggtcgtggtccagtatcggttagggattttcggtttctttactacttgggatcagcatgccccaggaaactgggcctttaaggaccaagtggccgctctgagctgggttcaaaaaaatatcgagttctttggtggtgacccatcatcagtcaccatatttggtgagtcggccggagctatttctgtgtccagtctgatcttgtcaccaatggcaaaaggccttttccataaggcgataatggaatcaggcgtcgctattataccatacctggaggctcatgactatgagaagtcagaagatctgcaggtcgtggcgcacttttgcggcaataatgctagcgatagtgaagctcttcttcggtgtcttcggacgaagcccagcaaggagctgctcactctgagccagaagaccaaaagctttaccagagtcgtcgatggagcattcttcccaaacgagccgctagacctgctgagccagaaagcattcaaagccatccctagcatcattggcgtcaataaccacgaatgtggcttcctgcttcctatgaaagaggccccagagatcctctcagggagcaataaaagcctggctctgcacctaattcagaacatcttgcacataccaccccaatatctgcatttggttgcaaatgaatatttccacgataagcacagcctcactgaaatccgcgactccctcttggacctcttgggcgacgtattctttgtagtaccagcactcataaccgcaaggtaccaccgggacgctggggctcccgtttatttctacgaattccgccatcggccacagtgttttgaagacacaaagcctgcatttgttaaggcagaccatgcagatgaggtaaggtttgtgtttgggggagcctttctgaagggggacatagttatgtttgaaggagctaccgaggaggagaaactgctgtcacgaaaaatgatgaaatattgggccacttttgccaggacaggaaaccctaatggtaacgatctgtcactctggcctgcgtacaacctgaccgagcagtacctgcagttagacctgaacatgtccctggggcagagactaaaggagcccagggtggatttctggacaagcactatccccctgattctctctgcctctgacatgctgcacagccctttgagttccctgacgttccttagcctgttgcagccattcttctttttctgcgctccttag

SEQ ID NO: 11585 - DNA, 393 bp, Artificial Sequence
  Description of Artificial Sequence: Synthetic coding sequence
atgctgccctttcttttcttctctaccctcttctcgtctatttttaccgaggcccagaagcagtattgggtgtgtaacagcagcgacgcaagcatctcgtatacttactgcgggagggatctgaagcagctatactttaatctgtatatcacagtgaacacgatgaacttacctaaacgcaaagaggtgatttgtcgtgggtctgacgatgattactccttttgccgggcattaaaaggagaaacagtgaacaccacaatctcttttagtttcaagggaatcaagttctccaaaggtaaatacaagtgtgtggtcgaggctataagcggctctcccgaagagatgcttttttgccttgagtttgttatcttgcaccagcctaactctaactag

SEQ ID NO: 11586 - DNA, 318 bp, Artificial Sequence
  Description of Artificial Sequence: Synthetic coding sequence
atgaaatgcaccgccagagagtggctgagggtaaccaccgttttattcatggccagggccattcctgcaatggtcgttcctaacgcaacattgttggaaaagctcctggagaagtacatggacgaagatggggaatggtggattgctaagcaaagaggaaagcgcgctatcaccgataacgacatgcagagtattttagacttgcataacaaactcagaagtcaggtgtatcctaccgcctccaatatggaatatatgacttgggacgttgagctggagagaagcgccgaatcgtgggcagaatcctgtttgtggtag

SEQ ID NO: 11587 - DNA, 567 bp, Artificial Sequence
  Description of Artificial Sequence: Synthetic coding sequence
atgacaatggtttgccaccggccagagggactggaacaacttgaagcccaaactaatttcacaaaaagggaactccaagtcctctatcgtggtttcaaaaacgaatgcccgagcggagtggtgaacgaagatacttttaaacaaatctacgcccagttcttcccccacggagacgctagcacatacgcccactatcttttcaacgcctttgacaccacccaaaccggatcggtgaagttcgaggattttgtaactgctttatccattctcctgcgcggtactgtgcatgagaaactgaggtggacttttaacttatacgatattaataaagatggttacatcaacaaggaagagatgatggatatcgtgaaggccatttacgacatgatgggcaagtacacctacccagtcttgaaagaagataccccgagacagcacgtggacgtcttcttccagaaaatggacaagaacaaggatgggatagtgacactggacgaatttcttgaaagctgtcaggaggatgataacattatgcgaagcctacagctttttcagaatgtgatgtag

SEQ ID NO: 11588 - DNA, 1275 bp, Artificial Sequence
  Description of Artificial Sequence: Synthetic coding sequence
atgcctcccttccttataacactttttctcttccattcatgctgcctgagagccaacgggcatcttagagaggggatgacactgctgaagactgagttcgcattgcacctgtatcagtccgtggccgcttgccgaaacgagacaaactttgttataagccctgccggtgttagcttgccactggagatcttgcagttcggcgctgagggctccactgggcagcaactcgccgatgccctgggatacaccgtgcatgacaagagagtgaaggattttctgcacgccgtgtacgctactttacccacctcgtcacaagggaccgaaatggagttggcctgcagtctgttcgtgcaagtgggaactcccctgtccccctgtttcgttgagcacgtttcatggtgggccaactcttctttggagcccgctgatttgagcgagcccaattccactgcaattcagacgtctgaaggggcaagcagagaaaccgctggaggcggtcccagcgaagggcctggtggatggccctgggagcaggtctccgccgcttttgctcagttagtacttgtatccaccatgtcattccagggcacttggaggaagaggttttcttccactgacacacagatcctgcccttcacatgtgcatacgggctagtgctgcaggttccaatgatgcatcagactacggaagtgaactacggacaattccaggataccgcaggccaccaagtcggcgtgctagaactgccatacttgggttcagcagtatcactgttcctggtactgcccagagataaggacacgcccctgagtcacatagagcctcatttgactgcctccacaattcacctgtggactaccagtctgcgcagagccaggatggatgtgtttctgcctaggtttagaatacagaatcagttcaatcttaaatctatcttgaatagttggggcgtcaccgacttatttgacccccttaaggcgaacttgaaggggatcagcgggcaggatgggttttacgtttctgaggccattcataaagctaaaatagaagtcctagaggagggtactaaggccagcggggctaccgccttgctgctgctgaagagatctcggatcccaatctttaaggccgatcgacccttcatctattttctgagggagcctaacaccggaattacagttttcttcgaccggatccagattatttaccagtgtctgtcttccaacaaaggatcctttgtgcattaccccctgaagaacaagcattctttttag

SEQ ID NO: 11589 - DNA, 1815 bp, Artificial Sequence
  Description of Artificial Sequence: Synthetic coding sequence
atggccgtccttgtctgtcccgcatcgtgccacggtttgaaggaattccggatccggagaggaatgtggagactgtgtctggtttattatttctaccctgcttcgagcacactctacgtgctgaggattgacgtcctcaactatacttctaaagatgagggccctagcgccgaaggtccacagagaaatacccggctaggctggatccagggcaagcaggtgacagtcctgggcagtcccgtgcctgtgaacgtgtttcttggagttccgttcgccgcaccacccctggggtcactgcgcttcaccaacccacagccagcctccccctgggacaacctccgggaagcgacttcataccctaatttatgtttgcaaaatagcgagtggttgttgctggaccagcacatgttgaaggttcactatccaaaattcggcgttagcgaagactgcctgtatctcaacatatacgcacctgctcacgccgataccggatcgaagcttccagttttggtctggttcccagggggtgcatttaagactggcagcgccagcatattcgacgggtctgctctcgcagcttacgaagatgtgctggtggtcgtggtgcagtacagattgggaatcttcggatttttcacaacatgggaccagcacgccccaggaaactgggcgtttaaagaccaggtggccgcactgtcttgggtgcaaaaaaatattgagttcttcggaggtgatccatctagtgtgacgatcttcggcgagtcagctggtgctatttctgtttccagtctgatcctgagtccgatggcgaaggggctttttcataaagcaataatggaatccggcgtggcaataatcccatatttagaggcccacgactacgagaagtccgaagacctccaagttgtggcccatttttgtggcaataatgccagcgactccgaagccctgctgcggtgcctccgcaccaagccctctaaggagctgctcactctaagccaaaagaccaaatccttcactcgcgtggttgatggggcattttttccaaatgaaccgctggacctgcttagccagaaggccttcaaggccatcccctcaatcatcggagtcaataatcacgagtgcggattcctgctgcctatgaaggaggcaccagaaatcttgagcggctcaaacaagtcactggcacttcatctcatccagaatatcctacacatccctccacagtacctacacctggtcgccaacgaatacttccacgacaaacactccctcactgagataagggacagcctcttggacctgttaggagatgtcttcttcgtggtacccgcactgattaccgctcgataccatcgcgacgctggagcgccagtgtacttttacgaatttaggcatcggcctcagtgtttcgaggatacaaagccggcattcgtgaaagctgaccacgccgatgaggtgagattcgtattcggcggagctttcctaaaaggcgatatcgtaatgttcgaaggcgcaactgaagaagaaaagttgctatccaggaaaatgatgaaatactgggccacattcgcgcgtacggggaatccaaacgggaacgatctttctctgtggcctgcttacaacctgactgaacagtatctgcaacttgacctgaacatgtcgctgggacaaaggctaaaggaaccaagagtggacttctggacctccaccatccccttaatcctaagtgctagcgacatgctccatagcccgctgtcgagcctcacttttctctctctcctgcagccattctttttcttttgtgccccttag

SEQ ID NO: 11590 - DNA, 939 bp, Artificial Sequence
  Description of Artificial Sequence: Synthetic coding sequence
atgaacatttggggacagatttggcccaaagccgtgtatctggtgtgtaactacagtccaaagggcaactggtgggggcacgccccttacaaacacgggcgaccttgctccgcctgtcctccatcattcggagggggatgccgggagaacctctgttacaaggagggctccgaccgttactaccctccccgtgaagaggaaaccaacgagattgaacggcagcagtcgcaggtacatgatactcatgtgcgtactcgctccgacgatagtagcagaaatgaagtcatctcagctcaacagatgtcacagatcgtgtcatgtgaggtgcgcctgagggaccaatgtaaaggtaccacatgcaatagatacgaatgcccagcagggtgtctggattcgaaggccaaggtcattggcagcgtgcattacgagatgcagtcctctatctgccgggcagccatacattacggcatcatcgataatgacggcggatgggtcgacattacgagacagggacgaaagcattactttatcaaatctaaccggaatggaatacagaccattggtaagtaccaaagtgcgaattcatttacggtgtccaaggtgacggtccaagccgttacgtgtgaaaccacagtggaacagttgtgtccatttcacaaaccagccagccactgccccagagtgtactgcccgagaaattgcatgcaggccaacccacactatgctagagtgataggaaccagggtgtactctgacctgagttcaatatgtcgggctgctgtgcacgcaggagtggtgcgaaaccacggaggttacgtcgacgttatgccggtggacaagagaaagacatatatcgctagcttccagaacggcatcttttccgagagcctgcagaaccctcccggtggcaaggcattccgcgtgttcgctgtggtttag

SEQ ID NO: 11591 - DNA, 777 bp, Artificial Sequence
  Description of Artificial Sequence: Synthetic coding sequence
atgatagccatttctgcagttagcagcgccttgttattctctctcttgtgcgaagccagtacggttgtgttattgaattcaacggattccagcccaccaaccaataatttcacagacatcgaggccgcactgaaagctcagctggacagtgctgacattccaaaagccaggcggaagcgctacatcagtcagaacgacatgattgctatacttgactaccacaaccaggtgagaggcaaggtgttccctcctgcggctaatatggaatatatggtgtgggacgagaatttagcgaaaagcgccgaggcctgggccgcaacatgcatctgggatcacggcccatcctaccttctgcgctttctcggccagaatttatccgttcggacaggcaggtatcgctccattctccaactcgtgaaaccatggtatgacgaagtgaaggactatgctttcccctatccccaggactgtaatccacgatgccctatgaggtgtttcggcccaatgtgcactcactacacccagatggtgtgggccacttccaacaggatcggatgtgccatccatacttgccagaacatgaacgtgtggggtagtgtatggcgccgtgctgtgtacctggtctgcaactacgcccctaaggggaattggatcggtgaggctccttacaaggtgggagtgccttgctccagctgcccccctagttacggtggatcttgcacagacaacttgtgtttccctggggtgacctcaaactacctctactggtttaagtag

SEQ ID NO: 11592 - DNA, 1215 bp, Artificial Sequence
  Description of Artificial Sequence: Synthetic coding sequence
atgccccctttcctgatcactctgttcctgttccatagctgctgtctacgggctaacgggcacttaagagaggggatgacccttctcaagactgaattcgcattacatctctaccaatccgtagctgcttgtcgcaacgagacaaactttgttatttctcctgccggtgtgtcacttcccttagagattttgcagtttggtgccgaagggtctaccggacaacaactggcagacgccttgggatacacagtccacgataaacgcgtaaaggactttctccatgcagtgtacgctacactgccgaccagtagccagggaaccgaaatggagctcgcctgctctctgttcgtgcaagtgggaactcccctctcaccctgctttgttgaacatgtgtcgtggtgggcgaatagcagcctggagcccgctgatttatccgagcccaatagcactgcaattcaaacatcagagggggctagcagggaaaccgctgggggaggtccgagcgaaggacctggcggttggccctgggagcaagtttctgctgccttcgcacagctggtgttggtgtcaaccatgagctttcaaggaacctggaggaagaggttctcatccaccgacacccaaatattgcctttcacttgcgcctatggactggtcctgcaagtgcccatgatgcatcagacaacagaggtgaactacgggcagtttcaggatactgccggtcatcaggtgggagttctggaattgccatacctgggctccgccgtcagcctattcctggttctgccacgcgataaagacactcccttgtcacacatcgagcctcacctcacagcttcaacaatacatctatggacaactagcctgcggcgagctcgaatggacgtttttttgccacgattccgcatccaaaatcaattcaatctgaagtccatcctgaatagttggggggtgacagatttattcgatccattaaaggccaacctcaaaggaatttccggtcaggatgggttctatgtgagtgaagcaatccataaggctaaaattgaggtgttggaagaaggcaccaaagcttcaggggctaccgctctcctgctgctcaaaagaagtcggatccccattttcaaagccgacagaccttttatatattttcttcgggagccaaacacaggttttgtgttttctatcggtcgagtttccaatcccttggattag

SEQ ID NO: 11593 - DNA, 936 bp, Artificial Sequence
  Description of Artificial Sequence: Synthetic coding sequence
atgctgtaccagacgatcaactctctgaagacgaaaaaccccaaattgaagattcttctttcaatcggcggatacctgtttggcagcaaaggatttcacccaatggtggattcctccactagtcgactggagtttatcaattccattattctgtttctccggaaccataacttcgacggattagacgtgtcctggatttacccagatcagaaggaaaacacacacttcacggtcctgatccatgagctcgctgaagcctttcagaaagatttcacaaagagcaccaaagaacggcttttactaactgctggagtgagcgccggtaggcagatgatcgacaactcataccaagtcgaaaagctagccaaggaccttgattttatcaatttgttgagtttcgactttcacggatcctgggaaaaacccctgatcacaggccataatagtcccctttccaagggctggcaagaccggggaccgtccagttattataacgtcgagtacgccgtgggctactggatccacaagggcatgcccagtgaaaaggttgtgatggggattccaacatatggtcacagcttcactttggcaagcgccgaaacaacggtcggagctcccgcatctggaccaggggctgctgggcctatcaccgagtcttccggattcctcgcctattacgaaatctgtcagtttctaaagggcgcaaagatcacgcgcttgcaggaccagcaagtcccctacgccgttaaagggaatcagtgggtgggctatgatgatgtcaagagcatggaaacaaaggttcagttcctcaagaatctcaacctgggaggagcaatgatttggagtatcgatatggatgatttcaccggcaagagctgtaaccagggcccataccctctcgtgcaggctgtaaaacgttcactcggaagcttatag

SEQ ID NO: 11594 - DNA, 555 bp, Artificial Sequence
  Description of Artificial Sequence: Synthetic coding sequence
atggcaagcgagcgactgccaaatcgacccgcttgcttactggtcgcatctggggcagctgagggtgtgagtgcgcaaagcttccttcactgctttactatggcatctacagcattcaatctccaggtcgctacccccggaggcaaggctatggagttcgtggacgtgactgaatccaacgcccgatgggtccaggacttcagactgaaggcctacgcgtctccagcaaaactagagtcaattgatgaacccatctgtgccgtaggccatggcgtcgcagccctttgctgtgcaacgaacgaggatagatcctgggttttcgattcatattctcttacgggcccttcagtctgcgagttagttcgcgctcccggttttgccagactgcctctggtggtggaggatttcgtgaaggactctggagcatgctttagtgcctcggaaccagatgctgttcatgtggtcctggatcgccacctcgtgacaggccagaatgctagctcgacagtaccagcagtccagaatctcctgtttttatgtgggtcccgaaagtag

SEQ ID NO: 11595 - DNA, 1257 bp, Artificial Sequence
  Description of Artificial Sequence: Synthetic coding sequence
atgcggagtttgctgctgctctcagctttttgtttactggaagctgcacttgctgcagaggtaaagaaacccgcagccgctgccgctccagggaccgccgagaagctgagccctaaggccgctactctcgccgaaagaagcgcgggtctagcattttcattgtatcaagcgatggccaaggaccaggcagtggagaacatactggtgtcgccagtcgtggtagcatcctccctaggactcgtcagtctcggaggaaaagcaaccaccgcttcgcaagcgaaagcagtgctgagtgccgagcagttgagggatgaagaggtgcacgctggactgggcgagctcctacgcagcctgtccaactccaccgcccgaaacgtaacctggaaactaggctcccgcctgtatggaccaagttccgtgagctttgctgacgacttcgtaaggtcctccaagcagcactacaactgcgagcactcaaagattaattttcgtgataagcgctccgctctgcagtctattaatgaatgggcggctcaaactacggacggtaaactgccagaggtgactaaggacgttgagaggacggacggggcactgctggtcaatgcgatgttcttcaagccccactgggacgagaaattccatcacaaaatggtggataaccggggtttcatggtgacccggtcatatacagtcggtgtaatgatgatgcatagaacagggctgtacaattactatgatgacgaaaaggaaaagttgcagattgtggagatgcctctcgcgcacaagctgtcttctctgataatactcatgccacatcacgtggaacccctagagcggttggaaaagttattgacgaaggagcagctcaagatctggatggggaagatgcaaaaaaaggctgtggcaatttctctgcccaagggtgtggtagaggtgactcacgacctccagaagcacctggctgggctcggtctgaccgaagccatagacaaaaacaaggccgatctgtcacgaatgtctggcaagaaggacctgtacttagcttctgtcttccatgctactgctttcgaactggacaccgatggaaatccttttgatcaagacatctacgggagagaagagttgcggtcacccaagctcttctacgctgatcacccctttattttcctggtgagagatacgcagtccggatcgcttttatttatcgggagattggtgcgccctaagggagataagatgcgagatgagctgtag

SEQ ID NO: 11596 - DNA, 1425 bp, Artificial Sequence
  Description of Artificial Sequence: Synthetic coding sequence
atggatcgtaatcccagtccacctccccctggcagagacaaagaggaagaggaggaagtcgctggcggagattgcattggatccacagtatacagcaaacattggctgttcggcgtacttagtggcttaattcagatcgtgtctcccgaaaacactaaatcaagctctgatgatgaagagcaactgacagagctagatgaggaaatggagaacgagatttgccgcgtgtgggatatgtccatggacgaagacgtagcactgttcctccaggagtttaatgcccctgacatcttcatgggcgtactggcaaaatctaagtgtccgaggctgcgtgaaatttgtgtgggtattctcggaaatatggcctgctttcaggagatctgcgtgtccattagcagcgataagaaccttgggcaggtgctgctacactgtctgtatgactcggacccaccaacactcctggagacaagccggttattgttgacctgtctttctcaggcggaggttgcttcggtgtgggtggagcgcatccaggaacatccagccatctatgacagcatttgttttatcatgtctagttccacgaatgtggacctcctggtcaaagttggggaagtcgttgataaattattcgacttagatgaaaaactcatgctggagtgggtgagaaatggcgctgcccaaccacttgatcagccgcaggaagagtcagaggaacagcctgtttttagactcgtgccatgcattctggaggcagccaagcaggtgcgctcagagaatcccgagtggctagatgtgtacatgcatattttacaactgctcacaacggtggacgatggaatccaagccatcgtgcattgccctgacaccggcaaggacatttggaatctcctctttgatttggtttgccacgagttttgtcagagtgacgaccctcccattattctgcaggagcagaagacggttttggcaagcgtgtttagcgttttatctgccatctacgcctcccagactgaacaagagtacctgaaaatagagaaggtcgatctcccattgatcgatagcttgatccgggtgctgcagaatatggaacaatgccagaaaaagccagaaaacagcgcagagtctaatacagaggagactaaaagaaccgacttgacacaagacgattttcacctgaaaatcttaaaggacattctttgcgagttcctctcaaacatatttcaggctctgaccaaggagaccgtcgcccaaggcgtaaaagaaggacagctcagcaaacaaaagtgttcatctgctttccaaaatttacttccattctatagccccgtggtggaggatttcattaaaatactgcgggaagtggataaagcactggccgacgatctggagaagaactttccaagcctcaaagtccagacatag

SEQ ID NO: 11597 - DNA, 438 bp, Artificial Sequence
  Description of Artificial Sequence: Synthetic coding sequence
atgctgacacgattggttctatctgcccacctgtcttcaactacctcaccaccttggacacacgcggcaatctcatgggagctggacaatgtgcttatgcctagccccaggatatggccccaggtaacccccactggtaggtcagcctccgtccgctctgaaggcaatacatcctctctgtggaacttctccgcaggccaggatgtccacgccatcgtgactagaacttgtgaaagcgtcctgagctcagctgtgtatacccatgggtgcggctgtgtgcggtctgctaccaacatcacctgccagagctctggccagcagaggcaggcagccagacaggaggaggaaaactctatatgtaaagcccatgattctagggaaggtcgactcggttatccgctttctgcccatcaaccgggaagcggcggtcccaattag

SEQ ID NO: 11598 - DNA, 1728 bp, Artificial Sequence
  Description of Artificial Sequence: Synthetic coding sequence
tagatctttggagggtcaatccactattttcgggtcccacgcgagtattggagagatcggctcttgaagatgaaggcatgcgggctgaacacattaacaacatatgtgccgtggaatctccacgagcctgagagagggaagtttgacttttctggaaacctggatctggaagcttttgtgttaatggccgcagagataggtctttgggtgattcttaggccaggcccttacatctgtagcgagatggatttaggaggcctccctagctggctgttgcaggatccaggcatgaggctgaggaccacatataagggttttactgaagccgttgacttgtactttgatcacctcatgtccagagtagtacccctgcagtacaaaagaggcggtcccattattgcggtccaggtcgaaaatgagtacggatcttataataaagatccagcctatatgccctatgtgaaaaaggccctcgaagacagggggatcgtcgaactccttctgaccagtgataacaaggacgggctttcaaaaggaatcgtgcagggggtcctggccaccataaaccttcagagcacccatgagcttcaactgctgacaacttttctgttcaacgtacagggaacccagccgaagatggtaatggagtactggactggatggtttgattcctggggcggaccacacaacatcctggacagtagcgaagttctgaaaactgtgtccgcaatcgtggacgcaggatcctcaatcaacctctatatgtttcacgggggaaccaacttcggttttatgaatggagcgatgcattttcacgattacaaaagcgatgtgacgtcctatgactacgacgcagttctcacagaggcaggggattataccgctaaatacatgaaattacgcgatttttttggcagtatctcagggattccactgccccctcctccagacctgttgcccaagatgccctatgaacctctgacaccagttctctacctatctctgtgggacgcacttaagtacctgggagaacctatcaagtcagaaaagcctataaacatggagaacctgcccgtgaacggaggcaacggacaaagtttcggctacatactgtacgagacctccatcaccagcagtggcatcttatctggtcatgtccatgaccggggacaggtgttcgtgaacaccgtgtcaattggctttctggattacaagacaactaaaatcgcggtaccactgatccaaggatacaccgtgctgcggatccttgtcgagaaccgcggtcgggtcaattatggggagaatattgatgatcaacgcaaagggctaataggaaacctgtacttgaatgatagtcccctcaagaactttaggatatacagcctagatatgaagaagtcattttttcagcgcttcggcctggataagtggtcttccctgcctgaaacgccaacgttacctgctttcttcttaggatctctgagtatctcttcaacgccctgtgacaccttccttaagctcgagggctgggaaaagggcgttgtgttcattaatggtcagaacctagggaggtactggaatataggacctcagaaaaccttatacctgcctggaccatggctgtcttctggaattaaccaggtaatcgtctttgaagaaactatggcaggtcctgcgctgcagtttacggaaactccacatcttggtcggaatcagtacatcaagtag

SEQ ID NO: 11599 - DNA, 255 bp, Artificial Sequence
  Description of Artificial Sequence: Synthetic coding sequence
atgaggacactgtttaatctgctgtggctggctctcgcctgttcccctgtccacaccactttgtcaaaaagtgatgccaagaaagccgcttctaagactctgctggaaaaatcgcaattttccgataagcccgtgcaggacaggggactcgtcgttacagacctcaaggcagagtcagtcgtgctggagcacaggtcatactgctctgccaaagcccgtgatcgacatttcgcaggagatgttctgggctactag

SEQ ID NO: 11600 - DNA, 744 bp, Artificial Sequence
  Description of Artificial Sequence: Synthetic coding sequence
atgagatccctgctcctcctctctgctttctgtctgctggaggccgcacttgccgctgaggtgaaaaaacctgcggcagcagcagcacccggaactgccgaaaaactttctcccaaggctgcaactcttgccgaaagatcggcaggcctcgccttttctctgtatcaggctatggctaaggatcaagccgtggagaacattctcgtttcaccagttgttgtcgcgtcctccctcggcttagttagcctgggaggtaaagcaacaacggcgagccaggccaaagctgttctcagcgccgagcagttacgcgatgaggaggtgcacgcaggcctcggcgagcttttaaggagtttatctaactctacagctcgcaacgtgacatggaaactgggatctaggctctacgggccatctagcgtgtctttcgctgatgatttcgtacgtagctctaaacagcactataactgtgagcactccaaaattaactttagagataagagatctgcccttcaatcgataaacgaatgggccgctcagacgaccgacggcaagctgcctgaggtaacgaaggacgtggagcggacggacggggctctgctggtgaacgccatgtttttcaagccacattgggatgaaaaatttcaccacaagatggttgacaatcgcggtttcatggttactcgatcgtataccgtcggagtgatgatgatgcacaggaccgggttgtataactattatgactag

SEQ ID NO: 11601 - DNA, 117 bp, Artificial Sequence
  Description of Artificial Sequence: Synthetic coding sequence
atgaggacccttttcaacctcttatggctggcactcgcgtgttctcctgtccacaccaccctgtccaagtcggatgctaaaaaggcagcaagtaaaactctgttggagaaagtatag

SEQ ID NO: 11602 - DNA, 750 bp, Artificial Sequence
  Description of Artificial Sequence: Synthetic coding sequence
atgagaagtctgctgctgctgtccgctttctgcctgctcgaggccgcacttgccgcagaagttaaaaagcccgctgccgcagccgctcctgggactgccgagaaactgtccccaaaggccgctacattagcagaaagaagcgccggtctagccttctctctctatcaggcgatggcaaaggaccaggcagtggagaacatactcgtgtccccagttgtggtggcatcttcccttggccttgtcagtttgggaggaaaagcgactactgccagccaggccaaggcagtgctctcagcagaacagctgagagatgaggaggtccacgctggcctcggagagttgctgcggagtctaagcaactcaaccgcacgcaatgttacctggaaactcggatcgcggctttatgggccttcctcagtgtcttttgccgacgacttcgtgagaagcagtaaacagcattataactgtgaacactcaaaaattaatttccgagataaacgctcagccctgcagagcattaatgaatgggccgctcagacaaccgatggcaaacttccagaggtgacaaaggacgtcgagaggactgatggggctctgctcgtgaacgccatgttcttcaagccacactgggacgagaaattccaccacaaaatggtggacaacagaggcttcatggtcacccgtagctatacagtcggtgtgatgatgatgcaccgcacaggattgtataactactacgacgatgaatag

SEQ ID NO: 11603 - DNA, 201 bp, Artificial Sequence
  Description of Artificial Sequence: Synthetic coding sequence
atgaagcccctgttagtagtgttcgtctttctgttcctgtgggacccggtgcttgccggtatcaacagcctgtcaagtgagatgcacaaaaagtgctacaaaaacggaatttgccgcctcgaatgctatgaatccgagatgctggtggcctattgtatgttccagcttgaatgctgtgtgaaaggaaaccccgcaccatag

SEQ ID NO: 11604 - DNA, 1002 bp, Artificial Sequence
  Description of Artificial Sequence: Synthetic coding sequence
atggtgagtaagtctaggtggaagttattggccatgttagcgctcgtattggtcgtcatggtatggtattcaatctccagggaggacagatacatcgaacttttctatttcccaataccagaaaagaaggagccttgcttacaaggtgaggccgaatccaaggccagcaaactttttggtaattattctcgggatcagccgatctttctgcgtctggaggactatttctgggtgaaaacaccttctgcctatgagctgccatacggtactaagggctctgaagacctcctgttgagggtgctcgccattacaagctcaagcatcccgaagaacatccagtccttaagatgcaggcgatgcgtggtagttgggaatggccaccggctccgaaacagctccctgggagatgcaattaacaagtacgacgtggtgatccggctaaacaacgcgcctgttgccggttacgagggggacgtgggtagcaaaacaacaatgaggctattctaccctgagagcgcacatttcgatcctaaagtagagaacaatcccgacactctcttggtgttggtggcttttaaagccatggatttccattggattgagaccattctctcagataaaaaacgtgtgcggaagggtttctggaagcagccacccctcatctgggacgtcaatcccaagcagatccggattttgaatccattcttcatggagatcgctgcagacaaactcctgtctctcccaatgcagcagccacgtaaaatcaagcagaaacccaccactggacttctcgccatcacgctggctcttcatctgtgtgacctggtgcatattgccggtttcggatacccagacgcatacaataagaagcagacaatccactactatgaacaaatcaccctgaagagtatggcaggctctggccataatgtgagccaggaagcactcgctatcaagcgtatgctggaaatgggcgctatcaagaatttgacatctttctag

SEQ ID NO: 11605 - DNA, 645 bp, Artificial Sequence
  Description of Artificial Sequence: Synthetic coding sequence
atgcggcctaagaccggccaagtgggctgtgagacacccgaggaactgggcccaggacccaggcagcgctggcccctgttattgctgggcttggccatggtggcacatggccttctccgccctatggtggcccctcagagcggggatcccgacccgggagcatccgtcgggagctcacggtcttcccttagatccttatgggggagactgctgctgcagccaagccctcagcgggctgaccctaggtgttggccaaggggcttctggagtgaaccacagtccctctgttatgtgtttggaactggaaccaaggtgaccgtattgggccagcccaaagctaaccccacggtaaccctgttccccccaagttcagaagagctgcaagcaaataaggcaacactcgtatgcctcatctcagatttctatcccggagcagtcacagtcgcctggaaggccgatggtagcccggtgaaggccggtgtcgagacaacaaagcccagcaaacagagcaataacaagtatgccgcatcctcttatcttagcctgactcctgagcaatggaagtcacacaggtcatacagctgtcaagtcacccatgaagggagtaccgtggaaaagacggttgctcccacagagtgtagctag

SEQ ID NO: 11606 - DNA, 1050 bp, Artificial Sequence
  Description of Artificial Sequence: Synthetic coding sequence
taattgtataaaaaccggctggggtccggcggtagaggacgctgtatcaagcaaggagaaaactggtactcccccaccgaatttgaagctatggcagggcgagccagttccaaggattggaagcggtcgatacgctacgctggcaggccacttcaatgcctaatacaagacgggatcttgaacccccatgcagctagctgcacatgtgctgcttgttgtgacgatatgactctcagtgggccagtgcgtcttttcgtgccctacaaacggcgaaagaaagaaaatgaacttccaaccaccccagtcaagaaggactcgccaaagaatatcactctgcttccggcaacagcagctactacgtttaccgtcactcctagcggccaaatcactacaagtggggctttaacttttgatagagcgagcacagtcgaggccaccgccgttatctctgagtccccagctcagggagacgtgttcgctggcgcaacagttcaggaagcctccgtgcagccgccttgcagggcctcccatcctgaaccccattatccaggttaccaggactcctgccagattgcgccattccccgaggctgctctcccgacttcccatcccaagattgtccttacctctcttccggcactggctgtgccaccgcctacgcctacaaaggcagcccctccggctctcgtgaatgggctggagcttagcgagccaagaagttggctgtatctggaggagatggttaactccctcctgaatacagcacaacagctaaaaacactgtttgagcaagcaaaacacgcgtctacttaccgcgaagccgcaaccaatcaagctaaaatacacgccgatgctgagcgaaaggaacaaagttgtgttaactgcggcagggaggctatgtccgagtgcacaggctgccacaaggtgaactactgctctactttctgccaacgaaaacgctggtctttgactatgctcaccagcttggtgtccattagttggctacgcgcaatactcccatgtcagccccctaaagtgttagggctctag

SEQ ID NO: 11607 - DNA, 600 bp, Artificial Sequence
  Description of Artificial Sequence: Synthetic coding sequence
atgagtttggacatccagagtctcgacatccagtgtgaagaattgtctgacgcccgttgggctgaactcctgcccctcttacagcagtgtcaagtggttaggctggatgattgtgggctaaccgaggccagatgcaaggacataagtagtgctcttagggttaacccagcccttgcagagctcaatctgcgcagcaatgagctcggggacgtgggagtccactgtgttttgcaggggctgcagactccatcatgtaaaatccagaagttgtcattacagaattgttgtttgaccggcgctggctgcggagtgctttcttctaccttgagaacgctccccacccttcaggagctccacttgtctgataatctcctgggcgatgccggactgcaactgctatgtgagggtctcctcgacccacagtgtcggctagaaaaactgcagctggaatactgttcacttagcgcagctagttgcgagcccttggctagcgtccttagggcaaagccggactttaaggagcttactgtgtccaacaatgacataaacgaagccggagtgcgcgtgctgtgccagggcttgaaagatagcccttgctag

SEQ ID NO: 11608 - DNA, 465 bp, Artificial Sequence
  Description of Artificial Sequence: Synthetic coding sequence
atggctggtatccccggacttctgtttttactgttcttcctgctgtgcgccgtgggtcaggtctctccctattccgccccttggaagccgacatggcctgcttataggcttccggtcgtgttgccacagtccacccttaatctcgcaaaacctgattttggcgctgaggccaagctggaggtgtcatcaagctgcggcccacagtgccacaaggggacacctctgcctacgtatgaagaggcgaaacagtatctctcgtatgagacactgtacgctaacggctctaggacagaaacccaggtgggaatctatatcctttcatccagcggggacggtgcacagcaccgagactctggcagctccggcaaatcccgtagaaaacgccagatctacgggtacgattctcggttctctatcttcggtaaggattttctcctgaattaccccttctcaacctcggtctag

SEQ ID NO: 11609 - DNA, 936 bp, Artificial Sequence
  Description of Artificial Sequence: Synthetic coding sequence
atgggcattattcagagcatcctggccacctcgcgagactgttactcattcaagaagaaaccaatcccgaagaagcccacgatgcttgctctggcgaaaattctgctgatcagtactctgttctactcccttctgagtggctcgcatggcaaagaaaaccaagacataaacactacgcagaacatcgccgaggtgttcaaaacaatggagaataagcccatctcactggagagcgaagctaatctaaactccgataaggaaaacattactacgtctaatctcaaagcctcccacagtcctccccttaacctacccaacaactcccacggcatcacagatttttctagtaacagtagcgccgagcacagtctcgggtcactcaaaccgacatccacaatctccactagtccacccttgattcactcattcgtgagcaaggtgccctggaacgcccctatcgccgatgaagatctgctgcctatctctgcccaccctaacgcaacacctgcactgagcagcgagaattttacttggagtctcgttaatgatacagtcaagactcccgataactcctctattaccgtgtcaatcctaagtagtgaacccacgagcccatccgtgacgccacttatcgtggaacccagtggttggctcactaccaacagcgactcctttacagggttcaccccgtaccaggaaaagacaactctgcaacccacactgaaatttaccaacaacagtaaactcttcccaaacactagtgacccacagaaggttcttagactggataacgccccagagccatatgatgtgtccttcgggaactcttcatactacaatccaacactcaatgatagtgccatgccagagtcggaggagaacgctcgcgatgggatccctatggatgacattcccccattgagaacctccgtgtag

SEQ ID NO: 11610 - DNA, 1404 bp, Artificial Sequence
  Description of Artificial Sequence: Synthetic coding sequence
atgctgatcttttggaccattaccctctttctcctcggggcagctaagggaaaagaggtgtgttacgaagatctgggatgcttttcagatactgaaccttggggcggtaccgctattagaccccttaagattctcccatggtccccagagaagattgggacccggttccttctgtatactaacgagaatcctaacaacttccagatactccttctatctgatccatcaactatcgaggctagcaactttcagatggaccgcaagacccggtttattatccacggatttatcgacaagggggacgaatcgtgggtgacggacatgtgtaagaagctgtttgaagtggaggaagtaaattgtatttgtgttgactggaaaaaaggaagccaagccacatacactcaggccgctaacaacgtgagggtagtgggggcacaggtggctcagatgctggacatcctgctgaccgagtatagttaccccccttctaaggtccacctgattgggcattctctaggggctcatgtggcgggagaggctggctcaaagacacccggactgagcaggatcactgggctggacccggtcgaagcgtctttcgagtccacccctgaggaggtgcgcctcgatcccagtgatgccgattttgtagacgttattcacaccgatgccgctccccttattcccttccttggtttcggaacaaaccagcagatgggacatctggatttttttcctaacggcggagagtccatgccaggttgcaaaaaaaatgcgctctctcagatcgtggacctggatggcatctgggctggcaccagggatttcgtggcatgtaatcatctgcggtcatacaagtactacctggagtccatcttgaacccggacggttttgcagcatacccctgcacatcttacaagtcttttgagtccgacaaatgctttccctgtcccgaccaagggtgtccacagatggggcactatgcagataagtttgccggtcgaacaagcgaggagcagcagaagttctttctcaacacaggagaggctagtaactttgcacggtggcggtatggcgtcagcatcaccctgtcaggtcgcacagccacaggccaaataaaggtcgctttattcggtaataaggggaatacgcatcaatactccatctttagaggcattctcaaacccggtagcacccacagctacgaattcgatgccaaactcgatgtgggcaccattgaaaaggtaaagttcttgtggaataataacgttatcaacccaaccctgcctaaggtcggggctaccaaaatcacagtgcagaaaggtgaggaaaagaccgtatacaatttttgttctgaggataccgtgcgggaagacactttacttaccctgaccccctgttag

SEQ ID NO: 11611 - DNA, 81 bp, Artificial Sequence
  Description of Artificial Sequence: Synthetic coding sequence
atgcgtactctctttaacctactttggcttgctctggcatgttctcccgtgcatactaccttaagtaagtctgatgcttag

SEQ ID NO: 11612 - DNA, 549 bp, Artificial Sequence
  Description of Artificial Sequence: Synthetic coding sequence
atgcggaggatgtgggcgactcagggccttgccgttgccctggcactcagcgtccttccgggatctagggctctaagaccgggtgattgcgaggtttgcatcagttacctgggcagattttatcaggacctgaaagatcgcgacgttaccttctcaccggcaaccatcgaaaacgaattgatcaagttctgcagggaggcgaggggaaaggaaaaccgcctgtgctactatatcggtgcaactgatgacgcagcaaccaagattatcaacgaagtgtctaagccgctggctcaccacattcccgtcgaaaaaatttgtgaaaaattgaaaaagaaggatagccagatttgcgagctgaaatacgacaaacagatagacctcagtactgttgatctaaaaaagttgcgcgttaaagaattgaaaaaaattcttgacgactggggtgaaacctgtaaaggatgcgctgagaaaagcgactatatccggaagattaatgaattgatgccaaagtacgctccaaaagctgccagtgcccgaaccgacctatag

SEQ ID NO: 11613 - DNA, 153 bp, Artificial Sequence
  Description of Artificial Sequence: Synthetic coding sequence
atgaaagtattctttctcttcgcggtgttattttgtctggtccagactaactcggtgcacattagccatcgcgaggccaggggcccatccttcaggatctgcgtggattttctcggacccagatgggccagaggatgtagcacaggtaattag

SEQ ID NO: 11614 - DNA, 666 bp, Artificial Sequence
  Description of Artificial Sequence: Synthetic coding sequence
atgggggcaaccaccatggaccaaaagtcattgtgggccggagttgtggtgctgttattgcttcaggggggttcagcttataagctagtatgctacttcactaattggtctcaggatcgccaggagccaggaaagttcacccccgagaatatcgatcccttcctgtgctcacatctgatctattcttttgccagcatcgagaacaataaggtgattattaaagataagtctgaagtcatgctctatcagaccatcaattctttgaagaccaaaaatcctaagctgaagatcctactgtcgatcggcggatacttgttcgggtctaagggctttcacccaatggtggatagcagtacgtctaggctggagtttatcaacagcattatcttgtttctgcgcaaccataactttgatggcctggacgtttcttggatttacccagatcaaaaagagaacactcactttactgtcttgattcacgagctcgccgaggcattccaaaaagattttaccaaatccaccaaggagcgactcctgttaaccgctggggtttccgcgggacgtcagatgatcgataacagttatcaggtggaaaaactggccaaggatctggacttcatcaatctgctctcttttgactttcatggcagttgggagaaaccctag

SEQ ID NO: 11615 - DNA, 1257 bp, Artificial Sequence
  Description of Artificial Sequence: Synthetic coding sequence
atgcgaactctgtttaacttgctgtggcttgcattggcctgctcccctgtgcacactactttgagcaagtcagacgcaaagaaggcagcatctaaaactctcctggaaaaggtgaagttttgcagttgctgtcctggatggtccgcgatggctcggagctggctgaccgcaactagcgccacgcagtcccaattttcggataaaccagtacaggacagggggctggttgtcacggacctgaaggccgagagcgtggtcctggaacatcgaagttactgctccgccaaggctcgggacaggcattttgccggtgacgttctggggtatgttactccgtggaacagccatgggtacgatgtgaccaaagtgttcgggtctaagttcacccagatttctcctgtctggttacagctgaagcgccgtggtagggagatgtttgaagtaacgggcctgcatgatgtggatcagggatggatgagagccgtgcgcaaacatgcgaaaggcctccatatcgtgccgagattgctgtttgaggactggacctatgacgatttcaggaacgtcctggacagcgaggatgagatagaggaactctctaagacagttgttcaagtcgctaagaatcagcattttgacgggtttgttgtggaggtttggaaccagctattgagccagaagcgtgtgggcctcatacatatgctgacgcatttggccgaagcattacaccaggccaggctcctcgctctccttgtgattcccccagcgattacaccgggaaccgaccagttgggcatgtttacacacaaagagtttgagcagctggcccctgtactcgacggcttctcacttatgacctacgactattcaacagcacaccagcctggccctaatgcccctctgtcgtgggtacgggcatgtgtacaggttctggacccaaagtctaagtggcgatctaaaatcctcctcgggctgaacttttatggaatggattatgccacctcaaaagacgccagggaacccgtcgtgggagctaggtacattcagacgctgaaagatcacagacctcgcatggtttgggactctcaggcctcggagcactttttcgagtacaaaaaatcccggagcggaaggcatgtggtgttctatccaacccttaaaagcttgcaggtgagactggagctggccagagagctcggcgtgggcgtttccatctgggaacttggccaaggcctcgactatttctacgatctgctgtag

SEQ ID NO: 11616 - DNA, 612 bp, Artificial Sequence
  Description of Artificial Sequence: Synthetic coding sequence
atgcgcagcctgctcttgctgtctgccttttgtttgctggaggccgctctcgcggctgaagtcaagaaacctgcggctgcagctgcgcctggcacagcagagaaactgtcaccgaaggcagctaccttggccgagcgtagcgcgggactggcctttagcttgtatcaagctatggccaaagatcaggccgtggagaacattttagtaagtccagtcgtggtggcttcctctctggggctggtctcccttggcggaaaagcaactaccgccagtcaggcaaaggctgtcttatccgccgagcaactccgagatgaagaagtccacgcaggactgggggagctcctgcgcagcctatctaatagcacagccaggaacgtaacttggaaactggggagtaggctgtatgggccttccagcgtcagcttcgcagacgatttcgtccggtcttctaaacagcactacaactgtgaacatagcaagattaattttcgggacaagagatctgcgttgcagtcaattaacgaatgggcagcccagactacagacggaaagctgcctgaggtaaccaaggacgttgagagaaccgatggggctctcctggtgaatgcctag

SEQ ID NO: 11617 - DNA, 492 bp, Artificial Sequence
  Description of Artificial Sequence: Synthetic coding sequence
atgcgctcactgcttctgctcagcgctttttgcctcctagaagccgcacttgctgccgaagtaaagaagccagctgcagcagcagcacccggaactgccgagaagctgtctccaaaggccgcaacactggccgagaggtccgccggactagctttttccctttaccaagctatggccaaagatcaagctgttgagaacatactggtgagtcccgtcgtggtcgcttcttcactcgggctcgtaagtttgggcggaaaggccactaccgcatcccaggctaaggcagtactgagtgcagagcagctcagagatgaagaggtgcatgcagggcttggagaacttctgcgtagtctgagcaactccactgcacgcaacgtgacttggaaactcggatcccgcttgtacgggccttcgagcgtttcattcgctgacgatttcgttcgcagctctaaacagcactataactgtgaacatagcaagatcaatttttag

SEQ ID NO: 11618 - DNA, 570 bp, Artificial Sequence
  Description of Artificial Sequence: Synthetic coding sequence
atgtctttagacatccagtctctggatatccagtgtgaagagctcagtgacgcacgatgggcagagctgttacctttgcttcagcagtgccaagtggtcaggctggacgactgcgggttaacagaggccagatgcaaagatatttcaagtgcgttgagagtgaatcccgctctggcagagctgaacctacggagcaatgaactcggagatgttggggtgcattgcgtgttgcaggggctgcagacgccgtcatgtaaaatccaaaaactgtccttacagaactgttgcctgacaggggcaggatgcggagtgctttcttccacactccgaactttacctacactacaagagctgcacttaagcgacaacttactgggcgacgccggacttcagctgctgtgcgaaggtctgttggacccccagtgtcgcctcgagaagctccagcttgagtattgtagcctgtctgcagcctcctgtgaacctcttgccagcgtattacgggcaaaacccgattttaaagagctcactgtatctaataacgacattaatgaggccggtgttcgggtctag

SEQ ID NO: 11619 - DNA, 585 bp, Artificial Sequence
  Description of Artificial Sequence: Synthetic coding sequence
atgtctttagatatccagtcgcttgatatccagtgtgaggagctcagcgatgctagatgggctgagctgcttcctttgctgcagcaatgccaggtggttcggctcgatgactgcgggttaacagaggctcgctgcaaagatataagctccgccctaagggttaatccagctctggctgaactcaacctgaggagcaatgagctaggtgacgtcggagtgcactgtgtcctgcaaggtctgcagacgccgtcttgtaaaatccaaaagctgtcacttcaaaactgctgtctaacgggtgcaggctgcggcgttctgtccagtacactacgaaccttacctacgctccaggagctgcacctgtccgacaatctgttgggggacgccggattgcaactgctatgcgaaggcctgctcgacccccagtgccggctggagaaactgcagctggagtactgttccttgtctgctgccagctgcgagccactggcctctgtgctgagagcgaaaccggacttcaaagagcttacagtttcaaacaatgatatcaacgaagccggagtccgtgtcctctgtcagggactctag

SEQ ID NO: 11620 - DNA, 1086 bp, Artificial Sequence
  Description of Artificial Sequence: Synthetic coding sequence
atgggaatcatacagtccatcctggctacatcacgggattgctactcgttcaagaagaagcccatccctaagaaacccaccatgttggctctggcaaaaattcttcttatcagcaccctgttctactccctgctttcaggaagccacggcaaagaaaatcaggacataaacaccacccagaatattgctgaagttttcaagactatggagaataaacccatctctcttgagagcgaggccaatcttaattccgacaaggaaaatatcacgacctccaacctgaaagcttctcactcacctcctcttaacctgcccaataacagtcatggcattaccgacttcagttcaaacagcagtgccgagcactccctaggtagtctcaagcctacatcgactatatcaacaagccccccactgattcattcatttgtgtcaaaggtcccttggaatgcacccattgctgacgaagacttgctacccatctccgctcacccaaacgccacccccgctctgagttccgagaatttcacatggagcttggttaacgacactgtgaagacgccagacaattcctccattactgtctccatcttgtcctccgagcctacttctccaagcgtgacacctctgatcgtcgagccctccggttggttaaccaccaatagtgacagctttactgggttcaccccgtaccaggaaaagacaaccctgcagcctaccctgaagtttaccaacaactcaaagcttttccccaatacctctgatcctcaaaaggagaatcggaatacagggatcgtgtttggcgcaatacttggtgccattctcggtgtcagtctcctgaccctcgtcggctaccttctgtgtggcaagcggaagactgatagcttcagccaccgccgactgtatgatgaccgcaacgagcccgtgctgcggctggacaacgctccagagccctacgatgtgtcatttgggaactcttcttattacaacccaacactaaatgatagtgccatgcccgaatccgaagaaaacgccagagatggaatcccgatggacgatattccccctctgagaactagtgtatag

SEQ ID NO: 11621 - DNA, 327 bp, Artificial Sequence
  Description of Artificial Sequence: Synthetic coding sequence
tgaccaaaaagtaagtggcgatctaaaattctattgggcttgaatttttacgggatggattatgcaactagcaaggatgccagggagcctgtagtgggtgctcggtacattcagactttgaaggaccaccggccaagaatggtatgggattcacaagcttccgaacacttcttcgaatacaaaaaatctaggagcggaagacatgtggtgttttatccaactctgaagtctctccaggtgcgcctggagctggctagagaactgggcgtcggcgtgagcatctgggaactgggccagggtctggattacttttacgacctcctctag

SEQ ID NO: 11622 - DNA, 504 bp, Artificial Sequence
  Description of Artificial Sequence: Synthetic coding sequence
atgcgaagcctgcttctcttgtccgcattctgcctgcttgaagccgcattggccgctgaagtcaaaaagcctgccgctgcagctgcacctggaaccgccgagaagctttccccgaaggcagcgacccttgctgagagatccgccggtctggcttttagtctgtaccaggcaatggcaaaggaccaagccgttgagaatattctggtgtccccagttgtggtggcctccagtctggggctggtgagccttggtgggaaggctacaacagcctcacaggccaaagctgttctgagtgctgagcagttgagagacgaagaagttcatgctggcctgggcgagctcctgcgcagcctgtccaattctactgcccgtaacgtgacttggaaattaggcagtcggctctatggcccatccagcgtgagcttcgccgacgacttcgtgcgttcctcgaagcagcactacaattgtgaacactccaagattaatttccgggacaaaagatag

SEQ ID NO: 11623 - DNA, 1209 bp, Artificial Sequence
  Description of Artificial Sequence: Synthetic coding sequence
atgatggtcgccttgagaggcgctagtgctctgctcgtcctcttcctggcagccttccttcccccacctcagtgtacacaggatcctgctatggtgcactatatctatcaacggtttcgggtgctggagcaggggctggagaaatgcacacaagccacccgcgcatacatccaggagtttcaggagtttagcaagaatatcagcgtgatgctgggtagatgccagacttacacttctgaatataagagtgccgtgggtaacttagccctaagagtagaacgggcacagcgcgaaattgactacatccagtatcttcgggaagctgacgagtgtatcgaaagtgaggacaagaccctcgctgagatgctgctgcaggaagccgaagaggagaagaagatacgcaccctgcttaacgcttcttgtgataacatgcttatggggattaaatcccttaaaatcgtcaaaaaaatgatggacacccatgggagctggatgaaggacgctgtttataatagccctaaagtgtatctattgatcggctctcgtaataacacagtctgggaatttgctaacattcgagccttcatggaagacaatacgaaaccggctcctcggaagcagatcctgaccctgtcatggcagggcacggggcaagtcatttataaaggcttcctattttttcataatcaagccacatcgaatgagataatcaaatataacttgcagaagcgaactgttgaagaccgaatgttactgcctggtggcgtgggcagagcgctcgtgtaccagcactctccttctacgtatattgacctggctgtggacgagcatggactttgggctatccactcaggtcctggtacccattcccacctggtgctcaccaaaatcgaaccgggaaccttgggagtggaacactcctgggataccccgtgtcgcagccaggatgctgaagcgtcttttctcctctgcggcgtgctgtacgtcgtgtacagtaccgggggacagggccctcatcgaattacctgtatttatgatcctctcggtacaatttctgaagaggacctgcccaatttatttttccctaagcgcccaaggtcccactccatgattcactacaatccgagggataagcagctctacgcctggaatgaagggaatcagatcatttataagttgcagaccaagagaaaactccccctaaagtag

SEQ ID NO: 11624 - DNA, 975 bp, Artificial Sequence
  Description of Artificial Sequence: Synthetic coding sequence
atgaggtctctgctgctgctctctgcattttgcctgctagaggcggctcttgccgctgaagtcaaaaaaccggcagcagctgctgccccagggactgcggaaaagttgagcccgaaggccgctaccttggcggaacgaagcgcaggcctggccttttccctctaccaagccatggctaaggaccaggccgtagagaatatcctggtgtccccggtggttgtggcatcttcactggggctggtgtcgcttggaggcaaggccacaactgccagtcaggctaaggctgtgcttagcgcagagcagctccgggacgaggaggtgcacgctgggcttggcgagctcttgcgatccttgagcaactcaaccgctcgaaacgtgacatggaaactggggtcacggctctatggcccaagttcagtgagcttcgctgatgatttcgtgagatccagcaagcagcactacaattgcgaacatagcaagataaatttccgggacaagaggtcggctctgcagtcaatcaacgaatgggctgcccagacaacagatggcaaactgcccgaagtaaccaaggacgtcgagaggacagatggtgccttgttagtgaatgcaatgttttttaaaccccactgggacgagaaatttcatcacaagatggtcgacaaccggggatttatggtaaccaggtcttacacagtcggagtaatgatgatgcaccggacaggcctctacaactactacgatgacgagaaggagaagctccaaattgtcgaaatgcccctggcgcataagctcagtagcctgattatcttgatgccacaccacgtggagcctctggagagactggagaagctgctcactaaggagcaactgaaaatctggatgggcaaaatgcagaagaaagctgttgccatttcactcccaaagggggtggtagaagtgacacacgatctccaggtgcggggagggcctgcttag

SEQ ID NO: 11625 - DNA, 990 bp, Artificial Sequence
  Description of Artificial Sequence: Synthetic coding sequence
atggtttcaaaatcaaggtggaaactgttagccatgctggcccttgtcctagtagtgatggtgtggtactccatctctagggaggattcattttactttccaatcccagaaaagaaggaaccctgtctgcagggtgaagctgagagtaaggctagcaaactgttcggcaactattcaagagatcagccaatttttctacggctggaggactacttctgggtgaaaactccgtctgcttacgaactgccctacggcaccaaaggatccgaggacctgctgctccgggtgctagccattacgtcgtcaagtattcccaaaaatatacagtccctgcggtgccgccgatgtgtggtggtcggaaatgggcatcggttgcggaattcaagccttggcgatgcaattaataaatatgatgtggttatcagactcaacaacgcgcctgtcgcagggtacgagggagacgtggggagcaaaaccactatgcgcctcttttatcctgagagtgctcattttgatcccaaagtcgaaaacaaccccgatacacttctggtgcttgtcgcattcaaggctatggactttcattggattgaaacaatcctgtcagacaagaaacgtgtgaggaaaggcttctggaagcagcccccactcatctgggatgttaatcccaaacaaatacgaattctgaatcctttcttcatggagatcgcggctgataagcttttgtccttgccaatgcaacagccgagaaagattaagcagaagcccacaaccggcctgttagcgatcacccttgcactgcacctctgtgacttggtccacatcgcaggcttcggatatccagatgcttacaacaagaaacagaccattcattactacgagcagattactcttaagtcaatggccggaagcggtcataacgtgtcccaagaggctctcgctatcaaaagaatgttggagatgggcgctatcaagaacctgacgtcattttag

SEQ ID NO: 11626 - DNA, 351 bp, Artificial Sequence
  Description of Artificial Sequence: Synthetic coding sequence
atgcgcacactgtttaatttgctgtggctggccctcgcctgcagcccagttcacaccacactatccaagtccgacgccaagaaagcagcctctaaaactctgctcgagaagtcacagttctccgacaaaccagtgcaggacagaggactggtcgtaacagatcttaaggctgaatcagttgtgttggagcaccgaagttattgttcagccaaggcaagagaccgccacttcgccggagacgtgttaggatatgtgacgccatggaattcacatggatacgatgtgacgaaggtattcgggagtaagttcacccagatttcgcctgtgtggctgcaattaaaacgccgatag

SEQ ID NO: 11627 - DNA, 282 bp, Artificial Sequence
  Description of Artificial Sequence: Synthetic coding sequence
atggattccctgcggaagatgcttatcagcgtagccatgctcggagctggggcaggagttgggtacgctctgttggtcattgtaacgcctggcgagaggcggaaacaggaaatgctcaaagagatgccactgcaggatccaagatcgcgtgaggaggccgctcgtacacaacagctgctgctggctaccctgcaggaagctgcgacaacacaagaaaatgtcgcctggcggaaaaactggatggtgggaggggagggcggtgctgggggtcgtagtccttag

SEQ ID NO: 11628 - DNA, 255 bp, Artificial Sequence
  Description of Artificial Sequence: Synthetic coding sequence
atgcgccctaaaaccggtcaggtgggctgcgagactcctgaggaactgggtcctggcccacggcaaagatggcccctcctgttgctcggcctcgcaatggtagcccacgggcttttgagaccaatggtggcaccccagtcaggcgaccctgatcccggagcttccgtaggaagcagccggagttccctgcgcagtctgtggggtaggtccgctcagggccaaccccactgccattctgtccctgctctgctctag

SEQ ID NO: 11629 - DNA, 27 bp, Artificial Sequence
  Description of Artificial Sequence: Synthetic coding sequence
atgtctctggacattcagtcgttgtag

SEQ ID NO: 11630 - DNA, 576 bp, Artificial Sequence
  Description of Artificial Sequence: Synthetic coding sequence
atgctgatattctggaccatcacactgtttctactgggggctgccaaaggcaaagaggtgtgttacgaggatttagggtgtttttctgacaccgaaccttggggcggaacagcaatacgtcccctcaaaatactcccttggtcccctgagaaaataggtactcggttcctactgtataccaatgaaaatccaaacaactttcagattctgctcctgtctgacccttctaccattgaagccagcaatttccagatggataggaagacacgatttatcatccatgggtttattgataagggggatgaaagctgggtgacagacatgtgtaaaaaactgttcgaggtggaggaggtgaactgcatatgcgtcgactggaagaaaggatctcaagctacctacacacaggctgcaaacaatgtgcgggtcgtgggagcacaggtagctcagatgctggatatcctcctaaccgaatacagctaccccccaagtaaggttcacctgatcggccactccctgggcgcacacgttgccggagaagcaggttcaaagacaccaggcctcagtcgtataacctag

SEQ ID NO: 11631 - DNA, 123 bp, Artificial Sequence
  Description of Artificial Sequence: Synthetic coding sequence
atgtctctcgacatacagtctctggatattcaatgcgaggagctctccgacgcgagatgggcggagctgctacctttgctgcaacagtgccaggtggtcagactcgacgactgcgggttatag

SEQ ID NO: 11632 - DNA, 648 bp, Artificial Sequence
  Description of Artificial Sequence: Synthetic coding sequence
atgaggccaaagaccgggcaggttggttgcgaaacccctgaggaacttggcccaggcccaagacagcgctggcctctgcttctgctgggactcgcaatggtcgcacacgggctcctgagaccaatggtggccccacagagcggagatcctgaccccggtgcctcggtgggctcaagccgtagttccctgcgcagcctttggggctcacgtctgctgttgcagccttccccacagcgggcagacccacgatgctggccccgtggtttctggtccgagccacagtccctgtgctatgtgtttggaactggaacaaaggtgacagtgctcggtcagcctaaagctaatccaaccgtaaccctgttccccccttccagtgaagagctccaagctaacaaagccaccctcgtgtgccttatatctgacttctatcctggtgcagtcacagtcgcgtggaaagccgacggaagtcccgtgaaggccggagtggagactactaaacctagcaaacaatccaacaataagtacgcagctagctcatacctgtctcttacacctgaacaatggaagtcccacagatcttacagctgtcaggtgacccacgagggctccactgtggagaagaccgtagcacccaccgagtgtagctag

SEQ ID NO: 11633 - DNA, 999 bp, Artificial Sequence
  Description of Artificial Sequence: Synthetic coding sequence
atgtgtcctgcagggtggaaactcctcgcgatgctcgctctggttctagtggtgatggtatggtatagcatcagccgagaggaccgctacatcgagctgttctactttccgatcccagagaaaaaagagccctgcctccagggtgaagcagaaagcaaggccagcaagttgttcgggaactatagtagagatcagcctatttttctcagactagaggactatttttgggtcaagacaccaagcgcttatgagcttccctacgggaccaaaggtagtgaggatctgctacttagagtactggctatcacctcatcatctataccgaagaacattcaatcattacggtgtcggcgatgcgtagtcgtgggcaatggacaccggttgcgcaatagctccctgggggatgctattaataaatacgatgtagtaatacgtctcaataatgcacccgtcgctggatatgagggtgatgtcggcagtaagaccaccatgaggttgttttacccagaaagcgctcattttgaccccaaagtcgaaaataaccccgatactctgctggtgctggtcgcctttaaagctatggacttccactggattgaaaccattttgtccgataagaagagagtgcgaaaggggttttggaaacagccaccactgatatgggacgtaaatcccaaacagataaggatcctcaacccgttttttatggaaatcgctgccgataaattactttccctgcctatgcaacaacccaggaagattaaacagaagcccaccactggtctgctggctatcacattggcgctgcacctctgcgatttagttcacatcgccggattcggttaccccgacgcctacaataagaagcaaactatacactactatgagcagattaccctgaagtcaatggccggttctgggcacaacgtaagtcaggaggctcttgctatcaagcggatgctggaaatgggtgcgataaagaatctgacatcattctag

SEQ ID NO: 11634 - DNA, 888 bp, Artificial Sequence
  Description of Artificial Sequence: Synthetic coding sequence
atgcggagtctcctgttgctatcagccttttgccttctcgaggccgctctggccgcagaggtgaagaaaccagctgcagctgcagcaccgggtacggccgaaaagctgtctcccaaagctgccactctggccgagaggagtgcgggactggcattctccttatatcaagccatggcaaaggaccaggccgttgaaaacatcctggtgagtccagtggtggtggccagctctctgggactggtctctctgggcggtaaggctacgaccgcaagccaggctaaggcagtgctctcagctgaacaactgcgggacgaggaggtgcacgcaggcctgggcgagcttcttagatcactgtctaactctacagctcgtaatgttacatggaagctgggctcccgcttatacggaccttcaagtgtgtccttcgccgatgattttgtgagatcaagcaagcagcactacaactgcgagcactcaaagataaatttccgagacaaacggagtgcactgcagtcgattaacgaatgggccgctcagacaacagatgggaagcttcctgaagttaccaaggatgtcgaacggaccgacggtgccctcctcgtgaacgcaatgttttttaagccccactgggacgaaaaatttcaccataaaatggtggacaatcgtggcttcatggtaacccgaagttataccgtcggggtcatgatgatgcatagaaccgggttgtataactactacgacgacgaaaaggaaaagttacagatcgtagagatgcctctggcccataagctgtcatcccttattatccttatgcctcatcatgtggagccactggaaaggctggagaaacttctgaccaaggagcaattgaagatttggatgggttag

SEQ ID NO: 11635 - DNA, 399 bp, Artificial Sequence
  Description of Artificial Sequence: Synthetic coding sequence
atgagaacactgtttaatctgctgtggctcgcccttgcatgctcccccgttcatacaacgctctctaagtctgacgccaaaaaggccgcatctaaaacactactagaaaaaagccagttcagcgacaaacccgtgcaggaccgaggtctggtggtgactgacctgaaagcggagagtgttgtgctggaacaccgttcctactgttctgccaaagcaagggatcggcattttgccggtgatgtgctgggatacgtgaccccttggaatagccatggatacgacgtcacaaaagtattcggcagcaaatttacccagatctcaccggtatggcttcagctcaaacggagaggaagagagatgttcgaagtgaccgggttacatgatgtggaccaagggtag

SEQ ID NO: 11636 - DNA, 360 bp, Artificial Sequence
  Description of Artificial Sequence: Synthetic coding sequence
atgagaacgctgtttaacctgctttggcttgccctggcctgtagccccgtgcacaccactttgagcaaaagtgacgcgaagaaggccgcttctaagaccctgctggagaaaagtcaattctccgataagccagtccaggaccggggtctggtcgtgacagacctcaaagcggagtctgtggttctggaacatcgaagctattgtagcgccaaggcgagagaccgacatttcgccggtgacgtactggggtacgttaccccctggaattcacacgggtatgatgtaactaaggtgttcgggtcgaaatttactcaaatttcccctgtgtggctgcagcttaagcgcagagggcgtgaatag

SEQ ID NO: 11637 - DNA, 390 bp, Artificial Sequence
  Description of Artificial Sequence: Synthetic coding sequence
atgcccatggcctcacctcagacactcgtgctctatttgctggtcctggctgtgaccgaggcctggggccaggaggctgtcatccccggatgccacctccatccttttaatgtcaccgtgagatcggatagacaggggacttgccagggctcccacgttgctcaggcttgtgttggacattgcgaatcgagtgcttttccatctcgctattcggtgctggtggctagcggctaccgacataatatcacttcagtgagccagtgctgcactatttccggcttaaagaaagtgaaggtgcagttgcaatgcgtcgggagtcggcgagaagagctggagatattcaccgcacgggcttgtcaatgcgacatgtgcaggctttctcgctactag

SEQ ID NO: 11638 - DNA, 1386 bp, Artificial Sequence
  Description of Artificial Sequence: Synthetic coding sequence
atgagcctcgatatccaatctctcgatattcagtgcgaggaactatcagacgcgaggtgggcagagctcttgccgctattgcagcagtgccaagtcgtgcggttggacgactgtggcttgaccgaggctcgctgcaaggatatttcctctgcgctgagagtgaatccagccctggctgaacttaatttgaggtctaatgagttgggcgacgttggcgtacactgcgtcctacagggactgcagaccccgagctgtaaaatccaaaagctgtctctccagaattgttgtctgacaggcgcagggtgtggagtactgtccagcacccttcgcaccctccccactctgcaggagctgcacctgtcagataacctcttaggagatgctggcctccagctgctgtgtgaaggactgctggacccacaatgccgcttggagaagttgcagcttgaatattgcagcctcagtgcggcttcttgcgaaccactagcatctgtgttgcgcgcaaaaccagactttaaagaacttaccgtttcgaataacgatatcaacgaggcaggcgtcagggtgttgtgtcaggggttgaaggacagtccatgtcagctggaggcgctcaagctcgaaagttgcggcgtcacaagcgataactgtcgtgatctctgtggcattgtggcgtctaaggccagtctgagggagctggccctggggtcaaacaaactgggagatgtagggatggcggagctctgtcctggccttctgcaccctagtagtcgactgagaaccctgtggatctgggagtgcggcataacagccaaagggtgcggagatctatgtagagtgctgagagccaaggaatccttgaaagagctgagtttagcagggaatgaactgggcgacgagggcgcacggctcctctgcgagacattgctggaaccgggatgccagctcgaaagcctgtgggtgaagtcctgctctttcacagcggcttgttgttcccatttttcctctgtactggcccagaacagattcctgctggagctccaaatatccaataataggttagaggacgctggggtgagagaactgtgtcagggcctgggacaacccggatctgtgcttcgggtgctctggctggcggactgtgatgtctctgactcaagttgcagcagcctcgccgcaaccttgttagccaatcatagcttgagagaactggacctcagtaataattgcctgggtgatgccggtatcctgcagctcgtcgagtccgtgaggcaacccggatgtctcctcgagcagttggtcctctacgatatctactggtccgaggagatggaggatcgactgcaggctctggaaaaggacaaacctagccttcgtgtcatttcttag

SEQ ID NO: 11639 - DNA, 453 bp, Artificial Sequence
  Description of Artificial Sequence: Synthetic coding sequence
atgcgatccctgcttctcctttcagcattctgtctgctggaggccgctctggcagctgaggtgaaaaaacccgctgcagcagcggctcccggtaccgccgagaagttgtcaccaaaggcagctacgctcgcagaaaggagcgccggtctagccttttctctctaccaggcgatggctaaagaccaagccgtggaaaatatcctcgtgagtcctgtggtggtggctagctcactgggactggtttcgctagggggaaaggctactactgctagccaggcaaaggccgttctatcagccgagcagctgagagatgaagaggtccatgccggactgggcgagctgctgagatctctgagcaacagtacagccagaaatgttacctggaagcttggctcgcggctctatggtccttcatctgtgtcgtttgctgacgacttcgtccgatctagctag

SEQ ID NO: 11640 - DNA, 1257 bp, Artificial Sequence
  Description of Artificial Sequence: Synthetic coding sequence
atgagatccctgctcctcctgagcgccttctgcttacttgaggccgcactggccgctgaggtcaaaaagcctgctgccgctgccgcacccggtacagcggagaagctttccccgaaagcggcaacactggctgagaggtccgcaggtttagcattctcactgtatcaggctatggcaaaggaccaggctgtggagaatatactggtaagcccagtggtggtcgcctcttccttgggtttagtgtcattgggtggcaaggccacaactgcctctcaggcaaaggcagtgttaagcgccgagcagcttagggacgaggaagtccacgccggattaggcgaactgctccgcagtttgagcaattcaactgcgagaaacgtcacgtggaagctcgggagccgattgtacggaccctctagtgtgagtttcgccgatgatttcgtcagatcctcaaagcagcactacaactgtgagcactccaaaataaattttagagacaagcggtcggcgctccagtctattaacgagtgggcggcacagaccaccgacgggaagctccccgaggtcaccaaggatgtggagagaacggatggtgcactattggtgaatgcgatgttctttaaaccacattgggacgaaaagttccaccacaagatggtcgataatcgcggatttatggttacacgctcttacacagtgggggtgatgatgatgcatcgcacaggcctttacaattactatgatgatgagaaggagaaactacaaatcgttgaaatgcccctggctcacaaactgtcatcattgatcattctaatgccccatcacgtggaacccctggagcgcttagagaagctgctcacaaaagaacagctgaaaatttggatgggaaagatgcaaaaaaaagctgtggcgattagtctcccaaaaggtgtcgtcgaagttacgcatgatttgcagaagcacctcgctgggttgggcctgaccgaagcgattgataagaacaaggcagaccttagcaggatgagcggcaagaaagatctctacctcgcctcggtgtttcacgcaaccgcttttgagttggatacagatggtaatccgttcgaccaggacatatacgggagggaggagttgcggtcgcccaagcttttctacgccgaccacccatttatctttctcgtgagagacacgcagagtgggagtctcctgttcatcgggcgactcgtccgccctaaaggagataagatgcgagatgagctgtag

SEQ ID NO: 11641 - DNA, 1002 bp, Artificial Sequence
  Description of Artificial Sequence: Synthetic coding sequence
atggtctctaagagtaggtggaagctccttgctatgttggctctggtgctggtagtcatggtttggtatagtatatcacgcgaggaccggtacatcgagctcttctactttccaatccccgagaagaaagaaccgtgcctccagggggaagctgaaagcaaggcgagcaagctgtttgggaattactctagggaccaacctatttttctccggctcgaagactacttctgggtaaagactccttccgcttacgagcttccatacgggaccaagggaagcgaagatctgctattaagggtcctggcgatcacatccagctccatccctaagaacattcagtccctgagatgccggaggtgtgtcgttgtggggaacggtcacagactacgcaactcatcattaggtgacgccatcaacaagtacgatgtggtaataaggctaaataacgcgcctgtggcgggatacgagggtgatgtgggatccaaaacaactatgaggctgttctaccctgagtctgcccactttgatcccaaagttgagaataaccccgacacgctactggtgctcgtcgctttcaaggcgatggacttccactggattgagactattctctccgataaaaagcgagtgagaaaggggttctggaaacaacccccactgatctgggacgttaacccaaagcagattcggattttgaatccctttttcatggagatcgctgcggacaagctcctgagcctgccaatgcaacaacccaggaaaatcaaacaaaagcctactactggtctactcgccattacattggccctgcatctttgcgacctggtgcacatcgccggattcggctatcctgacgcttacaacaaaaaacagaccattcactactatgaacaaatcacgttaaagagtatggcaggatccgggcataacgtgagtcaggaagcattggccatcaagcgcatgttagagatgggggctattaaaaacctcacgtcattttag

SEQ ID NO: 11642 - DNA, 987 bp, Artificial Sequence
  Description of Artificial Sequence: Synthetic coding sequence
atgtgccccgctgggtggaaactcttggcgatgttggctctggtactggtggtaatggtgtggtatagtatatctcgggaggactcattctattttccaatccccgaaaagaaagagccttgtctgcagggggaagcagaatcaaaggcatccaaactctttggcaactattcccgtgatcagcccatcttcctcaggctcgaagattacttctgggtcaagaccccgagcgcgtacgaactgccctatggcaccaagggttcggaggatctgctattgagagtgttagccattacctcttcatccatccctaagaacattcagtcgttaagatgccgccgttgtgtcgttgtgggcaatggccatagattacgtaactcttcactgggggatgccatcaacaaatatgatgtggtcatccggctgaataacgcacccgtggccggttatgaaggggatgtggggtcaaagactacgatgcgcttattctacccagaatccgcacattttgacccaaaagttgaaaataacccagacaccttactggtactggttgcgtttaaagccatggacttccactggatcgagactatcctttccgataagaaacgcgttagaaagggtttctggaagcagcccccactgatttgggacgtgaaccctaaacagatccgcattctcaatcctttcttcatggagattgccgctgataagctgttatcactgccaatgcagcagcccaggaagatcaagcaaaaacctactaccggcctgttagctattaccttggcactgcacctgtgcgatttagtgcacatcgcgggtttcggttaccccgacgcctacaataaaaagcagactatccattattatgagcagataaccttgaagagcatggccggatcggggcataacgtcagccaggaggcactggccatcaagcgcatgttggaaatgggtgccatcaagaacctcaccagcttctag

SEQ ID NO: 11643 - DNA, 585 bp, Artificial Sequence
  Description of Artificial Sequence: Synthetic coding sequence
atgaccatgagacacaactggaccccagatttgtcacccctttgggtgctgctcctgtgtgcacacgtggtgacactgctggtgagggcaactcctgtttcgcagacgacgacggctgctacagcctccgtcaggtccacaaaggatccgtgtcccagccagccgcctgtattccccgcagccaagcagtgtcccgcactcgaggtgacttggccagaagtggaggtaccgttgaatgggaccctctcgctcagttgcgtagcttgtagtaggttcccgaatttcagcatcttgtactggttagggaacggtagttttatcgaacatctgcccggtagactgtgggaaggcagtaccagccgggagcgagggagcactggtacccaactctgtaaagctcttgtcctggagcagcttacaccggctctgcattcgaccaacttcagctgcgttctggtagaccccgaacaggtggtgcagcgccatgttgtcctcgctcagctgtgggctggtctgcgagccacactcccacccactcaggaggccctgccatccagccactcttctcctcagcaacagggctag

SEQ ID NO: 11644 - DNA, 1386 bp, Artificial Sequence
  Description of Artificial Sequence: Synthetic coding sequence
atgagtttagacatacagtccctggacattcaatgcgaagaactgtctgacgcaagatgggccgagcttctcccattgctgcagcagtgtcaggtggtccggctggacgactgtggcctcacagaggcacgttgcaaggacatctcctcagcactgcgggtgaatcctgcactggccgagcttaatctgcggtccaatgaactgggggacgtgggagtgcattgtgtccttcagggattgcagacgccatcttgtaagattcagaaattgtcactgcagaactgttgcttaacaggcgcagggtgtggggtgttatcatccacgctgaggacattgcccaccctgcaagaactccacctcagcgacaacctgctcggggacgcaggcctgcagttgctgtgcgaaggcctgctggatcctcagtgtcgattggagaagttgcagctggaatattgctcactcagtgcagcctcctgcgaaccgctcgcttctgtcctccgcgcaaagcccgactttaaggaactgaccgtctctaacaatgacatcaatgaggcgggagtacgtgttctttgtcaaggactgaaagattccccctgccagttggaagctctgaagttggaaagttgtggcgttacctctgataattgccgcgatctgtgcggaatagtggcctcaaaagcttccctgcgcgagctggcactcggtagtaataagctaggagatgtgggcatggccgagctgtgtccaggcctgcttcacccctcatcacgcctccgcaccttatggatctgggaatgcgggattacggctaagggatgcggtgatctttgtcgtgtactgcgcgctaaagagagcttgaaggagctgagccttgccggaaatgagttaggtgatgagggtgccagattactttgtgagaccctactggaacccggttgccaactggaatccttatgggtgaagagctgttctttcacggcggcatgttgttcgcatttcagcagtgtgcttgctcaaaacagattcctgttagaattacaaatttccaacaacagattggaggacgctggtgtgcgcgaactgtgtcagggactcggccagcctggcagtgtgctgcgggtgttgtggttagcggactgcgatgtttccgactcatcgtgtagctcgttagccgctactcttctggccaatcattctctccgcgagctggacctgtcgaacaattgtctgggcgatgccggtattctccaattggtagagtcggtgaggcaacccggatgtctgctggagcagttggttctttacgatatatactggtcggaggagatggaggatagactgcaagctctagagaaggataaacccagcctgcgtgttatcagttag

SEQ ID NO: 11645 - DNA, 1995 bp, Artificial Sequence
  Description of Artificial Sequence: Synthetic coding sequence
atgccccaggccccaagcacaggctctagccttatacgtgatccgagtatcgcacaccgtaacacccagattttgtggaccgaggctggcagggatttggcacaagacactcgctatactggggaagagtctctgactatcttcgtcgataagcgcaaactatctaagagggcggaaggctcggacagcacaacaaatagctccagcgtgacattggaaactctacaccagctggcagcctcctatttcatcgaccgagactctacactgagaagattgcaccacattcagattgcaagtaccgccattaaagttaccgaaaccaggacaggccctctcgggtgctccaattatgataacctggatagcgtctcctctgttcttgtgcagtcacccgagaacaagatacagctgcagggtctgcaggtgctgctgcccgactacctgcaggaacgattcgtacaggccgcactgtcctacatcgcgtgcaattcggagggggagtttatctgtaaggagaatgactgctggtgccattgtggcccaaagtttccagagtgcaactgtccttccatggacattcaagccatggaggaaaacttgctaagaataacagagacttggaaggcctataactcagactttgaggaatctgacgagttcaagctttttatgaagaggttgccaatgaactatttcctgaacacctccactatcatgcacttatggaccatggacagcaactttcagcggagatacgagcagttggaaaactcaatgaagcagctgtttctcaaggcccaaaagatagtgcacaagctgttttcattaagcaagcgctgtcataagcagcccctgattagcctgcccaggcagcgaactagtacttactggctgaccagaatccagagttttctgtattgcaatgagaatggcctgctggggagtttcagtgaggagacccattcctgtacgtgtcccaatgaccaggttgtatgcaccgcattccttccatgtactgtgggcgacgcctcagcttgtttgacgtgcgccccagacaataggacgagatgtggaacctgtaatacaggctatatgctgtcccagggcctgtgcaagcctgaggttgccgaatccactgaccactacatcggtttcgagaccgaccttcaggacctagaaatgaagtacctgctgcagaaaaccgaccggagaatagaggtccacgccatttttatctccaacgatatgcgcctcaattcttggttcgaccctagctggcggaaacggatgttgctgacacttaaatccaataagtacaaatcatcattggtgcacatgattttgggtctgtctctccagatctgtctgactaagaattctacgctcgagccagtactagccgtttatgtgaaccccttcggtggaagccactccgagtcctggttcatgcccgtgaatgagaattccttccccgactgggagagaacgaagttggatctccccctccagtgctataactggacattgaccctgggaaataagtggaaaaccttctttgagacagtacacatctacctgcgatccaggataaaatcaaacggcccaaacggaaatgagagcatctactacgagccactcgaattcatcgacccttcaagaaacctcggatacatgaaaattaacaatatacaggtatttggctattctatgcattttgaccccgaggccatcagggacctcattctgcagttggattacccttacacgcaaggcagccaggactccgctctactacagcttctagagatccgtgatcgggtgaacaagttatcaccgcctgggcagagaagactggaccttttttcttgtctcctccgacaccgcctgaaactcagcacctccgaggtggtgcgcatacagtcggctctccaggccttcaatgctaagctcccaaacacaatggattacgacacaactaagctctgttcatag

SEQ ID NO: 11646 - DNA, 459 bp, Artificial Sequence
  Description of Artificial Sequence: Synthetic coding sequence
atggcacgcgactacgaccacctgtttaaactactcattattggagactccggggtggggaagagctctcttctactgcggttcgcagacaacaccttcagcgggtcttacatcacgacaattggcgtagatttcaagattaggacggttgaaatcaatggggagaaggtgaagctgcagatttgggatactgccggtcaggagcgctttcgcacaattaccagcacttactatagaggcacccatggcgtgatcgtcgtgtacgatgtgacctcagccgagtctttcgtaaacgtgaaacgctggcttcatgaaattaatcaaaattgtgacgacgtgtgcagaatccttgatgtacagctgcaccacggcgctggccctccatcaaaagagagacagcccggaaagaccgccgctgcaacaactgagagatgtggggaggcacacgaggaacagtag

SEQ ID NO: 11647 - DNA, 696 bp, Artificial Sequence
  Description of Artificial Sequence: Synthetic coding sequence
atgctctacattggtattgcagagtatttcttcaaaagcgcctctttcgcccattttaccgcgggagtgtttaatgtgacactcagtacagaggagatcagtaaccactttgtgcagaattcacagggtttagggaacgtgctgtctcggatcgctgagatttacatactgtctcagccgttcatggtgcggataatggccacagagccacccattataaacttgcagccaggtaacttcactctggatattcctgccagcatcatgatgctgacccagcctaaaaactctacggttgaaaccatcgtatcgatggactttgtggcgtccacgtccgtggggctggtgattcttggacagaggcttgtttgttccctttcccttaataggttccgcctggcactgccagaatctaaccgttctaatattgaggtgttgcgctttgagaacatcttgtcctctattcttcatttcggggtactgcctttggccaacgcgaagctgcaacagggttttcctttgtctaacccacataagtttctgttcgtgaacagcgacatcgaggtccttgagggatttctcctcatctctaccgatttgaaatacgaaacatcaagcaagcagcagccaagcttccatgtttgggagggcctgaacctgatttcacgtcagtggcgcggaaagtctgcaccttag

SEQ ID NO: 11648 - DNA, 1911 bp, Artificial Sequence
  Description of Artificial Sequence: Synthetic coding sequence
atgaccacgtggagcctgcggagaagacccgcaaggactcttggtctgctgctccttgtcgtgctgggttttctggttctccgaaggctagactggtcaaccctcgttcctttaaggctgcgacatcgccagctcggacttcaagcaaaaggctggaatttcatgttggaagacagcaccttctggatcttcgggggatctattcattacttccgggtaccacgcgagtactggagggataggctgcttaagatgaaagcctgtggccttaacactctgaccacttatgtgccatggaacctccacgaacctgaacgcggaaagttcgatttttctggcaatctggaccttgaggctttcgttcttatggccgcagaaattggtctctgggtcatactgagaccgggaccatacatctgctccgaaatggatttgggtggacttcctagttggctgttgcaagatcccggaatgagactgcggactacgtataagggcttcaccgaggccgtcgacttgtacttcgaccatctgatgtccagggtggttcccctgcaatacaaacggggtgggcctattatcgccgtccaagtggagaatgagtacggcagctacaataaagaccctgcctacatgccctacgtgaaaaaggccctggaggatcggggaattgttgagttgttactgacctctgacaataaggacggactgtccaaaggcatcgtgcagggggtcctggccaccattaacctgcaaagcacgcacgaattacagttgctcaccacctttttgttcaacgtacagggtacccagccgaagatggtgatggaatactggactggatggtttgacagctgggggggtccacataatattctggattcttctgaagtgctaaaaactgtgtccgcaatcgtcgacgctgggtcctctattaatttgtatatgttccacggaggaactaatttcggattcatgaacggcgctatgcacttccacgattacaagagcgacgtgacgagctacgactatgatgcagtgctgaccgaggcaggcgattatacagccaaatacatgaagctccgcgatttcttcggttcaataagtggcatcccactgcccccaccgcctgacctattaccaaaaatgccttacgaacccctcacacctgtgttgtacttgtcactttgggacgctttgaagtatctgggtgagcccattaagagcgagaagccgatcaacatggagaacctgcctgtcaacggaggaaatggacagtcctttgggtacatactctacgaaaccagcatcaccagctccggcatcctgagcggccacgtgcatgacagaggccaggtgttcgtcaatacggtatccatcggctttctggattataagacgactaaaatagcagtgccattaatacagggctacactgtcctgcgaattttagttgagaatcgagggagagtgaattacggggagaatatcgatgaccagaggaagggcctaatcggaaacttatacctgaacgattcacctctcaagaattttaggatatactcattggatatgaaaaagtcattctttcagaggtttggactggataagtggtcctctctgccagagactcctaccttacccgctttcttccttggatctctgagtatatcaagcaccccctgcgatacctttttgaaacttgagggctgggaaaagggcgtggtctttattaatggacagaatctcgggaggtactggaacatagggccacagaaaactttgtatcttcccggaccgtggctatctagtggtataaatcaagtaatcgtgttcgaggagacaatggctggtcccgctctgcaattcactgagaccccacacctgggcaggaaccaatatattaagtag

SEQ ID NO: 11649 - DNA, 1374 bp, Artificial Sequence
  Description of Artificial Sequence: Synthetic coding sequence
atgggatgctcactccctctcagctgcattatggttcgctcagtcgcctgggccggattcatggtactgttgatgataccgtgggggtccgctgctaagctggtgtgttacttcaccaattgggcccagtaccgccaaggcgaggccaggttccttccaaaagaccttgatccctcactttgtacccacctcatttacgcgttcgcgggtatgacaaaccatcaactgtccacaacagagtggaacgatgagacgctgtaccaggagttcaatgggctgaaaaagatgtttaccgatatggtggccacagccaataacagacagactttcgtgaactctgcaatacggtttctcagaaagtattcatttgatggcctggatctggactgggaatatcctgggtctcagggctccccagctgtagacaaagagcgcttcaccaccctcgtccaagatcttgccaatgcgttccagcaggaagcacagacaagtggcaaagagcgcctgctgctgtcggccgctgtccctgcaggacaaacgtacgtcgatgcgggatacgaggtggataaaattgctcaaaacctggacttcgtcaatctgatggcctatgattttcacggttcctgggaaaaagtcaccgggcacaacagccccctttataagcgacaagaggagagtggcgcagccgctagtctgaacgtggacgcagctgtccagcagtggttacagaaaggaactccagccagcaagctgatcctgggcatgccaacatacggcagaagcttcactctcgcgtccagttcggatacacgggttggagctcctgcaaccggctccggcacgccaggccctttcaccaaggaggggggaatgctggcctattacgaagtgtgttcgtggaaaggcgctaccaaacaacgaatccaggatcagaaggtcccttatatttttagggacaatcagtgggttggcttcgatgatgtggagtcctttaaaaccaaggtgagttacctgaagcagaaaggcctgggaggagcgatggtgtgggctctcgaccttgatgacttcgctggattctcttgtaaccagggccgttatcccctcatccagacactgcggcaggagctctcactgccctacctacctagcgggaccccggaattggaggttcccaaaccaggtcagccttctgaaccagagcacggcccttctcctgggcaggataccttctgccaaggaaaggcagatgggctgtatccaaatccccgagagagaagtagcttctactcttgtgcagcaggcagactattccagcagagctgtccaactggtttagtattctctaacagctgcaagtgctgcacttggaattag

SEQ ID NO: 11650 - DNA, 1125 bp, Artificial Sequence
  Description of Artificial Sequence: Synthetic coding sequence
atgtacgtctctacccgagagagatataaatggctgcgattctccgaagattgcctatacctgaacgtttatgctccagccagagccccaggggacccgcagctccccgttatggtgtggtttccgggaggcgcatttattgtgggcgctgcgagctcctacgaaggttctgatctggcagcccgtgagaaggtggtgctcgtcttccttcagcaccgactgggcatcttcggcttcctgagatggcgaggtagaacggacgactctcacgcaagggggaattgggggcttcttgaccagatggcagcactgcgatgggtgcaggagaacatcgcagctttcgggggagaccctgggaatgtcactctgtttgggcagtcggccggagccatgtcgatcagtgggcttatgatgagcccgttggcaagtggtctgtttcatcgcgcaatcagccagagcggaacggctttgttccgcctgttcattaccagcaacccgctcaaggttgctaagaaagtggcccacctggcaggctgcaatcataacagtactcagattttggtcaactgcctaagggctctaagtggcacgaaagttatgcgagtttcaaacaaaatgcgctttctgcaactgaacttccagcgcgatcctgaggagattatatggagtatgtcccctgttgtcgacggggttgtaatccccgacgaccccctggtgttactcacccagggcaaagtcagctcggttccctaccttctgggagtcaacaatctggagttcaactggctactgccctacatcatgaaattcccactgaatagacaagcaatgcgcaaggagaccataaccaagatgctctggagtacacggacgcttcttaatatcactaaggagcaagtgcccctcgtggttgaagaatacctggataacgttaacgagcatgattggaagatgctccgcaatagaatgatggacattgtgcaggatgccacctttgtttacgcaaccctgcaaactgcccattaccaccgggaaacccctatgatggggatttgccctgctggccacgcgactacacggatgaagagtacgtgctcttggatcctgcctcaggaatgggcatag

SEQ ID NO: 11651 - DNA, 384 bp, Artificial Sequence
  Description of Artificial Sequence: Synthetic coding sequence
atgaagacaggccttttctttctgtgcctcttaggcactgctgctgcaataccaacgaatgcgcgactgctgtctgaccattcgaaaccaacagccgagaccgttgccccagacaataccgctatcccctcactaagagctgaagctgaagagaacgagaaagaaacagccgtgtcgacagaggacgacagccatcacaaagctgaaaagtcctcagttctcaagagcaaggaggagtcccacgaacaatccgctgaacagggtaagtcatcgagtcaggaactggggttaaaagaccaggaggatagcgatggacatctgtcagtgaatcttgaatacgcacctactgagggtactctggacattaaagaggatatgtcatag

SEQ ID NO: 11652 - DNA, 285 bp, Artificial Sequence
  Description of Artificial Sequence: Synthetic coding sequence
atgcggacgttggctatactagccgcaattctgctggttgctttgcaagcacaagccgaaccgctccaggccagggccgatgaggttgccgctgccccagagcagattgccgcagacatcccagaggtcgttgtgtctctggcctgggatgaatcactcgccccaaaacatcccggaagccggaaaaacatggcctgctattgccggattcctgcttgcattgcaggcgagagacgatatggcacttgtatttatcaaggtcgcttgtgggcattttgttgctag

SEQ ID NO: 11653 - DNA, 414 bp, Artificial Sequence
  Description of Artificial Sequence: Synthetic coding sequence
atggcagccctctcgcgagctctgggcccactgcgcaccccagcaccccctctgtggattggcctatttctcgtcgctacgggatcccagcagagtttggcgcaacccttgccgggaaacacgacagaggccactcctcggtcactcagagcctcgggctctctgtgcgggccacacgccaaggccccttacctttgcgaggcaacccacgagcctgcagcggcacgcatacgggctcaggtacccgatacccgctggtcccgtgtgggcggacagaggttctatagtcgagtcctctcaccacttcaccgcggacctagtgggcatacagaagcatccgcccagcgcagccatatgggcaaattgaaagagcctcagccacaggatcacaaacccggactcggtgcctcttag

SEQ ID NO: 11654 - DNA, 228 bp, Artificial Sequence
  Description of Artificial Sequence: Synthetic coding sequence
atgctcaaagtacactatccaaaattcggcgtgtccgaggattgcctgtatctcaacatctatgcccctgcccacgccgacactggcagtaaactacccgtgctggtgtggtttcccggaggagccttcaagactgggtccgcaagtatttttgacggaagtgctcttgctgcctacgaggacgttctcgtggtggttgtgcagtatcgactgggaatctttggatag

SEQ ID NO: 11655 - DNA, 1491 bp, Artificial Sequence
  Description of Artificial Sequence: Synthetic coding sequence
atggccccagcaagaactatggcacgggctcgcctggcgccagcagattgcttaaattcttttaccgccggagttccaggattcgtgcttgacacaaatgcttcggtgtccaacggcgcaactttcttggagagtcccaccgtaaggaggggctgggactgcgtcagagcgtgctgtaccactcagaactgcaacctggccctggtggaactgcagccggaccgcggagaggatgccatagctgcctgcttcctgattaattgtctctatgagcagaatttcgtgtgcaagtttgctcctagggaggggttcatcaattatctgacacgtgaggtgtatcgaagctaccgccaactccggactcaaggattcggaggttctggaataccaaaagcgtgggccggaatagaccttaaagtccagccgcaagagcctctcgttctgaaggacgtcgaaaataccgattggcgtctgctgaggggcgacaccgacgtgcgtgtcgagcggaaggacccgaaccaggtggagttgtggggacttaaagagggcacctatctatttcagctgaccgtcacatcttcggaccatcctgaggacaccgcaaatgtgaccgtcactgttctgagcacaaagcagactgaggattactgcctcgcgtcgaataaggtgggcagatgcagaggttcatttcctcgctggtactatgatccgaccgagcaaatctgcaaatctttcgtttatgggggatgccttggtaacaagaataactacctgagggaagaggagtgtattttagcatgtagaggagtccagggcggacccctgcgaggtagtagcggcgctcaggctaccttcccccaaggcccaagtatggaaaggagacaccctgtgtgctccggcacttgtcagccgactcagtttaggtgctctaatggatgctgcatcgatagctttttagagtgcgacgacactccaaactgtcccgatgccagcgacgaggccgcttgtgaaaagtatacgtccggcttcgatgagctgcagcgaatacacttccccagtgacaagggccattgcgtcgacttgcccgacacagggctctgcaaagaatccatccctcgttggtactataaccccttcagcgaacactgtgcgaggttcacgtatggaggatgctatggcaacaagaataatttcgaagaggagcaacagtgtctggagagctgccgtggcattagtaaaaaggacgttttcggcttgcgcagagagatcccgatcccgagcaccggatccgtggaaatggcagtagcggtgtttttggtcatctgcatcgttgtggtagtggccatcctcggttattgcttttttaaaaatcagaggaaagactttcatgggcatcatcaccatccacccccaacccccgctagcagtaccgtgtctaccaccgaagacacagaacacctggtctacaatcacacaacacgacccctgtag

SEQ ID NO: 11656 - DNA, 528 bp, Artificial Sequence
  Description of Artificial Sequence: Synthetic coding sequence
atgccaccaggcacccgagcctgtagagtgcctagaccgggtcgtagggccccacggcctcgacgcgatggggagcccggtggacatggtgtggctcctgctagcgcagaagaagtgggagccaggccaggactgcgcgctgtggctagacttctcccccagcagcatcttcaggcgggttatgtgtgcgaacgcaaagatctgctagtgaacggatgctgcaatgtcaatgtgccgagcactaaacagtactgttgtgatgggtgttggccgaacggatgttgttcagcttatgaatactgcgtctcatgctgcctccagccaaataaacagctgttgctggagcggttccttaaccgagctgcagttgcctttcaaaatctgttcatggccgtcgaggaccatttcgaactgtgcctggcgaagtgccggacatcctcacaatcagtgcagcacgagaacacttatcgagatcccatcgctaaatactgttatggggagtccccacccgagctgttccctgcttag

SEQ ID NO: 11657 - DNA, 1881 bp, Artificial Sequence
  Description of Artificial Sequence: Synthetic coding sequence
atggatttggtcttaaagcggtgcctactgcaccttgccgtgataggagctttgttagccgtgggtgctacaaaggtccctcggaaccaagactggttgggagtgtctcggcaattgcggaccaaagcatggaatcggcaactctatccagagtggacagaagcccagcgtctggattgttggcgcggtggacaggttagtctgaaagtgtctaatgacggtcccaccctgatcggcgctaacgccagcttttctatcgctctgaatttccccggttctcaaaaagtgctacctgatggacaggtaatctgggtgaacaataccattatcaatggtgatcaggtgtggggcggacagcccgtctaccctcaggagaccgacgacgcttgtattttcccggacggaggcccttgtccaagtgggagctggtcgcaaaaacgatctttcgtctacgtttggaagacatgggggcagtactggcaagttttgggtggcccagtttctggcttgtcaatcgggaccggcagagccatgctgggcactcatacaatggaggtcacggtgtaccaccggagagggtcccgctcatacgtccctctggcgcactcaagtagtgctttcacaatcactgatcaagtgcccttttccgtcagcgtgagccagctgcgagccctggacggtggaaataaacattttctgagaaaccagccattgacctttgccttacagctgcacgatccctctggatatttagcggaggctgatctgtcttacacatgggattttggagatagcagtggcactctcatctcaagggcgctggtcgtcacccacacttatctggaacccggaccagttacagctcaggttgttcttcaggcagctatcccgctgaccagctgtggcagctcccccgtgcctgggacaaccgacggccatcgacctactgcagaggcgccaaacaccactgcaggacaggttcctaccaccgaagtggtgggaacaacccctggacaagccccaaccgccgaaccttccgggactacatccgtgcaggtcccaaccactgaggtgatttccacagccccagtgcaaatgccaacggccgagtccaccgccgctcaagtgaccactaccgagtgggtggaaacaaccgcccgagagttgcccatccctgaacccgagggccctgatgctagttccattatgagcacagagagtattactggaagcctcggcccattgctggatggaacagccactctgagattggtgaagcgacaggtcccattagactgtgtgctgtatcgctacggaagtttttcagtgaccctagacatcgtgcaaggaattgagagcgccgagatcctccaggccgtcccaagtggtgagggcgacgccttcgaattgacggtgtcgtgtcaggggggtctccccaaggaggcttgcatggagatcagttcccccggttgtcaacctccagcccaaagactctgccagcccgtgctgcccagcccagcctgtcaactggtactgcaccagatactcaaagggggtagtggcacctactgccttaacgtgtccctggctgacacaaacagcctcgctgtagtctcaactcagctgataatgccggtgcctggaatcctgctcactgggcaggaggccggacttgggcaagttcctctaatagtaggcattttgctagttctcatggctgttgttctcgcctccctgatttaccggcgtcgccttatgaagcaggacttcagcgtcccgcaactaccccacagctccagccattggctgaggctccctcgtatattctgttcctgtcccattggtgagaatagtcctctcctgtctggacaacaggtgtag

SEQ ID NO: 11658 - DNA, 1611 bp, Artificial Sequence
  Description of Artificial Sequence: Synthetic coding sequence
atgcccactctgtgttctagcttcggtctacaggtgctcctgcctgaatacctgagggagcggtttgtcgcagccgcactcagttacatcacctgttctagcgaaggcgaactggtgtgcaaagaaaacgattgttggtgcaaatgtagtcccaccttccctgaatgcaattgccccgatgcagacatacaggccatggaagatagcttgttgcagattcaggactcttgggcaacgcataatcggcagtttgaagaaagcgaagagttccaggcattgctgaagcgtttgcctgacgatcggtttctgaactctactgcaatatcccagttctgggcaatggatacctcattgcagcaccgctaccagcagcttggcgcaggcttgaaggtcttattcaaaaaaacccatagaatcttgaggcgcttgttcaatctgtgtaagcggtgtcacagacagccacggtttaggcttcctaaagagagcagcccaagaagcctctcatactggtggaacaggatccaaagtctgctttactgtggagaatctactttcccgggaacattccttgagcaaagccactcctgcacctgtccatacgatcagagttcttgccagggacctatcccatgcgcactgggtgagggaccagcatgtgcgcattgcgctccagacaacagcacgcggtgtggttcatgtaacccagggtacgtcctcgcacagggtctgtgccggccagaagtcgccgagagtcttgagaacttcttaggcctggagacggacctgcaggatctggaactgaagtacctgctgcagaaacaggactcaaggattgaagtccattcaatctttatctccaacgatatgagacttggaagttggttcgatccctcctggcggaaaaggatgctgctcaccctaaagtccaacaagtacaaaccgggacttgtgcacgtgatgctggccctttcattgcagatatgcctcacgaagaacagcacactggaacccgtcatggcaatttatgtgaacccctttggtggctcgcactcggaatcctggttcatgccggtcaacgagggctcttttcccgactgggaaaggacaaatgtcgacgcagccgctcaatgccagaattggacaatcaccttgggtaaccggtggaaaacgttcttcgagacagtccacgtatacctgcgctctcgtattaagtcccttgacgattcaagtaatgaaactatctattacgagccacttgagatgacggacccctcgaagaatttggggtatatgaagattaacaccttgcaagtgttcgggtattccctgccttttgaccctgacgcaattagggatttgattctccagctggattatccttatacccaagggtcacaagactcagccctcttgcagctgattgagctaagagatcgagttaaccagctcagtcctccaggcaaggtcaggttggacctattctcttgcttactgcggcacaggctgaaactcgccaataatgaagtggggaggattcaaagttccttgagagcttttaactcgaagttgccgaatccggtggaatatgagacagggaaactctgcagctag

SEQ ID NO: 11659 - DNA, 423 bp, Artificial Sequence
  Description of Artificial Sequence: Synthetic coding sequence
atgtcccagtccatcgaagttctgaacctacgcacccaacgagacttccagtatgttttgaaaatggaaacccaaatgaaaggcctcaaagcaaagttcagacagatcgaggatgaccgtaaaaccctcatgaccaagcactttcaggagttaaaagagaaaatggacgaactcttaccactgattcccgttctcgaacagtacaaaacagatgcgaagctcattacacaatttaaagaagagattcggaatctttcagcagtgcttaccggcatacaggaggagattggcgcttatgactatgaagagcttcatcagcgtgtactgtccctggaaacccgtctccgggactgcatgaaaaaactcatcgatctgaaaaagcggaaggaggaggaaaagcgccaacagaagggtgaagcctag

SEQ ID NO: 11660 - DNA, 1119 bp, Artificial Sequence
  Description of Artificial Sequence: Synthetic coding sequence
atggcctatatcgaacagcggagaatctcacacgagggaagcccagtgaaacccgtagccatccgcgaattccagaagactgaagatatgaggcgctatctacatcagaatagggtgcctgccgagcccagcagtttgctgtcactgtcagcaagccacaatcaactcagccacactgacttggagttacaccaacggagggaacagctcgtcgagaggacccggcgagaggcccaactggcagccctacaatacgaggaggaaaaaattcgaaccaaacagattcagcgggacgctgtgctggactttgttaaacagaaggcgtcacagagccctcagaagcagcacccactgctcgatggcgttgacggggaatgtccttttccctcacggagatcgcagcatacggacgacagtgctctgtgcatgtccctgtctggcttaaatcaggttggctgtgcggctaccctgccccattcctcagcctttacacctctcaaatctgatgatcggccaaatgccctccttagcagtccagctactgagactgtacaccatagtccggcttactcttttccagcggcaattcagcgcaaccaaccccagcggccagaatcattcctctttcgggctggagttagagcagaaacaaacaagggtcacgcttcccccctaccgcctagtgcagccccaactaccgactccactgactctatcacaggccagaattcgcgacaaagggaagaggaactggagctaattgatcagctacggaagcatatcgaataccgtctgaaggtctcccttccatgcgacctgggagcagcactgacagacggggtcgtgctctgccatctggccaaccacgttcggcctagaagcgtgccgtccatacacgtgccgtctcccgctgtgccgaaactgaccatggccaagtgcagacgcaacgttgagaatttcctagaggcctgcaggaaaatcggcgtcccacaagagcagctctgccttcccctgcatatcttagaggaaaaagggctgtcccaggttgctgtaacagtccaagccctcctggaactcgcgccacccaagcaacagcagcatcagctctctgcagtgtag

SEQ ID NO: 11661 - DNA, 1242 bp, Artificial Sequence
  Description of Artificial Sequence: Synthetic coding sequence
atggaaaacatgctcctttggctgatcttcttcactccaggatggactttaattgacggcagcgaaatggagtgggatttcatgtggcatctgcggaaagtacccagaattgtaagtgaacgcactttccatttgacaagtccagccttcgaagccgacgctaagatgatggtcaataccgtgtgcgggattgaatgccagaaggaactgccgaccccgagtctaagtgaactggaagattatttgtcctatgagacagtgttcgagaacggcacccgaacattaaccagggtgaaggtccaggatcttgtacttgaacctacgcagaacatcacaactaagggtgtttccgtacgcagaaagcggcaagtctatggaacagactcccgttttagtatcctcgataagcggttcctgacgaattttcccttcagtaccgctgtgaaactctccaccggttgctccggaatcctgatatctccacaacacgtattgacagcagctcattgcgtgcacgatgggaaggattacgttaaggggagcaagaaactcagggttggactcctcaagatgcgaaacaaatctggcggaaagaaacgcagagggtctaaacggtcccggagggaagcctctggaggggaccagagagaaggaactcgggaacacttgcgggagagggccaagggcggtcggcgtcggaaaaaatcgggcaggggccagcgtatagccgaagggagaccctcctttcagtggactagagttaaaaacacacatattccaaagggctgggcacgcggaggaatgggagatgctactctggactacgattacgcactgctggaacttaagcgcgctcacaagaaaaagtacatggaacttgggattagccccacgatcaagaagatgccgggagggatgatacacttttccgggttcgacaacgatagggccgatcagctcgtgtaccgattttgtagcgtttctgacgagtctaacgacctgctgtatcaatactgtgacgccgagagtggaagtaccggtagtggagtgtatctcagactcaaagatcccgacaaaaaaaattggaagagaaagataatcgccgtctatagcgggcaccagtgggtagatgttcacggggttcagaaagactacaatgtcgctgttcggatcaccccgcttaaatacgcccagatctgcctatggatccacggtaatgacgccaactgtgcctacgggtag

SEQ ID NO: 11662 - DNA, 2541 bp, Artificial Sequence
  Description of Artificial Sequence: Synthetic coding sequence
atgttcaagtgctggtcggttgttcttgtgttggggtttatctttctagaatccgaagggcgacctaccaaagagggcggatacgggctgaaatcatatcagccactcatgaggctccggcacaaggagaagaaccaggaaagcagtagggtaaagggatttatgattcaggacggacctttcgggtcttgtgagaacaaatattgcggtctgggacgacactgcgtcacttccagggaaacaggccaggcagagtgcgcctgcatggatttgtgtaaaagacactataagcctgtatgcggctccgatggcgagttttatgaaaaccattgtgaagttcatagggctgcctgtctaaagaaacaaaaaattaccattgtacataacgaggattgtttcttcaagggcgacaagtgcaagactaccgaatattcgaagatgaagaacatgctgctcgacttgcaaaatcaaaagtacatcatgcaggaaaacgaaaacccaaacggtgacgacatttccaggaagaagctcctcgtcgaccagatgtttaaatattttgacgcagacagtaatgggctcgtcgatataaacgaattgacccaggttataaaacaagaggagctggggaaagatttgtttgactgcacactctatgttctcctgaagtacgacgacttcaatgcagataagcacctggccctcgaagaattctatagggcttttcaagttatccagctatccttacccgaggatcagaaacttagcattaccgccgcaacggtgggccagtcagccgttttaagctgtgctatccagggcaccctccgaccacccatcatctggaaacgaaataacataatcctaaataacctggatctggaagatattaacgatttcggtgacgatggcagcctttatattactaaggttaccaccactcacgtcggtaattatacatgctacgctgatggttacgagcaggtgtaccagacacacattttccaggtaaatgttccccctgtaatccgcgtctatcctgaaagccaggcgagggagcctggcgtaacagccagtctgcggtgccatgcagaggggattcctaagcctcaactgggttggctcaagaacggcatagacattacacctaaactttccaaacagctgactctgcaggccaatgggagcgaggttcatatcagtaacgtcagatatgaggacaccggggcttatacctgcatcgctaaaaatgaagctggcgtggatgaagatatctcttcactctttgtggaggacagtgctaggaaaacactcgccaatatcctgtggcgggaggagggcttgggaattggaaacatgttctacgtgttctatgaggatggcatcaaagtcatccaaccaatcgaatgcgaattccagaggcatatcaagccctccgaaaaattactcggctttcaagatgaggtatgtccaaaagccgagggagacgaggttcagaggtgcgtttgggctagcgctgtgaatgtgaaagacaaatttatctacgttgcccagccgaccttggacagagtgttaattgtggacgtacagtcccagaaagtggttcaggcagtctctaccgaccctgtacctgtgaagttgcactacgataaatctcacgatcaggtgtgggtgctgtcctggggcaccttagaaaagaccagccctacccttcaagttatcacattagcctcgggaaacgttcctcaccacacaatccacacacaaccagttggaaaacaattcgatagagttgacgatttttttatcccaactaccacgctaatcatcactcacatgcgatttggtttcatactgcataaagatgaggcggctctccaaaagatagatctggagacaatgtcctacataaagaccataaacctcaaagactacaagtgcgtgccccaaagcttggcttacacacacctaggaggatactacttcatcgggtgcaagccagactccactggggctgtgtctccgcaagtgatggtcgatggcgttacagatagcgtcataggattcaattcggacgtcaccggaactccctacgtcagtccagacgggcactacctggtgagcatcaacgacgtcaaggggctggtcagggttcagtacatcactatccggggagagattcaggaggcctttgacatttacacaaaccttcatatctctgacttagcctttcagccctccttcaccgaggcacatcagtacaacatttacggaagtagctccacgcagactgatgtgttgtttgtggagctgtcgtcggggaaggtcaaaatgataaagtccctcaaagaaccactaaaagcagaggaatggccttggaacagaaaaaaccggcaaatccaggatagcggactgtttgggcagtacctgatgaccccctccaaggatagtctgttcattctggacggaagactgaataaacttaactgcgaaataacagaagtagagaaaggaaacacagtaatctgggtgggcgacgcatag

SEQ ID NO: 11663 - DNA, 582 bp, Artificial Sequence
  Description of Artificial Sequence: Synthetic coding sequence
atgctgggcgtgctcgaactgctactgctgggggctgcctggttggccggacccgcacgtggccagaacgagacggaaccaattgtgctggaagggaagtgcctggtcgtgtgtgactcgaaccctacctcagacccgaccggcacagccttgggaatttcagtgcgatcggggagcgctaaagtggccttctcagccatccgctccacaaaccacgagccatccgagatgtccaacagaactatgatcatatactttgaccaggttctagtgaatatcggtaataatttcgactccgagagatcaaccttcattgccccacgaaagggaatttatagctttaacttccacgtggtgaaggtctacaatcgacagacaatccaggtgagtctcatgcttaacggctggcccgtaatttctgctttcgcaggagaccaggacgtcacacgcgaagccgctagcaacggcgtcctcatccagatggagaaaggagatcgtgcttacctgaagctcgagaggggaaaccttatgggaggttggaagtatagtacattttctggcttcctggtgtttcccctgtag

SEQ ID NO: 11664 - DNA, 813 bp, Artificial Sequence
  Description of Artificial Sequence: Synthetic coding sequence
atgcacgggagttgctcatttctgatgctgcttctgcctttgcttctcctgcttgttgcaacaaccgggccagtcggggcactcacagatgaggaaaaacgcttgatggttgagctacacaacctctacagagctcaggtgagccctaccgccagtgacatgcttcatatgcggtgggacgaagaactcgcagcctttgctaaggcctatgccagacaatgcgtgtgggggcacaataaggagcgtggtagacgcggtgagaatttgtttgcaataactgacgaagggatggatgtccctctagctatggaggagtggcaccacgagcgcgagcactataacctgagcgcggcaacctgctcaccaggacagatgtgcggtcactatacccaagtcgtgtgggccaagaccgagaggatcggctgtgggtcccacttctgtgagaagttacagggcgtcgaggaaacgaatattgaattgctggtatgcaactacgagcctcctggtaatgtgaagggcaagagaccgtaccaagagggtactccgtgttctcagtgtccgtcagggtatcattgtaaaaacagcctgtgcgagcccatagggtcccccgaggatgcacaggatctcccgtacctggtgacagaggccccatcattccgagcaaccgaagccagcgacagccgcaaaatgggagcagaggggcctgataagcccagcgtagtatctggtttgaactccggcccaggccacgtatgggggccactgcttggcctcctcttgctaccccctctcgtgctggctggcatcttctag

SEQ ID NO: 11665 - DNA, 702 bp, Artificial Sequence
  Description of Artificial Sequence: Synthetic coding sequence
atggaccaggtgttcatgattgactcaaaatgtgagtcagggaaaggtaggtgctccttcaaccctaacgtgaatactgtgagtgtgatgataaatgaagagttgttctccggaatgtacattgattttatgggtacagatgccgctatcttccggagcttgactaaacgcaatgccgtccgtaccgaccaacataactcgaaatggcttagcgagccgatgtttgtagacgcccatgtcatcccagacggcactgatcccaatgacgctaaggtgtacttttttttcaaggagaaactgacagacaataataggtccactaagcaaatccacagtatgattgccaggatctgtccaaacgatactggcggactgagatcacttgttaacaagtggacgactttccttaaagcgagacttgtctgttctgtcaccgacgaggatggcccagagacacacttcgatgaactggaagacgtgtttctgttagagacggacaacccaaggactaccctcgtttatggcatcttcactaccagttccagcgtctttaaaggatctgccgtgtgcgtgtatcatctgagtgatattcagaccgtgtttaacgggccatttgcccacaaagaaggaccaaaccaccaactgatatcctaccaggggaggattccctatccccgaccgggaacgaatacttgtgtgtag

SEQ ID NO: 11666 - DNA, 1368 bp, Artificial Sequence
  Description of Artificial Sequence: Synthetic coding sequence
atgctgcatcccgaaaccagccctggacgtggacatctgctggctgtgctactagccttgttgggaactgcatgggccgaggtctggccaccccagctgcaggagcaagctcctatggctggggcactgaataggaaggagagttttcttctgctgtcactgcacaaccgattgcgcagctgggtgcagccccctgcagccgacatgaggcggctggactggagcgattctttggctcagctggcccaggcacgggcagcgctatgcggaatccccaccccctcacttgcttccgggttatggcgcaccttgcaggtgggatggaacatgcagctgttgcccgcaggtctggcctctttcgtggaagtggtgtctttgtggtttgccgagggtcaacggtatagccacgccgcaggcgaatgcgcaaggaatgctacctgcactcactacacacagctggtctgggctaccagctcccagctgggatgcggccgacacctttgtagcgctggacaggccgcaattgaggcctttgtctgtgcttatagtcctagaggaaattgggaagttaatggaaaaaccatcgttccatacaagaagggcgcatggtgtagtctgtgtactgcctcggtgtcagggtgctttaaagcatgggatcacgcagggggactctgcgaggtgccgcgaaacccatgcagaatgagctgtcagaaccacggtcggctaaacatctcgacgtgtcactgtcattgcccaccaggatacacaggcaggtactgccaagttcgatgtagcctccagtgcgtgcacgggcgattccgggaggaagaatgtagttgcgtgtgcgacattggctacggaggcgctcagtgtgccacaaaggtgcacttcccttttcacacgtgcgacctgaggattgacggtgactgtttcatggtatccagcgaggctgacacttactatcgtgctcgcatgaaatgccagaggaaaggcggagtgctggcccaaataaagtcacagaaggttcaggacatcttggcattctatctcggacgccttgaaaccactaatgaggtcattgacagtgactttgagactcgaaacttttggataggtctcacgtacaaaactgccaaggactcatttagatgggcgacgggtgaacatcaggcctttacaagctttgcatttgggcagccagataatcacggcctggtatggctcagtgcagctatgggtttcggtaattgcgttgaactccaggccagcgcagcttttaactggaacaaccagagatgcaaaacccgtaacagatacatctgccagtttgcccaggagcatatcagccggtggggacccggatcatag

SEQ ID NO: 11667 - DNA, 462 bp, Artificial Sequence
  Description of Artificial Sequence: Synthetic coding sequence
atggctcgtttttgggtttgcgtggcgggtgccggattctttcttgcctttctggtgctgcacagtcggttttgtggctcacccgtgcttaggaactttactttcgccgtaagctggagaacagaaaaaatactgtaccgcttggatgtgggatggcctaagcaccccgagtacttcaccggcacaaccttttgtgtggccgtggactctctgaatggcctcgtctacatcggacaaagaggagacaacatccctaaaatcctcgtgttcaccgaagatggatacttcttgcgcgcttggaattacactgtggacaccccacatggcatctttgccgcttctaccctctacgagcagagcgtttggatcactgatgtggggagtgatttcatgatcctctggctgcatggcgagaacggtactgggcctgctaaattcaatattccacactccgtcacatag

SEQ ID NO: 11668 - DNA, 375 bp, Artificial Sequence
  Description of Artificial Sequence: Synthetic coding sequence
atgtggcgctgcccactggggctactgctgcttttgcccctggccggacatttagccttgggtgcccaacagggaagggggcgaagagagcttgcccctggcctgcatctgcgtggtatccgggacgccggaggacggtattgccaggagcaggatttatgttgtaggggacgagccgacgactgcgcactgccgtatcttggggcaatatgttattgcgatctcttttgcaacaggactgtctccgattgctgtcctgatttctgggacttttgcctgggcgtgcctcccccttttccgcctatccaagctcctgctcggaggaccggcagcggctccgttacgaaaaaccatgcctggtggatccaaacgtag

SEQ ID NO: 11669 - DNA, 777 bp, Artificial Sequence
  Description of Artificial Sequence: Synthetic coding sequence
atgaagactctctacttggctgacacctttcccaccaacttcagggatagcgccggtgcaatgaaacaaatcaatgactacgtcgccaagcaaaccaagggcaagatcgtggatctactgaaaaatctcgactcaaacgcagttgtcataatggttaattacatcttctttaaggctaagtgggaaacctccttcaaccacaagggcacgcaggagcaggacttttacgtcacctctgaaaccgttgtgagagtgcctatgatgtctagggaggaccaataccactacctgctcgatcggaacctgtcatgccgagtcgttggggtgccgtatcaggggaacgcaacggccctgttcatcctcccgtcggaaggcaaaatgcaacaagtcgagaacgggctgtccgagaaaaccctgcggaaatggctgaaaatgttcaagaaacgacaactggagctgtaccttccaaagtttagcattgaagggagctaccagctggagaaggtgttaccttcactgggaatttccaatgtgttcactagccacgcagacttatctggcatctcgaaccactccaatatacaagtttccgagatggtgcataaggcggtggtcgaagtggatgagtccggtaccagggccgcagccgctacgggaacaattttcaccttcagaagcgcgagactaaattcacagcgcctggtatttaaccggccatttttgatgttcatcgtggacaacaatatcctctttctggggaaggtgaatcggccatag

SEQ ID NO: 11670 - DNA, 1731 bp, Artificial Sequence
  Description of Artificial Sequence: Synthetic coding sequence
atgattgtattcggatgggccgtctttctggcgtcgcgctcccttggtcagggtttgcttcttaccttggaggagcacattgcgcacttcttaggaacagggggagccgcaaccacaatgggaaatagttgcatctgtagggacgactcggggacagacgatagtgtggatacccaacagcagcaggcagagaactcagccgtccctactgctgacactagaagtcagcctagagaccccgttcgccctcccaggcgtggcagaggaccccacgagcccagaagaaagaagcaaaacgtcgatgggctggtgctcgacaccctggccgtgatcagaacactagtcgacaacgatcaggaacctccttattcaatgattaccctccacgagatggccgaaaccgatgagggctggctggatgtggtccagtccttaattcgcgtgattccattggaggaccccttgggtccggcagtgattacgctgttgctcgacgagtgccctttgcccacaaaggacgctctgcagaaactcaccgaaattcttaacctgaacggagaagtggcctgtcaggatagctcccatcccgcaaaacaccgaaacaccagcgctgttctcggatgtctggcagagaagctcgccggtcccgctagcattgggctgctttcccctggcattttggaatacctgttacagtgcctgaaactgcagtcccaccccaccgtcatgctttttgccctgattgcacttgagaagttcgcgcagaccagcgagaataaactgacgatctctgagagcagcatttcagaccgcctggtaaccctcgaatcctgggcaaatgacccggactacctgaaaagacaggtcggcttctgcgcacaatggagcctagataatctgtttctgaaagagggcagacagctgacttacgaaaaagtgaatttaagttccattagggccatgctgaactcgaacgacgtctccgagtacctgaagattagtccacatggactcgaggcaagatgtgatgcctcctcttttgaatcagttagatgtactttctgcgtggacgctggagtgtggtactacgaggtgactgtggtgacttccggcgtgatgcaaattggctgggccactcgcgactccaagttccttaaccatgaggggtatggtattggagatgatgagtattcctgcgcctacgacggctgccgacagcttatctggtataacgcccgtagtaaaccccacatacacccatgctggaaggaaggcgataccgtgggttttctattggatctcaacgagaagcagatgatattctttctgaatggcaaccagctgccccctgaaaagcaagtcttctcttccaccgtttcaggattttttgccgctgccagcttcatgtcctaccaacaatgcgagtttaatttcggagccaagccctttaaatatccaccaagcatgaaattcagcacgttcaacgattacgcatttctgacagccgaagagaagatcatcctcccacgccaccgtagactggctctgctcaagcaggtctccattagagagaattgctgcagcctgtgctgcgatgaagttgctgacacccaactaaaaccctgcggtcacagcgatttgtgcatggattgtgcattacaactggagacctgtccactctgtcgaaaagagattgtgtcacgcattaggcaaatctcgcacatttcctag

SEQ ID NO: 11671 - DNA, 1359 bp, Artificial Sequence
  Description of Artificial Sequence: Synthetic coding sequence
atggccgacatgcatcgcggttacgccgattccccctccaaagctggggcagcaccatacgtgcaggcattcgacagtttgttagccggtcccgttgcagaatatctcaaaattagcaaggagattggtggggatgtccaaaagcacgccgagatggtccacacgggcctgaaactggagcgggctctactcgtcactgcgagccagtgccagcagccagctgaaaataaactgtccgacctcctggcccctattagcgaacagatcaaagaggttattactttcagagaaaaaaatcgaggaagcaaactctttaaccacctttctgctgtgtctgaaagcatccaagcactcggatgggtggccatggcccctaagcctggcccatacgtgaaagagatgaacgacgccgctatgttttacaccaacagggtcctgaaggagtacaaagatgttgataagaaacacgtggactgggtcaaagcttacctgagcatctggacggagttacaggcctatataaaggagtttcatactactggcctcgcatggtctaagacaggtccagtggcaaaggaactgtcgggccttcctagcggcccatctgcgggaagctgcccaccgccaccaccaccttgtccgccaccgccaccggtgagcactatatcttgttcatatgaaagcgctagtcgaagctctctgtttgcacagattaatcagggtgagagcatcactcatgctttaaaacatgtgtcggacgacatgaagacgcacaagaaccccgctcttaaagctcagagcgggccagtgcggagtggtccaaaacccttcagcgccccaaaaccgcagacaagtccctcgcctaagcgcgctacaaagaaagagcccgcagttttggagctggagggtaagaagtggcgggtggagaaccaggagaacgtttccaatttggtcatcgaggatacggaactaaagcaggtggcttacatctacaaatgcgtgaataccacattacaaatcaagggtaagatcaacagcattacagtcgacaactgtaaaaagctgggactggttttcgatgatgtggtgggaattgttgagatcattaattctaaggacgttaaggtccaggtgatggggaaggtgcctacaatttcaattaataagactgatgggtgtcacgcctacctgagcaagaactcgctggattgcgaaatcgtgagtgcaaagtcctctgaaatgaatgtgctgatcccaaccgaggggggtgattttaacgaattccctgttccagagcagtttaagaccttatggaatgggcaaaaactagtaaccactgtgaccgagatcgcaggatag

SEQ ID NO: 11672 - DNA, 1533 bp, Artificial Sequence
  Description of Artificial Sequence: Synthetic coding sequence
atgggcaggcccacgcagtggccgagcttgctattactcctgctgctcccagggcctccaccagtagcgggactcgaggatgctgcctttcctcatctgggcgagtccttgcagccattgcctagagcctgccctctgcgctgtagctgccctcgagtggataccgtcgactgcgatggcctggatcttagagtgttccccgacaatatcacacgggctgcccaacatttgtccctgcagaacaatcaactgcaggagctaccttacaatgagttaagccgcttgtcaggcctgcggactctgaatctgcacaataacctgatcagctccgaaggacttcccgatgaggccttcgagtcattaactcaactccaacatctgtgtgttgcacacaataagttatccgttgcaccccagtttctgccaagatccctgcgagttgccgatctggccgcaaatcaagtgatggaaatcttccctctgaccttcggggagaaacctgccctccgatcggtttatctacacaacaatcagctgagtaacgccggtctgccgccagatgctttccggggatcagaggccatcgcaactttgagtttgagcaacaatcagttatcctatctccccccatcgttgccccctagtcttgagcggctgcacttacagaataatctgatcagcaaagttccaaggggcgcactgagccgccagacccagcttcgcgagctgtacctgcagcacaatcagctcactgactcaggcctggacgcaacaacattcagtaagttgcacagcctcgagtacctggatctatcccacaatcagctaaccacggtccccgcaggactgcctcggacgctcgcaattcttcatttagggcgtaaccgcattcgccaagtggaggcagctcgcctacatggagctcgaggcttgagatacttattgctgcagcacaatcagttgggcagctccggccttcccgcaggggcattgcgtccactccgcggattgcatactctacatctgtatggaaacggcctggaccgcgtcccacccgcactcccaaggcgtctaagggctttggtgttgccccacaatcacgttgctgcactgggagccagagacctcgtggccactcccggattgaccgaactcaatcttgcttacaaccgcctcgcatctgccagagtgcaccatagagcttttcggagactccgggcacttaggtcactagatctagccggaaaccagcttactcgtctgccaatggggttaccaaccggcctacgcaccctacagctgcagaggaatcaactgcgcatgctggagccagaaccgctcgctgggctggatcagcttagggaactctcattggctcacaacagactaagagtgggcgacatcggacccggaacctggcatgagcttcaggcgttgcaggtccgccaccgattggtgtcccataccgtgcccagggccccaccctctccctgtctgccctgccacgtacctaatattttggtgtcgtggtag

SEQ ID NO: 11673 - DNA, 114 bp, Artificial Sequence
  Description of Artificial Sequence: Synthetic coding sequence
atgaactctaccctgaacttttttatccagtcgtataataacgctagcaatgatacctacctctaccgcgtccagagactgattcgctcccagatgcagcaagtccactgctag

SEQ ID NO: 11674 - DNA, 1266 bp, Artificial Sequence
  Description of Artificial Sequence: Synthetic coding sequence
atggggagacccacccagtggccatcacttctgctactcctcctgttacccggaccgccaccggttgctggcctggaagatgctgcgttcccccatctgggagaatctctgcaacccttacccagagcttgtccactccgctgttcctgtccacgcgtggataccgtggactgtgacggcctggacttacgggtgtttcctgataacattaccagagctgcacagcacctctccctgcagaacaaccagctacaggagctcccctataacgagctcagtaggctgagcggactccgaactttgaacctgcacaacaacctaattagctcagaaggcctccctgatgaagcctttgagtcccttacacagctccagcacttatgtgtagctcataataagaataacttgatttcgaaagtgccacggggagcgttatctcgccaaacccagctgcgggagttatatttgcaacataatcagctgacagatagtggcttagacgctaccacattttctaagcttcacagtctcgagtacctggatctgtcgcacaatcaactaactaccgtccccgcaggcctcccaaggacgttagccatcctccacctcggccgaaatcgtattcgccaagtcgaggcggctcgactccatggggcacgtgggctgcgctatctacttctgcaacataaccagcttggcagctccgggctgcctgcaggtgccttgcgtccactccgaggtcttcacacattgcacctctacgggaatggattggacagggtgccccctgccttgcccagacgcctccgggctctggttcttccccataatcatgtggcagccctgggggcaagagatcttgtggccacgcccggtctcacggagctaaatcttgcatataacagattggcatcagcaagggttcatcacagagcattccggcgacttcgggcactgcgcagtctggacctggcaggtaatcaactaacacgactcccaatgggactacccaccggtctccggaccctccagctccaacgaaatcagctccgtatgttagagccagagcccctcgcaggcctcgaccagctgcgcgagttaagccttgcccataaccgactcagggtgggcgatattgggcctgggacctggcatgagttgcaagccctgcaggtccgccaccgtctcgtgagtcacacagtccccagggctccaccttccccctgtcttccctgccatgtgccaaacatactggtctcctggtag

SEQ ID NO: 11675 - DNA, 993 bp, Artificial Sequence
  Description of Artificial Sequence: Synthetic coding sequence
atgagttcttggagtaggcagcgccctaagagtccaggcggtattcagccccatgtctcccggaccctctttctgctcctcctcctggccgctagtgcctggggcgtgacgctgtcacctaaagactgtcaagtattccgtagtgatcacggatccagcatctcttgccagccaccagccgagatccctggatacttacccgctgatactgtgcatttggctgtggagttttttaacctaacgcacctaccagcgaatctgctccagggggctagtaagcttcaagaactacatctttccagcaatgggctggagtccctgtccccagaatttcttagacctgtgccccagctgagggtgttggatctcacaagaaacgccctcgttctgaaggaaaaccaactagaagtgctggaggtgtcatggcttcacgggttgaaagcattggggcacttggatttgtccgggaaccggttacgtaagctccctccagggctcttagcgaatttcacattactgcggactctagacctgggagagaaccagctggaaacactgcctccggacctgctgcggggtcccctgcagcttgagaggctgcatctggagggaaataagctgcaggtgctgggcaaagatctgttgcttccacagccggacctgaggtacctgttcctcaacggcaacaaacttgccagagtcgcggctggagcatttcagggtctcaggcaattggacatgctagatttaagcaacaacagtctggccagcgtgccagagggactatgggctagcctgggccagccgaactgggatatgcgggatggattcgatatttccggaaatccgtggatatgcgatcaaaacctttcggatctctaccggtggctgcaggcccagaaagataagatgttctcccaaaacgatacccgctgcgcaggccctgaagccgtcaaggggcagacactgctcgcagtcgctaaatcccagtag

SEQ ID NO: 11676 - DNA, 1815 bp, Artificial Sequence
  Description of Artificial Sequence: Synthetic coding sequence
atgatgagggccgtctgggaagccctggcggcattggccgcagtcgcatgtcttgtgggcgctgtgagggggggacctgggctgtctatgtttgctggtcaggccgcacagcccgacccttgtagtgacgaaaatggccaccccaggaggtgcattccagattttgttaacgctgctttcggcaaagacgtgagggtgtcctcaacttgtggaagacctccagccaggtattgcgtggtatcggaacgaggtgaagagcgcctgaggagctgccacctctgtaacgcctctgaccctaaaaaggcccacccaccagcgtttttgacagatctcaacaacccgcacaacctcacatgttggcaatcagagaactaccttcagtttccgcacaacgtgaccctgactttatctctaggtaaaaaatttgaggtgacttatgtatcactgcagttctgctcacccagaccagagtctatggcaatatacaagtcaatggattacggacgcacatgggtgccgttccagttctattccacccagtgccgaaagatgtataatcgaccgcacagggcacccattaccaagcagaatgaacaggaggcagtctgtactgattctcacaccgatatgcggcctctctccggagggctgatcgctttcagcactctggacgggcgacccagtgcacatgatttcgacaattcaccagtgctccaggattgggtgacagccaccgacatccgtgtggccttttctcggcttcatacatttggtgatgaaaatgaggacgattctgaactcgctcgagattcgtatttctacgccgtcagcgacctacaggtaggcggtaggtgcaaatgtaacggccacgctgccaggtgtgtgagagatagagatgacagcctggtttgcgactgcaggcacaacaccgccggaccggaatgcgatagatgtaaacccttccactacgatcggccttggcaacgggctaccgccagagaggcaaatgagtgtgtggcatgtaattgtaacctgcacgcgcgtagatgtcggttcaatatggaattgtataagctgagtggcaggaagtcaggcggagtgtgtctcaactgtaggcacaatacagccggaaggcattgccattactgcaaggagggttactatcgggatatgggcaagccaatcacccacaggaaggcctgtaaagcatgcgactgccatcctgtcggcgcagctggcaaaacttgcaaccagacaaccggccagtgcccctgtaaagacggagtcaccggcattacttgcaatcgctgtgccaaaggctatcagcagtccagaagtcccatagcaccctgtattaagatacctgtcgctccacccaccactgccgcttccagcgtcgaggaacccgaagactgtgatagctactgcaaggcctcaaagggaaaactcaagatcaacatgaaaaagtactgtaaaaaagactatgccgtccagatccatatcctcaaggccgataaagcaggcgattggtggaagttcacagtaaatattatctcagtctataaacagggaacctcgcggatcagaaggggcgaccagtcactgtggatcaggtcacgcgatattgcctgtaagtgcccaaaaatcaagcccctcaagaaatacctccttcttggcaatgccgaggatagcccagatcagtcaggaattgttgcagacaagtcttcacttgttatccaatggcgcgacacttgggccaggcgccttagaaaatttcagcagcgggagaaaaaagggaagtgtaagaaggcctag

SEQ ID NO: 11677 - DNA, 948 bp, Artificial Sequence
  Description of Artificial Sequence: Synthetic coding sequence
atggggcaagacagagaagaaactaatatcgagctgctcgtgtgcaactacgaacctcccggaaatgtgaaaggtaaacgcccataccaagagggcacaccctgctctcagtgtccctcagggtatcattgtaaaaactcactttgcgagcccatagggagtccagaagacgcacaggacctaccttatctggtgactgaggcgccttcctttcgggcaacagaagcttcggacagcagaaagatggggacaccatcgagtctggccacgggaattccggctttccttgtgacagaggtatccggaagcttagccaccaaggccctgccggcagttgaaactcaagcacctactagtctcgccacaaaagatcctccttctatggccaccgaggcaccaccctgtgttacaactgaagttcctagcattctcgcagcacactctctaccgagcttagacgaagagccagttacgttcccaaaaagcacgcatgtccctataccaaagtctgcagataaggtcacagacaagactaaagttccgagtcgaagcccagagaactctctggacccgaagatgtctcttacaggggcaagagaattactgccccatgcgcaagaggaagctgaggccgaagctgagttgccaccatcgtccgaggtactagcttctgtgttccctgctcaggacaagcccggagaacttcaagccaccttggaccacactggacatacctccagtaagtctctgcccaacttcccaaatacaagcgcaaccgcaaacgccactggaggccgtgccctggccctgcagtcgtctctaccgggagccgaaggaccagataagcccagcgtcgtgtccggtctcaattctggccctggccacgtgtggggcccactgctgggactcctgcttcttccacctctcgttctagccggtatattttag

SEQ ID NO: 11678 - DNA, 207 bp, Artificial Sequence
  Description of Artificial Sequence: Synthetic coding sequence
atgcaggtttcaactgcagctctcgccgtgctgctctgcacaatggccctgtgcaatcaggtgctgtctgctcctctggcggcagatacccccaccgcttgttgtttcagttacactagtcgccagataccccagaactttattgctgactatttcgaaacatcttctcagtgcagcaaacctagcgtgatggctgccccagggtag

SEQ ID NO: 11679 - DNA, 3369 bp, Artificial Sequence
  Description of Artificial Sequence: Synthetic coding sequence
atgagtctacaggaaatgttcagattccctatgggtctgctgctcgggtccgtgctgctagtggccagtgcgccagccaccctggaacccccaggatgctccaataaagaacagcaggtgacagtgtcccacacctataagatagatgtgcctaagtctgcattagtgcaagtagatgccgacccccagccactcagtgacgacggtgctagtctgctcgctttgggagaagcgagggaagagcaaaatatcattttccgccacaacattagactccagactcctcaaaaggactgtgaactcgccggtagtgtccaggatctgctcgccagggtgaagaaactagaagaagaaatggtagagatgaaagagcagtgcagcgcccaaagatgttgtcaaggcgttactgacctcagcaggcactgttcaggtcacggaacattcagcctagagacatgtagttgccactgtgaagagggcagggaaggtcctgcctgtgagagattagcctgtcccggagcctgttctggacatgggagatgtgtcgacgggagatgtttgtgtcatgagccttatgtgggtgcggactgcgggtaccctgcctgtccagagaactgctctggacacggggaatgcgtgcgcggagtctgtcaatgtcatgaggatttcatgagcgaagactgtagcgagaaacgctgtcccggagattgttccggacacggattctgcgatactggtgaatgctattgcgaggaggggttcactggactcgactgcgcccaggttgtaactcctcaggggctgcagcttctgaagaataccgaagatagcttgctagtatcttgggaaccttcatcacaggttgaccattatctgctgtcctattaccccctgggtaaggaactgtcagggaagcaaattcaggtccccaaagagcagcatagctacgagatcctcgggttgctgcccggtaccaagtacattgttacccttaggaacgtaaagaatgaagtgtcatcctcacctcagcatctgctcgctacaactgatctggctgtcttagggaccgcctgggtaaccgacgagactgaaaacagcctcgacgtagaatgggagaacccctccactgaagtggactactacaaattgaggtacggacctatgaccgggcaggaagtggcggaggtgactgtcccaaagagcagcgatccaaagtctagatacgacatcaccggcctgcacccagggactgagtacaagataactgtagtgccgatgcggggtgaactcgagggcaagcccattctgcttaacgggagaacagaaattgacagccctacaaacgtggtgaccgatcgcgtgactgaagacacagcaacagttagctgggacccagtgcaggcagttattgacaaatacgtcgtgcgctatacatccgctgatggcgacactaaggagatggccgtgcataaagatgaatcttctactgtgcttactggccttaaacccggtgaggcctataaagtgtacgtgtgggcagaacggggaaatcaggggagcaaaaaagctgacacgaacgcactcaccgagattgacagccctgctaatctggtcacagatagagtcaccgagaacacagctacgattagttgggatcctgtacaggccacaattgataggtatgtggtcagatatacctcagcaaaggatggagaaacacgagaggtaccagtgggcaaggagcaatcttctaccgtgttaactggtctcagaccgggtgtcgaatacaccgtccatgtatgggcgcagaagggcgcacaagaatccaagaaagccgatacaaaagctcagaccgacatcgattctccacagaacttggtcaccgattgggtgacagaaaatactgcaacagtgagttgggaccctgtgcaggcgacaatcgaccgctacgtggtgcactacacatctgccaatggggagaccagggaggtgcctgtcggtaaggagcagagcagcactgtgcttaccgggctgcgccctggcatggaatataccgttcatgtgtgggcccagaaaggcaatcaggagagtaaaaaagcagacacaaaggcacagacggagatagacggccctaaaaatttggtaaccgattgggttactgagaatatggctacagtgagctgggatcctgtacaggcaactatcgacaagtacatggtgaggtatacaagcgctgacggggaaactcgcgaagtacccgtaggcaaggaacattctagcactgttctgaccggactgagaccgggtatggagtatatggttcacgtctgggcccagaagggggctcaggaatctaagaaggcagataccaaggcccagaccgaactggatccaccgagaaacttacgcccatcagccgtgacccagtctgggggaattctgacttggactcctccaagcgctcaaattcacggctacatcctcacctatcagttccctgacggaaccgtcaaagaaatgcaactggggcgagaggaccaacgcttcgctctgcaaggtctcgaacagggggctacctaccccgtgagccttgtggctttcaaggggggtcgccgatcccggaatgtcagcactactctttccacagtcggggctcggtttcctcatccttctgattgcagccaagttcagcagaattccaacgccgcaagcggactctacacgatctacctgcatggcgacgcgtctcgaccactgcaagtctattgcgacatggagacagatggagggggatggattgtcttccaaagacgcaataccggacaactggacttttttaaacgttggaggtcttatgttgaagggttcggtgacccgatgaaagaattctggttgggcctggataagctgcataatttaactactggtacccctgcaagatatgaggttcgcgtggacttgcagaccgccaatgagtccgcctacgctatctatgactttttccaggttgccagcagtaaggagcgatacaagctgactgtaggcaaatatcgcggaactgccggagatgccctgacttatcacaatggctggaaattcaccacatttgatcgggataacgacatcgctctttccaattgtgcactaacacaccacggaggctggtggtataagaactgccacctcgctaatcccaacgggcgatacggcgaaacaaagcattccgagggggtaaattgggagccctggaagggccatgagttttcaattccatatgtggagctgaagatccggcctcacggctactcccgggaacctgtccttggtagaaagaaacgaacactccggggacggctgagaaccttttag

SEQ ID NO: 11680 - DNA, 897 bp, Artificial Sequence
  Description of Artificial Sequence: Synthetic coding sequence
atgctgcaccctgagacttcccctgggcgtgggcacctgctcgccgtcctcttggctttactgggcaccgcctgggcagaagtgtggccccctcagctccaggagcaggctccgatggcgggagcactgaatagaaaagagagctttctactgctctccttgcacaacagactcagatcatgggttcagcctccagccgcagacatgaggcggctggattggtcagactcactcaactggctgaagccaggccctttgtggaatcctaaccctgaaccgggtgtgcggcctgtcgctcatccagccagcggactcgaacacgccgcttgtccacgtgcatggagaccactgcttaaatggtcactttggttcgccgaaggtcagcgctactcccacgctgcaggtgaatgcgcccgtaatgccacctgtacacattatacacagctcgtgtgggctacaagttctcagctcggctgcggcaggcacctctgcagcgccggacaggccgctatcgaggcctttgtgtgcgcgtactctcccaggggcaactgggaagtgaacggtaagactatcgtgccttacaagaagggcgcttggtgcagtctgtgcacggcaagcgtcagcggctgcttcaaggcttgggaccacgcgggaggcctttgcgaagtgcctaggaacccgtgcaggatgtcttgccaaaatcatggccgtctgaacatctcaacatgccattgtcattgccctccagggtataccggcaggtactgccaggtgcggtgtagcctgcagtgcgttcatggtcggtttcgcgaggaagagtgctcctgcgtgtgcgatatcggttatgagcccagcgtgccgccaaggtgcatatttccctccacgcctgtcacatag

SEQ ID NO: 11681 - DNA, 1728 bp, Artificial Sequence
  Description of Artificial Sequence: Synthetic coding sequence
atggacttggtgctcaagcggtgtttacttcaccttgctgtgatcggcgctctgctggccgtcggggcaactaaagggagccaggtgtggggcggacagccggtgtatcctcaggaaaccgatgacgcgtgcattttccctgacgggggtccgtgcccatcagggtcgtggtctcagaagcgctcatttgtgtacgtgtggaagacctggggccagtattggcaagtactgggcggacctgttagtggcctgagcattggaactgggagagcaatgctcggaactcacaccatggaagtaactgtttaccacagacgcggttctcggtcctacgtgcctcttgcacacagtagctctgccttcaccatcaccgatcaggtccctttcagcgtctctgttagccagctgagagcacttgacggtggaaataagcactttctgcggaatcagcctttgactttcgccttgcagctacacgacccatccggatacttagctgaggctgatttgtcctatacctgggacttcggagattccagtggtaccctgattagcagggcactggttgtaactcacacatatttggaaccaggacctgtgacagcccaggtggtgctccaagccgcaatccccctgacatcttgcgggtcctcccctgtgcccggtaccacagatgggcatcggccaaccgcggaagccccaaacaccactgccggacaggtcccgactaccgaggtggtgggtacgacgcctgggcaggcaccgacggccgagccatccgggaccacatccgtgcaggtgccaacgacagaggtaattagtacagctcccgtccaaatgccaacagctgaatcgacagggatgacaccagaaaaagtgcccgtgtcagaggtaatgggaacaactctggccgaaatgtccacgccggaggccacaggaatgacaccagcagaggtctccattgtagtccttagcgggacaaccgccgcacaggtgactactaccgagtgggtggagacaaccgctcgcgaattgcctatacctgagcctgagggcccagacgcctcttctatcatgagcaccgagagcatcactggttccctgggcccattgctcgatggcacggctacactgagactagtaaaaagacaggttcctttagactgcgtgctgtatcgctatggctccttttccgtcacactcgacattgtgcaaggaatcgagtcagccgagatcctccaagctgtcccatcaggagagggggacgcctttgagcttacggtcagttgtcaagggggactccccaaggaggcatgtatggagatttcatcacccggatgtcagcccccagcccagcggctgtgtcagccggtcctgcctagccctgcatgccagctcgtcttacaccagatcttgaaaggaggtagcggaacctattgcctcaacgtgtccctcgccgacacgaacagccttgccgtggtctctacacaactaattatgcccggacaagaggccggtttgggccaagtccccctaattgtgggaatcttgctggtattaatggccgttgtcttagcttcattaatttaccggcgtagattgatgaagcaggattttagcgtcccccagctcccacattccagttcacattggttgcggctacccaggatattctgttcgtgcccaattggagaaaattctcctttgctttctggacagcaggtttag

SEQ ID NO: 11682 - DNA, 330 bp, Artificial Sequence
  Description of Artificial Sequence: Synthetic coding sequence
tgatcggggcagagtctcaagagcctgaacgcaagcagcggacatctcgcattgatcctatcttcgatcttcggattactgttgcttgtgttgttcatccttttcttgacatggtgcagagtccagaagcagaagcatctcccgctgcgggtgagcactcggcgacggggatcccttgaggagaatttatttcacgagatggaaacgtgtttaaagcgcgaagacccacatggcacccggacctctgacgacactcccaatcatgggtgtgaggatgcttcagacactagcctgctgggcgtacttcccgcttcagaggccaccaagtag

SEQ ID NO: 11683 - DNA, 312 bp, Artificial Sequence
  Description of Artificial Sequence: Synthetic coding sequence
atgtcagggagaggaaaagggggtaagggattgggcaaaggtggggcaaagcggcaccggaaggtccttcgcgataacatacagggtataactaagcctgccattcgacggctggcacgacgagggggagttaagaggatcagtggactaatttacgaggaaactaggggggtcctgaaagtcttcctggaaaatgtgattagagacgcggtgacttataccgaacacgctaaaagaaagacagtgacagccatggacgtggtctatgctttaaagagacagggacgcaccttatacggttttggagggtag

SEQ ID NO: 11684 - DNA, 2889 bp, Artificial Sequence
  Description of Artificial Sequence: Synthetic coding sequence
atgctgagaaggcccgctcccgctctggcacctgcggctagactgttgttggcagggctcctgtgtgggggaggggtctgggccgctagggtcaacaaacacaagccatggttggagcctacataccatggaattgtgaccgagaacgataataccgtcctgttagacccgcctcttatcgccctggacaaggacgccccactgcgcttcgccgagagttttgaagtgactgtaactaaagaaggcgagatatgtggatttaaaatccacggacagaacgtgcctttcgacgccgtggtggtggataagagcacaggcgaaggcgtaatcagatccaaggagaaactcgattgtgagctacaaaaggactattctttcactattcaggcgtacgattgcggaaagggtcccgatggcacgaatgtcaagaagagccataaggccacggttcatattcaggtgaatgatgttaacgagtacgctcctgtgttcaaagaaaaatcttacaaagctacggtgatcgaaggaaaacagtatgattcaatcctgagagtggaggcagtagacgcagactgtagcccacaatttagccagatttgtagttacgagattattacacccgatgtgccattcaccgtagacaaggacggatacataaaaaatactgagaaattgaattacggtaaggagcaccagtacaaactcaccgtcactgcttacgactgtgggaaaaagagggcaacagaagatgtcttggtcaaaatttcaataaaacccacttgtacccctggatggcagggctggaataacagaatcgagtacgagccaggaaccggggcacttgcagtgttcccaaacattcatcttgagacatgtgacgaacccgtggcatcagtgcaagccactgttgagctggaaactagccacatcggcaagggttgtgacagagacacctacagcgagaagtctctgcaccgattatgtggcgctgcagcaggcacagccgagcttctgccaagtccatcaggctctcttaattggacaatgggcttgcccactgacaatggccacgattctgatcaggtgttcgaatttaacggcacgcaggccgtccggatccccgatggggtcgtgtcagtaagtccaaaagaacctttcaccattagcgtgtggatgcggcatggccctttcggacggaaaaaggaaaccatactgtgcagttcggataagaccgatatgaacaggcaccattacagtctctacgtccatggctgcagattgatctttttgtttcggcaggatccgtccgaggagaagaaatacagaccagctgagtttcattggaagcttaatcaggtctgcgatgaggagtggcaccactacgttctcaatgtggagtttccctctgtgaccctctacgtagacgggaccagccacgagccgttctccgtgacagaggattacccgctgcacccttctaagatcgagacgcagctcgtggtcggtgcttgctggcagggaggcgacttgcatatgacccagttcttcagaggcaatcttgccggactaacactgcgcagtggtaaattggctgataaaaaagtcatcgattgcctgtatacatgtaaagaaggactcgatctgcaagtcctggaggattcaggcaggggcgtgcagatccaagctcacccgtctcagctcgttctgactctggagggcgaggaccttggcgagctggataaggctatgcaacatatatcttaccttaacagccggcagtttcctacacctggcatccgacggttgaagataactagcaccatcaaatgtttcaatgaagctacatgtatatcagtccccccagtcgatggatatgtcatggttctccaaccggaggaacctaagatctcattgagcggtgtacatcactttgccagggccgcatctgagttcgaaagctccgagggagtgtttctcttcccagaattgcgcattattagcaccatcactagggaagttgaacccgaaggagacggggctgaggatcccaccgttcaggagtcgctcgtctctgaggagattgtacacgatctagacacgtgtgaagtcaccgtggagggggaggaactaaatcatgagcaggagagcctggaagtcgacatggccagactgcagcagaaaggaattgaggtcagcagctctgaactggggatgactttcacaggggtggacacaatggcatcttatgaggaagttcttcatctactgcggtatcgtaattggcacgcacgatcattgttggataggaagtttaagctaatctgttccgagttaaatggtcggtatatttccaacgagtttaaagtggaggttaatgttattcataccgctaaccccatggaacatgcaaatcatatggcggcacagcctcagttcgtccatcctgaacaccgcagttttgtggacctgtccgggcataatcttgctaatccgcacccttttgcagtggtcccctccacagcgacagtggtgatcgtagtttgcgtgagcttccttgtttttatgattatcctcggagttttccgcattagagctgcacacaggaggacgatgagggaccaagacaccggaaaagaaaatgagatggattgggatgattctgcccttaccatcacagtaaatcctatggagacctatgaagaccagcatagctccgaggaggaagaagaggaggaggaggaggaggagtctgaggatggtgaagaggaagatgacatcaccagcgctgaaagcgaatctagtgaggaggaagaaggcgaacaaggagaccctcagaatgctacacggcagcagcagctggaatgggatgattcgactttgtcctactag

SEQ ID NO: 11685 - DNA, 912 bp, Artificial Sequence
  Description of Artificial Sequence: Synthetic coding sequence
atgttgcaccccgagacatcacctggacggggtcacttactcgctgtcttactagcattgctggggacagcctgggccgaagtatggccacctcagctgcaggaacaggcaccaatggccggagcccttaatcgcaaagagagcttcctgctcctgtctctgcataacaggctcaggtcttgggttcagcctcctgctgccgacatgaggcggctggactggtctgattctctggcacagctggcccaagcgagagccgctttgtgtggaactcctaccccgagtcttgcttcaggtttgtggcgcacgctgcaggttggttggaacatgcagctgttgccagccggtcttgtgagtttcgtggaagtcgtctctctgtggtttgccgaaggccagcggtatagccatgccgcaggcgagtgtgctaggaatgccacttgtacacattacacgcagttggtttgggccaccagtagccagctgggctgtggacggcacttatgcagcgctggtcaagccgcaattgaggctttcgtgtgtgcttatagcccacggggaaactgggaggttaatggaaagacgatcgtgccttataagaaaggtgcctggtgctccctgtgcacagctagcgtatcgggatgttttaaggcctgggaccacgccggaggtctgtgtgaggtgcctcgcaatccatgtcggatgtcctgccagaaccacggacggttgaacatatccacctgtcattgccactgtccgccaggatacaccgggagatactgccaggtacgctgctccttgcaatgcgtacatggcagatttcgagaagaggagtgctcctgtgtgtgtgacattggatacggcgaaccatctgtgcctcctcgctgtatttttccgagtaccccagttacctag

SEQ ID NO: 11686 - DNA, 1356 bp, Artificial Sequence
  Description of Artificial Sequence: Synthetic coding sequence
atggaggcaaccggtactgatgaggtcgataaactgaaaactaagtttatctccgcctggaataatatgaagtacagctgggtgctgaagaccaagacctacttttcacgcaatagtcccgtcctgctcttaggaaagtgttaccacttcaagtatgaggatgaggataagacacttcccgctgagtctgggtgtaccattgaagatcacgttattgcaggcaacgttgaggaatttagaaaagacttcatctctcggatctggctcacctatcgggaggagtttcctcagatcgaggggtcagccctcactactgattgcgggtggggctgcacattacggaccggccagatgctgctggcacaggggcttatcctgcactttttgggcagagcttggacctggcctgatgctctgaatattgagaacagtgacagcgaatcttggacaagccataccgtaaagaagtttactgcaagttttgaggcgtcgttgtcaggcgagcgcgagttcaaaacccccacaatttccttgaaggagacaataggaaagtatagcgacgatcatgagatgcggaatgaagtttaccatagaaaaatcatctcctggtttggggatagtccgctagccttgtttggcctgcatcaattgatcgagtatgggaagaagagcggcaagaaggccggtgactggtatggtcctgcagtagtcgcccatatcctccggaaggccgtagaggaagccaggcatcctgacctccagggaataaccatctatgttgcccaagattgtaccgtctataacagcgacgtaattgacaagcagagtgccagtatgacatccgataacgccgacgataaggccgttatcatcctggttcccgtcagactcggcggtgaaaggacaaatacagactatctggaatttgtaaaaggcatattatccctggaatactgcgtggggattattgggggaaaaccaaagcagtcatactactttgccggatttcaggatgattctctaatctacatggaccctcattactgccagtcctttgtggatgtatctattaaagacttcccattggaaacatttcactgcccctctccaaagaaaatgagcttcaggaaaatggacccatcctgcactattggcttctactgtcgtaacgtgcaagactttaagcgggcatctgaagaaataactaagatgctgaagttttcttcaaaggagaagtatcctctgtttactttcgttaatgggcattcccgggactacgacttcaccagcactacaacaaatgaagaggacctgttctcggaagatgaaaaaaagcaaaagaaaaagaagaaatag

SEQ ID NO: 11687 - DNA, 1557 bp, Artificial Sequence
  Description of Artificial Sequence: Synthetic coding sequence
atgcgtacatgggattaccggtggtccctggctcttgtcgctcagaccggcgtacactgctgcaacctcagctcacttcagcccttacccccacgctttaaaagattttcctgtcttagcctttcgtcaggatgggactatagcaactctgggaatatgaaaccgccactccttgtgtttatcgtgtgcctcctatggctgaaggactcccattgtgcgccaacttggaaagataaaaccgccatttcagagaatctgaagagcttcagtgaagtcggcgaaattgacgctgacgaagaggtaaagaaagctctaactggaatcaagcagatgaagattatgatggaaaggaaggaaaaggagcatacaaatttgatgtccacactaaagaagtgtcgtgaggaaaaacaggaggccctgaaactgcttaatgaagtgcaggagcatctggaggaggaggagcggctctgtagggagtctctggccgactcctggggcgaatgcaggagttgtttggaaaacaactgtatgcgtatttatactacgtgccagccctcttggtcttcagttaagaacaagatcgaaaggttcttccgcaagatctatcagttcctgttcccttttcacgaagataatgagaaggatttgcccatcagcgagaaactgatcgaggaagatgcccagctaacccagatggaggacgtgttctctcagcttaccgtggatgttaattcactgttcaatcgctcctttaacgtgtttagacaaatgcagcaggagttcgaccagacttttcagagccatttcattagcgacactgacctgaccgagccttatttttttcccgctttctctaaagagccaatgacaaaggcggacctcgagcagtgctgggacatccccaacttttttcaactattctgcaatttttccgtgtccatatacgaatctgtctcggagacaattaccaagatgctcaaagccatagaggacttaccaaaacaggacaaagccccagaccacggcggattgatctcaaagatgctgcccggtcaggatcgaggcctgtgtggggaacttgaccaaaacttgagtagatgttttaagttccatgagaagtgtcagaaatgtcaggcccatctttctgaagattgtcccgacgtgcctgctcttcacacagagttggacgaggccatcaggctggttaacgtgtctaatcaacagtacggtcagatattacagatgaccagaaagcacctagaagacacggcttatctggtggaaaagatgcggggtcaattcgggtgggtcagcgaattggccaatcaggctcctgagactgagattatatttaactctattcaggtggttcctcgtatccatgaaggcaacatttcaaaacaggacgagacaatgatgacggatctttcgatcctgccctcatccaactttacactgaagatacccctggaggagagtgcagagtccagcaactttatcggatatgtggttgccaaggctctccagcacttcaaagagcatttcaagacctggtag

SEQ ID NO: 11688 - DNA, 1716 bp, Artificial Sequence
  Description of Artificial Sequence: Synthetic coding sequence
gtcgagatgcggaagtggtcaagcgagccaggtccagaacccgatactgtcgaagcagtgattgaatacatgtacacaggaagaatacgggtaagcacgggatcagtgcacgaggttctggagctggccgaccgttttttactgatacggctcaaagagttctgtggcgagttcctgaagaaaaaactgcacttgagcaactgcgttgccatacatagcctggcccacatgtacaccctctctcaactagccttgaaagctgcggatatgattagaaggaacttccataaagtgatccaggacgaggagttttatacccttccttttcatttgattcgcgactggcttagcgatctcgaaatcaccgtcgattcagaggaggtgctctttgagaccgtccttaagtgggtgcagagaaatgcagaagaacgggagcgatactttgaagagctgttcaaactgctgagactgtcccagatgaaaccgacatacctaaccaggcatgtgaagcctgagagacttgtggccaacaacgaggtgtgtgtgaagcttgtcgccgatgcagtcgagcggcacgcgctgcgtgctgaaaacattcagtctgggacttgccaacatcctacctcccacgtgagcttgctgccaaggtacggacagaatatggatgtgatcatggtgatcggcggtgtctccgaaggcggtgattacctttctgagtgcgttgggtactttgtggacgaggataggtgggtgaacctaccgcatattcacaaccacctggatggtcatgcagtggcggtgactgagtcatacgtgtatgtggccggatcaatggagccgggtttcgcgaagacagtcgagcgctacaatcccaatctcaacacctgggagcacgtctgtagccttatgacacgcaaacattcattcggcctcactgaagtgaagggcaaactatattcaatcggaggtcacggcaacttcagtccaggttttaaggacgtgacagtgtacaatcctgagttagataaatggcacaacctggaatcagccccaaaaattctccgggacgtaaaagcactagcaattgaggacaggttcgtgtacatcgccgctcgaactcccgtcgatagggataccgaggatggactgaaagctgtcataacctgctacgatactgaaacaagacaatggcaagacgtggaaagtctacctctgattgataactattgtttctttcagatgtcagtagtgaacagcaacttctatcagactgccagctgctgtcccaaatcatattgcctggagaatgaggaagccgtgcgtaagattgcttcgcaagtgtctgatgagatcttggaaagtctgccacccgaggttctttctatcgaaggcgcagcgatttgttattacaaagacgatgtgttcattatcggcggatggaagaactccgatgacatcgataaacagtatcggaaggaggcgtacagatactgcgcagaacgcaaacgctggatgttactgccgccaatgccccagccgcgttgcagagcaactgcctgccatgtccggattccataccggtatctacacggaacacagcgttatcccatgccccagaatctgatgtggcagaaagatcgcatccgccaaatgcaggagatccatagacatgctctgaacatgcgaagggttccgtctagccagatcgagtgctag

SEQ ID NO: 11689 - DNA, 729 bp, Artificial Sequence
  Description of Artificial Sequence: Synthetic coding sequence
atgctcaagaaaatatctgttggagtagcaggggatctcaacaccgtgactatgaagctcggatgtgtcctgatggcctgggccctgtacctttctttgggggtgttgtgggtggcacaaatgctcctagcggctgggtgccacgcagaactgttcccggcaccaatactgcgagccgtgcccagcgcagaaccgcaagctgggagcccaatgacgctcagttgccaaaccaagctgcctctgcaaagatcggccgcaaggctgctcttttctttctataaagacggcaggatagttcaatctagaggactgagttctgagttccagattccgactgcctccgaagatcactccggcagctactggtgcgaggccgcaactgaggacaaccaggtttggaaacagtctccacaacttgagatccgcgtgcaaggagcatcaagtagtgcagcacctccgacattaaatcctgcccctcaaaagagtgcagcacctggaactgctcctgaagaggcacccggacccttaccacccccacctacaccctcaagtgaggacccaggcttcagtagtcctctggggatgcccgatccccatctctatcatcaaatgggcctcctccttaaacatatgcaagacgtgagggtcctgctgggccatttgctaatggaattgagggaattgtctgggcatagaaagcctggtaccactaaagcaaccgctgaatag

SEQ ID NO: 11690 - DNA, 1392 bp, Artificial Sequence
  Description of Artificial Sequence: Synthetic coding sequence
atgtacgttagcaccagagagaggtacaaatggctgagattttccgaagactgcctgtatttaaacgtgtacgcacctgcaagggccccaggggatcctcagctccccgtgatggtgtggtttcccggtggagccttcatcgtaggtgccgcatccagctacgagggcagcgacctggcggctcgagagaaggtggtgctggtgtttctgcagcaccgactggggatctttggctttctcagcacagacgactcacatgctcggggtaattggggactgcttgatcagatggcggcacttagatgggtccaggaaaacattgccgcattcggcggagatcctgggaacgtgaccctgttcggacagtcggcgggtgcaatgagtatctcggggttgatgatgtcccccctggcctcagggcttttccacagggctatctcgcagagcggcaccgcgctgttcagactttttatcactagcaaccccctgaaggtcgctaaaaaagtggctcatctggctggctgcaaccataattctactcagattctagtcaattgcctgcgggcactgagtggtacaaaagtgatgcgggtgtccaacaaaatgagatttctccaattgaacttccagcgagatcctgaggagataatttggtcgatgtcgcctgtggtcgatggcgttgtcatccccgacgacccactcgtgcttctgactcagggtaaagtgtcctccgtaccatacctattaggggtgaacaacctcgagttcaactggctgttgccctatataatgaaatttcccttgaaccgccaggccatgagaaaggaaactatcaccaaaatgctgtggtctacacgcacactgctcaacatcactaaagagcaggtgcccctggtagtcgaagagtatctggataatgtgaacgagcacgattggaaaatgctccgcaaccgcatgatggacatcgtgcaggatgctaccttcgtctacgctaccttacaaacagctcactaccatcgggacgccggactgccagtctatctgtatgaatttgagcaccatgcccgaggcattattgtcaagcccagaactgacggtgccgaccatggtgatgaaatgtactttctttttggagggccttttgcgacaggtttgagtatggggaaagagaaagctctgagcctgcaaatgatgaaatactgggcaaattttgccaggacagggaacccgaatgacggaaatctaccatgttggccaagatataataaagatgagaagtatctgcaacttgacttcaccacacgggtgggcatgaagctcaaggaaaaaaagatggccttctggatgtcactatatcagtcccagcggccagagaaacagcgtcagttttag

SEQ ID NO: 11691 - DNA, 1215 bp, Artificial Sequence
  Description of Artificial Sequence: Synthetic coding sequence
atgttctaccacgcttacgatagctaccttgagaatgccttcccttttgatgaactgcgcccactgacgtgcgatgggcatgacacatggggaagcttctcactcaccctaattgatgccttagacactctcctgattcttggtaatgtgagcgaattccaacgggtcgtagaggtgctccaagacagtgtggactttgacatagatgtcaatgcctccgtatttgaaactaacatccgtgttgtggggggactgttgagcgcacacctcctgtcgaaaaaggcaggagttgaggtggaagctggatggccttgcagcggtcctctgcttagaatggctgaggaagccgctcggaaactactgcctgccttccagactcctaccgggatgccttacggaacagttaatctcctacacggagtgaatccaggcgaaactcccgtgacatgcacagctggtatcggcacctttattgtcgaatttgctacactctcgagtctgacaggcgacccagtgtttgaagatgtagcccgagtggcactaatgagactctgggaaagcagaagcgatatcggacttgttggaaaccacatagacgttctcaccgggaaatgggttgcccaggacgctggaatcggggctggggtggatagctacttcgaatacctggtaaaaggcgctatactattgcaggacaagaaattaatggccatgtttctcgaatataataaagctatcaggaactataccaggttcgatgactggtacctttgggtccaaatgtataaggggaccgtctcaatgcctgtctttcagagtttggaggcttattggcctgggctacaatccctgatcggcgatatcgacaacgccatgcggaccttcctgaactactatacagtctggaagcaatttggtggccttcctgagttttataatattccccagggatacactgttgagaaacgcgagggttatccactgagaccagagcttatcgaatctgcaatgtacctctacagggccacgggggatcctacccttctggagctgggcagggatgcagtggagagtattgagaaaatctctaaggtggaatgcgggtttgccaccgtttcagtctgcatggcccctagaacaggaaagtctttgccactcttgttgaagagtttgttcaagggccgagctcttggggtgctcacctaccagcactag

SEQ ID NO: 11692 - DNA, 1281 bp, Artificial Sequence
  Description of Artificial Sequence: Synthetic coding sequence
atgggttggacagatacactggagagcgccgaggatatcttttggaaacaggcagacttcgggtacgccagggaacgacttgaagaaatgcacgtgctgtgccagccaaaggaaacaagtgacagctcccttgtgtgctcgagatatctgcagtactgtagagccaccaacctgtacttggatctaagaaatatcaaaagaaatcatgacaggttcaaggaagacttttttcagtccggagaaattggcggacactgtaaactggacattaggaccctgacctctgagggccaacgtaagagccctctccaatcatggtttgctgagctgcagagctacacccagttaaatttccggcctattgaagacgccaaatgcgatatcgtcatcgagaagccgacttactttatgaaactggatgctggcgtgaatatgtatcatcacttctgcgatttcattaacctctacataacacagcacgtaaataattccttctcaacggacgtgtacattgtgatgtgggacaccagttcctacggatatggcgacctattctccgacacttggaatgccttcacggactacgacgttatacacctcaaaacatacgattcaaagagggtctgttttaaggaagccgtcttctcattgctgcctcgaatgcgctacggcctgttctacaatactcctctgatctctgggtgccagaacacaggactgtttcgggcattcgcacagcacgtcttgcataggctaaatattacacaggagggacccaaggatggcaagatacgcgtgaccattctggcgagatcgactgagtacagaaaaattcttaatcaaaacgagctggtgaatgccttaaagacagtgtctacgtttgaggtgcagatagtcgactacaaataccgggagctgggctttctcgatcagctcaggatcacacataataccgacatcttcatcggcatgcacggtgccggactgactcacctgctatttctccctgattgggcagctgtcttcgaattgtataactgcgaggacgagagatgctacttggatcttgctcggctgcgtggcgtccattacataacatggagaagacagaacaaggtgtttccccaagataaagggcaccatcctactttgggcgaacaccctaagttcaccaactatagtttcgacgtggaagagtttatgtacttggtgctgcaagctgcggaccacgtgctgcagcatcccaagtggccgtttaaaaaaaagcatgatgagctctag

SEQ ID NO: 11693 - DNA, 1098 bp, Artificial Sequence
  Description of Artificial Sequence: Synthetic coding sequence
atgaagttgggctgcgtcctgatggcgtgggctctgtatctctcactgggcgtgttatgggtggctcagatgcttctggtggcctccagcttctctgcagcctctttcgagaccctgcagtgtgagggacccgtctgcacagaggagtcaagctgccacaccgaggatgatctcaccgatgcgagggaggctggattccaggtgaaggcttacactttctccgagccattccatctgatagtctcgtacgactggcttatacttcagggcccagcaaaacctgtatttgaaggggatcttctggtgctgcgctgtcaggcctggcaggactggcccctcacacaagtgactttctatcgcgatggctcagccctcggaccacctggtccaaatagagagttctcaattacagttgttcagaaagctgactcaggtcactaccactgttcgggcatctttcagagtcccggtcctggcattccagagacagctagtgtcgtagctataaccgtgcaggagctcttcccagcacccatccttagggcagtacccagtgctgagccgcaggccggttccccaatgacactctcctgccagactaaattaccactccagagaagcgcggcaagactgctgttttccttttataaagatggtcgcatcgttcagagtcgagggctgagcagcgagtttcaaatacctacagcgagtgaggaccactcagggtcctattggtgcgaggccgcaactgaagataatcaggtctggaaacagtcacctcagctggagattcgcgttcagggggcttcatctagcgcggcaccacccactctgaatcctgccccacagaaaagcgccgctcctgggactgcccctgaggaggccccagggccactcccaccaccacccacgcctagtagcgaggaccccggattctccagtccactgggtatgcctgatccccacctgtatcatcagatggggctgctgcttaagcacatgcaagacgtgagagtgttgctcgggcaccttctcatggagctgagagagttgagcggccatcggaaacccggtaccacaaaggcaacagctgagtag

SEQ ID NO: 11694 - DNA, 1407 bp, Artificial Sequence
  Description of Artificial Sequence: Synthetic coding sequence
atgcggtggattctgtgttggtctctgacgttgtgccttatggcacagactgcgctcggagccttgcataccaagaggcctcaagtagtgaccaaatatggaaccctgcagggcaaacagatgcacgtcgggaagacccctatccaagtatttctgggcgtacctttctcacggccacccttaggaatactgagattcgcccctcccgaaccgcctgagccctggaagggtattagggatgcaaccacttacccgcctggatgtctccaggaaagctggggccagctggcctctatgtacgtcagtaccagagaacgttacaagtggttgaggttttctgaagactgtctttatctaaatgtgtatgcacccgctagagcacctggagaccctcagctcccagtgatggtatggttccctggaggcgctttcatcgttggggcagccagttcatatgaaggtagtgatttggccgcaagagaaaaggtcgtgctcgtgtttctgcaacaccggctaggaatctttggctttctctccacagacgatagccacgccagagggaactggggactgttggatcagatggcggctttacggtgggtccaggaaaacattgctgcattcggtggagaccccggaaacgtgactctattcggccaatccgctggcgctatgtcaatttcaggcctcatgatgtccccccttgcctcaggcctgttccatcgcgcaattagtcaaagtggcacggctctgttcaggctcttcatcacatctaaccccctgaaggtggccaaaaaagtcgcccacttagccggttgtaaccataactccacccagatactagtcaactgcttacgggctctctcaggcacaaaggttatgcgagtgagtaacaagatgcggtttctgcagctgaattttcagcgtgaccccgaagaaatcatttggagcatgtctcctgtcgtagacggagtggttattcccgacgacccccttgtattgctcacccaggggaaggtttcttcagtgccctatctgttaggcgtcaataacctggagtttaattggttgctgccatatattatgaagttccccttaaatcgacaggccatgaggaaggagacaataacaaagatgttgtggtccacgaggactctgctgaacattacgaaggagcaggttcccctggttgttgaggaatacttggacaacgtcaacgaacatgactggaagatgctgaggaatagaatgatggacattgtccaggatgctacttttgtatacgcgacccttcagacggctcattaccaccgggaaacaccgatgatgggaatctgccccgctggccacgctacaacacggatgaagagtacctgctcctggatcttaccccaggagtgggcttag

SEQ ID NO: 11695 - DNA, 756 bp, Artificial Sequence
  Description of Artificial Sequence: Synthetic coding sequence
atgtcgagttacggttacggagatctcttcagcgacacctggaacgcgtttactgactacgacgttattcacctgaagacgtatgacagtaaaagagtttgttttaaagaggccgttttctccttactcccaagaatgcgctacgggctgttctacaacacgccattgatctcaggctgccagaacaccggtctgtttcgcgctttcgcacaacatgtgctccatcggctcaacatcacccaggagggcccaaaagacggcaagattagggttacgattctggccaggtcaaccgagtaccggaaaatcctgaaccagaatgagcttgtaaatgcattaaagaccgtcagcaccttcgaggtccaaatcgtcgactacaaatacagggagctgggatttctggatcagctccgcatcactcataataccgacatattcattggtatgcatggcgcaggtctcacccatctgctcttcctgcccgattgggctgccgtgtttgaactgtataactgtgaagatgagcggtgctatctggacctggctcgattacggggagtccactatattacatggcggaggcagaataaggtattcccgcaggataaaggacaccatcctaccctgggagagcaccccaagttcactaactattccttcgatgtggaggagtttatgtatctcgtactccaggccgctgatcatgtgttgcagcacccaaaatggcccttcaaaaagaagcacgacgaactatag

SEQ ID NO: 11696 - DNA, 927 bp, Artificial Sequence
  Description of Artificial Sequence: Synthetic coding sequence
atgattccagtggaattactgctgtgttatttgctgctccaccccgtagacgcaacctcgtacgggaaacaaactaacgttctcatgcactttcctctctccctggaaagccagaccccgtcctcggacccactgagctgtcaatttttacatccaaaaagcctgcccggttttagtcacatggcccctctccccaagtttctcgtctctttggctctccgcaacgcgctagaagaggcgggatgccaggctgatgtgtgggcgttgcaactacaactctatagacagggcggagtgaatgctactcaggtactgattcagcatctcagaggcctgcagaaggggagatctacggagcgcaatgtctcggttgaggcactggcttctgccttgcagttgttggctagagaacaacaaagtactggaagagtgggcagaagtttaccgaccgaggactgcgaaaacgagaaggaacaggccgtgcacaacgtagtacaactcctgcccggagttggcactttctacaaccttgggaccgcactctactacgccacacagaattgcttgggaaaagccagggagaggggccgagacggagctattgacctcggatatgatctgcttatgaccatggccggaatgtccgggggtccgatgggactcgctatttcagcagcactcaagcccgcactaagatctggcgtgcaacagcttatccagtattatcaggaccagaaggatgcgaatataagccaacccgagaccacaaaagagggcctcagggctataagtgatgtaagcgacctggaagaaactaccaccctcgcaagctttatcagcgaggtggtgtcatctgcaccatactggggttgggctatcatcaaatcttatgacctggaccccggtgctggcagtctcgagatatag

SEQ ID NO: 11697 - DNA, 2862 bp, Artificial Sequence
  Description of Artificial Sequence: Synthetic coding sequence
atgcgagtactcgcctgcctgctagctgccctggtgggcatccaggcggtggagaggttgcgactggctgatggtccacacggctgcgctggtaggttggaggtatggcacggaggacggtggggaaccgtgtgtgatgacgggtgggacctgagagatgctgccgtggcctgccgccagcttggctgcggaggggctttggcagctcctggcggtgcgttcttcggcgagggtgccggtcccgtatggttgtctgagctagcttgccggggaaatgagggacagctcggcttatgccatcataggggatggaaggcacacatctgcagtcacgaggaggatgcgggagtcgtttgtgccggtcagcgcgtggccaactctcgagatgacagtacttctccacttgacggagccccatggcctggactcttgctcgagctgagccctagcacagaggaaccattagtcacccacgcacccagacccgctggcaatccgcaaaatgcctcacgaaaaaagagccccagaccaaagcaggcaaaaagtacaagggctcctctgttgaccacaggcgctcccagacaagagcgcctcaggcttgtatctggccctcaccggtgtgctggcaggctcgaagtctggcacgggggacggtgggggacagtatgcgacgatggatgggatctgagggatgctgccgtggcttgtcgggagttagggtgtggaggagcgctggctgctcccggtggcgcacgtttcggcccaggggctggtcctgtgtggatggatgatgtgggctgcgggggtggagagcaggccctgcgggattgtccaaggagcccctgggggcgatccaactgcgaccactccgaagatgccggtcttgtttgcacaggacccgcacctcgtctgaggctcgccgacggacctcatggatgtgcaggtcggctggaggtgtggcacgggggacggtggggtagcgtttgtgatgacgcttgggacctccgggatgccgctgttgcttgccgagaattgggctgtggcggtgctctggctgcaccgggaggtgcattttttggcgaaggctcagggcctatcattttggacgacctgcggtgccgtgggaatgagaccgcactgagattctgtcccgctaggccctggggacaacatgattgtcaccaccgcgaggacgctggcgcagtttgcgatgggatgccgctgggatatgtacctcctactgcaccgaccgactcgaacaactccacccccagagaagctgcgtctagacctccttcaactatgacttcccaagcccctggaaccgctggcgtctctcctcctccggcatctcctacagtgttgtgggagccgggacccgaagccggttcacctcagctccgcctagttgctgggcctagtaagtgtagcggccgtctcgaagtgtggcatgaccagcggtgggggacggtgtgcgacgattcctgggacatgcgggattcagcagtcgtgtgcagagaattgggatgcggtggccctcagcagcctgaccctgctgctggtaggtttggatggggcgcagggccaatctggttggatgatgttggatgtgtgggaactgaagctagtctgtccgattgcccagcagctccatggggcaagcacaattgcgcacacaatgaagacgtcggggtcacttgtactggtccccctggacttgactcaattagtgatcctttcagctggtcatggattccgggtctggggcgagacagggacgcctggcttccaggagagctggccaccaaaccaagcgcctccgtgactgcttccgtactggagaaaacgaccactaaggcccctggaaagatgcccaaaagcactaagaagtgggttaccaagaatgctaagcggcctaccactcagccccctgttatgcccaccaccaaacatagtcgtgctcagtctccgccagatctgacttcacaaacaacggctgccctaacgacagaagccagtcgacgaccaacgtccgagtttacgcgacgacccactacagaggctcctcagaggtggactagccacaccactgcgactttgacacctcaagctccaagagagaggacaactaaaacaatggccatgctgactactcagggccctcaggaaatgacaagtgagagtacgattaaatcaataccacaagcgtctctggagccaagcgctgaaattcctgaggggtcacccgaatcccctaaggaccctgccccatccccaagtgtgtccacgacaggggaatccggcctgttcagggttcggctggcagacggcccaaacaggtgcgccggacgactggaagtttggcatgccggacgctggggtactgtgtgcgacgacaactgggatctgagggacgccacagtcgcgtgctgggaactcgggtgtggcaaagttcggcctagggtaggtaaaacccactacgggccaggtacaggaccgatatggctggacgatatgggctgtaagggtagtgaggccagtctgagcgattgtccatctggcgcttgggggaagcacaactgcgatcacgaagaagacgtggggttaacctgtaccggctataccgattacgacgattatcccccatggacatgggaccccacctcccgagaagatttggccaagggaacaacgaccgctggtgtgcctggtcacacacttccttggcgaacgacccgcaggcctggatcttcgagcccggctatccgcaggctacccgacacagaaccagaggccggacttcgggaggtaatgttgctggtgcagggactgccagggctgcagcggctcccatctccatag

SEQ ID NO: 11698 - DNA, 474 bp, Artificial Sequence
  Description of Artificial Sequence: Synthetic coding sequence
atgcttaggacagagagctgtagaccaaggagcccggcaggtcaggtcgccgcagccagccccctcttgctgctgctattactcctcgcttggtgcgccggagcctgcaggggcgctcccatcttgcctcaaggccttcagcccgaacagcagcttcagctctggaacgagatcgatgatacctgcagttcattcctctcaattgattctcagccccaggcctcgaacgcactcgaggagctctgtttcatgatcatgggcatgctgccaaagccgcaggaacaggacgaaaaagacaataccaagaggagtagcgtcgtccatcccctcctccagctagtaccccacttgcacgagagacggatgaagcgcttcagggtagacgaggagtttcagtctccctttgctagccaaagccgaggctactttctctttcgccctcgcaacggacggaggtcagccggtttcatttag

SEQ ID NO: 11699 - DNA, 1545 bp, Artificial Sequence
  Description of Artificial Sequence: Synthetic coding sequence
atgccatctacagtactcccttccacagttctgccgagtctgcttcccactgcaggagcgggatggtcaatgcgctggattctgtgttggtctctgaccctttgtcttatggcccagactgccctcggcgcattgcataccaagaggccccaggtggtcactaagtacggaaccttgcagggcaagcagatgcacgtgggaaagacacctatccaggtattcttgggtgtcccattcagtagaccacctctgggcatcctgagattcgccccacctgagccgccagagccctggaaaggtatccgagatgcaacaacctacccaccaggctgcctccaggagtcctggggacaactggcttccatgtacgttagcacaagagagaggtataagtggcttcgcttttctgaagattgcctgtatttgaatgtgtatgcacctgctagagccccaggagatccgcagctccccgtaatggtgtggtttcccggtggggctttcattgtgggcgctgctagcagttatgaaggaagcgatctcgctgcccgtgaaaaagtggtgttagtgtttttgcagcatcgtctgggaatttttggttttctgagtactgacgactcccatgcacggggtaactggggtttacttgatcagatggccgctctaagatgggtccaggagaacattgcggcatttggaggggatccaggaaacgtgacactcttcggacaatcagctggtgccatgtccattagtggcctgatgatgtcacctttggcatctggactatttcaccgagcaatttcccagagcgggaccgctctcttccgcttgtttataacttcgaacccgctcaaagtagccaaaaaagtcgcacatcttgctgggtgtaaccacaattctacgcagattctggtgaactgcctgcgtgctctgagcgggactaaggtgatgagagtctctaacaaaatgagattcttacagttaaacttccagcgagaccctgaggagattatatggtccatgagtccagtggtcgacggggtggttattcctgatgatccacttgtattactgacgcagggcaaagtatcctccgtgccttatttgctgggcgtgaataacctggagtttaattggttactcccttacaacataacaaaagagcaagtgcctttggtggtggaggaatacctggacaacgtcaatgaacacgattggaagatgctgcgtaaccggatgatggacatcgtgcaggatgctacattcgtttatgcgacactgcagaccgcacactaccaccggggtctgtcaatgggtaaagagaaggctttaagcctgcagatgatgaagtactgggccaattttgccaggaccggcaatcctaatgacgggaacctcccgtgctggcccagatacaacaaagacgagaaatatctccaacttgatttcacaacccgcgtcgggatgaagctcaaagagaagaagatggcgttctggatgagcctgtatcagtctcagaggccagagaagcaacgacagttctag

SEQ ID NO: 11700 - DNA, 1062 bp, Artificial Sequence
  Description of Artificial Sequence: Synthetic coding sequence
atgagcaaccctacgcagacagatgccgattccgacctggttggagatgtgtgtgacacaaatgaggattctgacggcgatggccatcaggataccaaggataattgcccccaacttcccaatagcagccagcttgattcagacaatgatggcctgggcgatgaatgcgatggcgatgacgataacgacggaatccccgactacgtaccaccgggtcctgacaattgccgcctggttcccaacccaaatcagaaagactctgacggaaacggggtcggcgacgtgtgtgaggacgatttcgacaatgatgccgtggtcgatccactcgatgtgtgtcccgagagtgctgaggtgactcttactgacttccgcgcttaccaaacagtggtgttggaccccgagggtgatgcgcagattgatcccaactgggtagtacttaatcaaggtatggagatcgtgcagaccatgaacagcgatcccggattggccgtgggttatactgcttttaatggggtggatttcgaaggaaccttccacgtaaatacagtcacagacgacgattacgccggtttcctttttagctatcaagacagtgggaggttctacgtagtgatgtggaaacaaacggaacagacttactggcaagccacccctttcagggccgtcgcacaacccggtttgcaactgaaggctgtgacctccgtgtcgggaccaggggagcacctgcgcaatgctctttggcataccggccacactcccgaccaagtgaggctgctttggacagatccaaggaacgtcggctggagggataaaactagttataggtggcaactcctccaccgacctcaagttgggtatatccgggtgaaactctatgaaggtcctcaactggtcgcggactctggagtgatcatcgacacgtcgatgagaggcggtcgcctcggtgttttttgcttctcccaggagaacataatatggagcaatctgcagtatcggtgcaacgacacagtaccagaggactttgagccatttcgcagacagctcttgcagggcagagtgtag

SEQ ID NO: 11701 - DNA, 1074 bp, Artificial Sequence
  Description of Artificial Sequence: Synthetic coding sequence
atggaaatcgagcataccctggaccaaatgattagcaaggtgggaaaccatatcgacgtgctgaccgggaagtgggtggcccaggacgccggaattggggctggcgtggacagttattttgagtacttggttaagggggcaatcttgcttcaggataagaagttgatggcgatgtttctggagtataacaaggctattcgcaactacacaagattcgacgattggtacctgtgggtgcagatgtacaaaggcaccgtttctatgcccgtgttccagtccttagaagcttactggcctgggcttcagagtctcatcggagatatcgataacgcaatgaggacctttctgaattactacaccgtttggaaacagttcggaggtctgccagaattttataacatcccgcagggttacaccgtggaaaagcgggagggctaccccctgcggccagagttgattgaatcagctatgtacttgtacagggcaacaggagacccaaccctgctggagctggggcgtgacgcggtagagtcgatcgagaaaatttccaaggttgaatgtggcttcgcgacgattaaagacctccgtgaccacaagttagacaatcgcatggagtctttcttcctagcggagactgtgaagtatctgtacctgctgttcgaccctacaaatttcatccataataatggcagcacgttcgacgcggttatcacaccatatggcgagtgcattctgggcgctggcggatatatctttaacacagaggctcaccccattgatccggcagcacttcactgctgccagcggttgaaggaggagcaatgggaagtggaagatctgatgcgagagttctattcccttaagaggagtcgatccaaatttcaaaagaatactgtttcttccggtccctgggagcctccagcccgacccggaaccctcttctcccctgaaaatcatgaccaggcccgagaaaggaagcccgctaagcagaaagttcccctgctctcctgtccttctcagccattcacaagcaagctggcgctcctggggcaggtattcctggacagtagctag

SEQ ID NO: 11702 - DNA, 1341 bp, Artificial Sequence
  Description of Artificial Sequence: Synthetic coding sequence
atgctccatcctgagacatcacctggcaggggtcatctcctggcggtgctcctggccctgctcggaacagcctgggccgaggtgtggcctcctcagctccaggaacaggcacccatggctggcgctctgaataggaaggagtccttcttgctgctgtctctgcataacaggttgcgctcttgggtccagcctcccgctgctgacatgcggcgattggattggtcggactcattagcccagcttgcccaagccagggccgcactgtgtggcattccaaccccctccctggcgagcggattatggcgcactttacaggtcgggtggaatatgcaactcttacccgctggactggcctcgtttgtggaggtggtgtcactttggttcgcggaagggcagaggtatagccacgcagcaggggagtgcgcaagaaatgcgacgtgtactcactacactcagttggtctgggctacttcaagccagctgggatgcggtcgccacctctgctcagcagggcaagctgcaattgaggccttcgtgtgtgcatacagccctcgaggaaattgggaagtaaatggcaagaccatcgtaccctataagaagggcgcttggtgcagcctgtgtaccgcttcagtgtctgggtgctttaaggcatgggatcatgcagggggactgtgcgaggtaccaagaaatccgtgcaggatgtcatgccagaaccacgggaggttgaacatctccacctgtcactgccattgccctcccggttatacagggagatattgtcaggtgagatgctctttacagtgcgttcatggtagattcagagaggaagagtgcagttgtgtgtgtgatatcggctacgggggtgcccagtgcgccaccaaagttcactttcctttccatacgtgcgacctgaggattgacggagattgtttcatggtcagttccgaggccgacacttactatagagctagaatgaagtgtcagaggaaaggaggcgtgctagcacagattaagagccaaaaagtacaagacatactggcattttatctggggagactggagacgactaacgaggtgatagactcggatttcgaaactagaaacttttggattgggctgacctacaaaacagccaaggacagcttccgctgggcgactggtgagcaccaggcctttaccagcttcgcattcggacagcctgacaatcatggctttggaaactgcgtggaactccaggcttcggccgctttcaattggaataaccagagatgcaaaaccagaaatagatatatatgtcagtttgcgcaagaacatataagccggtggggccctggaagctag

SEQ ID NO: 11703 - DNA, 900 bp, Artificial Sequence
  Description of Artificial Sequence: Synthetic coding sequence
atgggcggtccccgagcccttttagcagccttgtgggccctggaggctgccggaaccgccgctcttcggatcggggcattcaacatccagtccttcggagactccaaagtttcagaccccgcatgcgggtcaataatagccaagattctggcaggctacgatctggctctggtccaggaggttagggatcccgacctgtctgccgtcagtgccttgatggaacagatcaactcggtgagcgaacatgagtacagcttcgtctctagccagcccctgggacgagatcagtataaggagatgtacctgtttgtttatcgcaaggacgcggtgagcgtggttgatacttacctctaccccgaccccgaggacgtgttcagtcgcgaacccttcgtggtaaagttcagcgcccctggaacaggcgaacgggcacctccgctccccagccgacgcgctcttaccccccctcctcttcccgcagccgcacagaatctcgtgctgatccctctgcacgccgctcctcatcaggcagtggccgagattgatgcgctctacgatgtgtacctcgatgtgattgataaatggggcacagatgatatgctcttcctgggcgattttaatgcggattgttcctacgttagagcccaggactgggccgctatcaggctgaggtcttctgaggtcttcaagtggctgattcctgattctgcagacacaaccgttggaaacagtgattgcgcatatgacagaatcgtcgcctgcggcgctcggctcaggcgttctctgaaaccacagtccgccaccgtgcacgactttcaggaggaattcggcttagaccagactcaggcattggccatctcagatcactttcctgtggaagtcaccctgaagtttcatagatag

SEQ ID NO: 11704 - DNA, 1458 bp, Artificial Sequence
  Description of Artificial Sequence: Synthetic coding sequence
atggataacaataagcactgtaagcaggacaactgcctgttgactccaaattcagggcaggaggacgccgataatgacggcgttggtgatcagtgcgacgatgacgcggatggcgatggcatcaagaacgtggaggataattgcagactctttccaaataaggaccagcagaatagcgatacagacagttttggggacgcctgtgataattgccctaacgtcccaaataatgatcagaaggataccgacggcaatggggagggagacgcctgtgataacgacgtggatggcgatggcatccccaatggacttgacaactgccccaaggtgcccaatccattacagacagacagggacgaagatggcgtgggagatgcatgtgatagttgtcccgagatgtcaaacccaacccaaaccgacgccgattcggacttggttggtgatgtctgcgataccaacgaggacagtgatggagatggtcaccaggatacaaaggacaattgtcctcaactgcctaactctagccagctcgactccgataacgacggacttggggatgaatgtgacggtgacgatgataatgacgggatcccagactacgtcccccctggaccggacaattgccgtttagttcctaaccccaatcagaaggattccgatgggaatggggtgggcgatgtttgcgaggatgacttcgataacgatgctgtggtggaccccctcgacgtctgtccagaaagcgccgaggtgacactgaccgatttcagggcttaccagacagtcgtgctagacccagaaggtgacgcgcagattgacccaaattgggtggtcctgaaccagggtatggagatcgtacaaacgatgaatagcgatccaggactcgctgtcggctacaccgcatttaacggcgttgatttcgagggcacctttcacgtcaacactgtcactgacgatgactacgctggttttctgttctcatatcaagactccggcagattctacgtggtgatgtggaagcaaaccgagcaaacttactggcaggctactccattccgtgccgtggcccagccagggcttcagctgaaggccgtcaccagcgtctctggcccaggtgagcatcttcgcaatgcgctgtggcacacgggccacacccccgatcaggtgagactcctgtggactgatccgaggaatgtgggatggcgcgacaaaacctcgtacagatggcaactcctgcaccgaccccaggttgggtatatccgggtaaagttgtacgaaggccctcaattggtggcagactccggtgtgatcatcgataccagcatgcgcggtggaaggctgggggtattttgtttctcccaggagaacatcatttggagcaacttacagtatcgttgtaacgacaccgtgccagaggacttcgagccctttcgccgacaactgctccagggccgagtgtag

SEQ ID NO: 11705 - DNA, 2358 bp, Artificial Sequence
  Description of Artificial Sequence: Synthetic coding sequence
atgaaacacaccctggctcttctggcacctctgttgggcctggggctaggacttgccctctctcagttggctgctggcgctacggactgcaaatttctagggcctgctgaacacttaacttttacacctgccgcaagagccagatggcttgcacctagagttcgggcacccggtctgctcgactccctgtatggtactgtccggaggtttctaagcgtcgtgcagctgaatcctttcccgtcagaactggtgaaagctctgctaaatgagctggccagtgtgaaggtgaatgaagtcgtccgctatgaggccggttacgtggtgtgcgccgtgatcgctggactgtacctattattagtgccgacagcaggtttatgcttctgttgttgccgttgtcaccggcgttgtgggggtcgagttaagacagagcataaagctctggcgtgtgagcgcgcagcgcttatggttttccttctgctaactaccctgctgttgcttataggcgtagtgtgcgcttttgtcactaatcagagaacccacgagcaaatgggccctagtatcgaagcaatgcctgaaactctgttatccctgtggggcctcgtatcagatgttccccaggaacttcaggctgtagctcagcaattttccttgccccaagaacaggttagcgaagagctagatggggtgggcgtctccataggctccgctattcacacccagcttcggtcctccgtctacccactgctggccgcagtaggtagccttggacaagttctccaggtgagcgttcatcacttacagacactcaatgctaccgtggtagagctgcaggcagggcaacaggaccttgaaccagcgattagagagcaccgggaccgtcttttggaacttctgcaggaggctagatgtcagggcgattgtgcaggagctctatcttgggccagaaccctggaattgggagccgacttttctcaagtaccttccgttgaccacgtgttacaccagttaaagggggtgcccgaggctaacttctccagcatggtgcaggaggagaactccacttttaatgcgctacctgctcttgcggcaatgcagacaagcagtgtggtgcaggaactgaagaaggccgtggctcagcagcctgagggcgtcagaaccctcgccgagggctttcctggacttgaagctgcaagtcgctgggcccaggccttgcaagaggtggaagaaagtagccgcccatatcttcaagaagttcagaggtatgagacttaccgatggatcgtcgggtgcgtcctgtgcagcgttgtcctttttgtggtactctgcaacctcctggggctgaacttgggtatctggggattgagtgccagagacgatcccagccaccctgaggccaagggcgaggctggggctcgatttctcatggccggagttgggctgtcatttctgttcgctgcgccacttattcttcttgtatttgccacgtttctcgttggtgggaatgtgcagaccctcgtatgtcagagctgggagaacggcgagctgtttgaatttgctgatacacctggcaatttacctccctccatgaatttaagccagctgctggggttacgcaagaatatatcgattcaccaggcctatcagcagtgcaaggaaggcgctgccttatggacagttttgcagctgaatgactcatacgatttagaagagcatctggatattaatcagatacaacggccagttgtaaagacttcaatggaacagctggcacaggaactccagggtcttgctcaggctcaggacaactcggtactgggacagaggctccaggaagaagctcagggcctgagaaacttgcatcaagagaaggtagtcccacagcagagcctcgttgcaaagctcaacttgtccgtaagagcactcgagagtagcgctcctaatctgcagctagaaacgagcgacgtgctggcaaatgtgacatatctgaagggcgagttacctgcctgggcggcaaggatcctcagaaacgtttcagagtgctttctggctcgcgaaatggggtactttagtcagtacgtggcctgggtgagggaagaggtaacacagcggatcgcaacctgtcagcctctgagcggcgctctggataattccagagttatcttatgcgatatgatggcagatccttggaacgcattttggttttgtctggcttggtgcactttttttctgatcccatccataattttcgcggtcaagaccagcaaatattttcgccctatccgcaaacggttaagctccactagctccgaagaaacacaactttttcacatccctagggtgacttctctcaaactctag

SEQ ID NO: 11706 - DNA, 792 bp, Artificial Sequence
  Description of Artificial Sequence: Synthetic coding sequence
atggggcgagtcctggaagaagccagattcgctgtggccttcacagagtcaatgaaagaaatggcacaggcacagtggaaggccaggcagattagcctcgctgttacctctgctgtgcccgtgcagcctcatgccaaaggcaaggtgtatgtgcagagtcaaggaattgcaactaccccgaacgccgcttttaactggaacaccttcctgcagagatctgagatcaaccaatccgccgacaatctgcatatcttcctcttgatctgtggtctcagacaggtgaaagatcctctgtatctggtggacgctttctccgcatggcatcaagaggaaccaaatgtgcacctcgttatagtgggtcccgaagtggatcctgtcttcaccagggaggttaaggccaaggtaaagcgagccgctggggtgcgcttgatcggcgaaatgccacaggaagatcttcatgctgtagttaaaaactgcttcgcagtagtgaacagctcggtcagtgagggtatgagcgcagccattctggaggcaatggatttagaggtgccagtgctcgccaggaacattcctggcaacgccgcagtggtgaagcacgaagtgacgggtctactgttcagcaaccctcaggagtttgtccacctggccaaacggctggtgtcagacccggctcttgagaaggaaattgttgtcaatggacgtgagtatgtcagaatgtaccatagctggcaagtcgaacgagatacgtaccaacagctcattaggaaattggagggatcaaccgaggattag

SEQ ID NO: 11707 - DNA, 456 bp, Artificial Sequence
  Description of Artificial Sequence: Synthetic coding sequence
atgaagactgccgtgatgaaggagctgtattccttcctgcaccaccagaataggtatggatccgaacaggaatttgtggacgacctgaagaacatgtggtttggtttgtactcccgtgggaacgaggagggagacagctcagggtttgaacacgtattcagtggcgaagtcaaaaagggcaaggtgacaggctttcacaactggatcagattctatctggaggaaaaggaggggttagtggattactacagtcatatttatgatggacccgtaccagtgaaacctgggagaatctcactaagctgccctgatatttatctaggtcaggtgcacctttgggagtggcaagaagtccaccgacacagtctgcacagcgtctttcacctgatcgagctgcgcgcacggaaaggacacgaggggagctgcgaaaccgaagtgctgtcatccctcgactag

SEQ ID NO: 11708 - DNA, 363 bp, Artificial Sequence
  Description of Artificial Sequence: Synthetic coding sequence
atgttgccacagtggctgttgctcctgttccttctgttttttttcttatttctgctgacccgtggttccctgagccctactaagtacaatttactggagctcaaagaatcctgcattagaaatcaggactgtgagaccggatgttgccagagggcccctgacaactgtgagtcacattgcgcagagaaggggtccgaggggagtctatgccaaactcaggttttcttcggacagtaccgggcatgtccgtgtctgagaaatctgacttgtatttactcaaagaatgagaagtggctcagtattgcatacggcagatgtcagaagattggaaggcagaaactggctaagaagatgtttttttag

SEQ ID NO: 11709 - DNA, 951 bp, Artificial Sequence
  Description of Artificial Sequence: Synthetic coding sequence
atggctgaggctgctctggaggccgtgcgctccgaactacgcgaatttccggcagccgctcgcgaactgtgcgtccctctcgctgtcccttatctggacaaaccaccaacaccgttgcatttctatcgggattgggtttgccctaacaggccttgtattattcgaaacgccctacaacactggccggcactgcagaagtggtccctgccttacttcagagcgaccgtgggctctacagaggtctcagtagccgtcaccccagacggctacgcggacgcagttcgtggggataggttcatgatgccagcagaacgacgtctgcccctgagtttcgttctagacgtccttgaaggacgggctcagcacccaggagtcctgtacgtgcagaaacagtgttcaaacctgcctagcgaacttccgcagctgcttcctgacctggagtcccatgtgccatgggcctcagaggctctgggaaaaatgcctgatgcggttaacttctggcttggagaagctgccgctgtgacgtctctgcacaaagaccattatgagaacctgtactgcgtcgtctccggcgagaaacatttcctgttccatccaccctctgatcgacccttcattccctatgaactctatacaccagcgacttaccagctcacagaagaggggactttcaaagtcgtggacgaagaagccatggagaaggttccatggattcctctggatcctttagccccagatctggcccgttatcccagctatagtcaggcccaggcgttgcgttgcacggttcgggcaggcgagatgttgtacctgcccgctctgtggttccaccatgtccagcagtcacaggggtgcatcgccgtgaatttctggtacgatatggagtatgatctgaaatatagctactttcaactattggactcgctcaccaaagcaagtggactcgactag

SEQ ID NO: 11710 - DNA, 657 bp, Artificial Sequence
  Description of Artificial Sequence: Synthetic coding sequence
atggggagggtctttctaacgggagagaaggccaattcgatactgaagcgatacccacgagctaacggcttctttgaagaaatccgccagggtaatattgaacgcgagtgcaaagaagaattctgtacatttgaagaggccagagaagcatttgagaataacgagaaaactaaggaattttggtctacatacaccaaagcacaacagggtgagagtaatagaggttctgattggttccagttctacttaaccttccctttaatatttggcttatttattattctcctggttatctttttgatatggcggtgtttccttcggaataaaaccaggcggcaaacggtcactgaaggccatatacctttccctcaacatctgaatatcataacccctccaccacctccagacgaggtctttgatagttccggactctctcccggattcctgggctacgtcgtggggcgaagcgacagcgtcagtacacgcctctccaactgtgatcccccaccaacttatgaggaagccacaggacaggtcaacctgcagcgatctgagactgagcctcacttggatcctccacctgagtacgaggatatcgtgaattctaatagcgcgagtgccattcctatggtgccagttgtaaccaccatcaagtag

SEQ ID NO: 11711 - DNA, 909 bp, Artificial Sequence
  Description of Artificial Sequence: Synthetic coding sequence
atggctatgttcctggagtacaataaggctataagaaattatacccggttcgacgactggtacctctgggtacagatgtataaaggaactgtaagcatgcctgtgttccaatcgctcgaagcctactggcctggcttgcaatcccttataggggacatagacaatgccatgcggacttttctgaattattatactgtttggaagcagttcggaggtctgcctgagttttacaacattccacaggggtatacagtggaaaaacgcgagggctaccctctccgacccgaactgatcgaatctgccatgtatctctaccgggcaacaggggacccaactctgcttgagctgggacgggacgccgttgagagcatcgaaaaaatatctaaagtggagtgtggttttgctacgattaaggacctgagagatcataaactagacaacaggatggagagcttttttctcgcggaaacagtaaaatatctgtatctcctattcgaccctaccaacttcatccacaataatggaagcacgttcgatgcagtgatcaccccatacggggaatgcatcttgggagcaggcggatacatttttaacacagaggcccaccccattgatcccgctgcccttcattgctgccagaggctgaaggaggaacagtgggaagtggaagacctgatgcgggagttttacagcttaaaaagaagccggtctaaatttcagaagaatactgtcagtagtggcccatgggagcccccagcacggccaggaacactcttctctccagagaaccacgatcaggcaagggagaggaagcctgcgaagcaaaaggtgcccctcctgtcttgccctagccagcctttcaccagcaagctcgctttgctgggtcaggtttttctggactcgagctag

SEQ ID NO: 11712 - DNA, 459 bp, Artificial Sequence
  Description of Artificial Sequence: Synthetic coding sequence
atgctcgtggatgggccttccgagcggcctgctttatgctttcttcttttagcagtcgcaatgtccttctttggctctgccctttccattgacgagacccgggcacatctcctcctgaaagagaagatgatgcgcttgggcggtcggttggtgctgaacacaaaggaggagctggcgaacgaacgtctgatgaccctcaaaatcgctgaaatgaaagaagcgatgcgtacccttatcttccccccatctatgcatttcttccaggcgaaacatctgatcgaacggagtcaagtcttcaacattctgcggatgatgccaaagggggcagccttgcacttacatgatatcggcatcgtgacgatggactggttggttcgcaacgttacttatcgtccccattgtcatatctgctttactccgaggggcattatgcagtttcgcttcgcccatcccacctag

SEQ ID NO: 11713 - DNA, 3951 bp, Artificial Sequence
  Description of Artificial Sequence: Synthetic coding sequence
atggaacccaggttattctgttggacgacgctgttcctgcttgcaggatggtgcctgcctggcctgccctgcccttccaggtgcttatgctttaaatctactgttcgatgcatgcacttgatgcttgaccacattccccaggtgccacagcaaacaacagtgttggatctgcgtttcaatagaatccgggaaatcccaggctccgctttcaaaaagcttaagaatcttaataccctcctgttgaacaacaatcatatacgaaagattagtcgaaatgcgttcgaagggttggagaatttactgtacctgtacctgtataaaaacgaaatacacgccctggataagcagacctttaaggggctgatatccttggagcacctgtacatccattttaaccagctcgagatgctgcagcctgagaccttcggggacctgttgcgtttagagaggctgtttctgcacaataataagttatctaagatccctgcagggagtttctcaaatcttgactcactcaagcggctgagacttgatagcaatgccctcgtctgcgactgtgatttgatgtggctcggtgaactgctgcaagggtttgcccaacatggacatacccaagccgcagccacctgtgaatacccacggcgattgcatggcagagcagttgcgtccgtcactgtggaggaatttaactgccaatcccccagaattaccttcgagcctcaagacgtggaggtgccgtctggaaacactgtctattttacctgccgcgctgagggtaatcccaagccagagatcatatggatacataataaccattcattggatctggaggacgatacccgcttgaatgttttcgatgatggcacactcatgatccgcaatacacgcgaaagcgatcagggtgtgtatcagtgcatggcacgcaattccgcaggcgaggccaaaacgcaaagcgctatgctgcgctattcatctcttcccgcaaaacctagctttgtgatccagcctcaagacaccgaagttctgattggcactagcacaacactggagtgcatggctaccgggcacccacatccgttaataacctggacccgggataacgggttggagctcgatggctcacggcacgtggctacctcctccggactttatctacaaaatatcacccagcgggaccatgggaggtttacttgtcatgccaacaacagccatgggacagtccaggcagctgccaacattatagtgcaggcaccaccccagtttaccgtcactccaaaggaccaggttgtgttggaagaacatgctgttgagtggctgtgtgaggcagacggcaatcccccacctgtaatcgtctggactaagactggtggtcaattgccagtagagggacagcacacagtgttgtcctccggcaccctccgtatcgatcgcgcagctcaacacgatcaggggcaatatgagtgccaagctgtctcaagtctgggggtgaagaaagtgtctgtgcaattaacagtgaagcccaaggcccttgccgtgttcacccagttaccccaagacactagtgtggaagttggcaagaatataaatatatcctgccacgcacagggcgagccccagccaattattacctggaataaggaaggtgtgcagattaccgagagtggcaagtttcatgtggatgacgaaggcaccttgacgatatatgatgctgggttcccagaccaggggagatacgaatgtgtagctcggaatagctttgggctggcagtgacaaacatgtttttgacagttaccgccattcagggaagacaggctggggatgattttgtggagtcgagcatcctggacgccgtgcagcgggttgatagtgcaattaactcaactcgcagacatttgttctcgcagaaacctcacaccagctcagatctgctggctcaattccactaccctagagaccctctcatcgtagaaatggcccgtgcaggcgagatctttgaacacacattacaactgatcagggagcgcgttaaacagggactcacagttgatcttgaggggaaggaatttcggtacaacgacctggtgtctcccaggagtctgagtctgatcgcaaacctttccggctgtacagcacgacgccctctgcccaattgtagcaatcgatgcttccatgcaaaatatcgggcacacgatggaacatgtaacaacctgcagcagccgacttggggagcggcactgacagccttcgccaggcttctgcagcccgcataccgtgatggtatcagggctcccagggggctcggtctgcccgtgggttcccggcaacccttaccgcctcccaggttggtggccactgtatgggctagggctgcagccgtaacgcccgatcactcttacactaggatgttaatgcactgggggtggttcctagagcatgatctcgatcatacagtgcctgcattgtcaaccgccaggtttagcgatgggagaccttgtagcagtgtgtgtactaatgacccaccatgttttcctatgaacacaagacatgctgacccaagaggcacacatgctccttgtatgctgttcgcccgatcatcacctgcctgtgcaagtggaagacctagcgctaccgtggattcggtctacgctcgggagcaaattaatcagcagactgcatacatagacgggtccaatgtttacggaagcagcgaacgagagagccaggcactcagagaccccagcgtgcccagaggactgcttaagaccggattcccctggcccccatccggaaagccactgctcccttttagcaccggccctccgactgagtgtgcacgtcaggagcaggagtccccttgtttccttgccggagaccacagggccaatgagcacctagccctggccgctatgcacacgctgtggttccgagagcacaacagaatggctaccgaactgagcgccctgaaccctcactgggagggtaacacagtatatcaggaagcacgaaagatcgttggggcagaattgcagcacatcacctattcccactggctcccaaaagtcctcggagatccaggtactcgaatgctaagaggctaccgcggatataatccgaatgtgaatgcaggcattatcaactcttttgctaccgcggcattccgattcggacacaccctcattaaccctatcctatacaggttgaatgccacgttgggagagatcagcgagggtcatcttcccttccataaagccctgttttctccctcccggatcataaaggagggtggaattgatccagtgctacgtggactcttcggtgtggcagccaagtggagagctccctcatacctcctgagtcctgagctaacacaacgcttgtttagcgccgcttattctgccgctgttgatagcgctgcgaccataatacaacgtgggagggaccacggcatcccgccttacgtagactttcgggtcttctgtaacctcacctcggtgaagaactttgaagacctgcagaatgagatcaaggattccgagataaggcagaaacttaggaagttatacggctcaccaggagatatagacctttggccagcgctgatggtagaagacctgatccccggaacacgcgtcggtcctactttaatgtgcctgttcgtgacccaatttcagaggctacgcgacggagatcgcttctggtatgaaaatccaggggtgttcacaccagctcaactgacacagctgaaacaggctagcttgtctagggtgctttgcgataatggagattccattcagcaggtgcaggctgatgtctttgtcaaagctgagtacccccaggattatctgaattgcagcgagatccccaaggtagaccttcgagtgtggcaagactgctgcgccgacaagcaagcgggaggcactccagaagctggcagggtgtatcggtgctag

SEQ ID NO: 11714 - DNA, 891 bp, Artificial Sequence
  Description of Artificial Sequence: Synthetic coding sequence
atggacccatcaaaaattgcccacaccgagtaccccgtgaatacaatcatcatccatgaggatttcgataataacagtatgtccaataacattgcactgcttaagaccgatacggcaatgcattttggcaacctagtccagtcgatctgcttcctgggacgcatgctgcataccccaccggtgctgcagaattgctgggtgtctggatggaatcccactagtgccactgggaaccatatgacaatgtcagtgcttcggaagatattcgtgaaggacctggacatgtgtcccctatataagctgcagaaaacagagtgcgggtctcacaccaaagaagagaccaaaaccgcatgcttgggcgaccccggtagcccaatgatgtgtcagctacagcagttcgacctctgggtactgcgaggcgtcctcaatttcggaggagagacctgtcctggtctgtttttatacactaaagtggaggactacagtaagtggattactagcaaggccgaaagagccggtccgccactatcatccctccatcattgggagaagttaatttcattctcacatcacggaccaaatgccacgatgacccagaagacctattcagattctgagctgggtcatgtgggctcgtacctacagggccaacgtcggactatcacgcacagccggctagggaattcaagccgtgacagtctggatgtaagagagaaggatgtcaaggaaagcggccgttcccctgaggcatctgtccagcctctctattatgactactatggaggcgaggtgggggaaggcaggatcttcgccggacagaacaggctgtaccagccagaagaaattattctagtcagcttcgtgctggtgttcttttgttcgagtatttag

SEQ ID NO: 11715 - DNA, 2808 bp, Artificial Sequence
  Description of Artificial Sequence: Synthetic coding sequence
atgcggaagcccagacggaagtcgaggcaaaatgctgaaggtcgcagatcccccagcccgtacagcctgaagtgtagcccaacacgggagacattgacatacgcccaggcccagcggatagtggaagtggacatcgatggtcgcctccatcggattagcatctacgatcctctgaaaatcataactgaagatgagctaactgctcaagacattactgagtgcaactcaaacaaggaaaactccgaacagcctcagtttcccggaaaatcaaagaagccatccagtaagggcaaaaaaaaggagtcttgcagcaagcatgcatccgggacctcctttcaccttccacagccatcatttcgcatggttgactccggcatccagccagaagccccacccttacctgctgcatattataggtacattgagaagccgccagaggacttagacgcagaggtagagtatgatatggacgaagaggacctcgcatggctagatatggtgaatgagaagaggagagttgacgggcactcattagtatccgccgacaccttcgagctgctggttgatcgtctcgagaaagagagctatctcgaatccaggagctctggggcacagcagtcactcatcgacgaggacgccttttgctgcgtgtgtctcgatgatgagtgtcacaactcgaacgtgatacttttctgcgacatctgcaaccttgctgtacatcaggaatgttacggcgtgccatatattccagaaggtcagtggctctgccgatgttgtctgcaatcccccagccggccagttgattgcatcctctgccctaacaagggcggtgctttcaaacagaccagcgatgggcactgggcccacgtggtctgtgccatatggatccccgaagtctgctttgcgaacaccgtattcctggaacccattgagggaatcgacaacattcctcctgctaggtggaagcttacctgctacatctgcaaacaaaaagggctcggggcagctatccagtgtcacaaggtgaattgttatacggcttttcacgtcacatgtgcgcagagggcaggcctgtttatgaagattgagcctatgcgtgaaacaagcctgaacgggactatcttcactgttcgtaagacggcctactgtgaggcccattcaccgccaggggctgccacagcaaggcgcaagggagactcccctaggagtataagcgaaacaggggacgaagaggggctgaaggagggcgatggagaagaggaagaggaagaagaggtcgaggaggaggaacaggaggctcagggaggcgtgagcggtagcttgaagggcgtccctaaaaagagcaaaatgtccctcaagcaaaagatcaagaaggagccggaagaggccggacaggacactccatcgacactccccatgcttgctgtgcctcagattcctagctatcgacttaataagatttgctccggactgagttttcaaaggaaaaatcagtttatgcaacgcttgcataactactggttgctgaaaagacaggccagaaacggggtgcctctgattcggcgactccactcgcatttgcagtcccagagaaacgccgaacaaagggaacaggacgagaaaacttccgcagtcaaggaagaactgaagtattggcagaagctgaggcacgatctggagcgggcaaggcttctcattgagctcatcaggaaacgggaaaaattgaagagagaacaggtgaaggtccagcaggcagctatggaattagagctgatgcccttcaatgtactccttcgcaccaccctggatctgcttcaagagaaggatcctgcccatatatttgccgaacccgtgaacctgtcagaggtgccagactaccttgagtttatctctaaacctatggatttctcaacaatgcgtcgcaaacttgagagccacctctaccggacactggaagagttcgaggaagacttcaatttgattgttacaaactgcatgaagtacaatgccaaggatactatctttcaccgcgcagccgtacggctgagggacctgggcggagctattttgcgccacgccaggcgccaggcggaaaatatcggctatgaccccgagagaggaacccacctgcccgaatcccccaaattagaggacttctaccggttttcatgggaggacggcatgaccaacgggtttggaaagcacacagaatctgggtcggattctgagtgttctcttgggctgtcaggcggtttggcctttgaagcctgtagcggactgactcccccaaagcgatcgcggggaaaaccagccttgtctagggttccgtttctcgagggggtcaatggagatagcgattacaatggctcaggccgttctttgcttctcccctttgaggatcgcggtgatctagagccactggagctcgtctgggcaaagtgcaggggctacccatcatacccagctctaataattgacccaaagatgccaagagaaggcttgctgcacaatggcgtgcccattccagtgccacccctggacgttctgaagctgggggagcagaagcaggccgaggctggcgaaaagttatttctcgtgctgtttttcgacaataagaggacctggcaatggctcccccgagacaaggtgctcccgttaggggtagaagacaccgttgataaacttaagatgttggaaggcaggaaaacttctatccggaaatctgtgcaggttgcatatgacagagctatgatccacctctcacgagttcgtggtccacattcctttgtgacaagcagctatttgtag

SEQ ID NO: 11716 - DNA, 270 bp, Artificial Sequence
  Description of Artificial Sequence: Synthetic coding sequence
atgaaaaccgggctcttctttctttgcctgctgggcaccgccgcagcaatcccaactaacgctcggctcctctcggatcattccaaacctacagccgaaacggtcgcaccagacaacaccgcaatcccatccctccgcgcagaggcggaggagaatgagaaagaaacagcagtgtccacagaggacgactcacaccacaaggccgaaaaatctagcgtgctgaagagtaaggaagaaagccacgaacagtctgctgaacaggggaagtag

SEQ ID NO: 11717 - DNA, 657 bp, Artificial Sequence
  Description of Artificial Sequence: Synthetic coding sequence
atgggtcgggtatttctgaccggtgaaaaagcaaattctatactgaagcgatatcctcgggcaaacggcttcttcgaagagatcaggcaggggaatattgagagagaatgtaaggaagagttttgcacctttgaagaagccagggaagctttcgaaaataatgaaaagacaaaggagttctggagcacctacacgaaggcgcagcagggcgagtctaatcgaggctcagactggtttcaattttatcttaccttccccctgattttcggtctctttatcatacttctggtgatctttctgatctggcgatgcttcttaaggaataaaacaagacgtcagacagtaactgaagggcacattcccttccctcaacacctcaatatcattactcccccacccccaccagacgaggttttcgatagctctggcctgtctcccggattccttgggtacgttgtcgggagaagtgattcagtgagcacaagactgtcaaattgtgaccctccacctacgtacgaggaagccacagggcaggttaatctccagcgcagcgaaacggaaccgcacctggatccgcctccagagtacgaagatatagtcaactctaattccgcgagcgcaattcctatggtccctgtggtaaccacaattaagtag

SEQ ID NO: 11718 - DNA, 540 bp, Artificial Sequence
  Description of Artificial Sequence: Synthetic coding sequence
atgagcctcggcccagaagtgtttctagggccacccgaagcccagagcttcctctcctctcacacgcgcattcctagagccaaccactgggacctggagctcctaacccccggaaatcttgagagagagtgtcttgaggaaaggtgctcctgggaagaagccagagagtattttgaggataacacgttgacggagaggttttgggagagctacatatacaacggcaaggggggtcggggaagagtcgacgttgcaagtctggctgtcggcctgacgggaggaatcttattgattgttctggctggactcggggcattttggtatttgcggtggagacaacatcggggtcaacagccctgccctcaggaagccggtctgatctcccccctgagcccactgaaccccctcgggcctcccacccccctaccaccacccccaccgccaccacctgggctgccgacctacgagcaagccctggccgcaagcggcgttcatgacgcaccacctcctccctacacttctctacgtcggccacattag

SEQ ID NO: 11719 - DNA, 765 bp, Artificial Sequence
  Description of Artificial Sequence: Synthetic coding sequence
atgacattagaggatatcgtacaacgcgaggtctgggggaccgtagtcgccaggggcgctcccgctccgccaggtcccgtgccaacacgtggggctgcctctcgcagattaagcgtaagtccagcctcgaccagtgagacttctctgtaccaggttctgctcggagccagacagctggttcagccgggtccccatgccatgtatgcccgagtgcgccaggtcgagtccaatcccctctatcagggcacagcaagctcagctgacgtagcactagtcgaactcgaggcacccgtgcctttcactaattacatcctgccggtatgcctccccgacccgagcgtgatttttgaaacaggcatgaactgctgggttacaggatggggcagcccgtcagaagaggaccttctccctgagccccgaattctacagaaactcgcagtgccaatcattgacactccaaaatgcaatctactgtacagtaaagatacggagttcgggtatcaaccgaaaactatcaagaatgatatgctttgtgcagggtttgaggagggaaaaaaggatgcttgcaagggtgactccggcggtcctttggtttgtctggttgggcagagctggctccaagcgggagtgatcagttggggtgaaggttgcgccaggcagaatcgtcctggcgtttacattcgtgtcacggcccaccacaattggattcatagaatcattcccaagttgcaatttcagccggctaggctgggaggccagaaatag

SEQ ID NO: 11720 - DNA, 1899 bp, Artificial Sequence
  Description of Artificial Sequence: Synthetic coding sequence
atgaccccacctgtcctgactactgctgaaacctccgtcaagccctctgtttctgcctttacccatagcccccctgagaacaccactggcatatcatcaactatttccttccattctagaaccctcaatctgactgatgtgattgaagagttggctcaagctagcactcagaccctgaagtccactatagctagcgagaccacactatcatctaagtctcatcaaagcactacaacgcgtaaggcaattatccgtcactctacaatccctcctttcctgtcctcatctgctactttaatgccagtccctatatctccaccatttacccagcgggctgttacagataacgtggccacacctatcagcggcctgatgacgaatactgtggtgaaattacatgagtcaagcagacataatgccaaaccccagcagcttgtggccgaagtggctacttctcccaaggtgcacccgaatgctaagtttaccattggcaccactcactttatttattcaaatttgctgcatagtaccccaatgcctgccctgacaactgtgaagagtcagaatagcaaactgacgcctagcccatgggccgagaaccaattttggcacaagccctactctgaaatcgcagagaaagggaaaaagcctgaggtgagtatgctagccacgaccggactctccgaggccaccactttagtttccgattgggacggacagaaaaatacaaagaaatcggatttcgataagaagccagtgcaggaggcaaccacaagtaaattgctcccatttgattctctctctcgttacatctttgaaaaaccgagaatagtcggcggtaaggcagcgagttttaccatccctgccaactctgacgcgttcctaccctgtgaagccgttggcaaccctctgcccacaatccactggacgcgggtgccctccggtctggatctcagtaaaagaaagcagaactcccgggtgcaagtcctgcctaatggcacactctccatccagcgagtggaaattcaggacaggggacagtacctctgtagcgccagcaacctgttcggcaccgaccacctccatgtgaccctctctgtagtgtcttacccaccaaggattcttgagcgcagaacaaaagagattactgtgcacagtggttctaccgtcgagctgaaatgtagggccgaagggagaccttcccccaccgtcacatggattctggccaatcagaccgtggtttcagagagctcgcagggctctagacaggctgtggtaactgttgatggcacactcgtcctgcacaacttgtccatctatgatagagggttctacaagtgcgttgctagcaatccaggaggccaagactctctgctggtgaaaatacaagttatcgcggctcctccagtcatcctggagcagcgaagacaagttatcgttggtacgtggggagagtcactgaagctcccttgcacagcgaaaggtactcctcaaccttcagtgtactgggtgctgtccgatggcaccgaggtgaagcctctgcagtttaccaattcgaagctgtttctgttttccaacgggacactgtacatacggaatctggcatcatcggatagaggtacatatgaatgcattgcaactagctccactggctccgaacgcagagtggtaatgctcaccatggaggagcgggttacgtctccccgtattgaagctgcaagccaaaaaagaaccgaagtcaattttggggacaagttgcttctgaattgcagcgccactggggagcctaagccacagatcatgtggagactgccatcaaaggccgtggtagatcagcagcacagggtggccgctggctctacctctactctgatggatccatgtctcctagatcagtag

SEQ ID NO: 11721 - DNA, 681 bp, Artificial Sequence
  Description of Artificial Sequence: Synthetic coding sequence
atggacattatagttctccttccgaagggccactgtacgaaaatccaggaactgcagatgaccactgtgcttaagcagaatgtccacgtgttcggggtggagggcaattccgacgagcttgacgagccaattaagaccgtgttcgcggatgtcgctttcgtgaagaagcataatctaatgtctctcaattccattaattggagcagagtcctcgtgcagatggctcaccacttcttcgcgtactttcaatgcaccccaagcctggacactcatccgctcccactcgtggaggtggtagtgccaactggcgctgcagggaatctggcggcaggttatatagcacagaagattggattgcctattcgactggttgttgccgtgaacagaaatgacattatccatcgtaccgtgcaacagggggatttttccttgtccgaagctgtgaagtccactctggccagcgccatggatatacaagtcccatacaacatggaacgagtcttttggctgctgtcaggctcagacagccaggtgaccagggccctgatggaacagtttgaacgtacccagtctgtgaacctgcccaaggaactgcactccaaacactctcccgttttgcccagaccctgcctgtgctctcaggtgccagggtcttgtccgggatgttggccagatccatag

SEQ ID NO: 11722 - DNA, 729 bp, Artificial Sequence
  Description of Artificial Sequence: Synthetic coding sequence
atgtttcagaccgggggtctaatcgtgttttacgggctccttgcccagaccctgcccctgaacgtcaatcccgctctcccattgagcccgacaggtctggctggctctcttacaaatgcactgagtaatggattactaagcggtggtctcttaggcatcctcgagaacttgccactgctggacatactgaagcccggtggcggaaccagcgggggtctgttaggcggattattgggcaaggtgacctcagtgattccgggtctaaataatattatagacattaaagtgacagacccccagctgctggaactcgggctcgttcaaagtccagatggacataggttatacgtcaccataccactgggaataaaactgcaggtgaatactcccctagtgggcgcatccttgctcaggctggccgtgaaattggacataaccgccgagatcttagcagtgagagacaagcaggaacggattcacctggtgttaggggactgcacccactcacccggatcactccagatctccctgctcgatggactggggccactgccaattcagggattacttgatagtctcacgggcatcttaaacaaagtgcttcctgagcttgtgcagggaaatgtttgtcccctcgtgaacgaagtgctgcggggactggatattaccctagtccacgacattgtgaacatgttgatccatggattgcaatttgtgatcaaagtatag

SEQ ID NO: 11723 - DNA, 1422 bp, Artificial Sequence
  Description of Artificial Sequence: Synthetic coding sequence
atgagcctggaggcctctttatgctcgttagaagaatgcgcagcattccagcctagctctccttcacccctccagccacagggcccagtaaagtccaataatatcgtcactgtaacaggcattagcctctgcctttttattataatcgcgactgtgctgatcacactgtggcgcaggttcggccgtcctgcaaaatgttccacaccggcacgacataattctatccacagcccaagcttccggaagaactcagacgaggagaacatttgtgagctaagcgaacagagaggatctttttcagacggaggggacggcccaacaggaagtcctggagacactggcatccctctgacatatcggaggagcgggccagttccacctgaggacgatgcctcgggaagtgagtcattccagtcaaacgcccagaaaatcattcccccacttttttcctatcgtctggcgcagcaacagttgaaggagatgaagaagaagggcctgaccgaaacgaccaaggtataccacgtgtcacaatcgccactgacagatacagcaattgatgctgccccttccgccccactggacctagagtccccagaagaggccgcagcaaataagttcagaataaaatcccccttccctgaacagcccgctgtatctgccggagagagaccaccctccagactcgatctgaatgtgacccaggccagttgtgctatatcaccatcccagactttaattcgaaaaagtcaggctaggcacgttggttcaaggggtggacctagtgagaggagtcatgccaggaacgcacacttcaggcgcactgcctcattccacgaagctcgacaggcccgaccctttagagagaggagtatgtcgactttaactcccaggcaggcgccagcttacagctctcgtactcgcacatgtgaacaagccgaggatcgatttagacctcaatctcgcggagctcatctcttccccgaaaaattggaacatttccaggaggcctccggaaccagaggccctctcaaccctctgcccaagtcctatactctcggccaaccactccgtaagcccgacctcggcgatcaccaggctgggcttgtagccggaatcgagcgcacagaacctcaccgggcaaggcggggtccgtctccaagccacaaatctgtaagtagaaagcaatcctcccctatcagccccaaagacaactatcagcgggtttcaagtctgagtcctagccagtgcagaaaagataagtgccagtcgtttccgacacatccagaattcgctttttacgataacacgagcttcgggctgaccgaagcagagcagcggatgcttgaccttccgggttacttcggctctaacgaagaggacgagacgacctctacgttgagcgtggaaaagttagtaatctag

SEQ ID NO: 11724 - DNA, 2310 bp, Artificial Sequence
  Description of Artificial Sequence: Synthetic coding sequence
atgctgtctaagaaaggaatattcccctggatcctgacctgcattagcgaagagatggcattccggaccatttgcgtgctggtaggcgtttttatttgctcgatttgcgttaagggaagcagccagccccaggcacgagtatacctcacttttgatgaactgcgggaaaccaagacctcagagtacttctctctgagccaccatccactggactatcgaatattgctgatggatgaggaccaggacagaatctatgtgggaagcaaagatcatattctaagtctaaacattaacaacatttcccaggaagccctgtctgtgttttggcctgcaagcactatcaaggtggaagagtgtaagatggccggtaaagacccaacccacgggtgtgggaatttcgtgcgggtgatccagaccttcaaccggacccatctctacgtttgcggatccggagccttcagcccagtgtgtacatatctgaatcggggacgcaggagcgaagaccaggtcttcatgatcgacagcaagtgcgagagtggtaagggtcgatgttccttcaacccgaacgtgaacacagtttccgtcatgattaacgaggaactgttcagtgggatgtacatagatttcatggggacggacgcggcaatttttagatcgctcaccaaaaggaatgccgtgcgaactgatcagcacaactcaaaatggttaagcgagcctatgttcgtggacgctcacgtgataccggacggtacggaccccaacgacgccaaggtgtattttttcttcaaagagaagcttactgacaataaccgctcgactaagcaaatacactccatgattgcccgaatctgcccgaacgatacaggcggtctccgcagcctagtgaacaaatggacaacttttctgaaggcacgtcttgtgtgctccgtgacagacgaagacggcccagagactcatttcgatgaattagaagacgtcttcctccttgaaaccgacaaccctcgcacaaccctcgtgtacggcatattcacgacatctagctccgtgtttaagggatcagccgtgtgtgtctaccacctctcagacatccagactgtgtttaacggacctttcgctcacaaagaaggccctaaccatcaacttattagctaccagggacgcattccttaccccagacctggcacttgcccgggtggggcttttactcctaatatgcgtaccacgaaagagttcccagatgatgttgtgacctttattcgcaatcaccccttgatgtataattctatttacccaatccataaaaggccactcattgtgcggataggcacagattacaaatatactaagatcgccgtggatagggtgaatgctgcagacggtcgttatcacgtgctattcctggggacagatcggggtacagtccagaaggtagtagtgttgcctaccaataactccgtctcaggggagctcatcctggaagaattggaagtcttcaaaaaccatgctcctatcacaacaatgaagatatcatctaagaagcagcaactttacgtcagtagcaatgaaggggtctcacaagtgtcattacatcgttgtcatatctacggcacggcgtgcgctgactgttgtctggccagggatccttactgtgcttgggacggacacagctgttcacgcttctacccaaccgggaagcggagaagcaggagacaggatgttcggcacggaaacccactgacacagtgtcgcggattcaacctgaaagcgtataggaacgccgctgaaatagtccagtacggcgtgaagaataataccactttcttagagtgtgccccaaagtcaccacaggcctctattaaatggctgctgcagaaggacaaggaccgacgcaaagaggtcaagctgaatgagcgaattatagcgacatcccaaggcctgctgatccgatccgtccaggggtctgaccagggactgtaccattgcattgccaccgagaacagcttcaaacagaccattgcaaaaataaacttcaaggtgctagactccgagatggtggcagtggtgaccgacaagtggtctccgtggacgtgggcttcaagcgttagagcccttcccttccaccccaaggacatcatgggggctttctctcacagtgaaatgcaaatgattaaccaatactgcaaggatactagacagcaacaccagcagggcgatgagtcccagaagatgcgcggtgactatggcaagctaaaggccctcattaattcaaggaagtctcgcaatcgaagaaaccagctgcccgagtcctag

SEQ ID NO: 11725 - DNA, 942 bp, Artificial Sequence
  Description of Artificial Sequence: Synthetic coding sequence
atgcccggttggttgacactgcctacgctttgtcgatttctgttgtgggcattcaccatatttcacaaggcacagggcgacccggcaagccaccctggcactaccccgccatcttataaggtccgttggtctaaggttgaacccggtgaactgcgggagacactaatacttatcacaaacggactccacgccagaggctacggccctctgggaggaagggcccgtatgcgacgaggacaccggttggatgctagcctcgtgattgcaggtgtaaggctcgaggatgaggggcgatacagatgcgagctcataaacgggattgaagatgagtctgtagctctaaccttgtctctggagggggtggtcttcccctaccagccatctagaggcagataccagttcaactattacgaagctaagcaggcgtgtgaggagcaagatgggcgtttggctacctattcacaattataccaagcatggacagaggggctcgactggtgtaatgctggctggcttctggaggggtcagtcaggtacccagtgctgaccgcgagagccccttgcgggggacggggacggcctggaatccgctcttacggcccaagagaccgcatgcgggatcgctacgacgccttttgtttcaccagcgcactcgctggacaggtattctttgtaccgggtcggctgaccttgtccgaggctcacgcggcttgtcggcgacgaggggctgtggtggcaaaggtcggtcatctgtacgccgcttggaagttcagcggccttgaccagtgcgacggtgggtggcttgcagatggaagtgtccggtttcccatcacaacaccacggcctaggtgtggcggactgcccgatccaggcgttcgctcattcgggttcccgcgtccacagcaagccgcatatggtacgtactgctacgcagaaaattag

SEQ ID NO: 11726 - DNA, 1089 bp, Artificial Sequence
  Description of Artificial Sequence: Synthetic coding sequence
atggcttggactttcgaatgcagccggacaacatctcccgagcccctatctacctctccctgccgcaccaccagtagccgcaacagtcctacaatgtcctgtcctgcatcggtggcctgcgagcccagcacttccaccactacttccagcccccctaaggcatgtctgacgcgaccaagcagtccatcgccttcgtgctccacttccgcctggcacaataagaacaacctcatcagcaaggtgccccgaggtgctttgtctaggcagacgcaattacgggaattgtacctgcaacacaaccagcttactgactctggtctcgacgccacaacattctctaagctgcactcactggagtatttagatttgtcccataatcaactgactacggtgccggcagggcttccccgaaccctggcaatcctgcacctgggaaggaatcgcatcaggcaggtcgaggctgctaggctccatggtgccaggggattacgctacctcctcctgcaacataatcaactgggctcttctgggctgcccgctggcgcattgcgacccttacggggactgcacacacttcatctttacggcaacgggctggatagagtgcccccagcacttcccagacgtttgagagcgctcgtccttcctcacaaccatgtggcagccctcggcgcaagggacctggttgctaccccagggctgacagagctgaatcttgcatacaataggctagctagcgcgcgtgtacaccaccgggctttcaggagactgcgcgcactccgatccctggatctggcgggtaatcagctgacacggctccccatgggactccccacaggcctgaggacgttgcagctgcaacgtaaccaactgcggatgctggagccagaaccgctggctggcctagatcagctgcgagagctctccctcgcgcataataggttgcgagtaggagatattggacctggaacttggcacgaactgcaggccctccaagtccgccatagacttgtatcccacacagtgcccagagccccaccgagcccttgcttgccctgtcacgtacctaacatcttggtcagctggtag

SEQ ID NO: 11727 - DNA, 900 bp, Artificial Sequence
  Description of Artificial Sequence: Synthetic coding sequence
atgctccatcctgagacatctccaggcagaggccacctcctcgccgtactgcttgctcttctgggtactgcttgggctgaggtttggccaccccagctgcaagaacaggcgcctatggccggagcattgaatcgcaaggagagcttcctgctactatctctgcacaataggctgaggtcctgggtccagcctcccgctgccgacatgaggagactggactggagcgacagtttagcccagcttgctcagggtagccctctatggaatcctaatcctgagccgggagttcgaccggttgcccaccccgcaagtggtctcgagcatgcagcagctcccagagcatggtgccccctatctaagtggtcattatggtttgcagaagggcaacgctattctcacgctgctggagagtgtgcgagaaacgctacatgtactcactatacccaactggtgtgggcaactagctcccagttaggatgcggtagacacctctgttctgccggacaggccgctatcgaagcatttgtctgcgcctactctccgaggggtaattgggaagtcaatggtaagaccatcgtcccttacaaaaagggggcttggtgcagcctgtgcactgcctcagtctctggctgcttcaaagcctgggatcacgctggtggcctttgcgaagtgccaaggaacccctgcaggatgagctgtcagaaccatggaaggctgaacatcagcacctgtcattgccactgtcctcctggatacaccggccgttactgccaggtgagatgctccttgcagtgtgttcatggacgcttcagggaggaggagtgcagttgcgtttgtgatatcgggtatgaaccttccgttccaccacgctgtatttttccatctacacccgtgacctag

SEQ ID NO: 11728 - DNA, 1047 bp, Artificial Sequence
  Description of Artificial Sequence: Synthetic coding sequence
atgctggataccaacctgatcttactgcccctatttcagttcatcgtcccaaaagaatggaattcgaaatacagacccgtgtgcattcacctggctggtaccggcgatcatcactattggcgacgcaggacacttatggccagaccaatgatcaaagaggcacgtatggcgtcccttctgctggaaaacccttactacggctgtagaaaaccaaaggaccaggtcaggagtagtctcaaaaatgtcagtgatctgttcgttatgggcggagctttggtgctggaaagcgccgctctactgcactggctggagcgcgaaggatacggaccactgggcatgacaggtatatccatgggagggcatatggcctccttagctgtttcgaattggcccaagccaatgccccttatcccctgtctgagctggtccaccgcaagtggggtgtttactaccacagattccttcaaaatgggtcaggagtttgtgaaacacttcaccagcagcgcagataaattgacaaatcttaacttggtttcccgcaccctcaacctggatatttccaaccaagttgtgtcacagaaaccagcagactgtcacaacagcagcaagacctccgtatcagccacctccgaaggactgctgctgcaggatacttcaaagatgaaaaggtttaaccagacactgagtacaaataagagtggatatacttccagaaatccccagtcttaccacttgctgtccaaggaacaatcaagaaactccctccgtaaggaatccctgatcttcatgaaaggtgtaatggacgagtgtacacatgtcgcgaacttctcagtgccggtcgacccctccctgataattgtggtccaggccaaagaggacgcctatattcctaggactggcgtgaggtcgttgcaagaaatctggccaggctgcgagatcagatatctggagggtggacacattagcgcctacctatttaagcagggcttgtttcggcaggctatctacgacgcctttgacagattcctccacaagtatgcaaattag

SEQ ID NO: 11729 - DNA, 1044 bp, Artificial Sequence
  Description of Artificial Sequence: Synthetic coding sequence
atgcgggcttgcatttccctcgtcctcgcagttctctgtggcttggcctgggcagatctgtatagcgccccaacatcatgccaggggaggtgttatgaggccttcgataagcaccatcaatgccattgcaacgctcgctgccaggagtttgggaattgctgcaaagactttgagtccttgtgcagtgaccacgaagtctcccacagcagcgatgctatcacaaaagaagaaatacagtctatttccgaaaaaatttatcgcgcagacacaaacaaagcccagaaagaagatatagtactgaactcccagaactgcattagcccatctgaaactagaaatcaagtggacagatgccccaagccactgttcacttacgtgaatgagaaactgttctctaagcctacttatgctgcttttattaacctgctaaataattaccagcgtgccactggacacggagagcacttttctgctcaagaactcgccgaacaagacgcttttctacgggaaataatgaagactgcagtgatgaaagagctttactcttttcttcatcatcaaaatcggtacggaagcgaacaggaattcgtagacgacttaaagaacatgtggtttggcctgtactccagagggaacgaggaaggggacagtagcggttttgagcacgtgttcagcggggaagtgaagaaaggaaaggttaccggtttccataactggattagattctatctcgaggaaaaggagggcttagtggactattactcccatatttacgatgggccttgggactcctatccggacgtgttggcgatgcaattcaattgggatgggtattacaaggaagtgggttcagctttcattggatcatcacctgaatttgagttcgcattgtatagcctatgctttatcgctcgccctgggaaggtgtgccagctaagcttgggagggtatcctcttgccgttcgtacttacacctgggacaagagtacttatggaaacggcaagaaatatatcgcgacagcatatattgtctcttctacctag

SEQ ID NO: 11730 - DNA, 864 bp, Artificial Sequence
  Description of Artificial Sequence: Synthetic coding sequence
atgctgaagaaaatcagcgtgggcgtagcgggtgatcttaatactgtcactatgaagttggggtgtgtactgatggcttgggctttgtacctctcactcggcgtgttatgggtcgcccagatgctgttggctgcgagttttgaaactttacagtgcgagggaccagtctgcaccgaagagtcaagttgtcacacagaggatgatttgaccgacgctcgagaggctgggttccaggtaaaggcctacacattcagtgaacccttccaccttatcgttagttacgagctgttccccgcaccgattttgcgagccgtccctagcgcagagccccaagctggatcaccaatgacactgagctgtcaaaccaaactgccactccagagatctgccgcacgcctactatttagtttctacaaagatggccgtatcgtccagagccgtgggctgtcctccgaattccagatccctacagcaagcgaggatcatagtggaagctactggtgtgaggctgctacagaggataaccaggtgtggaagcagagtcctcagttggaaatccgggtgcagggcgcatcctcaagcgccgctcctcccacactgaaccccgctcctcagaagtccgccgctcccggaactgcaccagaagaagcgcctggacctttgcctccgcctcccacacccagttcagaagatccgggtttctcaagcccattaggcatgccagacccccatctgtaccaccaaatggggcttttactcaagcatatgcaggatgtccgagtgcttctcggacatttacttatggagcttagagaactgtcaggccatagaaaacctgggaccactaaggctaccgctgagtag

SEQ ID NO: 11731 - DNA, 1815 bp, Artificial Sequence
  Description of Artificial Sequence: Synthetic coding sequence
atgatgcgcgctgtgtgggaggccctggcagccctggccgctgtcgcatgccttgtgggggctgtgcgcggtggtccaggactgagcatgttcgccggtcaggcggctcaaccagacccatgcagcgacgaaaatggtcatccccgacggtgcattcctgatttcgtcaatgctgcattcggaaaggacgtacgggtctcctcaacctgtggacgaccccctgcgagatactgtgtcgtatctgagcgaggtgaggagcgtctgcggtcttgccacttgtgcaatgccagcgacccaaagaaggcccacccccctgccttcctcacagacttgaataacccgcacaacctgacgtgctggcagtctgagaactacctccaattcccacacaacgtgacccttaccctcagtctcggcaagaagttcgaagtgacttacgtctctcttcagttttgctctcctcgaccagagtctatggctatatacaagagcatggattatggtcgcacgtgggtgccctttcagttctactccacccagtgtagaaaaatgtacaatcggccacaccgcgcacccatcaccaagcagaatgaacaggaggcagtatgtactgactcccacacagacatgagaccgctgagtgggggacttatcgcgtttagcactttagatgggaggccgtccgcacatgattttgataatagtcctgtcctgcaggactgggttaccgctacagacattcgagtggcctttagtcggctacatactttcggcgacgagaatgaagacgactcggagcttgcccgtgatagctatttctacgcagtgtccgacctgcaggtcggaggcaggtgcaagtgtaatgggcacgccgcacggtgcgtccgcgatcgggacgatagtttggtgtgtgattgtcgacacaatacagctggacctgagtgtgatagatgcaaacccttccattacgatagaccctggcagcgcgcaactgccagggaggccaatgagtgcgtagcctgcaactgcaacttacacgcacgcaggtgtaggtttaacatggaactgtataaactgtccgggcgtaaaagtggtggtgtgtgcctgaattgtagacacaacactgccggacgccactgtcactattgtaaggaggggtattatagagacatgggcaaacccatcacccaccggaaagcttgtaaagcatgcgattgtcacccagtaggcgcagccggtaagacctgtaaccagacgacaggacagtgtccctgcaaggatggggtcacaggcattacatgtaatagatgcgccaaaggctatcagcaatccaggtctccaatagctccttgcataaagattcctgtagcacctcctacgacggctgcctccagcgttgaggaacctgaagattgcgatagctattgtaaggccagcaagggaaaattgaaaattaatatgaagaagtactgtaagaaggactatgctgtgcagattcacattctcaaggccgacaaggcgggtgactggtggaaattcaccgtgaacattatctccgtgtataaacaggggactagtcgtatccgtagaggcgaccagtcactgtggatccggtctcgggatatcgcttgcaaatgcccaaagattaagcctttgaagaagtatctactcctgggaaacgctgaagacagcccggaccaatccggtatcgtcgcggacaaaagttccttggtgatccagtggagggacacatgggcacgacggctgcgaaaattccagcaacgcgaaaagaaaggaaaatgcaaaaaggcgtag

SEQ ID NO: 11732 - DNA, 1005 bp, Artificial Sequence
  Description of Artificial Sequence: Synthetic coding sequence
atgagatctgccggtggccgtggagaaataaaggtgaggagggaactgcagcccagcaaacaggtgtctggattgactaatcatgcaagaacagggcaggagaaacggaaccttcaaagattggtgttggagactccaagccagaatatcttcttttctcctgtgtcagtaagtacgtccctggccatgctatctttgggagcacacagcgttacaaagacacagattctgcagggactggggttcaacctgactcacaccccagagtcagccatccaccagggctttcagcacttggtccattccctcaccgttcctagtaaagacctgaccctgaagatgggctcagccttgttcgtgaaaaaggaactgcagctgcaggccaatttcctgggtaatgtgaagcgcctctatgaggccgaggtcttctccactgatttcagcaatccctcgatcgcccaagctcgcatcaattctcacgtgaaaaagaagacgcagggcaaagtggtggatattatacagggtcttgacctgctcacagcaatggtcctcgtgaaccacatcttctttaaggcaaaatgggaaaagccatttcatcctgagtacacgcgtaagaatttcccgtttctggtgggggagcaggtgacagtgcatgttccaatgatgcaccagaaagagcagtttgcctttggggtggacacagagcttaattgttttgtgctgcagatggactataagggggacgcagttgcttttttcgtgcttccatcgaaaggcaagatgcggcagctggagcaggcactaagcgcccgaacgctacgcaagtggtcgcactcactgcaaaagcggtggatcgaggtgttcattccaaggtttagcatttccgcaagctataatttggaaaccatcttacccaaaatgggtatccaaaatgttttcgataagaacgcagatttcagcggcattgcgaaaagagacagtctgcaggtatccaaagtatcatag

SEQ ID NO: 11733 - DNA, 1065 bp, Artificial Sequence
  Description of Artificial Sequence: Synthetic coding sequence
atggccccagcaagaaggcccgcaggagccaggctgctgctggtgtacgccggtttactagcagccgctgccgctgggcttggatcccccgaaccgggtgcaccgagtcgcagtagagccagacgcgagccaccccctggcaacgagctgcctcgcggaccaggtgagagcagagctggcccagcagcaagaccccctgagcccaccgccgagagggctcattcagttgaccccagggacgcttggatgctcttcgtccgacaaagtgacaagggtgtcaacggaaagaagcggtcaagggggaaggcaaaaaagctcaaatttggactacccggacctccaggtccaccagggcctcaggggcctcctggccctattatccccccagaggctttgttaaaggaatttcagctgctgctgaagggagcggtgagacaacgtgagcgggctgagcctgaaccctgcacctgtggccctgccggacccgtggcggctagtttggctcccgtgtccgccaccgcaggtgaggatgacgacgatgtcgtcggggatgtcctcgcactgctcgccgcaccccttgcccctggacccagagcccctcgcgtagaagccgcattcctgtgtaggcttcgccgagacgctcttgtggagaggcgggctctgcacgagctcggcgtatactacctgccagatgccgaaggggcattcagacggggacctggcctcaacttaacatccgggcagtaccgagctccagtggctggattctatgcccttgctgccacgcttcacgtggcacttggagagccaccacggcgaggaccaccacggccaagagatcatctcaggttgctcatctgtatccagagccggtgtcaacgaaacgcctcactagaagccattatgggtttggaatcatcatcggagttattcaccatctccgtaaatggcgtgctgtacctgcagatgggacagtggaccagtgtctttctcgataatgcaagcggttgctccctcactgtcagaagtgggtcccatttttccgctgtgctgctgggtgtatag

SEQ ID NO: 11734 - DNA, 2685 bp, Artificial Sequence
  Description of Artificial Sequence: Synthetic coding sequence
atgtctctacccaggtgctgtccccaccctctgaggccggagggatccggcgcaatggggccagaagccttatcctctctgctgctgttactgctggtggcgtcaggggacgctgatatgaaaggacactttgatccagccaagtgtcgatatgcccttggcatgcaagacagaacgatcccggatagcgatatctccgccagtagctcctggtccgattctaccgcagccagacacagtcgtttagaatccagcgacggggacggcgcttggtgcccagctggcagcgttttcccaaaagaagaggaatacctccaagtggacctgcagcgcctgcacttggtggccttagtgggtacacagggtcgtcacgccggaggcctgggaaaggagttctcgagaagttaccgccttagatactcccgggatggtagacggtggatgggatggaaggatcgatgggggcaagaggtgatcagtgggaatgaggatcctgaaggggtcgtgctgaaagacctgggtcctccaatggtcgcacggctggtgcgcttttatccaagagctgaccgtgtaatgtcagtatgtttacgggtcgaactctatggctgtctctggcgcgatggcctgcttagctatacggctccagttgggcaaacaatgtacctgtccgaagccgtgtatctaaacgatagcacctacgacggacatacagtgggaggtctgcagtacggcggactcgggcagctggcagacggcgtggttggcctggatgatttccgtaaatcacaggaactgagggtttggcccggatacgattacgtcggctggagtaaccacagcttttccagcggatatgtggagatggaattcgagtttgatagactgcgtgcttttcaagctatgcaggtgcattgtaataacatgcatactctgggagccagactgccaggcggagtcgaatgtagattcaggcgaggacctgctatggcatgggagggggaacccatgagacataaccttgggggaaacctcggagacccccgagcgagggccgtgtccgttcctttaggtggcagggtcgctaggtttttgcagtgccgattcttgtttgctggaccttggcttctgttctccgaaatttctttcatttccgacgtggtgaacaattcaagccccgcactagggggaaccttcccaccagccccttggtggccgcctggtccccctcccacaaactttagctcacttgagctggagcctcggggacagcagcctgtggctaaggctgaagggtccccgactgctatcctgatcggatgcttggttgctattatcctgctgctgctcctgatcattgctctaatgctttggcgcctccactggcgccgactgctgagtaaagctgagagacgagtgctcgaggaagaactgacagtgcacctctcggttccaggggatacaatcttaataaataatcggccaggcccacgggagcccccaccctaccaagaacctaggcctcgcggaaatcccccacattcagctccatgcgtccccaatggatcagcctacagcggcgactacatggagccagagaagccaggtgcacctctgcttccgcctcctcctcagaactcggttccccactatgcagaagccgatatcgtcacgttgcagggcgtgacaggcggtaacacttacgctgtgccagctttacccccaggtgccgttggggacggccctccacgagtggatttcccccgaagtagactgaggtttaaagaaaagctgggtgagggacaattcggtgaagttcacttgtgtgaggttgacagcccccaggacttggtctccctcgatttccctctcaacgtgagaaagggccatcccctgctggttgctgtcaaaatactgcggccagacgccactaagaacgctcggaacgactttctaaaggaggtaaagatcatgtcgagactgaaggacccaaatatcatccggctcttgggggtttgcgtgcaggacgaccctctgtgcatgattacagattatatggaaaacggagatttgaatcaatttctctccgcgcaccagctggaagacaaagccgcagagggagctccaggtgatggacaggccgctcagggacccacaatctcctatcccatgttgctccacgttgcggctcaaattgcctctgggatgcgctacctagccaccctgaactttgtgcacagagatttggctacccgcaattgcttggtcggcgagaacttcaccataaaaattgctgactttggcatgtctcggaatctctacgctggggattactatagggtgcaggggagggccgtacttccaattagatggatggcttgggagtgtatcctgatgggcaagttcaccaccgcatctgacgtttgggcatttggcgtcaccctgtgggaggtgctgatgctatgtcgggctcagccctttggtcagctgacagacgagcaggtgatcgagaacgccggagagttctttcgagaccagggaagacaggtctatttatcacgtcccccagcatgcccgcaaggactctacgaactgatgctccgctgttggtcacgcgagtccgagcagcgcccaccgttcagccagctccaccgcttcctggcagaggacgccttgaacacagtctag

SEQ ID NO: 11735 - DNA, 2685 bp, Artificial Sequence
  Description of Artificial Sequence: Synthetic coding sequence
atgtctctcccgaggtgttgccctcacccgttacggccagagggcagtggcgctatgggtcccgaagctctgtcgtccctactccttttgctgttggtggccagcggtgatgctgacatgaagggacattttgatcccgctaaatgccggtatgccctgggaatgcaggacaggaccatccctgactccgacattagtgcctcttcgtcttggtcagattccacggccgcaagacactctaggcttgagtcatctgacggcgatggtgcgtggtgtcctgcaggatccgttttccctaaagaagaagagtatctgcaggtcgatcttcagcgcttgcacctcgttgcactagtgggaacacagggtaggcacgcaggtgggctgggcaaagaattctcacgatcttacagattacgatattcaagagatggcaggaggtggatgggatggaaggacagatgggggcaggaggtgatttctggcaatgaagaccccgagggagtcgtactaaaagacctcggaccacccatggtggcgaggttggttcgattctacccccgtgccgacagagtgatgagcgtatgcctccgtgtggagttgtacggttgcctgtggagagatggccttctgagttataccgcaccagtaggacagacgatgtacctgagtgaagccgtgtatctaaatgacagcacctacgatggacatacagtgggcggtctccagtacggagggctgggccagctcgcagatggtgtagttggtcttgatgattttagaaagagccaggaacttagagtctggcctggatatgactatgtggggtggtctaatcactcattctcaagcggttatgtcgagatggaattcgagtttgacaggctgagggctttccaggccatgcaggtccattgtaacaacatgcacactctcggggctcgattgcccggaggcgtggaatgcaggtttcggagggggcctgctatggcgtgggagggagagcccatgagacacaacctgggcggaaacctgggtgaccctcgcgcacgtgctgtcagtgtgccactgggtggtagagtcgctcggtttctgcaatgtagatttctgtttgctggaccatggttgttgttttccgaaatttcctttatttcagacgtggtgaataacagcagcccggcacttggaggaaccttccccccagcaccctggtggccacctggaccaccccctactaattttagttccctggaactggagccacgcggacagcaacctgtggccaaggcggaggggtcgcctaccgccatcttgatcggatgcctggtggccatcatcctcctgctactgctcattatcgccttaatgctctggcgactccattggagaaggctcctctcaaaggctgagcgccgagtcctagaggaggagctcaccgttcacctgagcgtgcccggtgatactattctgataaacaaccgccctgggcctagagaacccccaccctatcaggagcctcgccctcggggtaacccgccacacagcgcaccatgtgtgcccaatggcagcgcctattccggcgattatatggagcccgagaaacctggtgccccactcctccctcctccccctcagaatagcgttccacactacgccgaggccgatatcgtgactctgcaaggcgtgactggtggaaatacctacgctgtgcctgcacttccgcctggagccgtgggtgacggaccccctagggtcgattttccacgaagccggctgcgcttcaaagagaagctgggtgagggccagtttggagaagttcacctgtgtgaggtggacagccctcaagatttggtttccctggacttccccctgaacgtaaggaagggccaccctctgctggtggccgttaaaatcctgagaccagatgccactaaaaatgccagaaacgacttcctgaaggaggtaaagatcatgagcaggctgaaggaccccaatataattcgcctgttgggggtgtgcgtacaggacgatccactctgtatgatcacggattacatggagaacggcgatctcaatcagttcctgagcgctcatcaactagaggacaaagccgcagagggagcccctggagacggccaggctgcccagggccctaccatctcttaccccatgttgttgcatgttgctgcacagatcgcctccgggatgcgatatctggcaaccctcaatttcgtgcaccgggacctcgccacgaggaattgtctggtgggagagaacttcaccattaaaatcgccgatttcggcatgagcagaaacttatatgctggagattactatcgggtccagggaagggccgtactccccataagatggatggcttgggaatgcatcctgatgggaaagtttactaccgctagcgatgtgtgggcctttggcgtgacattgtgggaggtcctgatgctgtgccgggctcagccattcggacagttgactgacgagcaggtgattgagaacgctggggagttcttccgggatcagggtagacaggtgtatctgtccagaccacctgcttgcccccaaggtctttatgagctgatgctgaggtgctggtcccgcgagtccgagcagagaccacccttttcccagctgcaccgatttctcgctgaggatgctttgaacaccgtctag

SEQ ID NO: 11736 - DNA, 2886 bp, Artificial Sequence
  Description of Artificial Sequence: Synthetic coding sequence
atgctcctgcttcttctgttggctcctctgtttctgcggccacctggtgcaggtggtgcccagacaccgaacgccacgagcgagggttgtcagattattcaccccccttgggagggtgggattaggtaccgaggcttgaccagggatcaggtgaaagcgattaattttttgcccgtcgattatgagatcgagtatgtgtgcagaggcgaacgcgaggtcgttggacctaaagtccgaaagtgcctggccaacggcagctggacggacatggatacacccagccggtgcgtgagaatttgcagtaaatcgtacctcacactggagaacggcaaagtattcctcacagggggtgatctacccgctttggacggtgctcgggttgatttccggtgcgatccagacttccatcttgttggctcttctcgctccatttgttcacaaggacagtggagcactcctaagccgcattgccaagtcaacagaacgccgcactcagaacgcagggccgtctacatcggggctctgttcccaatgtcagggggatggcccggaggccaagcttgtcagccggctgtggaaatggctctcgaagatgtcaattcgaggagggatattctccccgattatgagctgaagcttatacatcatgattctaaatgtgatccgggacaagctaccaaatatctttacgaactgttgtataatgatccgatcaagatcatcctgatgccaggctgtagtagcgtgtccacactggtcgcagaagccgctaggatgtggaacctgattgttctgtcttacggctcatcaagccctgccctatctaatagacagaggttcccaacatttttcaggacacacccaagcgctaccctgcataatcctacgcgggtgaagctgtttgagaaatggggatggaagaaaatcgctacgattcagcagacaaccgaagtgtttacttcaacgctggacgaccttgaggaaagagtcaaagaagccggaatcgaaatcacgttccgtcagtcattcttttccgacccagctgtgcctgtaaaaaacctgaagaggcaggacgcgcgtattatcgtcgggctgttttacgagaccgaagcacggaaggtgttctgcgaggtttacaaggagcggctgttcggcaagaagtacgtctggtttttgattggatggtacgctgataactggtttaagatttatgatccctctatcaattgcacagtggatgagatgaccgaagctgtggagggccacatcacaacagagatcgtgatgctcaatcccgctaatacacgtagtatttcaaacatgacatcccaggaattcgtggagaagctaacgaagaggttaaaaagacaccccgaggagaccggcggattccaggaggcacctctggcatatgacgccatctgggccctggctcttgcactaaataagactagcggcggagggggaaggagtggagtccgcctggaggactttaactataacaaccaaactataaccgaccaaatatatcgcgcaatgaacagcagctccttcgagggagtgtcgggacacgtggtgttcgatgcatccgggagtcggatggcatggacgctcatagagcaactgcagggcggaagctataagaaaattggctattatgactccaccaaagatgacttgtcatggagcaagactgataaatggattggaggttctccgcctgctgatcaaacacttgttattaagacattccgattccttagccagaaactttttatttccgtgagcgtcctcagctctctcggcatagtactggcagtggtctgtctttcatttaatatttacaatagccatgtgcgttacatacagaacagccaaccaaacttgaacaacttaaccgcagtgggctgtagcctagctcttgccgctgtatttcctctgggactggatggctatcatattgggagaaaccaattcccctttgtatgccaagcaagactctggctattaggtttgggattctcccttgggtacggctctatgtttacaaaaatttggtgggtccacacagtgttcaccaagaaagaagagaagaaagaatggagaaagactcttgaaccatggaagctttatgccaccgttggcctcctcgtcggaatggatgtgctgaccctggctatatggcagatcgtggacccgcttcatcgaacaatcgagaccttcgccaaggaagagcccaaagaggatattgatgtgtctattctcccacagctggagcattgtagctctagaaagatgaatacgtggttggggattttttacggatataaaggtttgctgttgctcctgggcattttcttagcctacgagactaaatcagtgagtactgagaaaattaacgatcaccgcgctgttggcatggcaatctacaatgtcgcggtgctttgcctgataaccgcgcctgtgaccatgattctttcaagccagcaggacgcagcttttgctttcgcctccctcgcaatcgtattttcatcctacatcaccttggttgtgctgtttgtccctaagatgcgcaggcttataaccaggggagagtggcagagtgaagcacaggatactatgaagactggatcaagtaccaacaacaacgaggaggagaaatcccgcctcttagagaaggagaatagggaactggagaagattatagccgagaaagaggagcgggtgagcgagctgcgacatcaacttcaatcgaggcagcaacttcgcagtcggaggcacccgcctaccccccctgagccatccggcggtctgcctcgtgggcctccagaacccccagatcgtctgagttgcgacggttcccgcgtgcacctgctatacaaatag

SEQ ID NO: 11737 - DNA, 2559 bp, Artificial Sequence
  Description of Artificial Sequence: Synthetic coding sequence
atgttgcccacggaggttccacagagccacccaggcccaagcgcccttctgttgttgcagttgctgctccccccaacaagcgccttcttccccaatatctggtctctgttggccgcaccaggttcaataacccatcaggatctgaccgaagaggcagccttaaacgtgaccctgcagctctttctggaacagccaccaccaggacgccctcccctcagactcgaagacttcttagggcgtacactgcttgcggacgatctcttcgcagcttatttcggtccaggatcttctaggagattccgtgcagcacttggagaagtgagcagagccaacgcagcacaggactttctgcccaccagtaggaacgatcccgaccttcacttcgacgcagaacgcctgggacagggcagggccaggttagtgggcgctctgagagagaccgtggtggctgctcgagctctcgaccacaccttagcaaggcaacgcctgggagcagccctccatgctctccaagatttttattcacactccaactgggttgagctgggcgagcagcaaccccatccccatctgttatggcccagacaggagcttcaaaaccttgcccaggttgcagaccctacttgtagcgattgtgaagagttgtcgtgcccgcgaaactggctggggttcacactcctcacctctggatactttgggacacatcctccaaaaccccctgggaaatgcagtcatgggggacacttcgatcgctccagttcacagccccctagagggggtatcaacaaagattcaacatctcccggttttagcccccaccacatgctccacctccaagcagcgaagctcgcactcctggcatctatccaagccttttctctgctcaggagccgtctcggggacagggacttctcacgactgctagacatcacacccgcttcttccttaagctttgttctggacaccaccgggagcatgggcgaggagatcaacgcagccaaaattcaggcccgtcatcttgtcgagcaacgtaggggaagtcccatggagcccgtccattatgtgttggtcccattccatgacccgggattcgggcctgtgttcaccacatctgatcctgactccttttggcagcagcttaatgagatccatgctcttggcggtggagacgaaccagagatgtgtctcagcgcactacagttagctctgctgcacaccccacccctgagcgatatattcgtgttcacagacgcttcgccaaaggatgcgtttctgaccaaccaggtggagagcctgacccaggagcgtcggtgtcgggttactttcctggtgacggaagatacctcccgggtgcagggcagagcaagaagagagatcctttcacccctccgcttcgagccatataaggccgtggctctggctagcggcggtgaggtaatttttaccaaagaccagcacataagggatgtcgccgctatagtaggagagtcaatggccgcactggtaacactgcctctcgacccacccgtggttgtccccggacagccactggtattcagtgtggatggattgttacaaaagataacagtgcgcattcatggtgatatatccagcttctggatcaaaaatccggcaggagtctcacagggccaagaggaaggtggcggaccactggggcatacacggagattcggccaattctggatggttactatggatgatccaccccaaaccgggacatgggaaatacaggtgacagccgaagataccccaggtgtcagagtgcaagcccagactagtctggatttcttgtttcacttcgggatacccatggaagacggaccgcatcccggtctgtaccctcttactcagccagttgccggactgcagacccagctcttagttgaggtcacggggttgggctcgagggccaacccaggagacccacagccccatttctctcatgtgatcctgagaggggtccccgagggagctgagctcggccaggttcctctggagcctgtggggcctcctgaacgtggcctcttagcggcatctcttagccctactctgcttagtacgccacgcccattttctttggagctgattggccaagacgccgctggacgtcggctccacagggccgcacctcagccctccacagtagtccctgtactcctggagctttctggtccttccggcttcctcgccccaggatccaaagttcccctttccctgaggattgcaagcttttctgggccacaggacctcgatctgaggaccttcgtcaatccaagcttcagtctgaccagcaacctgagccgcgctcaccttgaactcaacgagtctgcttggggtaggctgtggttggaggttcctgattccgccgctcccgatagcgtagtcatggtcacagtgacagccggaggtcgggaggctaacccagtccctccaacacacgcctttctccgcttgctcgtgtctgcccctgcacctcaggtgcgaaaccattattttccaagtcaggggccagcacatcatccgtacagactcatctag

SEQ ID NO: 11738 - DNA, 756 bp, Artificial Sequence
  Description of Artificial Sequence: Synthetic coding sequence
atgcctcatttagcctctctttttacagctagctcccggtgctgccctcatcctctccgacctgaaggctctggggctatggggccagaggctctgagtagtctgctgctcctcttacttgtcgcaagtggggatgcagatatgaaaggccattttgatcccgctaaatgccgatacgcgcttgggatgcaagatcggaccattccagactcagatatttctgccagcagtagttggagcgattctactgccgctcgtcacagccgccttgaatccagcgacggcgatggggcatggtgcccagcgggtagtgtgtttcccaaggaagaggaatacctgcaagttgacctccagcgattgcacctggtcgcactagtcggcacacagggaaggcacgctggaggactcggcaaagaattctcaaggtcttatcgtcttagatatagcagggatggacggaggtggatgggctggaaggatcgatgggggcaggaagttatctcaggaaatgaggatccagagggcgtcgtactcaaggatcttgggccacccatggtggcgaggctggtacgcttttatcctcgggcagatcgggtgatgtcagtctgcctgcgcgtagaactctacggatgcctttggcgcggtgagtggttatcattcctcggcatctgcttcctttcaagaggtctggaagggggtgaatgcggcgaatgggcctcgcgcatcccatcacctgcaggaaaactgtcgctgtag

SEQ ID NO: 11739 - DNA, 726 bp, Artificial Sequence
  Description of Artificial Sequence: Synthetic coding sequence
atgaaatttatactcctgtgggcactcctgaacctcactgtcgcgcttgctttcaatcccgactataccgtgtcatccacgcccccttacctcgtgtacttgaaaagtgactacttgccctgtgcaggtgttctgattcaccccctatgggtgattactgcagcccactgcaaccttccaaagctgcgcgtaattctgggggtcacaataccagcagatagcaatgagaagcacctccaagtcatcgggtacgaaaagatgatccaccacccccacttttccgtgacttctattgaccatgatataatgcttatcaaacttaaaaccgaagcggagcttaatgactatgtgaaattggcaaatctcccttatcagaccatatccgaaaacactatgtgctcagtgtcaacttggtcctataacgtgtgtgacatatataaagaaccagactcattgcagacggttaacatcagtgttataagcaagccgcagtgtcgcgatgcgtacaagacatataacataacagaaaatatgctgtgtgtcggaattgtgcccggaagaagacagccatgtaaggaggtgtcagcagcaccagctatctgcaacggaatgcttcagggaatactcagctttgccgacggttgtgtcctccgcgcagacgtgggaatctacgcaaaaatattctattacataccttggattgaaaacgtcatacagaacaattag

SEQ ID NO: 11740 - DNA, 1536 bp, Artificial Sequence
  Description of Artificial Sequence: Synthetic coding sequence
atggccaaaggcctcagcgtacagaatgataagcaccccggatatcaacctgctctcctcctgagtcccggagctcctctgttcgcagatgggccagcgtacgctctgctccatctgcttctccatgaagggaaagcggaaatggcggatcaggccgctgcctggctgaccagacagggctcattccagggagggttccgctccactcaggacacagtgatcgcattggatgctctcagcgcctactggatagcttcacacacaaccgaggagcggggtctaaatgtgactctctcttcaaccggtcgcaacgggtttaagagccacgcactgcagctgaataaccgtcaaatccggggacttgaagaggaacttcagttctcactgggtagcaagatcaacgtgaaagtcggcggtaactctaaaggcaccctgaaggttctgagaacctacaatgtgctcgatatgaagaacacaacctgccaagacttgcagatcgaggttacagttaagggacacgttgagtatactatggaagctaacgaagattatgaagattacgagtatgacgaactacctgctaaggacgaccctgatgctccattgcagcccgttacgcccctccagcttttcgaggggaggagaaaccggagacgtagagaagcacctaaggtcgtggaggagcaagagtcgcgtgtgcactataccgtgtgcatctggaggaatgggaaggtgggtctgtcgggtatggctattgctgacgttaccttgctgtctggattccacgccctccgggctgatcttgaaaagctcacttctctgagcgaccgatatgtcagccactttgagactgagggccctcatgtgctgctatacttcgactctgtacctacgtcgcgagagtgcgtgggtttcgaagcagtgcaagaggtacctgtaggactggtacagccagccagcgctacactctacgactattacaatcctgaaaggcggtgctcagtcttctatggggcaccttcgaaatctcggctcctggcaaccctgtgcagtgccgaagtttgtcagtgtgcggagggtaagtgtcctcggcagcgcagggctctcgagcggggactccaggatgaggacgggtacaggatgaaattcgcttgctattacccacgtgttgaatacggatttcaagtcaaagtcctgcgagaggattccagagcagctttcagactcttcgaaacgaagatcacacaggtccttcactttactaaggatgtaaaggcagccgctaatcagatgcgcaacttcctggtgagggcaagctgccgcctccgtctcgagcctgggaaagagtatctgatcatggggctggacggcgcaacctacgacctggaaggccacccccagtaccttctggattctaattcgtggattgaagaaatgccgagcgagaggctgtgtagatctacccgacagagagccgcttgtgcacaactgaatgacttcttacaggagtacgggacacaaggttgtcaggtttag

SEQ ID NO: 11741 - DNA, 2067 bp, Artificial Sequence
  Description of Artificial Sequence: Synthetic coding sequence
atgttaccgaccgaggtgccgcagtcacacccaggacccagcgctcttctcctacttcagctcctcctcccgcctacaagcgccttctttccaaatatttggtctcttcttgcagccccaggttccatcacacatcaagacctgaccgaggaggctgccttgaacgtaacattgcagcttttcctggagcaaccccctcctggtcggccacctctccgcctggaggattttctggggagaaccttactcgctgacgacctattcgccgcttattttggcccagggtcctccaggcgatttcgcgcagccctcggtgaggtctctagagccaatgccgcacaggactttcttccaacatcaaggaacgatcccgacctgcattttgacgcagagcggctgggccaggggagggcaagacttgtgggcgctttgcgagaaacagtcgtagccgcaagagccctggaccataccctcgctcgccagcggttgggcgctgcccttcatgccttacaggacttctactcacactctaattgggttgagctgggcgagcagcagccacatcctcacctgctgtggcctagacaggaactccaaaacttagcacaggtagcagacccaacatgctccgactgcgaggagctctcttgcccacggaactggctgggcttcactctcttgacatcaggctatttcgggacccaccctcccaaaccaccgggaaaatgttcccacgggggacactttgatagatccagttcccaaccgcctcggggtggcatcaacaaggactccacttcaccagggttctccccacatcacatgttgcatctgcaggccgctaaacttgcactcctcgcttccattcaggcttttagcctcctgcggtcacgccttggtgatagagacttctctaggctcttagacatcaccccagccagctcactgagcttcgtgctggacacaaccggttcgatgggggaggagatcaatgccgcaaagatccaagctagacatctagtcgaacagagacggggatccccaatggagcctgtgcactatgtcctggtcccttttcacgaccccggattcggccctgtgtttaccacgagtgaccctgattctttctggcagcagctaaatgaaatacatgcattaggcggaggtgacgaacccgaaatgtgtctctctgccctgcagctggcgctgcttcatacaccccctctgtcagatatttttgtcttcaccgatgcgtcccctaaagacgcgtttctgacaaatcaggttgaaagcctgacacaggagcgtcgatgccgagtgacctttcttgtgacagaagacacctctcgggttcaaggcagggccaggagagaaattctgtctcctctgcgtttcgaaccatacaaggccgtggccctcgcctctggcggtgaggtgatctttactaaggatcaacacattagagacgtcgccgcaatagtcggtgagagtatggctgccctggtgacattaccactcgacccacccgtggtagtgcctggacagcctctcgtattttcagtggatggtctgctgcagaaaatcacagtgaggatccacggggatatctcttcattctggattaagaatcctgctggggtgtctcaggggcaggaggagggaggaggtcctcttggccacacaaggaggtttggacagttctggatggtgacaatggacgacccacctcagaccggtacctgggaaatccaggtgaccgccgaagatactcctggagtgagggttcaggctcaaacttcactggactttttgtttcattttggcatccctatggaagacggaccccaccccggtctctatcccctgacgcagcctgttgccggattgcagacccagcttcttgtggagtctcagagctgggggtcatctgctgccttcctgccgcgtcaccctagccggggacccagggggtgtcgcactaggccaggcgctttaggtgcacgcggtacctcaggtgcaaggtctccccgtagccttgcagtggcccacgctgctgtccacccctag

SEQ ID NO: 11742 - DNA, 2559 bp, Artificial Sequence
  Description of Artificial Sequence: Synthetic coding sequence
atgctacccacggaagtgccgcaaagccatcctggacccagtgccttactcctgctgcagttattactcccacctacatcagccttttttcccaatatctggtccctgcttgccgctccaggttcaattacgcaccaggatctgaccgaagaagctgccttaaatgtgaccttgcagctctttcttgaacagccaccaccaggcaggcctccgctgcgactcgaagacttcttagggagaacccttttggccgatgacctgttcgccgcttacttcggaccaggcagctctagaaggttccgagctgccctcggggaggtcagcagagccaacgccgctcaggattttttgcctacttctagaaacgatcctgatctccacttcgacgcagagcggctgggccagggccgagccagactggtgggagcccttcgtgagacagtggtcgccgcaagagccctggaccacacactagcacgccagaggctgggtgcagctctgcacgcactccaggatttctattctcactcaaattgggtcgaactgggcgaacagcagccccatcctcacctcttatggccaagacaagaactccaaaatcttgcacaggtagctgaccctacttgctcagactgtgaagagctgtcatgtccaaggaactggctggggttcactctattgacaagcggttacttcgggacccaccccccaaaaccacccggaaaatgtagccacggcggtcatttcgataggagctccagccagccaccccgtggcggaatcaacaaggatagtacctcccccggattcagccctcatcacatgctccatttacaggcagctaagcttgctttgctcgcctctatccaggcattttccctattacgcagcagactcggggatcgggacttcagtcggcttctggatataactccagcttccagcttgtctttcgtgctggatacaacaggaagcatgggagaagaaattaacgctgccaaaatccaggccaggcaccttgtggagcagcgccgaggttcccccatggagcccgtgcattacgtgctcgtgcctttccatgatcccggatttggccctgtattcactacttctgaccccgattctttctggcagcagttaaacgagatccatgctttaggcggtggggacgaacccgagatgtgtttgagcgcacttcagctggcactgctccacaccccccctctgtctgacatctttgtgtttacagatgcctctcccaaggacgccttccttaccaaccaggtggagtccctgacgcaagaacgaaggtgccgggtgacattcctggttaccgaggacacctctcgggttcaagggagagccaggcgggagattcttagtccattacgtttcgagccgtacaaagctgtggccctggcctccgggggtgaagtgatcttcactaaagatcaacacatcagagacgttgccgcaatcgttggagaatctatggcagctcttgttactctgcccttggatcctcctgtcgtggtgccaggacaaccattggtgttcagcgtagacggtcttctgcaaaagattacagtgcgcatccacggcgatatatcttccttctggataaagaacccagccggagtctcacagggtcaggaagagggcggaggtcccctgggccatacccgtaggttcggacagttctggatggttacaatggacgacccaccccaaacaggcacctgggaaattcaggtgacagcagaagatacgccaggtgttcgggttcaagcccagactagtttggacttcctttttcactttggaataccaatggaagacggcccacatcccggattatatcctctgacgcagcctgtggccggactgcagacccaactcctggtggaggttactgggctgggtagccgagcgaatccaggggacccccaaccacattttagccatgtgatactcaggggtgtgccggagggtgccgagctcggccaagtgccgttggagcccgtcggccctcccgaacgtggactgcttgcggcaagcctctcacctacccttttatctacaccccgacccttttctctggagctgatcggacaagacgccgcagggagacgcttacacagggccgctcctcagccctctacagttgtgcctgtgctgctcgagctgtcagggccaagcggctttttggcccctggttctaaggtgccactcagcctacgaatcgcatccttcagtggtccacaggatctcgaccttcgcactttcgtgaacccctctttcagcctgacaagcaacctgagtagagcccatctcgagctgaacgaaagtgcatggggcaggctgtggctggaagtgccagacagcgccgctccggactcagtagtgatggtcacagtgacagccggaggacgcgaagctaaccccgtacctcctacacacgcctttctgcgcctgctagtttctgccccagctcctcaggtgcggaaccactacttcccatcccagggacctgctcaccatccctacagacttatttag

SEQ ID NO: 11743 - DNA, 1737 bp, Artificial Sequence
  Description of Artificial Sequence: Synthetic coding sequence
atgcttcttctgcttcttttagccccactctttttgagaccacccggagcgggaggcgcacagacgcctaacgctacttcagaaggatgccaaatcatacatcccccatgggaaggcggtatcaggtataggggtttgacaagggaccaggtgaaagccataaattttctcccagtcgactacgaaatcgaatacgtgtgtagaggggagcgcgaggttgttggccctaaagtcagaaagtgcctcgccaacggaagctggaccgacatggatactcctagccggtgcgtgaggatctgctccaaatcttacttaaccctggagaacgggaaagtctttctgaccggaggggatctgcctgcccttgatggggcacgggtggacttcagatgcgatccagacttccacctggtcggctcgtcccggtccatttgttctcaggggcagtggagcacccccaagccgcattgtcaggtgaatcgcacccctcactcagagaggagggccgtgtacatcggtgcgctcttcccaatgagtggcggttggccaggaggtcaggcctgccagccggctgtggagatggctttggaggacgtcaacagcagaagggacatcctccccgattatgaattgaagctgattcaccacgattccaaatgcgaccccggtcaggctaccaagtacctgtacgagctcctctacaacgatccaattaaaattatcttaatgccagggtgtagctctgtgagcactttggtggcagaggctgcacggatgtggaacctaatcgtgcttagttacggttccagctcaccagcgttgtctaacagacagagatttcctaccttcttccgcacacatccatctgcaacactgcataaccctacccgagtaaagttattcgagaaatggggatggaaaaaaatcgcgacaatacagcagacgaccgaggtatttactagtacactcgacgacctggaggagcgggtgaaggaggctggcattgagatcactttccggcagagttttttttcggacccagccgtacccgtgaaaaacctgaaacgccaggatgccagaatcattgtggggcttttttacgagactgaagcgaggaaggtattttgcgaagtgtacaaggagagattattcggcaagaagtacgtctggtttctgatcgggtggtacgcggacaactggtttaaaatctacgacccctcaatcaattgcactgtggacgagatgacagaggccgttgaggggcacatcactactgaaatcgtgatgctgaatcctgccaacacccgttccatttccaatatgacgtcccaggagttcgttgagaagctgaccaaaaggctgaagcgccacccggaggagactggaggctttcaagaggcgccactggcctacgacgccatttgggccctggcccttgcgctcaacaagacaagtggcggaggcggtcgaagcggtgtgcgtctggaagacttcaattacaataatcagacaatcaccgaccagatatacagggcaatgaactcctcatcttttgaaggcgtctctggacatgttgtgttcgatgcatcggggtctcgaatggcctggacactgatcgagcaactccaaggaggttcctacaaaaagatagggtactacgattcaactaaggacgacctcagttggagtaagaccgataagtggatcgtgatcagcaggacacattctcctacctag

SEQ ID NO: 11744 - DNA, 1326 bp, Artificial Sequence
  Description of Artificial Sequence: Synthetic coding sequence
atggagttcgagtttgataggctgcgcgcttttcaggccatgcaggtccattgtaacaatatgcacaccctgggcgctcggctccctgggggtgtggagtgccgattcagacgcggaccagctatggcgtgggaaggagagccaatgcggcataacctgggcggaaaccttggggaccccagggccagagctgtctctgtccctttggggggtagagtggcacggttccttcagtgtaggttcctgttcgccggtccatggctgctgttcagcgagatctcatttatttctgacgtggttaataattcgtctcccgcactggggggaacttttcctcccgcaccatggtggcctcccggacccccacctactaatttcagtagcctggaactggaacccagaggtcaacagcccgtggcaaaggctgagggctctcctacagccatcctcataggctgtctggtggcaattatattgctcttgctgctaatcatcgcacttatgctgtggcggctgcactggagacgcctcctgtctaaagtgttggaatcccaccccagaacccggtcccccggactggtcgggatcaggcccacacccctgcccgtttctccaatggccttgaggtgttgctctcccattcagcccactgcttcattttggccactcacaccagttccattagaggccagggcccctccccatcctcccggaccaaacccccctacacctcgcggagtgactgggggaaacacctacgccgtgccggcactcccccctggagccgtgggcgatgggcctcccagggtggacttcccgagatcccggctgcggtttaaagagaaactgggggagggccagttcggcgaggtccatctgtgcgaagtggactcccctcaggacttggtcagcctggatttcccgctcaatgtgcgcaaaggacacccactcctggtcgccgtgaaaatcctgaggcctgatgccacgaagaacgccagaaacgactttttgaaggaggtaaagataatgtcacgcctgaaagacccgaatattattcgcctactgggcgtctgcgttcaggatgaccctctctgcatgatcacggattacatggaaaacggggatctgaatcagtttctctccgctcaccagctggaagataaagccgctgaaggcgctcccggtgacgggcaggccgcacagggaccaactatcagttacccgatgctgctccatgtggctgctcaaattgcttcaggcatgcgctatctagccacactcaatttcgttcacttttggggcgagagacaccggttccttcattag

SEQ ID NO: 11745 - DNA, 2685 bp, Artificial Sequence
  Description of Artificial Sequence: Synthetic coding sequence
atgtccttgccgaggtgttgcccacaccccctaagaccagaaggctccggagccatgggtccagaggcactgagtagcctcttgcttcttctgctggtggcgagcggcgacgctgatatgaaaggacactttgacccagccaagtgtagatacgccctgggcatgcaagacaggacaattcctgattccgacatctcagcatcatcttcctggagcgatagcacagctgccaggcattcccgactggagtctagtgacggcgacggagcttggtgtcccgcagggtctgttttcccgaaagaggaggagtatttgcaggtcgatctgcagaggttgcatctggtggcactagtgggtacacaggggaggcatgccggtggactgggcaaggaattctcccgctcatacagactccgctattcccgggacggccgtcgatggatggggtggaaggatcgatggggacaggaagtgatctctggcaatgaggatcctgaaggcgtcgtgcttaaagacttgggacccccaatggtggcccgtctggtgcgcttctaccccagagctgaccgggtaatgagtgtgtgtttaagagtagagctctatgggtgcctctggcgcgatggactgcttagctatacggcacccgtcggacaaacaatgtatctttccgaagctgtttacttgaatgatagtacatacgacgggcataccgtaggcggactgcagtatggcggtctgggacagctagccgacggcgtcgtgggccttgacgatttcaggaagtcgcaagaactgcgcgtgtggccaggttatgattatgttgggtggtcaaaccacagtttttcttccggttatgtcgagatggagttcgaattcgacaggctccgggcattccaggctatgcaagtccattgcaacaatatgcatactctcggcgcacggctacctgggggtgtggaatgcaggttccggagaggccctgccatggcctgggaaggggaaccgatgagacacaacctggggggaaacttgggcgatcccagggctagagctgtttccgttccgctggggggtagggtcgcgaggtttttgcaatgccgttttctgtttgctggtccttggttactgttctcagagataagttttatcagcgacgttgtgaataattcctccccagctctcggtggtactttccctccagctccatggtggccaccaggacccccaccaaccaacttttcctccctcgagctggagccgaggggacagcagcctgtggccaaagctgaagggtcacctacagctatacttattggatgtttggtggctatcatcctgttgttactgttgataatcgccttaatgctctggcgccttcactggaggcgattgcttagcaaagccgagcgaagagttctcgaagaagaactgaccgtacatttgtctgtcccaggggatacaatcttgattaataatcgtcccggacccagagaaccacccccttaccaggagcctaggccgagaggcaaccctccacatagcgctccttgtgtccccaatggttcagcctatagtggcgactacatggagcccgaaaagcctggggctccccttctgcctccaccaccccagaactcagttccacactatgccgaggcagacattgtgacgctgcagggagtcaccggagggaatacctatgctgtgcccgctctccccccaggagcagttggggatggaccccctcgagtcgattttccacggagccgactaaggttcaaggagaaactgggggaaggtcagtttggtgaagtgcatctttgcgaagtggacagcccccaggacctggttagtttggactttcccctcaatgtaaggaaaggacatccattgttagttgccgtgaaaatcctgcgccctgacgctacaaagaatgctcgtaacgatttcctcaaggaagtgaaaatcatgtcaagacttaaggatcccaatataatcagactgctgggtgtctgcgttcaagacgaccccttatgcatgataactgactatatggaaaacggagacctcaatcagttcctctccgcccatcagctcgaagataaagctgcagagggcgctcctggcgatggccaagctgcccaaggcccaactatttcctaccccatgttgctgcacgtggccgcacaaatagcttctgggatgaggtacctcgccacactaaactttgtgcaccgggacctcgcgaccaggaactgtctggtgggggagaacttcactatcaaaatcgcagacttcggtatgtctcggaacttatacgcaggtgactattatcgagtacaggggagggccgtcctgccaatccggtggatggcgtgggagtgcatccttatggggaaattcaccaccgccagcgacgtctgggcattcggagtgacactgtgggaagtgttgatgctgtgcagggcacagccattcgggcagctcaccgatgagcaagtcattgagaatgctggagagttctttcgcgaccaaggcagacaggtgtacttatcaagaccaccagcatgtccccagggactgtacgaactgatgcttagatgctggagcagggaatcagaacagcggcctccgtttagtcagctccatagattcctcgctgaggacgcattgaatacagtgtag

SEQ ID NO: 11746 - DNA, 216 bp, Artificial Sequence
  Description of Artificial Sequence: Synthetic coding sequence
atgcccgctggggttcccatgtctacttacctcaagatgttcgccgcatctctcctggccatgtgcgccggagccgaggtagtgcacagatactaccggcctgatcttacaatcccagaaatccctcccaaacggggtgagctgaagacagagttattgggccttaaagaaaggaaacacaagccccaggttagccaacaagaagagcttaagtag

SEQ ID NO: 11747 - DNA, 2760 bp, Artificial Sequence
  Description of Artificial Sequence: Synthetic coding sequence
atggggcctgaagcgctatctagtttattactcctccttttggttgcttctggggatgcagatatgaaaggccattttgatccggctaagtgcagatacgctcttgggatgcaggaccgaacaatacctgatagcgatatatctgcatcttcgtcctggtctgattccactgccgcaaggcactctcgattggagagcagtgacggcgatggagcttggtgccctgcgggtagcgtgtttccgaaagaggaggagtatctgcaagttgatcttcaaaggctgcatttagtagcccttgtaggaacacagggaagacacgccggtggacttggaaaggaattctcccgttcctatcggctcagatattcccgggatgggaggcggtggatgggctggaaagaccggtggggccaagaggtgatttctggcaacgaggacccagagggagtggtgctgaaagacttagggccacctatggtggccagattagtgcggttctaccctagggcagacagagttatgagtgtctgcctcagggtggagctgtacggatgtctgtggcgggatggcctcctgtcttataccgctcctgtcggccaaaccatgtacctgtccgaggccgtgtacctgaatgattcgacatacgatggacacaccgtcggcggacttcagtatggcggactgggtcaactagccgatggggttgtgggtttggacgactttcggaagagccaggaactgcgggtctggcctgggtacgactacgtgggttggagtaatcatagcttcagctctggatacgttgaaatggagtttgaattcgatcgtctacgggcttttcaggccatgcaggtacattgtaacaatatgcatactctcggcgctcggttgccaggtggtgtggaatgtagatttagaagaggcccagccatggcatgggagggcgaaccaatgaggcacaacctgggaggtaacctgggggatcctagagctcgtgctgttagcgtgccactgggagggcgtgtcgccaggttcctccagtgcagattcctgttcgctggtccgtggctcctgttttccgagatcagtttcatctcagatgttgtgaacaatagtagtccagctctgggaggtaccttccccccagcgccatggtggcctcccggtcctccacccaccaacttcagttcgctagaactcgagccccgaggacagcaacccgtcgctaaggcagagggctcccccaccgccattcttattgggtgcctggttgccatcattctgcttctgctgttaatcatagcactgatgctgtggcgccttcactggcgtagacttctctctaaggcggaacgtcgcgtgctggaagaagagctcacagtccacctgagcgtgcctggcgacacgattctcatcaacaacaggccaggcccaagggagccccctccataccaggagcctcggcctagaggcaacccaccacactcggcaccctgcgtgccgaatggttccgccctgctactatcaaacccagcctaccgactgcttctggcgacatacgctcgtcccccacggggaccaggacctcccacccctgcctgggccaagcccacaaacacacaagcctactcaggggactatatggagcccgaaaagccaggggctcccctgctcccgcctcctccacagaattcagtgccgcactatgcggaggcagatattgtgaccctgcagggggtaactggcggtaacacatacgccgtccccgcactgccaccaggagcggtgggagacggacccccaagagtggactttcctcgttctcgcctgcggtttaaggaaaaactgggggagggtcagttcggggaggtgcacctctgtgaggtcgactctccacaggacttagtttcattagacttcccactgaacgtacggaaagggcatccactgcttgtcgccgtgaagattctgcgcccagatgcgacaaagaatgcctctttttctctgttcagtcggaacgactttctaaaagaggtcaaaatcatgagcagactgaaggacccgaacattattcgcctgctcggagtttgcgtccaagatgacccattgtgtatgattaccgattatatggaaaacggtgatctgaaccagtttctcagcgcccaccagctagaggacaaggccgcagaaggtgcacctggtgacggccaggcagcccagggtccgaccattagctatcccatgttgctgcacgtggccgcacagatcgcctcaggcatgcggtacctggcaactctcaacttcgtgcatcgcgatctggctaccaggaactgtctggttggcgagaacttcactatcaagattgccgacttcggtatgtccagaaacttgtacgcgggtgattactaccgggtgcaggggcgagccgtcttgccgatccgctggatggcctgggagtgtattttgatgggcaaattcacgactgcatctgacgtatgggccttcggcgttacattgtgggaggtgctaatgctctgcagagcccagcccttcggtcagcttactgatgagcaagtgattgagaatgctggcgagttctttcgagatcaaggacgccaggtgtacttatcccgacctcccgcttgtccacagggcctgtatgagctgatgctgcggtgttggagcagagagagcgagcaacgtcccccttttagccagctgcacagattcctggctgaagacgccttaaacacagtatag

SEQ ID NO: 11748 - DNA, 447 bp, Artificial Sequence
  Description of Artificial Sequence: Synthetic coding sequence
atgcagacctttcctgtggcaggcgctttggacccggctatactggatacatcaagtccacaggcactgtacaccgtcctcctaattgtgctggtcatgatgtctctagtgttcggtaaattcgtgcccgttaattgggagcctccacagcccctgcccttccctaaatacctgagatgctataggtgtctgctcgagaccaaagagctaggttgcctgctggggagcgatatttgtcttacaccagctggcagctcctgtattacactacacaaaaagaacagcagcgggtcagatgtaatggtatctgactgtagatctaaagagcagatgagcgattgtagtaacaccagaacaagccccgtgtctggcttctggattttctcacagtattgttttctagacttttgtaatgaccctcagaatcgcggtctgtacactccttag

SEQ ID NO: 11749 - DNA, 5097 bp, Artificial Sequence
  Description of Artificial Sequence: Synthetic coding sequence
atgagactgctgtggggcctgatctgggctagctctttctttaccctgagcctgcagaaacctcgcctcctcctgtttagcccaagtgtggtgcaccttggagtccctcttagtgtgggcgtccagctgcaggatgttcctcgcggtcaggtagtgaaagggagtgtcttcctcagaaacccatcgaggaacaatgtcccgtgctcaccaaaggtggatttcacgctgagtagcgagcgggattttgccctgctcagcctgcaggttcctcttaaggacgctaagagttgcggcttgcaccagctactccgcggaccagaggtgcagctggttgcccattcaccatggttaaaagacagtctgtcccggacaacgaacatacaaggcataaacctgttatttagcagccggagaggccacctgtttctccaaactgatcaaccgatttataatcccggtcagcgggtgcgttaccgagtctttgcgctggatcagaagatgagaccgtccacagatactattaccgttatggtcgagaactcccatgggcttcgcgtccgtaagaaggaagtgtatatgccctcttccatctttcaggacgactttgttatacccgacatttcagagccaggtacatggaaaatttctgcccgattcagcgatgggctcgagtctaactccagtacccagtttgaagtcaagaagtacgtgctgcctaatttcgaagtgaagatcactcccggaaagccctatatcttgacggtgcccggtcacctggacgagatgcagcttgacatccaagccagatacatttatggaaaaccagtgcagggtgttgcctacgtccgctttggcctattagatgaggacggcaagaagacattctttcgcggactcgagtcccagactaaattggtcaacggacaaagtcacattagcctgtccaaggcagaatttcaggacgccctggagaagctgaacatgggcattactgacttgcaaggcttgcggctgtacgtagcagcggcaattatcgaatacccgggtggggaaatggaagaagctgaactgaccagctggtacttcgtgtctagtcctttcagcctggacctgtcgaaaaccaagcgccatttggtccctggtgccccttttcttctacaggccctagttagggaaatgtccggttctcctgcttctggcattcctgtaaaagtctcagcgacggttagttctccaggcagcgtgcccgaagtccaggatattcagcaaaatacggacggctccgggcaggtgtcgataccaattatcatcccccagacaatatcagagctgcaattgagcgtgagtgcgggaagtcctcatccagcaatcgcgcgactcactgttgcagccccacctagtggaggtccaggcttcttgagcatcgagcggcctgactcccggccacctcgcgtcggcgatactttaaaccttaatctgcgcgcagttggttcgggtgcgacattttcacactattactacatgattttgtctagaggccagatcgtgttcatgaacagagagcccaaacgcactctgactagcgtgtctgtgttcgtggaccatcacctagctccatcattctacttcgttgccttctattatcacggcgaccatcccgttgccaatagtctgagggtcgatgtgcaggccggagcttgtgagggtaagctggagttgtccgtagacggcgctaaacagtaccggaacggcgagagtgtcaaattacacctcgaaaccgactcactcgcactcgttgcattgggcgcactggatacagctctttacgccgcaggctcaaagagccacaagccactgaacatgggaaaagtgtttgaggcaatgaactcctacgatctcggttgtggtcccggaggcggagattctgcactgcaggtgtttcaggctgcaggcctcgccttctccgacggggaccagtggactctgtcacgcaaaagactcagttgcccaaaagaaaaaacaactcgcaagaagcgaaacgtcaattttcagaaagctattaatgaaaaattagggcagtacgctagtcctacagcaaaacggtgctgtcaggacggggtgaccaggttgcctatgatgcggtcctgcgagcaaagggcagcgagagtccagcagccggactgtcgggagccttttctgtcatgttgccagtttgctgaaagcctgcgtaagaaaagcagagacaaaggccaagctggattgcagcgcgcactcgagattctacaggaagaagatctgattgatgaagacgatatacccgtcagatcgttctttccagaaaattggttgtggcgtgtcgagactgtcgacaggttccagatcctcacactgtggttgcccgactctctcacgacatgggagattcacggcctctctttgtcaaaaaccaaaggcctttgcgttgcgactccggtacagctgcgggtcttccgagaatttcacctccacctaagactccctatgtctgtgcggaggttcgaacaactcgagctgcggcctgtgctgtacaattacctagacaagaatctgactgtgagtgtccacgtttcaccagtagaagggctgtgtctagctggcggaggcggactggcgcaacaagtgctggttccagccggttccgctcgccctgtcgccttttcagtggtaccaacagccgcagctgccgtgagtctcaaagtggttgccagagggtcttttgaattccccgtgggcgacgccgtctctaaggttttacaaattgagaaggaaggtgcaattcacagagaagaactggtatatgagctgaatcctctagatcacagaggcaggacactggaaattccaggcaatagtgaccccaacatgattccggacggtgatttcaactcctacgtacgcgtcactgcttccgaccctttggacactctgggttccgagggggcattgagtcctggcggagtggcctccttactgcgcctccccagggggtgtggggagcagaccatgatttatctggcacctactctcgccgcatccaggtatctggataagaccgagcaatggagcactctgccacccgagacaaaggatcatgccgtcgatctgattcagaagggctatatgcgcattcagcagtttaggaaggctgacggtagctatgccgcttggctgtcgcgcggatccagcacatggttgacagcgtttgttctgaaggtgttgtcactggcccaggagcaagtgggaggctcgcctgaaaagttacaggaaacgagcaattggcttttaagccagcaacaggccgacgggtcctttcaggacctatcaccagtgatccatagatccatgcagggaggactggtggggaatgacgaaaccgtcgccctaacggcattcgtgaccatcgccttacaccacggattggccgtgttccaagatgaaggagctgagccattaaagcagcgggtggaggcctcaataagcaaggcatcctcctttctgggggagaaagcttccgcagggctgctgggcgcacacgccgctgctatcactgcatacgccctcactttgactaaggccccagccgacttacggggagtagcacacaacaatctcatggccatggcacaggagacaggggacaacttatactggggctctgttacggggtcccaatccaacgccgtgagccccactcccgctcctagaaacccctccgatccaatgcctcaggcgcctgcactgtggattgagactaccgcttacgctctactgcatctgctgttgcatgagggaaaggctgaaatggctgaccaggctgccgcatggctgactcgccaaggctcgttccaggggggatttagatccacgcaagatacggtcatagcgctggacgcactctcagcatactggattgcgagccatactactgaagaacgcggtcttaatgtcacgctctcatcgacagggagaaatggatttaagtcacatgccctgcagctcaacaataggcagatcagagggctggaagaagaactgcagttctccctgggctctaaaatcaatgtcaaggtagggggaaactccaagggaactctgaaggtacttcggacctacaacgttctggacatgaagaatacaacctgtcaagacttgcagatcgaggtgacagtcaaaggacatgtcgaatatactatggaagcaaatgaggactatgaggactacgagtatgatgaactgcccgctaaagatgatccagacgctccattgcagcccgttacccccttacagctcttcgagggacgacggaaccgtaggcggagggaagcacctaaactaacttcactgtccgatagatacgtgtcccactttgagaccgagggccctcacgttctgctgtatttcgattccgtcccaactagccgagagtgcgtaggttttgaggctgtgcaagaggtgcctgtgggtctggtgcagccggcttcagctaccctgtatgactactataaccctgagcgacgttgctccgttttctatggagctccctcaaagagcagactgctggccaccctctgttctgccgaagtgtgccagtgtgctgaagggaagtgccccagacagcgccgagcattggagagaggtttacaagatgaagatgggtacagaatgaagttcgcctgctattacccaagggtcgagtatggctttcaggtgaaggtgctgagggaagactcacgcgcagccttcagactgttcgagaccaagattactcaagtactgcattttaccaaggacgttaaggccgcagccaatcagatgcgaaatttcttagttcgcgcttcatgccggctgcggctggagcccggaaaagaatatttaataatgggactggatggcgcaacatatgacctagaggggcatccacagtacctcttagactctaactcatggatagaggaaatgcctagcgaacgtctctgtagatcgacacgtcagcgggcagcatgcgcacagctgaacgacttcttgcaggaatacggcacccaaggatgccaggtgtag

SEQ ID NO: 11750 - DNA, 1986 bp, Artificial Sequence
  Description of Artificial Sequence: Synthetic coding sequence
atggacttagttcttaagaggtgtctgcttcatttggccgtcatcggggcactcctggctgtgggcgctacaaaggtccccaggaaccaagactggctgggcgtgtccagacagcttcggacgaaagcatggaacagacagctctaccctgagtggacggaggcacaacgattggactgctggagggggggtcaggtgtcccttaaggtctcaaatgatggaccaacactgattggtgctaacgctagctttagtatcgcactcaattttccagggtcccaaaaagtgttgcccgatggacaggtgatttgggtcaacaacacaataatcaacggctcccaggtgtggggaggccagcctgtatacccacaagagacagacgatgcatgcatcttccccgacggcggaccctgtccatcaggcagctggtctcagaagcgctcatttgtatacgtgtggaaaacttgggggcagtattggcaggtgctcggagggccagtgtccggattatccattggcacaggccgtgcaatgcttggcactcacacgatggaggtgacggtctatcatagacgcggtagtaggagctatgtccctcttgcccacagttccagcgcattcaccattactgaccaggttcccttctcagtctctgtatcccagttacgggcactggatggaggcaataaacattttctgaggaatcagccattaactttcgccctgcagctgcatgatccctctggatatctcgccgaggccgatcttagttatacctgggacttcggcgactcctccggaactctgatatcacgggcattggtcgtcactcatacgtatctggagcccggacccgtaacggcgcaggttgtgctgcaggctgcaattccccttaccagttgcggaagcagccccgtacctggaacaaccgatggacataggccaaccgcggaagccccaaatacaaccgcaggacaagtccctacaactgaagtggtgggaactacacctgggcaggcgccaacagctgaacctagtggtacaacatccgtgcaggtgccaaccaccgaagtcattagtacggcgcctgttcagatgcctacagcagagtccaccgggatgacaccggaaaaagtccccgtgagcgaagtcatgggcacaactctggccgaaatgtccacccccgaggcaacaggcatgaccccggcagaagtttcaattgtggtcctgagtggcactacagccgcacaggtgacaactaccgagtgggtggagaccacggctagagaattaccaatccccgagccagaaggccctgatgccagcagtattatgtcaacagaaagcatcactgggtcattgggtccactactggacggaaccgcaacactccggttagttaaacgtcaggtgcccctggattgtgtattatacaggtacggatcgtttagcgtgaccttggacatcgtccagggaatcgaaagcgctgaaatcctgcaggccgtgccatcaggggaaggtgatgcttttgagcttacagtctcatgccagggaggcttacccaaagaagcctgcatggagatttcctctccaggctgccagcctcctgcccagcggctgtgccagccagtcctgcccagccctgcatgtcaattggtgttgcatcagattctaaaggggggatctggcacctactgcctgaatgtatctcttgccgataccaactcactggctgttgtgagcacccagttaataatgcctggacaggaggccggactcggccaggtacccctgatcgttggcattctgctggtattgatggcagtcgttctcgcttccctcatctatcgacgcagactcatgaaacaggatttcagtgtgccccagctgccacactcttcctcccactggcttagactcccaagaattttctgctcttgtccaattggagagaacagtccactgcttagcggccagcaggtttag

SEQ ID NO: 11751 - DNA, 516 bp, Artificial Sequence
  Description of Artificial Sequence: Synthetic coding sequence
atgcgccacaacctgggaggcaatctcggggatcctcgcgcaagggctgtttctgtgcccctgggaggtagagttgccagattcttacagtgtagatttctgttcgcaggcccttggcttctgttcagtgaaatctcctttataagcgacgtcgtgaataactcctcaccagccttaggtggtactttcccacctgcgccttggtggccgccaggccctccccctaccaatttctcctcgctggagttggagccacgcggacaacagccagttgccaaagcagaagggagcccaacagcgattcttattggctgtctggtcgccattattctgctgcttctgcttattatcgctcttatgctgtggagactccactggcgccgactgctttcaaaggtcctcgaatctcaccctcggactcgaagcccaggactcgttggaatcaggcccacccccctccctgtctccccgatggctctggtgcacctatgcgaagtggattcaccccaagactag

SEQ ID NO: 11752 - DNA, 1986 bp, Artificial Sequence
  Description of Artificial Sequence: Synthetic coding sequence
atggacctggttctgaaacggtgcctgctccatctggccgttataggtgccctgctggctgtgggggctaccaaggtgccacggaatcaggactggctgggggtctctcgccagctgcgcacaaaggcgtggaatcgccagctctacccagagtggaccgaggctcaacgcctggattgttggcggggagggcaggtgtcactgaaagtctcaaatgatgggcctactctaatcggggctaacgcttctttttcaattgcattgaatttccctggctctcaaaaggtgttgcccgatgggcaggtgatttgggtgaacaacactatcataaatggcagtcaggtgtggggtggccagccagtttacccacaagaaaccgatgatgcttgcatctttcccgatggagggccttgtccaagcgggtcttggtcccagaagagatcctttgtctacgtctggaagacctgggggcagtattggcaggtcctgggtggaccggtatcaggtctttccatcggaaccggaagagccatgctgggcacacacaccatggaagtcacggtctaccaccggcgaggctccagaagctatgtgcctttggcgcactcatcctctgcctttacaattacagatcaggtgcccttcagcgttagcgtttcccagctgcgcgctctcgacggaggcaacaagcactttctgcgcaaccagccactgactttcgctctccagctacatgatccgtccggctatttagccgaagccgatctatcgtatacctgggatttcggagactctagtggaacactgatatctcgtgcccttgtggttacacatacctatctggagcctggtcccgtcactgcccaagtggtgttgcaagcggcaatacctctgactagttgtggaagctcacccgtccccggaaccaccgacggacatcgacctacagccgaagcacctaatacgacggctggacaggtcccaaccaccgaagtggtaggcaccacccctgggcaagctccaaccgcggaaccgagcggcacgacatccgtgcaggtgcccaccaccgaggtcatctccacagcccctgttcagatgcctactgcggagtcaacaggcatgaccccagaaaaagttcccgtctcggaggtcatgggtacaacgttggcagaaatgtcaactccagaagcaacgggaatgacacccgcagaggtgagtatcgtcgtgctctctggcacaacagcagctcaagtgactaccaccgagtgggttgagacaacggccagggagctccccattccagagccagaagggcctgacgcgtcgtccataatgagcacggagtctatcacaggtagcctggggcctctgcttgacggcacagcgacactgaggcttgtcaaacgacaggtccccttagactgcgtcctgtatcgatacggatcattcagtgttacattagacatcgttcaggggatcgaatccgctgagattctgcaggcagtgccgagcggcgaaggtgacgcatttgaactgacggtctcatgtcagggaggcctgccaaaggaggcctgcatggagatttccagccctggatgccagccgcctgcccagcgcttatgccagcctgtgctgcccagccccgcttgtcagttggtgttacatcagatcctcaagggcggatctggtacctactgtctgaacgtgtctctagctgataccaactccctggccgttgtaagcacccaactcatcatgcctggccaggaagctggactggggcaggtccccctcattgttggtatcctcctggtgctgatggctgttgtgttggcgtctctgatctatcggaggcggctaatgaaacaggacttcagtgttccacagctgcctcatagctctagtcactggctgaggctgccaagaattttttgcagctgtccaataggcgagaactcgcccctcttgtcagggcagcaggtttag

SEQ ID NO: 11753 - DNA, 1737 bp, Artificial Sequence
  Description of Artificial Sequence: Synthetic coding sequence
atgttactccttctcctacttgcccctctcttccttcgacctccaggagctggtggcgctcaaaccccaaatgctactagcgaagggtgtcagatcatacatcctccttgggagggcggaattaggtatcggggtctgacccgtgaccaggtcaaggcgattaatttcctgccggtggactacgaaattgaatatgtttgtaggggggaacgcgaagtagtgggacctaaagtgcgtaaatgtctagcaaatggctcttggaccgatatggatacgccatctcgttgcgtgaggatttgcagtaagtcttacctcaccctggagaacggcaaggtcttccttaccggcggtgacctccctgcccttgacggggctagagttgattttaggtgcgaccctgatttccacctcgtaggcagcagtcgcagcatctgctctcagggccagtggtctacacccaaaccacactgtcaggtgaacagaaccccccatagcgaacgccgtgcagtttacatcggagcccttttcccgatgtcaggcggttggccgggaggacaggcctgtcagccagccgtggagatggccttagaagatgtaaattcccgacgagatatactgcctgattatgagctaaagctgatacaccatgattctaaatgcgaccctggacaggccaccaagtacctatatgagctcctctataatgacccgattaagatcatactaatgccaggatgttcaagtgtatccactcttgtagccgaagccgcacggatgtggaacctaatagtgttatcttatggctcttcctccccggctctaagcaacagacagagatttcctacgttctttagaacacacccatctgcaacacttcacaaccccactcgtgtgaaactgttcgagaagtggggttggaaaaaaatcgcaaccattcagcagacaacggaagtttttacgagcacacttgatgatctagaggagagagtgaaggaagcgggtatcgagatcacattccgtcagtcctttttctccgacccggcagtgccagttaaaaacctgaagcgccaggacgctagaattattgtgggactgttttacgaaacggaggctagaaaggtcttctgcgaagtttataaggagcggctcttcgggaagaagtacgtctggttccttatcggctggtatgctgataactggttcaagatctacgatcccagcataaactgtacggtggatgaaatgactgaagcagttgagggacacattactaccgagattgtgatgctgaatccagcgaacaccagaagcatcagcaatatgacatcccaggaattcgttgaaaagctgacaaagcgcttgaagcggcatcctgaagaaaccggcggatttcaggaagcccctcttgcctacgacgcaatctgggcgctcgcactcgccctgaataaaacttctggagggggaggaagaagtggggtcagactggaggacttcaactataacaaccaaacaatcaccgaccagatctatagggccatgaattcgtcctctttcgaaggagtgagcggccacgtcgtgttcgacgcatcaggctcccgcatggcctggaccctcatcgagcagttgcagggcggatcgtacaagaagataggttattacgattctaccaaagatgacttgtcctggagcaagaccgacaaatggatcgtcatttctcggactcacagccctacttag

SEQ ID NO: 11754 - DNA, 1326 bp, Artificial Sequence
  Description of Artificial Sequence: Synthetic coding sequence
atggaatttgaattcgacagactgcgcgcattccaagcaatgcaagtgcattgcaacaacatgcacacactgggagctaggttgcccggtggggtggaatgcagattccgaaggggccctgccatggcatgggaaggagagcctatgcggcataatttaggcggaaatttgggcgacccgagagcgagggctgtctctgtgccactaggcggacgggtggcaaggttcctgcagtgccggttcctgttcgccggtccgtggctgcttttttctgaaatctcctttatctccgacgtcgtgaacaattcatccccggcactgggcggtaccttccctcctgccccatggtggcctcccggtcccccacccactaacttcagctctctcgagctggagccgagagggcagcaacccgtggctaaagccgaaggaagccccaccgctatcctgatcgggtgtctggtggccataatactcctccttttgctcatcatcgccctgatgctgtggcgactgcactggagacgcctcctttctaaggtgttggaatcacatcctaggacccgcagcccgggattagttggaatccgtccgacgccgctgccagtttcacctatggctttgcggtgctgcagcccgatccaaccgaccgccagtttttggccccttacgccagtgccattggaagccagagcaccccctcacccccctggtcccaacccgccaacacccagaggagtgaccggaggtaatacatacgcagtgcctgccctgcccccaggagccgtgggagacggaccgccacgtgttgacttcccccgttctcgcctgagattcaaagagaagctgggggagggacagtttggcgaggtgcatttgtgtgaggtcgattccccgcaggacttagtttcattggattttcctctaaacgtgcgaaaggggcacccgctgttggtggctgtcaagatcttgcggccagacgctacaaagaacgctcggaatgacttcctgaaggaggtcaaaatcatgtcaagactgaaagatcccaatatcattagactgctaggcgtctgcgtacaagacgacccactgtgcatgataacggattatatggaaaacggagacctgaaccaattcctaagcgcccatcagttggaggataaagctgcagagggggctcctggtgacggccaagccgctcagggtccaaccatcagttacccaatgcttcttcatgtcgccgcacagattgcctccggaatgaggtacctcgcgaccttaaacttcgtgcacttctggggagagaggcacaggtttctgcactag

SEQ ID NO: 11755 - DNA, 447 bp, Artificial Sequence
  Description of Artificial Sequence: Synthetic coding sequence
atgcaaacgttccccgtcgcaggggctctggaccctgccatcctggatacttcctcccctcaggcgctttacacggtgttactgatcgtgcttgttatgatgtcactcgtgttcggcaaatttgttccagttaattgggagcccccacaaccgcttccatttccaaagtacctccggtgctatcggtgtctgctcgagaccaaggagctgggctgcctgctgggttctgacatttgcctgacccccgctggctcatcctgcatcactctacacaagaagaactcttccgggagcgacgttatggtgagtgattgcaggtctaaagagcaaatgtcagactgctctaacacaagaacgagccccgtgtccggcttttggattttttcacagtattgtttcttggacttctgcaatgacccccagaacagaggtctctacaccccctag

SEQ ID NO: 11756 - DNA, 732 bp, Artificial Sequence
  Description of Artificial Sequence: Synthetic coding sequence
atggggccagaggctcttagcagtctgttactcttattactggtggccagtggcgatgccgatatgaagggccactttgacccagccaaatgtaggtacgcgctgggcatgcaagatcgtaccatcccagattcagatataagcgcgtcttcttcatggagcgattccacagccgcacgccattccaggctggaaagttctgacggagatggggcatggtgccccgcaggtagcgttttcccgaaagaagaggagtacctacaggtggaccttcaacgcctacaccttgtagccttggtgggaacacagggcaggcatgcgggaggcctggggaaggagttctcgagaagttataggcttaggtactcccgcgatggaaggcgttggatgggatggaaggacagatgggggcaagaggtgattagcggcaatgaagacccagagggggtcgtgctgaaggatctgggaccccctatggtagctagactggtcaggttctatccacgcgcagacagggtaatgtccgtttgtctgcgggttgaattatacggctgcctatggcgggactgctccatgggtgtgtgggcaagctggcaaatggtgtggtggggttggatgacgttaggacgggttcgaagttgcgggagtggacaagccatgacaatgtgggatggcgctactactgcctctcccgttgcaatgtggcgttggagcttgtctttgaccggatag

SEQ ID NO: 11757 - DNA, 732 bp, Artificial Sequence
  Description of Artificial Sequence: Synthetic coding sequence
atgggaccagaggccttgtcaagcctgctccttcttcttcttgtagcctcaggcgatgccgacatgaagggccacttcgatcctgccaagtgccgctacgccctggggatgcaagacagaacgatcccagattcagatatctccgcatcatcctcctggagtgactcaaccgcagccaggcattcccggttggaatctagcgacggggacggcgcttggtgccctgcaggctcagtgttccccaaggaagaggaatatctgcaggttgacctgcagcgactgcacctggtggcactggtaggaacacaaggccgacatgcgggtggactcggcaaggaattttcacgaagctataggctgcgttactcccgtgatggaaggcggtggatgggctggaaggatcgctgggggcaagaggtcatcagtggcaatgaggaccccgagggcgtcgtgctcaaagatctcggccctcccatggtggcccgattggtaagattctatccaagggcggaccgggtgatgtcagtctgcctgcgtgttgaactctacggatgtctctggagggattgtagtatgggcgtgtgggcaagctggcagatggtgtggtgggggtggatgactctggggagagtcagatcttgcggaagtggccaggctatgaccatgtgggatggggctacaacggcaagtccggtggccatgtggaggtggagcttgagtctcaccggctag

SEQ ID NO: 11758 - DNA, 1224 bp, Artificial Sequence
  Description of Artificial Sequence: Synthetic coding sequence
atgaggctgctggcgtggcttatcttcctcgccaactggggcggtgccagagcggaacctggaaagttctggcacattgccgacctccatctggatccagactataaggtgtcgaaggacccatttcaagtttgtccctcagcaggctcacagccagtgcctgacgctggcccatggggggactacctgtgcgattctccttgggccctgatcaattcgtctatatatgccatgaaagaaattgagcctgaacctgactttatcttgtggactggcgatgatacgcctcacgtgcctgatgaaaagttaggggaggcagctgtgttagaaatagttgagcgcctaacaaaactcatcagggaagtgttccccggtgcattttactgcgaaaagcttccagggccatccggagccggaagaatagtggtcctgaatacaaacctgtattacacctctaacgccctaactgccgacatggcagacccagggcagcagttccaatggctggaggatgtgctcactgacgcatctaaggcaggagacatggtctacatagttggccatgtcccacctgggttcttcgaaaaaacacagaataaggcctggttcagagaaggcttcaatgaaaaatacttaaaggtagtaaggaaacatcatcgtgttatcgctggccagttcttcggacatcaccacacagattcttttcggatgctgtacgatgacgcgggtgtgccaatctcggctatgttcattacgcctggcgtcacgccctggaaaacaactctgcccggagtggtgaacggcgctaataacccagctatccgcgtttttgaatacgaccgggcaactctatcactgaaggatatggtgacctatttcatgaacctgtcacaggccaacgcacagggaacacccaggtgggagctagaatatcaacttacggaagcctacggcgttcctgatgcctctgcccactccatgcatacagtcctggatagaatcgccggagaccagagcacgcttcagcgctactacgtgtacaactcagtgagttatagtgccggtgtgtgcgacgaggcctgtagcatgcagcatgtgtgcgcaatgcgccaggtcgatattgacgcttacacaacatgcctgtatgcatccggaaccactccagtcccgcaacttcctttgttactaatggccctgctgggcctgtgtaccctggtgctatag

SEQ ID NO: 11759 - DNA, 756 bp, Artificial Sequence
  Description of Artificial Sequence: Synthetic coding sequence
atgccacacctcgcgagtctctttacagccagctctcgctgctgtccacacccccttaggccggaaggatcgggcgcaatggggcctgaagccttgagtagtttgctgcttctgctgctcgttgcatcaggagacgctgatatgaagggacacttcgatcccgctaagtgccggtatgccctgggcatgcaagaccgaactattccagattccgatatatcagcttcctcatcttggtctgacagcacggcggcacgacattctagactggaaagcagtgacggcgacggggcatggtgccccgctgggtccgtctttcctaaggaagaggagtatttacaggtggaccttcaacgtctgcacttggtcgccctggtgggcacgcagggcaggcacgctgggggactaggaaaggagttcagccgttcgtaccggcttcggtatagcagggatggcagacggtggatgggatggaaggatcggtgggggcaggaggtaatcagcggcaatgaggatcctgagggagtcgtgcttaaggatttgggccctcctatggtggctcggttagttcgtttctacccgagagcagatcgagtgatgtcagtttgcctgagggtcgaactctacggatgtctctggaggggggaatggctgtctttcctcggaatctgtttcttatctcgagggcttgaagggggtgagtgtggtgagtgggcgtcacgtatcccctctcctgccggtaaactgtccttatag

SEQ ID NO: 11760 - DNA, 756 bp, Artificial Sequence
  Description of Artificial Sequence: Synthetic coding sequence
atgcctcatctggccagtctttttacagcttcctcgcgttgttgtcctcaccctttgagaccagagggtagcggagcaatggggccagaagctctaagttctctgcttctactccttctagtggcgagtggtgatgcagatatgaaggggcactttgatcccgcaaaatgccgctatgctttgggcatgcaggacaggaccatcccagattctgatatcagcgcctcttccagctggtccgactcgaccgccgctaggcattcccgcctggagagttccgacggggacggcgcttggtgccccgctggtagcgtatttccgaaagaagaagaatacctccaggtggatctgcagcgactacacctggtagctctcgttggcacccagggcagacatgctggcggattaggcaaagagttttccaggagctatagactacggtattccagggacggcaggagatggatgggatggaaggatagatggggtcaggaggtcatatctggcaatgaagacccagaaggcgtggttctcaaagaccttggtccccctatggtagcgcgactggtgaggttctacccacgcgctgatcgggtgatgagcgtctgcctgcgcgtggagctgtacggatgcctctggagaggagaatggctgtccttcctcggcatctgtttcctgtcacgcggtcttgaaggaggcgagtgtggcgagtgggcttctaggattccctctccggctgggaagctctccctgtag

SEQ ID NO: 11761 - DNA, 456 bp, Artificial Sequence
  Description of Artificial Sequence: Synthetic coding sequence
atggacctcgtgctgaagcgctgtctgttacatttggctgttatcggcgcactgttggctgtgggtgctaccaaagtgcccaggaaccaggattggctgggggtcagccgacagctacggacaaaggcctggaatcgtcagctgtatcccgagtggaccgaggctcagcgactagactgctggaggggcggtcaagtttccctgaaggtgtcaaacgacgggccaacactgattggagccaatgccagcttttccattgcgctcaactttcccggtagccaaaaagttctgcctgatggccaggttatctgggtgaacaatacgatcataaacgggtctcaagtgtgggggggacagcctgtttaccctcaagagaccgatgacgcctgtatctttccagatggagggccttgtccttctggtagttggtcgcaaaagagatctttcgtgtactag

SEQ ID NO: 11762 - DNA, 216 bp, Artificial Sequence
  Description of Artificial Sequence: Synthetic coding sequence
atgcctgccggtgtgcctatgtcaacttacctcaaaatgttcgctgccagcctcctggcaatgtgcgcaggagccgaggtagtgcaccggtattaccgcccagatctgaccattcccgaaattccccctaagcgtggggagctcaaaacagaactcttagggctgaaagaaaggaaacacaaaccgcaagtgtcccagcaggaagaattaaaatag

SEQ ID NO: 11763 - DNA, 447 bp, Artificial Sequence
  Description of Artificial Sequence: Synthetic coding sequence
atgcaaacatttcccgtagctggcgctttagatcccgctatactggacaccagttcaccccaggcgttatacacagtgctacttattgttctggttatgatgagccttgtgttcgggaagttcgttcccgtgaactgggaaccaccacagcccttgccttttcccaagtatctccgatgctacaggtgcttactggagacaaaagaactcgggtgccttctggggtccgatatttgtcttactccagcgggatcatcatgtattactttgcataagaagaactcttctggaagtgacgtgatggtaagcgattgccgctccaaagagcaaatgagtgactgttcaaacacacgaacgtcccctgtcagtggattctggatcttctctcagtactgtttcctagatttttgtaacgatccccaaaaccggggactgtatacgccttag

SEQ ID NO: 11764 - DNA, 447 bp, Artificial Sequence
  Description of Artificial Sequence: Synthetic coding sequence
atgcagacctttccagttgctggcgcactcgatccagccatcctagacacatcatcccctcaggcgttatataccgtactgttgattgttttggtgatgatgagtcttgtcttcgggaagttcgtacccgtcaactgggagccacctcaaccactgccctttcccaagtatctgagatgctaccggtgcctcctggagacaaaagagcttgggtgcttgcttggatcggacatttgcctgacccctgctggctccagttgcataaccctgcacaagaagaacagttccggatctgacgtaatggtcagtgactgtcgaagcaaggagcaaatgtctgactgctccaacacacgtaccagtccggtaagcgggttctggatctttagtcagtattgttttttagacttctgcaatgatccacaaaatcgcggtctttacacaccgtag

SEQ ID NO: 11765 - DNA, 1326 bp, Artificial Sequence
  Description of Artificial Sequence: Synthetic coding sequence
atggaatttgagttcgaccgcctgcgggctttccaggccatgcaagtgcactgcaataatatgcacaccctaggcgcacggcttcctgggggagtggagtgtaggttccgcagaggccctgccatggcttgggagggtgagcctatgaggcataacctcggaggtaatctgggcgaccccagggcgagagcagtgtccgtccctttagggggaagggttgcccgatttctgcagtgccggttcctttttgcgggtccgtggctcctcttctctgaaatctcgtttattagcgacgtggtaaataattcctcacccgctctcggcggaacatttccccctgccccttggtggccaccaggtccacctcctaccaatttcagtagcctggaactcgaacctcgtggacagcagccagttgccaaggccgaggggtccccaactgccattctgatcggctgcctggtcgccattatcctgctgctactccttatcatcgcgctcatgctctggcggcttcattggaggagactgctgtccaaggtcctggagagccaccccagaaccagatcccctgggcttgtagggattagacctacaccattgcccgtcagccctatggcactgaggtgttgtagccctattcaaccgaccgcctccttttggccattgacacctgtacccctcgaggctcgagcacctccacacccgccaggccctaatccgcctacacctaggggagtgactggcggaaatacgtatgctgtaccagctctgccacctggggctgtgggtgacggccctccacgggttgacttcccacgttcacgactcaggtttaaagaaaagttaggagagggccagttcggggaggtccatctctgcgaagtggatagcccgcaggacctcgtctccttggactttcccctgaacgtcagaaagggccaccccctgctggtggccgtgaagattttgcgcccagatgccacgaaaaatgcacgcaacgattttttaaaggaggtcaaaataatgtcacggctgaaggatcccaacatcatccgcctccttggcgtgtgcgtccaggatgaccctttatgcatgataactgactatatggaaaatggcgacctcaaccaattcttgtcggcccaccagcttgaagacaaggccgctgagggagcccctggtgacggacaggccgcacagggtcctacaataagctatccgatgctgctgcacgtcgccgctcagattgccagcgggatgagatatctggctaccctcaattttgttcacttttggggagaacgtcaccgatttctacactag

SEQ ID NO: 11766 - DNA, 2067 bp, Artificial Sequence
  Description of Artificial Sequence: Synthetic coding sequence
atgctgccaacagaggtgccacagtctcatcccggtccttccgccctccttttactccagttgctgttgcctccgacaagtgcgttcttccccaacatctggagcttgttggctgctccgggatctatcacacatcaggatctcaccgaggaagcagctctgaacgtaacgcttcaactctttctggaacagccacctccaggtcgaccacctctccgcctcgaggatttcctcggacgaacgcttctggccgatgatctttttgccgcttactttgggccaggttccagtcgcaggttccgcgctgccctgggagaggtatcacgcgcaaacgctgctcaggacttcctaccaactagcaggaacgaccctgatcttcacttcgacgcggagagactaggacaggggcgtgccagactggtgggagcactcagggagaccgttgtcgccgcacgagccctggaccataccttggccagacagagacttggcgctgcccttcacgctttgcaggacttttactcacattccaactgggtggaactcggagaacagcagccccatccacatctgctgtggcccagacaggagctgcagaatctggcacaggttgccgaccctacgtgctccgattgtgaggagctatcttgtccgcgaaactggctgggctttacactcctcacatccggctacttcgggacccaccctcctaagcccccaggcaagtgcagccacgggggtcatttcgatcgctcaagttctcagccccctaggggcggaattaataaagacagcacctcgcctggcttcagcccgcaccacatgctgcacttgcaggcagctaagctggccctccttgcctctattcaggcttttagcttgctgcgatcgagactcggagaccgcgacttcagccgtctcctggatatcacccctgcaagcagtttgagctttgtcctggacaccaccgggagtatgggcgaagaaattaacgctgccaagattcaagccaggcacctggtggaacaacggcgaggcagcccgatggaaccagtccactatgtgctggtacctttccacgacccaggctttggccctgtgtttactacaagtgatcccgattctttctggcagcaattgaacgagattcatgctctgggcggaggggatgagcctgagatgtgtctaagcgccctgcagctcgcactgctgcatacgcctcctttaagcgatattttcgttttcactgatgccagtccaaaggacgcgtttctgacaaatcaggtggagtcactcacccaggagcgaaggtgtcgcgtaacgtttctcgtgacagaggatacctcccgtgtgcagggtcgcgcaagaagagagatcctgagccctcttaggtttgagccctataaagcagtggccttggcaagcggaggagaggtgatttttactaaggatcagcacattagggacgttgcagcaattgttggggaaagtatggcagctctggtgacgcttccattggaccctccagtcgttgtcccgggacagccactcgtgttctctgtggacggactgctgcagaagattactgtgagaatacatggcgatatcagtagcttttggatcaagaaccccgctggtgtttctcagggccaagaagaaggaggcggtccactcggccacacccggcgatttggtcagttctggatggtgaccatggatgatccccctcaaactggaacctgggagatccaggtgacagccgaagacacccctggggtccgcgtacaggcacagaccagcctagactttctttttcattttgggataccgatggaggatggcccacacccaggcctctaccccctgacccagccggtggctggacttcagactcaactgttagtcgagtctcagagctggggctcttctgcagcattcctcccaagacacccctctaggggaccccgagggtgtcgcactcggccaggtgctctgggtgccagagggaccagtggagccagaagcccgaggagcctcgctgtggcccacgccgcagtccacccttag

SEQ ID NO: 11767 - DNA, 1326 bp, Artificial Sequence
  Description of Artificial Sequence: Synthetic coding sequence
atggagttcgaattcgataggttgcgtgcatttcaggccatgcaggtccattgcaacaacatgcacactctcggcgcaaggttacctggaggagtcgaatgtcgatttcggagggggcctgcaatggcctgggagggagagcctatgcgccacaacctagggggaaatctgggcgacccgagagcccgtgccgtgtctgtccccctaggtggcagggtggcaaggttcttgcagtgccgatttctattcgctgggccttggctccttttttcggagatttcatttatctccgatgtagtgaacaactcatctccagccctgggcggaacatttccaccagccccttggtggcctccgggaccaccccctacaaattttagcagcctggaacttgagccacggggacagcagcccgtagccaaggctgagggatcgccgaccgcaatccttataggctgtctggtggctatcatcctactgttacttctaatcatcgctctcatgctgtggcgattacattggcgaaggctgctttcaaaggtgctggaaagtcaccctcggacaaggagccccggtctggtcggcatcagaccaacactgctgcccgtgtcaccaatggccctacgatgctgttccccaatccagcccaccgcaagcttctggcctctcacacccgtgccgctggaagccagagcgcctccccacccacccggacctaaccctccgaccccacgcggtgttacaggcggaaatacgtatgccgtgccagccctgccgccaggcgctgtaggagacggtcccccacgggtggatttccctaggtcaagattacgctttaaggagaaactcggggagggtcaatttggggaagttcacctgtgcgaggtagactccccccaggacctggtgtccctggatttccctctgaatgtgcggaaaggccaccctctgctggtagctgttaagattctgcggcctgacgcaaccaagaatgcacgaaacgatttcttaaaagaggtgaagatcatgtcacgcctgaaggaccctaacatcatacgactcctgggagtgtgcgtgcaggacgatcccctgtgcatgatcaccgattacatggagaacggggacctgaaccagttcctgtcagcacaccagctcgaagataaagctgcagaaggggctcctggggacggccaagctgcccaaggtcccacaatctcctatcccatgctgctccatgttgcggctcagatcgctagtggtatgaggtacctcgccacccttaatttcgtccatttttggggcgaacgccaccgctttttgcactag

SEQ ID NO: 11768 - DNA, 2559 bp, Artificial Sequence
  Description of Artificial Sequence: Synthetic coding sequence
atgctgcccaccgaggtacctcagagccatccagggccttctgccttgctgctgctgcaactcctgctgccacccacctccgctttctttccgaacatctggagtctcctagccgctccaggcagcatcacccatcaggaccttacggaagaagcagcgttgaacgtgactctccaactctttttagagcagcctcccccaggcaggcctccactgcggcttgaagacttccttgggaggactctcttagccgacgacttgtttgcagcatactttgggccaggaagctcccggagattccgtgccgctctcggagaagtctctagagcaaacgcagctcaagactttctgcctacctcaagaaacgaccccgatttgcacttcgatgccgagaggctggggcaggggagggcgcgtctggtgggcgctctgagagagaccgtggtcgcggctcgggcacttgatcataccttagccagacagaggttgggtgccgctctgcacgcactgcaggacttctatagtcacagtaactgggttgaactgggtgagcagcagccccatccacatcttctgtggcctcggcaagagctccagaatctcgcccaggtggccgatcccacatgctctgattgcgaagagctttcctgcccacgtaactggctgggtttcacattactcacctctggctactttgggactcatcccccaaagcctccaggaaagtgctcacatggagggcactttgaccgcagcagtagccaacctccacgtggcggtataaataaggactccaccagtcccggattctccccccatcatatgttgcatctgcaggctgccaaattggcactcctcgcctccatacaggcgttttctctcttacggagtaggctcggagacagggacttcagccgcctcttagacatcacgccagccagtagcctatccttcgtcctggatacaacggggtccatgggagaagagatcaatgctgcaaagattcaggcccgtcacctggtggagcagagaagggggagccccatggaaccggtacactatgtactggtcccatttcatgacccgggtttcggccctgtgtttaccacatccgacccggattcgttctggcagcagctgaacgaaattcatgctttggggggaggtgacgagcctgagatgtgcctgagtgcattgcagttagccttgctgcacaccccaccattatctgatatattcgtatttaccgatgcgtcgccgaaggacgcttttctgacaaaccaggtggaatctctcacccaggagcgcaggtgtcgcgtgacatttctcgttaccgaagatacatcacgcgtccaaggtagggccagacgcgagattctgtcaccccttagattcgagccttataaggccgtggcgctggcgtcaggaggcgaagtaattttcacaaaggatcagcacattagggatgtggctgctatcgtcggggaaagcatggcggcactggtaaccttgcctctcgaccctccagtggtggtgccaggacagcctctggtattctcagtagatggtcttctccagaaaataacggttcggatccacggagatatatcaagcttttggataaagaacccagctggtgtgtcccagggacaggaagagggaggtgggccacttgggcacaccagacgctttggccagttctggatggtgaccatggacgatcccccacagactggcacttgggagatccaggtgaccgctgaagacacacccggagttagagttcaggcccagacgtcattagacttcctctttcactttggcattcccatggaagatgggcctcatccgggtctatatcctttgactcagcctgtcgcgggactgcagacacagctcttagtcgaggttaccggactgggctcacgagcaaaccccggagacccacagccccatttcagccatgtcattttacgtggggttcctgagggcgcagagctgggacaggttcctctcgagccagtgggaccccctgagcgtggcctccttgctgcctccctgtccccaaccctcctctccacaccacggcctttcagcctggagctgattggacaggatgctgccggacgcagactgcatagagctgccccacaaccatcaacggtggtacctgtgctgctcgagctgtctggcccttcgggctttctggcgcctggctctaaggtgccactgtccctccgtatagctagtttctcgggcccacaggatttggacctgcgtaccttcgtgaatccttccttttcactcacttcaaatctgtctcgcgctcatttggaacttaatgaatctgcttggggaaggctctggctcgaggtgccagactctgccgcaccagactctgtcgttatggtgacggtgaccgccggagggcgagaggccaaccctgtcccaccaacccatgccttcctgagattgctagtctccgctcctgctccacaggttcgcaaccactattttccgtcccaaggacccgcacatcacccatataggttaatatag

SEQ ID NO: 11769 - DNA, 732 bp, Artificial Sequence
  Description of Artificial Sequence: Synthetic coding sequence
atgggaccagaggccctgagctcactcttacttcttctccttgtcgcctccggagacgctgacatgaaggggcactttgaccctgcaaagtgcagatacgcattggggatgcaggaccggacaatccccgactctgatatctcagcatcttccagctggtcagattctactgccgcaagacattcacgactggaatcatcagatggcgatggagcctggtgtcccgctggttccgtgtttcctaaggaggaagaatacctgcaggtcgatcttcaaagactccatctcgtggcccttgtgggcacccagggcagacacgcgggaggcctcggaaaggagttcagccgcagttacaggttgcgctactccagggacgggcgtagatggatgggatggaaagatcggtggggccaagaggtcatctccggtaatgaggaccccgagggggttgtacttaaggacctcggaccacctatggtggcgaggctggtgcggttctatccgagagctgatcgtgtgatgtctgtctgccttcgtgttgagctgtatgggtgcttgtggcgcgactgcagtatgggggtctgggcttcctggcaaatggtctggtggggctggatgaccctgggcagggtgcggagctgcggatcaggacaggctatgaccatgtgggacggggcaacaacagcctcccccgtggcaatgtggaggtggagcctaagcttgactggatag

SEQ ID NO: 11770 - DNA, 2760 bp, Artificial Sequence
  Description of Artificial Sequence: Synthetic coding sequence
atgggccctgaagcgctgtcatctctcctcttactgttgctcgtagccagcggcgatgccgacatgaagggacacttcgaccctgccaaatgccggtacgctctcgggatgcaggaccggactattcccgactctgatatatccgcatctagcagctggtcggactcaaccgctgccaggcacagtaggcttgaaagttctgatggtgatggtgcctggtgccctgctggcagcgtgttccctaaagaggaggagtacctccaggtcgatctgcagcgcttgcacttggtggctctcgtgggcactcaggggcgacacgccggtggacttgggaaagagttcagtaggagttaccggctacgctactcaagggatgggcgtaggtggatgggctggaaggatcggtgggggcaggaggtcatttcaggaaacgaggacccagagggcgttgttcttaaggatttgggcccaccaatggttgctcggttggtcaggttctatcctagggctgaccgcgttatgtcggtctgtttgagagtggaattgtacggctgtctctggagggatggcctgttgagctataccgctccggtaggccagactatgtacctgagtgaagcagtttatctgaacgacagcacgtatgacggccataccgttgggggtttgcaatatggcggactcggccagcttgccgatggggttgtgggtttggacgacttccggaagagccaggagctgcgggtctggcccggttatgactacgttggctggtctaatcactcattttcctctggctatgtcgaaatggaattcgagttcgatcgcctgcgggcattccaggcgatgcaggtccattgcaataatatgcatacgctgggcgcacggctccctgggggagtggagtgtcgcttcaggcggggacccgcaatggcctgggagggcgaacctatgcgacacaacctgggcggaaatttgggagatccccgtgccagggcagtgagcgtgccactagggggacgggtggccaggttcctccaatgtcgctttctgtttgcaggtccctggctgctgttctcagaaatcagttttatctccgatgtcgtgaacaattcttcaccggctctcggaggaacattccccccagcaccctggtggccacccggtccgcctcccacaaatttttcgtccctggaactcgagccgaggggtcagcaaccggtggcaaaggctgagggtagccctactgctatcctgatcgggtgtttggtggctattattctgctgttgttactaattatagctctgatgttatggagactccactggcgacgcctccttagtaaggcagagaggcgcgtactcgaggaggaactgactgtgcacctctccgtcccgggagacactattctgatcaacaatcgtccgggacctagagaacctcctccttatcaagagccccgtccgaggggaaacccgccacactctgctccatgcgtacctaatggaagcgctctgcttttgtctaacccagcctacagactgttgttagctacctatgccagaccgcctcgaggtccaggtcccccaaccccagcttgggctaaaccgaccaatactcaagcatatagtggagactacatggagccagaaaaacctggggctccattgctgccaccacctcctcagaattccgttcctcactatgccgaagcagacatcgtgaccctgcagggggtgactggaggaaacacctacgctgtgcctgctctgccacccggagctgtgggcgacggtccacctcgtgtggattttccaaggtctagattacgatttaaggaaaaactcggagaggggcagttcggagaagttcatctgtgcgaggtcgacagccctcaagaccttgtgtctcttgacttccctctgaacgtgaggaaagggcacccgctgcttgtggctgttaagatcctgaggcctgatgctacaaagaatgcttctttcagtctttttagtagaaatgactttctgaaggaggtcaaaataatgtctcgattaaaggaccctaatatcattcggttactgggggtatgtgtccaggatgatcctctgtgtatgatcacggactatatggagaacggcgatctaaaccagttcctctccgcgcatcagctggaagataaagccgctgagggggctccgggagacggacaggctgctcagggaccaaccatcagctatccaatgttactgcatgtagcggctcagattgcctctggaatgagatatctggctactcttaattttgttcatcgcgacctagccacccggaattgtctggtgggcgagaactttaccattaaaatcgctgacttcggaatgagtcggaacctttacgctggcgactactaccgtgtacaagggcgagccgtgctgccaatccggtggatggcctgggagtgtatcctgatgggtaaatttacaactgcctccgatgtctgggctttcggcgttaccctctgggaggtgctgatgctttgtagggcccagccctttggtcagcttaccgatgagcaggtcatcgaaaatgcaggcgaattcttcagagaccaagggagacaggtctatctctctcgccctcccgcatgtcctcagggtttatacgaactgatgctaagatgctggtctcgtgagagcgagcagcggccacctttttcccaactgcatagattcctcgccgaggacgctttaaataccgtttag

SEQ ID NO: 11771 - DNA, 2700 bp, Artificial Sequence
  Description of Artificial Sequence: Synthetic coding sequence
atgctgcttctgctgctgctcgcccctttgtttctgagacctcccggtgccggaggagcacagactcccaacgccactagcgaggggtgccagattatccacccgccatgggaagggggtatccgatatcgcggactgacccgcgatcaggtgaaagccatcaattttctcccggtggactatgagatcgaatatgtgtgccgcggtgagagagaggtggtcggccctaaagttcgaaagtgccttgccaatggttcttggaccgacatggacaccccaagcaggtgcgtaaaccgcacccctcacagtgaacgaagagcggtgtacatcggggcacttttcccaatgagtgggggatggccaggaggtcaggcctgccaacctgccgttgagatggccctcgaagatgtgaacagccgacgtgacattctaccggattatgaacttaagttgatccaccatgactcaaaatgcgacccagggcaggctacaaagtacctgtacgagctgctgtacaacgatccaatcaagattatcctgatgccgggatgttcgagtgtgtcaaccctggtggcagaagcggcaagaatgtggaacttgattgtgttgtcatacggatcaagtagtcccgctttatcaaatagacagcgcttcccaacttttttccggacccacccttcagctacactgcataatcctactagggtgaagctgttcgagaagtggggttggaaaaagatcgccactatccaacaaactacagaggttttcactagcaccctggacgatctggaggagagggtcaaggaggctggtatcgagattacatttaggcagagtttcttttccgatccagctgtacccgttaagaatctgaaaagacaggacgcccgaattattgtcggccttttttatgagactgaagctaggaaggtattctgtgaggtgtacaaagaaaggctctttggcaaaaaatacgtctggtttctgatcgggtggtacgcggacaattggtttaagatttacgacccatccatcaattgcaccgttgacgaaatgacagaggcagtggagggccacatcacaacagaaatagttatgctcaatcctgccaacacaaggtccatttccaacatgacctcccaggagttcgtcgaaaaattgaccaaaagactcaaaagacatcctgaggaaactggagggtttcaggaagctccgctggcctatgacgccatttgggcattggcgctggctctgaacaaaacctcaggtggtgggggacggtccggggtaagactagaggatttcaattacaataatcagaccatcaccgatcagatttatagagcgatgaattcctcctcctttgagggggtttcaggccacgtcgtctttgacgccagtggttctcgtatggcatggacactgatcgaacagctgcaaggcggaagctataagaaaatcggttactacgactccacgaaggatgatttgagttggtcaaaaactgacaagtggattgggggatctccccctgccgatcagactctcgtcattaagactttcaggttcctttcgcagaaattgttcatcagtgtttcagtgttgagctcacttggaatcgtactggctgtggtgtgtttgtcattcaatatttacaattcacacgtgcggtatattcagaactcccagcctaatcttaacaacttgacagccgtaggttgcagcctggcactggcagccgtgttcccactgggactcgatgggtatcatattgggcgaaaccagttcccattcgtgtgccaggcaaggctctggctgctcggcctgggatttagcctggggtacggatcaatgtttacgaaaatttggtgggtacatacagtcttcacgaagaaggaagaaaagaaggaatggaggaagactctcgaaccctggaaactgtatgcgactgttggacttctggttggtatggacgtgctgactctggctatctggcagattgtggatccactccaccgcacaatagagactttcgccaaagaggaacctaaggaggacatcgacgtctcgatccttcctcagctcgaacactgcagttcccgaaagatgaatacgtggctcggcatcttctacgggtataagggtttgctgctgctactggggatctttcttgcctacgagaccaaaagcgtatctaccgagaagataaatgatcaccgggctgtgggcatggccatttataatgtagcagtgttgtgcttaattacagctccggtgaccatgatcctgtccagccagcaagatgctgcctttgccttcgcatccctcgcgatcgtgttctcatcttatataaccctcgtggtgctgtttgttcctaaaatgcgcagactgattactaggggcgagtggcagagcgaggctcaggacacgatgaaaacgggcagcagtacgaacaacaatgaagaggagaagtccaggctgctggaaaaggaaaacagagagctagagaaaattatagcagagaaagaggagcgcgtctctgaactgaggcatcagctacagagcaggcaacagctcagaagtcgacggcatccacctactccccctgagcctagtggaggactccccaggggcccacccgaacccccagacaggctgagctgtgatgggtcacgggtgcacctcctgtacaagtag

SEQ ID NO: 11772 - DNA, 447 bp, Artificial Sequence
  Description of Artificial Sequence: Synthetic coding sequence
atgcagaccttcccagtcgcaggtgctctggaccctgcaattctggatacttcaagtccacaagcactttacactgttcttctgattgtgctggttatgatgtccctggttttcgggaaatttgttccagtgaattgggaaccccctcaacccttgccttttcctaagtacctgcgttgttatagatgcttgctggagaccaaagagctgggctgtctattgggatcagacatctgcctgacacctgctggatcctcatgcataacgctgcataaaaaaaattccagcggctcagacgtgatggtctctgattgtaggtctaaggagcagatgagcgattgttccaatactcgaacaagtcccgtgtccggcttttggatattttcgcagtactgctttctcgacttctgcaatgatccacagaacagaggactgtacaccccgtag

SEQ ID NO: 11773 - DNA, 516 bp, Artificial Sequence
  Description of Artificial Sequence: Synthetic coding sequence
atgcggcacaatctcgggggaaacctgggtgacccacgcgctcgcgcagtgtctgtccccctgggcggaagagtcgccagatttctgcagtgccggtttttgtttgctggtccttggctactgttcagtgaaattagcttcatcagtgatgtggtgaacaatagtagcccagcgcttggcggaaccttcccacccgctccctggtggccccctggtccgccacccaccaatttcagttcactggagctggaaccgcgtggccaacagccagttgccaaagcggaaggctcacccacagccatacttattgggtgcctggtagcgattatattattgctgcttctcatcatcgcactgatgctgtggaggctgcactggaggaggctactaagcaaggttctggagtctcatccacgcaccagaagtcccggactggttggaattagaccaacgcccctgccagtgagccccatggcccttgtccacctctgtgaagttgattcaccccaggattag

SEQ ID NO: 11774 - DNA, 666 bp, Artificial Sequence
  Description of Artificial Sequence: Synthetic coding sequence
atgaccacacaacttcgtgtggtccacctgctccccttgctgctggcctgcttcgtccagacatctcccaaacaggagaaaatgaagatggattgtcacaaagatgaaaaaggcaccatctacgactatgaggctattgcactcaataaaaacgagtacgttagctttaaacagtacgttggcaaacacatcctattcgtgaacgtggccacctactgcggtctaacagcgcagtaccctgaactcaacgctctacaggaggaactaaagccttatggcttggtggtactcgggtttccgtgcaatcagtttggcaagcaggaaccaggggataacaaggagattttacctggccttaagtacgttcgcccaggcggaggcttcgtccccagtttccagctgttcgagaagggggacgtcaacggggagaaagagcaaaaggtgttcagcttcctgaagcatagttgtccacacccttccgaaatcctgggaactttcaagtccatatcctgggaccctgtgaaagtacacgacataagatggaactttgagaagtttctggtcgggcctgatggcattccagtgatgcggtggtctcaccgcgctacagtctcgtccgtgaagaccgacatcctcgcatatttaaagcagtttaaaactaagtag

SEQ ID NO: 11775 - DNA, 447 bp, Artificial Sequence
  Description of Artificial Sequence: Synthetic coding sequence
atgcagactttccccgttgcaggggctctcgatcctgctattctggacacatcatctccacaggctctatatacagtcttgctgatcgtcttggttatgatgagtctcgtattcggcaaatttgtgcccgttaactgggaacctccacagccactccccttcccgaagtacttacggtgttaccgatgcttgctggaaactaaggaactggggtgcctactagggtctgacatttgtctcactcctgcgggaagtagctgtattacccttcataaaaaaaattcaagcggatctgacgtcatggtgtcggattgcaggtccaaggagcagatgtcagactgttctaatacacgaacatcaccagtctccgggttttggatattttcccagtactgttttctggatttttgtaacgaccctcaaaatagggggctctacaccccctag

SEQ ID NO: 11776 - DNA, 1737 bp, Artificial Sequence
  Description of Artificial Sequence: Synthetic coding sequence
atgttgctcctactgctccttgctccattgttccttcgccctccaggcgcaggcggagctcagacgcccaacgccacctcggagggatgccagattattcacccgccatgggagggaggcatccgctaccgcggtctgactagggatcaggtcaaagctatcaatttccttcctgtcgattatgaaatcgaatacgtgtgcaggggcgaacgtgaagtggtggggcctaaagtgcgaaaatgcttggcgaacgggtcatggaccgatatggacacacccagccggtgcgtgcgcatatgctctaaaagctatctgaccctcgagaatgggaaggtcttcttaactggcggtgatttgcctgctctggatggggcacgggttgattttcggtgtgatccagacttccatttggtcggctccagtcgtagcatctgttctcaggggcagtggtccactcccaagccccactgccaagtgaacagaactccgcacagtgaaagacgggcagtgtacatcggggctctgttcccaatgagcgggggatggcctggcggtcaggcatgccaaccggctgttgagatggcccttgaagacgtgaattctagaagggatatattgccagactatgagctgaaactgatccatcacgatagcaaatgtgaccccggacaagccactaaatacctgtacgagctgttgtacaatgaccccattaaaattattttgatgcccggttgttcttcggtttccaccctcgtggctgaggctgccagaatgtggaaccttatcgtgttgagctacggttcttccagccctgctttgtccaataggcagcgtttcccaactttctttcgcacacaccccagcgccaccctgcataacccgaccagagtcaaactttttgaaaaatggggctggaaaaaaatagctaccatccagcagaccaccgaggtgtttacttctaccctagacgatcttgaggaaagagtcaaggaagcaggaatcgagatcacattccggcagagcttcttttccgatcctgctgtgcccgtaaaaaacctcaagcgccaggacgccagaataatagttggcttgttttacgagacagaagcacgcaaggtgttttgtgaagtctacaaggagcggctgttcgggaagaagtatgtctggtttctcattgggtggtacgctgataactggtttaagatttatgacccatcaatcaactgtacagtggacgaaatgacagaggcagtggagggacacatcactaccgagattgtgatgctgaatcccgctaacactcgttctatctctaacatgacatcccaggaattcgtggagaagttgactaagcgactcaagcgccatcccgaagagacaggtgggttccaagaggccccactagcttatgatgcaatctgggctctcgcactggcgctgaataagacctccggcggaggcggacggagcggagtaaggttggaggacttcaactataacaaccagactattacggatcagatttatcgtgcaatgaacagtagcagttttgagggcgtgtccgggcatgtggtgtttgatgcgtcaggatctcgaatggcctggaccctgatcgagcaactccagggaggttcatataagaaaatcggatattatgatagcaccaaagatgatctgagctggtccaagacagacaagtggatcgtcatctctcgcacccacagcccaacatag

SEQ ID NO: 11777 - DNA, 1737 bp, Artificial Sequence
  Description of Artificial Sequence: Synthetic coding sequence
atgttactcctgctccttctagcaccacttttcctgaggccacccggtgctggcggtgctcaaacacccaatgccacctctgagggttgccagattatccacccgccttgggagggtggtatccgctaccgcggtctgaccagggaccaggtcaaggccatcaacttcctacctgtggactatgagatcgagtacgtttgccggggtgagcgcgaggtggtcggcccaaaagtgcgaaaatgtctcgctaacggatcatggacagacatggacacaccttcccgttgcgttaggatctgtagtaaaagttatctcactctcgaaaatggtaaagtgttcctcacgggtggagacctcccagctttggacggcgcacgggtggatttccggtgtgatccggatttccatctcgttggctctagtcgcagcatctgttcacagggccaatggtccacgcccaaaccgcactgccaggtgaataggacccctcattcagaaaggcgcgcagtatatatcggcgctctgtttcccatgtctggcggttggcccggagggcaggcctgccagcctgctgtggagatggcactagaagacgtgaacagcagacgcgacatactgccggattacgaactgaaactgatccaccacgactctaaatgcgaccctggccaggcaacaaaatatctctatgagctcctatacaatgacccaattaagatcatccttatgcctggttgctcgtcagtgtcaactttggtcgcggaagctgccaggatgtggaatttaattgtattatcttatgggagctctagcccagctctgtccaaccggcagaggttccccacctttttccgcactcaccctagcgccacccttcacaatcctacccgtgtcaaattgttcgagaaatggggatggaagaagatagccaccatccagcagacaaccgaggtctttacatcaacactggacgatcttgaggaacgcgtaaaagaggctggcattgagatcacatttaggcaaagttttttcagcgacccggctgtccctgtcaagaatcttaaaaggcaagacgcaaggatcatcgtcggcctcttctatgaaaccgaggcacggaaggtcttctgcgaagtatataaagagcgcctgtttggtaagaagtatgtgtggttcctgatcgggtggtacgcggataactggtttaagatctacgacccatcgatcaactgcaccgtggacgaaatgacggaggctgtggaaggacacattacaactgagatagtgatgttgaaccccgctaatactaggagcatcagtaacatgactagccaagagttcgttgagaagctgactaagcgcctcaagagacaccccgaggagaccggtggctttcaggaggcaccactggcttatgatgctatttgggccctggctctggctctgaacaagacatctggcggtggcggacggtccggagtgcgcctcgaggatttcaactataacaatcaaacaattactgaccagatttatcgagcgatgaactcatcttctttcgaaggggtcagcggccacgtcgtttttgacgccagcggaagcaggatggcatggaccctgattgagcagcttcaaggcggtagctacaagaagataggatattacgattcaactaaagacgacctctcctggagcaagacggacaagtggatcgtaatttcccgaacccacagtccaacatag

SEQ ID NO: 11778 - DNA, 756 bp, Artificial Sequence
  Description of Artificial Sequence: Synthetic coding sequence
atgccgcatctggccagcctattcactgcatcttccagatgctgccctcatcctctgcgccctgagggaagcggagcaatggggccagaagctttgtcctctctcctgctgttgcttctggtagcaagcggcgatgctgatatgaagggacactttgatcctgctaagtgtcgctacgccctcgggatgcaggaccgtacaatacccgattctgacattagcgcatcctccagctggtccgactccacagcagctaggcactcccggttagagtcctcggacggtgacggggcatggtgcccagccggaagcgtgttcccaaaagaagaagaatatcttcaggtcgaccttcaacgccttcacctggtcgccctggtgggcacccagggccgtcacgccggaggacttggtaaggagttttcacgctcctaccgtctccgctactcaagagatggcaggcggtggatgggctggaaagatcgctggggtcaagaggtcatcagtggaaacgaagatcccgagggcgtcgttttaaaagacctcggcccaccaatggtggcaaggcttgtaagattctaccccagagctgacagagtgatgtcagtatgtttgcgggtcgaactgtatggatgcttgtggagaggcgagtggctctcctttctaggcatctgcttcctgagccggggactggaagggggagagtgtggtgaatgggctagccggattcccagccctgctggcaagctaagcctgtag

SEQ ID NO: 11779 - DNA, 1764 bp, Artificial Sequence
  Description of Artificial Sequence: Synthetic coding sequence
atgcgacctaggggactgccacctctgctcgtggtgctattagggtgctgggcatctgtatcagcgcagactgacgcaacgccagccgttaccacggaaggcttaaacagtaccgaggcagcactggccacttttggcacttttccctccaccaggcctcctggcactccccgtgcgccaggcccatcctctggtccacgtcccacgcccgtgaccgacgttgctgtgttgtgtgtttgtgacctctctccagcacaatgtgacatcaattgctgctgtgacccagactgtagtagcgtcgatttttctgtgttcagcgcatgctctgtcccagtggtgaccggcgactcccagttctgctctcaaaaagccgtgatctacagcctgaatttcaccgccaaccccccacagagggtctttgagcttgttgatcaaattaacccctctatcttttgtatccatatcactaactacaaacctgccctcagcttcataaatccggaggtgcccgatgaaaataatttcgacaccttgatgaagacctcagatggcttcaccctcaacgcagagtcctacgtcagcttcaccactaagctggacatccctaccgccgcaaagtacgaatacggagtgcctttgcagaccagcgattccttcctgcgattcccctcctcgcttacatcgtctctatgtaccgataacaaccctgcggcattcctggtgaatcaggccgtgaagtgcacgcgtaaaatcaacctggagcagtgcgaggaaattgaggcactctctatggccttctactccagccccgagattctgcgggtgccggattctcgcaagaaagtccccatcacggtacagtcgatcgttatccagtccctgaacaagacattgacccgcagagaggacaccgacgttctgcaacctacactggtgaatgcaggtcacttttctctttgtgtcaatgtcgtgctggaagtgaagtacagcctgacctatactgatgcaggcgaagtcaccaaggcggatctgtctttcgtcctgggtacagtgtcctcagtggtggtacctctgcaacaaaagtttgagatacactttctgcaagaaaacacgcaaccggtccccctaagcggcaatcccggttatgtggtgggtctgcctctggctgccggtttccagccacacaagggaagcggaatcatccaaacaacaaacaggtatggccagctgacaatccttcattcaactaccgaacaggattgcttggctttagaaggtgttcgaactcccgtcttattcggttatacaatgcagtcaggttgcaaactgcggctgactggcgctttaccctgccaactcgtcgcgcagaaggtgaagagcctgctttgggggcaaggttttccggattacgtcgcgccattcggcaattcacaggcccaggatatgttggattgggtgcccatccacttcatcacgcagtctttcaatcgtaaggactcttgccagctaccaggcgctctcgtgattgaggtgaagtggacgaagtacggttcactgctgaaccctcaagcaaaaatcgtcaatgttacagctaatcttatctcctcctcttttccagaggctaatagcggcaatgaaagaaccatcctgatttcaactgctgtgacgtttgtggatgtgtcagctcctgctgaggccggttttagagcaccccctgcaatcaatgcacggctcccgtttaacttctttttcccattcgtctag

SEQ ID NO: 11780 - DNA, 2067 bp, Artificial Sequence
  Description of Artificial Sequence: Synthetic coding sequence
atgctgcccacagaagtgccccagtcgcatcccggaccttctgctctcctgctcttgcaattgctgctgccacccacctccgccttttttccgaacatctggtctctgttggccgcaccgggttcgatcacgcatcaggacctgaccgaggaagccgctctaaatgttacgctgcaactctttctggaacagccaccacccggaagacccccactcaggcttgaggactttctgggtcggacacttctcgcagatgacttatttgcggcatatttcggaccaggctcctcccgcaggtttagagctgcccttggtgaagtaagtcgcgcaaacgctgctcaggatttcctccccacatccaggaatgatcccgatctacacttcgatgctgaaaggctcggtcaaggccgagcacgtctggtcggcgcactgcgtgaaaccgtggtagctgctagggcactcgaccacacattagctagacagaggctgggggcagctttgcatgctctacaggatttttatagccactccaactgggtggaactgggcgagcaacagccacaccctcatctactttggccaaggcaggaattgcaaaatctggcgcaggtcgccgatcccacatgtagtgactgcgaagaactctcttgtcctcgtaattggctggggtttactctcctgaccagcgggtactttggcacgcatccccctaaacctcctgggaaatgctctcacgggggtcattttgaccggagctcaagtcagcctccaaggggaggtatcaataaagacagcacttcccccggattcagcccgcatcacatgctgcatctgcaggcggcaaagttagccctgcttgctagtatccaggcattttcccttctacgatcccgactaggcgacagagatttttcaagacttttagacatcacccctgcgtcctctcttagtttcgtgttggatacaactggatccatgggcgaggagatcaacgctgctaaaattcaggctcgccatttagtcgaacagcgaagaggatcacctatggagccggtgcattacgtgttggtaccattccacgacccgggattcggaccagttttcactacgagtgacccggatagcttttggcagcagctgaatgagattcatgcacttggcggaggcgacgaaccagagatgtgtctctctgcattgcagctggctctgctgcacactccgcctttatccgatatcttcgtgttcaccgacgcctcaccgaaggacgcgttcctgacaaaccaagttgaatctctgactcaagagagaagatgccgcgtgacgttcttggtgacagaggacacaagcagggtgcaggggagagctcgtcgggaaatccttagtccactgcgttttgaaccctacaaagccgttgccttggcctccgggggagaagtgatattcactaaagaccagcatattagagatgtcgccgcaatcgttggcgagtcgatggccgctctggtgacattgcctcttgatccaccagtggtggttcctggacaacctctggttttttcagttgacggattactgcagaagattaccgtcagaatccatggcgatatctcttcgttctggataaagaatcctgctggtgtgagccagggccaggaagagggagggggaccactgggccacactagaaggtttggacagttttggatggtgaccatggatgatccgcctcagaccggaacatgggaaatccaggttaccgctgaagatacaccgggagtacgagtgcaggcgcagacctccctcgacttcctctttcactttggcatccctatggaggatggtccgcacccaggattgtacccgcttactcagcccgtggcgggactgcagacccagctgttggtagaatctcagagctggggctcgtctgcagctttccttccaagacatcccagccgtggccctagaggatgcaggacaagacctggcgctctgggcgctcgcggtacttccggcgcaaggagtccgaggtcactagcagtggcccacgctgcggtgcacccttag

SEQ ID NO: 11781 - DNA, 303 bp, Artificial Sequence
  Description of Artificial Sequence: Synthetic coding sequence
atgacaacacagcttagggtggtccacctattgccgctactgcttgcttgtttcgtccagacatccccgaaacaggaaaaaatgaaaatggattgccataaggacgagaaaggcaccatatatgactacgaggctattgctctcaacaaaaacgagtacgtcagcttcaagcagtatgtgggaaaacacatcctgtttgtgaatgtcgctacctattgcggcctgactgcgcagtacccaggtatgtcagtgcagggcgaggatctgtatctcgtgagctcatttctccggaagggcatgtag

SEQ ID NO: 11782 - DNA, 705 bp, Artificial Sequence
  Description of Artificial Sequence: Synthetic coding sequence
atgaaaaccctggccggactggtcttgggcctggtcatcttcgatgccgctgtcaccgctcctactctggagagtatcaactatgattctgagacttacgacgcaactctcgaagacttagataatttgtacaattacgaaaacatccctgtggacaaagtcgaaatcgaaatcgcaaccgtgatgcctagtggaaaccgcgagctgctcaccccaccaccccaacctgaaaaggctcaggaggaggaggaggaggaagaaagtacccctaggctgatcgacggaagctcgccgcaggaaccagagttcacgggcgtgttgggtccacacactaatgaagactttcctacctgcctgctgtgtacgtgtatttccaccaccgtgtactgtgatgatcatgagctggacgccatccctcctctccccaaaaacactgcttacttctattccagattcaaccgcattaaaaaaattaacaaaaacgattttgccagcctgagtgacctcaaaagaattgacctgaccagtaacctgatttcggagatagacgaagatgcatttagaaagctcccccagctgcgggagctggtgcttagggataataagattcgccagctgcctgagctgcctactaccctgacatttattgatatcagtaacaatcgcctgggcaggaagggtattaaacaggaggcctttaaatag

SEQ ID NO: 11783 - DNA, 2559 bp, Artificial Sequence
  Description of Artificial Sequence: Synthetic coding sequence
atgctgccaacggaggttcctcagtctcacccaggaccatcagctttgctgttgttgcaattgctactccccccaaccagtgccttcttcccaaatatttggagtctgctggctgccccaggaagcattacgcaccaggatctgacagaggaagcagccctcaacgtcacccttcagctatttctcgagcaacctcccccaggccgtcctccactgaggctagaagactttcttggaagaacattactggccgacgacctgttcgccgcttactttggccctggttcgtccaggagattcagagctgctttgggagaagtctctcgtgccaacgcagcacaagacttcttacccaccagtcgcaacgatcctgatctgcactttgacgccgaaaggttgggccaggggagagccaggttggttggagcgctgcgggaaacggtcgttgctgctcgagctctcgatcacacactggcacggcagagactaggagctgctctgcacgctcttcaggatttttactcccatagcaactgggtggagctcggggaacaacagcctcacccgcacttgctgtggcctcgacaggaattacagaacctggcccaggtggctgacccaacgtgctcagactgtgaggaattgtcttgtcctcgaaactggctcgggttcactctccttacatcaggatacttcggaacccatccaccgaagcctcctggaaaatgctcacacgggggtcactttgatcgaagttcttcacagcccccacgagggggaattaataaagacagcacgtccccgggatttagcccccatcacatgcttcacttacaggcagccaagcttgccctccttgcttcaattcaggctttttctcttttgcgtagtcgccttggggatcgcgatttcagtcgacttctggacatcacacctgcctcctctttgagctttgtgctggataccacgggctcgatgggggaagagattaatgctgccaaaatacaggcccgacatctcgtggagcagcgacgtggcagcccaatggaacccgtacactatgtccttgtgcctttccatgatcctggcttcgggcctgtcttcactacctccgaccctgacagcttctggcaacagctcaacgaaatccacgccttggggggaggggatgaacctgaaatgtgcctgtccgccttgcagctagcacttttgcacacacccccactgtcagacatttttgtgtttacagacgcctctcccaaggacgccttcctcacaaatcaggtggagagcctcacccaggaaagaaggtgcagagtaacgttcctggtcaccgaagacacttctagagtgcagggacgggctcgtagggagattctgtcacccctgcgatttgaaccatataaagcggtcgcgcttgcctctggaggagaagtcatctttaccaaagatcagcatatccgggatgtggctgccattgttggtgaatctatggctgccctggttaccctgcccctggatccaccagttgtagtgccagggcagcccttggtcttctctgtggacggtttattacagaagatcacagtcagaatccatggtgacatctccagcttttggatcaaaaaccctgctggtgtatcacaggggcaggaagaaggcggaggcccattagggcacactagacggttcgggcagttctggatggtgactatggacgaccctcctcagactgggacatgggagatccaggtgactgccgaggacacgccaggcgtgcgggttcaggcacagactagtttggacttcctgtttcattttggcatacccatggaagacgggccacatcccggtctgtaccccctgactcagccagtggccggtctgcaaacacagctgctggtggaagtgactgggttaggttctagggctaatccgggagacccacagccacacttctcacatgtaattctacggggtgttcccgagggagctgagctcggccaggttcctttagagccagtgggccctcccgaacggggactgctggccgcttccctttcccctaccctcctgtctacgcctcgtcccttctctcttgaattgattggccaggacgcagccggtagacgactgcatagggcggctccacagccctctacagttgtgccagtcctgctggaactcagtgggcctagcgggtttcttgctccgggttctaaggtacccctgtcactgagaattgcctcgttttccgggccacaggatttggacttaagaactttcgtaaatccctccttctctctgacttccaatctatcccgagcccacctagaactcaatgagagcgcctggggccgattgtggctggaggtgcccgattctgcggcacctgactcagtggtgatggtgaccgttacggctggcggaagggaggctaatccggtcccaccaacacacgccttcctccgcctgctcgtatccgctcctgctccccaggtgcggaaccattatttcccctcacagggtcccgctcaccatccttacaggctcatttag

SEQ ID NO: 11784 - DNA, 2760 bp, Artificial Sequence
  Description of Artificial Sequence: Synthetic coding sequence
atgggtcccgaggccctgtcctctttgctcctgcttctgctggtggcttctggtgacgcggatatgaagggccattttgaccccgctaaatgtcgatacgccctgggtatgcaggatcgtacaattcctgatagtgacatctctgcctcctcctcatggagcgactctacagcagccagacactcgcggctagaatcctctgatggagacggggcatggtgtccagctggctcagtcttcccgaaggaggaagaatacttgcaagttgacctgcagcggcttcatctggtcgctctggtagggacacaggggcgtcatgctggaggactgggcaaagagttttcacgctcctaccgattacgctatagtcgggacggaagacgttggatgggctggaaagatagatggggacaagaagtcatctctggcaacgaagacccagagggtgtggtgctcaaagaccttggtcccccaatggttgccagactcgtgaggttctatcctcgcgctgatagggtcatgtccgtctgtctgcgcgtagaactctacggctgtctgtggcgagatgggctgctttcttacaccgcaccagttgggcagaccatgtatctctccgaggctgtctacttaaacgatagcacctacgatggtcatacagtggggggacttcaatacggaggtctcgggcagctcgccgatggcgtagtcggcctggacgactttcgcaagtcacaggagctgcgggtatggcctggctacgactatgtggggtggagcaatcacagtttttcttcaggatatgtggaaatggaatttgagtttgaccggttacgcgcattccaggcgatgcaagtgcattgcaacaacatgcacaccctgggtgctaggctgcccggtggggtcgagtgcagatttcgtaggggcccagctatggcctgggagggtgagccaatgcgtcataatcttgggggaaacctcggggatcctcgggctcgcgcagtgagtgtgccgctgggcggtcgggtggcaaggttcctccagtgtcggttcctctttgccggaccatggctgctgttcagtgaaatttctttcatcagtgacgtggtgaacaacagctctccagcattgggcggaaccttcccacctgctccctggtggccacccggaccacctccaacgaacttctcttctctggaactcgagcctcgcggacagcagcccgttgctaaagctgaaggttcccccactgccattctgattggctgcttagtggcgattattttactgctgctgctgatcatcgccctcatgctatggcgcctgcactggaggcgcctcctttccaaagccgagaggagggtcctggaggaagagctgacagtgcacctcagtgtgccgggtgacacaatcctgatcaacaacaggccaggcccacgtgagccccctccctatcaggagccacgcccaagaggcaacccacctcattcagctccttgtgttcctaacggatccgcacttctgctatccaatccagcatatagactgttgctggctacctatgccaggccacccaggggacccggacctccaaccccagcttgggctaagcctacaaatactcaagcttatagcggcgactatatggaacccgaaaaaccaggggcacctctcctgccacctccccctcagaactctgtccctcattacgccgaagccgatatagtcactctccagggcgtgactggcggtaatacttatgccgttccagccttacccccaggcgcagtgggcgatggaccccctcgcgttgacttccctcgatccaggctgcgcttcaaagagaaactaggcgaagggcagtttggcgaagtccacctgtgtgaagtcgattctcctcaggacttggttagtctggatttcccacttaatgtccggaaggggcatcctttactggtcgccgtaaagatattgcgccctgacgcaaccaagaatgctagcttttctctgttctcgcgcaacgattttttgaaggaggtgaagataatgtccagactgaaagatcccaatataatcaggcttctcggtgtatgtgtccaagacgacccgctctgtatgatcactgattatatggaaaacggtgacctcaaccaatttctcagcgctcatcagctagaagataaggctgccgagggggcacccggagacggacaggccgctcaaggcccaacaatctcctatcccatgctgttgcacgttgccgcacagatagcctcaggaatgaggtacttggccacgctgaacttcgtccatagggacctcgcaaccaggaactgcctagtaggagagaacttcacaatcaaaattgctgattttggcatgtctcgaaatctgtatgccggagactactatcgagtgcaggggcgtgcagtcctcccaatcaggtggatggcctgggaatgtattctgatgggaaagttcacgacagcctcagatgtgtgggccttcggggtgactttgtgggaagtgctgatgttatgtagggctcaaccttttggacagctcactgacgaacaggtaatcgagaatgctggcgagttttttagagatcaggggcgacaagtgtacctcagtaggcccccagcctgccctcagggattgtacgagctcatgttgaggtgttggtctcgagagagtgaacagcggcctccattcagccaactacacaggtttcttgctgaggatgccttgaacactgtctag

SEQ ID NO: 11785 - DNA, 1737 bp, Artificial Sequence
  Description of Artificial Sequence: Synthetic coding sequence
atgctgctcctcctccttctcgcccctctcttcttacgtccacctggagcaggcggtgctcagactccaaatgctacctcagagggctgccagattatacatccaccctgggaaggaggcatccgttatcgtggtctgaccagagatcaagtaaaggcaattaattttctgcccgtggactatgagattgaatacgtctgcagaggcgagagagaagtcgtggggccaaaggtgcggaagtgcttagctaacggatcctggaccgatatggacactccttcacggtgcgtgagaatttgttccaaatcttacctgaccctggaaaatggtaaggtgtttctcactggcggagatcttccagcccttgacggcgctcgggtggattttcggtgtgaccccgacttccacttagtgggctctagtcgatctatatgcagccaaggacaatggtccacacccaaaccacactgccaggtgaatcgaacaccgcattccgaacgaagggcagtctacatcggcgcactgtttcctatgtccgggggatggcctgggggtcaagcctgccagcctgcagtcgaaatggccctagaagatgtgaatagtagaagagacatcttaccagattacgagctgaagttgatccaccatgattctaagtgcgaccccggtcaggccacgaaatatctgtatgagctgctctacaacgaccctataaagatcattctgatgcccggatgctcgagcgtttcaaccctcgtcgcagaagccgctcgcatgtggaacctgatcgtgctgtcttacggtagtagttcacctgctctctccaacaggcaacgattccctaccttcttcagaacccacccctcagccactttgcataaccctacacgcgttaagttatttgagaagtggggctggaaaaagattgccacaattcagcagacgaccgaagtatttacatctactctcgacgatcttgaggaacgcgtcaaggaggccggtatcgaaatcacttttaggcagtctttcttttcagatcccgctgtgcccgtgaagaacctgaagagacaggacgcacggataattgtcggcctcttttacgagactgaagctcgcaaggtcttctgtgaagtgtataaggaaagactatttggcaagaaatatgtctggttcctaattgggtggtatgccgataactggttcaaaatctacgacccaagcatcaattgcaccgtggatgagatgactgaagctgtggagggtcacatcactacagagatagttatgcttaacccagccaatacacgcagtatctccaacatgacatctcaggaatttgtggagaaactgacgaagagacttaagaggcaccctgaagaaacggggggtttccaggaagcccctctcgcttacgacgccatttgggccctggctctcgcacttaacaagacgagcggcggaggagggaggagcggcgtcagactggaagactttaattataacaatcagacaattaccgatcagatttatcgcgcaatgaatagcagcagcttcgaaggcgtttcaggccacgtcgtgttcgacgctagcggctcacggatggcctggactctcattgaacagctccagggtggcagctacaagaaaatcgggtattacgacagtactaaagatgatctctcatggtcgaaaaccgataaatggattgtcatctcccgaacacacagccccacatag

SEQ ID NO: 11786 - DNA, 516 bp, Artificial Sequence
  Description of Artificial Sequence: Synthetic coding sequence
atgcgccacaacctgggtggcaatttaggcgaccccagggctcgcgcagtgagcgtacccctcggtggcagggtggcgagatttctgcaatgcagatttcttttcgccggtccctggctcctattttccgaaatatctttcatcagcgacgtggtgaataactcctcgcccgctctcggcggaacttttccaccggctccatggtggccacccggaccacccccaaccaatttcagttccctggagctcgaacccagaggtcaacagcctgttgcaaaagcagagggatcccctacagccatactgatcggatgtcttgtggccatcatcttgctgttgttgctgattattgccctgatgctgtggagactgcactggagaaggttactgtctaaagtgcttgaatcccatcccaggacgcggtcgccgggacttgtgggcattagacctacacccttaccagtctcaccgatggctctggtgcacctctgtgaggttgattcgcctcaggattag

SEQ ID NO: 11787 - DNA, 2067 bp, Artificial Sequence
  Description of Artificial Sequence: Synthetic coding sequence
atgttacctacagaagtcccccagagccatcctggacccagtgcattgttattgctgcaactgctcctgccccctactagcgcatttttccccaatatttggtccctcctcgctgcgccaggcagcataacacaccaggacctaacagaggaagcagcactgaacgtcacattgcagttgttcctcgagcagcccccacccggtaggcctcctctcagactggaggacttcctcggacgaacccttttggcagacgatttgttcgccgcatattttgggccaggcagcagtcgacgcttccgtgccgcactgggcgaagtgtcccgggctaatgcagcccaggattttctgcctacatcgagaaacgaccccgatctccacttcgatgccgaaaggcttgggcaaggacgcgcacggctcgtgggagctctccgtgaaacggtagtggccgcacgagctctcgatcacacgctagcgaggcagcgactcggtgctgccttacatgctttgcaagacttttatagtcatagcaactgggtagagttaggagagcaacagccacacccacatctcttgtggccccgacaggagttacagaacctcgcccaagtcgcagacccaacttgttctgactgcgaggagctgtcctgtcccaggaactggctggggttcaccctcttaacaagcggctattttggcacgcaccctcccaagccgccagggaaatgtagtcatgggggacacttcgaccgctccagttctcaacctccacgcggtggcattaataaggactccacatctcccggtttttctcctcatcacatgttgcacttacaggcggcaaaacttgcactcctcgctagtatacaggcattctcattactgagaagccggctcggagacagggacttttcacgtctgctcgacatcacccctgcgtctagtttgagcttcgtgctggacacaactgggtctatgggcgaggagatcaatgcagccaagatccaggcacggcacttagtggagcagcgcaggggatctccaatggagcccgtacattacgtcctggtcccattccatgacccagggttcgggccagttttcactacctcggatcccgactccttctggcagcagctgaacgagatccatgcactgggcggaggggatgagcctgagatgtgtctatcagctttgcaactggctctccttcataccccacctctgagcgacattttcgtgttcacagacgcttctcccaaggatgcgtttctgaccaaccaagttgaaagccttacccaggagaggcggtgtcgggtgaccttcctcgttaccgaagacacctcgcgcgtccagggcagggcgagaagggaaatcttgagccccctgcgcttcgagccttataaggctgtggccctagccagcggaggcgaagttatattcaccaaggaccagcacatccgagacgtggcagctatcgtcggagaatccatggctgcactggtcaccttgccattggacccaccagtagtggtgccaggtcagcccttggtcttttctgtagacgggctcttacagaaaatcacagtgagaatccacggggatattagttccttctggataaagaatccagccggagtcagtcagggccaagaggaaggcggaggacctctcgggcacacacgcagatttggacagttttggatggtgaccatggacgatcctccccaaaccgggacgtgggagattcaagtcacggctgaagacacaccaggcgtccgagtgcaagctcagacctccttggactttctgtttcacttcggtatcccaatggaggatggaccgcatccaggcttgtatccactcacacagccagtcgctggcctgcagacccaactgctggttgagagccaatcgtggggttctagtgccgcattcctgccccgacacccctcccggggtccaaggggatgccgcacccggccaggggcacttggagcgagaggaacttctggagcccgaagtccgcgttccctggccgtggcccacgcggctgtacacccctag

SEQ ID NO: 11788 - DNA, 5097 bp, Artificial Sequence
  Description of Artificial Sequence: Synthetic coding sequence
atgcggttgctctggggactcatctgggcctcttccttttttactttgtcactccagaagccccgattactgttgtttagcccttccgtggtccacctaggagtcccgctcagcgttggagtccagctgcaggatgtgccaagaggccaggtggtgaagggatcagtctttctaagaaatccgtctcgcaataatgtcccttgtagtcctaaagtcgacttcaccctcagtagtgaaagggatttcgcactactttcactgcaggtgcctctgaaggatgccaagagctgcggcttgcatcagcttctgcgcggacctgaagttcaactggtggcacactccccctggctgaaggactctttgagcaggaccaccaatattcaaggaattaatttgctgttctcttcacgacggggtcacctttttcttcagacagatcagcccatatataaccctggacagcgagtaaggtaccgcgtgtttgccctggatcagaagatgcgcccatctaccgataccatcaccgtgatggtggaaaacagccacggcctaagagtgagaaagaaggaagtgtacatgccatcctccatttttcaggacgactttgtcattcccgatatcagcgaacctgggacctggaagatatcagcgaggttcagcgatgggctcgagtccaattccagtacccagtttgaagtaaagaaatacgtgctgcctaacttcgaagtcaagatcaccccgggaaagccctacatcctgacagtgccagggcacttggacgagatgcagctcgacattcaggccagatacatatacggtaagccggtacagggtgtggcatacgtgcggtttggcctgctagatgaggatggcaagaagacatttttcaggggcttggagtcccagactaagctggtgaatggccaatctcacattagcttgagcaaagccgagtttcaggatgctctggagaaactcaatatgggcattactgacttacagggactgagactatacgtggcggcagccataatcgagtatccaggaggggaaatggaggaggccgagctcacaagttggtattttgtgagttcacccttttccctagacctgtctaaaacaaaaaggcatctcgtgcccggtgcaccgttccttctgcaggcactggtgagggaaatgtcaggctcacctgccagtgggatccctgtgaaagtttctgcgacagtctccagccctgggagcgtgccagaggtgcaggacatccaacagaacaccgatggcagcggtcaagtgtctatacctattattattccccagacgatcagtgagctgcagctgtcagtgagcgccggttcaccccaccccgctatagcacgtctgacagttgcagctcccccatcagggggtcccggatttctttccatagaaagaccagatagcaggcctcccagggtgggcgacactctgaatctgaatcttcgagcagttggatctggggcaaccttctcccactattactatatgatactcagccgcggacagatcgttttcatgaatagagagcctaaacgaacattgacttcggtgtccgtctttgtagatcatcatcttgcccctagcttttatttcgtggccttttactaccacggggaccatccagtcgcgaattcgctaagagtggatgtgcaagcaggcgcttgtgagggaaagctcgaactctccgtcgacggcgcaaagcagtatagaaatggtgaatctgttaagctgcatctggagaccgactccttggctctggtcgccctcggcgcactggatacagcattatatgccgcaggtagcaagagtcataaaccccttaacatggggaaagtgttcgaggctatgaacagctacgatctggggtgcgggcctggaggtggggatagtgcattacaggtattccaggctgcaggtcttgctttcagcgacggagatcagtggacactgtcaaggaagaggttgagctgcccgaaagaaaagactactcgaaaaaagagaaatgtaaacttccagaaagccattaatgaaaagctcggacagtatgcttcacccacagcgaagcgctgctgtcaggatggggttacccggctacctatgatgcgctcatgtgaacaacgagctgccagggttcagcagccagactgtcgggaacccttcctaagctgctgtcagttcgccgagagtcttaggaagaagtcacgtgacaagggacaggccggacttcaacgtgccctcgaaattctccaggaggaggatctgatagatgaagatgatatacctgtgcgtagcttttttccagagaactggctgtggcgcgttgaaactgtagaccgatttcagatcctgacactttggctcccagatagtctgactacttgggaaatccacggccttagcctgtccaagacaaaaggactttgcgtcgcaactcctgttcagctccgggtcttccgggagtttcacctccacctcaggttaccgatgtcggtccggcgatttgagcaacttgagttgcgcccagtcctttacaactatttagataaaaatcttacagtgagcgtgcatgtctcacctgtggaaggcctgtgtctggctggtggcggtggactcgctcagcaggtgctggtacccgcaggctctgcgcgaccagtagcattcagcgtagtcccaacagcggcagccgctgtttccctgaaagtcgtcgcccgtgggtcatttgaattccccgtcggcgatgcagtctcaaaggttctccagattgaaaaagagggcgctatccacagggaagagttagtctatgagctcaatccattggaccatcgagggcgtacgctggagattccaggaaatagcgatcccaacatgataccggacggagacttcaactcctatgtcagagttaccgcatctgatcctctggatactttgggttcagagggagcgctgtctcctgggggtgtcgctagcctgcttagactccccagaggctgcggtgagcaaacaatgatctacctggcccctaccctggccgcatcgcggtacttagacaaaaccgagcagtggagcacattgccacctgagacaaaagaccacgctgtcgatctcattcagaaaggatatatgagaatacagcaatttagaaaggcagacggtagctacgcagcctggctgtctcgtggaagctcgacatggcttacagctttcgtgctgaaagtgctatctcttgctcaggaacaggtcggcggatcaccggagaaactccaggaaacctcgaactggctcctctcccagcaacaagcggatggaagctttcaggatctgagtccagtgatccatagatccatgcagggcggtttggttggaaatgacgagactgttgctctgacagcttttgttaccatagctctgcaccatgggcttgcagtgttccaggacgagggagcagagcccctgaaacagcgcgttgaggcctcaatctcaaaagcgagctctttcctgggggagaaagcctccgcgggattactgggggcacacgctgccgcaatcaccgcatacgcacttacactcactaaagcacctgcagacctaagaggcgtcgcccacaacaaccttatggctatggctcaggagactggtgacaacctgtactggggttctgttaccgggtctcagtcgaacgccgtgtcaccaactcccgcaccaagaaacccttccgatcccatgcctcaggcacccgcactctggattgagactaccgcttatgccctgctgcacttactattacatgagggcaaggcggagatggccgaccaagctgctgcctggctcacgaggcaggggagttttcagggtggattcaggagcacccaggatacggtcatcgctttggacgccctaagcgcctactggatagcatcccatacaaccgaggaacggggtctcaatgtgaccttgtcaagcacaggccgaaatggcttcaagagtcacgcactacagctgaacaatcgacagattagaggattagaagaggagctccagtttagcctgggcagcaaaatcaacgtgaaagtggggggtaatagcaagggcacactgaaagttctgcgcacttataatgtcctggacatgaagaatacaacttgtcaagatctacagattgaggttacagtgaaaggacatgtggagtacactatggaggcaaacgaggattatgaggactatgagtacgatgaattgcccgctaaggacgatcctgacgctcccctccaaccagtgacacctttacaactattcgaaggtcggagaaacaggcgcaggcgagaagcaccaaaactgacttcgctgtccgatcggtatgtgtctcattttgagaccgaaggaccccacgtgctcctgtacttcgactcagtgccaacttcgagagagtgtgtcggcttcgaagcagtccaggaagtgcccgtcgggctggtgcaacctgcctcggccaccttatacgactattataatcctgaacggagatgttcggtgttttacggggctccaagtaaatctagactcctggccacactctgcagcgccgaagtgtgccaatgtgccgagggcaagtgtccaagacaaagaagggccttggagaggggactgcaagatgaagatggctatcgcatgaaattcgcgtgctactacccaagggtcgaatatgggtttcaggtgaaagtgctgcgtgaggacagtcgggctgcgtttcgcctctttgagaccaagatcacacaagttctccatttcaccaaggacgtcaaggccgcagccaaccagatgcggaatttcttggtgcgcgcatcctgccgcctgcgtttggagcctgggaaagagtacctgatcatggggctcgacggcgctacttacgatctggagggccaccctcaatacctgctcgactcaaattcgtggatagaggagatgcccagcgaacgattgtgtaggagcactagacagagagcagcctgtgctcaactcaacgatttcctgcaggaatatggtacgcagggatgtcaggtgtag

SEQ ID NO: 11789 - DNA, 726 bp, Artificial Sequence
  Description of Artificial Sequence: Synthetic coding sequence
atgaagtttatcctgttgtgggcactgcttaacctgaccgtcgccttagctttcaatccagactatacagttagctctactcctccttatctggtctatctgaaatccgactacctgccttgcgcgggtgtgcttatccatccactgtgggtgattaccgccgcacactgtaatctgccaaaactgagggtgatactaggtgtgacgatccccgctgactccaatgagaagcacctgcaggtcatcggttacgagaaaatgatccatcatccgcacttctcagtgacgtccatcgaccacgacataatgctcatcaagctgaagaccgaggccgagctaaatgactacgtcaagctggccaacctcccatatcagaccatctccgagaacacaatgtgttctgtctcaacatggtcgtacaacgtctgcgacatctataaggagcccgattcgctgcagacggtgaatatcagcgtgattagcaagccacaatgcagggatgcatacaagacgtacaatattacagagaacatgctctgcgttggcattgtgcctggacggcgacagccatgcaaagaagttagcgccgctccggcaatctgtaacggcatgttacagggcatcctgtcctttgctgatggctgcgttctcagagccgacgtcggcatttacgccaagattttttactacatcccctggatcgaaaacgtcattcagaataattag

SEQ ID NO: 11790 - DNA, 732 bp, Artificial Sequence
  Description of Artificial Sequence: Synthetic coding sequence
atgggtcctgaagctctctcatcactgctgctgttgctcctagttgcttccggggatgctgatatgaagggtcactttgaccccgctaaatgtagatacgcacttggcatgcaagatcgcacaatcccagactcagacatttccgcaagttcaagctggtccgattccaccgcggctagacactcaagactggagtcctcggatggggatggggcttggtgtcctgcgggaagtgtgttccccaaagaagaggaatatctacaggttgatctgcagcggcttcacctggtcgctctggttggaacacaggggcgtcacgctgggggacttgggaaggaattcagccggagttatcgtctgcggtattcacgagatggacgtcggtggatgggatggaaggacagatggggccaggaggtcatctcgggaaacgaagaccctgagggagtcgttctaaaggatctgggcccacccatggtggcacgtcttgttcgcttctatccccgagctgacagggtgatgtccgtatgtctgcgcgttgaactgtatggatgcttatggagggattgttccatgggtgtgtgggcatcttggcaaatggtctggtgggggtggatgacgctgggtagggtccgctcctgtgggtccggacaggctatgaccatgtgggacggagccactaccgcttctcccgtggccatgtggcgctggagtctctccctaactggctag

SEQ ID NO: 11791 - DNA, 1986 bp, Artificial Sequence
  Description of Artificial Sequence: Synthetic coding sequence
atggatttggtgttgaagcggtgcctactgcacctcgcggtaatcggtgccttgttagcagtaggggcaacaaaagtgccccgtaatcaggactggttgggcgtgtcgcgtcagctgcgaacaaaagcatggaacagacagctatatccagaatggactgaagcgcagagactcgactgctggcgagggggacaagtgagcttgaaggtcagcaacgatggacccacgctgattggggcaaacgcttcgttttcaatcgccctgaatttccccggtagtcagaaggtcttgcctgacggacaggtgatatgggtaaacaacaccattattaatggcagccaggtttgggggggacaaccagtctaccctcaggagacggatgacgcttgtatatttcctgacggtggcccttgcccatctggatcttggagtcagaaaaggtcatttgtatacgtctggaagacatggggccagtattggcaggtacttggaggccctgtgtcaggcctgagcatcggaaccggcagggccatgctgggaacccacactatggaagttacggtctatcataggagaggatcccgctcctatgtccccctagctcattcttcatcagcgtttacaattacggaccaggtccccttttccgtgtccgtgtcgcaacttcgggctctggacggtggaaacaaacactttctgcggaaccaacctcttacattcgcactacagctgcacgacccgtctgggtatctcgccgaggcggacctgagctacacctgggatttcggcgatagctccgggactctcatctctagagctctggtggtgactcatacatatttagaaccaggcccagttaccgctcaggttgtgttgcaggcagccatccccctgaccagctgcggcagcagtccagttccaggaacgacagatgggcataggcccaccgctgaagctcctaacaccaccgcaggccaagttccaacaactgaagtcgttggcactaccccaggacaggcacctacagctgaacccagtggcactacttcggtgcaggtgcccactaccgaagtgattagcaccgcgcctgtgcagatgcctaccgccgaaagtaccgggatgacacccgagaaagtgccggtgagtgaagtgatgggtaccactctggccgaaatgtctacccccgaggcgacaggcatgacgcccgctgaggtgtccatcgtggtgctatctggaacaactgcagcgcaggtcaccaccacagagtgggtggaaactacagccagagagcttccgatccctgagcccgagggacctgacgcctctagtataatgtcaactgaaagtatcacagggtctctcggcccacttttagacgggactgccaccctgaggcttgtcaagagacaagtgcccctggattgcgtactctacagatacgggtccttctctgtcacgctggatatcgtccaggggatcgaatccgcggagatcctccaggccgtgcctagcggagagggcgatgccttcgaattaacagtgagctgccagggaggtttacccaaggaggcatgcatggagatctcctcccccggatgccagcctccagctcaacggctgtgccagcctgtcctcccatcccccgcatgtcaactcgtgctgcatcagatcctaaagggcggatccggcacttactgtttaaacgtcagtctcgccgatactaattcattagccgttgtctcaacgcagctgattatgccaggacaagaggcaggtttgggccaagtacctctgatcgtcggaatcctcctggtactgatggcagttgtgttggccagcctgatctataggaggcgacttatgaaacaggatttctcagtcccacaacttcctcattcctcatcccactggcttagactgccgaggatattttgcagttgccctataggagagaattctcctctgctgtccgggcaacaggtgtag

SEQ ID NO: 11792 - DNA, 2760 bp, Artificial Sequence
  Description of Artificial Sequence: Synthetic coding sequence
atgggacctgaggcactttcttctctgctgttacttctactggtggcctctggggacgctgacatgaagggccactttgatcctgcaaaatgtcgatacgcactgggcatgcaggaccgcaccattccagacagtgatataagcgcatccagctcatggagcgatagcacagccgcaaggcactctcgactcgagtctagcgacggcgatggagcatggtgccccgctgggtctgtcttccccaaggaggaagagtacctgcaggtcgatctgcaacggctacacctcgttgctctcgtgggcacacagggtaggcacgctggcggtctcgggaaggagttctctcgatcgtacaggctacgctattctcgtgacggcaggaggtggatgggatggaaggaccggtggggtcaagaagtaatttctgggaacgaagacccagaaggggtggtgctgaaagatctggggccaccaatggttgccagactggttcggttttacccaagggccgacagagtgatgagtgtatgtctgagggtggagctttatggatgtctttggagagatggattgctgtcttacacagcacccgtgggccagactatgtacttgagtgaggcagtgtatctgaatgacagcacatacgacgggcacactgtcggtggactgcaatacggaggactggggcagctggccgacggtgtggtaggtctggacgactttcgcaaatctcaggagcttagggtgtggccagggtatgattacgtcggatggtcgaaccatagcttcagctctggttacgtggaaatggagtttgagttcgatcggttgcgcgctttccaagctatgcaggtgcattgtaacaacatgcatactctcggagcacggctacccggaggggtggaatgcagatttcgaagaggcccagctatggcttgggaaggcgaacctatgagacataacttaggcggtaatttgggagaccctagggcaagagcagttagtgtccccctgggcggtcgcgtggcgagatttcttcaatgccgctttctgttcgccggtccctggttattatttagcgagatctcctttatttcagacgtggtgaacaacagttctcccgctctaggaggcacattccctcccgctccatggtggccacccggaccgccaccaactaacttttcctccctggaactcgaaccacgcggtcagcagccggtggccaaggccgagggcagccctaccgccatcttgatcggctgtctggtagccatcattttactgctcttgttgattatcgctctgatgctttggagactccattggcggagattgctctccaaagctgaacggagggtcctggaggaagagcttacagttcacttgtctgtcccgggtgacaccatacttattaataatagaccagggccaagggagccacccccataccaggagcctcgcccaaggggcaacccaccacactccgccccatgtgtccccaatggcagtgccctacttctgagcaaccctgcttatagactattgcttgcgacatacgccagaccccctcggggaccgggtccccctacccccgcatgggccaagcccacaaatacacaggcatattccggggactacatggagcctgagaagccaggcgctccgctgctcccacctccaccccagaattctgtgccacactatgctgaagctgacatcgtgaccctgcaaggagtgactggcggaaacacttatgctgtccccgctctgcctccaggggctgtaggcgacgggccaccacgcgttgacttccctaggagtaggctgcgcttcaaggagaaacttggcgaggggcagttcggagaagtgcatctctgcgaggttgactccccgcaggatctggtgtccttagatttccccctcaatgttcggaaggggcaccccctcctcgtggccgtcaagatcttacggccagatgcaacaaagaatgccagcttctcactgttttctcgaaacgactttcttaaggaggtcaaaataatgagtcgactcaaggatcccaacatcataaggctgttgggggtatgcgtgcaggacgatccactgtgtatgataacggattacatggaaaacggagacctcaatcagttcttgtccgcacatcaactcgaggacaaggccgcagaaggagcacccggagatggccaggctgcacagggacctaccatctcctaccccatgctcctccacgtggcagctcagatcgcgtcaggaatgcgctatcttgccacgctgaacttcgtgcatcgagacttagccacccggaattgcctggtgggagagaattttaccatcaaaatcgccgacttcggaatgagcagaaatctgtacgccggagactattacagggtccagggacgagccgtgctacctatcagatggatggcttgggagtgcatcttgatgggaaaatttaccaccgcctccgacgtttgggcatttggggttacgctatgggaggtgctgatgttgtgccgcgcacagcccttcggccagttaacagacgaacaagtgattgagaacgccggagaatttttcagagaccagggacgacaggtgtatctgagtcgcccacccgcttgtccccagggcctgtacgagttgatgctgcgttgctggagtagagaatccgagcagcgaccacctttttcccaactgcaccgcttcctcgccgaagacgctctcaacaccgtgtag

SEQ ID NO: 11793 - DNA, 216 bp, Artificial Sequence
  Description of Artificial Sequence: Synthetic coding sequence
atgccggcaggggtgcccatgtcgacgtatctaaagatgttcgccgcatcgctgctggccatgtgtgccggtgcagaggtggtccaccgctattacaggcccgatctgacgatccctgagatcccccctaagcgtggcgaactcaaaaccgagttgcttgggctgaaggagcggaaacacaaaccacaggtcagtcagcaggaggaactgaaatag

SEQ ID NO: 11794 - DNA, 2685 bp, Artificial Sequence
  Description of Artificial Sequence: Synthetic coding sequence
atgtctcttcctcggtgctgcccccaccctttaaggcccgaagggtcgggtgccatggggcctgaggcgctgtcttccctgctgctgctgctccttgttgcatccggagatgccgacatgaagggacacttcgatccagcgaagtgtagatatgctctgggcatgcaagacagaaccatccctgacagcgatatcagtgcatccagtagttggtccgattccactgctgccaggcactcccgcttagaaagcagcgacggagacggcgcttggtgccccgctggatccgtctttcccaaagaagaggaatacctgcaggtggacctgcagcgtctccacctcgtggcactggtggggacccaaggacgccacgcagggggactaggaaaggaattcagtcgcagctacagattgcgttattctcgggacgggaggcgctggatgggctggaaagatcgttggggacaggaggtgatatccggaaatgaagacccggagggtgtcgtcctcaaggatctggggccacccatggtggctcgacttgtccggttttacccgagggctgacagggtgatgtcagtgtgcctgagggtagagctctatggctgcctgtggcgcgatggcttactgagctatactgccccagtgggacaaacaatgtacctgagtgaggctgtctacctaaacgactcgacttatgacgggcataccgtggggggtttgcagtacggaggcttaggtcagcttgccgatggtgtggtggggctcgatgattttcgaaagtctcaggagctccgcgtttggcccggatacgactacgtaggctggagtaatcattcattcagcagcggttacgttgaaatggaatttgagtttgataggcttagggccttccaggctatgcaagttcattgcaataatatgcacacattgggagcccgtcttcccggaggagtggaatgtcggtttaggagggggcctgccatggcatgggagggcgagccaatgcgacacaatttgggaggaaacctgggagacccacgtgcaagggccgtgtccgtaccacttggaggaagagtggcccgatttttgcagtgcagatttctgttcgccggaccatggctcttgttctccgagattagctttatctcagatgtcgtgaataactctagcccggcactgggcggaacttttccccctgcgccttggtggccaccagggcctccccctacaaatttctctagcctcgagctcgagccgcgtggccagcagcccgtggcaaaggccgaaggatcaccgaccgccattctaatcggctgtctggtggcaatcattctacttctcctgctcattattgcactgatgttatggaggttgcactggaggagactgctgtcaaaggccgagcgtagagtgctcgaagaggagctcacagtccatttatcagtgccaggcgacacaatcctgatcaataatcgaccagggccacgcgaaccccctccataccaggagcccaggccaagaggtaacccaccacactccgcaccctgcgtgcccaatggttcggcctatagcggagattatatggagccagaaaaacctggagccccattgctgccacccccacctcagaattccgtaccccactatgcagaggctgatatcgttacactgcagggggtgacgggaggcaatacatacgccgtcccggcactgccgcctggtgccgtcggggatggtccccctagggtggattttcctcggtctcgtctccgcttcaaagaaaagctgggcgaaggccagttcggtgaagtccatctctgtgaggtagatagcccccaggacctggtgtcactggactttccattaaatgtgcgaaaaggccaccctctccttgtcgccgttaaaatactgcgccctgacgccactaaaaatgcaagaaacgacttcctcaaggaagtgaagattatgtctcgattaaaagatccaaatattatccgcctgctgggagtgtgcgtgcaggatgatccactgtgcatgatcacagactatatggagaacggcgatctaaatcaatttctgtctgcccaccagttggaggacaaagccgcagaaggggctcccggagacggccaggctgcacagggacctactatttcttacccaatgctgctgcatgtagcagcccagatcgcaagcggaatgagatacttagccacgctgaacttcgtccatagagatctggcaaccagaaactgtttggtgggggaaaatttcaccattaagatcgctgatttcggcatgagccggaatctgtacgccggtgactactatcgcgtacagggcagggcagtgcttccaattcggtggatggcttgggaatgcatcctgatgggcaagttcacaaccgcctcggacgtgtgggcattcggagtgaccctttgggaggtgctcatgttgtgtcgggctcagcccttcggacagttgacagacgagcaggtgatcgaaaatgcaggggaatttttcagagaccaaggccgacaggtctacctatctcgtccgcctgcctgtccccagggactttacgagctcatgcttagatgttggtcccgggagagtgaacaaaggccccctttttcccaacttcatcgttttttagctgaagacgccctgaacactgtctag

SEQ ID NO: 11795 - DNA, 273 bp, Artificial Sequence
  Description of Artificial Sequence: Synthetic coding sequence
atgcagctgttcttgcttctctgtcttgtattgctgagtccccagggagcatccctgcataggcaccatccccgagagatgaaaaaacgcgtcgaagacctccatgtgggcgcaaccgtggccccaagctctcggagggatttcaccttcgacctgtatcgggcacttgctagcgcagctccgtcacagtccatctttttttcgcccgtgtctatttccatgtctctcgcaatgctcagcttgggtgctggctcttcgacaaaaatgcagtag

SEQ ID NO: 11796 - DNA, 618 bp, Artificial Sequence
  Description of Artificial Sequence: Synthetic coding sequence
atgatgagaacacttatcacgacacacccacttcccctgttacttctcccacagcagctgcttcagctggtgcaattccaggaagtcgataccgattttgatttccccgaggaggataaaaaggaggaatttgaggaatgcctcgagaagttcttctcgacaggcccagcgagacctcccacgaaagagaaggttaaacgacgggtgttgatagaacccggaatgcctctgaatcacatcgagtattgcaaccacgagatcatgggcaagaacgtgtattacaagcatcgctgggtggcggaacactatttcctcctgatgcagtatgacgaactgcagaaaatttgctataaccgtttcgtgccctgtaaaaatgggattcgcaagtgtaaccgctccaaaggtctggtagaaggggtatactgtaatctgacagaggctttcgagatcccggcatgtaagtatgagtcattatacaggaaagggtacgtgcttataacatgcagctggcaaaacgaaatgcagaagcggattccacacacaattaacgatcttgtggaaccgcctgagcatagatcttttctgagcgaggacggagtcttcgttatctcgccttag

SEQ ID NO: 11797 - DNA, 30 bp, Artificial Sequence
  Description of Artificial Sequence: Synthetic coding sequence
atgtctttctctgcaacaatattgttctag

SEQ ID NO: 11798 - DNA, 600 bp, Artificial Sequence
  Description of Artificial Sequence: Synthetic coding sequence
atgagctttagcgctacgattctgttcagcccccctagcggttccgaagctcgctgttgttgctgcgcgtgcaagtcagagactaatggtggcaatacgggttcacagggcggaaacccacctcccagtactccaatcacagtaacaggtcatggtctcgccgtccagagctcagagcagctgctccacgtgatataccaaagggtggataaggccgttggtttggcagaggcagccctgggcctggctagggccaataacgaacttctgaagagactccaggaagaggttggggatctgaggcaaggaaaggtttccatcccagacgaagacggcgaaagtcgggctcactcctctccgcctgaggagcctggccctttaaaagagtcgccgggagaagcgttcaaagcacttagtgccgtggaggaggagtgtgattctgtcggctccggggtgcaggttgtcattgaagaacttaggcagctcggggcagcatctgtcggcccaggccctttggggtttccagccactcagcgcgacatgcgcctaccaggctgcactctagctgcatcagaagctgcaccactgctgaacccctag

SEQ ID NO: 11799 - DNA, 633 bp, Artificial Sequence
  Description of Artificial Sequence: Synthetic coding sequence
atgtctgctggcaagatgatgcggaccctgatcacaactcacccgctgccccttctgctgttgccacagcagctcctccagctggtgcaattccaggaggtggataccgacttcgatttccctgaggaggacaagaaagaggaattcgaggaatgtttagaaaaattcttctctactgggccagctcggcctcccaccaaggagaaagttaagcgcagggttctgattgaaccaggcatgccacttaatcatattgaatattgcaatcatgagattatgggcaagaatgtctactacaagcatcgttgggtggccgagcattacttcctactgatgcagtatgacgagctccagaagatttgctacaatcgcttcgtaccgtgcaagaatggaatcagaaagtgtaatcgctcaaagggcttagtcgaaggcgtttattgcaaccttaccgaagcctttgaaatacccgcttgcaaatacgaatccctgtaccggaagggctatgttcttatcacttgctcttggcagaatgaaatgcagaagcggattccccacacaataaatgatttggtggagccacctgagcaccggagttttctctctgaagatggtgtgtttgtcatctccccatag

SEQ ID NO: 11800 - DNA, 1221 bp, Artificial Sequence
  Description of Artificial Sequence: Synthetic coding sequence
atgcagctattcctcctgttgtgcctggtgctgctgagcccgcaaggagcatcactgcaccgtcaccacccacgggaaatgaaaaagcgagtggaggaccttcacgtcggagcaaccgtggccccatcatcgagacgggacttcaccttcgatctgtacagggcccttgcctccgccgcaccttcacagagtatttttttttccccagtgtcaatttcaatgagcttggccatgctcagcttgggcgcaggaagctccaccaaaatgcagatcctggagggtctcggccttaatttgcagaagtcctccgagaaagaactgcatcgcggttttcaacagctgttacaggaactgaaccagcctagagacggttttcagctcagtctgggcaatgccctgttcacagatttggtggtagatttgcaggatactttcgtgtccgctatgaagactctgtatctggccgacactttccccaccaactttcgtgactccgccggagccatgaagcagataaacgattatgtggctaagcagactaaaggtaagattgtggacttactgaaaaaccttgattcaaacgcggtggtaatcatggtgaactacatctttttcaaggctaaatgggagacctcttttaatcacaaaggtacccaagagcaagatttctacgttacgagtgagactgttgttagggtgcctatgatgagtagggaagatcagtatcattaccttctggataggaatctctcctgtcgggtggtgggagttccttatcaggggaacgctaccgctttgtttatcctcccttctgaggggaaaatgcagcaggtggaaaatggtttatccgagaaaacgctgaggaagtggcttaaaatgttcaagaagagacagttggaactgtatttgccaaagttctctattgagggttcataccagctcgagaaagtgcttccatctctcggcatctcaaacgtgttcacaagtcacgcagatctctctggcatctccaaccattctaacatccaggtcagcgagatggtccacaaagccgtagtggaagtggacgaaagcggaacccgggctgccgctgctactggaaccatttttacctttcgctctgccaggttgaactcgcagcggcttgtgttcaacagaccatttcttatgttcatagtagacaataatatactttttttgggcaaggtgaatcggccatag

SEQ ID NO: 11801 - DNA, 600 bp, Artificial Sequence
  Description of Artificial Sequence: Synthetic coding sequence
atggaaacctttcctcttctcttactatctctcggcctggtgttagccgaggcatctgagagcactatgaaaataatcaaggaagagttcaccgacgaggagatgcaatatgatatggcgaagtcaggccaggagaaacagactattgaaattctcatgaatcctatcctgttggtgaaaaataccagcctgagcatgtccaaagatgacatgtcaagcactcttctgacgtttcgatccctgcactataatgatcccaaaggcaactcctcaggcaatgataaagaatgctgcaatgacatgactgtatggcgcaaagtaagcgaggctaacgggagctgtaagtggagcaataacttcataagatcttctacagaagtgatgagaagggtgcaccgggcacctagctgcaagttcgtgcagaatccaggaattagctgttgcgagagtctggagctggagaatacggtctgccagtttaccaccggcaagcagttcccacgttgccagtatcactcagtcacgtcgcttgaaaaaatcttgacagtcctcacaggccacagtctgatgtcctggttggtgtgcggttcaaagctgtag

SEQ ID NO: 11802 - DNA, 411 bp, Artificial Sequence
  Description of Artificial Sequence: Synthetic coding sequence
atgagtttctccgccaccatcctgttcagtccaccaagtggaagcgaagcccgttgttgctgctgcgcctgcaagagcgaaacaaatggaggcaacacaggatctcaaggcggtaacccgcctcccagtacccctatcacagtaacagggcacggcctggccgtccagtcctctgagcaacttctgcatgtaatttatcagcgagtagataaagccgtgggccttgccgaagccgctctcggcctggctcgggctaataatgaattgctgaagagactgcaggaagaagtgggagatctccgccaggggaaagtgagtattcccgacgaggatggagagtctcgcgcacatagttctccgcctgaagaaccagggccactgaaagagagccccggagaagctttcaaatag

SEQ ID NO: 11803 - DNA, 252 bp, Artificial Sequence
  Description of Artificial Sequence: Synthetic coding sequence
atgtctttcagcgcaacaattctgtttagtccccctagcggctccgaggcgcgatgctgctgttgcgcctgcaagagtgaaacaaacggtgggaataccggcagtcagggaggaaacccacccccaagtacacccatcaccgtaacaggccacggtttggctgtgcagagcagtgaacagctactccacgtgatttatcagagggtcgacaaagccgtaggcctcgcagaagctgccctcgggctcgcctag

SEQ ID NO: 11804 - DNA, 30 bp, Artificial Sequence
  Description of Artificial Sequence: Synthetic coding sequence
atgtcattctccgcgactattctgttttag

SEQ ID NO: 11805 - DNA, 519 bp, Artificial Sequence
  Description of Artificial Sequence: Synthetic coding sequence
atgcagctttttttactactctgtttagtgctccttagtccccagggggcttcgctgcatagacaccaccccagagaaatgaagaagcgagtggaagatttacatgtgggagctacggtagcacccagcagtcggagagatttcaccttcgatctgtatagagctctggcgtccgctgctcctagccagagcatatttttctcccccgtgtcgatctcaatgtccctggctatgctgagtctgggtgccggatcttctaccaaaatgcagatcctcgaggggctgggactgaatctccaaaagtcgtccgagaaggaactgcaccgcggatttcaacagttattgcaagaactgaaccagccaagagacggttttcagctgagcctgggtaatgccctcttcactgatctagtggtcgacctgcaggacacatttgtgtcggccatgaaaactctctatctggccgatacttttccaacaaacttccgggattctgcgggagctatgaaacagatatag

SEQ ID NO: 11806 - DNA, 615 bp, Artificial Sequence
  Description of Artificial Sequence: Synthetic coding sequence
atgcccggtggtaagaaggtcgctggtggcggaagttcaggagccacccctacttcagcagcagctactgccccaagtggcgttcgcaggcttgagacctccgaaggcacatctgcccagagggacgaggaacccgaggaagaaggcgaggaggatctgcgggatggcggagtgcctttcttcgttaatagaggtggacttccagttgatgaagctacctgggaacgaatgtggaagcacgtggctaagatccatccggatggggagaaagtcgcgcagcggatacgcggagcaacggatttacctaaaatccctatcccttctgtgcccacttttcagccctcgacacctgtccctgaacggctggaggccgtgcaacgctacattagagaactgcagtacaatcatacagggactcagtttttcgaaataaagaagtcacggcctctgaccggtctgatggatctggccaaagagatgactaaagaggcattacccattaagtgcctggaggccgtgatcctcggtatgtatccaagcagccctgaaggagagggttccggactgctgtgggcttctgcgagttgctctgagtcagaaggtggcgttggctag

SEQ ID NO: 11807 - DNA, 1221 bp, Artificial Sequence
  Description of Artificial Sequence: Synthetic coding sequence
atgcagctgtttctgctgctctgcttggttctactgagcccacagggagctagtctccacagacaccacccgagagagatgaagaaacgggttgaagatcttcatgtgggggcaaccgtggccccttcctcgcgtcgcgactttacatttgatctctatcgagccctagccagcgccgcacccagccagtctattttctttagtccggtctctatcagcatgtccttagcaatgctgagtttaggagccggaagcagcactaagatgcagatcttggaaggcttggggctgaatctccagaagagctctgaaaaagaactgcatcggggattccaacaactgctgcaagagctcaaccagccccgtgatggcttccagctcagcctgggcaacgcactgttcaccgatctggtagtggacctgcaggacacgttcgtctctgccatgaagacactgtacttagctgatacattccctacaaatttcagggactccgcaggggcaatgaaacaaattaatgactacgtggccaaacaaaccaaaggaaagatcgttgaccttctgaaaaacctagactctaacgccgttgtaatcatggtaaactatatctttttcaaggccaagtgggaaacctccttcaaccacaaagggacacaggagcaggatttttatgtgacttctgagaccgtagtgagggtgccaatgatgagcagagaggatcaatatcactatctgctggatcgtaacttgtcgtgtcgggttgtgggagtgccctatcagggtaatgcaactgccttgtttatcctgcccagcgagggcaagatgcagcaagtcgagaatgggctgagtgagaaaacactgcgaaagtggttgaaaatgttcaagaagcgacaattggaactttacctacctaaattttctattgaaggctcatatcagctagagaaagtcttaccgagtctgggaatcagtaatgtgtttacctctcacgctgacctgtctggtatatctaatcactcgaatatccaggtgtccgaaatggttcacaaggcagtcgtggaagtcgatgaaagtggaactcgagctgccgcagccacgggcaccatattcaccttcagatccgcaagactgaattcacagcgccttgtcttcaacaggcccttcctgatgtttattgttgacaacaacatcctgtttctgggaaaggtcaatcggccttag

SEQ ID NO: 11808 - DNA, 3837 bp, Artificial Sequence
  Description of Artificial Sequence: Synthetic coding sequence
atgcgcctgttactgctcgtcccactcctcctggcacctgccccaggaagcagcgctccgaaggtgaggaggcagtcggacacttggggtccgtggtctcagtggtcaccttgttcccggacttgtggcggtggcgtgtcattcagagagagaccgtgctactctcagcggagggacggtggcagcagctgcgttgggccagccaggtcccatcgctcatgtcgcactgagtcctgcccagatggagctagagattttagagcagaacagtgtgctgagtttgacggcgctgaattccaggggaggcggtatcgttggttgccgtactactccgcaccaaataagtgcgagttgaattgcatacccaaaggagagaatttctactacaaacatcgagaagcagtggtagatggtacaccatgtgaaccaggaaagcgggatgtatgcgttgatggctcatgcagagttgttgggtgcgatcatgagctggattcaagcaagcaggaggataaatgcttgcggtgtgggggtgatggaaccacctgctatcccgtggccggaaccttcgacgccaacgacctgagtagaggttacaaccagattttgatagttccgatgggagccaccagcatattgatcgatgaggctgccgctagccggaatttcctcgctgtcaagaatgtacgaggggaatattacctcaacgggcattggaccattgaagcggctagggctctgcccgcagcatctacaatcctgcactacgaacggggtgccgaaggcgacctggcgcctgagcgcctgcatgcgagaggacccactagcgaacctttggtgattgagcttatctcacaggaacctaaccctggcgttcactatgaataccatttaccgttgcgccgacccagccccggattctcatggtctcatggttcctggtctgactgctctgccgagtgcggcggagggcaccaatcacggctggtattttgcacgattgaccatgaggcatacccagatcatatgtgtcagcgccagccgaggcctgccgatagacgctcctgtaacctgcacccttgcccagaaacaaagcgctggaaagcaggcccttgggctccctgcagtgccagctgtggaggaggatcacagagccgctcagtatactgtatctcaagcgacggggctggtatacaggaagcagtcgaagaagctgaatgcgcagggttacccggaaaacccccagctatccaggcttgcaatcttcagcggtgcgctgcctggagccccgagccctggggggagtgcagcgtgtcatgcggggtcggcgttcggaaaagaagcgtgacttgccgaggcgaacgaggctcactgttacacactgccgcttgtagtctggaagaccgtccgcctctgaccgaaccctgtgtgcacgaggactgcccacttttgtccgatcaggcctggcacgtcggaacatggggattatgctcgaagagctgtagctccggtactaggcggagacaggtcatctgcgccataggccctccttctcactgcgggtccttgcaacactccaagccagttgacgtggaaccatgtaacacacagccctgccacttaccccaggaggttcccagcatgcaagatgtgcatactccagcttccaatccttggatgccgctgggccctcaggaaagtcccgctagtgatagccggggacagtggtgggcagcccaggagcatcccagcgcaagaggcgatcaccgtggcgaaaggggggatccgagaggtgatcaggggactcatttgtccgcattgggaccagctccgtctttgcagcagccaccatatcaacagccactgcgcagcggttctgggccacacgattgcagacacagtcctcatggctgttgtcctgacggacatacggcttccctgggtccacagtggcaagggtgccccggagccccatgtcagcagagccgatatgggtgctgcccagatcgtgtgtctgtcgctgagggcccacaccatgctgggtgtaccaaatcctatggaggagattctaccggtgggatgccccgtagtagagctgttgcctcaacagtccacaacacccaccagcctcaggcacaacagaatgagcccagcgaatgtagaggctcccaatttggatgttgttacgataatgttgccacagccgctggacctctaggagagggatgtgtgggacaaccaagccacgcttacccagtacggtgtctgctgccttccgctcacggcagttgcgccgattgggccgcacgctggtactttgtggcgtctgtcggccaatgtaatagattctggtacggcggatgccacggcaatgcgaataacttcgcttccgagcaggaatgtatgagctcttgccagggttcgctgcatggccctcgcaggccccagcccggagctagtgggagaagtacccacacggatgggggaggcagctcccctgctggagagcaggaacccagtcagcaccgaacgggtgccgctgttcagcggaaaccatggccatcagggggtttatggcgacaggaccagcagcctggccctggggaggccccacatacccaggcctttggtgagtggccctggggccaagagttgggcagtagggcccctggcttaggcggtgacgcaggctctcccgctcccccttttcactccagctcatatcgcatctcactggcgggagtggaaccgtccctcgtgcaggcagctttaggccagttggtgcgcttgtcttgttccgacgataccgccccagagtcgcaggctgcctggcagaaagatggacagcccatctcatctgatagacacaggcttcaattcgatggatcactgataattcacccactgcaggctgaagacgctggtacctactcctgcgggtcgacgcgtcccggacgggactcacagaaaattcagctacgcatcatcggcggagatatggccgtcctctctgaggcagaactttccagatttcctcagccacgggatccagcgcaggactttggccaagctggggcagccggtccccttggtgccattccatcaagtcacccacagccagccaaccggctgcgccttgaccagaatcagcccagggttgtggacgcttcccccggtcagaggatccggatgacctgtcgcgctgaggggtttcctccgcctgccattgaatggcagagggacggccagccagtttcatctccgagacatcagctgcaaccggacgggagcctggtgattagccgcgtcgctgttgaagatgggggattttacacctgcgttgcctttaatggacaggatcgagaccagagatgggtccaactccgtgtgttgggggagctgacaatcagcggactgcctcccaccgtgacagtgccagagggggacactgccagattactgtgcgtagtggcgggagagtccgtgaacatccgttggagccggaacgggcttccagtgcaagccgacggtcatcgggtgcatcagtcccccgacggaacattactgatttacaatctacgagcccgagacgaagggtcatacacatgcagtgcctatcaggggtcacaggcagtctcgcgttcaacggaggtgaaagtcgtgagccccgcacctacggcgcagccacgcgaccctggtagagattgcgtggatcaacctgagttggcaaattgtgatctgatcctccaggcccagctctgtgggaatgaatattatagcagtttctgctgtgccagctgctccaggttccagccccacgcgcagccaatctggcagtag

SEQ ID NO: 11809 - DNA, 261 bp, Artificial Sequence
  Description of Artificial Sequence: Synthetic coding sequence
atgcagttatttctcctcctttgtctcgtcctcctctcaccccagggtgcctcactgcatcgacatcatcctcgcgaaatgaaaaagcgcgtggaagacttgcacgtcggggctaccgttgccccttcgagccgccgtgatttcacatttgacttgtaccgcgctctggcttccgccgcaccaagccaatctattttcttttccccagtctctataagcatgtccctagccatgttgagccttggggcaggctcttcctag

SEQ ID NO: 11810 - DNA, 906 bp, Artificial Sequence
  Description of Artificial Sequence: Synthetic coding sequence
atgcaactttttttactactgtgcttggtgcttctgagccctcagggggcatcactccatcgtcatcatcccagagagatgaaaaagagggtggaagatctgcatgtgggagcgacagtcgccccttccagcagaagggatttcacatttgacctttacagagccctcgcaagcgcagccccaagccaaagtatcttcttttcccctgttagtattagcatgagcctggctatgctgagcctgggggctgggtcttcaacaaaaatgcagattctcgaggggctgggcctgaacttgcagaaaagctccgagaaggagctccaccgcggtttccagcagctgctacaagagctgaatcagccacgggatgggtttcaactgtccctggggaacgctctgttcaccgatctggtggtggatctacaggacacattcgtcagcgcaatgaagacactgtaccttgccgacacatttcccaccaactttagagattccgccggtgccatgaagcagattaatgattacgtcgcaaaacagaccaaaggaaagattgtagatctgttaaaaaacctggactccaacgctgtcgtgattatggtgaactacattttttttaaggccaagtgggaaaccagcttcaaccataaagggacccaggagcaggacttttacgtcacaagtgaaacagtagttcgggtgcccatgatgagtcgcgaggaccagtaccactacctgctggatcgcaatctgagctgtagggtcgtgggggttccctatcagggcaacgccacagcacttttcattttaccttctgaagggaagatgcagcaggtcgaaaatggattgagcgagaagactctgcgcaagtggctgaagatgtttaagaagcgctattttcagacgtag

SEQ ID NO: 11811 - DNA, 411 bp, Artificial Sequence
  Description of Artificial Sequence: Synthetic coding sequence
atggagacctttccgctcttgttgctgtccttgggcttggtactcgccgaagcatcagagtctactatgaagatcattaaagaggaatttacagatgaggagatgcagtacgacatggccaaatccggtcaggagaagcagacgattgaaatcctaatgaacccaatcctgctggtgaaaaacacctcgctctctatgagcaaagacgacatgagctctaccctactgaccttccgttccctgcattataatgaccccaagggtaactcgtctggaaacgataaggagtgttgtaatgacatgaccgtttggaggaaagtttctgaagccaatggttcatgcaagtggtctaataatttcattagatccagtactgaagtcatgaggcgtgtccatcgcgctccaagttag

SEQ ID NO: 11812 - DNA, 1221 bp, Artificial Sequence
  Description of Artificial Sequence: Synthetic coding sequence
atgcagttgtttctgctgctctgtctcgtgctgctctctcctcagggagcttcccttcataggcatcaccctcgggagatgaaaaaacgagttgaggacttgcacgtcggcgcaacagtcgctccgagcagtcgcagggactttacattcgacctgtaccgggcattggctagtgctgctccaagccaatccatttttttttcacctgtctccattagcatgtccctcgctatgctaagcctgggtgcaggtagcagtacaaaaatgcagattctggaaggcttgggcctcaacctccaaaaatcaagtgaaaaagagctgcacagaggttttcagcagttgctccaggaactgaaccagcccagagatgggttccaattgagcctaggaaacgcgctgtttacagacctggtggttgacctgcaagacacatttgttagtgctatgaagacgttgtacttggccgacacattcccgaccaatttccgcgatagtgccggtgcaatgaaacagatcaatgattacgttgccaagcagactaaaggtaagatcgtggatctgctcaaaaatctcgactccaatgcagtggtaatcatggttaattatattttttttaaagccaaatgggagacatctttcaaccacaagggcactcaggagcaagacttttatgtcacttctgagaccgtggtgcgggtccccatgatgagtcgggaggaccagtaccactatctgttggatcgcaatttgagctgtcgcgtggtgggcgtaccctaccagggaaatgcaaccgcactatttatcctgccctcagagggaaagatgcagcaagttgaaaacgggctgagcgagaagacattgcggaaatggcttaagatgtttaagaagcgtcagctggaactctacttgcccaagttttctatcgagggatcctatcagctggagaaagtgctgccttcccttggcatcagcaatgtatttacatcccacgcggacctctcaggaataagtaatcattccaatatccaagtgtccgaaatggtccataaggctgtggtggaggtggacgaatccggaactagagccgcagctgccacgggaacaatatttacctttcgcagcgcccgtctgaactctcagcgcctggtttttaatcgccctttcctgatgttcattgtcgataacaacatactgtttcttgggaaggttaaccgcccatag

SEQ ID NO: 11813 - DNA, 618 bp, Artificial Sequence
  Description of Artificial Sequence: Synthetic coding sequence
atgatgcgtactctgataaccacacatcctctcccactgctccttctcccccagcagttgcttcagttggtacagtttcaggaggtggatacagactttgacttcccggaagaggacaagaaggaggagtttgaagagtgtctggaaaagttcttcagcacgggacctgcaagaccgcctactaaggagaaggttaaacgtagggtcctgattgagcccggtatgccgctaaatcacatcgaatattgcaaccacgagataatgggaaagaacgtgtactacaagcaccggtgggtggcggagcattattttctactcatgcaatacgatgaattacagaagatctgttataacagatttgtgccctgtaagaatggcatccggaagtgtaatcgtagcaagggcctcgtcgaaggggtttattgtaacctgacggaagccttcgagataccagcctgtaaatatgagtccctttataggaaggggtacgtacttataacctgtagttggcagaacgagatgcagaagcgcattccccatacaatcaatgaccttgtcgagccccctgagcatcgaagctttctttccgaagacggtgttttcgtcatctccccatag

SEQ ID NO: 11814 - DNA, 240 bp, Artificial Sequence
  Description of Artificial Sequence: Synthetic coding sequence
atgtcattttctgcaactatcctgttctctccaccgtccggcagtgaggcaaggtgctgttgctgtgcatgtaaatctgagactaatggtggaaatactggttcccagggagggaatcccccaccttcaacgcccattacagttacaggtcatgggctggctgtgcagagctccgaacagcttctgcatgttatctatcagagggtcgacaaggccgtggggctcgcggaggccgcttag

SEQ ID NO: 11815 - DNA, 618 bp, Artificial Sequence
  Description of Artificial Sequence: Synthetic coding sequence
atgatgagaacactgataacaacccaccccctgccgctgctgctcttacctcagcagctactgcagttggttcagttccaggaggtggacaccgactttgacttccctgaggaagataaaaaggaagaattcgaggaatgtttggagaaatttttttccaccggaccagcaaggcctcccacaaaggagaaggtcaagcgccgagtgctgatagagccaggtatgcctttaaaccacatcgagtactgcaatcacgaaatcatgggcaaaaatgtttactacaagcaccgctgggtcgcagagcattattttttgctgatgcagtatgacgagcttcagaaaatttgctataatagatttgtgccttgcaagaacggtattcgaaagtgcaaccgctcaaagggcctggtggaaggggtctattgtaatctgacggaggccttcgagatccctgcatgcaaatacgaatccctgtatcgcaaaggctatgtgctgatcacatgctcctggcagaatgaaatgcaaaagaggatccctcacacaataaatgacctcgtggagccacccgagcatagaagcttcctgtcagaagacggagtgttcgttatctccccatag

SEQ ID NO: 11816 - DNA, 3789 bp, Artificial Sequence
  Description of Artificial Sequence: Synthetic coding sequence
atgagactgctgctgctggtccctctgctactggccccagcccctggcagcagcgctcccaaagtgcggcgacaatcagacacctggggcccttggtctcaatggtcaccgtgctctaggacatgtggcggaggcgtgtcctttagagaaaggccatgctattcacaaagacgtgatggaggctcttcctgtgtggggcctgccaggagtcataggtcgtgtcggacggagtcctgtccagacggagcaagagatttccgggctgagcagtgcgctgagtttgatggggctgagtttcaaggaagaagatatcgatggttaccctactactctgcccctaacaagtgcgaacttaactgcattcccaagggagaaaacttttattataagcatcgagaagcagtggttgatggcaccccctgtgagccaggcaagcgagacgtgtgcgttgatggctcatgccgggtggtggggtgtgaccacgaattggattccagcaagcaagaggacaaatgtctccgatgtggaggagacggcaccacgtgctaccccgtagccggtacctttgatgccaacgatttaagccggggttataaccaaattctgatcgtacctatgggagccacctcgatattgatcgacgaggcagcggcatctaggaacttcctagccgtgaagaatgtgcgtggggaatattacctgaatggccactggactatcgaagctgctcgggctctaccagctgcaagtacaatattacactatgagagaggcgctgagggggacctcgcccctgaacgccttcatgccagaggaccaacatccgagcctctggtgatcgaattgattagccaggagcccaaccccggtgtgcattacgagtatcatttacccctgcggagacccagccccggattttcctggtcccacgggtcttggtccgactgtagcgctgaatgtgggggtggccatcagtctagactggtattctgtacaatcgaccacgaagcttacccagaccatatgtgccagagacagcctagacccgcagacagacggtcatgcaaccttcatccatgtccagaaactaagaggtggaaggctggcccttgggcaccctgttctgccagctgcgggggaggctcccagtcaaggtcggtgtattgcatttcttcggacggagccggaattcaggaagcagtggaagaggccgagtgtgccggactgccaggaaaaccacccgctatccaggcatgcaaccttcagcgttgtgctgcctggagtccggaaccctggggggagtgcagtgtcagctgtggggtcggagtccgcaagcgtagcgtgacttgtcgaggcgaaaggggctcccttctgcacactgccgcatgctctctggaagaccgacccccattgacagaaccttgtgtgcatgaggactgccccttacttagtgaccaggcttggcacgtcgggacatgggggctttgctccaaaagttgcagttcaggaacccggaggcggcaggttatatgcgctattggtcctccatcacattgtgggtcccttcagcactctaagcctgttgatgtcgaaccctgtaatacacagccatgccacctccctcaggaagtcccttcaatgcaagacgttcacacacccgcatctaacccttggatgccactcggtccacaggagtccccggctagtgacagtagaggccagtggtgggcggcacaggaacacccctcagcccgtggggatcacaggggggaaaggggtgatccccgtggagatcagggcacccatctgtccgccctgggccctgcgccaagcctgcaacagcctccctatcagcagccactccgatccggctcggggcctcatgactgtcgtcacagcccacacggatgttgtccggatggccacactgcaagtttgggcccacaatggcagggatgccctggagcaccctgccagcaatcacgctatgggtgctgtcctgatcgagttagtgtggctgaaggccctcatcatgctggctgcaccaaatcttacggcggtgatagcaccggcggaatgccgagatctagggccgtggccagcaccgtgcacaatacccatcaaccccaggcccagcagaacgaaccctctgaatgtcgcggttcacagttcgggtgctgctacgacaacgtcgctaccgccgcagggcctttaggcgaagggtgcgtcggccagccgtcccatgattgggcagcacgatggtactttgtggcttcggtggggcaatgtaacagattctggtacggagggtgtcacggcaatgccaataactttgcctccgagcaggaatgtatgtcctcttgccagggaagcctgcatggtcctcgacgtccccagcccggtgccagcggccgatcaacccatacagatgggggaggcagcagtccggcaggcgagcaagagccgtcccagcacaggacaggagcagctgttcagagaaagccctggccatccggcggattgtggcgtcaggatcagcagccgggtcctggggaggcaccacatacgcaggcctttggcgaatggccctggggacaggagctggggagcagggccccaggactaggcggtgacgctggaagtccggctccacccttccattcctcctcatacagaattagtttggccggagtggagccttccttggtgcaggcagcactgggtcaactcgttcggctctcctgcagcgacgataccgccccagagagccaggctgcgtggcagaaagacggacaaccaatcagctctgataggcacaggttgcaatttgatggttctcttatcattcaccccctgcaagcggaagatgcgggaacatatagctgtggatcgaccaggcctgggagagattcacagaagattcaattgcgtatcattggtggagatatggccgtcctttccgaagccgagctctccaggttcccccagcctcgggacccagctcaagatttcggtcaggctggcgctgccggtccacttggcgcaatcccaagctcccaccctcagcctgcaaacaggctacgtctggatcagaatcagcccagggtcgtggacgctagcccgggacagcggattcgcatgacttgccgggctgaggggttccctcccccagcgattgagtggcagcgcgacggtcagcccgtgtcatcccctaggcaccagctccaaccagatggtagtctggttatctccagggtggcagtcgaggacggcggattctatacttgtgtcgctttcaacgggcaggacagagatcagcgttgggtccagctcagagtgctaggagagctgaccataagcgggctgccgcctaccgtgaccgtgcccgagggtgacaccgcgagactgctttgtgtcgtcgccggagagagcgtgaatatccggtggtcacgaaatggtctgcccgtgcaggccgatggacaccgggtgcaccaatcccctgatggaaccctgttgatctacaacttacgagcgagggacgagggctcttatacctgcagcgcttaccaagggtctcaggccgttagtcggtcgactgaagttaaggtggtctcaccggcaccaactgcccagccccgagacccaggacgggattgcgttgatcaacccgaactggcaaattgtgacttgatactgcaggctcagctgtgcgggaatgagtattactcaagtttctgctgtgcttcttgtagtcgatttcagcctcatgcccagccgatctggcaatag

SEQ ID NO: 11817 - DNA, 321 bp, Artificial Sequence
  Description of Artificial Sequence: Synthetic coding sequence
atgtcattttcagcaacaatcctttttagcccaccatcaggctccgaggcccgatgctgctgctgtgcctgtaaaagtgagactaatggagggaacactggcagtcaaggcggaaatccccctccttccactccaataaccgtcactggtcacggcttggcagttcaatctagcgagcagctcctgcatgtcatatatcagagagttgacaaggccgtggggctggccgaagccgctctcgggcttgctagagccaataatgaactcttgaaacgccttcaggaggaggtaggggatctgagacagggcaaagtctcttag

SEQ ID NO: 11818 - DNA, 444 bp, Artificial Sequence
  Description of Artificial Sequence: Synthetic coding sequence
atggcactgcagaggacacatagcctgctcctcctactcttgctcactctcctgggcctcggcctagtgcagccctcatacggacaggatggcatgtaccagcgcttcctgagacaacatgtgcatcctgaggagacgggcggaagtgataggtactgcaatctcatgatgcagaggcgaaagatgactttgtatcactgtaagcgatttaatactttcatacacgaagatatctggaatatccgctccatctgctcaaccaccaacattcaatgcaagaatggcaaaatgaactgccatgagggagtggtcaaggtcactgactgcagggatactggttcttcccgggctcccaattgccgatatcgagcaatcgctagcacgcgcagggtggttatcgcctgtgagggtaacccccaggtgcctgtccatttcgacggttag

SEQ ID NO: 11819 - DNA, 435 bp, Artificial Sequence
  Description of Artificial Sequence: Synthetic coding sequence
atgcaactgtttttgctgctgtgtctggttctcctatctcctcaaggtgcctctctacacaggcatcacccccgtgagatgaagaagcgtgtggaggacctccatgtcggcgcaaccgtggctccctccagccgacgggactttacgttcgacctctatagggcgctcgcttctgccgcaccaagtcagtctatctttttctcacccgtttctatttctatgagcttggctatgctgagcctgggagctggatctagtaccaaaatgcagatactggagggactggggttgaacctgcaaaagtcttccgagaaggaattgcatcggggttttcagcagttgctccaggaactcaatcagccaagggacggctttcagcttagcctgggaaacgcactgttcactgacctcgtggtcgacttacaggacacttag

SEQ ID NO: 11820 - DNA, 540 bp, Artificial Sequence
  Description of Artificial Sequence: Synthetic coding sequence
atgggcagctccggcttgctctccttactggttttattcgtgttgctggcaaatgtccagggcccaggactaaccgactggttattcccccgaagatgtccaaaaatccgggaagagtgcgagttccaggaaagggacgtgtgtacgaaggatcggcagtgccaggataacaaaaagtgttgcgtgttcagctgcggtaaaaagtgtttggatttgaaacaggatgtctgcgaaatgcccaaggagacaggaccatgtttggcctatttccttcattggtggtacgataagaaggataacacatgtagcatgttcgtctacggcggttgtcaggggaacaacaacaattttcagtccaaggccaattgtctgaacacatgcaagaataaacagccctgtccaaagattaaagtagagtgtgaagtggaggagatcgatcagtgcaccaagcccagagactgccccgaaaacatgaaatgttgtcctttctcacgcggtaagaaatgcctcgacttccggaaagcatctttgagcacctag

SEQ ID NO: 11821 - DNA, 444 bp, Artificial Sequence
  Description of Artificial Sequence: Synthetic coding sequence
atggcactgcaaagaacccatagccttcttctcttactgttgctgacattgcttggacttggcttagtccagccctcctatggccaggacgggatgtatcagcgtttcctgagacagcacgtccaccctgaggagaccggaggtagcgacagatattgtaacctgatgatgcagcgcaggaagatgacactctatcattgcaagcggttcaataccttcatccacgaagatatatggaacatccgcagcatttgctcaaccacaaacatccagtgtaagaatggcaaaatgaattgccacgaaggggtggtcaaagtcacagactgccgcgacacagggtcctcccgggctcctaattgtcggtatagggctatcgctagcacccgtcgcgtagtaattgcatgtgaaggcaacccccaggttccggtacacttcgatgggtag

SEQ ID NO: 11822 - DNA, 600 bp, Artificial Sequence
  Description of Artificial Sequence: Synthetic coding sequence
atggagacattcccactccttctgttatccttgggattggttcttgcggaggcttctgaaagcactatgaaaattatcaaggaagagtttaccgatgaggaaatgcagtatgacatggcaaagtctgggcaagaaaaacagacaattgaaattttgatgaaccccatactactggttaagaatacctctctgtctatgtcaaaggacgacatgtcaagcaccttgctgacatttaggtccctccactataatgatcctaagggcaactcctctggaaacgataaggagtgttgtaacgatatgacagtttggagaaaagtgtcagaggccaatggcagctgtaaatggagtaataatttcatccgcagctccacagaggtgatgaggcgggtacacagggctccttcctgtaagttcgtacagaaccctgggatttcgtgctgtgagtctctggagctagagaatactgtatgccaatttacaacgggcaaacagtttccgagatgccagtatcactcagtcacctcgttagaaaagatactgacggtactgaccggccattcactgatgagctggctggtgtgcggaagcaagctttag

SEQ ID NO: 11823 - DNA, 153 bp, Artificial Sequence
  Description of Artificial Sequence: Synthetic coding sequence
atgtccttctcagctaccattctctttagtccgcctagtgggagcgaagctcgctgttgttgttgcgcttgcaagagtgaaaccaatggcggaaacactgggtcacaaggaggcaaccccccaccgagcacaccaataacggtcacaggctag

SEQ ID NO: 11824 - DNA, 75 bp, Artificial Sequence
  Description of Artificial Sequence: Synthetic coding sequence
atgcagttattcctcctcctctgcctagttctgctgagcccccaaggcgcttctctgcacagacaccatccttag

SEQ ID NO: 11825 - DNA, 633 bp, Artificial Sequence
  Description of Artificial Sequence: Synthetic coding sequence
atgtctgccggaaaaatgatgaggacgttgatcactacccatccactcccactacttttattgccgcagcagctcctgcagctagtgcagtttcaggaagtcgatactgactttgactttcccgaggaggataagaaggaagagttcgaggaatgcttggaaaaattttttagtactggacctgcccgaccaccaaccaaggaaaaagtcaagaggcgagtccttatcgagcctggaatgccgctcaatcacatcgagtactgcaaccatgagattatgggcaaaaatgtatactataagcaccgctgggtggccgaacattactttctgctgatgcagtatgatgaactccagaagatctgttacaatagatttgtcccatgcaagaacggcatccgcaaatgcaatagatccaaaggcttagtcgaaggggtgtattgcaatctaaccgaggccttcgaaatccccgcatgcaaatatgagagcctttaccggaaaggctacgtactgatcacatgtagttggcagaatgaaatgcaaaaaagaattccacataccattaacgaccttgtggagccacccgaacatcggtcattcctcagcgaagatggggtgtttgtgatatctccttag

SEQ ID NO: 11826 - DNA, 36 bp, Artificial Sequence
  Description of Artificial Sequence: Synthetic coding sequence
atgtccttcagtgccacaattcttttcagcccctag

SEQ ID NO: 11827 - DNA, 444 bp, Artificial Sequence
  Description of Artificial Sequence: Synthetic coding sequence
atgataatcatggtgatcattttcttggtgctcctcttctgggagaacgaggtgaacgatgaggctgtgatgtcgaccttggagcatctgcatgttgattacccacagaacgacgttccagtaccagcacgatactgtaatcacatgatcatccagagagtgattagagaacctgaccatacctgcaaaaaagagcacgtctttattcacgagcggcctcgcaagattaacgggatctgtatttctcctaagaaggtggcctgtcagaatctctccgctattttttgtttccagtctgagaccaagttcaagatgactgtgtgccaattgattgaagggacccggtatccagcatgtaggtatcactactcccccactgagggcttcgtattagtgacatgtgatgatttgcgccctgattcctttcttggatatgtgaagtag

SEQ ID NO: 11828 - DNA, 696 bp, Artificial Sequence
  Description of Artificial Sequence: Synthetic coding sequence
atgcaattattccttctactgtgtctggttctcctgtcgccccaaggggctagcctgcaccgccaccatccaagggagatgaaaaaacgcgtggaagacttgcatgtgggcgctacagtcgccccatcttcgagacgcgatttcacctttgatctctatagagccctagccagcgcagctccctcccagtctattttcttctcccccgtctccatttccatgtccctagcgatgctttcgcttggggctggctcttcgaccaaaatgcagattttggaggggcttgggctgaatctgcagaagtcttccgagaaagagttacacagggggtttcagcagctgcttcaggagctcaatcaaccgagagatggtttccagctctccctgggtaatgccctgtttacggatctggtcgtcgatctccaagatacatttgttagcgctatgaaaaccctttacctggccgacacctttcccacgaatttcagggactccgctggggctatgaaacagatcaacgactacgtggcgaaacaaacaaagggaaagatcgtggatctcctaaagaacctagattcaaacgctgtcgtcattatggttaattacatattttttaaggctaagtgggagacctcattcaaccacaagggaactcaggaacaagacttttacgttacaagtgaaacagtagtgtag

SEQ ID NO: 11829 - DNA, 1626 bp, Artificial Sequence
  Description of Artificial Sequence: Synthetic coding sequence
atggccaagttcggcgtgcatcggatcctacttctcgctatcagccttactaaatgccttgaatccaccaagcttctggcggacctcaagaagtgcggagatttggaatgcgaggcccttataaacagggtgagtgccatgagagactatagaggccctgactgtcggtacctaaactttacgaaaggcgaagagatttccgtctatgtgaaactggctggcgaaagagaggatctttgggctggcaagggcaaagagttcggctatttccctagagatgcagttcaaatcgaagaagtgttcatcagtgaagaaatccagatgtccacaaaagaatctgacttcctttgcctgctgggggtctcctacacctttgacaatgaggattctgagctaaatggagactacggggaaaatatctatccgtatgaagaggacaaagatgaaaagagctctatttacgaaagtgattttcagatcgaacctggcttctatgctacttatgagagtaccttgtttgaggaccaggtccccgcactcgaggcacccgaggatatcgggtcaaccagcgagagtaaggattgggaagaggtcgtcgtggaatcaatggaacaggatagaatccctgaggtgcatgtgccgcctagctctgctgtgtccggagtgaaggagtggtttggactgggtggcgagcaggccgaagagaaagcctttgagtctgtgatcgagccagtgcaggaaagtagcttccgctctcgtaagatcgccgtggaggacgaaaatgacctagaggagctgaataacggtgaaccacagactgagcaccagcaggagtccgagtcagaaattgactctgtgcccaagactcagtccgagctggcttctgagtccgaacacatccccaagcctcagtcaacgggttggtttggtggcggattcaccagctatctgggatttggtgacgaggatactggcctcgagctcatcgctgaggagtccaaccctccactgcaggactttccgaattctatctcatcagataaggaagcaaccgtaccctgcactgagatactgacagaaaaaaaagatactatcacgaatgatagccttagcctgaagcccagctggttcgattttggatttgccatccttggcttcgcttatgcgaaagaagacaagattatgctggatgaccggaaaaatgaggaggatggcggagcagatgagcacgagcaccccctgacttccgagttggatcctgagaaggagcaggagatcgagactattaagatcatcgaaaccgaagaccaaattgataagaagcccgtgtccgagaaaaccgatgagtctgacactatcccatatctgaaaaagtttctgtacaactttgacaacccctggaactttcagaatataccaaaagagaccgaactgccctttccaaagcagattttggaccaaaataatgtaatcgaaaacgaggaaactggcgagttttctatagataattacccgacggataacaccaaagtgatgatattcaaaagttcctatagcctttccgggtggtatgagaatatctatatcagaatttacttcattttcaaacacaatcttttcctctag

SEQ ID NO: 11830 - DNA, 1245 bp, Artificial Sequence
  Description of Artificial Sequence: Synthetic coding sequence
atgaatcccactctcggcttagccatcttcctcgccgtcttactgactgtcaaaggcctgctgaagccaagcttctcccccaggaactataaagccctgtctgaagtgcagggatggaaacagaggatggccgcaaaggaacttgcgagacagaatatggacctgggttttaagttgttgaaaaaattggcattctacaaccccggtcgaaatatttttctaagtcctctttcaataagcacagccttttccatgctgtgtctcggagcccaggactcaacactcgatgagatcaaacagggctttaattttcgtaaaatgcctgaaaaggatctgcacgaagggttccattatatcatccatgaattgactcagaaaacccaagacctgaaactgtccatcgggaacacgctgttcatagatcagaggcttcaacctcagcgcaagtttttggaggatgctaaaaacttctacagtgcagagacaatcctgactaactttcagaaccttgagatggctcagaagcagataaacgattttatttctcagaaaacacatggcaaaatcaacaatctaatcgagaatatagatcccggtaccgtgatgctgttggccaactacatattctttagggcaagatggaagcacgaattcgatcccaatgtgaccaaggaggaggatttcttcctagaaaaaaattcaagcgtaaaagtgcctatgatgttccggagtggaatctaccaggtggggtacgatgataagctctcttgcaccatcctcgaaatcccctatcagaagaatataacagccatattcatcttacctgatgaaggcaagctgaagcacctagaaaaggggcttcaggtcgatactttcagtcggtggaaaaccctcctttcaaggagggttgtggacgtgtcggtaccaagactgcatatgaccggcaccttcgatctcaaaaaaaccctaagttacataggagtgagtaagatattcgaggaacacggcgatttaaccaagattgcgccacatcggtcactgaaggtgggcgaggcagttcacaaggcagaactgaagatggacgagagagggactgagggtgcggcagggactggagcacaaacactgcctatggagacgcccctcgtggtgaaaattgacaagccatacctgctcctgatctattcagagaagattcccagcgtgttgttcttgggcaagatcgtgaatcctattggcaagtag

SEQ ID NO: 11831 - DNA, 618 bp, Artificial Sequence
  Description of Artificial Sequence: Synthetic coding sequence
atgatgcgaactcttatcacgacgcatcccttgcccctgctgctgctcccccagcagttgcttcagctggttcagttccaggaggtggataccgacttcgacttccctgaagaggataaaaaggaggaatttgaagagtgcctggagaaatttttctcgacagggccagctcgccctccaaccaaggagaaggtaaagaggcgggtgctcatcgaaccgggtatgcccctgaaccatatagagtattgcaatcacgagatcatgggcaaaaatgtttactacaaacaccggtgggtggccgaacactattttctcctgatgcagtacgatgaactgcagaagatctgttataatcggtttgttccctgtaaaaacggtatacggaaatgtaaccggagcaaaggactcgtggagggcgtgtattgtaacttgacggaggcttttgagatccctgcatgcaagtacgaatccctgtatcggaaggggtacgtgcttatcacctgctcatggcaaaacgaaatgcagaaaagaattcctcatacaatcaacgacctggtcgagcctccggagcacaggtctttcctgtcggaggacggggtttttgtgatatcaccatag

SEQ ID NO: 11832 - DNA, 516 bp, Artificial Sequence
  Description of Artificial Sequence: Synthetic coding sequence
atggaaacttttcctttgttgctgctaagcttgggacttgtcttggctgaggctagtgagagtaccatgaagattatcaaggaggaatttacggacgaagaaatgcagtatgatatggccaaatctgggcaagagaaacagacaatcgaaattctaatgaatccaatcctgctggttaagaatacaagtctttccatgtctaaagacgatatgtcctcgacactgctaacgttccggagcctccactataacgaccctaagggaaattcgtccggaaatgacaaagaatgttgtaatgacatgaccgtgtggaggaaagttagcgaggctaatggcagttgcaaatggagtaacaatttcatccgaagcagcaccgaggtgatgaggcgagtccaccgtgcgccatcatgcaaatttgtccagaacccaggcatttcatgctgcgaaagtctggagctcgaaaatactgtctgccagttcacgaccggaaaacaattccccagatgccagtactag

SEQ ID NO: 11833 - DNA, 633 bp, Artificial Sequence
  Description of Artificial Sequence: Synthetic coding sequence
atgtcagctggaaagatgatgcgtacactgatcacgactcatcccctgccactccttctgttaccacagcagcttctgcaactagttcagtttcaggaagtcgatacagatttcgactttcctgaagaggataagaaggaagaattcgaggaatgcctggagaagtttttttctactggccctgccagacccccaacaaaggagaaggtgaaacgcagggtcctcatcgagcccggtatgccacttaaccatattgagtactgtaaccacgagatcatgggaaagaacgtgtactacaaacaccgctgggtcgccgagcattactttctgcttatgcagtatgacgaactgcagaagatatgttacaacagatttgtcccttgtaagaatgggattcgtaaatgcaatcggtccaagggacttgtagagggggtgtattgcaacctcacagaggcatttgaaattccggcttgcaaatatgaaagtctctatcgtaagggctatgtgttgattacctgctcctggcagaatgaaatgcaaaagaggatcccccatacaattaacgatctcgtcgagccaccggaacatcgatcattcctgtctgaggacggagtgtttgtcatcagcccatag

SEQ ID NO: 11834 - DNA, 537 bp, Artificial Sequence
  Description of Artificial Sequence: Synthetic coding sequence
atggaaactttcccgctgcttctgctgagcttggggctcgttctcgctgaggcatccgagtcaactatgaagattattaaagaggagttcaccgacgaggagatgcagtacgacatggccaagagtggccaggagaagcagacaatcgagatactcatgaatcctattctgctggtaaagaacacgtcattgtccatgagcaaggatgacatgtcgagtacgctcttgacatttcgcagcctgcactacaacgatcccaagggcaattcaagtggtaacgacaaggagtgctgcaacgacatgactgtctggagaaaagtttccgaggccaacggctcctgtaaatggtcaaataacttcatacgcagttccactgaggtgatgcgtcgggtccaccgggcacctagttgcaaatttgttcagaacccaggaatctcctgttgtgaatccctggagctggagaacaccgtttgtcaatttaccaccggcaagcaatttccaaggtgccagtaccattcagtaaccagtttggagtag

SEQ ID NO: 11835 - DNA, 474 bp, Artificial Sequence
  Description of Artificial Sequence: Synthetic coding sequence
atgcagttgttcttgttgctttgtctagtcctgctgagtccccaaggcgcatccctccatagacaccatcccagagagatgaaaaaacgtgttgaggatcttcatgttggggcaaccgtggccccatcttcacgacgcgatttcacctttgatctgtatcgggctctcgcctctgcagcccctagccagagcatattcttctcccccgtgtccatatccatgtccttggccatgctatctctgggtgctggaagctccactaagatgcagatcctcgagggtctgggactgaatctccagaaatctagtgaaaaggagttgcaccggggattccagcagctgctgcaagagctaaatcagcctcgggacggatttcagctcagcctaggaaacgctttattcacagatctggttgtcgacctgcaggatacttttgtgagcgccatgaaaactctgtacttagccgacacctag

SEQ ID NO: 11836 - DNA, 1035 bp, Artificial Sequence
  Description of Artificial Sequence: Synthetic coding sequence
atgccacctcgcatgctcgtggcccctttgcccttgcactttctactggctgctgtgtccagcgaaaatcggagcggaaggaggcagtggcagcaggccgtggccgctggctccggccctggacgaaatagcagtagagcaatccactggtctttgccgagggccctggttccagccacaggaacaagagcaagtgggagtcagaaacgccagcgcccaccaaagggacaggaggccctgtggagcagaccgcactcaagacattcagcagagcgcgcaggagggtcgcactctgacccaggccgtctcagcgcgcctctcggactgggtctcccttccggccgaggaagattgaccgcgatgcctggcagggcacctctcaggacagttcctggcgcactaggagcatggcttctgggaggtctgtgggcttggacactttgtggcctctgtagtctcggagccgttggcgcaccacgcccatgtcaggcaccccagcaatgggaaggaaggcaagtgatgtatcaacagtcctctggacgaaatagcagggccctattgagttatgacgggctgaatcagagagtccgtgtgttggatgagcgcaaggcactcattccttgcaaaaggctgtttgagtatattctgctctataaggatggcgtgatgttccagatagatcaagccacaaaacagtgttccaaaatgacattgacgcagccctgggaccctctggacatcccccagaatagcacgtttgaggatcagtactccatcggtgggcctcaggagcaaatcacggttcaagaatggagtgatcggaaatccgctcggtcgtatgagacatggattgggatatacactgtgaaagactgttatccagtgcaggaaaccttcaccatcaattattcagtcatccttagcactagatttttcgatatccagttgggcataaaagatccatcagtcttcaccccccctagcacatgccagatggctcagcttgagaaaatgtccgaagactgttcgtggtag

SEQ ID NO: 11837 - DNA, 321 bp, Artificial Sequence
  Description of Artificial Sequence: Synthetic coding sequence
gggcagccaaaagctgcaccttccgtgacccttttcccccctagcagcgaggagctgcaagcgaacaaggccactctcgtgtgcttggtgtcagacttttacccaggggctgttacggtggcctggaaggccgacggatcccccgttaaggtgggggtggagacaactaagccaagtaagcagtcaaacaacaagtacgcagcatccagctatctgtctctgacgcccgaacagtggaagtcgcacagatcctactcctgcagggtcacccacgagggaagtacggtcgagaagaccgtcgctcctgccgaatgttcctag

SEQ ID NO: 11838 - DNA, 672 bp, Artificial Sequence
  Description of Artificial Sequence: Synthetic coding sequence
atgcggttacaacgtcctcggcaggctcctgcaggcggaaggagagcgccaagagggggaagagggtctccttaccgacccgatcctggcaggggcgctaggcggctgcgacgttttcagaaggggggagagggtgccccacgtgccgatccgccatgggcgcctctgggtacaatggctctcttggcccttcttctggtcgttgctctgccgagagtgtggaccgatgcgaatctgaccgccaggcaacgggatccagaagacagccagcggaccgacgaaggcgacaacagggtgtggtgtcacgtgtgtgaacgggaaaacaccttcgagtgtcaaaatccaagacgctgtaagtggaccgagccgtattgcgtgatagctgcagtcaagatctttccacgcttctttatggtggccaaacagtgctcagccggatgcgccgcaatggaacgccctaagcccgaagagaaacgcttcttgttagaggagcccatgccttttttctacctcaagtgctgtaagatccgctactgcaatctcgagggtccacctattaacagctctgtgtttaaagagtatgcgggttctatgggggagtcttgtggtggcctatggcttgctatccttttactgctggccagtatcgccgctggtctgagtctatcttag

SEQ ID NO: 11839 - DNA, 408 bp, Artificial Sequence
  Description of Artificial Sequence: Synthetic coding sequence
atgacgcccacacctaccgccgcatggaccccaccacctccacttagacctagcgcagctgccgcaggcgctcagtgtcgatcctgtccatttaggggaggttgcgccccatccactgctcggaccccacccgcatgcatgcgtcccgctgggccttgcgcccctccaacctggcctgcaccctccacgaccaccagcacctgcaccagtagaagagcaggctgtaccgccagtagcgccagctacagcaccctggcagcagcctgctcgctgaggaggtccggggtgcggtggcccccttcaagcgcttattccacttgggcgttcgcttcatgttgcgcgtcttcagcttcatgccgctgctgctgttgttgctgggccgctggagcctggacaagtgcatggtag

SEQ ID NO: 11840 - DNA, 1542 bp, Artificial Sequence
  Description of Artificial Sequence: Synthetic coding sequence
atggcaccagcacgaacaatggccagggccagactcgcccctgccggaataccagcagttgccctgtggcttttgtgcacactaggcctacaaggcacccaggccggacccccacccgcacctccaggattgccagccggtgccgattgtctcaattcttttaccgcaggcgtcccaggcttcgtgctagacacaaatgcgtcagtctctaacggtgcgaccttcttggagtcacctacagtgagacgaggctgggattgcgtccgcgcttgctgtaccacgcagaattgcaacctggctctggtcgagttgcagcctgaccgcggtgaggacgccatcgcagcatgcttcctaattaattgtctgtacgagcagaattttgtgtgcaagtttgctccaagggaaggctttatcaactatcttacacgagaagtgtataggtcttatcggcagctccgaacccaagggtttggaggaagcggcatacccaaggcctgggcaggcatcgacctgaaagttcagccccaggagcctttagtgttgaaggatgtggagaacactgactggcgcctgctcaggggggataccgatgtgagagtcgaacggaaggatcctaatcaagtcgagctgtgggggctgaaggaggggacctacctcttccagctgacagtaacaagttctgaccatcccgaggatacagcgaatgttacagttacggtactgtccacaaagcagaccgaagattattgtctggcgtcaaacaaagtggggagatgtagagggagctttccgaggtggtattacgatccaacagaacaaatctgcaagtcttttgtgtacggcggatgccttggcaacaagaataactacttgcgggaggaggagtgcattctcgcttgtagaggggtccaaggcccttctatggagcggagacacccagtttgctctggtacgtgtcaacccacccagttccgatgctctaacggatgctgcatcgactcttttcttgaatgcgatgacaccccaaattgtccggacgcctccgacgaagctgcttgcgagaaatatacatccggcttcgacgagctccaacgtatacactttccctcagataaaggccactgtgtggacttgccggacacaggcctgtgcaaggagtccattcccagatggtattataaccctttctccgaacactgtgccaggttcacttatggtggttgctacggaaataagaataatttcgaggaggaacaacagtgtctggagtcttgtagaggaatcagtaaaaaagatgtgttcggccttcggagggaaatcccgattccctccaccggctccgtggaaatggcagtggctgtgttcttggtcatctgcatagtagtggtggtggcgatccttgggtattgtttttttaaaaatcagaggaaagacttccacggtcaccatcaccaccctccaccaacccccgctagctctacagtctctacaaccgaggatactgagcatcttgtctacaaccatactactaggccgttgtag

SEQ ID NO: 11841 - DNA, 1341 bp, Artificial Sequence
  Description of Artificial Sequence: Synthetic coding sequence
atgctgcatcccgaaacctccccaggcagaggccacctgctggctgttctactggccctgcttggcaccgcttgggcagaggtctggccccctcagttgcaggagcaggccccaatggccggagcgcttaacagaaaagagtctttcctcctgctatccctacacaatagactgagatcctgggtgcagcccccagcggctgatatgagacgcctcgactggtcggactcactcgctcagttggcccaggcgcgagcggcactctgtggcatcccaactccatccctggcctccggcctgtggcgcaccctacaggtgggatggaatatgcagctgctgcccgcaggactagcttcattcgtggaagtggtgtccctctggtttgcggaaggccagcggtatagccacgcagctggagaatgcgcaagaaatgccacctgcacacactatactcagctcgtgtgggctaccagcagccagctgggctgtggtagacacttgtgcagcgctgggcaggcagccattgaggcatttgtttgtgcttactcacctcggggaaattgggaggtgaacggcaagaccattgtgccatacaagaagggagcttggtgctcgctatgcactgcctcggtgtcaggctgttttaaagcatgggaccacgccggaggactttgtgaagttccgagaaatccctgtcgcatgtcctgtcaaaatcatggaagattaaacatttccacatgccattgtcactgtccacctggttatactggaagatactgtcaggtccgctgctctctccagtgtgtgcatggacgattccgagaagaagaatgttcctgtgtgtgtgacattgggtatgggggtgcacagtgcgcaacgaaagtgcacttcccctttcacacttgcgacctgcgtattgatggtgattgcttcatggtttcaagtgaggccgacacctactatagagcccgtatgaagtgccagagaaagggaggcgtcctcgcccagataaaatctcagaaggtgcaagatattctcgctttttacctggggagacttgagaccactaacgaagttattgattctgacttcgagacccgcaacttctggataggacttacttataagacagcaaaagattccttccggtgggccactggcgaacatcaggcatttacctcctttgcttttggccagccagataatcacggctttggcaactgtgtggaactccaggcttccgccgcttttaattggaataaccagagatgtaagaccaggaatagatatatttgtcagtttgcacaagaacacatcagtcgatggggccctggatcctag

SEQ ID NO: 11842 - DNA, 936 bp, Artificial Sequence
  Description of Artificial Sequence: Synthetic coding sequence
atgggtgttatggcaatgctcatgctgccattattgctgctgggcataagtggcctgctattcatatatcaagaggtctctaggctctggtctaagtccgcagtccagaacaaagttgtcgtaattaccgacgccatttccgggctcggcaaggaatgtgcccgagtcttccatacgggcggagccagactcgtgctctgcgggaagaactgggagcggctggaaaacctctatgatgccctaatcagtgtggctgatccgagtaaaacgttcactcctaagttagtgctgctggacctttccgacatcagctgtgtgcccgacgtagctaaggaagttctggattgctacggctgtgtggatattttgattaacaatgctagtgtgaaagtaaaaggacctgcgcacaagatatcattggaacttgataaaaaaataatggacgcaaattatttcggcccaattaccctcacgaaagcattgctgcccaatatgatcagtaggaggacaggccagatagtgcttgtcaacaacatccagggaaagtttggtatccctttcaggacaacctatgctgcaagcaaacatgcagcgttggggttcttcgattgcttaagggccgaagtcgaggagtacgacgtcgtgatctcaacagtttccccaacatttattagatcctatcacgtttatccggagcagggcaattgggaggcctctatctggaagttcttctttagaaagctgacgtacggcgtacacccagttgaagttgctgaagaggtcatgagaaccgtgcgccgtaagaaacaggaggtattcatggcaaaccccatcccgaaggccgctgtgtacgtgcgcacattctttcctgagttcttttttgccgtcgtggcctgcggggtgaaggagaagctaaatgttcctgaggaggggtag

SEQ ID NO: 11843 - DNA, 594 bp, Artificial Sequence
  Description of Artificial Sequence: Synthetic coding sequence
atggcaaaaaacgggctcgtgatttgcatcttggtcattacactgctgctggatcagacaacaagccacacgtctcggctgaaggccagaaagcactccaaaagaagggtccgggacaaggatggcgacctaaaaacccagatagaaaaactctggactgaggtcaatgccctcaaggaaatccaagccctgcagacagtgtgtttgcgcggaacaaaggttcacaagaaatgctacctggccagtgaaggactgaagcatttccatgaggcgaatgaggactgcatctcaaaaggtgggatcctggtcatccccaggaatagtgatgagatcaatgctctgcaggattacggaaagcgttctctgcctggggtcaacgacttttggctgggcattaacgacatggtgacagagggcaagtttgtggacgtcaacgggatcgcaatcagctttttaaactgggatagggctcagccgaatgggggtaagcgagagaattgtgtcctgttcagccagagcgcccaaggcaagtggtcagacgaggcgtgcaggagcagcaagaggtatatctgcgaatttacaatccctcagtag

SEQ ID NO: 11844 - DNA, 705 bp, Artificial Sequence
  Description of Artificial Sequence: Synthetic coding sequence
atgaaagtgctgctgttgacaggccttggagccctcttctttgcctactattgggacgataattttgatcctgggggtcttgactacttggtgcttaatcacattggaggagctcctgcaggcacccgggcaagaagtccacaggcgacaagatggctcatgcaggtgaattttgtcagctatgtgcagctcacctcacgcgcacttccttctctcaccgatagcaaaggttcacttgtggtggtaagctctctgctgggcagggtgccaacaagctttagcacgccttatagtgcagccaaatttgccctcgacggcttctttggaagtcttagacgagagttagacgtgcaggacgttaacgtggctatcactatgtgcgtgctgggactccgcgatcgcgcttccgcagctgaggccgtccgtagctctaccagccggccacggcagccagagcataggggagtccctctgcaatcgcaaacagccatgttcttgcccccaaccgtgcctggcgcaagaacgctgaccgaaactcccctgcgtggttggccccagccaaagatgaaaagtagtagacagaagtccaagactgagaagaatgatgggcatctggagcccgtgaccgcctgggaggtgcaggtccctagggtgaggcggctgtgtcggggtctggccagacctcatctgtttggccacgattag

SEQ ID NO: 11845 - DNA, 228 bp, Artificial Sequence
  Description of Artificial Sequence: Synthetic coding sequence
atgaaggtcttgctcctcacaggcctgggcgctctgtttttcgcttactactgggatgacaacttcgatccagcttctctgcagggagctagagttttgctgacgggggcaaatgctggggtgggggaagagctggcatatcactacgcacgcctgggtagccacctggtgctgacggctcacactgaagctctcctccagaaagccggttggacgacctcctgctag

SEQ ID NO: 11846 - DNA, 225 bp, Artificial Sequence
  Description of Artificial Sequence: Synthetic coding sequence
atgcagccctccgagatggtcatgaaccccaagcaggtgtttctgtctgtcctaatatttggggtagccggattgctactgtttatgtaccttcaggtgtggatcgaggaacagcataccggtcgcgtggaaaaaagaagggagcaaaaggtcacctccggttggggccctgtaaagtacctcagacccgtacctagaatcaaacctcaggtcagccacgcatag

SEQ ID NO: 11847 - DNA, 861 bp, Artificial Sequence
  Description of Artificial Sequence: Synthetic coding sequence
atgaaggtcctgctcctgacaggtctgggggcacttttcttcgcctactactgggatgataacttcgaccctgcatccttgcagggtgctagagtgctactcaccggtgccaatgccggagtgggtgaggagctggcctaccactatgcacggcttggctcccacctggtactcaccgcccacacagaggccctgctccagaaagtggtgggcaattgtcgcaagctgggagcacccaaagtcttctatatcgcggctgacatggccagcccagaggcacccgagagcgtggtgcaattcgctcttgacaagctgggaggcctcgattatcttgtgctgaatcacattggcggagctccagcgggaactcgagcccgtagcccgcaggcaacaaggtggcttatgcaagtaaacttcgtctcctatgtccaactgaccagcagagcactgcccagtctcacggatagtaaaggctcactggttgtggtaagtagtctgctcggccgtgtgccgacctctttcagcaccccttacagtgcggctaaattcgctcttgatggcttttttggtagcttaagaagggagctagatgtgcaggacgtgaacgtcgcaatcactatgtgcgtgcttggcctgagggacagagcatcggctgcagaggctgtgcggggtgtcactagggtaaaagccgcaccgggtcctaaagctgccctggcagtgattagagggggagccacgcgggctgccggtgtgttctacccatggcgctttcggttgctgtgccttttaaggaggtggctgcctcgccctagagcttggttcattagacaggaattaaatgtgaccgccgcagcagcctag

SEQ ID NO: 11848 - DNA, 459 bp, Artificial Sequence
  Description of Artificial Sequence: Synthetic coding sequence
atgcaggtcaattttgtttcatatgtgcagctaacatcacgggcattgccttccctgaccgactctaagggctccctagtcgtggtgagcagcctacttgggagagtgccaacttcgttttccacaccttactctgcagctaaatttgctctggacggattttttggaagtctgaggcgcgaacttgatgtacaggatgtcaatgtggctatcacgatgtgtgtactgggacttagggaccgagcctcagccgctgaggcagtaagaggtgtcactagagttaaagcagctccagggccaaaggcagcattggccgtgattagaggcggagcaaccagggctgctggggtattttatccttggagatttcgcctactgtgtctcctccggagatggctgccaagaccaagagcttggtttatcagacaggagctgaatgtgactgccgctgccgcttag

SEQ ID NO: 11849 - DNA, 2856 bp, Artificial Sequence
  Description of Artificial Sequence: Synthetic coding sequence
atgcgcgtgctcgcatgtctgctggccgctttagtgggcatccaggctgtggagcgcctacggttggccgatggtccgcatgggtgtgctggcaggttagaggtgtggcatggcggacgatggggaaccgtctgtgacgacggctgggatcttagagacgcggcagttgcgtgtcgacaactggggtgtggaggggctctcgcggctccaggaggcgcttttttcggagaaggggcaggcccagtgtggctgagcgaacttgcatgccggggtaatgagggacagctcgggctgtgtcatcataggggatggaaagctcacatatgctctcatgaggaggacgccggagtggtctgtgccggacagcgcgtcgccaattctagagatgattcaacttcgcccctggacggagccccttggccaggactccttctggaactgagcccgtccaccgaagagccgctggtgacccatgcccctcgacccgctgggaatccacagaacgcatcccggaagaagagccctcgccctaagcaggcaaagtccacacgcgcaccactgctgaccacaggggctcctagacaggagcgactgaggctggtaagcggcccacaccgctgcgctgggaggctggaggtgtggcatggaggtagatggggtaccgtttgtgatgatgggtgggatcttagagatgccgcagtggcgtgcagggagctaggttgtggcggtgctttggctgcaccgggaggggctaggtttggcccaggcgcaggcccagtgtggatggatgatgtgggttgcggaggcggtgagcaggctctcagggactgtcctaggagcccttgggggcgatctaattgtgatcactccgaggacgccggacttgtgtgtacaggtccagccccacgcctcagactggcagacggaccacacggttgcgctggccgactggaagtttggcatggtgggaggtggggctctgtgtgcgacgatgcttgggatctgcgcgatgcagcagtcgcctgcagggagctcgggtgcggcggagccctggctgcgccaggaggtgcgttctttggggaaggttccgggcctatcatcctggacgatttgagatgtaggggaaatgaaaccgcactccgattttgtcctgcccgaccatggggccagcatgattgtcatcacagagaagacgctggggctgtctgcgatggcatgccactcggttatgttcccccaacagcgccaactgactcgaacaattccacgccccgtgaagcggcttcgcgccctcccagtacaatgacgagtcaggccccaggaacggcaggggtgagtccaccccctgcctcccctactgtgctgtgggaacctgggcctgaggctggctctcctcagttacgcttagtggccggaccttctaagtgttcaggcagactagaagtctggcatgaccagcgatggggcaccgtgtgtgacgattcatgggatatgcgcgattcagccgtagtctgtcgcgaactggggtgtgggggtccacagcagcctgatcccgctgccggaaggttcggctggggcgctggtcccatctggttggacgacgtgggatgtgtgggcaccgaggcatctctatccgactgccctgcagcaccgtggggaaaacataactgcgcccataatgaagatgtgggagtgacctgcacaggaccacctgggctagactccatttcagacccatttagctggtcatggattccgggactgggtagggaccgtgatgcatggcttcccggagagctcgcaactaaaccatctgcctctgtaaccgctagcgttctggagaagaccactaccaaagccccaggcaaaatgcctaagtccaccaaaaaatgggtgacaaaaaatgctaagcggccaacgacacaaccaccagtcatgcctaccactaagcactcccgcgctcagtctccaccagatcttactagccagaccactgcagctttgactaccgaggcaagcaggcgccctacctccgaattcaccagaagaccgaccacagaagctccccagaggtggacatctcacactaccgccactctcacaccccaagcccctcgtgagaggaccactaagacaatggccatgctgacaacccagggcccacaagagatgactagcgagtctacaatcaaaagcataccacaggcttccctcgagccctctgcagaaatcccggagggctctcctgaatccccaaaggatcccgctccttccccctccgtgagtacaacaggtgagtccggcctgttccgagtgaggctcgctgatgggcctaataggtgtgccggtaggcttgaggtgtggcacgccggtcgctggggcacagtgtgtgacgataattgggacctgcgtgatgcaaccgtggcctgctgggaacttggctgcggtaaagtgaggcctagagtggggaaaacacactatggcccaggtaccggtcctatttggttggatgacatgggctgtaagggcagcgaggccagcctcagtgattgcccctcgggtgcctggggcaagcacaactgtgatcatgaggaggatgtagggttaacctgtacaggctataccgattatgatgactaccctccctggacatgggaccctaccagccgtgaggacttagccaagggcaccacaacagccggagttcctgggcacactcttccttggcggaccaccaggagacccggaagcagttccccggcaataaggcgtttgcctgacacagagccagaggccggtgctcctagaggggatgccccaagatctcgcacagcccgagtggccgctcccccttag

SEQ ID NO: 11850 - DNA, 8430 bp, Artificial Sequence
  Description of Artificial Sequence: Synthetic coding sequence
atgactctggagggactatatttagcccgaggccctctggccagactcctgctggcctggagcgccttgctttgcatggctggagggcaaggcagatgggatggagcgctcgaagccgctggacctggcagggtgcgccgacgcggttctcccggtatcctgcagggccctaacgtgtgcggatcaaggttccatgcttactgctgtcctgggtggcgcacattccccggacgaagccaatgtgtggtcccgatctgccgacgtgcgtgtggcgagggcttctgctcacagccaaatctgtgtacctgcgcagatggaaccctcgcccctagctgtggggtcagtagaggtagtggctgtagtgtgagctgcatgaacgggggaacttgccgcggtgctagttgtctgtgccagaagggctatacaggaactgtgtgtggacagccaatctgtgaccgcggatgtcacaacggcggacgatgcattggcccaaacagatgcgcctgcgtgtatggcttcatggggcctcaatgcgaacgtgattatcgcacaggaccctgctttggtcaagtgggtccagagggttgccagcaccagctgactgggttagtctgtactaaggccttgtgctgcgccaccgtgggacgcgcatggggcctaccctgcgagctatgccctgcccagcctcacccatgtcgcaggggcttcatccccaatatacacacaggagcttgccaggatgtggatgagtgtcaggccgtgcctggactgtgtcagggcggatcctgcgtgaacatggtgggctcctttcactgccgctgtcctgtcggtcaccggctgtcagattcctccgctgcatgtgaggactacagggccggagcttgcttttctgtgttgttcggaggtcggtgcgccggagatttagcagggcactacactcggaggcaatgttgctgcgatagaggcaggtgctgggcagccggtcccgtgcccgagctctgtcccccaagaggatccaacgaattccagcagctctgcgctcagcgactaccccttttaccaggtcacccagggctctttccaggcttactaggcttcggatctaacggaatggggcctcctctgggcccagctagactcaatcctcacggctccgacgctcgcggaatcccttccttgggccctggtaactctaacattggcacagccaccctgaaccagacaatagatatctgtcggcactttacaaatctgtgcctgaacggccgatgcttgcctaccccctcctcttaccgctgcgagtgcaatgtcggctatacacaggacgtgcgcggagaatgcattgacgtggatgaatgcacgagtagcccttgccaccatggagactgcgtcaatatccccggaacataccattgtcgctgttaccctggattccaggccacgccaacccgtcaggcctgcgtggatgtggatgaatgtatagtcagcggcggtctttgccacctcggcagatgcgtgaacactgaggggtctttccagtgcgtgtgtaacgctggtttcgagctcagccctgacggtaaaaattgcgtcgaccacaacgagtgcgccacaagtaccatgtgcgtgaatggcgtatgtcttaacgaggacggcagcttttcatgcctctgtaagcctggctttctgcttgcccctggaggccactattgcatggacattgacgagtgccagacacctggcatctgtgtgaatggccactgtacaaacacagaaggcagcttccgctgtcagtgccttgggggattggcagtcggtaccgatggcagagtttgtgtggacacccacgttcgtagtacgtgttatggagctatcgaaaagggtagctgtgccagaccctttcccggtacagtcacaaaatcagagtgctgttgcgccaacccagaccacggatttggcgaaccgtgtcagttatgccccgctaaagacagcgccgaatttcaggcattgtgctcctctggcctgggcattacgaccgatggacgcgatatcaatgaatgcgccctggaccccgaggtgtgtgctaatggagtttgcgagaatctccgtgggagttacaggtgcgtctgtaacctgggctacgaggctggcgctagcgggaaagattgcacagatgtggacgagtgcgctctcaactctctattatgtgacaacgggtggtgccagaactcacctgggtcctactcgtgtagctgcccgccagggtttcacttctggcaggacactgaaatttgtaaggatgtcgatgagtgtttgtcttcaccttgtgtgtcaggcgtatgccgcaatctggctggcagttacacatgcaagtgcgggccagggtcccgattagatccctcgggaaccttctgtttggacagcacaaagggaacgtgttggctcaaaattcaagaaagccggtgtgaggtgaatctgcagggagccagcctcaggtcagaatgctgcgctaccctaggggctgcctggggttctccctgtgagcgctgtgagatagacccagcttgcgcccgtggttttgcaagaatgactggtgtcacttgcgacgacgtcaatgaatgtgaaagctttcctggcgtctgcccaaacggcagatgcgttaacactgccggtagtttccgctgtgagtgcccagaggggttgatgctagatgctagcggcagactgtgtgtcgacgtgcgtcttgaaccctgcttcctacgctgggatgaagacgagtgcggggtaaccttgcccggaaaatatcggatggatgtgtgttgctgctccattggtgcagtgtggggggtcgaatgcgaggcctgtcctgaccccgagtccttggaatttgcctcactgtgccccaggggactcggttttgcgagcagggattttctgtctggcaggcccttctataaggacgtcaacgagtgcaaagtcttcccgggtctgtgtacccacggcacgtgtcggaatactgtaggttcgttccattgcgcgtgtgccggaggctttgccctcgatgcgcaggagcgtaattgcacagatatcgacgagtgcaggatatcaccagatctatgtggtcagggcacttgcgtgaacacgcctgggagtttcgagtgcgagtgcttcccagggtacgaatcagggtttatgctcatgaaaaattgtatggacgttgacgaatgcgccagagatccactgctttgccggggtggcacctgcacaaacactgacggctcatacaaatgccaatgcccccctggtcacgaactgaccgctaaggggactgcctgtgaagatatcgatgaatgcagcctctccgacggcttgtgtccacacggtcaatgcgtgaacgtaattggtgcatttcaatgctcctgtcacgctggctttcagtcaacaccagatcgccagggttgtgtcgatatcaatgagtgtcgtgtgcagaatggtggctgtgatgtgcactgcataaataccgaaggcagctataggtgcagctgcggccaggggtattcactgatgccagacggaagggcatgcgctgacgtcgacgagtgtgaagaaaacccacgggtgtgcgatcaagggcattgcactaatatgcccggtggtcatagatgcctgtgttacgatgggtttatggccaccccggatatgaggacatgtgttgatgtcgatgaatgtgacctgaatcctcatatatgcttgcatggtgattgtgagaataccaaagggtccttcgtttgtcattgccagcttgggtacatggttcgcaagggtgccacgggatgtagcgatgttgacgagtgcgaagtggggggacataactgcgatagccacgccagctgcttgaacataccaggtagcttctcctgccgttgcctcccaggttgggtgggtgacggctttgagtgccacgacctggacgaatgtgttagccaagagcaccggtgctcgcctagaggtgattgcctcaacgtgcccggttcctaccggtgtacctgtcgtcaaggcttcgccggtgatgggttcttctgcgaggaccgcgacgagtgtgcagaaaacgtggacctttgtgataatggccagtgcctcaacgcccctggtggctaccgctgcgaatgcgagatgggcttcgatccaacagaagatcacagagcctgtcaggatgtggacgaatgcgcccagggcaacttgtgtgcatttggatcatgcgagaacctcccaggtatgttcagatgtatttgcaacggagggtacgaactggaccgtggcggagggaattgtactgacatcaatgaatgtgccgatccagtgaattgtataaacggggtgtgcatcaacacaccaggaagctatttatgctcttgcccgcaggacttcgagctgaatcctagcggagtaggttgtgttgatacacgggctggcaattgctttctggagacacatgatcggggagattccgggattagctgctccgctgaaattggcgtgggcgtgactcgtgcttcttgctgttgtagcctcggacgcgcatgggggaatccttgtgagctgtgcccgatggccaatacgaccgagtatcggacactctgtccagggggtgagggcttccagcccaaccgtattaccgttatcctggaggatatagacgaatgccaggagctcccgggtctgtgccaggggggtgactgcgtaaatacctttggttctttccagtgcgagtgccccccagggtatcacctttccgagcacacccggatctgtgaggatatcgatgaatgtagcactcatagtgggatctgtggccctggaacctgttacaataccctgggcaactatacctgcgtgtgcccagcggagtacctgcaggtgaatggcggaaacaactgtatggacatgcgaaaatccgtgtgctttcgtcactacaacggtacctgtcagaacgagctcgcttttaatgtcaccagaaaaatgtgctgctgctcgtataatataggacaggcatggaatagaccttgtgaagcctgtcctacacctatttctcccgattatcagattctctgcggcaatcaagccccagggttcctgacagacattcatacaggcaagccactcgatatagatgagtgcggtgagataccggctatatgtgccaacggtatatgcattaaccaaatcggcagcttccgctgcgaatgtcccgctggcttcaactataattccattttgttggcctgcgaggacgttgatgagtgtggtagccgagaaagtccttgccagcagaacgctgactgcataaacatacctggctcttatcggtgcaagtgcacacggggatacaagctatctccgggaggagcttgtgtggggaggaacgagtgtcgggaaatcccgaatgtgtgcagccacggagactgcatggataccgaaggctcttacatgtgcctctgtcatcggggtttccaggcgtcagccgaccaaaccctgtgcatggatatcgacgagtgcgatcggcagccttgcgggaacgggacctgtaaaaacataataggctcatataattgcctctgttttcctggttttgtggtgacacacaacggtgactgcgtcgacttcgacgaatgtactacgctcgttggccaggtgtgtagatttggccattgcttaaacacagccggatcctttcactgcttgtgtcaggacggattcgaactaacagcggacgggaaaaactgcgttgataccaatgaatgtttaagcctggctggtacatgtctgcccggtacctgccaaaacttggaaggttcatttcgatgcatctgtccccctggattccaggttcagtctgatcactgcattgacatcgatgagtgctcagaggagccgaatctttgtctgtttggaacgtgtacgaattctccgggatccttccagtgcctgtgtccacctggttttgtgttgtccgacaacgggcatagatgttttgacaccagacagagcttttgttttacaagatttgaagctggaaagtgtagcgtacccaaggccttcaacacgaccaaaacaagatgttgctgtagcaagagacccggtgaggggtggggggacccttgtgagctgtgtcctcaggaggggtctgctgcgtttcaggagctgtgcccttttggacacggtgccgtgccagggcctgatgactctagggaagacgttaatgagtgcgccgagaatccaggcgtgtgtaccaacggcgtgtgcgtaaatacagacggaagtttccggtgcgaatgccctttcggctacagcctagatttcactgggatcaactgcgtcgacaccgacgaatgcagtgtagggcatccctgcggtcaggggacctgcaccaatgtaattggaggattcgaatgcgcatgcgccgatggattcgagcctgggctgatgatgacctgcgaagatatcgacgagtgttctcttaatccccttttgtgcgctttccgatgccacaacacagaaggatcctacttatgcacatgtcccgcaggctacacccttagggaggacggcgcaatgtgcagagacgtggacgaatgcgccgacggccagcaggactgtcacgcaagaggcatggaatgtaaaaatctgatcgggactttcgcctgtgtgtgcccaccaggcatgagacctttgcctgggtcaggggagggatgcacagatgataacgagtgtcatgctcaacccgatctgtgcgtgaacggccgttgcgtaaacacagctggctcttttcggtgcgattgcgacgaaggcttccagccttcaccgaccctcaccgaatgtcacgacatcaggcagggcccttgctttgccgaggttctgcagactatgtgtcgcagcctgtcaagtagcagcgaggccgttacgagggcagaatgctgttgtggcggtggcagaggttggggtccccgttgtgagctctgtcctcttcctggcacgtcagcctaccggaagctttgcccccatggctccggctacacggccgaggggagagatgtggatgagtgcagaatgctggcacacctttgcgcccatggagagtgcatcaactcactcggatcctttcgctgccattgccaggctggttacacaccagacgcgacagcaacaacttgcctggacatggatgagtgttcacaagtgcccaaaccatgtacgttcctgtgtaaaaataccaaggggtcatttctctgttcctgccctaggggatatctactggaggaagatgggagaacttgtaaagacctcgacgagtgcacatctaggcagcacaattgtcagttcctttgcgtgaataccgtaggcgcattcacatgtcggtgtcctccaggcttcactcagcatcaccaggcttgtttcgacaacgacgaatgtagtgcccaacctggcccatgtggtgcccacgggcattgccacaacacccctggaagtttccgctgcgagtgtcaccagggcttcactcttgtgagcagcggccatggatgcgaggacgtgaacgaatgtgatggcccacaccgatgtcagcacgggtgtcagaatcaacttgggggttacaggtgttcctgcccgcagggcttcactcagcacagccaatgggctcagtgtgttgatgaaaatgagtgtgcgctgtcaccgcctacatgtggatcagcttcttgcagaaatacattgggcggattccgatgtgtctgtccatccggattcgactttgaccaggcattgggcggatgtcaggaagtggacgagtgcgccggacggaggggaccgtgttcttacagttgcgcaaatactcctggcggtttcctctgtggctgtccacaagggtattttagagcgggtcaaggccactgcgttagcggacttggtttctcccccggaccgcaagacacccctgataaagaggagctgctcagctcagaggcatgttatgaatgcaagatcaatgggctaagtccacgcgataggccccgacggagcgcacacagggatcatcaagtcaatcttgccacattggactctgaggccttgctgaccctgggccttaatctgtcccatcttggcagggccgagagaatactcgagctcaggcccgctctcgaaggcctcgaaggacggattcgctatgtcattgtgagagggaacgaacagggctttttccggatgcatcacctgcgtggtgtgtcttctctacagctgggccgacgacgtcccggacccggaacctataggcttgaggtggtgagccacatggcaggtccttggggtgtacagcccgaagggcagcccggaccgtggggccaggccttacggcttaaggttcaactgcagctcctgtac

SEQ ID NO: 11851 - DNA, 291 bp, Artificial Sequence
  Description of Artificial Sequence: Synthetic coding sequence
atgagggtaaccagtgccacctgtgccctgctgctggctctcatttgctctgttcagctcggggatgcctgtctggatattgataagctcttggccaacgtggtgttcgacgtatcgcaggaccttttgaaagaggaattggccaggtataatccctcacccctcactgaggagtcattcctgaatgtgcagcagtgtttcgccaacgttagtgtcactgagaggttcgctcactcagttgtgattaaaaaaatcctccagagcaacgattgtatcgaggcagccttctag

SEQ ID NO: 11852 - DNA, 1890 bp, Artificial Sequence
  Description of Artificial Sequence: Synthetic coding sequence
atgcagcaggatggtctgggcgtgggtaccaggaatggctcaggcaaagggaggtctgtgcatccctcctggccttggtgcgccccacgtccccttcggtatttcggtagggatgcaagggccaggcgagcccagacagcagcaatggccttgctagccggaggtttatcacgaggtttaggaagtcatcccgcagcagcaggacgcgatgccgtagtcttcgtttggctactcctgagtacatggtgcaccgcccctgctcgcgctattcaggtgactgtcagcaatccgtaccatgttgtgatcttatttcagcccgtgacgctcccctgtacttaccaaatgacatccactcctacccagcccatcgtcatttggaagtacaaatcattttgcagagacagaatcgccgatgcctttagccccgcttctgtcgacaatcagctcaatgctcagttagctgctggaaaccccggttataacccatacgttgaatgccaggactcggttcgcaccgtgcgggtggtggctaccaaacagggcaacgccgtgaccctcggcgactattaccaaggccgaagaatcacaattactggaaatgcagatctgacattcgatcaaacagcctggggagatagcggcgtgtactactgcagtgttgtgagcgctcaggacttgcaggggaataatgaagcttatgccgaactgatagttctcgattggttgttcgttgtggtggtgtgcttggcagcatttctgatttttctattactcggaatttgctggtgccagtgttgcccccatacttgttgttgttatgtgaggtgtccttgttgtcccgacaaatgctgctgtccagaggcattgtatgcggctggcaaggcggcaacctccggggtacccagtatctacgcgccttcaacatacgcccacctctcccctgctaaaaccccaccccctcccgctatgatccccatgggtccagcctacaatggatatcccggtggataccccggagacgttgatagatctagttcggccggaggacagggatcctatgtgcccctcttgcgagacaccgattctagcgtggcttcagtacggtccgggtatagaatccaggccagtcagcaggacgactctatgcgggtgctatactacatggagaaagagttagccaatttcgatccgagcaggccaggtccgccatccggtagggtcgagcgggcaatgtccgaggtgacctctttacatgaggatgattggaggtcccgaccgtctcgtgggcctgccctgacacctatcagggatgaggagtgggggggtcactcgccccgaagccctagagggtgggatcaggagcctgctagagagcaggcgggtggcggatggcgggcacgcaggccgagagcgcgaagcgtggacgcgcttgacgatctgactcctccatctaccgcagaatccggatccaggtctcccacctccaacggcggaaggtctagggcctatatgcctcccaggtcccgaagtagggatgacttgtacgaccaggatgacagcagggattttcctaggagtcgggacccgcactacgacgacttccgctctagggagcgaccgccagcggatccaaggtcccatcaccaccggacccgggacccgagggataatggaagtcgatccggggacctgccctatgacggcagacttctggaggaggccgtccgtaaaaagggaagtgaggagcgcaggcggccacataaagaggaggaagaggaggcttactatcctcccgctccacctccttatagtgagacggacagtcaggcctccagggagaggagactaaagaaaaatttggcgctatctagggaatcacttgttgtatag

SEQ ID NO: 11853 - RNA, 591 nt, Artificial Sequence
  Description of Artificial Sequence: Synthetic coding sequence
augucaagacgaucaaugcugcuggcgugggcucuuccuagccugcuuaggcugggggcugcucaggaaaccgaagaccccgccuguugcaguccaauaguaccgcggaacgaguggaaggcccuagccucagaaugcgcccagcauuugucccugccacucagauaugucguggugucucacaccgccggcuccagcugcaauaccccagcuagcugucagcaacaggcaaggaauguccagcauuaucauaugaagacacuuggguggugcgauguugguuauaauuuuuuaaucggagaagacgggcucgucuaugagggcagagguuggaauuuuaccggagcccauucaggacaccuguggaauccaaugucaauaggaauaagcuucauggguaacuauauggacagaguaccuacuccccaggcuauccgugccgcucagggccuacuggcuugcggcgucgcccagggcgcacucaggaguaauuacguguugaagggccaucgcgaugugcagcggacccuuagcccaggcaaccaacuuuaccauuuaauacagaauuggccacauuauaggaguccuuag

SEQ ID NO: 11854 - RNA, 1056 nt, Artificial Sequence
  Description of Artificial Sequence: Synthetic coding sequence
auggaagcuuucgcacugggacccgcaaggagaggacguaggagaacgcgagccgccgguucauuacucucaagggcugccaucuuauuauucauaagcgcuuuccuuguucgagucccuagcuccguggggcaucuaguuaggcuccccagagcauucagguugaccaaggauucggucaagauaguagggucuacuaguuucccugucaaagccuacgucaugcuucaccagaagaguccacacguccugugcgucacccaacaauuacguaacgccgaacuaauagaucccaguuuccaaugguaugguccuaaggggaagguugugucugucgaaaaucggacugcacaaauuacgaguacuggaagccugguguuccagaacuucgaagaguccaugucggggauuuacacuugcuuucuggaguacaagcccacaguggaagaaauuguuaagagacuccagcucaaguaugcgaucuaugcauacagggagccacauuauuacuaccaauucaccgcacgauaucacgccgcuccaugcaacaguaucuacaauaucagcuucgagaagaaguuguuacagauccuaucuaaacuccuacuggaccucucgugugagauuagccugcucaagucagagugucauagaguuaaaaugcaacgugccggccugcagaaugagcuguucuucgccuucucgguuagcucccuggauacugagaaaggccccaaacgcugcacggaccauaauugcgagcccuauaaacgcuuguuuaaggcaaagaauuuaauugaacgguuuuucaaucagcagguugaaauccuggggcggagagcagagcagcugccgcagauuuauuauauugagggcacacuucagaugguguggauuaaucgguguuuccccggcuauggcaugaacgugcaacagcacccuaagugucccgaguguugugugaucuguucuccaggguccuauaacccucgcgacggaauccauugccugcaaugcaacucuuccuugguguauggagccaagaccugucuauag

SEQ ID NO: 11855 - RNA, 420 nt, Artificial Sequence
  Description of Artificial Sequence: Synthetic coding sequence
auggaaacaaacguguuccaccucauguugugcguuacuagcgcccggacgcauaagucaacgucucugugcuucggacacuuuaauuccuacccuucacucccccugauccacgaccuccuucuagagauuucauuucagcucucugccccacaugaagacgcaaggcucacuccagaagaacuugagcgcgccucucuguugcagauccucccugaaaugcuuggcgcagaacggggcgacauccuccggaaggcggacucuucuacaaauauauuuaacccucgcggaaaccucaggaaauuccaagacuucuccgggcaagacccaaacauccuuuuaagccaccugcucgcacggaucuggaaacccuacaagaaaagagagaccccagauuguuucuggaaauauuguguauag

SEQ ID NO: 11856 - RNA, 606 nt, Artificial Sequence
  Description of Artificial Sequence: Synthetic coding sequence
auggguucggggcgccgugcucuuuccgccgugcccgcaguccugcuggugcuuacucuucccggacuuccuguaugggcccagaacgacacugaaccgauagugcuggaaggcaagugccuaguuguaugugacuccaauccggcaaccgauucaaaggguagcuccucuuccccuuuaggcauaucaguccgggcugcuaacuccaagguagccuuuuccgccguuagauccaccaaccaugaaccuuccgaaauguccaauaaaaccagaaucaucuauuuugaccaaauccuggucaacguuggcaacuucuuuacacuggagagcguguuuguugcucccagaaaaggaaucuacaguuuuuccuuccauguaauuaaaguguaucagucucagacuauccagguuaauuugaugcucaaugguaagcccgugaucagugcauucgccggagacaaggacguuacucgagaggcugccaccaaugguguccuucuauaucucgauaaagaagacaaagucuaucugaagcucgaaaagggaaaucuggugggcgguuggcaguacucuacauuuagcggauuucugguguuuccacuauag

SEQ ID NO: 11857 - RNA, 264 nt, Artificial Sequence
  Description of Artificial Sequence: Synthetic coding sequence
augaaaguguugcgagcuuggcucuuaugccugcugaugcuggggcuggcucuucgcggggcugcuucccgcacacaccggcacucuauggagauccgaaccccugauaucaaccccgcaugguacgcuucucggggaauccgaccuguaggaagauucggucgcagaagggcuacgcugggugacgugccuaagccaggccuccgcccuaggcuaacgugcuuuccauuggaaggaggugcuaugucaucccaggauggcuag

SEQ ID NO: 11858 - RNA, 1098 nt, Artificial Sequence
  Description of Artificial Sequence: Synthetic coding sequence
augccaggcgguaagaaggucgcuggaggugggucaucaggagcuacacccaccagugccgcagcuacugcccccagcggagugcggcggcuugaaacaucagaaggaacgagugcccagcgcgaugaggaaccagaagaggagggugaagaagaucugcgcgauggaggcguuccuuucuucgugaaucguggcggucugccagucgaugaggcgaccugggagcgaauguggaagcacguggccaaaauccaucccgauggagagaaagucgcacagaggaucaggggagccacagaccugccaaagauacccauaccaucuguccccacauuucaaccaaguacacccguucccgaaaggcuugaggccguccagcguuacauuagagaacuccaauacaaucauacaggcacccaguucuucgagaucaaaaagucccgcccauuaacgggucucauggaccuggcuaaggagaugacuaaggaagcccugccuaucaaguguuuagaggcugucauucugggcauauaucugaccaauucuaugccuacucuggagagauucccgauauccuucaaaacuuacuuuucuggaaacuauuucagacacauaguacugggugucaacuucgccgggcguuacggagccuuaggcaugagucgucgugaagacuugauguauaagccaccagcauuucgaacacucagcgaguuaguccuggauuuugaagccgcguacggccguuguuggcacguacucaaaaaagugaagcucggucagagcguaucccacgacccacacaguguagagcagauagaauggaagcacagcguccuugacguugaaagacucgggagggaugauuuccggaaggaacucgagaggcacgcacgggauaugcggcucaaaaucggcaagggcacaggcccuccuaguccaacaaaagaccgcaagaaggaugugaguagcccacagcgugcccagaguaguccccaucgcaggaauucccggucugagaggcggccuucuggggacaagaaaacuuccgagccaaaggcuaugccagaccuuaauggauaucaaauccggguguag

SEQ ID NO: 11859 - RNA, 1377 nt, Artificial Sequence
  Description of Artificial Sequence: Synthetic coding sequence
auggcaugggcgucaagauuggggcugcuguuggcccugcugcuaccgguugugggcgcaagcacacccggcaccguggugagacuaaacaaggccgcguugucauauguguccgagaucggcaaggcuccccuccagagggcccugcaggugaccgucccacacuuucuugacuggagcggcgaagcucugcagcccacacgcauucgaauccuuaacguucaugugccuagacuucacuuaaaguucaucgcuggguucgguguacgccuuuuggccgccgcuaauuucaccuuuaagguguuucgcgcuccugaaccauuagagcucacccuacccguggagcugcuugcggacacccgagugacccagagcaguauccggacucccgucgugucuaucuccgcuugcagccucuucucuggccacgcaaacgaguucgauggcuccaacucuacgagccaugcauuacugguccuuguccagaaacacauuaaggccguguuaucuaauaaacugugucuuucaauuagcaaucugguucaagguguaaaugugcaccuggguacucucauuggucucaauccagucggccccgagagucagauuagauacagcauggucuccgugccaacugugacauccgacuauauuucuuuggaagugaacgcggugcuauuccuacucgguaaacccaucauucugccuaccgacgccaccccguuuguguugccccgucaugucgguaccgagggcagcauggcuaccguuggucuuagucagcaacucuucgacagcgcucuacuauuauugcagaaggcuggcgccuugaaccuggacaucaccggccaacuccgcagcgacgacaaccuccucaauaccucggcucugggcaggcucauucccgaggucgcccgccaguucccagagcccaugccagugguccugaaagucagacuaggcgcaacaccaguggcuaugcugcauacuaauaacgccacccucagacugcagccauuuguagagguccucgccaccgccucaaacuccgcuuuucaauccuuguuuucacucgacgucgugguaaacuuaagacugcagcuguccgucucuaaagucaaauugcaaggcacuacuuccguucucggcgauguccagcuuacuguggccucaaguaaugugggguucauagacacagaucaagucaggacgcuaaugggcacuguguuugaaaaaccccugcuugaucaucugaaugcacugcucgcgaugggaauugcucucccuggcguggugaacuuacauuauguagcuccggagaucuucguguaugagggcuacguggucaucucuagcggacuguuuuaccagagcuag

SEQ ID NO: 11860 - RNA, 1815 nt, Artificial Sequence
  Description of Artificial Sequence: Synthetic coding sequence
augaugcgggccgugugggaggcucuggcagcccucgccgcugucgccugccugguaggagcugucagggguggaccuggacugagcauguuugccggacaagcggcacagccagacccauguucagacgagaacggacacccucgccgauguaucccugauuucgucaacgccgccuuugggaaagacguccgggucagcagcaccuguggccgcccaccggcucguuauugcgugguaagcgaacggggcgaggagagauugcggagcugccauuuguguaaugccagugacccuaagaaagcccaccccccagcauuucuuacugauuugaauaacccacauaaucucacauguuggcaguccgagaauuauuugcaauucccccauaaugugaccuugacccucagcuuaggcaagaaguuugaaguaacuuacgucagccuacaguuuugcucaccaaggcccgaguccauggcuaucuacaaaagcauggacuacggccgcacaugggucccuuuccaguucuacaguacacagugccgcaaaauguauaauagaccccauagagccccaauaaccaaacagaacgagcaggaagccguaugcacagauucgcacacagacaugcgcccacuguccggagggcuaaucgcuuucuccacccuugacggccgcccauccgcucacgauuucgacaacucaccagugcuccaggacuggguuacugcaaccgauaucagggucgcauuuagccgauugcacacuuuuggugaugagaaugaggacgacuccgaauuggcgcgcgacucguauuuuuacgccguaucugaccugcaagugggcgggcgcuguaaguguaauggccacgccgcccggugugugagggauagagaugauucccugguuugugacuguagacauaauacagcaggcccugagugcgaccgguguaaaccuuuucauuacgacagaccauggcagcgagcuaccgcacgggaggccaaugaguguguagccugcaauuguaaucuccaugcucggcggugccgguuuaacauggaacuauauaaacugaguggccgcaagagcggcgguguguguuugaacugcaggcauaacacagcaggacgccacugucacuauuguaaggagggguauuacagggauauggggaaaccuauaacgcacaggaaggcauguaaggccugcgauugucaucccgugggggcugcugggaagacuugcaaucaaacaacuggccagugucccugcaaggacggaguuaccgguaucacauguaacaggugcgcgaaagguuaucagcaaucccgcagcccuauagcaccauguauuaaaauaccaguggcgccacccacaacugccgcgucguccguggaggagccugaggauugcgauuccuauuguaaagccaguaagggaaagcugaaaauuaacaugaaaaaauauugcaagaaggacuaugccguacagauccacauuuuaaaggcugacaaggcaggcgacugguggaaguuuacagucaacauaauuagcgucuauaaacaaggcacuaguaggaucagaaggggagaccaaagcuuauggauuagaucuagggauauugcauguaagugcccuaagauaaaaccucugaaaaaauaccugcugcugggcaacgcagaggauucuccggaucaaucaggaauugucgccgacaaaucgucccuagugauucaauggagggacacaugggcgcggcgucuaagaaaguuucagcagcgcgaaaagaaaggcaagugcaaaaaggccuag

SEQ ID NO: 11861 - RNA, 675 nt, Artificial Sequence
  Description of Artificial Sequence: Synthetic coding sequence
augccagggcgcgcaccccugcggaccgugccuggugcccugggcgccugguuguugggaggccuuugggcauggacucugugcggucuguguucacucggagccgugggagccccucggccuugucaagcuccucagcagugggagggccgccaaguuauguaucagcaaagcagcgggagaaacagccgcgcccuucugagcuacgauggauugaaucaacgugugagaguucuggaugagcguaaggcucugauaccgugcaaaagauuguucgaguacaucuuacuauauaaggacgggguaauguuccaaauugaucaggcuacgaagcaaugcucuaaaaugacgcugacacagccaugggauccucuugauauuccccagaacagcacuuucgaggaucaguacagcauaggcgguccccaggagcaaaucacaguacaggaguggagcgacaggaaauccgcacgcuccuaugaaacguggaucggcaucuacacaguuaaagauugcuaccccgugcaagagacauuuaccauuaauuacucggucauacugucgaccagauucuucgauauacaguugggaauaaaggauccaagcguguuuacaccaccaucaaccugucagauggcccagcuggaaaagaugagugaagacuguagcugguag

SEQ ID NO: 11862 - RNA, 5106 nt, Artificial Sequence
  Description of Artificial Sequence: Synthetic coding sequence
augggguuucugcccaagcuccuucugcuggcgaguuuuuuccccgccggucaggcaucauggggugugucaaguccucaggaugugcaggguguaaaaggcaguugcuugcugauaccuuguauuuucaguuuuccugccgacguugaagucccugacgggauuaccgcaauaugguauuacgacuauagcggccaacgacagguggugagccauuccgcugaucccaaacugguugaggcgcgauuccggggucggaccgaauuuaugggaaauccugagcaucgugugugcaauuugcuccucaaagaccuccagccagaagacagcggcagcuacaacuuccguuucgagaucucggaagugaaccguuggucugacgugaagggcacccucguuacggucacagaagagccccgcgugcccaccaucgcuucccccgucgagcuccuggaaggcaccgagguagacuuuaauugcagcacaccuuaugucugccugcaggaacagguucggcugcaguggcagggacaggauccagcaagaagcgugacauuuaauucacagaaauucgagccuaccggcguggggcaccuggaaacccuacacauggcuaugucuuggcaggaccauggacgcauucugcgcugucaacuaaguguggcaaaccauagagcacaguccgaaauccaucuccaggugaaauacgcacccaaagguguuaaaauccugcugucccccucggggcgaaauauccugcccggagaauugguaacacuaaccugccaaguuaacagcucuuaucccgcuguaagcucaaucaaaugguugaaggauggaguucgccugcaaacaaagaccggaguccuacauuugccucaggcagccuggagcgaugccggaguuuacaccugccaagcugaaaacgguguagguucacuggugucucccccaaucucccugcauaucuuuauggccgaaguucaagucucccccgccggaccuauccucgagaaucagacagucacccucguauguaauaccccgaacgaggcaccuuccgaccuccguuacagcugguacaaaaaucacgugcuguuagaggacgcacauagucauacccuccggcugcaccucgccacccgcgccgauacaggguuuuauuuuugcgaaguccagaacguacacgggagugaaagaagcggacccguaucuguaguggugaaccaccccccucugacuccagugcugacugccuuucuugaaacccaggcuggccuggugggcauccuccacugcuccguaguaucggagccgcuggcuacgcuggugcugagucauggaggccacauucucgccuccacuagcggagauuccgaucauaguccuagauuuuccgggacuuccggcccaaauucucucagauuggaaauucgcgaucuggaggagaccgacagcggugaauacaaaugcagcgccaccaacagccuaggcaacgcuacuaguacacuggacuuucaugcuaacgccgcucggcuccugaucucuccagccgcagaggugguugaagggcaagcggugacccuuuccugcagauccgggcugucuccuacgccggacgcaagguucuccugguaccugaauggcgcuuuguuacacgagggucccggauccucacugcugcugccugccgccagcucaaccgacgccggcuccuaccauuguagggcccgcgauggucauucugcuucaggcccaagcucuccggccguccugacaguacucuacccgccccggcaaccuacuuuuacaacucgguuagaucuagaugcugcuggggcaggcgccgggaggcgagguuugcuccugugcagaguugauagcgaccccccugcgcgcuugcaacugcuccacaaggaucgcgugguggccacuaguuugccuaguggcggcggcugcuccacuugcggcggcuguagcccacggaugaaggucacaaaagcccccaaucucuugcgggucgagauacacaauccucuacucgaagaagaaggguuauaucugugugaggcuuccaaugcccugggaaaugcaucuacuagugccacauucaauggacaagcuacgguucuggcaauugcccccucucacacccugcaagagggaacggaggccaaucuaaccuguaaugugucucgcgaggcagcagggucccccgccaauuuuuccugguuuagaaacggcguccugugggcacagggaccacuggaaacgguuacucuucuucccgucgccagaacugaugccgcucuuuacgccugcagaauccugacagaagcaggcgcccaacucucuaccccugucuuguugucagucuuguauccgccugacaggccuaagcuguccgcccugcuggauauggggcaagggcacauggcuuuauuuauauguacugucgacagcagaccgcuggcccucuuagcgcuguuccauggagaacaccuucucgcaaccucucugggcccacagguaccuucucacggcagguuucaggccaaagcugaagcaaacagccugaaacuggaagugagggaauuggggcuaggugauuccggcuccuaccgaugcgaagcaaccaaugugcugggcagcaguaauaccagccucuucuuccagguucguggagcaugggugcaaguuucucccucaccagaacugcaggagggucaggccgucguucugagcugccaagugcauaccggcgugccagaggguacaaguuaucggugguaccgggacggacaaccucuccaggagaguacaagugccacgcuucgguucgccgcgaucacacugacacaagcaggcgcuuaucauugccaggcacaggccccugguagugcaaccacuagcuuagccgcccccaucuccuugcauguauccuacgcuccucgccaugugacccucacuacucucauggauacugggcccgggcggcuaggauugcuucugugccgcgucgacucagacccaccugcucagcuucgguugcuccacggagaccggcucguggcaucuacacugcagggugucggaggccccgagggaaguucuccaagacugcaugucgcugucgcuccaaauacuuugcgucuggaaauccacggugcuauguuggaagaugaagggguauauauuugugaggccaguaacacccuggggcaggccagcgcuucagcugauuuugaugcccaagcaguuaacguucaagucuggccaggugccacugucagagaaggucagcuuguaaacuugaccuguuugguguggaccacucaccccgcucaguugacuuacacaugguaucaggacgggcagcaaagguuggaugcccauaguauaccauugccaaacgugacaguucgcgaugcuacuagcuauaggugcggagugggcccuccugggcgggccccacgccugagccggccgauuacucucgaugugcuauacgcgcccagaaacuugcgacucacauaucuccucgagucgcacggaggacagcucgcucugguccuguguacuguggacucgcggccuccugcucagcuggcacugagucacgccgggcgucuguuagcuucuuccacggcggccucugugccuaacacccugagacucgagcugcgcgggccacagccccgagacgagggauucuacucgugcagugcucggucuccgcugggucaggccaacacgaguuuggagcugcgccuggagggaguuagaguaauccuugccccagaagcagcugucccugaaggggccccuauuacugucacuugugccgacccugcagcccacgcgccgacccucuauacaugguaccauaacggucgcuggcuccaggagggaccugcugccucuuugucuuuucucguugccaccagggcucacgccggcgccuauucuugccaggcccaagacgcccaaggaaccagaucuagccggccagccgcccuucaggugcucuaugcgccccaggaugccguucuuucaucauuuagggauagucgagcccgaucaauggccgucauucaauguacagucgauucagagccaccagcugaacuggcacugagucacgacgggaaaguccuggccacaucgagugggguccacagccuggccagcgggacaggacauguacagguagcuagaaacgcgcugagguugcagguccaagacgugccugccggagaugacaccuacgugugcacugcgcagaauuuacucgguuccaucucaacuauaggccgucugcagguggagggcgcacgagugguggccgagcccgggcuggaugugccagagggagcugcgcuuaaccugaguuguaggcuguugggugguccagguccuguggguaacuccaccuuugcaugguucuggaacgaccggcggcuccacgccgagcccgugccaaccuuggccuucacccacguugcccgggcucaagcaggcauguaccauugcuuggccgaauugccgacaggggcagccgcaagcgccccagugaugcugagaguucucuauccuccuaagacgccaacuaugaugguguuuguggagcccgaaggcggacugagggguauuuuggacugcaggguggacucagagccacuggcuucccucacacugcacuugggcagucgauuaguggccucaucgcaaccucagggagcucccgccgagccccacauccaugugcuggccagcccaaaugcacugcgggucgacauagaggccuuacgaccuagugaccagggcgaguacauuugcuccgcuagcaacgugcugggcagcgcuuccaccucaacauauuucggcguucgagcucuccaccguuugcaccaauuucaacagcuucucugggugcuaggguugcucguuggccugcugcuguugcuacuggggcucggagccuguuacaccuggagcagcuugauucugaugcaaccgcauguccgcccucaaccuguuccucacccaugggccgaucaauggugcugccugccaucugguggugaaucgggacagaauuuauag

SEQ ID NO: 11863 - RNA, 708 nt, Artificial Sequence
  Description of Artificial Sequence: Synthetic coding sequence
augaccguccucgccccagccuggagcccgaccacguauuugcuccugcuucuccuacuguccucaggccuauccggcacacaggacugcagcuuccaacauuccccgauuagcagugauuuugccguaaaaauccgggaacuguccgacuauuugcuccaagacuauccgguuacaguagcuaguaaucugcaagacgaagaguuguguggcggccuguggcgguuggucuuggcccagagguggauggaaaggcugaagaccgucgcuggcucaaaaaugcagggauuauuggagcgggugaauacagagauccacuucgucaccaagugugccuuucagccuccaccuuccuguuugcgauuuguacagaccaacaucagccgacuccuacaagaaaccagugagcagcucguggcucugaagccauggaucacccgacagaauuucagcagaugccuugaacuucagugccaaccugacucgucaacccugccacccccaugguccccucggccucuugaggcgacagcccccacagccccucagccaccacuacuucuacuccuccuguuacccgugggcuuacuguuacucgccgccgcuuggugccugcacuggcagcgcacccgaagacgaacccccaggccaggggaacagguaccccccgugcccucaccccaagaccugcugcugguggagcauuag

SEQ ID NO: 11864 - RNA, 5472 nt, Artificial Sequence
  Description of Artificial Sequence: Synthetic coding sequence
auggcucucuccucugcauggagauccguccuuccccuuugguuguuguggucugcagcuuguagccgggcagcuagcggagaugauaaugcuuuuccuuuugauaucgaaggcuccuccgccguugggcggcaagacccgccagaaacgagugagccuaggguagccuugggccgguugccacccgcugccgagaaauguaaugccggcuucuuucauaccuuaucuggagaaugugugccaugcgauugcaacgggaauuccaaugaaugccuugauggcagcggguacuguguccauugucagagaaacaccaccggggagcacugcgagaaaugccuggauggguacauuggagauagcauucgaggggcuccucaauuuugccagccgugcccuugcccacugccccacuuagcaaacuuugccgaauccugcuaccggaaaaacggagccguacgcugcauuugcaaugaaaauuacgcuggcccaaacugugagcggugcgcuccuggguacuacgggaacccuuuacuaauaggcuccacuuguaaaaaaugcgauuguucaggcaacucugauccgaaucuuauuuucgaggacugcgaugaagugacuggucaguguaggaacugucuuaggaauaccaccggcuuuaagugcgaacggugcgccccuggguacuacggcgaugcucgcauugccaaaaauugugcuguuuguaacugcgggggcggacccugcgacagcguuaccggcgaaugucuggaggaggguuucgagccaccuaccggaauggacuguccaacgauuucuugugauaaaugcgucugggacuuaacagaugcacuccgacuggcagcccucaguaucgaggaaggcaaguccggagugcugagugucuccucuggagcugccgcucaccgucacgugaaugagauuaaugcgaccauuuaucugcugaagaccaaacuuucugagcgugagaaccaguacgcacugcgcaagauccagaucaacaacgccgagaacacaaugaaguccuugcucucagauguggaggagcugguggaaaaggagaaucaggccucaagaaaagggcaacucguccagaaggaaucgauggauacuaucaaucacgcaucgcagcuuguugaacaggcccaugacaugagggacaagauucaggagauuaauaacaagauguuguacuacggcgaagagcaugagcugagcccuaaagaaaucagcgaaaaacuugugcuggcccagaagauguuagaggaaauuagaaguagacagcccuucuucacucaaagggaacugguggacgaggaggccgacgaggcuuacgagcugcugucacaagccgaguccuggcaaagguugcauaacgagacccgaacguuauucccgguagugcuggaacaacuugacgacuauaaugccaaacugucugaucugcaagaggcucuggaccaagcccuaaacuaugugcgcgaugccgaggauaugaaucgcgccacugccgcaaggcagcgcgaccaugaaaaacagcaagagcgugugagagagcaaauggaagucgugaauaugucgcugucaacuagugccgacagucuuacuaccccccgacuuacgcugucagaacucgaugacaucauuaaaaaugccucagggaucuacgccgagauugacggagcuaagagcgagcuccaggucaaacuguccaaucugucuaaccucucucacgaucuugugcaggaggccauugaucaugcccaggaucuccagcaggaggcgaacgagcugagcaggaagcuccauucguccgauaugaacggacugguucaaaaggcuuuggacgcaucaaacguguaugaaaauauugugaacuaugucagcgaggccaaugaaaccgccgaauuugcccucaauacuacugauaggauuuaugacgcagugucagggaucgauacccagauaauauaucacaaagaugaaucugagaauuugcugaaucaagcccgagaguuacaagcaaaagccgagagcaguagcgaugaggcaguugccgacacgagucggcgaguggguggcgcucucgcgcgcaaauccgcccugaaaacuagacucucugaugcugugaagcagcuccaggcugcagagcgcggugaugcccaacagagacuggggcagucccgccuaauaaccgaagaagcaaacaggaccacgauggaagugcaacaggccacugccccgauggcuaauaaccugaccaacuggagccaaaacuugcagcauuuugauucuucugcauacaauacugccgugaauuccgcuagagacgccguucgaaaucugaccgagguggugccucaguugcuggaucagcuccggacaguugagcagaagcgcccagcaagcaacgucagcgccuccauccaacgaauccgggagcuaaucgcucagacgcgcucaguagcaagcaagauucagguaucuaugauguucgauggccagagcgcagucgaagugcacuccagaacaucuauggacgacuugaaggccuucacuagccugucacuuuacaugaagccucccgucaaaaggcccgaauuaacagagaccgccgaucaauuuauccuguaccuagggaguaagaacgcuaaaaaggaguauaugggacuggcgauaaagaacgauaaccuaguguacguuuauaaccugggcacgaaagacguggagauuccccucgacuccaagccugugucuaguuggccugcuuacuuuagcaucgugaaaaucgagagagucgggaaacauggcaaagucuuuuuaacagucccuagcuuaagcucuaccgccgaagaaaaguuuaucaaaaagggcgaauucucuggcgaugauucauuacuugaccuugaccccgaagacacagucuuuuacgugggcggagugccuucuaacuuuaaguuacccacgucacugaaucugccuggauuuguggguugucuagaacucgccacucuaaacaaugauguaauuagucuguauaauuucaagcacauuuacaauauggauccauccaccucgguuccaugcgccagagauaaacuugcauuuacgcaauccagagcugcuucauacuucuucgacgggaguggauaugcagucguccgcgauaucacgcguaggggcaaauuuggucaaguaaccagguuugacauagaagucaggacuccagcagauaaugggcugauucuccucauggucaauggcuccauguuuuuucgccuagaaaugcgaaaugguuacuuacauguuuucuacgacuucggcuucucaggggguccugugcaucuggaggacacacugaagaaagcccagaucaacgacgcaaaauaucacgagauuucuauuauauaccauaacgauaaaaagaugauccucgugguugaccggcgccacguuaaaucgauggacaacgagaagaugaaaauacccuucacagacauuuacauaggcggugccccaccggagauucugcaaucccgugcccucagagcucaucugccucucgauaucaauuuccggggauguaugaagggguuccaguuccagaagaaggauuucaaucuucucgagcagaccgagacccugggcguggguuacggcugccccgaggauaguuugaucuccagaagagccuauuucaauggccagagcuucauagccucuauucagaagauaaguuuuuuugacggcuucgaggggggguucaacuuccggacucuccagcccaauggccuguuauucuacuacgccucaggcucugacgucuucucaauuagccuagauaauggaacagugauaauggaugugaaggggaucaaggugcagagcguggacaaacaguacaacgauggacugucacauuucguuaucuccucggugagccccacgcgauacgagcucauuguggacaaaucucgugugggcuccaaaaacccuaccaaaggcaaaaucgagcagacacaggccucugaaaaaaaguucuauuuuggcgggucuccuauauccgcgcaguacgccaacuucacuggaugcauuucuaaugcuuacuuuacaagagucgaccgcgauguggaaguggaggauuuucagcgguacaccgaaaaggugcacacgagccuguaugaauguccuauagagucuucuccucuguuucuguugcacaagaaaggaaagaaucugucuaagccaaaagcgucacagaacaagaagggcggcaagagcaaggacgcgcccucuugggacccugucgccuuaaagcugcccgagcgaaauacccccaggaauagucacugccaucuuagcaauuccccccgcgccauugagcaugcauaccaguauggcggaacagcaaacuccagacaggaauuugagcauuugaagggagauuucggugcaaagagccaguuuucuaucagacucaggacucgaaguagccacggcaugaucuucuaugucucggaucaggaagaaaaugauuucaugaccuuauuccuugcccaugggagacucguguacauguucaacgugggucauaagaaauugaaaauccguucucaagagaaguauaaugacgggcuguggcaugacgucauuuuuauuagggagagaagcagcggacgccuagucauagauggacugagagugcuggaagagucguugccaccuacugaggccacuuggaaaauuaaaggaccaaucuaucucggaggggucgcacccggaaaagcuguuaagaauguacagaucaacuccaucuauuccuucagcggcugccuaucuaaccuccagcugaacggggccucuaucaccuccgccucacagacauucaguguuaccccuugcuucgaaggaccgauggaaacugguacguacuuuucuacagaaggcggauacgugguacuugacgagagcuucaacaucggucugaaauucgagauugccuucgaaguacguccaaggucuagcucgggaacacucgugcacggccauagcgugaacggggaauaccucaacgugcauaugaagaauggucaggucaucgugaaagugaacaaugggaucagggauuucucuacuucugugacacccaagcagucccucugugauggaagauggcaucgaauuacugugauuagagacucuaacgucgugcaguuagauguugauuccgaagugaaucacguggucggaccucucaacccaaaacccauugaucaccgggagccaguuuucguuggaggcguaccugagucccugcucacuccaagauuggccccuagcaagccauucacggguuguauuagacauuuugugaucgauggccaccccgugagcuuuucuaaagccgcccuuguaaguggagcagucuccaucaacagcugcccggccgcuuag

SEQ ID NO: 11865 - RNA, 1434 nt, Artificial Sequence
  Description of Artificial Sequence: Synthetic coding sequence
augacuagcaaguuccugcuggugucuuuuauacuugccgcucuuucgcucagcacaacuuuuucucuccagccugaucagcaaaagguccugcuggugucuuucgacggauuucgaugggauuaccucuauaaggugcccaccccccauuuucauuacauaaugaaguacggaguccacgucaaacaggugacgaacguuuuuauuacuaaaacguaccccaaccacuauacccuugugacaggccuguucgccgagaaucaugggauaguggccaaugauauguucgaccccauccguaacaagucauuuagcuuagaucauaugaacauuuacgauucaaaguucugggaggaagcaacuccaaucuggauuaccaaccaacgcgccggucauacuucaggagcugccauguggcccggcacagaugugaaaauucacaagagguuuccgacccauuacaugccguacaacgaaucuguuaguuuugaagaccguguagcaaagauaauugagugguucacuuccaaagaacccauuaaccuuggucuacuguacugggaagauccagaugacauggggcaucacuugggacccgacagcccucuuauggggccuguuauuucugacauugauaaaaaacucggguaucugauccaaaugcugaaaaaggccaagcuauggaacaccuugaaucuaauuauaacuucugaccacggaaugacucaguguuccgaagagagacugaucgaacuugaucaguaucuggauaaggaucacuauacacugaucgaccaaucuccagucgcugcuauccugccuaaagaaggaaaauuugacgaaguuuacgaagcucuaacucacgcucacccuaaccucaccguguacaaaaaggaggaugugcccgaacgguggcacuacaaguauaacuccagaauccaaccaauaaucgccguggcugacgagggauggcauauccuacagaacaaaucagaugacuuucuucugggaaaucacggcuacgacaaugcccuagccgauaugcaccccauauuucuugcacacgggcccgcauuccguaagaacuucagcaaagaagccaugaauucaacugaccuguauccccuucucugccaccuccuuaauauaacggcaaugccacacaacgggagcuucuggaacgugcaagaccugcugaauagcgcuaugccacgugucguucccuauacucaaucuaccaucuugcugccuggaucugucaaacccgcugaauacgaccaggaagggucuuauccauacuucauaggcguuucacucggcagcaucaucguuauuguguuuuucgucauauucaucaagcaucugauccauagccagauuccugcucuccaagacaugcacgccgaaaucgcccaaccauugcugcaggccuag

SEQ ID NO: 11866 - RNA, 1131 nt, Artificial Sequence
  Description of Artificial Sequence: Synthetic coding sequence
augcugaaaaaaauuucugugggcguugccggagaucugaauacugugacuaugaaacugggguguguucugauggccugggcccuguaucugucucuggggguccuguggguugcccaaaugcugcuagcugccucuuuugaaacucuucaaugugaagggccugugugcacagaagaauccagcugccacacagaggacgaucuuacggaugcaagggaggcuggauuucaggucaaagcuuacacauuuucugaaccauuccaccuuauagugucauaugacugguugauacuccaggguccugcuaaaccaguguucgaaggcgauuuguuaguguugagaugccaagcauggcaagauuggccacugacacagguuacauucuaucgugauggcucagcucuagggcccccugguccuaaucgagaauuuuccaucaccguggugcaaaaggccgauuccggccauuaucacugcucagguauauuccagucuccaggcccaggaauucccgaaaccgcaagugugguugcgauuacagugcaagaacucuuccccgcaccaauccugcgggccguucccuccgcugagccccaggcugguucuccaaugacacuaucaugucaaacaaaacucccucuucagcgaagcgcugccagacugcuguucucuuucuauaaggauggccguaucgugcaaaguagaggccuuagcagcgaguuucagauucccacagccagcgaagaucacagcgggagcuauuggugcgaagcugcuacggaggacaaucagguauggaagcagucaccccagcuggaaauucgcgugcagggugcaucuaguagugccgccccccccacccuuaauccggcuccgcaaaagucugcggcccccggaacugccccugaggaagcuccaggucccuugccuccccccccaacccccagcagugaggaccccgguuucaguaguccccugggcaugccugauccucaucucuaccaccaaaugggacucuuacugaaacauaugcaggacgugcggguacugcucggucaccucuuaauggaauugcgagagcuuagcggacaccgcaagccaggcacuacuaaggcgaccgcagaauag

SEQ ID NO: 11867 - RNA, 1572 nt, Artificial Sequence
  Description of Artificial Sequence: Synthetic coding sequence
auggccagaaaggcacugaaguuggcuucuuggacuuccauggcgcuggcugccuccggcauuuacuuuuauaguaauaaguaccuugauccgaacgacuuuggagcaguccgagucgggagggcagucgcaaccacggcagucauuucuuacgauuauuugacuagucuuaaaagcguccccuacggaucagaggaauaccugcagcuccgauccaagguucaccuccgguccgcgcgccgguuaugcgagcugugcugugcuaaucgaggaacguucauuaaagugggacagcaccugggagcacuugauuacuuacuccccgaggaguauacaaguacccugaaagucuuacacagccaggcaccucaguccuccaugcaggagauccgccaggugauccgggaagaccuuggaaaggaaauacacgacuuguuucagagcuuugaugacaccccucucgguaccgccagccuggcacagguucacaaagcuguucugcacgacggccggaccguggccgugaaaguacagcauccuaaagucagagcacagagcuccaaagacauacuacugauggaagugcuaguccuggcugucaaacaacuguuuccugaguuugaguuuauguggcuuguugaugaagcgaagaagaaccucccccuugaacuggauuuucugaaugaggggcggaaugcagaaaagguuagccagauguugcgccauuucgacuuucugaaggugccaagaauccauugggaccucucuacugagcgggugcuuuuaauggaguucgucgacggcggccagguaaacgaucgggauuauauggagcggaacaaaauagaugugaaugagauuucccgccaucuggguaagauguacucagagaugaucuucguaaacggauuugugcacugcgacccacacccagguaaugucuugguccgcaaacauccuggcacggguaaggcugaaauugugcuuuuggaucacggucuauaucagauguuaaccgaagaauuuaggcugaacuacugccaucuauggcaaagucuuauuuggacggacaugaagcguguaaaggaauacagccaaaggcugggagccggcgaucuguacccccuguucgcaugcaugcugacagcacggagcugggauucugugaacagaggaaucucccaggcccccgugacagcaaccgaggaucuggagauacgaaacaaugccgcgaacuaucugccucaaauaagucaccuccucaaccauguaccucggcagauguuauugauccucaaaacuaaugaccuucuucgcgggauugaggccgcucugggaacucgugcaucagcaucaagcuucuugaacaugucaagauguugcaucagagcccucgcugagcauaagaaaaagaacacuugcucauuuuuucggagaacgcagaucaguuuuagugaggcuuuuaaucuguggcaaauuaaccuccacgaguugauucuaagagucaagggccucaaacucgccgaccgcgugcuggcccugaucugcuggcuuuuccccgcaccccuuuag

SEQ ID NO: 11868 - RNA, 1197 nt, Artificial Sequence
  Description of Artificial Sequence: Synthetic coding sequence
auguggcuguuacugacuauggccagccuuaucuccgugcuuggaacuacacauggccuguuugguaagcugcaccccgguagucccgaaguaaccaugaacauuagccaaaugaucacuuauuggggguauccaaaugaggaguacgaaguggugacugaggacgguuauauccuugaaguaaaccggauucccuacgggaagaaaaauuccggcaauaccggccagcgcccugugguguuccugcagcacggccugcuagcuuccgccaccaauuggauuuccaaucuuccuaacaauucucucgcauucauccuggcagacgcagguuacgauguuuggcuaggcaacucaagagggaauacaugggcccggaggaacuuguacuauucuccugauagcguggaguuuugggccuucucuuuugacgaaauggcaaaauacgaucugccugccaccauagacuuuaucguaaaaaagaccggucagaaacagcugcauuacguuggucauucucaggggacuacaaucggcuucaucgcuuuuucgacaaaucccucacuggccaaaagaaucaagaccuuuuacgcgcucgcuccuguagccaccgugaaauauaccaaguccuugaucaacaaacuucguuucgucccacagucacucuucaaguuuauuuuuggggauaagaucuucuacccucacaauuucuucgaccaauucuuagccaccgaagugugcaguagggaaaugcucaaccuuuuaugcuccaacgcccuguuuaucauuugugguuuugacagcaagaacuuuaauacaucgagacuagacguuuaccugucucauaauccagcuggcacaucaguccagaacauguuucauuggacccaagccguuaagucgggaaaauuccaggccuacgacuggggcuccccugugcagaaccguaugcauuacgaccagucccagccacccuauuauaacgugaccgcaaugaacgugccuauugccguguggaaugggggaaaagaccugcuggcggacccccaggaugucggacugcuucuuccuaaauuaccaaaccuuauauaccauaaagaaauccccuuuuacaaccaccuugacuucauaugggcaauggacgccccccaggaaguguauaaugauaucguaaguaugauuagugaggauaaaaaguag

SEQ ID NO: 11869 - RNA, 555 nt, Artificial Sequence
  Description of Artificial Sequence: Synthetic coding sequence
augagggggcagggcaggaaagagagucuaagugauuccagagaucuugauggauccuaugaucagcuuacggauaguguggacgacgaauucgaacuaaguaccguaugccauaggccagagggccuagaacaguugcaagagcagacaaaauucacgagaaaagaacuucaggugcuguaucgagguuucaagaacgaguguccauccgggauuguuaacgaggagaauuucaaacagauuuacucccaauuuuuuccucagggagauaguagcacuuacgcgaccuuucuguucaaugcauucgauacuaaucacgacggaucagugagcuuugaagaaaugcucgauauuaugaagagcauauacgauaugaugggcaaguacacauacccugcacucagggaggaagcaccucgcgagcacgucgaaaguuucuuucagaagauggaccggaauaaggaugggguggugacgaucgaggaauucauagagaguugucagaaggugcagcugccugcacuguauaucacauuaacauggacacaagccuag

SEQ ID NO: 11870 - RNA, 3900 nt, Artificial Sequence
  Description of Artificial Sequence: Synthetic coding sequence
augucucugcaggagauguuucguuuuccaaugggacuguuguuaggauccguccuacuuguggccagcgccccugcuacucucgaaccacccgggugcagcaauaaggaacagcaagugacagugucacacaccuacaaaaucgauguuccuaagagcgcgcuuguccagguggacgccgacccacagccacucucagaugacggugcaucccuuuuggcucuuggggaagcccgugaggagcagaacauuaucuucagacacaauauccgccuccaaacaccacagaaagauugcgaguuggccgggagcguacaagaccuguuggccagggugaagaagcuggaggaggagauggucgaaaugaaggaacagugcucggcccagagauguugucaaggaguuacugaucugucaaggcacuguucuggccacgguacuuuuagccuugagaccugcagcugccauugcgaggagggccgcgagggaccugcaugcgagcgccuggccugcccaggugcaugcagcggacacggaagguguguggacggcaggugccugugccaugagccauacgucggcgcugacugcggcuauccugcaugccccgaaaauuguucaggacauggcgaauguguaaggggcgucugucaaugccaugaagacuucauguccgaggacuguucagagaaaagguguccuggcgauugcagcggccacgguuucugugacaccggggaaugcuauugugaagaaggauuuacuggacuugauugcgcacagguggugacaccccagggucugcaguuauugaagaauacagaagauuccuuacuagugaguugggagccaaguucucaaguggaccacuaccuguuauccuacuaccccuugggcaaggaacugucaggcaagcaaauccaggugccaaaagaacagcacucauaugagauccuaggccugcugccuggcacuaaauacaucgucacccugaggaacgugaagaaugaagugucguccuccccgcagcaucuccucgcuacgacagaccucgcuguucugggcacagcuuggguuacugaugagaccgagaauucccuugaugucgaaugggagaacccaagcacagaaguggacuauuacaaacugcguuacggacccaugacaggccaggaagucgcugaggucacugugccuaagaguagcgaucccaaguccagguacgacauaaccggauugcacccuggcacugaguacaaaaucacugucguucccaugcgcggagaacuggaagggaagccaauccuccugaaugggcgcaccgagauugacaguccaacaaaugucguaaccgaucgcgugacugaagacacagcuacuguuaguugggauccagugcaggcugugaucgauaaguaugucgugcgauacaccuccgcagacggagauacaaaagagauggccgugcacaaagaugaaucgaguacaguguugaccggccuuaagccgggugaggccuacaaaguguaugucugggcggagaggggcaaucaaggcucaaaaaaagccgauacuaaugcacugacagagaucgacucaccugcaaaccuggucacggacagagugacggagaacaccgcuacgaucaguugggacccgguucaggccacgaucgauaaguaugugguacgauauaccagugccgacgaucaggagacgcgagaaguucucgucgggaaggaacaaagcaguacagugcugacaggccuuagacccggaguugaauauacaguacacgugugggcucagaaaggcgaucgagaaagcaagaaagcugacacaaacgcaccaacugauaucgacuccccgaaaaaccuugugaccgaccgagugacagaaaauauggccacuguguccugggauccaguucaagcagcgauugacaaguacgucgugcgcuacacuucugcggggggugagacuagggaagugccugugggcaaggaacaaagcucuaccguacugaccggccugagacccggcauggaauauaugguccacgucugggcgcaaaagggugaccaagaaaguaagaaagcugauacuaaggcacagacggauauugacaguccgcagaaucuggugacugauagggugaccgagaacauggcaacagucuccugggaucccgugcgggcuacuaucgaccgguacgucguucgguauacuuccgcaaaggacggugaaacuagggagguacccguaggaaaagagcagucaucuaccguauuaacuggauugcggccugggguagaauacacugugcauguuugggcacagaaaggagcccaagaaucuaagaaagcagacacgaaagcacagaccgacauugacucuccacagaaucuugugacugacugggugacugagaauacggccacagucagcugggaucccgugcaggcaaccaucgauagauaugucguucacuacacgagugccaacggagaaacaagagaggucccaguuggcaaagagcagucaucgacuguccugaccgggcugcggccugggauggaguacacugugcacguuugggcccaaaagggaaaucaagaaaguaaaaaggcugacacuaaggcacaaacggagaucgacggaccuaagaaucuggugacagacugggugacugaaaacauggcuaccgucuccugggaccccguccaggcaacuauugauaaauauauggucagguauacauccgccgauggugaaacgcgcgagguccccguuggcaaagaacauucaaguacaguccugacaggauugcgcccuggaauggaauacauggugcacgugugggcucagaaaggggcucaagagucaaaaaaagcugauaccaaggcacagacagagcuggacccaccucgaaaucucagaccguccgccgugacccaguccggaggaauucucacuuggacucccccuucagcgcagauacauggauacauucuuacauaccaguucccugacgguacagugaaagaaaugcagcuugguagagaggaccagcgguucgcacugcaaggguuagagcagggggcuacauauccugucagucugguggcuuuuaaaggcggaaggcguagccggaacgugucaacaacccugaguacgguuggagcacgguucccgcaccccucggacugcucacaggugcaacagaauuccaaugcggcuagcggauuguacaccaucuaccugcacggggacgccucuagaccguuacagguguacugugacauggagacagacggaggaggcuggauaguguuccagcggcgcaacaccggccagcuggauuuuuuuaagagauggagaucauauguggaggguuuuggagacccgaugaaagaauuuuggcugggccuggacaaacugcauaacuuaacgacugguacuccagcacgcuacgaggugagaguagauuuacagaccgcaaaugaauccgcuuacgcgaucuacgacuucuuucagguagccucaucaaaggaaagguacaaacucaccgucggaaaguacagagguaccgccggggaugcucucacauaccauaauggcuggaaauuuaccaccuuugacagggauaacgacauagcacugaguaauugcgcgcuuacucaccacggggguuggugguauaaaaacugccaucuggcgaauccuaacggaagguacggcgagacuaaacauucggaaggcguuaacugggaaccuuggaagggccaugaauucaguaucccguacguagagcugaagauccggccgcauggcuacucaagggaacccgugcugggucgcaaaaagagaacgcugagggguaggcugcgcacuuucuag

SEQ ID NO: 11871 - RNA, 1662 nt, Artificial Sequence
  Description of Artificial Sequence: Synthetic coding sequence
augaccaggggagguccaggcgguagacccggacuuccccaacccccuccuuugcuucuguuacugcugcucuuacccuuacuucuugugaccgccgaaccgccuaagcccgcaggcguauacuacgcuacugcuuacuggaugcccgcagagaaaacaguacaggugaagaacgucauggacaagaauggcgacgcauauggguucuacaauaauucugugaaaaccacugggugggggauccuugagauucgggcgggauacggcagccagacccuuuccaaugaaauuaucauguuugucgccggcuuuuuagagggcuaccugaccgcaccucauaugaacgaccacuacaccaaucuguacccccaguugauuacaaagccaucgauuauggauaaaguacaggacuucauggagaaacaggacaaguggacacgaaagaauauuaaggaguacaagacagauucuuuuuggaggcauacaggguauguuauggcucaaaucgacggacuguacguuggagcaaagaagagggcaaucuuagaggguaccaaacccaugacucuguuccagauccaguuccugaauuccgugggggaccuauuggauuuaauacccucauuguccccaacaaagaacgguagccuuaagguguucaaacgaugggacaugggucacugcucugcucugaucaaaguguuaccggguuucgagaacauucuuuucgcccauagcuccugguacaccuacgccgcuauguuacgcauauauaagcacugggacuucaacgucaucgacaaggacacauccucaucuagacucucuuuuagcucuuacccaggguuccucgagagccucgaugacuucuacauuuugagcuccggccucauccuacuacagacuacgaacaguguuuucaauaagacccuucugaagcaaguaauuccagagacauugcuauccuggcagcgcguucgaguggcaaauaugauggccgacuccggaaaacgaugggcagacauuuucucuaaauacaacagcgggaccuacaauaaucaauauauggugcuugaccugaaaaaaguaaaauugaaccauucacucgacaagggaacacuguacaucgucgaacagauuccuacguauguggaauauagcgagcagaccgacguucugcggaaaggguacuggccgaguuacaauguaccauuucacgaaaaaauauauaauuggagcgguuacccuuugcuggugcaaaaguuggggcuggauuauucuuaugaucuggcacccagggcaaagaucuuucgccgugaucagggaaagguaacugauacagcaucaaugaaauauaucaugagguacaauaauuacaagaaggacccuuauagccggggcgacccauguaacacaaucugcugucgugaagaucugaauuccccuaauccuucuccaggaggcugcuaugacacaaaaguggcagacaucuauuuggccagucaguauacuagcuaugcaauuuccgguccaacuguccaaggaggcuugccuguguuccguugggaucgguuuaauaaaaccuuacaucaggggaugcccgaggucuauaacuuugauuuuaucaccaugaagccuaucuugaagcuggauauuaaauag

SEQ ID NO: 11872 - RNA, 2271 nt, Artificial Sequence
  Description of Artificial Sequence: Synthetic coding sequence
auguccagaccaggaaccgccacccccgcccuagcucuuguucugcuagcgguuacucuagcuggcguaggcgcacagggcgccgcccuugaggaccccgauuauuauggucaggagauuuggagcagagaaccauauuacgccagaccagagccagaauuagaaaccuuuuccccuccacucccugcagguccuggugaagagugggaaaggaggccacaagagccacguccaccuaaacgggcuacuaagccgaaaaaggcuccaaagcgagagaaaagcgcaccagaaccuccuccucccggaaagcacucaaauaagaaggugaugcguaccaagagcuccgagaaagccgccaaugacgaucacagcguaagaguggcaagggaggaugugagagagagcugcccaccuuugggccuugaaacccugaagauuaccgauuuucaacugcaugcaagcacggucaagagauacggccuaggugcucaccguggucgucugaacauucaagcugguauuaaugagaaugauuuuuaugauggcgcauggugugccgggcggaaugaccuacagcaguggauugaaguugacgcucgacgccugacccgcuuuacuggagugaucacgcaggggaggaacucguugugguugucugauugggugacuuccuacaaaguaaugguguccaacgauucacauaccugggucacugugaaaaacggcagcggagacaugauuuucgaggguaacucugaaaaagagaucccugucuuaaaugaguuaccgguccccauggucgcccguuacauucgcaucaauccacaguccugguucgauaauggaagcaucugcaugaggauggagaucuuagggugcccccugcccgacccgaauaauuacuaccaccggcggaaugaaaugacaaccaccgaugaccucgacuucaaacaccauaacuacaaagaaaugcgacagcugaugaaaguggucaacgaaaugugcccuaacauuacuagaauuuacaacauuggaaaaucccaucagggccugaagcuauaugccguugagaucagcgaccaccccggugagcaugaggucggggagcccgaauuucacuauauugcaggcgcacacggaaaugaggugcuugggcgggagcugcuccugcuguugguccaauuuguaugccaggaauacuuggcuagaaaugcacgcaucguacaccugguggaggaaaccagaauacauguguugccaagccucaacccugacggcuacgagaaagccuacgaaggcggauccgagcucggaggauggagucugggccgguggacucacgacggcaucgacauaaacaacaacuuuccagaccuuaauacauuacugugggaggccgaggacagacaaaauguccccaggaaagugccaaaucacuauaucgcgaucccugaaugguuccucagcgagaacgccaccgucgcggccgagacuagggcugugauagcauggauggaaaagauaccuuucguccugggaggcaacuugcaggggggcgaacugguugucgccuauccguacgaucuagugcguucccccuggaaaacacaggaacauaccccuaccccggacgaucauguguuuagauggcuggcuuacuccuaugcuucuacccaucgccuaaugaccgacgccagacgccgugugugucauacugaagauuuucagaaagaggaagggacaguuaauggcgccuccuggcacacaguugcugggucucugaaugauuucuccuaccugcacaccaauugcuuugaguugucuauuuaugucggaugcgacaaguacccucacgaaagccagcugccugaagagugggagaauaaccgugaaucccugaucguguuuauggaacagguucaccgggggaucaaaggccugguacgcgacucacacgguaagggcauacccaaugcuaucauuucuguugaaggaauaaaccacgauauacgcaccgcaaacgauggugacuauuggcgccucuugaaucccggugaauauguagugacugcaaaggcagaaggcuucacagcgucuaccaagaacugcauggucgguuacgacaugggugcuacccggugugauuuuacacugagcaagacaaauauggcaagaauccgcgagaucauggagaaguucggaaagcagccugugagccuaccagcccggcggcucaaacugcgggggcagaagcgaaggcaaagggguuag

SEQ ID NO: 11873 - RNA, 702 nt, Artificial Sequence
  Description of Artificial Sequence: Synthetic coding sequence
auggcuacucccccuuuuagacugauacggaagauguuuaguuuuaaggugucucgguggaugggguuagcuuguuuccggagcuuggcagccagcagcccuucuaucaggcagaagaaacucaugcauaaacugcaagaagagaaggccuuucgcgaggaaaugaagauauuucgugagaagauugaggacuuucgugaggaaauguggacuuuccgggggaagauucaugcuuuccgggggcaaaucuuaggauucugggaagaggaaagacccuuuugggaggaagagaaaacauucuggaaagaggagaagaguuuuugggagauggaaaaaagcuucagagaagaggaaaagacguucuggaagaaguaccggacauuuuggaaggaagacaaggcauuuuggaaggaggacaaugcgcugugggagcgugacagaaaccuacuccaggaagacaaggcucuaugggaagaagaaaaggcccuaugggucgaggaacgggcacugcuggagggagagaaggcacucugggaggauaaaacaagccuuugggaggaggaaaaugcauugugggaagaagagagggcuuuuuggauggagaauaauggacauauagccggugaacaaaugcucgaggacggcccccauaacgcuaaccggggccagcgccugcuugcuuucucucgcggaagggcuuag

SEQ ID NO: 11874 - RNA, 696 nt, Artificial Sequence
  Description of Artificial Sequence: Synthetic coding sequence
augaugcugagcugccuauuucuguugaaagcacuauuggcucuuggaagcuuagagucauggaucaccgcaggagagcaugcaaaggaaggcgaguguccaccccacaaaaaccccuguaaggaauuaugccagggugaugaguuaugucccgccgaacagaaaugcugcacaaccggcuguggaagaauuuguagggauauaccgaagggccgcaaaagagacuguccucgggugauucggaagcagagcugccugaagaggugcauuacagacgagaccugcccgggaguuaaaaagugcuguacuuuaggaugcaauaaaucauguguugugcccauuaguaaacagaaacucgcggaguuuggaggggagugcccagcugauccuuugccgugugaggaacugugcgacggugaugcuagcugcccacaaggccacaaauguugcagcaccggcuguggccgcacgugccuuggcgacauagagggcggaagggggggagacugccccaagguuuuggucggacucuguaucguggggugcgugauggaugaaaacugccaagccggugagaaauguugcaagagcggaugcgggagguucugugugccaccggugcuucccccaaaacugacaaugaaucccaacuggaccgugaggagcgauuccgagcucgagauacccgugcccuag

SEQ ID NO: 11875 - RNA, 1050 nt, Artificial Sequence
  Description of Artificial Sequence: Synthetic coding sequence
auggggccuauuagcgcgcccagcugccgguggcggaucccguggcagggccugcuacugacagccagucuguucacguucuggaauccccccaccaccgcucaacucacaaucgaagccgugccaaguaaugcugccgaagggaaagaggugcuguuacuggugcacaaucucccccaggacccucggggauauaacugguacaaaggugaaacaguagaugccaaucggcggaucaucggguacgugaucagcaaccagcaaaucacuccuggcccugcguauuccaaccgugagacaaucuacccuaacgccagccuucugaugcggaaugugacaagaaacgauacuggcagcuauacauuacaagugaucaagcuaaaccugaugagugaagaagugaccggucaguuuucuguccacccagagaccccaaaaccaaguaucuccuccaauaauucuaauccuguagaggauaaagacgccguggcauuuaccugcgaacccgaaacccagaacaccaccuaccuuuggugggugaacggccaaucacugccggugagcccaagacugcagcugaguaaugguaaccggacgcugacacuuuuaucuguuacucgcaaugauguuggcccuuacgaaugcgagauccagaaucccgccuccgccaauuuuuccgauccugucacacugaauguccuguacggcccggacgcccccacaaucucuccuagugauacuuauuaccaugccggugucaaccuaaaccuaucuugccaugcagccucuaacccccccucccaauacucaugguccgugaauggcacauuccaacaguacacucagaagcucuucauuccuaauauuaccacaaagaacagugguuccuaugcaugccacacgacaaacucugcaacugggcgaaaccgcacuaccgugagaaugauuacugugucagacgcucuuguccagggcuccucuccaggcuuauccgcccgcgccaccguguccauaaugaucggagugcucgccagaguugcucucaucuag

SEQ ID NO: 11876 - RNA, 510 nt, Artificial Sequence
  Description of Artificial Sequence: Synthetic coding sequence
augacagcgggucggcggauggaaauguugugcgcugggcgugugccugcccuccuccugugccugggguuucaucugcugcaagccguccuuucaacuaccguuaucccguccuguauuccaggugagagcagcgauaacuguacagcccuggugcagacagaagacaacccccgaguugcccagguuucaauuacgaaguguagcucagauaugaauggguauuguuugcauggccagugcaucuauuuaguugacaugucucagaauuauugucggugugagguggguuacacuggggucagaugugagcauuucuuccugacugugcaucagccauuauccaaagaguacguagcucugacagugaucuuaaucauccuguuccucauaacuguagugggaucuacguauuauuuuugccggugguauagaaauaggaagagcaaagaaccaaaaaaggaguacgagcgugucaccagcggcgacccagagcuuccccagguguag

SEQ ID NO: 11877 - RNA, 273 nt, Artificial Sequence
  Description of Artificial Sequence: Synthetic coding sequence
augaaguuauccgugugccuccuucucgucacucuggcacugugcuguuaucaggcuaacgcagaguuuugccccgcgcuaguguccgaguuguuagacuucuucuucaucagcgagccucucuucaaacuuucucuugcuaaauucgacgcucccccugaggcgguggcagcuaaacugggagucaaaagauguacggaccaaaugagucuccagaagaggucccucaucgccgaaguucuagugaaaauucucaagaaguguaguguguag

SEQ ID NO: 11878 - RNA, 429 nt, Artificial Sequence
  Description of Artificial Sequence: Synthetic coding sequence
augccacggugccgguggcugagccucauucuccuuacaaucccacuugcccuggucgcacgaaaggacccuaagaaaaacgagacuggcguuuuacggaaacuuaagcccgugaaugcaaguaaugccaaugucaagcaaugucuaugguuugcuaugcaagaguauaacaaggagucugaagauaaauauguuuuccuuguggugaagacacugcaggcccagcugcaaguaacaaaccugcuagaauaucugauugauguugagauugcgaggucagacugucgaaagccucuuagcacaaaugagauuugcgccauucaagaaaauucuaaacuaaaacgcaaauuaucguguucuuuuuuaguuggugcccugccuuggaacggugaguuuacuguuauggaaaaaaaaugcgaagacgccuag

SEQ ID NO: 11879 - RNA, 438 nt, Artificial Sequence
  Description of Artificial Sequence: Synthetic coding sequence
auggggauuggauguuggcgaaauccucuguuguuacugaucgcucugguguuaagcgccaagcucggucauuuccagcgaugggaagguuuccagcagaaacuuaugaguaaaaaaaacaugaauuccacacuuaauuuuuuuauacagagcuacaacaacgccucuaaugauacguacuuguaccgagugcagcgccucauacggucucagaugcagcucacaaccggaguggaauacauuguaacgguuaagaucggauggacgaaaugcaaacgcaacgauacaucuaauagcuccugccccuuacaaagcaagaaacugcggaaaucccucauuugugagucgcucauuuauacaaugccauggauuaauuauuuucaguuguggaacaauaguugucucgaagcagaacacgucggaagaaaccugagguag

SEQ ID NO: 11880 - RNA, 552 nt, Artificial Sequence
  Description of Artificial Sequence: Synthetic coding sequence
augaaacuuuuguuucccauuuuugcuucacugauguugcaguaccagguuaacacagaguucaucgguuuacguagaugcuugaugggcuugggaagaugccgagaccacuguaacguggacgagaaagagauccagaagugcaagaugaaaaaaugcugcgugggaccgaagguagucaaauugaucaagaacuaucuacaguaugguacccccaacgugcugaaugaggacguucaggaaauguugaagccugccaaaaauagcuccgccguaauacagagaaagcacauccucagcguguugccucagaucaaaucaacgaguuuuuuugcaaacaccaauuucgucaucauccccaacgccaccccaaugaauuccgccacgaucaguacuaugacacccggacagaucacuuauacggcuacuagcaccaaaagcaauacuaaggagagcagagacuccgcaaccgccaguccaccaccugccccgcccccaccuaacauucugcccacaccaucacuugagcuugaggaagccgaagagcaauag

SEQ ID NO: 11881 - RNA, 609 nt, Artificial Sequence
  Description of Artificial Sequence: Synthetic coding sequence
augagaggccacccaagucugcuucuguuauauauggcgcucacaacuugccucgacacuaguccuuccgaagaaaccgaucaagaagucuuccuggggccacccgaggcucaaaguuuccuaagcucccauaccagaaucccgagagcgaaccacugggauuuggagcuauugacacccgggaacuuggaaagggaaugccuagaagaacguuguuccugggaagaagccagagaguacuuugaggacaacacuuugaccgagcgauucugggaaagcuauauauacaacggaaaagguggacggggaagaguggauguugccucccuggcagucggccugacuggcgggauccugcugaucguucuggccggucugggcgcuuucugguaucuccgcuggcggcagcaccgcgggcagcagccguguccucaggaggcgggccuuaucucccccuugucacccuuaaacccccuaggcccacccaccccgcuacccccuccuccuccccccccacccgguuugcccaccuaugaacaggcccuggcagcaagugggguccaugacgcucccccuccccccuacacuucucuucgccgaccucacuag

SEQ ID NO: 11882 - RNA, 558 nt, Artificial Sequence
  Description of Artificial Sequence: Synthetic coding sequence
augagauuacugauccugacuugccugguagcagucgcucucgcgcgcccuaaacugccacuccgcuacccggaacgguugcaaaaccccucugaaagcagugaaccuaucccucuagaaucgagggaggaauauaugaacggcaugaaucgucagagaaacauccugcgcgaaaaacagacagacgagaucaaagauacccgaaaugagagcacccaaaacugcgugguagccgagccugagaagauggaguccaguaucuccagcagcuccgaagaaaugagccuaucuaagugugccgaacaguuuugucggcugaacgaguauaaccaauugcagcuccaggcagcccacgcccaagaacaaaucagaagaaugaaugagaacucucaugugcaagugccuuuucagcaacugaaucagcuggccgccuaccccuaugccgucugguauuauccccagauuaugcaauaugugccuuuuccucccuucagcgacauaucuaacccaacugcucacgaaaacuacgagaagaauaaugugaugcuucagugguag

SEQ ID NO: 11883 - RNA, 1410 nt, Artificial Sequence
  Description of Artificial Sequence: Synthetic coding sequence
augauuacugaaggcgcucaagcccccagacuacuucucccaccacuucuacuucuuuuaacacucccugcuacuggcuccgauccugugcucugcuuuacccaguaugaagagucaagcgggaaaugcaaaggucugcugggcgggggcguuucuguggaagauuguugucucaacacagcauuugccuaccaaaaacgguccggcgggcugugucagcccuguagaucacccagguggucucucugguccacgugggcgccuugcucuguuacaugcuccgaggggucacagcugcgcuaucgucggugcguuggauggaaugggcaguguagugguaaagucgcuccugguacuuuggaguggcagcugcaagcaugcgaggaccagcaguguugcccugagaugggcgguuggagcggcuggggcccuugggaaccauguagugucaccuguucaaaaggcacacgcacucggagacgcgccugcaaucacccagcccccaaauguggaggccacugccccggucaggcccaggaguccgaggcaugcgacacacagcagguuuguccaacccacggcgccugggcaacuuggggccccuggaccccuugcucagcuuccugccacggcggcccucaugaaccaaaggaaaccagguccagaaaguguuccgcccccgagccgucccaaaaaccaccuggcaagcccugcccaggucuggcuuaugaacagcgccgaugcacaggccugccuccauguccaguggcuggcggaugggggcccugggggccagugucuccuugcccugucacuugcggccucggccagacuauggagcaacggaccuguaaccacccaguuccccaacacgguggcccuuucugugccggggacgcuacucggacacauauauguaacaccgcuguuccuuguccaguggacggagaaugggacagcuggggagaguggagcccuugcauccggcguaacaugaaaaguauuuccugccaagaaauaccaggacagcaaaguagggggcgaacuuguagaggccggaaguuugaugggcaccggugugccggccaacagcaagacauccgccauuguuacucaauucagcauuguccccuaaaaggauccuggucugaguggagcaccugggggcugugcaugccaccgugcgggcccaaccccacccgagcccgccagcgccuguguacccccuuauuaccgaaauacccaccuaccguuucgaugguugaagggcagggggaaaaaaacgugacauuuuggggccggccccugccccgaugcgaagagcuucaaggacaaaagcucgugguugaggagaagaggccaugcuugcauguuccagccugcaaagaccccgaggaagaagaacucuag

SEQ ID NO: 11884 - RNA, 453 nt, Artificial Sequence
  Description of Artificial Sequence: Synthetic coding sequence
augcuaaucgcuaccucuuucuuucucuucuucaguagugucgucgcagcaccuacucacucuagcuuuuggcaguuucaacgcagaguuaagcauaucaccgggagauccgcuuuuuuuucuuacuacggcuacggcugcuacugcggguugggagauaaggguauccccguggacgauacagacucccccagcucuccaucucccuacgaaaaacugaaggaauuuucaugccagcccguacucaauaguuaucaguuucacaucgucaacggagcugugguguguggcuguacacugggaccuggcgcuuccugccacugcaggcucaaagcaugugaaugcgacaagcaaucuguccacugcuucaaggaaucacucccaacauacgagaaaaacuuuaaacaguucucuagccaacccagauguggacggcacaagccuuggugcuag

SEQ ID NO: 11885 - RNA, 1347 nt, Artificial Sequence
  Description of Artificial Sequence: Synthetic coding sequence
augcgagagugcauuuccguccacgucgggcaagccggcguucaaaugggaaaugccugcugggaacuguauugucuggaacaugggauccagccugacgggcaaaugccuagcgauaagacaaucggcggcggcgaugacagcuucaccaccuucuuuugcgagacuggagccgggaaacacgugccaagggccguguuugucgaccuggaacccacaguuaucgacgagauacggaauggccccuacagacagcuguuucauccagaacaguuaaucaccggaaaggaagaugcagcaaacaacuacgcucggggccacuauacuauugggaaagaaauuauagaucccguguuggaucgcauacggaagcuuucugaccaaugcacuggucuucagggcuuccucguauuccacucauuuggcggcggcacaggaucuggguuuacaucucugcucauggagagacugucaguggauuauggcaagaagaguaagcucgaauuuucuauuuacccagccccccaaguauccacggccguaguggaacccuauaacucgauccuaaccacacacaccacacuggaacacuccgacugugccuucaugguggauaaugaggccauuuacgauaucugccgccgcaaucuugacaucgaaagaccgaccuauacuaaccugaaccgccugauuagccagaucgugucaucuauuaccgccucacuaagguuugauggcgcccucaacgucgaucuuaccgaauuccagacaaaucucgugcccuaucccaggauccacuucccuuuagcuacauaugcaccaguuaucucagcugaaaaggccuaccaugaacagcucucuguagccgagaucaccaacgccuguuuugagcccgcuaaccagaugguaaagugcgauccgcgccauggcaaauacauggccuguugucugcuguaucgcggcgaugucgucccuaaggacguuaaugcggcaauagcagccaucaaaaccaaaagauccauacaauucguggauugguguccaacaggauuuaagguggggauuaauuaucagccuccuaccgugguucccgggggagaucuggccaaagugcagcgcgccgugugcauguuaucaaauaccaccgcuauagcugaggccugggcuagacuggaccacaaguucgaucugauguaugccaaaagggcuuuugugcauugguauguuggagagggaauggaagaaggggaguucucggaagcccgcgaagauauggcggcccuggagaaagacuaugaagaaguuggcauugacuccuacgaagacgaggacgaaggagaggaguag

SEQ ID NO: 11886 - RNA, 942 nt, Artificial Sequence
  Description of Artificial Sequence: Synthetic coding sequence
augcggguugugacaauagugauucugcucugcuucuguaaggccgcagagcugaggaaggccucccccggcagcguuagaaguagaguuaaccacggcagagcgggcggagggagacgcggcucaaauccgguaaaacgguaugcgccuggauugccuugcgacgucuacacauaccuucacgagaaauauuuggacugucaggagcguaagcuggucuacguccuuccuggauggccucaggacuugcuccacaugcuguuggcccgcaauaagauucgcacacuuaagaacaacauguucagcaaguuuaaaaaguugaaaagccuagaccugcagcagaacgaaauuuccaagaucgagagcgaagcguuuuuuggccuuaacaagcuuacgacccugcuguuacagcauaaccagaucaagguucugacagaagaaguuuucaucuauacaccucuguugucuuauuuacgacuguacgacaacccguggcauugcaccugugaaauagaaacuuuaaucuccaugcugcagauuccacgcaaccgcaaucuggggaauuaugcuaagugugaaagcccacaggaacaaaaaaauaaaaaguuacgccagaucaagucagaacaguuaugcaacgaagaagagaaagagcagcuggauccgaaaccccagguaucaggaaggccuccuguuauuaaaccggaggucgauucuacauucugucauaauuacgucuuuccaauucagacccucgacugcaaaaggaaggaacucaagaaaguacccaacaauauaccaccagauauugugaaguuagaucucuccuacaacaaaauaaaccaacugaggccgaaggaauucgaggaugugcacgaacuuaagaagcugaaucugucuucgaauggaauugaauuuauagacccuggaucguugagauag

SEQ ID NO: 11887 - RNA, 972 nt, Artificial Sequence
  Description of Artificial Sequence: Synthetic coding sequence
augcaagcugccuggcuucuaggagcacucgugguaccacaacugcuuggguuuggccacggugcccgaggagcagagcgggaaugggaagguggcuggggaggagcccaggaggaagaaagggaacgggaagcucuuauguugaagcauuuacaagaggccuugggguuaccugccggccguggcgacgagaaucccgcuggcacaguagaaggcaaggaggauugggagauggaagaggaccagggcgaagaagaagaggaggaggccacaccgacuccuagcuccggaccaucacccuccccuacccccgaggauauaguuacauacauacuagggaggcuugcaggacuggacgcgggucugcaccaacugcaugucaggcugcacgcucuugacacaagggugguggagcucacccagggucugaggcaauugcggaacgcagcgggggauacacgcgaugcaguacaggcauuacaagaggcccagggcagagcugaaagggagcacggcaggcuagaggggugccucaaaggcuuaagacuggggcacaaauguuuuuugcuuucuagggacuuugaggcucaggccgccgcucaggcacgcugcaccgcucgaggcgggucauuagcucagccugcagaccgccaacagauggaagccuuaacaagguaccugcgagcagcucuugccccuuacaauuggccagugugguuggggguacaugauagacgcgcugagggacuauaucucuucgagaacggccaacgcguuagcuucuucgccuggcaucgcucuccccggccugagcugggagcgcagccaagugccucuccccacccacucuccccggaucagccuaacggaggaacgcuggaaaauuguguggcucaggcuagugaugacgggaguuggugggaucacgauugucagcgucgccuauacuacgugugugaguuucccuucuag

SEQ ID NO: 11888 - RNA, 1086 nt, Artificial Sequence
  Description of Artificial Sequence: Synthetic coding sequence
augaauggacugagccugagcgagcuguguugucucuuuugcuguccaccauguccaggaagaauugccgcgaagcuggcauuccugccaccagaggccaccuacagcuuggugccagaaccagagcccggaccgggcggagccggagcagccccccuuggaacuuugcgcgccucuucuggagccccaggaagguggaaauuacaccucacggagcgggccgauuuucaguauucucaacgggaguuggacacgauugaaguuuucccuaccaagucugcccgagguaaccguguaucuugcauguacgucagaugugugccaggagcccggcaaggccaucaggcccaagguggacacccacagcuugccugggugggacggcuaggggacuccaauaacccggcacccgguggaugucuacucgguaagagcuggggaaccggugccgcccuggcuugcggauauauacauuugcuagcacguuauaccgugcuguuuagucacgggaaugcaguggaccuggggcagaugagcuccuucuauauuggccugggcagccgccuccauuguaacaucuucagcuacgauuauagcggguacggagcuucaucggguaggcccucugaaagaaaucuguacgccgacauugacgcagcauggcaggcuuugaggacaagguacggcaucucuccagacucuauuauccuguacggucaaagcauuggcacagugcccacuguagaccuggccucucgauaugaaugugccgccguggugcugcacaguccgcuuacuuccgggaugcggguggccuuucccgauacaaaaaaaacuuauugcuuugaugccuuuccaaauaucgaaaagguuuccaagaucacgucucccguucugaucauccauggaaccgaggacgaaguuauugacuucucccauggccuugcucuguaugagcguugcccgaaggccguagagccacucuggguggagggcgccggacacaacgauaucgagcucuauucacaguaucuggaaagacuucgaagguuuauaucucaagagcugccuagccagcgggccuag

SEQ ID NO: 11889 - RNA, 1404 nt, Artificial Sequence
  Description of Artificial Sequence: Synthetic coding sequence
augcgaaccgccccaaguuugcggagaugugugugucuacuguuggcugccauucuagaucuggcgcgcgguuauuugacuguuaacauagaaccucuuccucccgugguugcuggggacgcaguaacccugaaauguaacuucaaaacugauggacguaugcgcgaaaucguaugguaucgcgucacugauggaggcacaauuaagcaaaaaaucuuuacguucgacgcuauguucucaaccaacuacucucacauggagaacuaucguaagagggaggaucugguuuaccaaucaacugugaggcugccagaggugcgcauuucugauaacggcccuuacgagugccauguggggaucuaugaucgggccacacgagagaagguggugcuagcgaguggaaacauuuuccuuaauguaauggcaccacccacgucgauugaaguggucgcugcggauacccccgccccuuucucaagauaucaggcucagaacuucacccuugucuguaucguuuccggagguaagccagcucccaugguguauuuuaaaagggacggggagccuauugacgccguuccauugucugaaccucccgcugcauccaguggcccucuccaggauagcaggccguuccgcagucuucuccaccgggaccucgaugacacuaagaugcagaagucucucuccuugcuggaugccgaaaaccgagguggccggccuuacacagagcgcccuucucgcggccuuaccccugauccaaauauccugcuucagccaacaaccgaaaauaucccugaaacaguugucucacgcgaguuuccccgcugggugcauagugcagaaccaaccuacuuucugaggcacagucgcacucccucuuccgauggaacaguggaaguccgcgcuuugcucacauggaccuugaacccucagauugauaacgaggcauuguucucuugcgaggucaagcauccagccuuguccaugccaaugcaagcagagguuacccuagucgccccuaaaggacccaaaauuguaaugacccccucgagagcuaggguuggcgauacagugaggauccugguccacggauuucagaaugaaguauucccugaaccuauguuuaccuggacuagagucgguucucgccuucuggacggaucagcggaauucgacgggaaggagcucguacuugagcgggugcccgcugaacucaacggauccauguacaggugcacugcacagaacccucuaggcucuacagauacacacacucgccuaaucguguucgagaacccgaauauaccucgaggcacugaagacaguaacggaucaaucgggccgaccggagcccgacucacccuugugcuagcccugacagugauucuggaacucacuuag

SEQ ID NO: 11890 - RNA, 783 nt, Artificial Sequence
  Description of Artificial Sequence: Synthetic coding sequence
auggcgagaccuggaauggaacgguggagagaccggcuggcccuugugacgggagcgagcgggggcauaggugccgccguggcccgcgcuuugguucaacagggccucaaagugguugguugugcucguacuguugggaauaucgaggagcuagcugcugaauguaaaucugccggauacccugguacacucauccccuacagaugugaccuuucuaacgaggaagacauacuaagcauguucucugcaauacgaucucaacauucuggaguugacauauguauuaauaacgcuggucucgccaggcccgauacuuuacuguccgggucaaccucaggcuggaaggacauguuuaaugugaacguacuggcccugagcauuuguacacgagaagcauaccaaaguaugaaggaacggaacgucgacgauggucauaucauuaacauuaauucaaugaguggucaccgggugcuuccucucuccgugacccauuuuuacagugcuacuaaguaugccguaacagcguugaccgaaggauugagacaggagcucagggaggcucagacucacauccgugccacuugcauuucccccggggucgucgaaacccaguucgcauuuaagcuacaugacaaggaccccgaaaaggccgcugccacauaugaacagaugaaaugccugaagccugaagaugucgccgaagccgucauuuacgucuuaucuacccccgcacacauccagaucggcgauauccagaugagaccuacugagcaggugaccuag

SEQ ID NO: 11891 - RNA, 1218 nt, Artificial Sequence
  Description of Artificial Sequence: Synthetic coding sequence
augucgucuccugcucucacagcuggcgccucuggcaagguuauggauuuuaauaacgguaccuaccuggucagcuucacacuguuuugggagggccaagugucauuaucauugcuuuuaauccaccccucugagggugcuucugcccuguggcgugcucggaaccaaggauacgauaaaauuaucuucaaaggaaaauucgucaacggcacuucgcacguguuuacagaaugugggcuaacgcucaacuccaaugccgaacucugugaauauuuggacgaccgugaccaggaggcguuuuauuguaugaagccgcaacacaugccaugcgaggccuugacauacaugacgacucguaauagggaaguuucauaccuuaccgauaaagagaacagccuuuuucaccgcaguaaggucgguguggagaugaugaaagaccgaaagcacauugauguuacaaauugcaacaagagggaaaagauugaagaaacuugucagguuggaaugaagccaccagugccagguggcuauacacugcaggguaaguggaucacgaccuucugcaaucaggugcaguuggacacuaucaaaaucaacggcugcuuaaaaggaaaacugauuuauuuacugggagauagcacauugagacaguggaucuacuacuucccuaaaguaguuaagacacuaaaguucuuugacuuacacgagaccggaaucuucaagaaacaucuccugcuggacgccgaacggcacacucaaauacaguggaagaaacacuccuacccauuugugaccuuccaacuuuauucacucauagaccacgauuacauuccccgugagauugaucgacugucaggcgauaagaauaccgcaauugucaucacguuuggucagcacuuuaggccauuuccaauagauaucuucauccggagagccauuggggugcagaaggcaaucgaaagacucuuucugagaucacccgccacgaaagucaucauuaagacggagaauauuagagagaugcauaucgagaccgaaagauuuggcgacuuucacggcuacauccauuaccuaaucaugaaggacauauucaaagaucugaauguggggauuaucgaugccugggacaugacaauugcauacgggaccgacaccauucaccccccagaucacgugauuggcaaccaaauaaauauguuccugaacuauaucuguuag

SEQ ID NO: 11892 - RNA, 597 nt, Artificial Sequence
  Description of Artificial Sequence: Synthetic coding sequence
augcccguaccugccuuaugucuccugugggcacucgcuaugguuacucgcccagcaucagccgcgccgaugggcggcccagaauuggcccagcacgaggaacugacgcugcuuuuucacggaacacugcagcucggccaagcucuuaauggcguguaucggacuacagaaggcagacucacaaaggcacgaaauucucucggacucuacggcagaacuauugagcuacucggccaggaggugagcaggggacgagacgccgcccaagagcugcgcgcaagccuccuugaaacacagauggaggaggacaucuugcagcugcaggccgaggcgaccgcagaaguccucggagagguggcccaagcacagaaaguucugcgcgauuccguucagcgccucgaaguccagcucaggucagccugguuagguccugcguaucgagaguuugaaguacuaaaggcucacgcugacaagcaaucgcauauccucugggcccugacuggccacguucagaggcagaggcgcgagaugguggcacagcaacaucggcucagacagauucaggagaggcugcauaccgcugcauugccagccuag

SEQ ID NO: 11893 - RNA, 1455 nt, Artificial Sequence
  Description of Artificial Sequence: Synthetic coding sequence
auggcuggcccauggacguuuacccuguugugcggccuucuggcugccacgcuuauucaggccacgcugagcccuacugcuguucugauucuugguccaaaagucauaaaagagaagcucacucaggagcugaaggaccacaacgcuaccagcauuuugcagcaguugccacuccugucugccaugcgcgaaaaacccgccggcgguauuccugugcugggaucacuggugaauacaguccucaagcacaucauuugguuaaaagugaucacugcuaauauucugcaacugcaggucaaacccucugccaacgaccaggaacuccuaguuaaaauaccccuugauauggucgcagguuucaacacacccuuagucaagaccaucguugaauuucacaugaccacugaggcccaggccacgauucguauggauaccuccgcauccggacccacccgguuaguacucucugacugugcuaccagccaugggucccugcggauccagcugcugcacaagcucagcuuucucguuaaugcacuggccaagcagguuaugaacuugcuggucccuagcuugcccaaucuagugaagaaccaauugugcccaguuauugaagcuagcuuuaauggcauguacgccgaucuccuacagcugguaaaggugccaaucucguuaucgauagaccgacuggaguucgaucuccuauauccggcaauaaaaggcgauaccauucaauuguacuugggugccaagcugcuggacucccaggguaaaguuacaaagugguucaauaacucugcagcaagucucacuaugccuacacuggacaauauaccauuuucccugaucguaucccaagacguugugaaggcggccguugccgcaguucuaucacccgaagaguucaugguucuguuagacucuguccuuccggaaagcgcgcaccggcugaaaagcucuaucggauuaaucaacgaaaaagcagccgacaaacugggaucuacccagaucgugaaaauccugacacaggacaccccagaguuuuucaucgaccaggggcaugccaagguggcccaauuaaucguuuuagaaguuuuccccuccagcgaagcccugcguccacucuucacccuggguauugaggcuagcagcgaagcucaauucuacacaaaaggagaccagcucaucuugaacuugaacaauaucuccagcgaccgcauacaacuaaugaacucuggcauuggcugguuccagcccgacguccucaagaauauuaucacagagaucauacacucaauccuucuaccuaaucaaaacgguaaacugcgcucuggugugccggugagucuugugaaggcccugggauuugaagccgcagaguccagccugaccaaagacgcucuagugcucacacccgcaagucuauggaaaccuagcagccccguuucgcaguag

SEQ ID NO: 11894 - RNA, 750 nt, Artificial Sequence
  Description of Artificial Sequence: Synthetic coding sequence
augcuacagcuauggaaguuaguccucuuaugcggaguccuuaccggcaccuccgaaucucuccucgacaaccucggcaacgauuuguccaacgucguugacaaacucgaaccggugcuucacgagggguuggagacuguggauaauacucugaaaggcauccuugaaaagcucaaaguggaucugggcguccugcaaaagucaagugccuggcaguuagcaaagcaaaaagcccaggaggcagaaaagcugcugaauaaugugaucuccaaauuacugccaaccaauaccgacaucuucggccugaaaaucaguaauucccucauccucgacgugaaagccgagcccaucgacgacggcaagggucugaaucuguccuucccagugacagcaaaugugaccguagcuggaccuauuauaggccaaauaauuaaucucaaagcuucucuagauuugcugaccgccgugaccaucgaaacugacccccaaacacaccaacccguggccguucugggcgaaugugccucugauccaacauccaucuccuugagccugcuggacaaacauucccaaauuauuaacaaguuugucaauagcgugauuaauacccugaaauccaccguauccuccuugcuucaaaaagagauuuguccacuuauccggauuuucauccacucucuagaugucaauguaauccagcaaguggucgacaacccgcagcauaagacccaacugcagacucucauuuag

SEQ ID NO: 11895 - RNA, 1959 nt, Artificial Sequence
  Description of Artificial Sequence: Synthetic coding sequence
augcaggggccacugcuccucccugggcuuugcuuccugcugagucucuucggggccgugacacagaaaacaaagaccaguugcgccaaauguccacccaaugcaaguugcguuaacaacacucacugcacgugcaaccaugguuauacuagcggaagcgggcagaagcuuuuuaccuucccucuggagacauguaacgacaucaaugagugcacacccccuuauucugucuacuguggguuuaaugcaguguguuauaauguagagggcaguuucuauugucagugugugccaggcuaccgccugcacagcgggaaugaacaguucaguaauucuaacgagaacacuugccaagacaccaccucauccaaaacgacggaggguaggaaagagcuccagaagaucguugacaaauuugaaagucuacugacuaaccagacucuguggagaacugagggccgccaagagaucaguuccacagccacuaccauucuccgggaugucgagagcaaggugcuggaaaccgcccugaaggauccggagcagaagguguugaaaauucagaaugauagugucgcuaucgagacucaggccauuaccgacaacuguucggaagaacgcaagacguuuaaucuuaacgugcagaugaacagcauggauauuagguguucugacauuauucaaggcgacacacagggaccaagugcgaucgcuuucauuucuuauucaagucucggaaacauaauuaacgcuacguuuuuugaggaaauggacaagaaagaucagguauaccuuaauucacaaguugugagcgcagcuaucggacccaaacgaaauguaagucugucuaagucagugacucugacuuuccagcacgucaagaugaccccaucuacaaaaaaaguguucuguguuuacuggaagucaacagggcagggcucucaauggucuagggacggguguuucuugauccacgucaacaagucucacacaauguguaauugcucccaucucucaucuuucgcaguuuuaauggcccucacaagucaagaggaggacccagugcugacagugauuacuuauguggggcuuucuguaucccuacugugucugcuccuggccgcguuaacauuucuccuuuguaaagcaauccguaacacaucuaccagccugcaucugcagcuuagucugugccuguuccucgcucacuuacucuuucuuguaggaaucgaccggaccgaacccaaggugcucugcucaaucauugcuggcgcucuccauuacuuauaucuugccgccuuuaccuggaugcuccuggagggcguccaccuguuucuaacagcucgcaaucucacaguggucaacuacucaucuauaaaucgacugaugaaguggauuauguuucccgugggcuaugguguuccagcugucacugucgccauuagcgcagccucauggccacaucucuacgggacugcagacagaugcuggcuccaccuugaccagggcuucaugugguccuuucucggcccugugugugcuauuuuuucugccaacuuagugcuuuucauccugguguuuuggauccuuaagaggaagcuguccucccucaauucagaaguuagcaccauucagaauacgcgcauguuggccuuuaaggcaaccgcucagcuuuucauucugggauguaccuggugccugggucuguugcagguuggcccggccgcucaggucauggcauaccucuuuaccaucaucaauagccugcaaggguucuucaucuuucugguuuauugucuccucagccagcagguucagaagcaguaccagaagugguuucgcgagauaguuaagagcaaauccgaaucugaaacuuauacacugagcuccaagaugggaccugauaguaagccaagugagggugauguguucccagggcagguaaaacgcaaguacuag

SEQ ID NO: 11896 - RNA, 1263 nt, Artificial Sequence
  Description of Artificial Sequence: Synthetic coding sequence
augucgcccccuccucugcugcagcccuugcuacuacuucuaccucuucucaacguugagccgucaggcgcuacacucauucgaaucccucuccaucgggugcagcccggacgucggauucugaaccuccugagaggauggcgagagccugcugaacugccgaaacugggcgcuccaucucccggggauaagccaauauucguuccgcucuccaauuauagggacgugcaguacuuuggagagauuggccucgguacucccccgcagaauuucacuguggccuuugacacaggcucguccaaucucugggucccuucacgacguugucauuuuuuuuccgugccgugcuggcuucaccacagguucgaucccaaagcauccucuucuuuccaagccaauggaacaaaguucgcuauccaguacgggaccggacguguggauggcauucucucugaagacaagcugacaauuggcggaauuaagggagcaucagugauuuucggcgaagccuugugggagcccucccucgucuuugcuuucgcucauuuugauggaauucugggguuaggguuuccaauccugagcguagaaggcguucggcccccuauggauguucuuguggaacagggauuauuagauaaaccgguauucagcuuuuacuugaaccgagauccagaggaaccggauggaggcgagcuggugcugggcggaagcgauccugcccacuacauuccccccuuaaccuucgucccgguaacaguaccugccuacuggcaaauccacauggagagagucaaggucgggccaggguugacauuaugugccaaaggcugugcugccauucucgauacagggacaucucugauuacaggcccuaccgaagaaauaagagccuugcaugccgccauuggugggauaccacuucuagcgggagaguauaucauccuauguagugaaauucccaagcuccccgcuguuucauucuuguugggaggugugugguucaaccucacugcccacgauuaugugauacaaacaacacgcaauggagugcgacugugccuaaguggauuccaggcccuggacgucccucccccugccgguccuuuuuggauccugggugacguguucuugggcacuuacguggcuguauuugaccgaggagacaugaagagcagcgcaagggucgggcuggccagagccaggaccaggggcgcggaccugggguggggugaaaccgcucaagcccaguuccccggcuag

SEQ ID NO: 11897 - RNA, 1293 nt, Artificial Sequence
  Description of Artificial Sequence: Synthetic coding sequence
auggcuuggacauucgaauguucacggaccacauccccugaacccuugaguacaucacccugucgcacaacuucgucucgcaauuccccuacgaugagcugucccgccagcguggccugugagccguccacaaguacuaccacuuccagcccucccaaauuguccgucgccccccaguuucuaccgcgaucccuucgagucgccgaucucgccgccaaccaggugauggagauuuucccccucaccuuuggagaaaagccagcacuacguagcgucuaucuacacaauaaccaacuuagcaacgccggucuaccccccgacgccuucagaggcuccgaagcaauugccacuuugagucucucaaauaaccagcugagcuacuuaccaccuucacuacccccuucacuugaacggcuucaucugcagaauaaucugauuuccaaagugccccgcggugcacucucuagacagacacagcugagagaacuauaccugcagcacaaucagcugaccgacagcgggcuggaugcaacgacuuuuucuaaguuacacagccuugaguaccuggaucuuucucacaaucagcuaacaacggugcccgccggacuuccacgcacgcuggccauucuacauuuagggagaaaccgcauccgccaggucgaagcugcccgacugcacggcgcaaggggguuacgauaucugcugcugcaacacaaucagcuggguuccuccggccuuccggcuggggcacucagaccauuacggggcuugcacacuuugcaucuuuaugggaacggucuugaucgggucccaccagcucuuccacgccgucuccgcgcccugguacugccccacaaccacgucgcggcguugggggccagagaucuuguggcaacgccaggguugacagaacugaaccuagcuuauaaccggcucgcgagugccagagugcaucacagagcauuucggaggcuucgagcccugagaucucuggacuuagcggggaaccaguugacucgauugccgaugggacuccccaccggguugcgcacccuucagcugcagagaaaucaauugcgaaugcucgagccugagccucuggccggacuugaccaacugcgcgaacugagccuugcacacaaucgguugagggugggugacauuggcccaggcacauggcacgagcuacaggcacuacaagucaggcaccgccuugugucucacaccguaccacgugccccccccucucccugccugcccugucaugugcccaacauccuggugucaugguag

SEQ ID NO: 11898 - RNA, 3162 nt, Artificial Sequence
  Description of Artificial Sequence: Synthetic coding sequence
auguggcagccaagacggcccuggccgagaguccccuggcgcugggcgcucgcucuucuugcucuuguaggcgcaggguugugccaugcagguccucagccaggcuaccccgcccggccuagcgcccgaaacaagaacuggugugccuacauaguaaauaagaauguuuccugcucugugcuugaaggcagcgaaagcuuuauucaagcacaguacaauugugcuuggaaucagaugccauguccaucggcccuggucuacagggugaauuuuagacccagguacguuaccagauacaagacaguuacacaguuggaguggcguugcugcccuggauuccgagguggagacugucaagaaggcccaaaggacccaguuaagacucuuaggccuacaccagcuagaccacguaacagucucaagaaagccacugauaacgaaccuagccaguuuuccgaaccgcggaaaacccucagcccgaccggcacugcccagccuuccuggggggucgauccuaaggaaggaccucaagaacugcaggaaaaaaagauucagguguuagaagagaagguuuuacgucuuacacgaaccguccuggaccugcaguccucacuggccggcgucucggaaaaucugaagcacgcgacgcaagaugacgcaaguaggacgcgagcacccggguugagcucccaacaccccaaaccagacacaacuguuagcggggauacagagacuggccaaucacccggcguguuuaauacgaaggaaagcgguaugaaagacauuaagucugaacuggccgaagugaaagacacucugaaaaauaagagugacaaauuagaggaguuggacggaaaaguaaagggguaugaaggccagcuccgccagcugcaagaggccgcucagggcccaacaguaacuaugacaaccaaugagcucuaccaggccuacguggacucuaagauugaugcccuuagagaggagcugauggagggcauggacagaaagcuggccgacuuaaaaaacaguugcgaauacaaacugaccggccuucagcagcaaugugaugacuaugggucauccuaccugggcgugauugaauugauuggagaaaaggagacuagcuuaaggaaagagauaaacaacuuaagagcaagacugcaggagccaucagcacaggcuaauuguugcgauuccgagaaaaacggugacauugggcagcaaauuaagacucuggaucagaagauugaacggguagcugaagcaacccggauguugaacggcagacuggauaacgaguuugacagacucaucgucccagaacccgacguagacuucgacgcgaaauggaaugaacuagacgcacggaucaacgugacagaaaagaacgccgaggaacacugcuuuuacauagaagagacauuaagaggagcuauuaacggggagguuggggaccucaagcagcuaguggaccagaaaauccagucucucgaggaccgccugggauccguucucuuacagaugaccaauaacaccggggccgagcugucuccccccggggccgcagcgcucccgggcgucagcggcagcggggacgaacgggugaugauggagcugaaucaucugaaagacaagguacagguaguggaagauauauguuuacugaacauucaaggaaaaccacaugguauggagggagcccuuccaaaucgagaggacagagcgguccgcgacagccugcaucugcugaagucauuaaacgacacuaugcaccggaaguuucaggaaacagagcagaccauccaaaaacuccaacaggacuucaguuuccuauacucgcagcucaaucauacugagaacgacgucacccacuuacagaaggagauguccaauugucgcgccggagagaaugccggcaugggaagauuuacuaaaguuggcgagcaagaaagaaccguggacacuuuaccgucaccgcagcacccuguggcccauugcugcucccaguuagaggaaagguggcaacgacuucaaucucaagugauuagcgagcuggaugcgugcaaggaguguacccagggcguucagcgggaggucagcaugguggaagggcgggucucacauauggaaaaaaccuguuccaaacuugacucuauuagcggaaaccuucaacgaaucaaggaaggauugaauaaacacgucucgucucuguggaauugcguccggcagaugaauggaacacuaaggagucacucucgggacaucuccggacuaaaaaauuccguacagcaguuuuacagucauguauuucagaucagcacagacuuacaagacuuggugaaguuccaaccuucugcuaaggccccaucuccaccuccuccggccgaagccccuaaggagccacuucagccagagccggcgcccccaagacccucaggaccugcuacugcagaggacccugguaggcgccccgugcucccucagcgcccgccagaagaaagacccccucaacccccgggcucuacugguguaaucgcugagacuggacaggcaggcccucccgccggugcaggcguaucuggucgcggccugccacgaggcguugacgggcagacaggcagcggcaccguccccggagcugagggguucgcuggcgcuccuggcuacccaaagaguccaccuguggccagcccuggagccccaguaccgucauuggugucuuucuccgcaggccuaacucagaagcccuuccccagcgacgggggagucgucuuauuuaauaaaguguugguuaacgauggcgaugucuauaacccuuccacggggguguuuaccgccccuuacgacggcagauaccuuauaacugccacccugacccccgaaagagacgccuaugucgaggccguguugucugucucaaaugccuccguggcccaguuacauaccgccgguuaccgcagggaauuucucgaguaucaccgcccuccgggagcucugcauacaugcggcgguccaggcgccuuccaucuuaucguccaucugaaggcaggugaugcuguuaacgugguggugacaggagggaagcucgcccacacugauuuugacgagauguacuccacauuuuccgggguauuccucuaccccuuucuuucacaucuauag

SEQ ID NO: 11899 - RNA, 1548 nt, Artificial Sequence
  Description of Artificial Sequence: Synthetic coding sequence
auggcccagcuuuuucucccauugcuggccgcucuugucuuagcacaggccccagcugcccuggcugacgugcuugagggcgacagcucugaggaucgcgccuucagggugaggaucgccggcgacgccccccuucaaggcguguuaggcggugcccugacgauucccugccacgugcauuaccucaggcccccaccuaguagacgugcagugcuagguucuccacgggugaaguggacguucuugagucgggggagagaggcugagguacucguggccagaggcgugcgcgugaaagugaacgaagcauaucgauuuagggucgcuuugcccgcauaucccgccagccuuacagacgucucauuggcgcuuagcgaguuacggcccaacgauucaggcaucuacaggugcgaggugcagcacggcauugaugacucauccgaugcaguugaagacagccagcucuacccaauccagacaccucgcgaagccugcuacggagacauggacggauuuccuggcguacgcaauuacggcguggucgaucccgaugauuuguacgacguguacuguuaugcugaggacuugaauggugaguuguucuuaggugacccucccgagaaacugacccuggaagaggcccgagcauauugucaggaaagaggagcugagaucgcgacaaccggacagcucuacgcggccugggaugggggucuggaucacugcaguccugguuggcucgcugauggcucaguucgauaccccaucgucacaccaagccagaggugcggcggcggucugccuggggucaagacucuguuucuguuccccaaccagacuggauuuccuaacaaacacucucgguucaauguguauugcuucaggggcuccacaugcuuacuuccaucgcugcgaccuccaacucagccuccaacucaagauggucucgaggcaauuguaacugucacagaaaccuuggaagagcugcagcugccucaggaggcaacugagagcgagaguagaggcgccaucuauaguaucccaauaauggaagacggcgggggcggcagcuccaccccugaggacccagccgaggcaccucguacauuguuggaauucgaaacccaaaguauggugccgccaacaggauuuucagaggaggaaggaaaggcacuugaagaagaggagaaauaugaggacgaggaagagaaagaggaggaagaagaagaagaagaagucgaagaugaggcucucugggccuggccaucagaacugucaagucccggccccgaggcuucacucccaacugagccugccgcccaggaggagucucugucacaggccccugcccgggcuguucuccagccuggggcgucccccuugccugauggggaguccgaagccucccguccgccgagaguucauggaccgccgacagagacccucccgaccccgcgcgaacggaauuuggcuucccccucaccaagcacacuggucgaggcacgcgaagugggggaggccacuggcgguccggagcucaguggcuag

SEQ ID NO: 11900 - RNA, 1023 nt, Artificial Sequence
  Description of Artificial Sequence: Synthetic coding sequence
augccggggugguugacucuuccaacacucugcagauuccuacugugggccuucaccauuuuccacaaggcgcagggcgacccugccucccaccccgggccucacuaucugcucccacccauacacgaggucauccacucacacaggggagcuaccgcaaccuuacccugcguucuaggaacaaccccgccuagcuacaaaguuagauggucuaaagucgaacccggagaacugcgggagacucugaucuuaauuacaaauggccuccaugcucgcggcuaugggccacucggcggaagggcccgcaugaggcgcggacacaggcuggaugcuucccuaguaauugcaggcguaagauuggaagacgagggucgguaucggugugaacugaucaaugguauugaggacgaaagcguggcucuuacucugucucuugagggcgucguauucccuuaucagccuuccagaggccgguaucaguucaacuacuaugaagccaagcaggccugcgaggaacaagauggcagacucgccacguacucccaguuguaccaggcuuggacugaaggguuagacugguguaaugcuggcuggcuccuggagggaucgguucgguaccccguacuaacugcaagggcccccugugggggucgcggaagaccuggcauuagauccuacggaccaagagauaggaugcgcgaucgguacgaugcuuucugcuucaccuccgcuuuggcugggcagguauuuuucguucccgguaggcuaacccucuccgaagcccaugcagcauguagaaggcgaggcgcagugguagccaagguaggccaccuguacgccgcauggaaguucucuggcuuggaccagugcgauggagguuggcuggcagacggguccgugcgguuccccaucacuaccccuagaccucgcugcggagggcucccugaccccggaguucgaagcuuuggguuucccaggccgcagcaggcugcauacggaaccuacugcuaugccgagaacuag

SEQ ID NO: 11901 - RNA, 690 nt, Artificial Sequence
  Description of Artificial Sequence: Synthetic coding sequence
auggaucugcugcaguuccuugcauuucuguucguucugcugcucucugguaugggcgcgacaggcacacugcggacgagucuggaccccagccuggaaauuuauaaaaaaauguuugagguuaaaagacgugagcagcuccuggcuuugaaaaacuuggcccagcugaacgauauccaccaacaguacaaaauuuuggacguuaugcugaagggccuauuuaaaguucuagaagauaguagaaccguccucaccgcagccgauguccucccugauggccccuucccacaagaugagaaacugaaagacgccuuuucacaugucgucgaaaauacagccuucuuuggggaugucguucuccgcuucccgagaauagugcauuauuauuucgaccauaacaguaacuggaaccugcuuauucgguggggcaucagcuucugcaaccagaccggcguguucaaccaaggcccccauucacccauucuuagucugauggcucaggagcuggggauaagcgaaaaggacuccaacuuccagaacccguuuaaaauagaccgcacugaauucaucccaucaacagaccccuuucaaaaggccuugagagaagaggagaaaagaagaaagaaggaggagaagcguaaagagaucaggaagggaccccguaucucccgaucccaaucggaacuauag

SEQ ID NO: 11902 - RNA, 465 nt, Artificial Sequence
  Description of Artificial Sequence: Synthetic coding sequence
augucuguggguacaucacuugaacaggcucagaugucuacauugaccugcccacuguucauuccgacgguuggccgcaaaacagccuuacauuccggugaagauuuccaaacucuacucuucgaacggguuuuuguuaaccucgacggauguuucgacauggccaccggacaguucgccgcuccauuaaggggcaucuauuuuuuuucucucaauguacacucauggaacuauaaggaaaccuauguacacaucaugcauaaccagaaagaagcugugauuuuguacgcccagcccucagaacggaguaucaugcagagccaaucugugaugcucgaucuggcuuacggggacagaguuugggugagguuauuuaagcgucagcgcgagaacgcaauauauuccaaugauuucgauacauacaucacuuucucuggccaucugaucaaggcugaagacgacuag

SEQ ID NO: 11903 - RNA, 900 nt, Artificial Sequence
  Description of Artificial Sequence: Synthetic coding sequence
augaggucagugggggaaggugcuagggaauggaucagagaaugccaacaucaguuucgacaucauagguggaauugcaccacucuggaccgggaucacaccgucuucgggcgcgucaugcugagguccagucgcgaggccgcauuuguauacgcuaucuccagcgcaggcguaguucacgcgauuacacgcgcuugcagccagggagagcuuucaguauguucaugcgaccccuacacacgcggucggcaucaugaucagaggggggacuucgacuggggagggugcuccgauaauauucauuacggcgugagauuugccaaagcauucguugacgccaaagagaagcggcucaaagacgccagggcccugaugaaccuucauaacaauagauguggccgcaccgccguccgccguuuucugaagcucgaauguaagugucauggggugucaggcuccuguacucugaggaccuguuggcgggcuuuaucggauuuccgccgaaccggagauuacuugaggcguagauacgauggggcgguacaggucauggccacccaagacggugcgaacuucacagcugcuaggcaagguuaucgccgcgcaacacggacagaccuggucuauuucgacaacucucccgauuauugugugcuggacaaagcagccgggucacuaggcaccgccggaagaguuuguagcaaaacgucaaagggaaccgaugggugcgagaucaugugcugcgguagaggcuacgacacuacucggguaaccagggucacucagugugagugcaaguuccacuggugcugugccgucagguguaaagaauguaggaacacaguggacgugcauaccuguaaagcuccuaagaaggccgaauggcucgaccagaccuag

SEQ ID NO: 11904 - RNA, 1710 nt, Artificial Sequence
  Description of Artificial Sequence: Synthetic coding sequence
augcuucuccucuucagcgucauuuugauuucuuggguuucuaccguuggcggugaaggaacacuuugcgauuuccccaagauucaccacggguuucucuacgacgaggaagauuauaacccauuuagccaggugcccaccggcgagguguuuuauuacagcugugaauauaacuucguuucaccauccaagucuuuuuggaccaggauaacaugcacagaggaggguuggucuccuaccccuaaaugucugagaauguguucuuuuccuuucgugaaaaauggccauagcgaaucuagcgggcucauccaucuugagggggauacuguucagauuauuuguaauacaggguauucucugcagaacaacgaaaagaacauuuccugcguagagagaggcugguccacaccaccgaucugcaguuucaccaagggggagugucacgugcccauccuggaagccaacguggacgcgcagccaaagaaggagucguauaaggugggugacgugcuuaaauuuagcuguaggaagaaucuuauucgcguggggucagacucaguccaauguuaucaguucggauggucuccaaacuuuccuacauguaagggucaggugcggucaugcggacccccaccccaacugaguaauggggaagugaaggaaauuagaaaagaggaauacggccacaacgaggugguagaauaugacugcaaccccaacuucaucauuaacggccccaagaagauacagugcguugacggcgaguggacaacauugccgacuugcguagagcaggugaaaacaugcggcuauauucccgaacuugaauacgguuacguccagccauccguaccccccuaccagcacggugugucuguggaagucaauugcaggaacgaauaugccaugaucggaaauaacaugaucacauguaucaacgggaucuggacagaguuaccuauguguguagccacacaccaauuaaagagguguaaaauugcuggugugaauaucaaaacucuuuugaagcuuucgggcaaggaguuuaaccauaauucuaggauccgguaccguugcucugacaucuuucgguaucggcauucggucugcaucaaugguaaauggaacccugaagucgauugcacagaaaagagagagcaguuuuguccgccacccccacagauaccaaaugcccaaaacaugaccaccacggucaacuaucaggacggggaaaaaguagcuguuuuguguaaagaaaacuaucuccugcccgaggcgaaagagaucguguguaaagauggacgcuggcagucccuuccucguugcguggaaagcaccgcuuauugcgggcccccuccguccaucaacaacggcgacacgaccucauuuccgcugagcguguacccuccgggcucaacagugaccuacaggugucaauccuuuuacaaacuccaagggucugugaccgugaccugucgaaauaagcaaugguccgaacccccccgaugucuugaucccugcguagugucugaggagaacaugaacaaaaacaauauccaguugaaguggagaaaugacggcaaacuguacgcaaagacaggagaugcagucgaguuucaauguaaguucccgcauaaggccaugaucucuuccccccccuuucgugcuauaugccaagaggguaaguuugaauauccuaucugcgaguag

SEQ ID NO: 11905 - RNA, 351 nt, Artificial Sequence
  Description of Artificial Sequence: Synthetic coding sequence
augaaggguuuaaggucacuugccgcaacaacccuggcccuguuccuggucuucguguuccuaggaaauaguucaugugccccacagaggcuccuggagagacggaauuggaccccacaggcuaugcucuaccuaaagggagcucagggaagacgauuuaucuccgaccaguccaggagaaaagaccugagcgacaggccacuacccgaacguaggucaccgaauccccaauugcugacaauccccgaagccgccaccauucuucuggccucauugcaaaagucccccgaagaugaggaaaagaacuuugaucaaacccgcuuucuugaggacagccuuuuaaauugguag

SEQ ID NO: 11906 - RNA, 192 nt, Artificial Sequence
  Description of Artificial Sequence: Synthetic coding sequence
augaagcauguguugaaccuguaccugcuuggagucgugcugaccuuguuaaguauuuuugucagagugauggagucucuugaggggcugcucgaauccccaucucccggcacuaguuggacuaccagaucacaacucgcaaacacugaaccaacaaaaggcuuaccugaucauccuucacgguccauguag

SEQ ID NO: 11907 - RNA, 567 nt, Artificial Sequence
  Description of Artificial Sequence: Synthetic coding sequence
auggugccuggcgcagccgguugguguugucuugugcucuggcugcccgccugcgucgccgcccacggcuuucgaauacacgauuacuuguauuuucaggugcuguccccuggggacauucgcuauaucuuuacugcuacuccggccaaagacuucgguggaauauuccacacucgcuaugaacagauucacuuaguuccagccgaaccuccagaggcuuguggggagcugagcaacggauucuuuauucaagaccagauagcucuugucgaaaggggggguuguagcuuucuuuccaaaacuaggguggugcaggaacauggaggacgcgcagucaucaucucagacaaugcagucgacaaugacaguuucuacguggagaugauacaagacagcacacagcggaccgcugauauuccugcucuguuucuccuggggcgcgacggauacaugauaagaaggucacucgagcagcacggccuccccugggcaauuauuucgaucccugugaauguaaccucaauuccaaccuucgaauugcugcaaccacccuggacauucugguag

SEQ ID NO: 11908 - RNA, 2559 nt, Artificial Sequence
  Description of Artificial Sequence: Synthetic coding sequence
augaagccuauguugaaggauuuuaguaaccuguugcucguggugcugugcgauuacguguugggagaggcggaauaucuccugcugcgcgagccaggucacgucgcucucaguaaugauacuguguauguagacuuucaguacuuugauggcgcaaauggaacgcucagaaaugucagcguccugcuccuugaagccaacacuaaucagaccguuacaacuaaauaccugcucaccaaucagucccagggaacccucaaauucgagugcuuuuauuuuaaggaggccggagacuacugguucaccaugacuccugaggcuacugauaacuccacaccuuuuccauggugggagaagucugcauuccugaagguugaauggccgguuuuccauguggaucucaauaggagcgcuaaggcugccgaagguacauuccaagucggauuauucacuagucaaccccuaugccccuucccuguagacaagcccaacauuguaguagaugugauuuucacuaauucucucccugaggcacgcagaaauucacgucagccuuuagagauccgaacaucuaagcgcacagagcuugcgcagggccagugggucgaguucggaugugcuccucugggccccgaagccuacgugacaguuguuuugaagcuccuuggcagagacagcgugaucaccaguacaggaccgaucgacuuggcucagaaguucggauauaaguuggugauggugccagagcucacaugcgaaagcgggguugaggugacuguuuuacccccaccuugcacguucguucaaggcgucgugacuguuuuuaaggaggcaccaagauacccagggaagagaacuauccaccuggccgagaacucccugccucucggugagcggcgcacaauuuuuaauugcacguuguucgacauggggaaaaacaaauacuguuuugacuuuggcauuagcucaaggagccacuuuuccgcgaaggaggaauguauguuaauucagaggaacaccgagacuuggggccuguggcagccuuggagucagugcagcgccaccugcggcgacggaguaagagagcggagaagggugugucugaccuccuuuccgagcucucccgucugucccggcauguccuuggaggcuagccuuugcagccuggaagaaugcgccgcauuccaacccucgagcccauccccccuccaaccucagggcccagucaaguccaauaauauuguaacuguuacaggaauuagucuuugccuguuuaucaucauagccaccguacucauuacacuguggcgcagguuuggacgccccgcgaagugcaguacccccgcacgacacaacagcauccacuccccaucuuucaggaagaauagugacgaggagaauauaugcgagcucuccgaacagagagggagcuuuucagauggcggcgaugguccuaccggaucucccggggacaccggcaucccgcucaccuauaggagaagcgguccuguuccacccgaagaugacgcaucugguuccgaaucuuuucagucaaaugcccagaagaucaucccaccacuguucuccuacagacuggcccagcagcaguugaaagagaugaagaagaaaggucuaacugagacgaccaagguuuaucacguaucccagucgccuuuaacagauaccgccauugacgcagcuccuagcgccccacucgaccuggagucacccgaggaagcugcagccaauaaguuuagaauaaaaucccccuuucccgagcagcccgcugucucugccggugaaagacccccgucuagacuugauuugaaugugacacaggccuccugugcgauaagccccagccagacccugauccgcaaaucucaggcucgucacgugggcucccgagggggccccagugaacgcucacaugccaggaacgcacauuuucgacgaacagccuccuuccaugaggcuagacaggcaaggccauuuagggagaggucaauguccacacugaccccacgccaggcacccgccuauagcagcagaacuagaacuugugagcaggccgaggauagauucagaccccagucuaggggcgcccaccuuuuucccgagaagcuugagcauuuccaagaggccaguggcacacgugguccucucaauccucugccuaagucauacacucucggccagccacugcgaaaaccagaccucggggaccaccaggcuggccuugucgccggaauugaaaggaccgagccccaucgggcccgcagagguccuucuccgagccauaagagcguauccagaaagcagucgucaccaauuucccccaaagacaacuaucaacgcguguccucccuuuccccaucccagugccgcaaggacaagugccagucuuuuccaacacacccugaguucgcguuuuacgauaauacgucuuuuggguuaacugaggcagaacagcgcaugcucgaucuaccugguuacuucggguccaacgaagaggacgagaccacuucuacucuaaguguugagaagcucguuaucuag

SEQ ID NO: 11909 - RNA, 369 nt, Artificial Sequence
  Description of Artificial Sequence: Synthetic coding sequence
augggauuucacuuuuguaucuggauuauuuuucugcuuccuccaccuugcaagaaaugccucagucccccaaccaugaaucuccgcccuccaaaaucuugcggaaauguguucuauugggugcuugucuugaacucaggccuucuguacaaauucugucaaaccauaaaaugccgagcaaacuggcgcccagcccgggccccacgagguuggaacgaggcaacagaacgccaucaggagcguaggacucagauggagaccgaaauggguggcaucucgaccacguacuggcauaggcuaugcacuuguacagaucgaagggccgaaaaacugguaauggacgggaauaacugcugguuucacaaauag

SEQ ID NO: 11910 - RNA, 978 nt, Artificial Sequence
  Description of Artificial Sequence: Synthetic coding sequence
augcaagggcgaguugccgggucuugugcuccgcugggucuucuguugguguguuugcacuugcccggacucuucgcuaggucuaucggggugguggaagagaaggugucucagaaucuaggcaccaaucugccucaguuaggucagccuuccucaacaggcccaucaaauucagaacacccacaacccgcccuggacccacgcuccaacgaucuggcccgggugccacucaaacucagugugccugcgucugacggguuucccccagcaggaggcuccgccguacagcgcuggccacccaguuggggccugccagcgauggacucuuggccgcccgaagaucccuggcaaaugauggccgccgcggcugaggauagacucggggaagcucugccggaggaguuaucguaucugagcucagccgccgcucuugccccaggaucuggcccccuccccggagaauccucaccugacgccaccggacugucuccaaaggcuagucuucuucaccaggauucugaaagcagacggcuuccucguucaaacagcuuaggugccggcgguaaaauucugucucagcgcccacccuggucccugauucauagagugcuccccgaucaccccuggggcacauuaaauccaagugugaguuggggaggcggcgggccagggacagguuggggcacaaggccgaugccucacccugaagggauuuggggaaucaacaaccagccaccugguaccucaugggggaacaucaacagauauccuggcggguccuggggaaacaucaacagguacccaggggguuccuggggcaauauuaaucgauauccaggcggaagcugggguaacauacaccucuauccuggcaucaacaacccguucccuccuggcguccugcguccaccagggucuucuuggaauauuccugccggcuucccaaacccacccucaccuagauugcaguggggcuag

SEQ ID NO: 11911 - RNA, 2631 nt, Artificial Sequence
  Description of Artificial Sequence: Synthetic coding sequence
augggcccggaagccuugucaucucucuuacuguuacugcuaguggcgucaggggaugcagauaugaagggccauuucgauccagcuaaauguagguacgcacuaggaaugcaggaccgaacuaucccagacucugauauuuccgcauccaguucuugguccgacucuaccgccgcccgucacagccggcuugagaguagcgacggcgacggagccuggugcccggccggcucggucuuucccaaagaggaggaauauuugcaggucgaccuccagagauugcaccucgucgcccuuguggguacucagggccggcaugcgggaggauugggcaaggaguuuucucgaagcuaccgcuugagguacagucgcgauggcaggagguggaugggauggaaagaccgguggggucaagaggucauuucaggaaacgaggaucccgaaggggugguccuuaaagaccugggcccuccaaugguagcacggcucguucgauuuuacccaagagccgacagagugaugucuguaugcuugagagucgaauuauacgggugccuguggcgagacggucuccugucauacaccgcuccugugggucagacaauguaccuuagcgaggccguguaucugaaugauaguaccuacgauggacacacaguggguggccugcaguaugguggccuggggcaauuggcugacggugugguaggccuagaugauuuccgaaagucccaggagcugagaguuuggcccggauacgacuaugugggcuggucgaaccauucauucuccucaggguauguagagauggaguuugaguuugauagacuccgagcauuucaagccaugcagguccacuguaauaacaugcacacgcugggggcucgccuuccaggagggguggaaugucgauucagacggggcccagccauggcuugggaaggagaaccuaugaggcacaaucugggcggaaaccugggugauccaagagcacgugcagucuccguaccucugggcgguagggucgcuagguuccugcaguguagguuccuguuugcaggccccugguuacucuucucagaaaucucuuuuaucagcgauguggucaacaacuccaguccagcccuaggcggcacuuucccccccgcacccugguggccuccaggccccccccccacuaauuuuucaagccuggagcuggaaccccgaggccagcaacccguggcuaaggcggaaggaucaccaacugccauacuuaucggaugucugguugcuaucauucugcuccugcuguugauaauugcucugaugcuauggcggcuccauuggcgucgccugcuuuccaaagccgagaggcggguccucgaagaagaguuaacagugcaucucucagucccuggugacacgauucugaucaauaaccgcccugggccucgcgaaccaccccccuaccaggaacccagaccaagagguaauccgccccacagugcccccuguguacccaaugguagcgccuacuccggagacuauauggaacccgagaagccaggcgcuccucugcuacccccaccgccacagaacagcgugccccauuacgccgaggcugauauugucacccugcagggcguuacuggcggcaauacauaugcaguacccgcccuaccaccgggcgccguuggagacggacccccucggguggauuuuccccguucaagacuucgcuuuaaggagaagcugggggagggacaguuuggcgaagugcacuuaugcgagguggauucuccgcaggauuuaguuucccuggacuucccucuuaauguuagaaagggccacccccugcuaguugccgucaagauucugagacccgacgcuaccaaaaaugcucggaacgacuuucugaaggaggugaaaaucaugagcagacuaaaagaccccaacauaauaaggcuguugggggucugcguccaggacgacccacugugcaugaucaccgacuacauggaaaauggagauuugaaccaauuucuuagcgcccaucagcuugaggauaaggcugcggaaggagccccuggagauggacaggcggcccagggaccgacuaucucuuaccccaugcugcugcacguggcugcacaaauugcuagcgguaugagguaccuggccacccugaauuuuguccacagagaucuugccacaaggaacugcuuggucggggaaaauuuuaccaucaagauugcugacuucggcaugagcagaaacuuguacgcaggggacuacuaucguguucaaggcagggccguucugccuaucagauggauggcgugggaaugcauuuugaugggaaaguucaccacagcuuccgacgucugggccuucggagugaccuugugggaagugcugaugcuaugccgggcacagccauucggacaacugacagacgaacaggugaucgaaaaugccggggaauucuucagggaccagggcaggcaggucuauuugucgcggcccccagcgugcccccaggggcucuaugagcuuaugcuacggugcuggucccgggagagcgaacagcgaccgccuuuuagccagcuucaccguuuccuugccgaggacgcauuaaauacaguuuag

SEQ ID NO: 11912 - RNA, 672 nt, Artificial Sequence
  Description of Artificial Sequence: Synthetic coding sequence
augaaauucgucccuugccuccuccuagucacacuuucuugcuuaggaacguugggacaggcaccacgccagaaacaggguuccacaggugaggaauuccacuuucagaccggggggcgagacucuuguacuaugagacccuccaguuuggggcagggagcgggcgagguguggcugcgaguagacuguagaaacacagaccagacauauuggugugaguaccguggacagcccucuaugugccaggcauuugccgcggacccuaagccauauuggaaccaggcgcugcaggagcugaggcgucuccaccaugcaugccaaggggccccaguguugaggcccucaguuugucgcgaggccgggccucaagcccauaugcagcaagucacaagcucucugaaagggagcccagagccuaaccagcagccugaggccgguacgccuucucuucggccaaaagcgacgguaaaacugacagaagccacacagcugggaaaagacucuauggaagaacuaggcaaagcaaaaccaaccacgagacccaccgcaaagccaacacagcccgguccccguccaggcgggaacgaagaagcuaaaaagaaagcgugggaacacugcuggaagccguuccaagcccucugcgcuuuucugaucuccuuuuuuaggggcuag

SEQ ID NO: 11913 - RNA, 585 nt, Artificial Sequence
  Description of Artificial Sequence: Synthetic coding sequence
augaccaugcgacacaacuggacccccgaccuuuccccccuauggguccugcuguugugugcacauguugucacccuacucgugcgagcuacccccgugucccaaacaacgacugccgccacugccagcguacguuccacgaaagaucccugucccucucagccucccguuuucccggccgcuaaacaaugcccagcucucgaggugacauggccugaggucgaagucccgcugaacggcacucuuagucuuucuuguguggcgugcucuagauucccgaauuuuucaauucuuuacuggcuggggaauggaucauucaucgaacaccugccugggagacugugggagggcagcacaucccgggagaggggcuccacuggaacacagcuguguaaggcccuaguccuggaacaacugaccccagcgcuacacaguacuaacuuuuccuguguccuugucgauccugaacaaguggugcaaagacacgucguauuagcacaguuaugggccggauugcgugcuacccucccgccgacccaagaggcacucccaucuagccauucuaguccucagcagcaaggcuag

SEQ ID NO: 11914 - RNA, 777 nt, Artificial Sequence
  Description of Artificial Sequence: Synthetic coding sequence
augaucgccauauccgcuguaagcagcgcucuccucuucucauuacugugugaagccaguacuguuguucuucucaauuccacagacuccucaccccccaccaauaauuucacagauaucgaggccgcacugaaggcacagcuagacucugccgauauaccuaaagcuagacggaagagguacauuagucaaaacgacaugaucgccauccuggacuaucacaaccaagugagaggaaagguguucccccccgcugcaaauauggaauacauggucugggaugaaaaccuugcgaaguccgccgaggccugggcagccacaugcauuugggaucacggcccgucauauuuauuaagguuccuuggccagaaucugagcguaagaacaggacgguaucgcagcauuuuacaacugguaaaacccugguacgacgaggucaaagacuacgccuuccccuacccacaggauuguaauccccgcuguccaaugcgaugcuucggaccaauguguacucauuacacucagauggugugggcuaccuccaaucggaucggcugcgcuauucauaccugucagaauaugaauguuuggggcagcguauggcggagggcugucuaucucgucugcaacuacgcaccaaagggcaacuggaucggagaggcaccauauaaagucggugugccaugcaguucgugcccgccaucuuacggugguaguuguacggauaacuuguguuucccuggagucacuucuaauuauuuguacugguucaaguag

SEQ ID NO: 11915 - RNA, 906 nt, Artificial Sequence
  Description of Artificial Sequence: Synthetic coding sequence
augcuuccucuaaccaugacaguccugauccuucucuugcucccuacugggcaggcagccccaaaagauggagugacccggcccgauagugagguucagcaucagcuucuucccaauccuuuccagccaggucaagaacagcuugggcugcugcagagcuaccugaagggcuuaggacguaccgaaguacagcuggagcaucucucaagggagcagguccuccuguaucuguuugcuuugcacgauuacgaucaaucagggcagcucgacggucucgaacuuuugagcaugcugacagccgcguuggcccccggagccgccaauagucccacaacuaauccagucauucucauuguggacaagguuuuggagacucaggacuugaauggagacggacuuaugacuccagcggaacugauuaauuuccccggugucgcccugaggcauguggaacccggagagccucuggccccaucuccacaggagccccaagcugucggaaggcaaucauugcuggccaagucaccucugcggcaagaaacccaggaggcccccggaccgagggaggaagcaaagggccagguggaagcacggagagaaaguuuagaccccguacaggagccuggcggucaagcagaggcggauggcgauguuccaggcccaagaggagaagcugaaggccaagcagaggcuaaaggcgaugcccccgggccucgaggggaagccggcggccaggcugaggcagaaggcgaugcaccagggccccgcggcgaagcuggaggucaagcugaagcccgcgaaaacggggaggaggccaaggaguugccgggagaaacgcuggaguccaaaaacacacaaaaugauuuugaaguacacauugugcaagucgaaaacgacgagauuuag

SEQ ID NO: 11916 - RNA, 969 nt, Artificial Sequence
  Description of Artificial Sequence: Synthetic coding sequence
augaagacccuagcuggacucguguugggcuugguuauauucgacgccgccgugacagcgcccacccucgagucuauuaacuacgacagugagaccuacgaugcuacucuagaggacuuggacaaccuguauaacuaugagaacaucccuguggacaaagucgagaucgaaauagccacagugaugccguccggcaaucgcgagcugcugacaccaccuccacagccagagaaagcucaagaggaagaggaagaagaagaauccacgccgcgcuugauugacggcagcagcccccaagagcccgaauuuacaggcgugcucggcccucacacaaacgaagacuuccccaccugucugcuguguaccuguauaucuacaacuguguacugugaugaucaugaacucgacgccauuccucccuugcccaaaaauacugccuacuuuuacagucgguucaaccgaaucaagaagauaaauaaaaacgacuuugcauccuuaagcgaucucaagaggaucgaccugaccuccaaccugaucucagaaauugaugaggaugccuucaggaaacucccacaacugcgcgaauuaguacuccgggauaauaaaaucaggcaauuaccagaacugcccaccacccugacauucauugauauuuccaauaaucgcuugggcagaaagggcaucaagcaggaagccuucaaagacauguacgaccuucaccaccuuuaccugacugacaauaaccuggaucauaucccacugccccugcccgaaaaccuccgggcacuccaccugcagaacaacaacauacuugaaaugcaugaggauacuuucugcaaugucaagaaucugacuuacauucguaaggcacuggaagauauccgccucgauggcaacccuauaaaccucuccaaaaccccucaagccuauaugugucucccucgccuucccguuggaucauuagucuag

SEQ ID NO: 11917 - RNA, 618 nt, Artificial Sequence
  Description of Artificial Sequence: Synthetic coding sequence
augguuaaucuggccgcuaugguguggcgccggcuacugaggaaacgguggguguuggcucucguuuuuggcuugucuuugguauacuuccucucuucgacauuuaaacaggaagagcgcgcugugcgggaccggaaccuucuacaagugcacgaccauaaccagccaaucccauggaaaguucaauuuaaccugggaaacuccagcagaccaaguaaucaauguaggaauuccauucaagggaaacacuuaauuacugacgagcugggcuaugucugugagcgcaaagauuugcucgugaacggcuguuguaacguuaacguuccgucgaccaaacaauacugcugugacggcuguuggccaaauggaugcugcuccgccuacgaguacugugucaguuguugcuuacaaccuaacaagcagcuucuacuagaaagguuccugaacagagcagcugucgccuuucagaacuuguucauggccguggaggaccacuuugaacucugccuugcuaaaugucggacgucuagucaaucuguccagcaugagaauacuuacagagacccuaucgcaaaguacuguuacggugagucaccccccgagcuguucccugcguag

SEQ ID NO: 11918 - RNA, 3057 nt, Artificial Sequence
  Description of Artificial Sequence: Synthetic coding sequence
auggugagccauuucaugggcucuuuauccgucuuaugcuuucuccuauuacuuggauuucaguucgucuguccucagcccucuacacaacaucggaagguuccccagcggauggcugcugagggggcaccggaagaugacggcgggggcggugccccagguguguggggggcuugggguccuuggucggccuguaguaggaguuguucagggggaguuauggagcagacuagacccugucugcccagauccuaucgccugaggggcggacaacgaccuggagcgccugcucgcgccuuugcagaucauguggugagcgcaguucgcaccuccgugccccugcaccguucacgugaugagacaccagcacuggcaggcaccgacgccucuagacaaggaccaaccguacugaggggcucccggcauccucagccccaggggcuagaagugaccggugaucgucgaucccggacccgaggaaccauuggcccagguaaguacggcuacggaaaggcuccuuauauacucccccugcagaccgacacagcccacacaccacagaggcuccgucgucaaaagcucuccucacgacauagucggagucagggagcaucaucugcccggcacggauauucaagcccagcacaucagguaccccagcacggaccccucuaucaguccgacagugguccuagaucuggacugcaggcggcggaagcccccauuuaucagcugccgcuaacacacgaucaaggguacccagccgcuagcucccuguuccacucaccugagaccucaaauaaccacgggguaggaacccauggugccacucagucuuucucccaaccugcucgcucuacagcuauuuccuguaucggagccuaucggcaauacaaacucugcaacaccaacgucugccccgaaagcagccgaucaauccgcgaagugcagugugccaguuacaauaauaaaccguucaugggccgauucuacgagugggagccauuugccgaggugaagggcaacagaaagugcgaacugaauugccaggccauggguuaucgauucuaugucagacaggccgaaaaaguuauugacggcacucccugcgaccagaacggcacggccaucugcgugucaggucaguguaagucaauuggcugugaugacuaucuugguucugauaaggugguggacaaaugugggguauguggaggagacaauacugguugucaggucguguccggcguauucaaacaugcccuaacaucacucggcuaccacaggguuguggagauccccgagggcgcuaccaaaauaaacaucacagaaauguauaagucaaauaacuaccucgcccugaggagucggagcggcaggucuauaaucaacggcaauugggcgauugaccggccggggaaguaugaaggcgggggcaccauguuuacuuauaagcgaccgaaugagaucucuagcacagcgggcgaaucuuucuuggcugaggguccuacaaacgagauucucgacguguauaugauucaucagcagccuaauccaggaguucacuacgaauacguuaucauggggacuaacgccauuuccccccagguaccuccccacagacguccaggugagccuuuuaacggccaaauggugaccgaggggcggucacaggaagagggcgagcagaaaggaaggaaugaagagaaggaggaccugcguggggaagcuccugagauguuuaccuccgaauccgcgcagacuuuuccagugcgucacccagaccgcuuuucaccacaccgucccgauaauuuagucccgcccgcgccucagccgccacgacguucaagagaccauaauuggaaacaauugggaacuaccgaguguucuaccacgugcgguaaaggaucacaguauccuauuuuuagaugcguccaucgaucuacucaugaggaggccccggaaucuuacugugacucuaguaugaagccgacacccgaggaagagcccugcaacaucuuucccugucccgccuuuugggauaucggcgaauggucagagugcuccaagaccuguggucucgggaugcagcaccggcagguacugugccggcaaguuuacgcgaaucggucauuaaccgugcagcccuauagaugucagcacuuagaaaagcccgaaacuacaaguaccugccagcucaagauuugcucugaguggcagauccgcacagacuggaccucguguuccgugccuuguggcgugggucaacgaacucgggaugugaaguguguuuccaauauuggggacguugucgacgaugaggaaugcaacaugaaacuccgcccuaaugacauugaaaacugugauaugggucccugcgcuaaaagcugguuuuugaccgaauggagcgagcggugcuccgcugaaugcggugcuggggugaggaccagaucuguaguuugcaugaccaaucaugucucuucacuaccuuuggagggaugcgggaacaaccguccugcagaggccaccccaugugauaauggcccuuguaccgguaagguugagugguuugccggcuccuggucccagugcagcauugaguguggcuccggcacacagcagagagaagucaucuguguuagaaaaaacgccgauacuuuugaagucuuggacccaucugaauguucauuucucgagaaacccccaagucaacaguccugccacuuaaagcccugcggagcaaagugguuuucuaccgaguggaguauguguuccaaaucuugucaggguggauuucggguucgcgagguccgcugucugagugaugauaugacccucuccaacuuaugugacccccagcucaaacccgaagagcgcgaaucuuguaauccacaggauuguguaccugaggucgacgagaauuguaaagauaaguacuacaacuguaaugucguuguccaggcucgccuguguguuuauaacuacuacaagaccgcuugcugcgcuucauguaccagagucgcaaaucgacagacaggcuuuuuaggcagcagguag

SEQ ID NO: 11919 - RNA, 1503 nt, Artificial Sequence
  Description of Artificial Sequence: Synthetic coding sequence
augaagugcacggcgagagagugguugcgagugaccacagugcuguuuauggcccgcgcuauucccgccauggugguaccgaacgccacccuacucgaaaaguuguuggagaaauacauggaugaagauggcgagugguggaucgcaaaacagcgcggaaaaagggcuauuacggacaacgacaugcaguccauacuagaccuacacaauaagcuaaggucgcagguguauccuaccgcauccaauauggaguauaugacaugggacguggaacuagaaaggagcgcagaaaguugggcugaaucaugccucugggagcacgggccugccucacuguuaccuucuaucggccaaaaccuuggggcucauuggggccguuauagaccuccaaccuuucauguccaaagcugguaugaugaggugaaggauuucucuuacccauacgaacaugaaugcaacccuuacugcccuuuccgcugcuccgguccuguauguacccauuauacacaggucgucugggccaccucuaacagaauaggcugcgccaucaaccugugucacaacaugaauauuuggggccagaucuggccgaaggccguguaccucgugugcaauuacucacccaagggcaauugguggggccacgcuccuuacaaacacggacgcccuuguuccgccuguccgccuucauucggcgguggaugucgcgagaaucucugcuacaaggagggcuccgacagauauuacccaccaagggaagaagaaacaaaugagauagaacggcagcagagccaggugcacgacacccauguuaggacacgcucagacgacaguucaaggaaugaggugaucucggcccagcagaugucucagaucguaaguugcgaggugcgacuucgggaucaguguaaaggcacuacaugcaaccguuaugaaugcccagcaggcugcuuagauucaaaggcuaaggugauaggaagugugcacuaugagaugcaguccaguauuugccgggcagccauccacuauggcauuauugacaacgacgguggcuggguagacauuacucgucaggggaggaaacauuauuucaucaagucaaacagaaaugggauucaaacuauagguaaguaucagucagccaauagcuuuaccgugaguaaggucacagugcaggccguuacaugcgagacaacaguugaacaacuuugcccauuccauaagccggccucccacugcccuagaguguauugcccacgaaacugcaugcaagcuaauccucauuaugcucgcguaauagggacuagggucuacucggaccucaguaguaucugucgcgccgcgguccacgcuggcgucguuagaaaccacgggggauacguugaugucaugccaguggacaagcggaagacuuacauugccucauuucaaaacgggaucuucagcgagucauugcaaaacccaccagguggaaaggcuuuucggguguucgccguaguguag

SEQ ID NO: 11920 - RNA, 2070 nt, Artificial Sequence
  Description of Artificial Sequence: Synthetic coding sequence
augaaauucggcgcugugacccguauuggcggcccaccgcucggcaaccaaagcccguccucgugcucacuauugcacgaaaaggauccacccacaaccucuggaccccagacagaucaaccuaaaaagcaccugacaaacuuuaagagugcgacucggcgggucgcgcgcacucaguggcuaacagcagaccgacagacaugggccaguauuagcagcguaccuugggcccaaacaaucagcgaaaagaagccgggcggaucacugugggagaccagauccucaccaccuaccacggccgguacugaggaagcuaugaauacaaccagccuucuggcaccugcagcugagauaauggccaccccaggcagcccuagccaagccucaccgacccugggggccuucacccauggcacacagacuccuaguccuacaaaggcuacagcuccccgguacccucagaccggcgaccucucagcagaguggccuuucacugccggcgaggagcccguccugguccccagaccacaucaaguaagccgcguuaggagcagcuguugccucagccccauccugugcagccccgccaugauugcauuccuccugacgaguguucugaugauaccacaugccgggggccacccgcucgauacuccacacuugccucaagaacugccuccagggcugccuaauaauauuaacaucaccuucuucucuggaauguucaagaacguugagagcgucgcagaaaucuuugacugccugggcccucacuucacgugguugcaggccguguuuaccaauuuucccgugcugauucaauuugugaacgggaugaaguguguugcugggcuuugucccagagauuucgaggauuacggguguacuuguagguucgaaauggagggccuuccuguggacgaauccgacuccugcugcuuccagcaccgucgcugcuaugaggaggcagccgaaauggauugucugcaagacccggccaaauuaagcacugaaguuaacugcgugucuaagaagauuauaugugaaaguaaagacaacugcgagcauuuguuguguacgugcgauaaagccgcgauugaguguuuagcccguagcucccugaacagcucuuugaauuugcuggacaccagcuucuguuuagcgcagacaccugaaaccaccaucaaagaggaccucacaacacuguugccccguguuguaccaguugaaccuaccgacacaagucuaaccgcucucuccggcgagguugcugcugaaacggaagccgaccgcuugaucacccugagcaaaaaaaaggccggccaugaucaggaaggcguuggagcagcccgcgccacgagucccccggguuccgccgagaucguagcuacccgagucacagccaagauagugaccuuagucccagccggcauuaagagccucggacuggcugucagcuccguggagaacgauccagaagaaacuaccgagaaagccugcgaucgguuuacuuuucuccaucugggaucaggagauaacaugcagguaaugccccaguugggcgagaugcuuuuuugccugacuucgcggugcccugaggaguuugaguccuauggcuguuacuguggacaggaagggaggggagagccgagagacgaucuugaccguuguugucugucgcaucauuguugucuggaacaaguucgacgucuuggaugcuugcuugagcgccugccauggucucccguaguguguguagaucauaccccgaaaugcgguggucaaucguugugcgaaaaacuguugugugccugugaccagacugcagccgaguguaugacuuccgccagcuuuaaucagaguuugaaaucgccuagucgacugggguguccaggccagcccgcggcgugugaagacucucuccauccaguaccagccgcucccacucuuggcagcucaagcgaagaagacagcgaagaagacccuccccaagaggaccugggacgagcaaaacgcuuucugaggaaaucccuuggaccacuuggcauuggcccacugcacgguagguag

SEQ ID NO: 11921 - RNA, 1359 nt, Artificial Sequence
  Description of Artificial Sequence: Synthetic coding sequence
auggaauuggcauugagacgaagcccugugcccagauggcuacugcugcugccccugcuucugggacucaacgcaggagccguaaucgauuggcccacagaggagggcaaagaggugugggauuaugucaccguacgaaaggaugcuuauauguuuuggugguuauacuacgcaacuaacaguugcaagaauuucagcgaguugccacugguuauguggcuucaaggcggcccaggcgguuccucgaccggguucgggaacuuugaggagauuggaccucucgauagugauuugaagccucgcaagaccaccuggcugcaggcugcuucucugcuguuuguugauaaucccgucggcacagguuuuagcuacgugaauggcucgggcgccuaugcaaaggaucucgccaugguggcuagcgacaugauggugcuacugaaaaccuucuuuuccugccauaaagaauuucaaaccgucccguuuuauaucuucucggaaaguuaugggggaaagauggcugcuggcaucggccuggaacuuuacaaggcaauucagcgaggaacuaucaaauguaauuuugccggaguugcacuuggcgacucuuggauuagcccugucgauucuguccuuuccuggggacccuaccucuacuccauguccuugcuagaggauaagggccucgcugaaguguccaagguggcagaacagguccugaacgccgugaacaaaggcuuauaucgagaagcgacugaacuuugggguaaagcggagaugauuauugagcagaauacugacggagucaauuuuuacaauauacugaccaagaguacaccuaccuccacaauggaauccucgcuggaauuuacucagucucacuugguaugucuuugccagcgccauguacgacauuugcagagagaugccuuaucucaauugaugaacgggccaaucagaaagaagcugaagauaauaccugaggaccaguccugggggggccaggcuacaaacguguuugucaauauggaagaagauuucaugaagccugugauuucuauaguggacgaacuguuggaggccgguaucaacgugacuguguauaacgggcagcuagaccucauuguugacacuaugggccaagaagcaugggugaggaaacucaaguggcccgagcugcccaaauucucacaacuuaaauggaaagcccuguacagugacccuaaaaguuuagaaacaucugccuuuguuaagucauauaagaaccuagcuuucuauuggauacuuaaggcuggucacauggugcccagugaucagggagacauggccuuaaagaugaugcggcuggucacgcaacaggaguag

SEQ ID NO: 11922 - RNA, 1395 nt, Artificial Sequence
  Description of Artificial Sequence: Synthetic coding sequence
auggugcggcuggccgcugagcuccugcugcuucugggucugcuacucuuaacccugcacaucaccguguuacgcgggagcggagccgcagauggaccugaugcagccgccggcaaugcaucccaagcacaacugcagaacaaccuaaacguaggcucugacacuaccucugaaaccucuuuuucucuuagcaaagaggccccuagagagcaccuugaucaccaagcggcgcaccagccuuuuccccggccccgauuccggcaggagacagggcauccuucacuccagcgagacuucccucgcucuuuucuccucgaucuccccaauuuuccugaucugaguaaggcugauauuaacgggcaaaaucccaacauucaaguaaccaucgaggucgucgacggcccagacagcgaggccgauaaagaucagcaccccgagaauaaaccaucuuggucuguacccucucccgacuggcgcgccugguggcaacggucauuaucauuggcuagggccaacaguggcgaucaggacuacaaauaugacucuacgucugaugauagcaacuuccucaacccuccgaggggaugggaccauacggcuccgggacauagaacuuuugaaacuaaagaccaacccgaguacgauucuacagauggagagggcgauuggucauugugguccguguguagcgugacauguggcaauggaaaucagaagcggacucgauccugcggauacgccugcacagcgacugagagcagaaccugcgacagaccaaauugucccggaaucgaggauaccuuucgcaccgcagcuaccgaggucucucuucuggcaggcagcgaggaguucaacgccacaaaguuauuugaagucgauacagacucuugugagagauggauguccugcaagucggaguuuuugaaaaaguacaugcacaaaguuaugaaugaccuuccuucuuguccuugcagcuauccuaccgaaguggcuuauaguaccgccgauaucuuugauagaaucaaaagaaaagauuuuagauggaaagacgcuucugguccuaaagagaaacuagagaucuacaaaccaaccgcaagauacugcauacgaucgaugcuuucccuggagucaaccacacucgcugcucagcacuguuguuacggcgacaacaugcaacuaauaacaaggggaaagggcgccggcaccccaaaccugauuucuacagaauucucugccgaacuccacuacaaggucgacguuuugccuuggaucauuuguaaaggcgacuggucccgcuacaacgaggcaaggccaccaaauaauggccagaaaugcaccgaaaguccaucagaugaggacuauaucaagcaguuccaggaagcucgcgaauauuag

SEQ ID NO: 11923 - RNA, 1536 nt, Artificial Sequence
  Description of Artificial Sequence: Synthetic coding sequence
augcugguugacggcccaagcgaaaggccagcacucuguuuccugcuguuagccgucgcaaugucauuuuucgggucugcguugagcauugacgaaacccgagcacaucuccuguuaaaagagaaaaugaugcggcuggguggaagacuuguacucaacaccaaagaggaacuggcgaacgaaagauuaaugacacugaaaaucgcagaaaugaaggaggcuaugagaacucucauuuuuccaccuucgaugcauuucuuccaggcuaagcaccugauugaaagaucccaagucuucaacauuuuacguaugaugccuaaaggcgccgcccugcaccugcaugauaucgguaucgugaccauggauuggcucguacguaacgucacauaucggccccauugucacauuuguuuuacaccgcgugggauuaugcaguuccgcuuugcacauccuaccccuaggccuucggaaaagugcaguaaauggauccugcucgaagacuaccguaaacgaguccagaauguaaccgaguucgacgauucucuccuuaggaacuuuaccuugguuacccagcauccagaaguuaucuacaccaaucagaacgucgugugguccaaguucgagacuaucuuuuucacgaucuccggccugauccauuacgccccaguuuuuagggacuacgucuuuagaucuaugcaggaauuuuaugaggauaacguucuuuauauggagauuagggcuaggcugcugccaguguacgaauugucaggagagcaccaugacgaggaguggucggugaagacuuaucaggagguggcucagaaauucguggaaacacaccccgaguuuauuggcaucaagauuauauacagugaucauagaaguaaagacgucgcuguuauagcugaaaguauuagaauggcaaugggccugcguaucaaauuccccacaguugucgcaggauucgauuuagucggccacgaggacaccgggcauucacugcacgauuauaaagaggcccugaugauccccgcuaaggauggcgucaagcuccccuacuucuuucacgccggggaaacagauuggcagggaacuaguauagaccggaauauucuggaugcucugauguuaaauacaaccagaaucggacauggcuucgcauuguccaaacaccccgcagugcgaacuuauucauggaaaaaagauaucccuauugagguguguccuauuaguaaucagguccugaagcuggucuccgaucuacgcaaucacccaguggcuacucugauggcgacaggacauccuauggucauuagcucagaugauccugcgauguuuggcgcuaaaggauuaucauacgacuuuuacgaaguguuuaugggcaucggaggcaugaaagcugaccugcggacucucaaacagcucgccaugaauucuauaaaguacucuacgcugcucgaaagcgaaaagaacacguucauggaaauauggaagaagagaugggauaaauucaucgccgacguggccacuaaguag

SEQ ID NO: 11924 - RNA, 777 nt, Artificial Sequence
  Description of Artificial Sequence: Synthetic coding sequence
augaaacagauccuccaucccgcgcuggagacuaccgccaugacccuuuuucccgugcuacucuuccuuguugcaggccuccucccaucguuuccagcaaaugaagacaaagauccagcuuucacggcauuguugacuacucagacacagguacagagggagauagucaauaaacauaaugagcugcggcgcgcugugagcccaccagcuagaaacaugcuaaaaauggaauggaauaaagaggcugcugcuaaugcacagaaaugggcuaaccaguguaacuacaggcacagcaauccaaaggaccgcaugacuucacucaaguguggagaaaaccuuuacaugaguucugcaaguuccuccuggagccaggcuauucagagcugguucgaugaguacaacgauuuugauuucggcgugggaccgaaaaccccaaaugcugucgucgggcacuacacccaaguggucugguacagcuccuaccucgugggguguggcaaugcuuauugccccaaucagaaaguguuaaaguauuacuacguuugucaauacugucccgcugguaauugggcuaacaggcuuuacgugccuuacgagcagggagccccaugcgccucauguccugacaacugcgacgacgggcuguguacaaauggaugcaaguacgaagaccuguauaguaacugcaaaagcuuaaaacugacucuaacauguaagcaucagcugguucgagauucaugcaaggccaguuguaauugcagcaauuccauuuauuag

SEQ ID NO: 11925 - RNA, 714 nt, Artificial Sequence
  Description of Artificial Sequence: Synthetic coding sequence
augguuacgccucccccucccccuguguuuagccugcuaaaaaucagccagcgaauagucugccucguacuggauaagucugggaguauggguggaaaggauagacugaauaggaugaaccaggcugcuaagcacuuucugcuacagacuguagagaauggaucuugggucggaaugguacacuuugauagcaccgcuacuaucgugaauaaauuaauacaaauaaaguccucugacgagcgaaauacucuaauggccggacucccuacauacccccuaggcgguacuucuaucuguuccgggauaaaguacgccuuucagguuauuggcgaacuccacagucaacucgacgguagcgagguacugcuuuuaacagacggagaggacaauacugcaagcucuugcauugaugagguuaaacaaucuggagccaucguucauuuuauugcgcuuggccgagcggcagacgaagccgugaucgagaugucuaaaauuaccggcggaucacauuuuuacguuucagacgaagcccagaacaauggcuugauugaugcauuuggagcccucaccagugguaauaccgaucugagccagaaaucccugcaggugcgcgugcuaauuccuuggguuuuuauguucacauuugcuacccgcaagaaucaccuaguggucaucaguuuugaauuucacauuuuccugaaggugaacuucuag

SEQ ID NO: 11926 - RNA, 459 nt, Artificial Sequence
  Description of Artificial Sequence: Synthetic coding sequence
auggacaaugugcagcccaaaauuaagcauagaccuuuuuguuuuaguguaaaaggacaugugaagaugcugcggcuggcacugacaguaacaaguaugacuuuuuucauuauagcccaagccccugaaccuuauaucgugauuaccggcuuugaagucaccgugaucuuguuuuuuauucuacuguaugugcugagacucgaccggcuuaugaaauggcuguucuggccacuucuggacauuauuaauucccuugucacaacaguguuuaugcugaucgugagugugcucgcccuuauuccugaaacaacuacccuuacgguuggcggcggcguguucgcccuuguaacagcagucuguuguuuggcugauggggcccuuauuuaucggaaauuacuuuuuaauccaagcggaccuuaccagaagaaaccgguucacgagaagaaagaaguucucuag

SEQ ID NO: 11927 - RNA, 3744 nt, Artificial Sequence
  Description of Artificial Sequence: Synthetic coding sequence
auguuggcuagcucaucaagaauccgggcugcauggacgagagcgcuccuguugccucugcuucucgccggacccgucgguugucugucucgacaggaacuuuuuccauucgguccuggucagggcgacuuggaguuggaagacggugaugacuuugugagccccgcacuggagcugucaggcgcccugcgguuuuacgaucgcagcgauauugacgccguguacgugaccacaaacggaauuauagcuaccuccgagccgccagcaaaagagucucacccaggccuauuccccccuacauucggugcuguagcuccuuuucuggcggauuuggauacaaccgacgggcuuggcaagguguauuaccgugaagacuugaguccaucaaucacccagagggcggcagagugcguacaccggggguuuccagaaauuucuuuucagcccucuuccgcaguuguugucacaugggaaucuguggcuccauaccagggccccaguagggauccugaucagaaggguaagagaaauacauuccaggccguccuugcuaguucagacagcucuagcuacgccauauuuuuauauccugaggauggccugcaguuccauaccacguucaguaagaaggagaauaaucagguuccagcaguaguggccuucucacaaggcucagugggguuccuguggaaguccaacggcgcguacaacaucuucgccaaugacagggaauccgucgaaaaccuugcgaagagcagcaacagcggccagcaagggguauggguguuugagauaggguccccggcuaccacuaacggcguggugccagccgacguuauccuuggaaccgaagacggcgcugaauacgaugaugaagacgaagacuacgaccuggccaccacucggcugggacucgaggacgucggcacgacaccuuucaguuacaaagcccugagacgcggcggcgcugacacauacuccgugcccucaguacucagccccagaagagcagcaaccgagaggccuuugggccccccaacugagagaacccgaaguuuucaacuugcuguugagaccuuccaucagcagcauccacaggugauugauguggacgagguugaggaaacuggggugguauucuccuauaacaccgacuccagacaaacgugcgccaauaaucgccaccaaugcucagugcacgcggagugccgugauuaugcuaccgguuuuuguuguuccugcguggcagguuauacugguaacgggcgccagugcguggcagaagguucgccacagcgaguaaacgguaaagucaagggccggaucuuugucgggucuagucagguacccaucguauuugagaauacagaucuccauagcuacguggugaugaaccauggucgcucauauaccgcuauuaguacuaucccugagacugucggauauagucugcugccacuggcaccggugggcggaaucauaggauggauguuugcuguugaacaggauggcuucaaaaacggguuuucuaucaccggcggcgaguuuacacggcaggcugaggugacauuugucggacaucccggaaaucugguuaucaagcagagauuuucuggcauagaugaacauggacaccuuacuauagacacagagcuagaaggcagagugccucagauccccuuuggcucaagcgugcauaucgaaccguauacugaauuguaucauuacucaacaucugugaucaccucauccagcacucgggaguauacagucacagagccagagcgcgacggggcaagcccaucaagaauuuacacauaccaguggcgacagaccauaaccuuccaggagugcgugcaugacgauucuagacccgccuuaccguccacacagcagcuguccguugauucaguuuucguuuuauacaaccaggaagagaaaauacuucgguacgcccuaucaaauuccaucgguccaguacgcgagggaucuccggacgcccuucaaaauccauguuauauugguacucacggcugcgauacaaacgcugccuguaggccuggucccaggacacaguuuacaugcgaauguucuauaggcuuccgcggagacgggcggacguguuacgacaucgaugaaugcucugaacaaccuagugucugcggcucccacacaauuuguaacaaucacccagggaccuuucguugugaaugcguggaaggauaucaguucagugaugaaggcaccuguguugcggugguggaucagagacccauuaacuacugcgaaaccggucuccauaacugugacauuccacagcgcgcacagugcaucuacaccggugguucaagcuacacaugcagcugccucccgggguuuagcggugacggccaggcaugccaggacguggacgagugucagccuagccguugccauccggaugcauucugcuacaacacaccuggcuccuuuaccugccagugcaaaccaggcuaucagggcgacggcuuccgguguguaccuggcgaagucgagaaaacccggugccagcacgaaagggaacauauccugggagcggccggagcaaccgauccccagagaccaaucccucccggauuguuuguuccugagugugacgcacacggccacuacgcaccuacucaaugucacggcucuacaggguacugcuggugugucgaccgagauggucgggagguagaagguacaaggacacgaccaggcaugacgcccccuugucucucgacugucgcucccccuauccaccagggccccgcugucccgacagccgucauuccgcucccgccuggcacccaccugcuguucgcccagacagggaagauugagagguuaccucuugaagggaacaccaugcguaagacugaagccaaggcguuucuccaugugccagcaaagguaaucaucggacuggcauuugauugcgucgauaagaugguuuauuggacugacauaacagagccuagcauaggcagagccagcuugcacgguggugaaccuaccacaauuauccgccaggaucuuggcucuccggagggcauugcuguugaccaccugggucgcaacaucuucuggacugauucuaaccuagacaggauugaagucgccaagcuugacgguacgcagcggagggugcuguucgaaacugaucuugugaauccuagggggauugucacagacaguguccgugguaaccuguauuggaccgauuggaaccgcgacaauccaaaaauugaaacuucguauauggacgguacaaacaggcgcauacuaguccaggaugaucugggccuuccuaauggauugacauuugacgccuuuucaucucagcuauguuggguagacgccgggaccaauagagccgagugccugaauccaucgcagccuagccggagaaaggcucuggaaggccugcaguauccauucgccguuacuucuuacggaaagaaccuguacuuuacagacuggaagaugaauagugucguggcccuugaucuagcuauuucaaaggaaacagaugccuuucagccucauaagcagacgcgucuauaugguaucacuaccgcacucucacaguguccucaaggccacaacuauugcagugugaacaauggaggcuguacucacuuaugccucgcuacuccgggcucuagaacaugucgcuguccagacaauacccucgguguggauugcauugagcagaaguag

SEQ ID NO: 11928 - RNA, 525 nt, Artificial Sequence
  Description of Artificial Sequence: Synthetic coding sequence
augcuccggacagaguccugccgaccgaggagcccugcagggcaaguggcugcugcauccccuuuguuauuacuucugcuauuacuggcauggugugcaggggccugucggggggcuccuauuuuaccgcagggucuccagcccgaacagcaguugcagcuguggaacgagaucgacgauacuugcucuuccuuuuuaucuaucgacucccagccccaggccucaaaugcauuggaagaacuaugcuucaugauaauggggauguuacccaagccccaagagcaggacgagaaagauaacacuaaacguuuccucuuucauuauucaaagacgcagaagcucggcaaauccaacguggucaguucuguagugcaccccuugcuccaacuggucccccacuuacaugaaagacguaugaaacgguuucgaguugaugaagaauuucaguccccuuucgcaagucagagccggggauauuucuuguuccggccaaggaaugggcgcagaagugcuggguucaucuag

SEQ ID NO: 11929 - RNA, 1218 nt, Artificial Sequence
  Description of Artificial Sequence: Synthetic coding sequence
auggacaccaucuuccuuuggucauugcuccuccuguuuuuugguucccaggcaagccgcugcucagcacagaagaacaccgaauucgcaguggaucuguaucaggaagucucacucucucauaaggauaacauaauuuucucuccgcucgguaucacacucgucuuagaaaugguacaguuaggagcaaaagguaaagcacagcagcagauucgacagacgcucaagcaacaggagacauccgcuggggaggaauucuuugugcuaaagucguuuuucucugccauuagcgagaaaaaacaggaguucacuuuuaaccuggccaacgcccuguauuuacaggagggguucacagucaaggagcaguauuuacaugguaacaaggaguucuuccaauccgcuaucaagcuaguggacuuucaggacgcaaaagcaugugcugagaugauuuccacuuggguggaacguaagaccgacggaaagauaaaggauauguuuuccggagaagaguuuggcccacuuacccgguugguucucgucaacgccauuuacuuuaaaggagauuggaaacagaaauuuaggaaggaagacacucaauugaucaauuucacaaaaaagaacggcaguacuguaaagauaccuaugaugaaggcccucuugaggacaaaauacggcuacuuuucagaaagcagcuuaaacuaucagguacucgagcuaagcuauaagggggaugaauucagcuuaauuauuauacucccugccgagggaauggacaucgaagaggucgagaagcuuaucaccgcucagcagauucugaaaugguuaagugagaugcaggaagaggaaguagaaaucucccuuccaagguucaaaguggagcaaaagguagacuucaaggauguguuguauagccuuaacauaaccgaaauuuuuagugggggaugugaccuuagugguauuaccgacagcucugaaguuuaugugagccaggugacccaaaaaguauucuuugaaauuaaugaagaugguuccgaggcugcuacaucuacuggaauccauauccccgugaucaugucccucgcgcagucacaguuuaucgcaaaucacccauuucuguucauaaugaagcacaauccgaccgagucuauccucuuuaugggacgagucaccaauccagauacucaggagaucaaaggacgcgaccucgacagucuauag

SEQ ID NO: 11930 - RNA, 3687 nt, Artificial Sequence
  Description of Artificial Sequence: Synthetic coding sequence
augaagggagcacgccuguuugucuugcucagcagucucuggaguggugguauugggcuaaauaacucuaagcauucguggaccauccccgaggaugggaacucucagaagacaaugcccucugccagcgugccacccaacaagauccagucccugcaaauccugccuaccaccagagugaugucugcugagaucgccaccacccccgaggcccgcacgagugaggauucacugcuaaaaaguacucucccaccauccgaaaccagcgcaccugcagaaggcgugagaaaccaaacccuuacaagcacagaaaaagcagagggcgucgugaaacuucagaauuugacccugccuacaaacgccuccauaaaguuuaacccuggagccgagagcguugugcuguccaacuccacucucaaguuccuacaguccuucgcaagaaaaucaaacgagcaggccaccagccuuaauacagugggcggaaccgguggcauuggaggcguuggugggaccgggggggucgggaacagggcuccgagggaaacuuaccugagcagaggcgacaguuccuccagccaaagaacagacuaccaaaagucuaauuuugagacaacucgggggaaaaauuggugugccuacgugcauacacgccucuccccaaccgugaucuuagauaaccaggugacauacgugccagggggcaaaggacccugcggguggaccggcggauccuguccacagaggucacagaaaaucucuaacccgguguauaggaugcagcacaagauugugacgagccuggacuggcgauguuguccaggauacaguggcccgaagugccagcugagagcccaagagcagcaaagucuuauucauaccaaucaagcugagucccauacggcuguggggcggggugucgccgaacaacaacagcaacagggauguggggauccugaagugaugcagaaaaugacagaucaggucaacuaccaggccaugaaacuuacccugcugcagaaaaaaaucgauaauauaagucugaccguaaaugacgugcgcaacaccuacaguucucuggaaggcaagguuagugaggauaagucaagagaauuccagucucucuugaagggccucaaaagcaaaucgaucaacgugcucauaagagacaucgugagggagcaguucaagauauuccagaacgauaugcaggaaacaguugcccagcuguucaagacuguuagcucucucucugaggaucuugagucuacccgucaaaucauccaaaaggugaacgaaucuguuguuuccauugcugcacagcaaaaguuuguacugguacaggagaaccgaccaacucuuaccgauaucguagaacugcguaaccacauagugaacguccgccaagaaaugacccuaacgugugagaaaccaauaaaggagcuugaagugaaacagacacacuuagaaggagcacuggaacaggaacacucucgcaguaucuuguauuacgaaaguuugaauaagacauuguccaaauugaaagaggugcacgaacagcugcuuuccacggagcagguguccgaccaaaagaacgcgccugcggcugagaguguaucaaacaacgucacagaauauaugucaacccuucaugagaacaucaaaaagcagucccugaugaugcuucaaauguuugaggaccugcacauucaagaaucuaaaaucaauaaucugacagucucacuggaaauggagaaagagagcuugagaggcgagugcgaagauauguugucuaagugucggaacgauuucaaguuccagcuuaaggacacggaagaaaaccugcacguccugaaccagacucucgccgaggugcuguuuccaauggauaauaaaauggauaagaugagcgagcagcugaacgaucuaaccuacgauauggagauucugcagccucugcucgaacaaggugcaucccugaggcagacuaugacauaugaacagccgaaggaggcuaucgugauccgcaagaaaaucgaaaaucuuacauccgccgugaacucucucaacuucaucaucaaagaacugacaaaacgccacaaucuucuuagaaaugagguucagggcagggacgacgcgcuggagagacgaauuaaugaguaugcucuggaaauggaggauggccugaacaagacaaugacaauaaucaacaacgccaucgacuuuauccaagacaacuacgcacuuaaagagacucugaguaccaucaaggacaacucagaaauucaucacaaauguacuucugauauggaaacgauucuuaccuucauuccccaauuucacagacuaaaugacucaauacagacacucgugaacgacaaccagcgguacaauuuugugcuacagguugcuaaaacacuggccggaauuccgcgcgacgagaagcugaaccagucaaauuuccagaagauguaucagauguuuaacgagaccaccucacagguucggaaauaucagcagaacaugucgcaccuggaagagaaauugcuccuuacgaccaaaaucagcaaaaacuucgagacuagacugcaggacaucgagucuaagguuacgcagacgcucauuccauauuauauuucaguaaaaaagggcucugucguuaccaacgaacgggaccaggcacugcagcuccagguccugaauagcagguucaaggcguuggaagcaaaaucaauucaccugucuaucaacuucuucucgcugaacaaaacacuucaugaggugcugacaaugugccauaacgcuucgaccuccgucucugaguugaacgccacuauaccgaaauggaucaagcacagccuucccgauauccagcuucuccagaaaggauuaacagaauucguggagccuauaauacagaucaagacccaagcggcacucuccaaucugaccugcugcaucgaccguucgcugcccgggucauuggcaaacgugguuaagucccagaagcaagugaaaucacugccuaagaaaaucaaugccuugaaaaagcccacugucaaccucaccacagugcugauuggacggacgcagaggaauacggauaacaucauuuacccugaggaauacucauccugcuccagacacccaugccagaauggggguacauguauuaacggucguacuucauuuacgugugccugccgacacccauucaccggugauaauugcaccauuaaacugguugaggagaaugcccuggcccccgacuucuccaaagguucauaccgcuacgcuccaaugguugcauuuuuugcuucucauacuuacggcaugacuauacccgggccuauucuuuuuaauaaucuggacgugaacuacggcgcuuccuauacaccgcggaccgguaaguucaggauuccguaccuggguguauauguauucaaguauacaauugaaagcuucagcgcucauaucucuggauucuuggucguggacgguaucgauaaacuugcuuucgagucugaaaacauaaacagcgaaauucauugcgauaggguguuaacaggugacgcauuacucgaacugaauuacggucaggaaguguggcuucgccuggcuaaggggaccauccccgccaaguuuccgcccgugacaacguuuucuggauaccugcuuuacagaaccuag

SEQ ID NO: 11931 - RNA, 1365 nt, Artificial Sequence
  Description of Artificial Sequence: Synthetic coding sequence
auguggccccuaaccguuccuccaccucuguugcuccuguuguguucagggcuggccgggcagacacucuuucagaaucccgaggaagguuggcaguuauacacuagugcucaagccccugacggcaaguguauuuguaccgcaguuaucccagcccagagcacguguucccgagacggcagauccagggagcucagacaacugauggaaaaaguccagaaugucucccagucaauggaagugcuggaacugaggaccuacagggaccuccaauacgugcggggcauggaaacucucaugcgauccuuggaugccaggcugcgagccgcggaugguucccucuccgcuaaaucuuuccaggaacugaaagaucguaugacugaacugcugccacugucaucugugcuggagcaauauaaagcagauacacgaaccauagugcgccugcgcgaagaaguacggaaucucucuggcagucuugccgcaauccaggaagagaugggcgccuacggauaugaagacuuacagcagagagucauggcacucgaggcuaggcugcaugcuugcgcacaaaaguuaggauguggaaagcugaccggcguuuccaauccgauuacaguccgggcaaugggcucucguuucgggucuuggaugacagauaccauggcaccuagugcagacucaagggugugguacauggacggguauuacaaagggaggcgggugcuggaguuccggacccugggcgacuucauuaaaggacagaacuucauccaacacuugcuuccucaacccugggccggcaccggacacguaguguauaacgggagucuguuuuacaauaaguaccaguccaacguggucgucaaauaucauuuccgcagccgaucuguucuuguccaacgaaguuuaccaggcgcaggauacaacaauacauucccauacucuuggggcggcuucagcgauauggacuuuaugguggacgaaucuggucucugggcgguuuauacaacgaaucagaacgccgguaauauaguugugucacgucuggacccccacacgcuggaaguaaugagaaguugggacaccgguuacccaaaacgaagcgcuggagaggcguucaugaucugcgggguguuguacgugacaaauucucauuuagccggugccaaaguuuacuucgccuauuuuaccaauacaagcaguuaugaauauacagacguacccuuucacaaccaguauagccacaucuccaugcucgacuacaacccaagggaacgugcccuguacaccuggaacaacggccaucaagugcuauauaaugugacacuguuccacgugauaaguacuucuggcgaucccuag

SEQ ID NO: 11932 - RNA, 909 nt, Artificial Sequence
  Description of Artificial Sequence: Synthetic coding sequence
augugcgcggaaagacuggggcaguucaugacgcuggcuuugguccuagcuacuuuugauccagcccgggggacagaugcuaccaacccccccgaagggccccaggaucggagcagccagcagaaaggccgccuaucauuacaaaacacagccgagauccagcacugccuuguaaaugcaggcgacguagggugcggaguauuugagugcuuugaaaacaauuccugcgagauucggggccuccauggaauuuguaugaccuuccugcauaacgccgguaaguucgaugcacagggcaaaagcuuuaucaaggacgcgcugaagugcaaagcgcacgcacuucgccaccgauucgggugcaucuccagaaaauguccugcgauccgagaaauggugucucagcugcaaagggaaugcuaucugaaacaugaucuaugugccgccgcccaggaaaauacacgcgugauaguggagaugauucacuuuaaggaccugcugcuccacgagcccuauguugaucuggugaaccugcuguugaccugcggugaggaagugaaggaagccauuacucauucaguacaaguacagugcgagcagaauuggggaucccuaugcuccauucuuuccuucuguacuucugcuauccaaaaaccgccaaccgccccacccgagcggcagccccagguggaucggacaaaauugagcagagcacaccauggagaggccggacaccaccugccagagccaucaucucgagaaacuggaaggggagccaaaggcgagcgcgggagcaagucucacccaaacgcacacgccagaggccgagucggggggcuaggugcccagggcccuagugggucuagugaaugggaggaugagcagucagaauacagcgauauccgccgguag

SEQ ID NO: 11933 - RNA, 2529 nt, Artificial Sequence
  Description of Artificial Sequence: Synthetic coding sequence
augaagccuggugguuuuuggcuccaccugacacuacucggagcauccuuaccagcagcccucggauggauggauccaggcacuucuagggguccugacgugggcgugggagagucacaggcagaagaacccaggucauucgaagugacccggagggaaggucuguccagccauaaugagcuccuugcaucuugcggcaaaaaguucugcucccggggaaguagaugcguguugucucggaaaacaggggaaccagagugccaaugucuugaagccuguaggccaucauacgucccuguuuguggaagcgacggccgcuucuaugagaaccacugcaagcugcaccgagccgcuugucuuuuggggaagcgcauuacagugauucacuccaaagacuguuuccuuaaaggagacaccuguaccauggcagguuaugcccgucugaaaaacguacuguuagcacugcagacucggcuccagccccugcaggagggcgacaguaggcaagauccugccucccaaaagagacugcucguggagucucuguuucgcgaucuggacgcugauggaaauggucacuugagcaguuccgaacuggcacaacacguuuugaagaagcaggaucuggaugaggaccugcugggauguagcccaggcgauuugcucagauucgacgauuauaacuccgacucaucucugacacuccgcgaauuuuacauggcauuucagguaguucaguuaucucucgcuccagaagacagggugagcgucacaacugugaccguggggcuguccaccguccuuacgugcgccgugcauggcgaucugcguccacccaucaucuggaaaaggaaugggcucacucucaauuuucuggaccucgaagauaucaacgauuucggcgaggaugacucucuauauauuaccaaaguuaccacaauccauaugggaaacuacaccugccacgccucaggccaugaacaacuguuucagacucaugugcuacaagucaacguaccaccggugaucagaguguacccugaaucucaggcacaggagccugggguggccgcaagucugagaugucacgcagaagguauaccgaugccccgaaucacuuggcucaagaauggcgucgacguuuccacucagaugagcaaacagcugucccugcuggcuaauggcuccgagcuccacaucuccaguguucgguacgaagacaccggagccuacacguguaucgccaagaacgagguuggcguggacgaggacaucagcucauuguucaucgaggauucugcucguaagacgcuugcaaacauuuuauggagggaggagggauugucaguggggaacauguuuuaugucuucucugacgacgguaucauagugauccaucccguggacugugagauccaaaggcaucucaagcccacagaaaaaauuuucaugaguuacgaagaaaucugcccccagcgcgagaagaacgcuacgcagccaugccagugggugucagcugucaauguucggaaucgguacauuuauguggcccagccagcccucucccgggugcucgugguggacauucaggcccagaagguguugcaaucuaucggcgucgacccccugccugcaaaguugucuuacgauaaaucacacgaucagguaugggugcuuucuuggggagauguacacaaaagccgaccaagccuccaggucauuaccgaagccucaacuggacaaucucagcaucuaauaagaacccccuuugcggggguggacgauuucuuuauucccccaacuaaccugauuauuaaucauauccgguucggguuuauauucaacaaaagcgacccugcagugcauaaggucgaucuugagacaaugaugccauuaaagacaaucggcuuacaccaccacgggugcgugccgcaggcgauggcccacacccaccuggguggauacuuuuuuauucagugcagacaggacucucccgccucagcagcccgccagcuccuggucgauucggugacagauucuguccuuggucccaauggcgacgugaccggaacgccucacacaucccccgacggacgcuucaucgugucugccgcagccgacagcccaugguugcacgugcaagaaauuaccguuaggggagagauccagaccuuguaugaccugcagaucaauagcggaaucagcgaccuugccuuucagcgcuccuucaccgaauccaaucaguacaauauuuacgcugcccugcacacugagccagaucuccuguuccucgaguuaagcacagguaagguaggcauguuaaagaaccugaaggaacccccggcgggcccugcucagccauggggcgguacccacaggauaaugagagacucggggcuguuuggucaguauuuacucacaccugcaagggagagccuuuuucucaucaauggcaggcagaauacccuucgaugugaagugagcggcauuaaggguggcacuaccgugguaugggucggugaagucuag

SEQ ID NO: 11934 - RNA, 2256 nt, Artificial Sequence
  Description of Artificial Sequence: Synthetic coding sequence
auggcuuuccgaaccaucugcgugcuggugggcguguucauuuguuccauaugcguuaagggaagcagccagccucaggcccgcguuuaccuuacauucgacgagcuucgggaaacaaagaccucagaguacuucuccuuaucccaccacccuuuggacuaccggauauuauuaauggaugaagaccaggaccgcaucuacgugggauccaaagaucauaucuugucccugaacaucaacaacaucucucaggaagcccugaguguauucuggccugcuagcacuauuaaagucgaggaauguaagauggccggaaaggauccgacacacgggugcggaaacuucguaagggucauucaaaccuuuaaccggacccauuuauacguaugcgguucaggcgccuuuucucccgucugcacuuaucucaaucgaggccgcaggucagaggaucagguuuucaugaucgauuccaagugcgaauccggaaaaggcagauguagcuuuaauccgaacguaaauacagucuccgugaugauuaacgaagaacuuuucagcggaauguauauugauuuuaugggcacagaugccgcuauuuuccgcucccugacaaagcguaacgcagugcgaaccgaccagcacaacucaaaauggcucuccgagccuauguucguagacgcacaugugaucccagacggaaccgaccccaacgacgccaagguguacuucuucuucaaggaaaaacugacugauaauaaucgcagcacaaagcagauccauagcaugaucgcgcgcaucugucccaacgauacuggugggcuuagaucacuagugaauaaauggacaaccuuucugaaagcaaggcuagugugcuccgugacugaugaagauggcccagaaacacauuucgacgagcuggaagacguauuccuguuagagaccgauaauccaagaacuacccucguguauggcauuuucacuacgucuucaucuguguuuaagggaucagccgugugcguguaccaccugagcgacauccagacaguguuuaauggcccuuuugcccacaaggagggacccaaucaccagcugauuuccuaucagggccgcauuccauacccaagaccaggaacaugcccagguggagcuuucacgcccaauaugagaacgaccaaagaguucccugaugauguuguaacguuuauccguaaccauccccuuauguacaauucaauuuauccgauucacaagcggccucugaucgucagaauuggaaccgauuauaaguauaccaagauagcgguugacagggugaacgcugccgacgguagguaucacguccuguuccuggggacugauagagggaccguccagaaagugguaguccucccuacgaauaauuccguuagcggagaacucauacuggaggagcuggagguauucaagaaccaugcaccaaucacgaccaugaagaucucgucuaagaaacagcagcuguacguaucgaguaaugagggcguuagccaggugucacugcauaggugccauaucuaugguacagcgugugcagacugcugucuggcuagagaccccuacugcgcgugggauggccauagcugcucacguuucuacccaaccgggaaacguaggucuaggaggcaggacgugcgacauggaaacccccuaacccagugucgaggcuuuaaccugaaagcuuauaggaaugcugccgagaucguccaauacggagugaaaaauaacacuaccuuccuggagugugcaccuaaaaguccccaagcuuccauaaaauggcugcuacagaaagacaaggauagacgaaaggaagucaagcucaacgagagaaucaucgcuacuagccaagguuugcucaucagaucagugcagggcuccgaccaggggcucuaccacugcauugcaaccgaaaacuccuucaaacaaacaauugccaaaauuaauuuuaaaguucucgauagcgagaugguugccguuguuacugacaaaugguccccauggacuugggcuuccucuguccgcgccuuaccauuccauccuaaggauauaaugggagccuuuagccauagcgaaaugcaaaugaucaaccaguauugcaaagacacacggcagcagcaccagcagggagacgagucucagaagaugcgcggagacuacggaaagcugaaggcacuaauaaacucgaggaagucucggaaccggaggaaucaauugccagagagcuag

SEQ ID NO: 11935 - RNA, 2316 nt, Artificial Sequence
  Description of Artificial Sequence: Synthetic coding sequence
augggguggcucaccaggaucgugugccuauuuuggggagugcuuuugaccgccagagcuaacuaucagaacgguaaaaauaacguuccacgucuuaaacugagcuauaaagaaaugcuggaaucaaacaaugugauaaccuucaauggccuggcgaauuccucuucauaucauaccuuucugcuggaugaagagaggucucgccuuuacgucggcgcaaaagaucacauuuucucguucgauuuggugaacauaaaggauuuccagaagaucguguggccuguuaguuacacacgacgggacgaaugcaagugggccggcaaggacauacugaaggagugugccaacuucaucaaaguacuuaaggcauacaaucaaacacauuuguaugcauguggaacgggggcauuucacccuauaugcacguacauugaaauuggucaucauccugaggauaacaucuucaagcuggagaacagccauuucgagaauggacgaggcaagucccccuaugacccaaaacuccugacagccucacuuuugaucgacggggaacucuauuccgggacugccgccgauuucaugggucgugauuuugcaauauuuaggacauuggggcaccaucaccccaucagaacagaacagcaugacucccgauggcuuaaugauccuaaauucauaagugcucaccucaucagcgaaucugacaacccagaggacgauaagguguauuucuucuuccgcgagaacgcgauugacggagaacacuccggaaaggccacucaugccagaauuggucagaucuguaaaaacgacuuugggggacauagguccuuagucaauaaguggacaacauuucucaaggcucgauugauauguucaguuccagguccuaacggaauugacacucauuucgaugaacugcaggacguuuuccucaugaauuuuaaagauccuaagaacccagucgucuaugguguauucaccacaaguuccaacaucuucaaaggaucugcugugugcauguauucuaugagugacgugcgccggguuuuccuuggccccuaugcacaccgcgacggccccaauuaccagugggucccuuaucaagguaggguccccuauccucggccugggacauguccuagcaagacuuucggaggauuugacuccacgaaggaccuaccggaugauguuauaaccuuugcgcgaucucauccugcuauguauaacccagucuucccaaugaauaaccgccccauaguaaucaagacugacgugaauuaccaguuuacccagauaguugucgaucguguggaugcugaagacggacaauacgacguuauguucauugguacagauguugggacagugcuaaaggugguuuccauccccaaggagaccugguaugaucuggaggaaguacugcuugaagaaaugacaguguucagagagcccaccgcaauuucugccauggaguugaguaccaaacaacagcagcuguauauuggaagcaccgcaggcgucgcccaguugccccugcaccggugugacaucuaugggaaggcuugcgcagaguguugucuggcacgagauccauauugugccugggacggcucggcuugcuccagauacuucccuaccgcuaaaagacgaacgagacgacaagacauucgcaauggggacccccugacacacugcucugaucuacaucacgacaaucaccauggccauucgccagaagagcgaauaauuuacggaguggaaaacucuucaaccuuccuagaauguucucccaaaagccagagagcacugguguauuggcaguuccagcggcgaaaugaggaaagaaaagaagaaaucaggguagacgaccacauaauaagaacugaccagggacugcuauuaagaucccuucagcagaaagacucaggcaauuaucuaugucacgccguugagcacggcuucauccaaacucugcugaaagugacucuggagguuauugauacugagcaccuugaagaacuccugcacaaggaugacgauggcgacggcuccaagaccaaggaaaugucuaauuccaugaccccuucccaaaaagugugguaccgugacuuuaugcagcugauuaaucauccgaaccuaaauacaauggacgaguucugugaacagguguggaagcgagaccggaagcaaaggcgccagagacccggacauacacccgggaacuccaacaaguggaagcaucuccaggaaaacaagaaaggucgcaaccgccguacgcacgaguucgagcgggcaccaaggucagucuag

SEQ ID NO: 11936 - RNA, 4605 nt, Artificial Sequence
  Description of Artificial Sequence: Synthetic coding sequence
auggcgcucaccccuggcuggggcucuagcgcuggucccguuaggccugaacuguggcugcuuuuaugggcggcugccuggaggcugggcgccucagcuuguccugccuuguguacauguacaggaacaaccguugacugucacggcaccggguugcaggcuauccccaaaaauaucccacgcaacacagagagguuggaauugaacggcaauaauaucacuagaauccauaaaaaugacuucgccggacucaagcagcuuagagucuuacagcuuauggagaaucagaucggggccguggagagaggcgcuuucgacgacaugaaggagcuggaacgauuacgucugaauagaaaccaguugcacaugcuucccgaacuguuguuucagaauaaucaggcccugucccgacuugauuugucagagaaugcgauucaggcaaucccucgaaaagccuucagaggagcgacugaccucaagaaccugcaacuggacaagaaccagaucagcugcaucgaagaaggggcauuuagggcauuacggggacuagagguccuuacacucaauaauaacaacauaacaaccauccccguguccuccuucaaccauaugccaaaacugcgaacauucaggcuccauagcaaccaccuuuucugugauugccaccuggccuggcugagccagugguugcgccagaggccuacaaucgggcuguuuacgcagugcaguggcccggcaucacugcgggggcuaaacguggcagaagugcaaaagagcgaguucuccuguucuggucagggagaagcaggacgaguacccaccugcacucucuccucuggcagcugcccggccaugugcacaugcuccaacggaauuguggauugccgaggcaaaggguugacagcaauaccugccaaccuucccgaaacuaugacagagauacggcuggaauuaaauggcaucaaaagcaucccuccuggagccuucaguccuuaucgcaaacuucggaggauugauuuaucuaauaaucaaauugccgaaaucgcaccugaugcauuucaggggcuccggagccucaauagcuugguguuguaugggaauaagaucaccgaucugccacgcggugucuucggggggcuguauacccugcagcugcuccuucugaaugcuaacaaaaucaauuguauacgcccagaugcauuucaggaucuacaaaaccuuagccuacuuagccucuaugauaacaaaauccagucucucgcuaaggggacuuuuaccagucuccgcgcuauucaaacauugcaccucgcccagaauccuuucaucugugacuguaaccuaaaauggcucgccgauuuucuacgcacaaauccuauugagacaaguggcgcacguugugcaagcccuagacgacuggcuaacaagcgcaucggccagaucaaaucuaagaaauuuagguguucagcaaaggagcaauauuuuauucccggaaccgaggacuaccagcugaacagcgagugcaacucagacguggucugcccacauaaaugccggugcgaagccaacgucguagagugcucaucuuugaaauuaaccaagaucccugagcggauuccccagucuacagcggagcugagacugaacaauaacgaaauuaguauacuggaagccacagguauguuuaaaaagcugacccaccugaagaagaucaaccugucaaacaauaaggugucugaaaucgaagauggagccuuugagggggcggccuccguaucugagcugcaucucaccgccaaccagcuagaaagcauccgguccgggauguucagaggacuggacggacuccgcacucucaugcuccgaaauaaucggauuaguuguauccacaaugauagcuuuacuggucuccggaaugucagguugcuguccuuguacgauaaucagauuacuacaguuagcccaggagcuuucgacacacuacagucguugucuaccuugaaucugcuggcuaaccccuuuaacuguaauugccaacucgccuggcucgggggguggcuuaggaagaggaaaauuguuaccgggaacccuaggugucagaaccccgauuuucugcggcaaauuccacugcaggaugucgcguuucccgauuuucgaugcgaggagggacaggaggagggcggcugccugccccguccacaauguccucaggaaugugccugccuggauaccguuguaaggugcucaaacaaacaucugcgagccuugcccaaggguauuccaaagaacguuaccgaguuguaccuggaugguaaucaguucacauuggucccuggacaauugucuaccuuuaaauauuuacagcugguggaucucaguaauaacaagauuuccucccucucaaauuccaguuuuacuaauaugucacagcuuacaacccugaucuugagcuauaaugcccugcagugcaucccacccuuagcauuucaaggacugagaucccugcgccugcugagccuccauggcaacgauaucucuacacuucaggaaggcaucuuugccgacgugaccucacucagccaucuugcuauaggugcuaaucccuuguauugcgauugucacuugcgguggcuaagcaguugggucaagacgggcuauaaagaaccuggcaucgcccgaugugccggcccucaggauauggagggcaaacuguuauuaacuacgccugcuaagaaguuugaaugccaggggcccccaacacuugccgugcaggccaaaugcgaccucugucuauccucaccuugccaaaaccagggaacuugucacaaugacccacuggaagucuauagaugugccugcccaaguggcuauaaagggcgagauugcgaaguaucuuuagauagcugcaguagcggccccugugaaaacggcgggaccugucaugcgcaggagggcgaggaugcuccuuuuacuuguucaugccccacuggauuugagggcccuaccugcggugugaauacagaugacuguguggaccacgcuugcgcaaauggcggaguuugugucgacggggugggcaauuacacuugucaaugcccccuccaauaugaaggcaaggccugugagcagcugguggaccugugcagcccugaccuaaauccuugccagcacgaggcacaguguguuggaacucccgaugguccaagaugcgaaugcaugcccggcuacgccggagauaacugcucagaaaaccaggaugauugucgggaucaccgaugucaaaacggcgcccaguguauggaugaaguuaacucguacucuugccuuugcgcugagggguacucuggccagcucugugaaauccccccucacuuaccugcgccuaagucuccuugcgaagggaccgaaugucaaaauggagccaacuguguggaccaaggaaaccggcccguaugccagugucuccccggcuuuggcgggcccgagugcgagaaacuccugucuguuaacuucguugauagggauacauaucuucaguucacugacuugcagaacuggccccgagcaaacaucacccugcaggugaguacagcugaggacaauggaaucuugcuuuauaacggcgauaacgaucacauugcgguggaacucuaccaaggccauguccgcguaaguuacgauccagggucuuacccuagcagugcgaucuacucugccgagacaauuaacgacggucaguuccauacaguagaguuggucgcguucgaucagauggugaaucuuaguaucgacggggguucuccuaugacuauggacaauuucggaaaacacuacaccuugaauagcgaagcuccccuguacgugggcgggaugcccguugauguuaacucugccgccuuucggcucuggcagauccuuaacgggaccggcuuucacggcuguauccgcaaccuguacaucaacaacgaacugcaagauuuuacaaaaacucaaaugaagccuggaguggugccuggcugugagccuugccggaaacuguacugccugcauggaaucugucagccaaaugccacacccggaccaaugugccacugcgaagcuggcugggugggccuccacugugaccaacccgccgacggcccaugccacggucacaaauguguacacggucagugcguaccucucgaugcccuuucauacagcugccagugccaggacgguuauaguggagcccuguguaaucaggccggagcccuugcugaaccgugcaggggccuucagugcuuacauggccauugucaagccucaggcaccaaaggggcucauugugucugcgacccggguuuuucaggcgagcucugugaacaggaguccgaaugucggggcgacccugugcgggauuuucaccaagugcaaaggggguaugccauaugccagacuacuagaccucuuaguuggguggaauguagagguagcuguccaggucagggaugcugucaaggcuugcguuugaagcggagaaaguuuacguucgaguguuccgauggcaccucauucgccgaagagguagaaaaaccaaccaaguguggcugugcccuuugugcauag

SEQ ID NO: 11937 - RNA, 342 nt, Artificial Sequence
  Description of Artificial Sequence: Synthetic coding sequence
auggauuccagacaggccgcugcacuguuggugcuucuacugcugauugacggagggugcgcagaagguccagguggccagcaagaggaucaacucagcgccgaggaagauagugagccauuaccaccacaggaugcgcagaccucagguucucuacuccacuaccuucuucaggcuauggagcggccuggccgaucacaggcuuuuuuauuucagccucagcgcuuuggcagaaacacacaggggucuuggcgaaacgagugguugucuccccgagcuggagaggggcuuaacucacaguuuuggagccucgcggcaccacagagguucggcaagaaauag

SEQ ID NO: 11938 - RNA, 2568 nt, Artificial Sequence
  Description of Artificial Sequence: Synthetic coding sequence
auggcaagacaucuccuuuugccacucguuaugcuggugauuucaccuaucccaggagcuuuccaggacucagcacuaagcccuacccaagaagagccagaagacuuggauuguggccggccugagcccagcgcccgcauuguggguggaaguaaugcacagccaggaacuuggccauggcaagugaguuuacaccacggcgggggacauauuugcggcgguuccuugauugcacccagcugggugcucucggcugcccacugcuuuaugacuaaugggacacuggagccugcagcugaauggagcguccugcuuggcgugcacucccaagauggcccgcuggacggagcccauacuagagcuguugcggcaauaguggugccugcaaacuauucacaggucgaacuuggagcugaccuugcacuccugagacuugcuucccccgcuucacugggcccagcugucuggccaguuugucugccucgugcaucacaucgauuugugcaugguacagcuugcugggcaacagguuggggagacgugcaggaagccgauccacucccacugccuugggugcugcaggaaguggaauugcgucuucucggagaagcaacuugucagugccuuuauucucagcccggccccuuuaacuugaccuugcaaauccugccuggaauguugugugccggauacccugagggaaggagagacaccugccagggagacuccggagguccauuggugugcgaggagggcgguagaugguuccaggccggaauuacuagcuuugguuuuggaugugggaggcggaauagaccagggguguuuacugcuguugccacauacgaagcauggauccgugagcagguuaugggaagcgaacccggccccgccuuccccacacagccacaaaaaacccagagcgacccccaggagccuagagaagagaauugcaccauagcacuccccgaaugugguaaagccccucgcccuggcgccuggccuugggaggcccaggugaugguccccggcucacgcccaugucauggcgcccuaguauccgaguccugggugcuugccccagcaaguuguuucuuggacccaaauaguucagauucuccgccgcgggacuuggaugcauggcggguucuguugcccucuaggccgagggccgaacggguggcucgccucguccaacacgagaacgcaucaugggauaacgcguccgaccuggcucugcuccaguugagaacaccagugaaucugagugcugcuaguaggccgguaugucugccccauccagaacauuacuuccugccgggaagcagguguaggcucgcuagauggggccgaggagagccugcacucgguccaggagcacuauuagaggccgagcuucucggcgguugguggugucacugcuuguauggacggcagggcgcagccgucccccugccgggagacccgccucacgcccugugucccgccuaccaagaaaaagaggagguaggaucgugcuggaacgacucccgauggucucuccugugucaggaggaggguacaugguucuuggcaggcauucgagauuuucccucagguugcuugaggccccgggccuuuuucccgcuucagacacauggcccuuggaucagccaugugacgagaggugccuaccuggaggaccaguuggcuugggacugggggccagauggugaagagaccgaaacacagaccuguccuccacauaccgagcauggagcuugcggccugagacuggaggcugccccuguuggcguucuuuggccauggcuggcugagguccauguggcuggcgacagagucuguacuggaauccuacuagcuccaggguggguguuagcugccacacacugcguuuugcggcccgggagcacuacaguuccauauauagaaguguaucuaggccgagcaggagcaaguucauugccccagggccaccaggucagucggcuggucauuuccauuagacuaccucagcaccugggucugcggccaccccuggcacuccucgaacucagcuccagaguagagcccagcccuuccgcgcuccccaucugucuccaucccgccggaauaccccccggugcuucuuguuggguccugggcuggaaagaaccccaggaucgagugcccguagccgcggcugugucaauccuaacacaacggauuugcgauugucuguaucagggcauucugccgccagguaccuugugcguucucuacgcagagggucaggaaaaccgaugugagaugacuucugcuccuccacugcugugccagaugacagaagggagcuggauucuaguaggaauggccguucagggaucaagggaauuauucgccgccaucggaccagaagaagcuuggaucucccagacugugggcgaagcuaacuuccuucccccaucggggucuccccacuggccuaccggcggaucuaacuuguguccgccagaacuggcgaaagcuagugguucgccccacgccguguauuucuugcuccuccugacucugcugauccaguccuag

SEQ ID NO: 11939 - RNA, 912 nt, Artificial Sequence
  Description of Artificial Sequence: Synthetic coding sequence
augcuucacccagaaacgagccccggacggggccaccuucucgccguguuacuggcuuugcuuggaaccacgugggcagaggucuggcccccgcaacuccaagagcaggcacccauggcuggagcacucaaccggaaagaaagcuuccuccuguuaucucugcacaaccgucuucgcucaugggugcagccccccgccgccgacaugagacgguuagacuggagugacagucuugcucaauuagcucaggcaagggcugccuugugcgggauccccaccccaucucucgcuucaggccuguggcggaccuugcaaguggguuggaacaugcagcugcuuccggcaggucuggccuccuucgucgagguggucucauuaugguucgcggaaggccagcgcuacucucacgcagccggcgagugcgcccggaacgcgaccuguacccacuacacccagcuagugugggcaaccucuucccagcugggcugcggacggcaccuauguucggccggucagacagcuaucgaggcauucgugugcgcuuacuccccucgcggcaauugggaagugaauggaaaaacgauuauccccuacaagaaaggcgcuuggugcucacuauguacagccucagucucugguugcuuuaaggcuugggaucaugcuggaggucucugcgaggugccaagaaauccuuguagaaugucuugucaaaaccaugggcgucugaauaucaguaccugccauugccauuguccgcccggcuauacuggaagguauugucaggugaggugcagccuccaaugcgugcauggcagauuuagagaggaagagugcagcugugugugcgauaucggguauggcgagcccagcgugccuccccggugcauauuucccuccacucccguuacuuag

SEQ ID NO: 11940 - RNA, 1158 nt, Artificial Sequence
  Description of Artificial Sequence: Synthetic coding sequence
augaaaaugcuccccggggugggugucuucgguaccggcaguucggcccggguauuggucccucuccugagagccgaaggcuuuacagucgaggcccuguggggcaagacagaggaggaagccaaacaguuagcugaagagaugaauauagccuucuacacuucccgaacagaugacauccuccuacaucaggacguggaucuggugugcaucagcauuccuccuccccugacccgacagaucuccguuaaagcucucgguauuggaaagaacguugucugugagaaagcugcuacguccguggacgcuuuucgaaugguaacagccucccgcuacuauccacagcugaugagccuugucgguaacgugcugcgauuucucccugccuucguccgaaugaagcagcuuaucucagaacacuaugugggagcugugaugaucugugacgcgcguaucuauucugguucacuccucucacccuccuacgguuggauuugcgacgagcugaugggcgggggcggccugcauaccauggguacauacauugucgaucuacugacccaccugacaggccggcgagcagaaaaaguacacgggcuucuaaaaacauucgugagacaaaacgcggcuauccgaggcauucgccaugugacuuccgacgacuucugcuuuuuucagaugcuuauggggggaggcguguguucaacagugacacugaacuucaauaugccaggggccuucgugcacgaagugauggugguuggaagcgcgggucgguugguugcuagaggcgccgauuuguauggucagaaaaacagcgcuacccaggaagaauuacugcugcgggacucacuugcaguuggugccggccuccccgaacaagggccacaggacgucccgcucuuauaccugaagggaaugguguacaugguccaggcucuaaggcaaucguuucaggggcagggagauaggaggacaugggaucgaacuccuguguccauggcagccucauuugaagauggacucuauaugcaaucugugguggaugccauuaagcgcagcucucgauccggggaaugggaggcaguggaaguccugaccgaggaaccagacacuaaucagaauuugugcgaagcuuuacagcguaacaaccuguag

SEQ ID NO: 11941 - RNA, 1470 nt, Artificial Sequence
  Description of Artificial Sequence: Synthetic coding sequence
augccaguuacuuucgcguuacugcuccucuuagggcaggcaaccgcugacccuugcuacgauccacagggccggccccaauucugucucccaccagucacacaacuagcagccguugcugcaucauguccucaagcuugcgccuugucucccgguaaccauuugggagcuagagagacuuguaacgggucgcugacauuggcucuuggaggaccauuucugcugaccagugugucucuaagauuuugcaccccgggccccccugccuuaauccucuccgcagcuugggcaucaggcggcccuuggcgacugcuguggcaccggcccgcuuggccuggugcauugggagggccugaacggguuacauuucacaguacaccuggaccuaaagcaacaguagcugcuagucacuuacggguggaguucggcggacaggccggcuuggcagcugcuggguugagaggcagaugucagugucauggacacgcagcucgcugcgccgcccgggcccgaccccccagaugccacuguaggcaccacacaacuggcccaggcugugaauccugucggccuucgcauagagauuggccguggagacccgccacaccaagacacccccaucccugucugccguguuccugcaaucagcacgccaggagaugucgauucaauucagaacuauuccgccuaucugggggucgcaguggcggcguuugugagcgcugucggcaucacacggcugggaggcacugucauuauugccaacccggguucuggagggauccaagucagccuaucuuuucucgccgagccugcagagcaugucagugucaucccaucggugcuacagggggcacuuguaaucagacuucaggccagugcaccugcaagcucggcgucacaggccucacaugcaaucgcugcgggccgggguaucagcagucaagaucuccgcgcaugcccugccaacgcauuccggaagcgacuacuacuuuggccacaacacccggggcuuauaguucggauccucagugucaaaacuacugcaacauguccgacaccagaguacacaugagccuuagacgauacugucagcaagaucacguccugagagcccagguccucgcaagcgaagcugcaggacccgccuggcaacggcuugcggugaggguucuggcggucuauaagcagcgggcccagccuguaagacgcggugaucaggacgcuugggucccccgcgcagacuugacaugcggcugucugcgacugcagccugggacggauuaccuacugcugggguccgcugugggcgauccagacccgacacgguugauccuagaucggcacggguuagcacuaccuuggcgacccagaugggcaagaccguuaaaaaggcugcaacaggaggaacgcgccgggggaugucggggcguuagagcgcccacuccuuccccccgcccagagcacuag

SEQ ID NO: 11942 - RNA, 8430 nt, Artificial Sequence
  Description of Artificial Sequence: Synthetic coding sequence
augacacucgagggauuguaucucgcaagagggccucuggcacgguugcugcucgccugguccgcacugcuaugcauggccggcggacaaggacgcugggauggggcccuugaggccgcuggacccggacgggucaggagaagaggaaguccuggcauucuccaagggccuaaugugugugguagccguuuucacgccuacugcugucccggguggagaacguuuccagggagaagucagugcguggugcccaucuguaggcgggccuguggagagggguucuguucgcagccaaaccuguguaccugugccgacggaacccuagcacccucauguggagucagccgggguucuggcugcaguguuucuugcaugaauggcggcacgugucggggggcgagcugccugugucagaaaggguacacagguacaguguguggccaacccaucugcgaucguggcugccacaacggggggcgcugcaucggccccaaucgaugcgccugugucuacggcuuuaugggcccucaaugcgaacgggauuaccguacagguccuuguuuuggccagguggggccggaagggugucagcaccagcucacaggccuuguuuguacgaaggcacuguguugcgcgacaguuggaagagccuggggccugccaugcgaacucuguccugcccagccucacccaugcagaaggggguucauuccgaauauucacacgggagccugccaggauguugacgagugucaggcugugccugggcugugucagggcgggucaugugugaauauggugggcuccuuucauuguagauguccagucggccaucgucugagugacucuagcgccgcuugugaggacuaucgggcaggggccugcuucucaguacuguuugggggccgaugcgccggagaccuggcgggacauuauacgcgcaggcagugcuguugcgaucgcggucggugcugggcggcuggaccuguccccgaauugugcccgcccagaggaucuaaugaguuccagcagcucugcgcgcagagacugccccuacuucccggacauccgggccuguuucccggccuucugggguucggaucuaaugguaugggcccaccauuaggcccugcccggcugaacccacacggaagcgaugcgcguggcauuccaagccugggcccaggcaacuccaauaucggcaccgcaacgcugaaucaaacuaucgauaucugcaggcauuuuacaaaucuaugucugaacggucgcugucuucccacacccucuaguuaucguugugaauguaacguaggcuauacccaggauguccgcggagaauguaucgauguggaugaguguaccagcagucccugccaucacggugacugugucaauauucccggaacguaccacugucgaugcuauccuggcuuucaagcuaccccuacaagacaggccugcgucgauguggaugaaugcauugugagcggaggacucugucaccugggccgaugcgucaacacugagggcucauuucagugcguuugcaaugcuggcuucgagcugucccccgacgggaaaaauuguguugaucauaacgaaugcgcaacguccaccauguguguuaaugguguuugucugaacgaggauggcaguuucagcugucuguguaagccugguuuccugcuugcuccgggaggccacuauuguauggauaucgacgagugucagacaccuggaaucuguguuaacggacacuguacgaauacugaggguagcuuucgcugccagugucugggcggacuggcugugggcaccgauggccgaguuugugucgacacucauguccgaagcacuugcuacggugcaauugaaaaaggauccugugcuagaccuuucccuggcaccgucacuaaaagugaauguuguugcgcaaacccagaucacgguuucggagagcccugucagcucuguccggccaaagauagugcggaguuucaagcacucugcuccucaggucucgguauaacuacugaugggcgggauauaaacgagugcgcccuggacccugaggucugugcaaacggcguuugugaaaaccuucgugggaguuaccgcugcguguguaaccugggcuacgaggccggugcuuccggaaaggauugcacugacguugaugagugugcucugaacaguuuacucugugauaauggauggugucaaaauucucccggauccuacucuugcucgugcccuccuggguuccauuucuggcaggacacagagauuuguaaagauguggacgagugccuuucaaguccguguguuuccggaguaugucgcaaccuggcuggcucuuacaccugcaaaugcggccccggaucucgccuggaccccucgggcaccuuuugcuuggacagcacuaaagggacgugcuggcuuaaaauucaggaaucccggugcgaggugaaucuucaaggagcuucccugcggagcgaauguugcgcaacuuugggagcugccugggggagcccgugcgagcgaugugagauugacccagcgugugcccguggguuugcaaggaugaccggaguuaccugcgacgacguuaaugagugcgagucguuccccgggguguguccaaacggucggugcgucaacacagccggaucuuuuaggugcgaaugccccgagggacucauguuggacgcaagcgggcgccuguguguggauguacgccuggaacccuguuuucugcggugggacgaagaugaauguggaguuacacuaccuggcaaauauaggauggaugucuguugcugcucuaucggggccguuuggggcguggagugugaagccuguccagaucccgagucuuuagaguucgcaucacugugcccucgggggcugggcuuugcgagucgggauuuccuguccgggcggcccuucuacaaagauguaaacgagugcaagguguuccccggccuuugcacacacggaacaugccgcaauacagugggauccuuucauugugcuugcgccgggggauucgcucuggaugcacaagaacggaauuguacugauauugaugaauguaggauaucaccagaucuguguggacaaggcacauguguaaacacccccggcaguuucgaaugcgaguguuuuccuggcuaugaaagcggauuuaugcugaugaaaaauugcauggauguagaugaaugugccagagauccucuccucugccggggcgggacaugcacaaauacugacgggagcuauaaaugucaaugcccuccaggccacgaauugaccgcaaaggggacagccugcgaggauaucgacgaaugcucgcugucugacggcuuauguccgcacggccaaugcguuaauguuaucggggccuuccagugcaguugucaugccggcuuucagucuacaccggauagacagggcugcguggacauuaaugagugcagaguacagaauggcgguugcgauguccauugcaucaauacugaaggaucuuaccguuguucuugcggccagggcuauucacugaugccugacggacgggccugugcugauguggaugagugugaagaaaacccccgggucugcgaccaagggcauugcaccaauaugccagggggucauagaugcuuguguuacgacggcuucauggcgacacccgauaugagaaccuguguugacguugacgagugcgaccugaauccucauauuuguuugcauggugacugcgaaaauaccaaagggucuuucgugugccacugucaguugggcuauaugguuaggaagggugcuacuggcuguagugacguggacgagugcgaggucgggggacacaauugugauagccaugccuccugucugaauauccccggauccuuuucaugccgaugucucccagggugggugggugauggauuugaaugccaugaucuagaugaauguguaagucaggaacaccggugcucuccccgcggggauugccucaauguuccagguucuuauagaugcaccugccgucagggcuucgccggugacggauucuuuugugaagacagagaugagugugcagagaacguugauuugugugauaauggucaaugucucaaugccccugguggcuacaggugcgaaugugaaaugggauucgauccaaccgaagaucaccgugccugucaggauguugacgagugcgcucagggaaaccuaugcgcguucggaagcugugagaaccugcccgguauguucagaugcaucugcaauggcgguuacgaguuagaccggggcgggggaaauugcaccgacauaaacgagugugcggacccagugaacuguauuaaugggguguguauaaacacgcccggaaguuaccuguguuccuguccacaggacuuugaacucaacccgucaggcguaggguguguugauacccgggcugguaauuguuuccucgagacccaugauagaggagacucugggauuucuuguagugcagagaucggcgucggcgugaccagggcuucauguuguuguucacuugggcgcgccuggggaaaucccugcgagcugugcccuauggccaacacaacugaauauaggacacucuguccgggaggggagggcuuucagccuaaccggauuaccgugauccuugaggacaucgaugagugccaagaacuuccuggacuuugccaaggcggggacugugucaauacauuuggaagcuuccagugcgaaugcccuccgggauaccaucugagcgagcacacacggauuugcgaggauauagaugagugcucaacucacucaggaauuuguggaccaggaacuugcuacaacacacugggcaacuauaccugugucugcccagcagaguaccugcaggucaaugggggaaacaauugcauggauaugagaaagagcguauguuuuagacacuauaacggaaccugccagaacgaguuggccuuuaaugugacgagaaagauguguugcugcucuuacaacauagggcaggcuuggaacagacccugcgaagcaugcccuacaccaaucucccccgacuaccagauccuuugcgggaaccaagcccccggcuuucuuacagacauucacaccgguaaaccccuggacauugacgaauguggggaaaucccggcaauuugcgccaaugggaucugcaucaaccaaauagguuccuuccggugugagugcccugcuggcuuuaacuacaacagcauucuuuuggcuugcgaagauguggacgaaugcggcaguagagagucccccugccagcaaaacgcugauuguauuaauauucccggaagcuaucggugcaagugcacacgcggauauaagcuuuccccggguggggccugcgucggccgaaaugagugucgcgaaauccccaauguaugcagccauggcgacugcauggauacagaaggguccuacaugugccugugccaucgaggauuucaggcguccgcugaccagacccuuugcauggacaucgaugagugcgaucgacagccuuguggcaacgguacuugcaagaacaucaucgguuccuacaauugccuuuguuucccgggcuucguagucacucauaauggggacugcguugacuuugacgaauguacgacgcucguugggcaggugugccgcuucggacacugccugaauacagcuggaucuuuucacugccugugucaagauggcuucgaacugacagcugauggaaagaacugugucgacacaaaugaaugucuaagucuggccggaacaugcuugccugggacuugccagaacuuggagggauccuuccggugcauauguccgcccggcuuucagguccagucagaucacugcaucgauauugaugaaugcagcgaggagcccaaucugugucuguuuggaaccuguacaaacucccccggaaguuuccaguguuugugcccucccggauucgugcuguccgauaauggccauagauguuuugacacccgccagucguuuuguuucacccgcuucgaagcggguaaguguagcgugccaaaggccuucaacacaacuaagacuaggugcuguugcucaaagcgccccggggaaggcuggggggaccccugcgaacuauguccgcaggaaggguccgcagcauuccaggaguugugcccauucggucacggggcugugcccggacccgacgauucuagggaagacguuaaugaaugcgccgaaaauccagggguuuguacaaauggaguuugcgucaacacagacggauccuuucggugugaauguccuuuuggguacagcuuggauuucacuggaaucaacuguguugacacugacgaaugcucaguuggacaccccugcgggcagggcaccuguacgaaugugaucgggggguucgaaugugcuugcgcugauggcuucgagccaggcuugaugaugacuugcgaggacauagacgaaugcucuuuaaacccauugcugugcgcuuuuaggugccauaacacagagggcagcuacuuauguaccugccccgccggguacacccucagagaagauggggcuaugugcagagacguugaugaaugcgcugacggacagcaggacugucacgcucgcggaauggaauguaagaaucugauugguacuuuugcuugcgugugcccgccagggaugcgcccccuucccgguucaggugagggcugcacagaugacaaugagugucacgcacagccugacuuguguguuaauggucggugcgugaauaccgcgggaaguuucaggugugacugugacgaggguuuccaaccuagcccgacgcuaacagaaugccacgauauucgacaaggacccugcuucgcggaggugcugcagaccaugugucgaagccugucaagcuccuccgaagccguuacccgcgcugagugcuguugcggcggugguaggggauggggcccuaggugcgaauugugcccacugccugggacuucagcauacagaaaacucugcccccaugguucuggguacacagcugagggaagagauguagaugaaugcagaauguuggcacacuugugugcgcauggagaauguaucaacagcuugggguccuuuagaugucacugccaggcagguuacacucccgaugcaaccgccacgacuugccuggauauggaugaauguucccagguccccaagcccuguaccuucuuaugcaaaaauacaaagggcagcuuccuuugcucuugcccccgcggauaucuccucgaggaagacgguagaaccugcaaagaccuggaugagugcaccagccgacagcauaauugucaguucuuguguguuaacacggugggugccuucaccugccggugcccacccggcuucacacagcaccaccaggcguguuuugauaacgaugaaugcucugcccagccaggaccguguggcgcccacgggcacugccacaauacgccaggaagcuuucguugcgaaugccaccaaggcuuuacccuggucucuaguggucaugguugugaagaugucaaugaaugugaugggccccaccggugccagcacgggugucagaaccagcuugguggauauagaugcucuugcccccaagguuucacacagcauagccagugggcccagugcguugacgagaaugagugcgcucuguccccaccuacaugcggcucugcauccugucguaauacccugggcggcuuuagguguguuuguccauccggguuugacuucgaucaggcucugggaggaugucaggagguggacgaaugcgcgggucggcgggguccauguagcuacucuugcgccaauacccccgggggcuuucuguguggcuguccccaaggauauuucagagccgggcaggggcacugugugucaggacuuggauucagcccuggcccacaggauacucccgacaaggaggaacugcugucauccgaggcaugcuaugaauguaagaucaaugggcugaguccgcgggaucggccacgacgcagcgcccacagagaccaccaagugaaucuggcgacacuggacagugaagcucuccugacacuuggcuuaaaccuuucgcacuuggggcgcgccgaaagaauuuuagagcugcguccagcacucgaggggcuggagggccgcauccgauacguuauugugcgggggaacgaacaaggguucuucagaaugcaccaccugcgaggagugucaucauugcaacuggggagacguagaccuggcccugguacauaccgguuggaagucguaucacacauggcaggaccuuggggcguucagcccgaggggcagccaggucccugggggcaggcauuacggcugaaagugcaguugcagcuucuguag

SEQ ID NO: 11943 - RNA, 303 nt, Artificial Sequence
  Description of Artificial Sequence: Synthetic coding sequence
auggagacccgucaagugucaaggaguccccguguucguuuguuacugcugcugcuacugcuuuugguggugccuuggggcguuagaacagcaucaggcguggcacugcccccugugggaguccucucucugagaccgccaggaagggcaugggcagauccugcuacaccacggccgcgacgcucucuggccuuggcagaugacgcagcuuuucgggaacgugcucgucuccuggccgcccuggaaagacgccauuggcuuaacuccuauaugcauaagcuauuaguccucgaugccccuuag

SEQ ID NO: 11944 - RNA, 1404 nt, Artificial Sequence
  Description of Artificial Sequence: Synthetic coding sequence
auguggcgcugcccacugggccugcuuuuauuacugccccuggcugggcacuuggcacugggagcucagcaaggacgaggcaggagagaacucgcuccuggguugcaccuucggggcauaagggaugccggaggaagauauugccaggaacaggacuuauguuguagggggcgcgccgaugauugugccuuacccuaccuaggcgccaucugcuauugugaucuuuuuugcaacagaaccgucagcgacuguugcccugauuuuugggacuucugccugggagugcccccaccuuucccacccauacaggggugcaugcacgggggaaggaucuacccuguauuaggcacuuauugggacaauugcaauagguguacuugccaggagaauagacaguggcagugcgaucaggaaccuugccuugucgauccagacaugauaaaggccauuaaccagggaaauuacggauggcaggcaggaaaucacucggcuuuuuggggcaugacccucgacgaggguauucgcuaucgccugggcaccauccguccuagcaguagugugaugaauaugcacgaaaucuacacaguauuaaaucccggcgagguucuucccacagccuuugaagcuucagaaaaauggccaaaccucauucacgaacccuuggaccaagggaacugugccggcucuugggccuuuucaacagccgccgucgcuagcgaucgcgucucgauucacagucuggggcacaugaccccagugcuguccccacaaaaccuacuuucaugcgauacacaccagcagcagggcugccgaggcggcagacucgacggcgcuuggugguuccuccgccguagaggcguugucucagaucauuguuaucccuucucaggacgggagcgggacgaggcuggacccgcacccccauguaugaugcacucucgagccauggggcggggaaagcggcaagccacugcucacuguccuaauuccuacguuaacaacaaugacaucuaccaggucacaccugucuauagacuugguuccaaugacaaagagauuaugaaagagcuaauggagaaugggcccguccaagcucugauggaggugcaugaagacuuuuuucuguauaaggggggcauuuauagucauacgcccgugucacuggggaggccagagcgcuaccguaggcacggcacacauagcgugaaaauuaccggauggggagaagagacucugccagacggaagaacccugaaguauuggacggcugcaaauuccuggggcccagcauggggggagcgagggcacuuucggauuguuaggggcguuaaugaaugcgauauugagagcuucgugcuagggguguggggccggguuggaauggaagacaugggacaccauuag

SEQ ID NO: 11945 - RNA, 2205 nt, Artificial Sequence
  Description of Artificial Sequence: Synthetic coding sequence
auguuuuacgucuguagcucauguguuuuuuuauguggcucuaacuuccccaacuucccauuucagguagccagcgcaaagagcgcucccgagauuccuacaaucgaucaggcauauagcaaacuguccaacuccaucacuguugaaugggccacugugcccggagccacgucuuacuuauugacugcugaggauggcgauacggucaucgaaacaacaguggcuaauaguccaggaacggugacaggguugaaagccgccacaugguacgagauuacgauacggagcauuagugcugcugggagaagccaagcaucaccaccuaagcaggcuaagacuguucuugccgcgccuauccuggaagugucuucacccucaucugauucgaucuuggugcagugggaagcuguguacauggcaaucgcauucagugugucuaucaugagggcuaauggccuggggucaaucuggaaggagaacaccacgaacaccucucucacuuuuacuucccuggaagcggggacacuguauaccauuaaggcuuaugccuggaaugccaaccggaucccuggugacgacaguacuugcaaucagcgaacaucgccucgcgccccagcaaauauucagguaucuuucgacucuggugcucugaaagcauccuucucuugggcacgagccgagggcgcauucaacuacacaguuauggcguugucugacucuuccgagcugacaugcuccaccacauucucaucauguacaauaucuucucuccaaugcgguacugaguauuuaauuagcguccuggcuaguaaugacgcgggaucuagcaaguccagcucugcuaugacccugaagaccguggccugcgcuccgggucgcgugacaauacaggaagaccccccuggacacuuauccguagcauggagcucaguggacuugggggacuauuaugugguguuugugaaauccgacgauggccuugagguccauugcaacacuucacuaacucaauguaauuucuugagcgaguguggcuuuacuuacuuuauuucuguguucguuuacaacaaggccggccagagcccacugggcgauaucuucaauuacacuaccgcgccuugcugucccagcgacauaaauccaguucuaguguccuccgaucgaguagaaauagugugguccccaguucggggagcugagcuauaugagaccaaagcuguggacggcuauaauauggucgaguguaaugacacgacacccgcauguacuuugucugcgcuggagugugacaccaaauacaauaucaccgucuauucauucaaugaaguucgagggaguaacauguccuguaccccacaauucaucacgacugcaccguguagcccugagaucaaaaacgucuccagagacgcuuuuucgaugauuaauguucacuggagaucaacaaaugacgacgcuacauauacugugacggcucaaggugaaaaaggccuguaucagugcucaucuaccggggagaguuguacaaugagggggcuuccuuguggaagcgucuucuccgugacagccguagccgaaacccaggcaggaagaagccuccccuccuauucagugcccuuggaaacugugccgugcugccccaccggauuaaccguaacucagauuacacaguccgugauaaacgugaguuggaccauuggccgcguugcacagacucacguagccgugcuggagagccauaccggccagucuaaaugccauacucaccaaaaucacugucuacuggggugcaucaccugcgggaucaauuacaccgucacguugaaagccauuuccgcaacuggguuaaccgccgacugcucauaucaaagcuacuucucuggcgcuuguugcccccugggugucaagcuguacagguuaggaccuaacggcauucgcaucuauuggcaggcaucucgugggagcgcaaauuauagcacagauuuguauggcuccaaagggaucuuuacaugcacaccaagcgcaggccuguccuucugugacgugacggaaauucccugcggugauguguacaccgucaugguuucccccguggccaagaccggucucaaguuaacauuuugucccaaaaaaaucuacuccguaaccuguucugguucuacacucgggauggugauauauagagggaagcggaacgaagaguag

SEQ ID NO: 11946 - RNA, 1098 nt, Artificial Sequence
  Description of Artificial Sequence: Synthetic coding sequence
auguuggacggaucacccuuagcaagguggcuggccgcugcauucggccugacucugcugcucgcugcucuucgccccagugcugcuuacuucggacugaccggaucagagccucugaccauacuuccuuuaacgcucgaacccgaggccgcagcacaggcccacuauaaagcuugugaucgcuugaaauuggaaaggaaacagagacgcaugugucgucgggaccccgggguggcugagacccuuguggaggccguauccaugucagcgcuggaaugccaguuucaauuucguuuugagagguggaauugcacccuggaggggcgauauagggcaagucuguugaaaaggggauuuaaagaaacugcguuuuuauacgcuaucucuucugccggccucacacacgcccuagcuaaagcuugcagcgcuggucggauggaacgcugcacgugugaugaagccccugaccuggagaaucgggaagcuuggcaguggggggguugcggggauaaucuuaaguacucaucaaaguucguaaaggaauuccuugggcgacgcuccucuaaagaucucagagcgcgaguggacuuccacaacaauuugguuggcgugaaaguaauuaaagccggcguggaaacuacuugcaaaugccacgggguuagcgguagcugcacugucaggacguguuggcggcagcuggcaccuuuucaugagguuggcaagcaucuuaagcauaaguaugaaaccgcacugaaaguuggcagcaccaccaacgaggccgcgggcgaagcaggugcgauuaguccccccagagggcgggcuucaggagccgggggcagcgaucccuuaccaaggacaccugagcucguacauuuggacgacagucccucuuuuugucuggcagggagauuuucaccugggaccgccgggagaaggugucauagggagaagaauugcgagucgaucuguugcggcagagggcacaauacacagucuagggucguaacgaggccgugccagugccaagugcguuggugcugcuacguagaaugucgucagugcacacagcgggaggaaguguacacgugcaagggauag

SEQ ID NO: 11947 - RNA, 795 nt, Artificial Sequence
  Description of Artificial Sequence: Synthetic coding sequence
augaggcuacgcccucugcccuuggugguggucccggguuugcugcaauugcuguucugcgauaguaaggagguggugcacgccacagaggggcuagacugggaagacaaagaugcucccgggacguugguuggcaaugucguacauucaaggauuauuaguccacuaaggcuguucguaaagcagucuccagucccuaagccuggaccaauggcauaugccgacagcauggagaauuuuugggauuggcucgcuaauaucaccgagauucaggagccucuggcacggacgaagagaaggcccauugugaagacaggcaaauucaagaagauguuuggcuggggagauuuccacucuaauauuaaaacuguuaaacuaaaccuacuaaucaccgguaagauagucgaccauggcaacgguacauuuucaguuuauuucaggcauaacagcacuggacuggggaacgucagugugucacuagucccuccauccaaaguaguggaauuugaaguaagcccccagagcacauuggaaaccaaagaguccaaaucuuucaacugucgcaucgaguaugagaagacggaccgugcuaagaaaacagcccucugcaauuuugauccaucaaagauuuguuaucaggaacagacucagucucacguguccugguuaugcuccaagccuuucaaaguuauuuguaucuauauugccuuuuacuccguggacuacaaacuggugcaaaaggucugucccgacuacaacuaccacagcgagacucccuaccucagcucugguuag

SEQ ID NO: 11948 - RNA, 1125 nt, Artificial Sequence
  Description of Artificial Sequence: Synthetic coding sequence
augaaaccucuccuugagacucuuuauuugcucggcaugcugguaccugguggcuugggauacgaccgcucccucgcacagcacaggcaggagauuguggacaagagcguuuccccauggucacuggagaccuauucuuacaauaucuaccauccuaugggcgagaucuaugaauggaugcgggagauaagcgagaaguacaaagaagucgucacucagcacuuucuuggagugacauacgaaacacaccccauguauuaucugaagauuagucagccuucagggaaucccaagaagaucauuuggauggacugcggaauccacgcuagggaguggaucgcaccagccuuuugccagugguuuguaaaggaaauacugcagaaucauaaagacaacucuucuauucgaaaacuccuacggaaccucgacuuuuauguacugccuguucuuaacauugauggauacaucuacacuuggaccacugaccgacuguggcgcaaaagcaggagcccccacaauaaugguacuuguuucggaacggaccugaaccgcaacuuuaacgccucuugguguucuauaggggcaagucggaauugccaggaucagacuuucugcggaaccgggccuguuagugagccagaaaccaaagcaguggcaaguuucaucgaaucaaagaaggaugacauucuguguuuccugaccaugcauaguuacggacagcugaucuuaacucccuauggcuauaccaaaaacaaaaguucaaaucacccugaaaugauccagguaggucaaaaggcagcaaaugcccugaaggccaaauacggcacuaauuacagagugggauccuccgcggacauacuguaugcaaguaguggcagcucaagggacugggcaagagacaucgguauuccauuuuccuauaccuucgaguugcgcgauucugguaccuaugguuucguccugccagaggcacagauccaaccuaccugugaggagacaauggaagccguguugagcguacuggacgauguuuacgccaagcacuggcacagcgacuccgccgggcgugugaccuccgccacaaugcugcugggacucuuagucagcugcaugagccuucuuuag

SEQ ID NO: 11949 - RNA, 1728 nt, Artificial Sequence
  Description of Artificial Sequence: Synthetic coding sequence
auggcauccugguuacgcagaaaacucagaggaaagcgucgcccugugaucgcauuuuguuugcugaugauccuaucugcuauggcuguuacaagauucccgccacaaagaccuagugcgggcccugaccccgggcccauggagccccagggagucacaggugcuccagcuacucacaucagacaggcucucucaagcucucggcgccaaagggcaaggaacaugggguuuuggaggucacgcgcacuccccaggaauuccauacucguuugugccgaggaacagggccaccgagcccgagucgacaggucccgcgaguccccagggggugaucuucggcacccuggcagagugaggagggacauuaccuugaguggccauccccgacugaguacacaacauguggugcuccuccgggaggacgaagugggcgacccuggaacaaaggaucugggacauccacaacacggcuccccuauccaggagacacaauccgaagugguuacucuugucucaccccuuccgggcagcgacauggccgcccucccugcauggcgggccacuucugggcucacacuguggccucauacugcugagggccgagaccuccugggugcagagaacagggccuugaccggaggacagcaggcugaagauccgacauuggcuaguggcgcgcaucaguggccagguagcguggaaaaacugcagggguccguguggugugaugccgaaacucuucuuucuucuucccgaacuggaggucaggccccuccgugguuaacagaucaugauguacaaaugcucaggcuauuggcacagggugaggucguugacaaggcaagaguuccagcucauggacaagugcugcaagucggguucagcacugaggcggcucuucaggaucuaucaagcccuagacuuagccagcuuuguucacagggacuguguggacuaauuaagagaccuggggaccugccagaagugcucuccuuucacguggaccggguccugggcuugaggcggucucucccugccguggcccgcagguuccacagcccucuguuaccuuauagauacacggauggcggagcacggccaguuauuuggugggcuccagaugugcaacaucugagcgaucccgacgaagaucagaauagccuagcucuaggguggcuucaguaccaagcucugcuggcucauuccugcaauuggccuggccaggcgcccugucccggcauccaucacaccgaaugggcccggcucgccuuguucgauuuccuccuccaaguccacgauagguuggaucguuacuguugcggauucgaaccagagccuucagaucccuguguagaggaacgacugcgagaaaagugccagaacccugcugaacucagauugguccacauccuggugcguaguucugacccaagccauuugguuuauaucgauaacgcuggaaaccugcaacacccugaagacaaacucaacuuuaggcugcuggaagggauagacggguuuccggagagcgcagugaaagugcuggcuucaggcuguuugcaaaauaugcuacuaaagucccugcagauggauccuguuuuuugggagagucaagggggcgcgcaggggcucaagcaaguccuccaaacccuggagcagaggggccaggugcugcuaggccacauccaaaagcacaaucucacucucuuccgggaugaagauccuuag

SEQ ID NO: 11950 - RNA, 1680 nt, Artificial Sequence
  Description of Artificial Sequence: Synthetic coding sequence
auguggacaaacuuuuucaaacuucggcuguuuugcugccucuuggcgguucucaugguugugguucugguuauuaacguaacgcagguggaguacuuggaucacgaaacaguuuccgccacauuuauugacagcucaggccaauucgugaguucucagguuacaggaauuaguagaaaccccuacugcggcuaugaccaacagacucuauccucucaagagcgcauggaagaagacagccugcucgcggcacuacacagacaggugccggacgucgguccugugcccuucgugaagagcacugauccgucuuccucuuauuucgugaucuugaauucugcugcuuuuuuuaaggucgggagucaacuggaagugcucguacaugugcaggauuuucagcgaaagccaaaaaaauacgggggagauuaucugcaggcccgcauacacagccucaaacuucaggcaggagcuguuggccgcguggucgauuaucaaaaugguuuuuacaaggucuucuucacacuguuguggccgggcaaggugaaggugucgguaagcuuagugcacccaucugaaggcaucagagugcugcagcgacugcaagaagauaaaccugaucgcguguacuuuaaaagucuguuuaggucagggcgcaucagcgagacaacagaaugcaacguguguuugccaggaaaccugccuuuauguaacuuuacugaucuguacacuggcgagcccugguucuguuucaaaccuaagaaacuaccgugcucuucccgcaucacacauuucaaagguggcuaucucaagggguugcucacugcggccgaauccgcuuucuuucagucggggguaaauauuaaaaugccagugaacucauccggcccggacugggucaccguaauuccccgccgaaucaaagagacuaacagccuggaguugucccaaggcucuggaacuuuuccauccgguuauuauuacaaggaccaguggcgccccaggaaauuuaagaugcggcaauucaacgauccggauaauauuaccgagugucuucagaggaaggugguccauuuauuuggcgauaguacuauuaggcagugguucgaauaucugacaacuuuugucccggaucucguggaguucaaccuggggaguccaaagaacguggggccuuucuuggcgguugaucaaaagcacaacauccuguuaaaauauaggugccauggaccucccauccgauuuacuacaguguucucuaaugagcugcacuacgucgcaaacgagcuuaacggcaucgugggggguaaaaauacuguuguugccaucgccgucuggucacauuuuagcacauuuccccuugaaguguauauuaggcgucugagaaauauucgcagagccguuguuaggcuucucgaccggagcccgaaaacagucguggugaucagaacugcuaaugcgcaggaacuaggccccgaagugucacucuucaauagcgauugguacaacuuucagcuggacacuauucucaggcgcauguucucuggcgucggagucuaccuaguggaugcgugggaaaugacgcuggcacauuauuugccacauaagcugcauccugacgagguaauugugaaaaaccaacuugacauguuucugagcuucguauguccacuagagacuuag

SEQ ID NO: 11951 - RNA, 3624 nt, Artificial Sequence
  Description of Artificial Sequence: Synthetic coding sequence
augagguugacucacauuuguugcuguugccuucuguaccaacuggguuuccuuaguaauggcaucguuucugaacugcaguucgccccagacagggaggagugggaggucguguuuccagcacuuuggaggcgggagccugucgacccagcgggaggaucaggagggagcgcugacccuggaugggugcgcggcguaggagggggcggcagugccagagcacaggcagcagggucuucccgggaggucagguccgucgcucccgucccucuggaagagcccguugaggggcggagcgagucccgucugcgaccccccccaccuuccgagggggaggaggacgaggagcuggaaucgcaggagcucccccguggcagcaguggagcagccgcccucagcccuggcgccccggccagcuggcagcccccucccccaccacagccaccgccuagccccccucccgcucaacaugccgagccagacggcgaugaggucuugcugcggauaccugcuuuuucacgggauuuauaccugcuccugcggagagacggccguuuucuggcuccacguuuugccgucgaacagcgacccaacccgggcccugggccaacaggggcggccucagccccccaaccgccugccccgccggaugcagguugcuuuuauacuggugcagucuuacgacacccggggagccucgcuagcuuuuccacuugcggcggcggauugaugggcuuuauccaacugaacgaggauuucaucuuuauugaaccgcuuaacgacacaauggcuaucaccggacacccucaccgcguguaccggcagaagagaucuauggaggagaaaguaaccgagaagucagcucuucauucccacuacugcggaauuaucuccgauaaggguagaccaaggucaaggaaaaucgcagagucuggacgggguaaaagauauuccuauaagcuaccacaagaauacaacauugaaacugucgugguugcugacccugcgaugguuagcuaucacggugcggacgcugcucggcgcuucaucuugacaauucugaauauggucuuuaaccuuuuccaacauaaaagccucagcguccaggucaaccuccggguuauaaagcugauuuuacuccacgaaacaccaccagaacuuuacauuggccaccacggcgagaagauguuggaauccuucuguaaauggcaacacgaggaguuuggcaagaagaaugauauucaccuagaaaugucuacaaauuggggggaagauaugaccagcgucgacgcugccauccucauuacgaggaaagauuuuuguguccacaaggacgaacccugugauaccgugggcauugcauaccucucaggcaugugcucugaaaaaaggaaauguauuauugccgaagacaacgggcugaaccuggccuucaccaucgcccaugagaugggccauaacauggguaucaaccacgauaacgaccauccuucuugugccgacggacuccacauuaugucuggagaauggauuaaaggccagaaccugggugaugucagcuggagucgguguuccaaggaggaccuggaacgcuuccuuagaagcaaggcuuccaacugcuugcuccagacaaacccgcagagcgugaacuccgugauggugccuaguaaacucccagggaugacuuacaccgccgacgagcaaugccaaauacucuuuggaccucuggccaguuucugccaggaaaugcaacacguuauuuguacagggcuuuggugcaagguggagggcgagaaggaaugucgcaccaagcucgauccgcccauggacggaaccgauugugaucugggcaaguggugcaaggcuggcgaauguaccucaaggacaucagcaccugagcacuuagcaggggaauggucccucuggagccccuguucaaggaccugcagcgccgguaucagcucaagggaacggaagugccccggcuuggacucagaagccagggauuguaacgggccccgaaagcaguauagaauuugugaaaauccucccuguccagcugggcuuccuggauucagggacuggcagugucaggcguacucugugaggacgucuagcccuaagcacauacugcaguggcaggcuguguuggacgaagaaaagccuugcgcgcucuucugcagcccggucggaaaagagcagccuauccugcucagugaaaaggucauggacggcacuagcuguggcuaccagggguuggauauuugcgcaaauggucgcugccaaaaagugggaugugacggacuacuuggcucccuugcgcgggaggaccacugcggagugugcaaugggaacgggaaaagcuguaagauuauuaagggagacuuuaaucacacccgaggggccggguacgucgaggugcucgugauucccgcuggugcccgccgcauaaaaguagucgaggagaaaccagcucacucauaucuggcgcuucgcgacgcuggaaaacaaagcauaaauagcgauuggaagauugaacacagcggggcauucaauuuagccggcacaacagugcauuauguuaggcgcggacugugggaaaaaauuagugcgaaaggaccgacuacugcuccacugcacuuacuuguccuccucuuucaggaucagaauuauggacuucauuaugaguauaccaucccuagcgauccccuuccggagaaucagucgagcaaggccccugaaccuuuauuuauguggacgcacacauccugggaggacugcgacgcaaccugcgguggcggcgagcgcaagacaaccguuuccugcaccaaaaucaugaguaagaacauuucuauaguggacaaugagaaaugcaaauaccuaacgaaaccugaaccucaaauccggaaaugcaacgaacagccaugccagacacgguggaugaugaccgaguggacucccugcucaagaaccugugggaagggcaugcagagccggcaaguggcuugcacgcagcagcucagcaacggcacccuuauuagggccagggaacgagacuguauuggucccaaacccgccucugcacagcgaugcgaaggccaggauugcaugacuguuugggaagccggcgucugguccgaaugcuccgugaaaugcggaaaggggauccggcacagaacuguacgguguacaaauccacguaagaagugcguguuaagcacacggccucgagaagcagaagauugcgaggauuauucuaaguguuacguguggcgcaugggugauuggagcaaguguaguauaacuuguggcaaagggaugcagaguagagucauccagugcaugcauaaaauuacagggcggcacggcaaugaaugcuuuucgucggagaagccugcugccuacaggccuugucaccugcagccaugcaacgagaagauuaaugugaauacuauuaccucaccuagacuggcugcccugaccuuuaaaugucugggagaccaauggccaguguauugucgggucauccgagagaaaaaucugugucaagacaugcgaugguaccagcgguguugugagacaugucgggacuuuuaugcccagaagcugcagcagaagagcuag

SEQ ID NO: 11952 - RNA, 258 nt, Artificial Sequence
  Description of Artificial Sequence: Synthetic coding sequence
augaaaaucacaggcgggcuccuccugcuuugcaccgucguguacuuuugcaguuccuccgaagcugccaguuuaagcccaaagaaagucgauuguaguaucuauaaaaaauauccgguaguugccauucccuguccuauuacuuaccuuccagugugcggaagcgacuacauaacuuacggaaaugagugccauuuaugcacggaaagucucaaaagcaauggucgcguccaguuccugcacgaugggucuuguuag

SEQ ID NO: 11953 - RNA, 2982 nt, Artificial Sequence
  Description of Artificial Sequence: Synthetic coding sequence
augggcuccgggaggguuccuggccuuugccuguugguacuccuaguucaugcccgcgcagcacaguacucaaaagccgcucaagauguggacgaaugcgucgaaggaacugacaacugucauauugacgccauaugucagaauacucccaggaguuauaaaugcauuuguaagucugguuacaccggggacgguaagcacugcaaagacgucgaugagugugaaagggaggacaacgccggaugcgugcaugauugugugaacauucccgggaauuaccgguguacauguuacgauggauuucacuuagcacaugauggacauaauugcuuggacguggacgaaugcgccgaggggaauggcgguugccagcaaucuuguguuaauaugaugggcucuuacgagugccacugccgggagggcuuuuuucugagcgauaaucagcacacaugcauucagaggccagaggaaggcaugaauugcaugaauaagaaucaugguugugcccauaucugucgggaaacaccuaagggcgguauugccugugagugucgcccaggauuugaguugacaaagaaucagagagauuguaagcugacuuguaauuaugggaacggcggcugucaacauacaugcgacgauacagagcaagggccaaggugugguugucauaucaaguuuguucuccacacagacggcaaaacauguaucgagacuugcgcagucaacaaugggggaugcgacagcaagugucacgacgcugcuacuggaguucacugcaccugcccagugggguuuaugcugcagccggaccgcaagacgugcaaggacauugacgagugucgccugaauaauggcgggugcgaucauaucugcagaaauacaguuggauccuucgagugcaguuguaaaaaaggguacaagcuguuaaucaaugaaaggaacugccaagauaucgacgaguguaguuucgacaggaccugcgaccauaucugugugaauacaccggggucauuccaaugcuuaugucaccgcggcuacuuguuauaugggauuacucauuguggcgauguugacgagugcaguauuaaccgaggcggcugcagauuuggauguauaaacacuccuggcucauaccagugcacuugcccagcaggccaaggccgucugcauuggaacggaaaagauuguacagaaccacugaagugucaaggaucccccggggccaguaaggcuauguugucguguaauagaucugggaagaaggauacuugugcccuaaccugcccaagucgcgcucgcuuuuugccugaaucugagaauggcuucaccguguccugcgguacuccuaguccaagagcggccccugcccgugccgggcauaacgggaauucuacaaauucaaaucauugccaugaagccgcaguucuguccauaaaacagcgagcuucauucaaaaucaaggaugcaaaaugcagauugcacuugaggaauaaggguaagaccgaggaggccgggcgcaucacuggucccgggggcgcacccugcagugaaugccaggugacuuuuauucaccuaaagugcgacaguucuaggaaaggcaaagggagacgggcccggacuccacccggcaaagaggugacccgucugacccuggaacuggaagccgaggugcgagccgaagagacaacugcaucaugcggccugccuugcuuacggcagcgcauggagaggagacucaaaggcucacucaagaugcuaagaaaauccauuaaucaggaucgguuuuuguuacggcucgcgggccucgacuacgaacucgcacauaagcccggacugguggccggagagagagccgagcccauggaaucaugucggccuggacagcauagagcagggacaaaauguguaucuugcccacagggaaccuacuaccacggacagacagagcaauguguucccugccccgccgggacuuuccaggagcgcgaggggcagcugagcugcgacuuaugucccggcucagacgcucauggaccccucggggcuaccaacguuaccacgugugccggacagugcccgccugggcagcacucaguggauggguucaaaccaugucagccuugcccuagagguacauaccagccagaagcgggcaggacauuguguuuccccugcggcgguggguuaacuacuaaacacgagggagcuaucucuuuccaagacugcgauacaaaagugcaguguagcccaggccacuacuacaacaccucgauucacaggugcaucagaugcgcgaugggguccuaccagccugauuuccggcagaauuucugcagccgcugucccgggaauacgaguaccgauuuugacgguuccaccuccgucgcucagugcaaaaacaggcagugcggcggcgagcuaggugaauucaccggcuauauagagagcccuaacuacccaggaaauuaucccgcuggcguggagugcauuuggaauaucaaucccccccccaagcgcaagauucugaucgucgucccagagauauuccugcccagcgaagacgaauguggagacguccuggucaugagaaagaacuccucccccagcaguaucacaacauacgaaacaugccagaccuaugaacgccccauugcauuuacagcccguucucgcaaguuauggaucaauuuuaagaccucagaagcaaauucagcucggggcuuucaaauucccuacguaacguaugaugaggauuaugagcaacugguugaggauaucgucagggacggccgacuguacgcaucagaaaaccaucaggaaauucuuaaggauaaaaagcugauaaaggccuuuuuugaggugcuugcccacccucaaaacuauuuuaaguauaccgagaagcacaaggagaugcugcccaaaagcuucauuaaacuucugagaucuaaggucuccucuuuccugcgaccuuacaaauag

SEQ ID NO: 11954 - RNA, 4773 nt, Artificial Sequence
  Description of Artificial Sequence: Synthetic coding sequence
augccagggggggcaugcguauuggucaucgcuuuaauguuccuugccuggggagaggcucaggagugcuccccuggaggacaccaauucuugagauccccuuacagaagugugagauucgauuccuggcaccuucagcagucugccgugcaagaucugauaugcgaucauucauugucacccggaugguauagguuucugauccuggauaggccggcugagaugcccacuaaguguguggagaugaaccacugugguacucaagcacccaucuggcucagucucagggauagugagacccuuccuucucccggagagauuaagcaacucacagcuugugccacauggcaauuuuuguuuagcacuacuaaggacuguugccuguuucagaucccagucucaguaaggaacuguggaaauuucaguguuuaccugcugcaaccuacucagggguguaugggcuacugugccgaagccaucagcgaugcaagacuccacccaugcggcagugacgagacggagacaggcggggacugcgugcggcaacuggcugcuucccuuccaccuccgccagcagggcgcccagaaguuuuaguugaacugauagaaagccgauuauuuugccgcuguaguuuugaugugccagcuacuaaaaauaguguuggauuucacaucgcuugguccagacugagcagccaggaggucaaagaggaguugacccaagaaacaacaguacaggccuuuaguuuauuggagcucgauggcaucaaccugagacugggcgaccguaucuucugcuccgcuagugucuucuuucucgagaacccacaugugcaaucaguagcuaucgaaucccaggaguuuuucgcgggcuucaaacuccagccugagcugagcacuauuucugaggauggcaaagaguacuacuugcgcaucgaaucaacaguuccaauaauuugcucugaguuuagugaacuggaccaggaguguaaaaucagucuuaagcugaagacaaucgggcaagggagagaacaucuuggacugaaccuugcucucuccagcugucacgucgaucucuuacagacgucaucaugcgccaacggaaccugcucacacaccuucguguauuauaccgcugucacugacuuuagccgagacggcgacaggguuagcaacaucguggugcaaccaauugugaaugaggacuuucuguggaauaacuacaucccagacucuauucagauaaaggucaaagacguaccgaccgcauacugcuauacuuucaccgacccgcacauuauuacauucgacggaagaguguaugacaacuuuaaaaccgggaccuucgugcuguacaaaagcaugagcagagacuucgaggugcauguucggcagugggauugccggagcuugcauuaucccgucagcuguaacugcgguuucguggcgcaggaggguggcgauaucgugacauucgauauguguaacggacagcuacgagagagccagccuuaucuuuuuauaaaaucgcaagaugucacaaggaauauaaaaaucucagaaucauaucuaggccguaaagugacaauuugguucaguagcggugccuucauucgagcugaccucggugaguggggaaugucccugaccauucgagcuccuucaguggacuauagaaacacacuuggccucugcgggaccuucgaugagaacccagaaaaugacuuucacgauaaaaacggcaugcagauugaucaaaacuuuaacaauuauguugccuucaucaaugaauggaggauauugccuggcaagucaaugagcgauacauugccugugaguaugacaucacccggaaagcccucauacugcucuuguaguuuggauacagccgcguacccgaguucagaagaccuggacucagucagucguuccgagauugcucugggcuguaaggaccuuaaucaugucagucugagcagccugauccccgagcucgacgugaccuccgaauacauuaauagcgacacucuugucagggagaucaauaaacauaccagucccgaagaauauaaccugaaucuguuccugcaagagaagaaacacauuaaccuuaccaagcugggcuugaacguacaaaagcacccuggcaacgagaaggaagacagcuuacaguaucucgccaauaaaaaguauacccagggacguggcucgcacagucaggagaugagauacaaccgucagaacagauggaagaggcagaacuuccacgaauuuccucccuuauuugcguuuccuagccugagccagacggaccuggaggaauuaacuuauuucuuccccgaggaucaugccgaggacgugcagcaagaauucuuucccagcuggccaaccccaagcggccugacugaguacuccacuuuaaccuugugccaggagacacuagcuaacucuagcaucggccgacucugucuugccuucuugggcaaaaggcuggacagcguaaucgagaugugugugaaagacguccugcugaaggaugaccugaguugggccgaagcuggcguggcucuucuagagaaugaaugugaaaaacgcaucguugaagaagggaaguauaacacagaggaauacggcacaucaaucgaggauaucuuguccgugcuuaagugcccaaaucugugcagcgggaaugggcagugcauggaguggggcugugcauguucuccuucuuucuccagcuaugacugcucugauuccuacgacaaggcgcccgagauuacagaacuggguaaugccggauuuugugauguacagaaguauaauuguaugauggugcgaguguucggcaagggcuuuaaggaguugcccucuaucaagugcgaggugacgaaacuacaguacaacucuagcgaguggaugccaggcgagcccaucuacacacagacagucuuucauaacagccgggcuguugacugucaacugccuacagaugugcagcaguuugacacaauggaccuagugggcgguaaaccuacggguaaguggcagcuaaagguguccaacgauggauacaaauuuaguaaucccaaaauaaccgugaucuaugauggcgcaugccaagugugcgggcuguauaaaaacgacuccuguacuauuaaagaaaacgucuguauaaucgacggacuuugcuacguagaaggugauaaaaauccaaccucuccgugccugaucuguagacccaaaaucagucgguucacuuggucuuuccuggagaauaaucagccucccgugauacaggcccugcaggauaagcuccaaaccuucuacggcgaaaacuucgaguaucaguucguggccuucgauccggaagguucagacauacacuuuaccuuggauucuggccccgagggggccagcguuagcagugcgggacuuuucauguggaaaacugaucugcucaccacucagcaaaucacaguucgccuaaaugaugacugcgacgccgaaacucgcgucacgauugaagucaccgugaagagcugugauugccuuaacggcggcuccugcgucucugaccgcaacuucuccccaggaaguggagucuaucuguguguaugcuuaccuggauuccauggaucccuuugcgagguugacauuagugggugucaguccaauccuugugguuugggauccuacauuucaggauuucauuccuauagcugugacugcccucccgaauugaagguggagacacaguuugugaaucaguucacuacacagaccgucguguugacaagaucugacaaaagcgugaacaaggaagaagaugacaagaaugcccaagggaggaaaagacacguuaaaccaaccagcggcaacgccuucaccauauguaaguauccaugcggcaaaucucgcgaguguguggcuccaaauauaugcaagugcaagcccggguacaucgggucuaauugccagacagcccugugcgaucccgacuguaaaaaccauggaaaauguaucaaacccaauauuugucaaugcuuaccaggucauggcggagcuacaugugacgaggagcacugcaacccuccaugccaacacgguggcacaugccuagcagguaaccucugcacuugccccuacggguucguggguccacgaugugaaacaauggucugcaacaggcacugugaaaauggcggccaaugucuaaccccagacauuugucaguguaaaccgggcugguauggcccaaccuguucgaccgcgcuuugugauccagucugucuaaaugggggauccugcaauaaaccaaacacuugccuguguccgaacggauuuuucggggaacauugucaaaaugcguucugccauccucccugcaaaaauggaggucauugcaugcgcaacaaugugugugugugucgcgaaggguauacuggaagacgguuucaaaagagcauuugugacccuacuuguaugaacggcgguaaaugcgucggaccaucuacuugcuccuguccaagcggguggagcgggaaacgaugcaauacuccuaucugucugcagaaauguaagaacggcggggaauguauugcacccucaaucugccauugcccgaguucuugggagggcguucgaugccaaaucccuauaugcaauccuaagugucuuuauggagggcgguguaucuuuccaaacgucuguucuuguaggacagaguauucuggugucaagugugagaagaaaauccagauccggaggcacuag

SEQ ID NO: 11955 - RNA, 624 nt, Artificial Sequence
  Description of Artificial Sequence: Synthetic coding sequence
augucgacuaaaccugauaugauccagaaaugcuugugguuggaaauccucaugggaauauuuaucgcaggaacacuuucacuggauuguaacuuacucaacgugcaccugagacgcgugacuuggcaaaauuugagacaccucagcucuaugucaaauucauuccccguggagugucucagagagaauauagccuucgagcucccgcaagaguuucuucaguacacucaaccaaugaagagagacaucaaaaaagcguucuacgaaaugucacugcaggcauucaacaucuucucucagcauacuuucaaauauuggaaagagcgacaucugaaacagauacagauuggguuggaucaacaagcggaauaccuuaaucaaugccuugaagaagacaagaacgagaaugaggacaugaaggagaugaaggaaaacgagaugaagccaucggaggcucgggugccacagcugucaucucuagaguugcgacgcuauuuucacagaauugauaauuuucugaaagaaaaaaaauacucggacugcgcaugggagaucgugagaguggagauucgccggugccucuacuacuucuauaaguucacagcacuguuuagacggaaauag

SEQ ID NO: 11956 - RNA, 939 nt, Artificial Sequence
  Description of Artificial Sequence: Synthetic coding sequence
auggagucagcuuuacccgcggcaggguuuuuauacuggguuggagcuggcacugucgcauaccucgcacugaggauuucauacagccuguuuacugcguugagaguguggggggucggcaaugaggcaggggugggucccggccuuggagaaugggccgucgugacuggaucaaccgacgggauuggcaaaucauacgcugaagagcuugccaaacaugguaugaagguaguccucauuuccagguccaaagacaagcuggaucaagucaguucagagauaaaggaaaaguuuaaaguugaaacuagaacuaucgcugucgauuucgcauccgaagacauuuacgacaaaauuaagacugggcuggccggucucgagaucgggauucucgugaauaacguaggcaugucauaugaguacccagaguacuucuuggacguccccgaucuggauaacguaauuaaaaaaaugauaaacauuaauauauuguccgucuguaagaugacucagcugguucugcccggcauggucgaacgguccaaaggggcaauacuaaauauuaguucagguucugggaugcucccugucccccugcuaaccauuuacucagcuacaaagacguuuguagacuucuuuucccagugucugcacgaggaauaccgcagcaaaggcguguucgugcagucuguguugcccuauuucguagccacaaagcuagcgaaaauuagaaagccuacccuugauaaaccaucaccugaaacuuuugucaaauccgcuaucaagaccgugggccuucagucuagaaccaauggauaucuuauucacgcucugauggguaguauaaucucaaaucugccaucuuggauuuaccucaaaauugugaugaacaugaacaaguccacuagagcacacuaucucaagaagaccaagaagaacuag

SEQ ID NO: 11957 - RNA, 2214 nt, Artificial Sequence
  Description of Artificial Sequence: Synthetic coding sequence
auggagcuggguugcuggacccagcugggauuaacauuuuuacagcugcugcuuauuaguuccuugccucgagaauacaccgugaucaacgaggcauguccaggagccgaauggaauaucaugugucgcgaauguugugaguacgaucagauugaguguguuugccccgggaagcgggaggugguagguuacacaauaccgugcugucggaacgaagaaaacgagugcgacuccugucucauccacccuggcuguacuaucuuugaaaacugcaaguccugcaggaacgguucgugggggggcaccuuggaugauuuuuacguaaagggauuuuauugugccgaaugucgcgccggcugguauggcggggacuguaugcgcugcggccaaguacuuagagcaccuaaagggcaaauucugcuagaguccuauccacugaacgcccacugugaguggacaauccacgccaaaccaggcuucgucauucaguugagguuugugaugcucucucuagaguuugacuacaugugccaguacgauuacguggaggugagggacggugacaauagagacggacagauuaucaagagaguguguggcaaugaaaggccugcccccauccagagcaucggcucuagccuccacguucuguuucacuccgacggauccaaaaauuuugacgguuuucaugcaaucuacgaagaaaucacugcauguaguuccucaccaugcuuccacgauggcaccuguguccuggacaaggcugguagcuauaagugcgcaugccuggcgggauauaccggacagaggugugaaaaucuucuugaagcuggaaaaagcaagauaaaagccagcgaagacucccuuuccgugcucgaagaacggaacuguucugauccugggggcccagugaacggcuaucagaaaaucacagggggaccaggccugaucaacgggagacaugccaaaauugguacugugguaagcuucuuuugcaauaacaguuacguucugucuggaaaugaaaagcgcaccugccaacagaacggggaauggagcgggaaacaacccaucugcauuaaagcauguagagaaccaaagaucucggaucuugugaggagaagaguacuaccuaugcaagugcagucuagggaaacuccacuucaucagcuguauuccgccgcuuucagcaaacagaaacugcagucugcgccaacuaagaagccugcacuucccuucggagaucugccuaugggcuaucagcaucuacauacucaauugcaguaugaauguauuucacccuucuacagaaggcuggguagcucccgccggaccugcuuaagaaccgguaaguggucggggcgggcgcccuccuguaucccgaucugcggcaaaaucgagaauauaaccgcuccaaaaacgcaaggucugcgcuggccuuggcaggccgccauauauagacgcacgucuggaguccacgacggcucccuucauaaaggcgcuugguuucuuguguguagcggggcucuggugaacgaacgcacuguggugguggccgcucacugcgugaccgaccuuggaaaagucaccaugaucaagacagccgacuugaaagugguucuuggaaaguuuuauagagacgacgaucgggaugagaagacgauccagucacugcagauuucggcuauuauucuccacccgaauuaugauccaauccuucucgacgcugauauugccauucugaagcucuuagauaaggcuagaauaaguacccgagugcagcccaucugucucgcagcgagccgagaccucaguacaagcuuccaggagucucacauuacaguggcuggauggaauguacuugcagacgugagauccccuggauuuaagaacgauacccucagaagcggcguggugagugugguggauuccuugcuaugugaggaacagcacgaagaucaugggauaccggugucuguuacagauaauauguucugcgccaguugggaaccaacggccccuagugauauuugcaccgcagagacuggcgggaucgcagccguguccuuuccugggcgagccucuccugagcccagauggcaccucaugggccuuguaucuuggaguuacgauaagacaugcagccacaggcucuccacagccuuuaccaagguccugccauuuaaggacuggauugaacggaacaugaaauag

SEQ ID NO: 11958 - RNA, 1503 nt, Artificial Sequence
  Description of Artificial Sequence: Synthetic coding sequence
augggcaccgccagauggcucgcacugggcagucuguucgcucucgcgggacuccuugaggggagacuggucggcgaagaagaagcuggguuuggugagugugacaaauucuuuuaugccgggacuccaccggccggccuugccgcagauucacacguaaagauaugucagagagcagagggugccgagagauucgccacccuguacuccaccagggacagaauuccagucuacucugcuuuucgcgccccacggccugcucccggcggcgccgaacagagguggcugguugaaccccagaucgaugaccccaauucuaaucuggaagaagccaucaacgaggcugaggcaaucacgucggugaacucccucggaaguaagcaagcucugaacaccgauuaucuggacagcgacuaccaaagaggccaguuguaccccuuuucucuuucaucugaugugcaagucgcaacauucacccugacaaauucugccccaaugacgcaaucauuucaggaacguugguacgucaaucuccacucucugauggaucgagcacugacaccccaaugcggcucaggcgaggauuuauauauacugacaggcaccgugccuagugauuaucgagucaaagacaaaguugcagucccggaguuuguuuggcuugcugccugcugugcaguccccgggggcggcugggcgaugggguuuguaaaacauacucgggauagugacaucauugaggacgugauggucaaggaucuccaaaaacuucugcccuuuaauccacagcuguuucagaacaauuguggggaaacugaacaggauacugaaaagaugaaaaagauucucgagguaguuaaucagauacaggacgaagagcggauggugcagagccagaaauccuccuccccccuuuccucuacacgcucuaaaaggucgaccuuguugcccccugaggcauccgaagggucuucaucauucuugggcaagcugauggguuuuauugccacacccuucaucaagcucuuucaacugaucuacuaucuggucguggcaauccugaagaauaucguguacuuucucugguguguuacaaaacaggugaucaaugggaucgaaucuugucucuacagacuuggauccgcgaccaucagcuauuucauggcgaucggcgaggaguugguuagcaucccauggaaagugcuuaaggucguggccaaggucauccgugcccuacucaggauucuuugcugccugcugaaagcaaucugcagggucuugucaaucccagugagagugcugguagacgucgcaacauuucccguguauaccaugggagcaaucccuaucgucuguaaagauaucgcauugggacuggggggcaccgucucucugcucuucgauacagccuuugggacccugggagggcuguuccagguggucuuuagcguuuguaagagaauuggcuauaaaguuaccuucgacaauagcggcgaacuguag

SEQ ID NO: 11959 - RNA, 300 nt, Artificial Sequence
  Description of Artificial Sequence: Synthetic coding sequence
augaaaucagcaaaguugggcuuccuccuaagguuuuucauauucugcagucucaacacccuguuacugggcggaguaaacaaaauagcggagaaaaucuguggagacuuaaaagacccauguaagcuggacaugaacuucggcucuugcuacgaggugcacuuuagauacuucuacaaccggacaucaaaacgcugcgaaacuuuuguguucuccggcugcaaugguaauuugaauaacuucaaacugaagaucgaacgagagguugccuguguggccaaguauaaacccccuagauag

SEQ ID NO: 11960 - RNA, 390 nt, Artificial Sequence
  Description of Artificial Sequence: Synthetic coding sequence
augccgauggccucgccacaaacacuggucuuauaucugcucguguuagcugucacagaggcuuggggccaggaagcagugaucccuggcugccaccuacaucccuucaauguuacgguccgguccgaccgccaggguacaugccaaggaucccacguggcacaagcuugugucggacauugugaaaguagcgcuuucccuucaagauauucuguacucguggcuagcggcuacaggcacaacaucaccagugugucccaaugcuguacaaucuccgggcugaaaaaggucaagguccagcuccaguguguggggagccgacgagaagagcucgaaauauucaccgcccgagccugucagugcgauaugugucgccuuagccgguacuag

SEQ ID NO: 11961 - RNA, 1965 nt, Artificial Sequence
  Description of Artificial Sequence: Synthetic coding sequence
auggcgaaauuugggguucaucgcauccuucuucuggccaucucuuugacgaagugccuggaauccacaaaacuacuggcugauuugaagaaguguggggaccuggaaugugaagcacuuaucaauagggucagcgcaaugagagacuauaggggcccagauugccgguaccuuaacuucacuaaaggagaagagaucagugucuacguuaaguuagccggagaaagggaggaucuaugggcaggcucuaagggcaaagaguucggauauuucccucgggaugcuguacagauagaagaaguguucaucagcgaggagauacagaugucuaccaaggagucugacuuccugugccuuuuaggcgugaguuacaccuucgacaaugaggauucagagcucaacggugacuacggagaaaauauuuauccauacgaggaagacaaggacgagaagucuucuaucuacgagagcgauuuccaaauugaaccgggguuuuaugcgacuuaugagaguacucuuuucgaagaucaggugccagcacuggaggcccccgaagacauuggaagcaccucagaaucaaaagacugggaagaagucgugguggagagcauggagcaggaucgcauuccggaagugcacguaccuccauccagugccgugagcggugugaaagaaugguuuggccuggggggagaacaagcugaagaaaaagcauucgaguccguaaucgagccugugcaggaguccucuuuccguucacgaaaaauugcgguugaggacgaaaaugauuuggaggagcucaacaauggcgagccacagaccgaacaccaacaagaauccgaauccgagaucgauagcguuccaaagacacagucugaacuagccagcgagucagagcauauacccaagccccagucuacuggcugguuugguggaggguucacaaguuaucuaggguucggcgaugaggacacaggacuggaacugauagccgaagaaucgaauccucccuuacaggauuucccaaauuccauuucuuccgacaaagaagcuacuguuccaugcacagagauccucacugaaaaaaaagacacuaucaccaaugacagccuguccuugaaaccaucuugguuugauuucggcuucgcgaucuugggcuuugcuuaugccaaagaagacaaaauuaugcuugaugacaggaagaacgaggaggacgggggugcggacgagcaugagcauccguuaacgucugagcucgauccagaaaaagaacaggaaauagaaaccauuaagauuauagagaccgaagaccagaucgacaagaagccaguauccgaaaagacagacgaaucggauacgauuccuuaccugaagaaauuucucuacaacuuugacaacccauggaacuuccaaaauauucccaaggaaaccgagcuuccuuuucccaagcagauucuggaccagaacaacgugauugagaacgaggaaacgggggaauuuucaauugauaauuaucccacagauaacacaaaggucaugauuuucaaaagcucuuauagccucuccgauaugguguccaacauugaacucccuacaaggauccaugaggaagucuauuuugaaccaucuuccagcaaagacucugaugagaauucuaagccaucgguagacacagaaggaccugcccuaguagaaauugaucgaucuguggaaaacacccugcuuaacagucaaauggucuccacagacaacucacugucaucacagaauuacauuagccaaaaagaagacgcuucagaauuccagauucucaaguauuuguuccagaucgacguuuaugauuuuaugaacagcgcuuuuagccccaucgugauuuugacagaaagaguuucccuuccuuucaagcccuuugcuauuauccugccgaucuugcuaaauauuagaguugccacaaaguacguguag

SEQ ID NO: 11962 - RNA, 1152 nt, Artificial Sequence
  Description of Artificial Sequence: Synthetic coding sequence
auggcgggcaucccagguuugcuuuuccuacuuuucuuucucuugugcgccgucgggcagguaucuccguacagcgcaccauggaagcccacauggccagcauaccgcuugcccgugguauuaccucagucaacauugaauuuagcaaagcccgacuucggcgcggaggccaaguuggaagucagcucuucuugcgguccgcagugccacaaaggaacgccacugccgacauacgaagaggccaaacaguaucuaagcuacgagacauuguaugcaaaugguucuagaacagaaacacagguugguauauacauuuugucaucgucaggagauggugcccagcauagggacucaggaucuucagguaaaucacgccguaaacgacagaucuaugguuacgacagcagguuuagcaucuucggcaaagauuuucuccuuaacuaucccuucucgacuucagugaaacugucuacagggugcacuggaacgcuugucgcggagaaacauguuuugaccgccgcccacuguauccacgauggcaaaacuuacguaaagggaacucagaaguugagagugggguuccugaagccgaaauuuaaggaugguggccggggcgcuaacgauucaacaagcgccaugccugagcagaugaaauuucaguggauaagagugaagagaacucacgugccuaagggguggauaaagggcaacgcuaaugacauuggcauggauuaugauuaugcauuacuggaacucaaaaagccccacaaaagaaaguuuaugaaaaucggaguaucgcccccugcuaaacaacugccagguggcaggauccacuuuagcggguaugacaaugacagaccuggcaaccucguguacagguucugcgaugugaaggacgaaacuuacgaccugcuuuaucagcaaugugacgcacaacccggggccagcgguucuggcgucuacguccggauguggaaacggcaacaacagaaaugggagaggaaaauaaucgguauuuuuucagggcaucaguggguggacaugaacggcucuccccaagacuucaaugucgccgucaggauuacaccuuuaaaguaugcacaaauuuguuacuggaucaaggggaauuaucucgauugucgcgagggauag

SEQ ID NO: 11963 - RNA, 1662 nt, Artificial Sequence
  Description of Artificial Sequence: Synthetic coding sequence
augaaaugguguuggggcccugugcuccucauugccggugccaccguccugauggagggccuacaggccgcccaacgggccugcggucaacggggcccuggcccaccgaaaccacaggagggaaacaccgugccuggagaguggccauggcaggcauccgucaggcgccaaggugcgcacauaugcagugguuccuuaguggcagauacuugggugcugaccgcugcccauuguuucgagaaggccgccgcaacugagcucaacucuuggucuguugugcugggcagcuugcagagagaaggucuuaguccaggcgccgaggaaguuggaguggccgcucugcaguuaccacgggccuacaaccacuauucacaaggcucugauuuagcuuuacugcagcucgcucaccccaccacgcacacaccucucugccugccucaaccggcgcaccgcuuuccauucggugcaucuuguugggcuaccgguugggaucaggauacuagugacgcacccggaacccugaggaaccugagguuaagacucaucucgcggccuaccuguaauuguaucuauaaucagcuccaccagcggcacuugaguaauccagcccgucccgguaugcuuugcggcggaccccagccagggguucagggcccgugccagggcgauagcgggggaccuguauuaugccucgagcccgacggacauuggguacaggccggcaucaucucauuugccuccuccugcgcacaagaggaugcuccuguacugcugaccaacacagccgcucauucuagcuggcuucaggcccgugugcaaggcgcagccuuucuggcucagucgcccgagacgccagagaugucggaugaggacucaugugucgccugugguucccugaggacugcuggcccucaggccggcgcuccaagcccauggccaugggaggccaggcucaugcaccagggccagcucgcuugcggcggagccuuagucuccgaggaggcaguuuugacggcugcucacugcuucaucggucgacaggccccagaggaaugguccgucggauuggggacaagaccagaggaguggggacugaaacagcucauacugcacggggcguacacccacccugaaggugguuacgauauggcccugcuuuugcuggcacaaccagucacacugggagcuucccugaggccacugugccugcccuaccccgaccaccaccugcccgauggcgagcgaggauggguguuaggcagagcuaggccgggcgcuggcauaucgucucuccagacagucccagucacacuguuggguccccgcgccuguucccggcuccaugccgcacccgguggcgaugggucaccuauacuacccggcaugguuugcacauccgcugucggagaguugccauccugcgaaggccucucuggcgccccacuaguucacgaggugcgagguaccugguuccucgcuggacuacauucauuuggagaugcaugccagggaccagccagaccagcuguguuuacugcguuaccagcuuaugaagacuggguuagcucccucgacuggcagguuuauuuugccgaggaaccagaaccagaagcagaacccggcucaugccuggccaacauaucucagccuacgucguguuag

SEQ ID NO: 11964 - RNA, 936 nt, Artificial Sequence
  Description of Artificial Sequence: Synthetic coding sequence
augggaauuauucagucaaucuuggccaccucaagagacuguuacuccuuuaagaaaaaacccauacccaaaaaaccaacuaugcuggcccuggccaaaauacugcugauuaguacgcuauucuauucccugcugucuggaucacacggaaaggagaaucaggauauuaauacaacacaaaauauugcugaagucuucaagacaauggagaauaagcccauuucccuagaauccgaggcuaaucuuaauagcgauaaggaaaauauuacaaccucuaaucucaaagcuucucauucuccaccacucaauuugccuaacaauucacacggaaucacugacuuuaguagcaacaguucagccgaacacucccuuggcagccuuaagccuaccuccacaauaagcacaagccccccgcuuauccacucauuugucuccaagguaccuuggaacgccccaauugccgacgaggaccugcuuccaaucuccgcgcaccccaaugccacccccgcucuaagcagcgagaauuucacuuggucacuggucaacgauaccguuaaaacuccugauaauaguucuaucacugugucuauucuguccucagagcccacuucccccagcgucaccccucucaucguugagccaucaggcuggcugacuacgaauuccgacagcuuuacuggauuuacacccuaucaagaaaagaccacucugcaacccacccugaaguuuaccaacaauuccaagcuauucccuaauacaagugacccccagaaggugcugcgacuggauaacgcccccgaaccauaugaugugucauuuggcaauagcuccuauuauaacccgacccugaacgauagugcuaugccggagucugaagaaaaugcuagggacgguaucccuauggaugauaucccuccacuucgcaccucggucuag

SEQ ID NO: 11965 - RNA, 3120 nt, Artificial Sequence
  Description of Artificial Sequence: Synthetic coding sequence
augcagaguagacugcuccugcugggugcuccagggggacacggcgguccugcuagccgccgcaugcgguugcuccucagacaggugguacaaaggcguccuggcggcgaucgccagcggccagaggugaggcuccuccaugcaggguccggcgccgacaccggagacacaguuaacauaggcgacgugucguauaaauuaaaaaucccaaaaaaccccgaauuaguaccacagaacuacauuuccgacucacucgcacaguccguuguucaacaucuucgcuggauuaugcagaaagaucuguuggggcaggauguguuuuuaaucggucccccaggcccgcuccgccgcucaaucgcaaugcaauaucuggaguugaccaagcgggaaguugaguauaucgcgcuuagccgggauacaacugaaacggaccuuaaacagagaagagagauuagggcaggcacugccuucuacauugaccagugugcgguaagagcagcuacugaaggucgcacacucaucuuagaaggauuggagaaagcugagcguaauguucuuccugugcugaacaaucuucucgaaaacagggagaugcagcuggaggauggaagguuccucauguccgcagagagauacgacaaauuacuuagagaucauacgaaaaaagagcucgauagcuggaaaaucguucgcgugagcgagaauuucaggguaauugcacuggggcugccgguccccagauacagcggaaacccccucgauccaccccucaggucaagauuucaggcuagagacaucuacuaucuaccguucaaggaccagcugaaacuccuuuauaguauuggcgccaaugugagcgcagaaaaagugagucagcucuuaaguuucgcgacuacucugugcucucaggaaagcagcacacuugggcuuccugauuuuccucuggacagucucgcugcagcuguacagauccucgacuccuuccccaugaugccuaucaaacaugcaauucaguggcucuaucccuauuccauucugcugggacacgaagggaaaauggccguggaaggcguccucaagcguuucgaguugcaggauuccgguagcucucuuuugccaaaagaaauuguuaaggucgagaaaaugauggagaaucaugucucucaggccagcgugaccauucguaucgccgacaaggaaguaacaaucaaagugccagccgguacacgucugcucucucaaccuugugcuuccgaucgcuuuauccagacucuuagccacaaacaacuccaagcagaaaugaugcagagccauauggugaaagacauuuguuugauuggggguaaaggaugcgggaagacuguaauagccaaaaacuuugcugacacacuggguuacaauaucgaaccuaucaugcuguaccaggacaugacugcucgggaucugcugcagcaacgguauacguuacccaacggagauacggccuggcgaagcucaccccuugugaacgcagcucuggaaggaaagcuugugcuacuggauggcauucaccgggugaacgccgggacacuggccgucuugcaacgucugauccacgacagggaacuuucccuuuacgauggcuccaggcugcucagagaagauagguauaugagacucaaagaagagcuccagcuuagcgacgagcaacugcagaaacgcagcaucuucccgauccacccgaguuucagaauaaucgcacuggcagagccuccagugaucgggucuacagcucaucaguggcuagggccugaguuccugaccauguucuuuuuccacuauaugaagccccuuguuaaaagcgaggaaauccaggugaucaaagagaaagugccaaacgugccacaggaggcacuggauaagcugcuguccuucacucacaaguugcgagaaacacaggacccaacagcccaaucccucgcugcaagccucuccaccaggcagcuucugcgaauuucccggagacuuucccaauauccaaacgagaaucuucacuccgcggucaccaaggcuugccugucucgcuuucuccccucgcuggccagaucugcacuggagaagaaccuggccgaugccacaaucgagauuaauacagaugacaacuuggagccugagcucaaagauuacaagugugaagucacuagcggcacucuuaggauuggcgccguuucggcccccaucuauaacgcccaugagaagaugaaggucccggaugugcuuuucuaugauaauauucagcacgugaucguaauggaggacaugcugaaagacuuuuugcucggggaacaccuccugcuggucgguaaucagggugucgggaagaacaaaauaguggauagguuccuacaccuccugaauagaccaagggaguacauucagcuccaucgcgacacaaccguccagacccugacacuacagcccagugugaaggauggacucauaguguaugaggacucaccccuggugaaggcugucaaguuaggccauaucuuggugguugaugaggcagauaaggcacccacaaauguaacaugcauauugaagacgcugguggaaaacggcgagaugauccucgcugauggucgccgcauaguugcaaauucugcaaacguuaacgggcgggaaaacgugguggugauccauccagauuuccgaaugauugugcuugcgaaucggccaggauuuccuuuuuuggggaacgauuucuuugggacccucggcgacauuuucucgugccaugcaguggacaacccaaagccccauucugagcucgaaaugcugagacaauauggaccgaacgugccggaaccaauuuugcagaagcugguggcugcuuucggggaguugcguucacucgcagaccagggcauuauuaacuaucccuauucaacccgcgaagugguaaauauagugaagcaucuccagaaguuuccgacugagggcuugaguaguguaguaagaaacguauuugauuuugauagcuauaauaaugauaugcgugaaauauugauaaacacucugcauaaauauggaauuccaaucggagccaaacccacaagcguccagcuugcuaaggaguag

SEQ ID NO: 11966 - RNA, 801 nt, Artificial Sequence
  Description of Artificial Sequence: Synthetic coding sequence
augcgccuccuguuucuugcuguccugaggccccacaccgggaaugcagucacggcucagagggugcgggcucaucuugaagcggcaggacauguaugugugcucaaggacgccuucgacuucgagagccgaucugaaaucgccaacuugauucuggcugaaaacugugaagccgcacuugcuuugcaccuguaucggggcggccgacugcuccaaggccaucgcaucccuuuuggggucauuuuuggagggacagaugucaacgaagaugcuaaccaggcagagaaaaauacggugauggguaggguguuggaagaagcccgauuugcagucgcauucacggaaagcaugaaagaaauggcgcaggcacaguggguugauccuguauuuacuagggagguuaaagcgaagguuaagagagcagcuggaguccgacuuaucggggaaaugccacaggaggaucuucacgcugucgugaagaacugcuucgcuguugugaauagcuccguaagugaaggaaugagcgcugcuauacuggaagcaauggaucucgaggugcccgugcucgcaagaaauauuccaggaaaugcugccguuguuaagcacgagguuacaggucuccuguuuagcaacccucaagaguucguucaucucgcaaaaagguuggucucugauccggcgcuugagaaggagauaguuguaaacggccgggaauacguaaggauguaccauucuuggcaaguggagcgugacaccuaccagcaguugauaaggaaguuagagggcuccaccgaagacuag

SEQ ID NO: 11967 - RNA, 2478 nt, Artificial Sequence
  Description of Artificial Sequence: Synthetic coding sequence
auguuuagcggauuuaacgucuuccgagugggaaucaguuucgugauaaugugcaucuuuuacaugccgacgguaaauagccucccugagcugucaccacagaaguauuuuuccaccuugcagccagguaaggccagucucgcauauuucugccaggcagauucgcccaggacgucaguauuccuggaagaacugaaugaagcgguuagaccucuccaggacuaugggauauccguggcuaaggugaacugcguuaaggaagagaucagcagauacugcgggaaagagaaggaucugaugaaagccuaccucuucaaggguaauauucugcuccgcgaguuccccacugacacucuguucgacgucaacgcaaucgucgcucaugugcuauucgcccugcuuuucucugagguaaaguacaucaccaauuuggaagaccuucagaacauagaaaaugcccucaaaggcaaagcaaacauaaucuuuaguuaugugcgggcuaucgggaucccugagcacagagccguaauggaagccgccuucguauacggcaccaccuaccaauucguacugacaacagaaaucgcccuccuggagucuauaggauccgaagacgucgaguaugcccaccuguauuuuuuccauugcaaauuggugcuggaucugacacagcagugucggcgcacccugauggagcaaccucucacuacauugaauauccaccuguucaucaaaaccaugaaagccccacuccugacugaggucgcagaggacccucaacaagucucaacuguacaccuccagcuuggccugccccugguguucauugucucccaacaagcgacauacgaggccgacagacguacggccgaauggguagcguggagacuccuggguaaagccggcguacugcuguuacuaagagacagccuugaagucaacaucccucaggaugcaaaugugguguuuaagcgagcugaggaaggagugccuguggaauuucugguccugcaugacguggaucucauuauuagucacguugaaaacaauaugcacaucgaggaaauccaagaagacgaggacaaugauauggaagggcccgacaucgacguccaggaugacgaaguggccgagacuguguuccgugaccguaagcgcaaacugccucucgaacugacaguggagcugaccgaagagaccuuuaaugcaacagucauggcauccgauucaaucguguuauuuuaugccgguuggcaggccgugucuauggcauuucugcagucguacauugauguggccgugaaauugaaaggaacauccacuaugcugcucacgaggauuaauugugcagauuggucagacgucuguacuaaacaaaacguaacagaguuccccaucaucaagauguacaagaagggggagaacccaguauccuacgccgggaugcuuggcacggaagaucugcucaaguuuauccagcucaauagaaucagcuacccagugaauaucacuucgauucaggaagcagaggaguaccuuucaggagagcucuauaaagaucugauccucuauaguucuguaagcguucugggacucuucucaccuaccaugaagacggcuaaagaggauuuuagcgaagcugggaauuaucuuaagggauaugugaucacggggauuuauagcgaagaagauguccugcuccuaucaacuaaauaugcagccucccuuccugcccuauuauuggcccggcacaccgaagguaagaucgagagcaucccauuggcuucaacccaugcccaagauaucguccagauaaucaccgacgcccuguuagaaauguuuccggaaaucacaguggagaaucugcccucuuacuuccgacuccagaaaccuuugcucauccuuuucucagacgguacggucaauccccaguacaaaaaggccauccugacacuggugaagcagaaguaucuggacagcuucacuccauguuggcugaaucuuaagaauacccccgugggccgcggcauccucagagccuacuuugacccucuucccccacucccucucuugguacuggucaaccuucacuccgguggucaaguguuugcguuucccucugaucaggcaaucauugaggagaaccuugugcucuggcugaaaaaacuggaagcagguuuggagaaccacauuacaauucugccagcacaggaguggaagcccccauugccugccuacgacuuccuguccaugauagacgccgcaacuucccagcgagguacccgaaaaguacccaaguguaugaaggagacugauguucaagaaaaugauaaggaacagcacgaagacaaauccgccguccgcaaggaaccaauugagacccugcgcauuaagcauuggaacagaaguaacugguucaaggaggcugagaagucauuccggcgggauaaagagcuuggcugcaguaaaguuaacuag

SEQ ID NO: 11968 - RNA, 672 nt, Artificial Sequence
  Description of Artificial Sequence: Synthetic coding sequence
augacauggagacaccauguacgacuccucuuuacugugucuuuggcacuacaaaucaucaaucuuggaaauagcuaucagagagaaaaacauaacgggggacgggaagaggucaccaaaguggcuacucaaaagcauaggcaauccccucugaacuggaccucaagucacuucggcgagguaacaggaucugcugagggcuggggcccagaagaaccccucccauacucuugggcguucggagagggugcaucagcaagacccagauguugcaggaauggggguacgugcguccugggcagcuuuugcguuuguccugcucacuucacugguagguacugcgagcacgaucagagaagauccgagugcggagcccuagagcauggggcguggacacuucgagccugccaucucuguagaugcaucuuuggagcucugcacugucugccucuacaaacaccagaccgcugcgacccgaaggauuucuuagcgucucacgcccauggacccucugccggcggcgcacccucacugcugcuccuccuuccuugugcucuuuugcaucgcuugcuuagaccagacgcucccgcccauccacggucccuggugcccucuguucugcaaagggaaagaagacccugcggaaggccggggcucggccaccgucuguag

SEQ ID NO: 11969 - RNA, 1320 nt, Artificial Sequence
  Description of Artificial Sequence: Synthetic coding sequence
augccagcuaucgcaguacuggccgccgccgccgccgccuggugcuuuuuacaaguggaaucucggcaucucgacgcucuagccgguggagccggcccuaaccacgggaauuuccuggauaaugaucaauggcucagcacugugucucaguaugaucgagauaaguacuggaaccgauuuagggacgaugacuauuuccgaaauuggaaccccaacaaaccuuucgaccaggcucuugauccaucuaaggauccuugccuaaaaguaaaguguucuccucauaagguaugcguuacgcaggacuaucagaccgcucuuugcgugagucguaaacaccuguugccucgccagaagaagggaaacgucgcacagaagcacugggucgguccuucuaaccucgugaaauguaaaccuugucccguggcucagagcgcaaugguuugcgggagcgacgggcacuccuauacuucaaaaugcaaacucgaguuucaugcuugcuccacuggcaaaucguuggcaacucugugcgacggccccuguccuugccuuccggaacccgaaccgcccaagcacaaggcagaaaggucugcaugcacggacaaggagcugcguaaucuggcaucucgguugaaggauugguuuggagcccugcaugaagaugccaaucgggugauuaaaccaacuaguucuaacaccgcccagggaagauuugacacuucgauccugccuauuugcaaggauucccucggguggauguucaacaagcuggacaugaauuaugaccuucugcucgauccaagugagauuaaugcgaucuaucucgacaaauacgaaccuugcaucaagccauuguucaacucaugugauagcuucaaggacgggaaacugucuaacaacgaguggugcuacugcuuccagaaaccuggugggcuucccugucagaaugagaugaacagaauccagaagcuaagcaaaggaaaaucgcuauugggcgcuuucauucccagguguaaugaagaggguuacuacaaagcaacacagugucaugguaguaccgggcaauguuggugugucgauaaguauggcaaugaacuggcugggagcagaaaacagggcgcugucagcugugaggaagagcaggaaacaaguggagacuucggaaguggaggcucgguggugcuuuuggaugaccuagaauaugagagggagcucggccccaaggacaaggagggaaagcuuagaguccauaccagagcugugacggaagacgacgaggacgaggaugacgacaaagaagaugaaguuggguauauuugguag

SEQ ID NO: 11970 - RNA, 7872 nt, Artificial Sequence
  Description of Artificial Sequence: Synthetic coding sequence
augaaagugaagggcagagguaucacaugucugcuagugagcuucgccgugauaugccuuguggccacuccuggaggaaaagccugcccaaggcgcugugccugcuauaugcccacagaaguucacuguacauuuagguaucugacaucaaucccagauaguauuccaccaaauguggagaggaucaaccugggauacaauucgcugguuaggcuuauggaaaccgauuucucuggccuuacgaaacuggaacugcugaugcugcauucgaacggaauccacacuauccccgauaagacguucucagacuugcaggcgcugcaggugcugaagaugucguacaacaaggugagaaagcuccagaaagacaccuuuuacggacuccggucccuuacaagauugcauauggaccauaauaauaucgaauucauuaaucccgaaguguuuuaugggcugaauuuucugcgccugguucaucuugaaggcaaccagcucaccaaacuacauccugauacauucgugagucuaucguaucugcagauuuucaagauaagcuucauuaaauuucucuaccugucagauaacuuuuugaccucacucccucaagaaauggugagcuacaugccagacuuggacagccuguauuuacacggaaauccuuggaccugcgacugccaccugaaguggcugucagauuggauccaggaaaaaccagacgucauuaagugcaaaaaggaccgcagccccagcagugcucagcaaugcccccucuguaugaacccuaggaccucuaaaggcaaaccccuggccaugguuucugccgccgccuuccaaugugccaagccuacuauagacaguagucuuaagaguaagagucugaccauccuggaggauagcagcagcgcauucauaagcccgcagggcuuuauggcuccuuucggaucccucacauugaauaugacggaucaaagugguaaugaagccaacauggugugcucuauccagaaaccuucucgcacuagcccuauagccuuuaccgaggagaaugacuacauugugcugaauaccucauucucaacauuucuuguguguaacauugauuacggacacauucagccuguguggcagauucuggcucucuacucugacagcccccuuauccuugagaggagccaucuguugagcgagaccccacagcuguacuacaaauacaagcaggucgccccaaagcccgaggauaucuucaccaacauugaagcggaccugagggccgacccaagcuggcugaugcaggaucaaaucagccugcagcugaauagaacagcgaccacuuuuaguacacugcagauucaauauuccucugacgcucaaauaacacuuccacgggcagagaugcgaccugugaagcacaaauggacuaugaucucgagggacaauaauacaaagcuggaacacaccguccucgucggaggcaccgucgggcuaaacugucccggacaaggagacccaacuccacauguggauuggcugcuagcugacggcagcaaaguucgagccccuuaugugagcgaagauggccgcaucuugauugacaaguccggaaagcuugagcugcagauggcagacucuuuugauacaggcguauaucauuguauuaguucuaauuaugaugaugcugacauuuugaccuacaggaucacagucgucgagccgcuugucgaggcauaccaagagaacggcauccaucacacugucuuuaucggggagacuuuggacuugccuugccauuccacaggaauccccgacgccucaaucagcuggguuauucccggaaacaacguauuauaucagucuaguagagauaaaaagguccuaaauaacggaacucuccgaauccugcaaguaacaccuaaagaucagggauauuacagauguguugccgcaaacccuagcggaguggauuucuuaaucuuccaagugagcgugaagaugaaaggccagaggccucucgaacaugauggcgaaacagaagggucaggccuugaugaauccaaucccaucgcgcaccugaaagagcccccaggcgcucaacuccguacaagcgcccuuauggaggcagaaguuggcaaacauacaaguucuacguccaagaggcauaacuacagagagcugaccuugcagagaagaggcgacucaacccauagacguuuccgagaaaaccguagacacuucccuccuucugcacgacgcauagacccucagcacugggccgcucugcucgagaaggccaagaaaaaugccaugccagauaaacgcgagaacacaaccgugagcccgccccccguggugacacaacuccccaauauccccggggaggaggacgauaguucaggcauguuagcccuccacgaggaguucauggugccugcuacaaaggcccugaaccucccagcucgaaccgucacugccgacuccagaacgauuuccgacucucccaugaccaacauuaacuacgguacagaguucucucccguggucaacagccagauucucccgcccgaggagcccacagauuuuaaacuaucuacugcaauuaaaacaacugcgaugaguaaaaauaucaacccgacuaugucuagccagauucaagguacuaccaaucaacauuccucuacaguuuucccgcuucugcuaggcgcaacggaauuucaagacucugaucaaaugggaagaggaagagaacauuuccagaguagaccgcccauuaccgugaggacaaugaucaaggaugugaaugugaaaaugcugaguucuacaaccaacaaacugcuuuuagaaagcguuaacaccacuaauucccaucaaacguccguuagagaaguuagcgagccuagacacaaccacuucuauagccacacaacccagauacuuagcaccaguacguuucccagcgacccacacacagccgcccacucacaauuucccauaccuagaaacagcacagucaauaucccacuguuccgccgguucgggaggcaacguaaaauugguggccgaggccgaauuauuucccccuauagaacccccgucuugcgacgccaccgcuauucaauuuuucgaucaacuaccagaggcucuucagagaaaagcaccaccgcuuucuccgcaaccgugcuuaacguuacaugccugagcugcuuaccccgugaacgccuaaccaccgcaacagcagcucuaaguuuucccagcgcugcccccauaacguucccuaaagccgacauagcuagagucccaucugaggaauccacgacacuuguccagaauccucuguugcuguuagagaacaagccuucugucgaaaaaaccacaccaaccaucaaguacuuuaggacagagauuagccaggugaccccaacaggugcagugaugaccuacgccccgacaucuaucccuauggagaaaacgcacaaagugaacgcuucguacccaaggguuucuagcaccaacgaagcaaagcgcgauagcgugaucacuucuucccucuccggagccauaacuaagccucccaugacaauuaucgcuauuacccgauuuagccggcgaaaaaucccuuggcaacagaacuucguaaauaaucacaauccaaaagggcgucugagaaaccagcacaaagucagccugcagaagucaacagcggucaugcucccaaaaacuucccccgcacucccuagggacaagguguccccauuccauuucacuacauuaucuaccucaguaaugcagauaccgagcaacacccuaacuaccgcucaucacacuacuacuaagacccauaauccaggcucucugccuaccaaaaaagagcuaccuuucccccccuugaaucccaugcugcccucaauuaucagcaaggacucaucuaccaagagcaucauuagcacccaaacagcaaucccugcuacaacaccuaccuuucccgcuucggugaucacauaugagacucagaccgaacgaucccgcgcacaaacaauucaacgagagcaggagccacagaaaaaaaaccggaccgacccuaauaucucuccagaccagagcuccgguuucacgaccccuacugcaaugaccccuccaguauuaaccacagcugaaacaucugugaagccuucggugucagcauucacucacucuccaccugagaacaccaccgguaucucgucgaccauaagcuuucauagcaggacacucaaucugaccgacgugauagaggagcucgcccaggcaucuacccaaacgcugaaaagcacuauugcuucugagaccacccugucaucaaagucgcaccagucuacuaccacacgcaaggcuaucauucgccacucgacuauucccccuuuucugucaagcucugcaacacugaugccuguuccuauaucuccccccuucacucagagagcagugaccgauaaugucgcuaccccuaucagcggccugaugaccaacaccguugugaagcugcaugaaagcucgcggcacaacgcaaagccccaacaacuugucgccgaggucgccacguccccaaaaguccaccccaaugcaaaguucacuauuggaacuacucacuucauauauuccaaccugcugcacaguaccccuaugcccgcccucaccacgguaaaaucacaaaauucuaaacucaccccaucucccugggccgagaaccaauuuuggcacaagccuuacucggaaaucgcagaaaagggaaagaagccugaaguuagcaugcucgcgacuacgggauuaagcgaggccacaacacucguaagugacugggacggccagaaaaacacaaagaaaucagacuucgacaaaaagccgguccaggaggccacuacuagcaagcuucucccauuugacucccugagucgguacaucuucgagaaaccccgcauugucggaggaaaggccgccaguuuuaccaucccagccaacagcgaugcauuccugcccugcgaagcuguuggcaacccacugccgacuauucacuggacaagggucccaucgggccucgaucugucaaagcgcaaacaaaacucaaggguccaggucuugccaaauggcacccugagcauccagaggguggaaauucaagaucgaggacaguaucucugcucagccucuaacuuauucggcaccgaucaccugcacgugacuuugucuguuguaagcuaucccccuaggauccuugagcgacggacgaaggagauuaccgugcacucugggucgacuguggagcugaaauguagggcugagggaagaccuuccccuacugugacauggauccuggcaaaccagaccgucguuucugagucaucccagggcucucgccaggcuguggugacaguggacggcacauuggugcugcacaaccucagcaucuacgauagaggcuucuacaaaugcguggcuaguaauccugggggccaggacucucuucuugugaaaauccaggugauagccgcaccccccgugaucuuagaacagagacgccaggucaucgucggcaccuggggcgaaucucucaagcucccaugcacagccaagggaaccccgcagccgucgguguacuggguucuauccgacggaacugaggugaaaccccuucaguucaccaauucgaagcuguuucuguucagcaauggcacuuuguauauccguaaucucgcuagcagugauagagguaccuaugagugcauugccacaagcuccaccgguagcgaacguagggucgucauguuaacgauggaggaacgaguuacaucaccucgcaucgaagcugcgagucagaagcgaacggaagugaauuuuggggacaagcuguuauuaaauugcucagcaacaggcgaacccaagccccagaucauguggaggcuucccucuaaggcaguggucgaccagcaacauagggugggaucuuggauacauguuuauccaaauggcucacucuuuauaggaagcgugacugagaaagauucaggcgucuaucuuugcguggccagaaauaaaaugggcgacgaucuuauuuugaugcaugucucccuucggcuuaaaccagcuaagaucgaccacaagcaguacuuccgcaagcaggugcuucacgggaaggacuuccagguggacugcaaagccucagguagccccgucccagagauuucauggagccugcccgacgggaccaugaucaauaaugccaugcaggccgaugacucgggucaccgaacaagaagguacacauuguucaauaaugggacauuguauuucaacaaagucggaguggcugaagaaggcgacuacacuuguuaugcgcagaauacccucggaaaagacgagaugaaagugcaucugacuguaaucacugcagccccaagaauacgucaaucgaacaagacaaacaagcgaaucaaggcuggugauaccgcagugcucgauugcgaggucacgggggaucccaagcccaaaauuuucugguugcuacccuccaaugacaugauuaguuuuucgaucgaccgauauaccuuucacgcuaacgggucccugacgaucaacaaggugaagcucuuggauuccggggaguacgucuguguugcgcgcaaucccaguggggaugacacgaagauguacaaacucgaugucgucagcaaacccccccuaaucaauggauuguacacaaauaggacgguuaucaaggcuacagcaguacgucauucuaagaaacauuucgacugcagagccgagggcaccccaucucccgaggugauguggaucaugcccgauaacauuuuccucaccgcgccuuauuauggaucuaggaucacagugcacaaaaacggcaccuuggaaauacgaaaugucaggcucuccgacucagcugacuucauuugcgucgcaaggaacgagggcggggaaagcguucuagugguccaacuggaaguguuggaaaugcugagacgacccaccuuucgaaaccccuuuaaugaaaaaaucguugcccagcugggaaaaagcacggcauugaacugcucugucgacggaaaccccccgccugagaucauuuggaucuuacccaacggaacuagauucaguaaugggccgcagucuuaccaauaucuuaucgccaguaacggcuccuucauuauuuccaaaaccacucgugaggacgcaggaaaguaccggugcgcugcgagaaacaaagugggcuauauagaaaaacuugucauuuuagagauugggcagaaaccuguuauccugaccuaugcacccgggaccgucaaggggaucucuggggagucacuaagccuccacugcgugucugauggcauucccaagcccaacaucaaauggaccaugccaucuggauacgugguggacagaccccaaaucaacgguaaauauauccuucacgauaacggcacccucgugaucaaggaggcaacagcuuacgacaggggaaacuauauauguaaggcacagaauuccgucggucauacucugaucaccgugcccgucaugauuguagcuuauccaccucgaauuaccaaucgacccccgcggaguauagucacucguacaggcgcagcauuucaacuacacugcguggcucucggcgugccuaaaccagaaaucaccugggagaugccggaccauagucugcucucaacagccucuaaagagcguacucacggaucugaacaguuacaccugcaagguacccuggucauccagaacccucagacauccgacagcgggaucuacaagugcaccgcaaaaaaccccuuaggaagcgacuaugccgccacguauauccaggugaucuag

SEQ ID NO: 11971 - RNA, 1995 nt, Artificial Sequence
  Description of Artificial Sequence: Synthetic coding sequence
augaaaaccggccuguucuucuugugucuucuggguacagccgccgccauuccuacaaaugcuagguuacuuagcgaccacucuaagccuacagcugaaaccgucgcccccgauaacacugcaaucccaucucugcgcgcugaggcugaggagaacgagaaagagacagcgguuuccacagaggaugacagucaccacaaagcugagaaaaguucugugcuuaagucuaaggaagaaucgcacgagcagagugccgaacaggguaagucgucuucccaagaauugggauuaaaggaccaagaagacagugacggccaucugucuguuaaccucgaauacgcaccaaccgaggggacccuggacaucaaagaggacaugucugaaccacaagagaaaaaacugucugaaaacacugauuuucuggccccaggagucuccuccuucacugacaguaaucaacaagagucaauaacuaaaagagaagaaaaccaggagcagcccaggaauuauucucaccaccaacuaaaccgguccagcaaacacucucagggucugcgugaucaaggcaaccaggaacaggauccaaauauaucuaauggagaggaagaggaggaaaaagagccgggagagguggggacucacaacgauaaccaggaaaggaaaaccgaacuuccaagggagcacgccaacaguaaacaagaagaagauaauacacagagcgaugacauuuuagaggaaagcgaucagcccacgcagguguccaaaaugcaggaagacgaauuugaccagggcaaucaagagcaggaggacaauucaaacgcugagauggaggaagagaacgccaguaaugucaacaagcacauccaagagacugaauggcagucucaggaaggcaagaccggacuugaagcuaucucuaaucacaaggaaacagaggaaaagacagucagcgaagcuuuauugauggaaccgacggaugacgguaacacaacaccuagaaaucacggcguggaugacgacggcgacgacgauggugacgacgggggcacugacgggccucgccacagugccagcgacgacuauuuuaucccuucccaagccuuccuggaggccgagcgcgcccaaagcaucgcuuaccaucugaaaauugaagagcaaagggaaaaaguacacgagaacgagaacauaggcaccacggagccaggggagcaccaggaagcgaaaaaagcagagaacuccucuaaugaagaggaaacuagcagcgagggaaacaugcgugugcacgcuguugacucuugcaugucauuucaguguaaaagaggacauaucugcaaggcagaucaacagggaaaaccccacugcgugugccaggauccugugacaugccccccaacaaagccucuggaccagguguguggcacugauaaucagaccuacgcgucaaguugccaccuauuugcuacgaaaugucgcuuggaagggaccaaaaagggacaucaguuacagcuggacuauuucggcgccuguaaaucaauccccacguguacggauuucgaagugauucaguuuccccugcggaugagggauuggcucaagaacauacugaugcaguuauacgaggccaacuccgagcaugccggauaccugaaugagaagcaaagaaacaaaguaaagaagauuuaucuagacgagaagcgccugcuugccggagaccaccccaucgaccugcuucugagagauuucaagaaaaauuaucacauguacguauauccuguccacuggcaguucucugagcuagaccagcacccaauggauagaguucucacucacuccgagcuggccccccucagggccucccucguuccaauggaacauuguaucaccagguuuuucgaggagugugaucccaauaaggauaaacacauaacgcucaaagaauggggccacuguuucggcaucaaggaagaggacauugaugagaauuugcucuuuuag

SEQ ID NO: 11972 - RNA, 1254 nt, Artificial Sequence
  Description of Artificial Sequence: Synthetic coding sequence
auguuagccuugcuuguuuugguaacaguugcacucgccuccgcgcaucauggcggggagcauuuugagggcgagaaaguguuucgagucaauguggaagacgagaaucacaucaauauaauacgcgaguuggcaucgacgacccaaaucgauuucuggaaaccagauagcgucacccaaauuaaaccucauagcacaguggauuuccgagugaaggcagaagacacugugacaguggaaaacguccugaaacaaaacgaguuacaguacaagguguugauaucgaacuuacggaacguuguggaggcccaguucgacucccgggucagagcuacuggucauucauacgaaaaguacaacaaaugggagaccaucgaagcuuggacgcagcagguggccacugagaaccccgcauuaaucuccagaagcgugaucggcacgaccuucgaaggcagagcaauuuaccuuuugaaaguugggaaagccgggcaaaacaaacccgcaauuuuuauggacugugguuuucaugccagagaauggauaucgcccgcauuuugccagugguuugugcgcgaagcaguuagaacauacgggcgggagauccaaguuaccgagcugcucgauaagcuggauuucuaugugcuucccguccuuaacauugacggcuacauauacaccuggaccaaaagcagguuuuggcggaagacacguuccacucacaccgggucuuccuguaucggcaccgaccccaaucguaacuucgaugcaggcuggugcgagauuggcgcuucaaggaauccgugcgaugagacauauuguggcccagcagccgagucugaaaaggagacuaaggcccuagcugacuucauaaggaauaaacuguccucuauuaaagccuaccugacuauucacuccuauucgcagaugaugaucuauccguauucuuaugcauauaaacugggagagaacaacgccgagcucaaugcccuggcaaaagccacuguaaaagagcucgcaucgcuacacgguacuaaguacaccuacggacccggggccaccacuaucuaccccgccgcgggcggauccgacgacugggccuacgaucaagggauacgcuauucuuuuacuuuugagcugcgagauaccgguagauacggauuccugcuaccagagucacagauuagagcgaccugcgaggaaacuuuucuggccauuaaguacguagccagcuauguucuugagcaccuguauuag

SEQ ID NO: 11973 - RNA, 588 nt, Artificial Sequence
  Description of Artificial Sequence: Synthetic coding sequence
auggcagugagccagggggauggaacacuuugcuuugugcugcugcuguguugcuggcaggagaccgaguuaaggccuaggaccgugauuccagggagcccgaccgagauaccuuuuucuucuaaacaggaggacaugagugaacuauuagaugagauucuggugcaagagauucucgaccugaauaagaccaccccauccgaaaugcccucaacagccuccacacuguccaccccucuacaugccggaauugacgagaauuaucaggccggaggaucagagaauuaucaugaacuccuagaaaaucugcaguucucacccggaauugaagucaagaucagcaacgacgaggccaacgcuaacgcaaaucuacacggcgauccuagcgaaaauuacaggggaccccaagugucgcccgggucugagaaaucagugucuucaaaagaaaagaacucuaagaauacacaauacgagaaucucagcauuuuggaccaaauacuccagaacauugggagaucaagcggaaauaucuuucauaaggagcaacagaggacaagugcacaacguagaagccaggguagccaguag

SEQ ID NO: 11974 - RNA, 2334 nt, Artificial Sequence
  Description of Artificial Sequence: Synthetic coding sequence
augaacgcgaacaaagaugagagacugaaggcucggagccaggacuuccaccuguuucccgcacucaugaugcuaucgaugacgaugcuauuccuccccgucaccggcacgcugaagcagaacaucccacgccugaagcugacauacaaggaucuacugcucaguaauuccuguauaccauuucuagguaguagugaaggacuggauuuucagacccuacuguuagaugaggaacgcgguagguuacugcugggcgcuaaagaucacaucuuccuucucucccucguggaucugaauaagaacuucaaaaaaaucuacuggccugcugccaaagagcgcguggaguuauguaagcucgcuggaaaggacgccaacacagaaugcgccaacuuuauuagaguucuucaacccuauaacaagacacacaucuaugugugcggaacuggggcauuccauccgauuugcggcuacaucgaucugggcgucuauaaggaggauaucauauuuaagcucgacacccacaaccuggagucagguaggcugaaaugucccuucgauccacaacagccauucgcgaguguaaugaccgaugaguaucuguacuccggcacggccucugauuucuuagggaaggauacugccuuuacgaggagccucggcccuacccacgaucaccacuacauccguacggauauuagcgagcacuauugguuaaauggggccaaguuuauugguaccuuuuuuauuccugauacuuacaaccccgacgacgacaagauuuacuuuuuuuuccgugaguccucucaagaggguucaaccucugacaagacuauucugucuaggguugggaggguaugcaagaacgacguuggcgggcagcggucacugauuaacaaguggacuacauuccucaaggcuagacugauuugcuccauaccaggguccgauggcgcagacacuuauuuugacgaacugcaagauaucuaucuccugccuacaagagacgaaagaaauccagugguauauggcguguuuaccacaaccagcuccaucuuuaaagggucugcagugugcgucuacucgauggcugauauaagggcuguuuuuaauggccccuacgcccacaaggagagcgcagaucaucgcuggguucaguaugaugguaggauuccguacccaaggcccgggacgugcccaagcaaaacguaugacccgcugaucaaaagcacucgcgacuuucccgacgacgugauuaguuucaucaaacgucauagcgugauguacaaguccguguacccugucgccgggggaccuaccuuuaaacgaauuaacguggauuaucgacuuacccagaucgugguggaccacguuauugcagaggauggacaguaugauguaauguuucucggcaccgacauagggacagugcugaaaguuguaucaaucucuaaagagaaguggaacauggaggagguaguguuggaagagcugcagaucuucaagcauucaagcaucaucuugaacauggaacuuagcuugaagcaacagcaacuuuacauugggagccgcgaugggcugguucaacuuagucugcauaggugcgauacauauggaaaagcuugugccgacugcugccucgcacgugacccauauugcgcaugggacggcaaugcuuguucccgauacgcccccaccucaaaacgacgggcacgucgacaagacguuaaguacggagaccccaucacacagugcugggacaucgaagauucuaucucacacgagacggcagaugaaaaggugauauuugguaucgaauucaauucuaccuuucuugaguguauccccaaaucccaacaggcuacuauuaaaugguacauucaaagauccggggacgagcaccgagaggaacugaagcccgacgaacggauaauuaaaacagaguacggccuccucauccgcagucugcagaaaaaggacuccggcauguacuauugcaaagcccaagagcauaccuucauccauacaaucgugaagcugacuuugaacgucauugagaaugaacaaauggagaacacucagcgcgcagaacacgaagagggaaaagugaaagaccuccuagcagagucucgccugcgguacaaggauuacauucagauccuguccuccccaaacuucucacuggaccaguacugcgagcagauguggcaucgagaaaaaagaaggcagaggaacaagggaggaccaaaguggaaacacaugcaggagaugaagaaaaagagaaaucgucgccaccauagagaccuugacgagcucccuagagccguagcuaccuag

SEQ ID NO: 11975 - RNA, 1332 nt, Artificial Sequence
  Description of Artificial Sequence: Synthetic coding sequence
augcagcccagcgagauggugaugaauccgaagcaagucuuccuguccguccuuauuuuuggaguggcugggcucuugcuguucauguaccuacaaguauggaucgaagaacagcacacuggucgggucgaaaagcgaagggaacagaaggugaccucugguuggggaccaguuaaauaucugcggccugugccucgcaucaugagcacugaaaagauacaggaacauauaacaaaccagaacccuaaguuccauaugccugaggacgugagagaaaaaaaagagaaccucuugcucaacucugaacgauccacucgucuucugaccaaaaccagucacucccagggcggggaucaagcuuugaguaagucgacuggauccccuaccgaaaagcugaucgagaaacgacagggggccaagacaguguuuaauaaguuuuccaauaugaacuggccagucgacauccauccucugaauaagagucuggugaaagauaacaaauggaagaagacugaggagacccaagaaaagagaagguccuuccuacaggaauuuugcaagaaauacggaggcguuucucaucaucaaucacaucuguuccacacugugucacguaucuaugucgaggauaaacacaagauuuuguauugugaggucccaaaggccggcuguagcaacuggaaacguauccucaugguccugaauggacuggcauccuccgcguauaauauaucucauaaugcuguucacuacggcaaacaccuuaagaaacuggacucguuugacuuaaaaggcaucuauaccagacucaacaccuauacgaaagcuguguucgucagggaucccauggaacgccuagugagugccuuccgugauaaauuugaacaccccaacucauacuaucaucccguguucggcaaggcuauaauuaagaaguacagacccaacgcuugcgaagaagcccucaucaacggcucuggagugaaguucaaggaauucauacacuaccuauuagauucucaucguccggucggcauggauauccacugggagaagguaaguaaacuguguuaccccuguuugaucaauuaugacuucgucggcaaauucgagacccuggaggaagacgcuaacuauuuuuuacagaugauaggagcccccaaggagcugaaauuuccuaacuuuaaagaucgacauuccucagacgagcgcaccaaugcucagguagugcgacaauaccuuaaggaccugacacgaacugaacgccagcugauuuacgauuucuauuaccucgauuaccucauguucaauuacacaacgccuuuuuuguag

SEQ ID NO: 11976 - RNA, 3228 nt, Artificial Sequence
  Description of Artificial Sequence: Synthetic coding sequence
augcgaggggguaagugcaauaugcucuccagucugggaugcuugcuccugugcgguucuauaacccucgcccuugggaacgcucagaagcucccgaaagguaagaggccuaaccugaaggugcacauuaacacgacaagugacucgauucugcugaaguuccuuaggccuuccccaaacguuaagcuugaaggucuccugcuuggcuauggcagcaacgucagcccuaaccaauauuucccccugccugccgaggguaaguucacugaagcuauugucgaugcagagccuaaauaucuuauuguggugcggcccgcgccuccucccucucagaaaaagagcugcucaggcaaaacccggaguagaaagccccuucaguuaguaguagguacccuaaccccuagcuccgucuuucucagcugggguuuccuaauaaacccacaucacgauuggaccuuaccaucccauugcccaaaugaucgcuucuacaccauuagauaccgugaaaaggacaaggaaaaaaaauggauuuuccagauaugccccgcaaccgagacaaucguggaaaaccugaaacccaauacuguuuaugaguuuggugugaaggauaacguugaaggaggcaucugguccaaaauuuuuaaccauaaaaccgucguuggaaguaagaaggugaaugggaaaauccaguccaccuacgaucaagaucacacgguaccugccuacguaccgaggaaguuaaucccgauuacaauaauuaagcaggugauacagaaugugacccacaaggauucugccaaauccccugaaaaggcuccccucggaggaguuauccuuguacacuuaauuauucccggccugaaugagacgaccgugaaacugccagccucccucauguucgagauuucugacgcccugaaaacucaguuggcuaaaaacgagacacucgcucuacccgcugaaaguaagacccccgaagucgagaaaauuucggccaggccaaccacagugacgcccgaaacaguuccaagaucuacaaaaccaacaaccaguagcgcucuggacgugagcgagaccacacuggcuucaucugaaaagcccuggauagugccaacagcaaaaauuuccgaggacaguaaggucuuacagccccaaacugcgaccuacgauguuuucaguagcccgacaacuagugaugagcccgagaucagcgauuccuacacggcgacuucagaccgaauccuggauucuaucccaccuaaaacuagcaggacucuggagcagcccagggccacacuggcgcccucagagacaccuuuuguuccccagaagcuagagauuuucaccagcccugaaaugcagccuaccacccccgccccucagcaaacaacuagcauuccaucaaccccgaagagacggccccggccgaagccacccagaacuaagccagaaagaacgacguccgccggaacaaucacuccaaaaauuucuaaaagccccgaaccgacauggacgacccccgcuccggguaaaacccaauucauuucauugaagcccaagauuccucugagcccggaggugacgcacaccaagcccgcgccaaaacagacaccaagagccccucccaaaccaaagacuucuccgcgaccuagaaucccucaaacacagccugugcccaaagucccccagaggguuacugcaaagcccaagaccucuccaagcccagagguguccuacaccaccccugcuccuaaggauguccugcuuccccacaaacccuacccugaggugucacagagcgagcccgcuccucucgagacccgaggaaucccguucauucccaugauuucaccgagccccucccaggaagaauugcaaacgacauuggaggagaccgaccaaucgacacaagagccauucacuaccaaaauuccccgcacaaccgagcucgccaagaccacccaggccccccaucguuucuauacaacuguccgcccaagaacauccgacaagccacauauccgcccuggaguaaaacaggccccccgcccaagcggagccgacaggaacguaucgguggauucaacucaucccaccaagaagccagggacaagacgccccccacugccuccucgacccacucacccacggcgcaagccucuuccuccaaauaacguuaccggaaaaccuggcucugcuggaauuaucucgagcgggcccaucacuacccccccuuuacgaaguacuccucggccaaccggcacuccauuagaaagaauagaaacugauaucaagcagcccacggugcccgcauccggggaagaacuggaaaauauaaccgauuucagcucaaguccgacgcgcgagacugauccacucgggaaaccaagguucaaaggaccccacgugagguauauacagaaacccgacaacuccccgugcuccauuacugacagcgugaagagguuucccaaggaagaggcaaccgagggaaacgccacuuccccgccccagaacccuccaacuaaucugaccguugugacugucgaaggaugcccgaguuucgugauuuuagacugggagaagccacugaaugauaccguaacagaauacgaaguaaucucgcgugaaaauggaucuuuuaguggaaaaaauaaaagcauacagaugaccaaccaaacguucucaaccguugaaaaucugaagcccaacacauccuacgaguuccaagugaagccuaagaacccauugggcgaaggccccgugagcaacacgguggcuuucucaacggaguccgcugacccucgaguuuccgagcccgugucugccggaagggacgcaauuuggacggaacgccccuuuaauuccgauaguuauagcgaaugcaaaggaaagcaauauguuaagcguacuugguauaagaaguuuguuggugugcaacucugcaauagucugcgcuauaaaauauaucuaucugauucccucacuggaaaguucuauaacaucggagaucagaggggccacggggaggaccacugucaguuugucgacucguuccuggacggucggacagggcagcagcuuacgucagaccaacugcccauuaaagaaggguauuucagggccgugaggcaggaaccaguucaauucggcgaaaucgguggacacacccagauuaacuauguucagugguacgagugcgggacaacuauccccggcaaaugguag

SEQ ID NO: 11977 - RNA, 483 nt, Artificial Sequence
  Description of Artificial Sequence: Synthetic coding sequence
auguugcccuuccucuucuuuuccacgcuuuuuagcucuaucuucacugaggcacagaaacaguacuggguguguaacucaucagaugcuucuauuagcuauacauacugcgauaaaaugcaauauccuauuucaauuaaugugaaccccuguaucgaacucaaaagguccaagggccuauuacauaucuuuuauaucccuaggcgggaucugaaacagcuuuacuuuaaccuauacauuaccguaaacaccaugaaucuuccaaaaagaaaggaaguuaucugucgggguagcgacgaugacuauagcuucugcagagccuuaaagggcgagacagucaacaccacaauuucauucagcuucaagggcauaaaguuuucaaagggcaaguacaaaugugugguagaggcuaucuccggcagcccugaagagauguuauuuuguuuggaauucgugauucugcaccaaccuaacuccaacuag

SEQ ID NO: 11978 - RNA, 780 nt, Artificial Sequence
  Description of Artificial Sequence: Synthetic coding sequence
auggcagcuuugaugaggaguaaggauucuucguguugucucuuacuucuggcugcuguuuugaugguggaaaguucacagauugggucaucucgagcgaagcugaacagcauuaagagcuccuugggaggggagacaccagggcaggcggccaacagguccgcuggcauguaccaaggcuuagcauuuggcgguucaaaaaagggcaaaaaucugggccaggcuuacccuugcucuagcgauaaggagugugagguaggccgauauugccacaguccacaucaaggaucaucugcuuguaugguguguagacgaaagaaaaagaggugucacagggacggaaugugcugcccuucuacucguuguaacaacgguaucuguauccccguuacagaaaguauacucaccccacacauaccagcccuugauggaaccagacaccgagacagaaaucacggacauuacuccaaccacgauuugggguggcagaaccuagggaggccacauaccaagaugucacauauaaagggccacgagggugauccauguuugaggucuuccgacuguauugaaggcuucuguugcgcgcgccacuucuggacaaagauuuguaaacccguguugcaucaaggugagguguguacaaaacagagaaaaaaagguagucaugggcuagaaaucuuucaaagaugugacugcgcaaaagggcucagcuguaagguguggaaggaugccacuuauucaagcaaagccagguugcaugugugccagaaaauauag

SEQ ID NO: 11979 - RNA, 3030 nt, Artificial Sequence
  Description of Artificial Sequence: Synthetic coding sequence
augggacaauuguguuggcuaccuuuacuugccccccugcuccuguugcgucccccaggaguccaauccgcugguccaauucgcgcuuucguugugccacauucccacauggacguggguugggucuacacaguccaggagagcaugagggcuuacgcggccaauguuuauacuaguguuguggaggaacuggcuagagggcagcagcgaagguucauugccgucgagcaggaauuuuuccgccucuggugggaugggguggcuagcgaucagcagaaguaccagguccggcaacugcuggaggagggaagacuggaguuugugauaggggggcaggucaugcacgaugaggcagugacccaucucgacgaccagauucuucagcugacugaagggcacgguuuucuguaugaaaccuuugggauucgcccucaguucucuuggcaugucgauccuuuuggagcuucugcuacaacuccaacacuguuugccuuagcuggcuuuaaugcccaccuaggaucccgcaucgacuaugaucuaaaggcagcaaugcaggaagcucguggguugcaguucguguggcguggcagcccgucccugucagaacgucaggagauuuuuacccacaucauggaucaauacaguuauugcacaccuucacacauaccguucuccaaccgcucgggauucuacuggaauggugucgcugucuuuccaaaacccccacaggauggggucuauccuaauaugucugaaccaguuacgccagcaaauaucaaucucuaugccgaagcacugguggcuaacgugaagcaaagggccgcgugguuccggacgccccacguccuuuggcccugggguugcgauaaacaauuuuucaaugcuaguguucaguucgcgaauauggacccacugcuggaccacauuaacucacaugcagcagaacucggcguuagcguacaauaugccacauugggggauuauuuuagggcucuucacgcccuuaaugucaccuggcgcgugcgagaucaccacgacuuccugccauacucaacagaacccuuucaggccuggacaggauucuacacuucucggucaagucucaaggggcuggcccgacgggcaucugcccugcucuacgccggggaauccauguucacucgcuaccuguggccugcuccaaggggucaccucgacccgacaugggcucugcaacagcugcagcagcuucgcugggcugucucugaaguucagcaccaugaugcaaucacgggcacagagucgccaaagguccgggauauguaugcaacccaccuugcaucuggcauguugggcaugcguaaauugauggcuagcauuguuuuagacgagcugcagccacaagcuccuauggcagcuuccucugaugccgguccugccggucauuuugcgucugucuacaacccacucgcuuggacggugacuacaaucguuacauugacagugggguuuccuggaguccgugucaccgacgaagcugggcauccagucccuucucagauacagaacuccaccgaaacucccagcgcuuaugaccugcucaucuugaccacgauaccaggccugagcuaccgucacuacaauauccguccuaccgcuggcgcucaagagggcacacaggaaccugcagcuacaguggccaguaccuugcaauucggacgacgauugaggcggcgaacaucucaugcuggacgcuacuuagucccaguggcaaacgacuguuacaucgugcugcuggaccaggauaccaauuugaugcacagcauuugggaacgacagagcaaucgcaccguccgggucacacaggaauuucuggaguaucacguuaacggugaugucaaacaagggcccaucagcgacaauuauuuauucaccccaggcaaagcugccgucccggccugggaagccguggagauggaaauuguggccggucagcuugugaccgaaaucaggcaauauuucuaucgcaauaugacagcucagaauuauaccuaugcgaucaggucaagauuaacucaugugccacagggccacgauggugaacugcugugucacagaauugaacaggaguaucaggcuggcccacuggagcugaaccgcgaagccgugcugagaacaagcacgaaccuuaauucucaacaggugauuuacucugacaacaacggguaccagaugcaacggagacccuacgucuccuauguuaacaauucgauagcuaggaauuauuacccuaugguacagucggccuucauggaagacgguaaaucccgguuggugcuacugagugaacgcgcccauggcauuagcucucaggguaauggccagguggagguuauguuacaucggcgguuauggaacaauuuugacugggacuuagguuacaaucucacuuugaacgacaccagcgucguccacccugugcucuggcuccuucuuggcuccuggagccuaacgacggcauugaggcaaagaucagcccuggcguugcagcauagacccguagugcuuuuuggcgaccuggcuggcacugccccaaagcugccgggcccucagcagcaggaagccgugacucuccccccaaaucuccauuuacagauccuuucuaucccagguuggagguacucuucaaaucauaccgaacacagucagaauuuaaggaaggggcaccggggugaggcccaagcagaccugcgucggguucuacugcggcuguaucaucuuuacgagguaggcgaggacccugugcucucucaacccgucacagugaacuuggaggcuguucuucaagcccugggguccgugguggcgguugaggaacgcucucucaccggcaccugggaccuaagcauguuacaccggugguccuggcgcaccggccccggccgccaucggggggauacuaccucuccaucuaggccucccggaggaccaaucauuacagugcacccaaaagagaucaggaccuucuuuauccauuuucagcagcaauag

SEQ ID NO: 11980 - RNA, 1443 nt, Artificial Sequence
  Description of Artificial Sequence: Synthetic coding sequence
auguuauuuaggaaucgguuccuucugcuguuggcccuagcugcgcuguuagcuuuuguuucccucagucuacaguucuuccaccuaauccccgugagcacgccuaagaacggcaugucgucaaaaagccggaaaagaaucaugccagaccccgugacggagcccccuguaacagaccccguguaugaagcucugcucuacugcaauauaccgagcgucgcagaacgaucuauggagggccaugccccccaccauuucaaguuagucucagugcacguauuuauucgccauggggaccgguacccccuuuaugugauuccaaaaacuaaaagaccggagaucgauuguacuuuagucgcuaaccgcaagccauaccacccuaagcuggaagcauucauuucucacaugucaaagggcagcggagcauccuuugaguccccgcucaauucccucccguuauacccuaaucacccucucugcgagaugggcgagcugacacagaccggcgugguacagcaccuacagaauggccaacuccugcgugacauuuaccuuaagaagcacaaacuuuugcccaaugauuggucggcggaucagcuuuaccuggagacuacuggaaaaagucguacccuccaaaguggacucgcucuguuauacggauuucucccugauuucgauuggaagaaaaucuacuuccgacaucagccuagugcauuguucuguucggguucguguuauugucccguccgcaaucaauaccuugagaaggaacagagacggcaguacuugcugcgguuaaaaaacucccaacuagagaagaccuacggugagauggcaaagauuguagacgugcccacaaaacaauugcgugcagcuaauccuauugacagcaugcuaugccauuucugccacaacgugucuuuucccuguacaagaaauggcuguguagacauggaacacuuuaagguaauuaagacacaccaaaucgaagacgagcgggagcgcagggagaagaaacucuacuuugguuauagucuacucggcgcccauccaaucuugaaucagaccauuggucggaugcagcgggccaccgaaggccguaaagaagaacuguuugcucucuacucggcucaugauguuacccugucaccugugcugucagcucugggucugagcgaggcccgguuuccuagauucgcagccagacuuauuuucgaacuguggcaggaucgggagaaaccguccgagcauagcgugcguauccuuuauaauggcguugauguuaccuuucacacguccuucugccaggaccaccacaaaagauccccuaaaccuauguguccccuggaaaaccucguuagauucgugaagagggauauguuuguugccuuggguggcucaggaaccaacuacuaugaugcaugccaucgggaaggcuucuag

SEQ ID NO: 11981 - RNA, 1341 nt, Artificial Sequence
  Description of Artificial Sequence: Synthetic coding sequence
augcugcacccggaaacuuccccaggcagaggccaccuacuugcagugcugcuggcccuguugggcacugccugggcagagguguggccgccacagcugcaagagcaagcccccauggccggagcccuuaaucgcaaggagaguuuccuucugcuguccuugcacaaucgccuuaggaguugggugcaaccuccugcagccgauaugagacgguuggauugguccgacucucucgcccaguuggcacaagcccgagcugcccuguguggcaccccuaccccaagccuggcgaguggacuguggcgcaccuugcagguaggguggaauaugcagcugcucccagcuggccuugucucauucguagagguugugucccugugguuugcagaagggcaacgcuauagucaugcagcgggagagugcgcucggaacgcuaccuguacccacuacacacaacugguuugggccacuucuagccaacuggggugugguaggcaucugugcuccgcaggacaggccgccaucgaagcuuuugucugcgcauauucaccaagaggcaauugggagguuaauggaaagaccaucguuccauacaagaagggugcaugguguucucuaugcacagccuccguaucuggauguuuuaaggcaugggaucacgcagguggccugugugaggugcccagaaauccuugccgaaugaguugccaaaaccacggaaggcucaauauaucuacaugccacugccauugucccccagguuacacagggcgguacugucaaguaagaugcagccugcaguguguacauggaagauuuagggaagaggaguguagcugugucugugacauuggcuacgguggggcacagugcgcuacaaaagugcauuuucccuuucauaccugcgaucugagaaucgauggugauuguuucauggugagcuccgaggcugacacauauuauagagcgcguaugaagugccagcguaagggaggcgugcuggcucagauuaagucacagaaggugcaagacauucuagcauucuaucugggacgacucgagaccacaaaugaagugauugauuccgauuuugagacgaggaacuuuuggauaggacugacuuauaaaaccgcaaaggauagcuucagaugggcgacuggugaacaccaggcuuuuaccucauuugccuuuggccagccagacaaucacgguuucggaaacuguguagaacugcaagcgagcgcugccuuuaauuggaacgaucagagguguaaaacgcgcaaccgauacaucugccaguucgcgcaggagcauaucucucgcuggggaccuggauccuag

SEQ ID NO: 11982 - RNA, 2313 nt, Artificial Sequence
  Description of Artificial Sequence: Synthetic coding sequence
augguugagucagccggccgugcuggccaaaaaaggccuggguuucucgaaggcgggcugcuucuacuccuguugcuagugacagccgcucugguggcacugggcguucuguacgcugaucgccguggcaaacagcugccucgacuggcaucuagacuguguuuuuuacaggaggagcgaacuuuugugaagcggaaaccacgaggaauuccagaagcucaagaggugagugagguguguacgacuccaggcugugugauugccgccgccagaauccugcagaauauggacccaacuacggagcccugugacgacuucuaccaguucgccuguggagguuggcuccgaagacauguuauaccugagacaaauagcagauacaguaucuuugauguccugcgcgaugagcuggaaguaaucuuaaaagccguccuggaaaauucaacagcgaaagacagacccgcuguggagaaggccagaacucuguauagaaguugcaugaaccagagcguuauugagaagagaggcucucaaccauugcucgacauccuggagguggucgguggauggccaguugcuauggaccgcuggaaugagacugugggacuugaaugggagcuugaacggcaacucgcguugaugaacucucaguucaaccgccguguacuuauagaccuguucauauggaaugacgaucaaaacucuagccgccacaucaucuacaucgaucagcccacacuagggaugcccuccagagaguacuauuucaacgguggaagcaaccgcaaggugagggaggcguaucugcaguuuauggucucaguggcuacacuucugagggaggaugccaaucugccaagggauucuugccuuguucaagaggauauggugcagguccuagaacuggaaacucaacuggccaaggccacggucccacaggaagagcgccacgacgucauugcucuauaucaccgcaugggauuggaggaacugcagucucaguuuggccucaaaggauucaacuggacauuauucauacagaccgugcuguccucagugaaaauuaagcuccugccagacgaagagguaguggucuaugggauccccuauuugcagaauuuagagaauauuaucgauacauacagugcccggaccauucaaaacuaucugguauggcgucucguccuggacaggauagguagccucucacagagauucaaggauacccgcgugaacuaccggaaggcccuuuucgguacuaugguggaggaaguuagguggagggaaugugugggguaugugaacaguaacauggagaacgccguagguucccuuuacguucgagaggcuuuuccgggggacuccaaauccaugguacgcgagcuuauugacaagguccgcacaguauucguggaaacacuggacgagcuuggcuggauggacgaggaaucgaagaaaaaggcgcaggagaaggcuaugucaauccgcgaacaaaucggccaccccgauuauauccucgaagaaaugaauagaagacucgacgaggaauauagcaaccuuaacuucuccgaggaccucuacuucgagaauagccugcagaacuugaaaguaggggcgcagcgcagccuacggaaacugcgugagaaaguggacccuaaccuguggauuauuggagccgcaguugugaacgccuucuacucuccaaauaggaaucaaaucgucuuuccugcugguauccuucagccuccuuucuuuucuaaggagcaaccucaggcacugaacuucggagguauuggaaugguuaucggccacgagaucacacauggcuucgaugacaacgggcggaacuucgauaagaauggaaacaugauggacugguggucaaauuucagcacucagcauuuucgugagcaguccgaauguaugaucuaccaauacggaaauuacagcugggaucuagccgacgagcagaaugugaauggguuuaauacccugggggagaacaucgccgauaacgggggagucaggcaggcuuacaaggcuuaccugaaauggauggcugagggcggcaaagaucagcagcucccaggccucgaccuuacccacgaacaacucuucuuuauaaacuacgcacagguguggugcggaucauaucggcccgaauuugcuauucaguccaucaaaacugacguacacaguccucucaaauaucgggugcuggggucacuacaaaaccuggccgcguucgcugacaccuuccacugugcucgaggcacaccaaugcaucccaaagaacgcugccgaguaugguag

SEQ ID NO: 11983 - RNA, 1317 nt, Artificial Sequence
  Description of Artificial Sequence: Synthetic coding sequence
augagcaaacgagauaaggcugggaaggauaccgcuagagguaaggguaaagacauuaguaaauauggcagugugcagaagucguucgcagaccgggggcugccaaagccaccuaaggaaaaacuuuuacaaguggagaaauuaaggaaggaauccggcaaaggcuccuuucugcagccaacagcaaagccccgggcacuugcccagcagcaagccguuauccgaggauucaccuacuacaaggcggggaagcaggaggugaccgaggcgguugccgauaacacccugcaaggaacuagcuggcucgaacagcucccccccaagguugaggggcgauccaauagugcugaacccaauucugcggaacaggaugaagccgagccuagauccagcgaaagagucgaccucgccuccgggaccccuacgaguaucccagccaccaccacaacagccacuaccacgccuaccccaacaacaucccuucucccaaccgagccccccucgggaccugagguuagcucccaggggagggaagcaagcugugaaggcacauugcgggcaguugauccaccuguucgucaccacucauacggccgucacgagggggcauggaugaaggacccggcugcacgagaugaucggaucuaugugacuaauuauuauuacggaaacagccucgucgaauucaggaaccuagaaaauuuuaaacagggcagauggagcaauauguauaagcugccuuauaacuggauuggaacaggacaugugguguaccagggggcauuuuauuauaauagggcauuuacaaaaaauauaauuaaguacgaccugcgacaaagauuuguagcuuccugggcccucuugccagacgugguguaugaggacaccacaccguggaaauggagagggcauucggauaucgauuuugccguggacgagucaggacuaugggugaucuaccccgcuguggaugauagagacgaggcacagccugaggucaucguguugucgcgucuggacccaggggaucugucggugcacagggaaacaacuuggaaaacacggcugcggcggaacucuuacgggaacuguuuccugguuugcgggauucuguaugcaguugacacauauaaucagcaggaaggacagguagccuaugcuuucgacacccauacagguacagaugcuagaccucagcuccccuuuuuaaaugagcacgcuuacacuacacagaucgauuacaacccaaaggaacgugugcuauacgcaugggauaauggccaucagcucaccuauacacuucauuuuguggucuag

SEQ ID NO: 11984 - RNA, 3570 nt, Artificial Sequence
  Description of Artificial Sequence: Synthetic coding sequence
augccaggacuccuuaauuggauaacgggagcagcucucccccugacugcaagugaugugacuucuugugugaguggcuaugcucugggacugaccgccagucucaccuacgguaauuuggaagcccagccuuuccaagggcuauucguguacccccuggaugaaugcaccacggugaucggcuucgaggcuguuaucgcugaucguguagugacagugcaaaucaaggauaaagccaaacuggaauccggucauuucgaugcuucccacgugcgcucacccacuguuaccgggaauauucuccaggauggaguguccauugccccccacucuugcacgccaggcaaagugacucucgacgaggaccucgagcgcauccuguucguggcuaaucuugguacaaucgcccccauggagaacgugaccauuuucaucaguaccaguagcgaacugccuaccuuaccgucuggggcagucagaguguuacugcccgcugucugugcgccaacagucccccaauucuguacaaaaucuacugggaccucuaaucagcaagcgcagggcaaggacaggcacugcuuuggcgcgugggcaccggguagcuggaacaagcugugucucgcuacacuguugaacacugaagugucaaacccgauggaguacgaguuuaauuuucagcuggagauucguggaccaugccuucuagccggaguggaguccccaacacacgagauucgcgcggaugccgccccaagcgcacguagcgccaaaucuauuaucaucacgcuggccaacaaacacacuuuugacaggcccgucgaaauucugauccaccccagugaaccacacaugccacaugugcugauagagaaaggcgacaugaccuugggcgaguucgaucagcaucugaaggggcggaccgauuucauuaaaggaaugaaaaaaaagucaagggccgagaggaagaccgaaaucauacgcaaacgauuacacaaggacauuccacaucauuccgucaucaugcuuaauuuuugccccgaucuacagagugugcagcccugucuucgcaaggcucacggagaauuuauuuucuugaucgaccgcuccaguucuauguccggcauauccaugcaccgggugaaagaugccaugcugguggcacuuaagucucugaugccugcuugucuuuucaauaucauuggcuucgguucuacuuucaaaucacuguucccuucgucacagacuuacuccgaggacucccuggccauggcaugugaugauauccaacguaugaaagccgauaugggcgguaccaacauucuauccccguugaaaugggugauccgccagccuguucacagaggacauccacgguuacuauucgugaucacugacggggcagugaauaauaccggcaaaguucuggaacugguacggaaccacgccuucaguaccaggugcuauuccuucggcauaggcccuaaugucugccacagacuggugaagggacuagcaucggugucagaggggucugccgagcugcucauggagggagagcggcugcagccuaagaugguuaagucucuaaagaaagccauggccccagugcuauccgacgugacgguggaauggaucuuuccugagacgacagaaguccucgugagucccguuucugccucuucccuuuuuccgggcgaacggcuagucgguuacggaauugugugcgaugccuccuugcauauuucaaacccuagguccgauaagaggagacgguauucaauguugcauagucaggaaagcggaaguucaguauucuaucauucacaggaugauggcccgggacucgaggguggcgauugcgcuaagaauucuggggcccccuucauccucgggcaggcaaagaacgcucgucucgcuucuggggacucuacaacaaaacaugacuuaaaccugucccaacgacgccgugcuuacucuacaaaccaaaucaccaaucacaagccccuaccacgggcuacgauggcauccgacccaaugcccgccgcuaagcguuaccccuuaagaaaggcccgccuacaggauuuaacgaaucagacuucguuagacgugcaacgcuggcaaaucgaccugcaacccuuacucaacuccggccaggaucugaaucaggguccaaaacuucguggaccgggugcccggaggccuagcuugcugccacaggggugccagccuuuucuucccuggggacaagagacucaggccuggucgccagugcgcgagcguacaucugacaguaggucccccggugaucuugagccuagccaccauccaagcgcguuugagacggaaaccagcucugacugggacccacccgccgagucacaagagagagccucaccuagccgcccagcaaccccagcaccuguucuugggaaagcucuggugaaaggucugcaugauucccagcgacugcagugggaggugucguuugaacucgguaccccuggaccugagcgcggaggggcucaggaugccgaucuguggagcgaaaccuuucaccacuuggccgcccgggcgaucauucgugacuuugagcagcuggcggagagggaaggagaaauugagcagggcuccaaucgaagguaucaaguaucagcgcuacauaccaguaaagcgugcaacaucaucuccaaauacacagcauucgugcccguagaugucucaaaaucacgguaccugcccacugugguugaguauccuaauuccgccgcuuuacgaaugcucgggagccgugcgcuugcccagcaguggagaggcacuucuucagguuuuggccgaccccagacaaugcugggugaggacagcgcccccggcaaugggccacaacgcagccucgcgacuaauacucugucuuccaugaaggcgagcgagaaucuguucgggucuuggcugaaucuuaauaaaagccgcuuacuaacccgugccgcaaaaggcuucuuaagcaaaccauugauuaaggccgucgagucuacuucuggcaaucaaagcuucgacuacauuccacuagucucccuccaguuagcuucaggcgccuuucugcuaaaugaagccuucugcgaggccacgcauauccccauggagaaguugaaguggacaagcccuuucacaugucacagaguuaguuugacaaccaggccguccgaguccaaaacaccuucgccccaguuguguacuucuucccccccaaggcaccccagcugcgauucauucucucucgaaccacuggcuaagggaaaacugggccuggaaccacgggcugugguugaacauacuggcaagcuuugggccacuguugucggucuugcuuggcucgaacauucuagcgcuucuuacuuuacugagugggagcuggucgccgccaaggcaaacaguuggcucgaacagcaagaaguccccgaggggaggacacaggggacuuuaaaggccgcagcaaggcagcuguuugugcuacuccggcauugggacgagaaccuggaguucaacaugcuauguuauaacccuaauuacguuuag

SEQ ID NO: 11985 - RNA, 1344 nt, Artificial Sequence
  Description of Artificial Sequence: Synthetic coding sequence
augccgcacgugcucauugagaagggggacaugacauugggagaguucgaucagcacuuaaaaggucgcacugauuucaucaagggcaugaagaaaaagucccgggcggagagaaaaacagagaucauucggaaaagguuacauaaagauauuccacaccacucugucauuaugcucaauuucugucccgaccugcagucaguacagccuuguuugagaaaggcacacggggaguucauuuuucugauugaucgguccagcuccaugaguggaaucucuaugcaccgggugaaggacgcuaugcugguggcuuugaaaucuuugaugccugcuugccuguucaacaucaucgguuuuggaagcaccuucaagagucuauucccaucuucacagacauacucugaggacucccuagcaauggcaugcgaugauauccagaggaugaaggcagacaugggaggcacaaacauccuuuccccgcuuaagugggucauacgccagccaguccaccgaggccacccacgcuuguuguucguuaucacugauggagcgguuaauaauaccggcaaggugcuugaauuaguccguaaccacgcauucaguacccgauguuacuccuucgggauuggcccaaauguuugccaccgccuggucaagggacuugccucuguguccgaagguagcgccgaacugcugauggagggggagaggcugcagcccaaaaugguuaaaaguuugaaaaaggcaauggcccccguucugucugacguaacaguggaguggaucuuccccgagacgaccgaagugcugguauccccaguuucugcuuccucacucuuccccggugaacgacucguagguuacgguauugugugcgacgcuucccuccauauaaguaacccuaggagugauaagaggagacgguacaguaugcugcacucucaggaaucuggauccuccguuuucuaucauucacaggaugauggccccgggcucgaagggggugauugcgccaagaauuccggggcaccauucauacugggucaagcuaagaaugcacgguuggcauccggcgauuccaccacgaagcacgaccugaaccugagccagaggcgccgggccuacuccacuaaccagauuacgaaccacaaaccucugccuagagccacuauggcuagugaccccaugccagcugcuaaacgcuacccguugcgcaaggcaagacugcaggaucuaacaaaucagacaucucucgauguacaacgcuggcagauugaccuccaagccuuuauuugcuugacuucagaagacaccuuccagaucagaacaccgaccggacaguag

SEQ ID NO: 11986 - RNA, 726 nt, Artificial Sequence
  Description of Artificial Sequence: Synthetic coding sequence
auguggacgguuagaacggaagguggacauuucccacugcauagcccuacguucagcuggcgcaacguggccuuccuucuccuucugucucuugcccuugaauggaccucugcgaugcucacuaagaaaaucaaacacaaaccuggacugugcccuaaggaacggcugacuuguaccacugaguuaccggacagcugcaacaccgacuuugacuguaaagaguaucagaaauguuguuuuuucgccugccaaaagaaaugcauggaccccuuucaagagcccugcauguuaccugugaggcaugggaauugcaaccacgaagcccaacgcuggcacuucgacuucaagaauuaucgaugcacacccuuuaaguaccgcggcugugaaggcaacgccaacaauuucuugaaugaagaugccugucggaccgccugcaugcuuaucgucaaggacgggcagugcccucuuuuucccuuuacagagcgcaaagaaugccccccuagcugucacucagacaucgacuguccccaaaccgacaaguguugcgagucuagauguggguuugugugcgcccgagccuggacugugaaaaaagguuucuguccaaggaaaccccugcuguguacaaagauugacaagccuaaaugccuucaggacgaggagugcccguuaguugagaaguguugcucccacuguggacuuaaauguauggacccacgccgguag

SEQ ID NO: 11987 - RNA, 1074 nt, Artificial Sequence
  Description of Artificial Sequence: Synthetic coding sequence
augcgcccacccccugcccucgcucuggcgggcuugugucuccuggcucucccugccgcugccgccucauauuucggacugacuggaagagagguguugaccccauuccccggucucgggaccgcagccgccccugcucaaggcggggcucaucucaaacaaugugaucugcuaaaauuaagccggcgucaaaaacagcucugcaggcgggagccuggccuggcugagacccugagagaugcagcacaccugggauuacuggagugccaguuucaauuccgccaugaaagauggaauugcucauuagagggacgcaugggucugcuuaagaggggauuuaaggaaacugcuuucuuauacgcaguaaguagcgcagcgcucacccauacgcucgcacgggcguguagcgccggacggauggagagaugcacgugcgaugauucaccuggucuggagaguaggcaagcuuggcaguggggggugugcggcgacaaccucaaauacucuacaaaguuucugagcaauuuccuuggcaguaagcgagggaauaaagaucuucgugcccgcgccgacgcacacaacacacacgucgggauuaaggcgguaaaaucuggguugaggacuaccugcaagugccacgguguuucagguucaugcgccguaaggacguguuggaagcaacugucgcccuuucgugaaaccgggcagguuuuaaaauugcgguacgauagcgcgguuaagguaagcagcgcaaccaaugaagcucuggguagguuggaguugugggcuccagcaagacagggcucuuugaccaagggccuagccccgcguucuggugaccugguauacauggaagauaguccaucauucugucggccaucuaaauauucuccuggaaccgccggaagggugugcucccgcgaggccaguuguucuucccucuguugcggcaggggcuaugacacccagagucggcucguggcuuuuuccugccacugucagguacaguggugcugcuacguggagugucagcaaugcguccaagaggaguugguguacacauguaaacacuag

SEQ ID NO: 11988 - RNA, 810 nt, Artificial Sequence
  Description of Artificial Sequence: Synthetic coding sequence
augguucggugccucggaccggcucugcuucucuuacuucuuuuggguagugcaaguucggugggcggcaaucggugugucgacgcggcugaagccuguaccgccgacgcacggugucagagacugcggagugaauauguagcacaaugucugggucgcgcugcgcaagguggcuguccccgcgccaggugucgccgggcccugcgcagguucuucgcccgcggcccccccgcucugacccaugcccuguuauucugccccugugccggucccgccugugcagagagaagacgacagaccuucgugcccucuugcgccuucucuggcccagggccugcccccccaagcugccuugaaccucucaauuuuugcgaaagaagucgcgucugucgcccucgccugcucgcauuucaagugagcugcacgccugcccccucagcccccgacggaugcuuguuggaccaaggugcucgcugccucagagccuacgcugggcuggugggaacagcggugaccccaaacuacgucgauaaugugagcgcgaggguugcgccguggugcgacugcggugcaucugggaauagaagagaagauugcgaggccuuucgugggcucuuuacucgcaaccguugucuggacggcgccauucaagccuucgccuccggguggcccccaguguuacucgaccagcuuaauccgcagggggaucccgaacacucucugcuucagguguccucuacaggccgugcauuagagcgccggagcuugcuuagcauccuuccuguuuuagccuuacccgcccuguuguag

SEQ ID NO: 11989 - RNA, 1728 nt, Artificial Sequence
  Description of Artificial Sequence: Synthetic coding sequence
augucugguaacugggugcaccccggccaaauccugaucugggcuaucuggguacucgcagcuccaaccaaaggcccaucugccgagggaccccagcgaaauacuagacuuggcuggauucagggaaagcagguaacaguacucggcuccccagugccugugaaugucuuccuaggaguacccuucgcugcucccccacugggcucucuccgguuuacaaacccccagcccgcuagcccuugggacaaccugagagaagccacuagcuaucccaaucugugccugcagaacucugaguggcuuuuauuagaucagcauaugcuuaagguucauuacccgaaauuuggcguguccgaggauugucuuuaucugaacaucuacgcaccugcacacgcggauacaggaagcaagcuccccguucucgugugguucccuggcggggcauucaaaacuggcucugcuagcauuuuugacgguucugcucuggcugcuuaugaggauguguuagugguggucgugcaguaccgccugggcauauucggcuuuuuuaccacuugggaccagcacgcaccaggaaauugggcauuuaaggaucagguggccgccuugucaugggugcagaaaaauaucgaguucuucggaggggaccccuccucaguuaccauuuuuggcgagagcgcgggagcuaucagcgugucuagucuaauuuuguccccaauggcaaagggccuauuccacaaggcaaucauggaauccggcguagccaucaucccauaccucgaggcacaugauuaugaaaaauccgaagaccugcagguuguggcacauuuuugcggaaauaacgcaucugacucugaagcacugcugcguugcuuacguacuaagcccucaaaagagcugcuuacucugagccagaagaccaagaguuuuacgcgaguagucgauggggccuucuuuccuaaugagccacuggaccuccugucgcagaaagccuuuaaagcgaucccaucuaucauugguguuaacaaccaugaaugcggauuccuucucccuaugaaggaggcccccgagauucuguccgguaguaacaaaucuuuggcacuccaccuaauucagaacauccugcauaucccaccccaguaccuucaucugguugccaaugaauacuuucacgauaagcacucuuugacagagauuagggacucguuguuagaucucuugggagaugucuucuuugucguucccgcgcucauaacugcccguuaccauagggaugcuggugcccccguguauuucuacgaauuucgccacaggccucaguguuuugaggauaccaagccagcauuuguaaaagcugaucacgccgaugaggugcgguuuguguuugggggcgccuuccugaaaggcgacaucguuauguuugagggggcaacagaagaggaaaaauugcugagccgcaagaugaugaaguauugggccaccuucgcacggaccggcaaucccaaugguaacgaucuaucauuauggccagcguauaaccuuacggaacaguaucuucagcuagacuugaauaugucccuuggucagcgucugaaagagccccggguugacuucuggacgucaaccaucccucucauccugagcgccucugacaugcugcacucuccacuuucgucuuugacuuucuugagccugcuucagccuuucuucuuuuucugcgccccuuag

SEQ ID NO: 11990 - RNA, 1026 nt, Artificial Sequence
  Description of Artificial Sequence: Synthetic coding sequence
augggaacccuaccauggcugcuggcguucuucauccugggcuuacaggccugggacacaccuacuaucgucucacguaaggaguggggugccagaccauuggcaugcagggcccuccuaacgcugcccguggcuuacauuauaacagaucagcuaccagguaugcaaugucagcagcaaaguguguguagccagaugcugcgagggcugcagucacacucuguguacacuauuggguggugcgacguagcuuauaacuuccugguuggcgaugacggacgcguauacgaggggguuggguggaauauacagggguugcacacccagggcuacaauaauauuuccuugggcaucgcauucuucggcaauaaaaucggauccucacccucuccagccgcauuaagcgcagccgagggacugauuagcuacgcuauacagaaaggucaucugucacccagauacauccagccccugcugcucaaggaagaaaccugccuggauccacagcauccaguaaugccccgaaagguaugcccaaauauuaucaaacgcucugcaugggaggcccgagaaacccauugucccaaaaugaacuuaccagccaaguacguuauuauaauacauaccgccggaacuaguuguaccgugagcacugacugucagaccguagucagaaauauucaaagcuuccauauggacaccagaaacuucugcgacaucgguuaucauuuccucgugggccaagacggcggcguguacgaagggguuggauggcauauacaggguucccauacuuacggcuuuaacgauaucgcucuuggaauugccuucauagguuacuuuguggaaaagccacccaacgccgcugcccuugaagccgcccaagaucugauucagugcgcagucguagagggauaucuaacucccaacuaccugcuuauggggcauucagaugugguuaacaucuugaguccuggacaggcccuguauaauauuaucuccacauggccucacuucaagcauuag

SEQ ID NO: 11991 - RNA, 897 nt, Artificial Sequence
  Description of Artificial Sequence: Synthetic coding sequence
auggguauugugugcgcucaguguuccuuuauccugcuccuuaguaucauucgagcccgcccuccgccauuucuguucuguccucugaguagccagcggaccgagagucccuacaagccugugcaccuuggacuaggaccaaccgacaagguagcugcuauagcgauggcucgcauuaucgaccuugugccuugggaugauggaucuacucauguauacgcuucucccgcaauccuccugcccauggaacgacagaggaaccagcucgccggagucaagcaacaacuguaucauccagcacucccuacccugcgucauauggaccgagauacuguaaaggcaugucugccagaugagcacugucaaagcacaaccuacugccggaaggacgaguuugauaaugcucauuucacauugcuggguguacccaauaaaccccugcaaugccuggacaucaccgcgacuggucaaaaguuaaggaauagauaucaugagggaaaacuggccccaauugcacccgggauuaaucguguagacuggccuugcuucacacgagcuauugaggauuggucacauuucgugucuuccgccggugaauuuaaacugcccugccugagaaaacgggcugagggauuguccggauacgcagugagauaccugaagcccgaugugacccagacguggcggcaggaagcuuuaugcggcgccugggccggcaggccaugcagcccagacagcccccguccuuacccaugcugcccaccgcaguacuguuuaucgcaaaaccccucacucgaucgguacggacagaagccuuugccauucgacagcuuaaacacauucaggucuuucggaucuucuuacagcagagugaacuaccuuacgccauggcauuag

SEQ ID NO: 11992 - RNA, 5799 nt, Artificial Sequence
  Description of Artificial Sequence: Synthetic coding sequence
auggcaccuggcgcucugcgaggagggugugaacagcgcgcccccggcggcggagcccgaacugcagcccuggguccuuggccuuggccaagucccggcccugcgccuucaccaggcgccgcuccuccccguucgcgcaaaaugagcggcgcccuguuauggccucucuuaccccuucugcugcuccugcuaagcgcccgcgacggagugcgcgccgcucagccccaagcuccaggcuaccugauagccgccccauccguguuuagagccggcguugaagaggugaucucagucacaaucuuuaauagcccgagagagguuaccgugcaagcgcagcugguggcgcaaggagagccagugguucaaagucagggggcaaucuuggauaaagggaccaucaagcucaagguaccuacuggauuacgaggacaagcccuguuaaaaguaugggggcggggauggcaggccgaagagggaccacucuuucacaaccaaacaagcgucacggucgacggccgcggggcuuccgucuucauucagaccgacaagccuguauacagaccucagcauagaguccuuauaucaaucuuuacaguuagucccaaccugaggccaguuaacgagaagcucgaagcguauauucuggaucccagagggucgaggaugauugaauggagacaccuuaagccguuuuguugugguaucacaaauaugucauucccuuuguccgaccagcccgugcucggagaaugguuuaucuucguugagaugcaggggcacgcguauaauaaaaguuuugaagugcagaaguacgugcugccuaaguuugaguugcucauugacccuccucgguauauucaagaucuggacgcaugcgaaacgggcacagugcgugcaagguacacguucggaaaacccgucgcgggcgcucucaugauaaauaugacugugaauggggugggauauuacucccacgagguugguaggcccguacuucggacuacuaagauccuggguucgagggauuuugauaucugugugagagauaugauuccugccgaugugcccgagcauuuuagaggacggguuuccauaugggcuauggugacgucugucgaugggucucagcaaguugcuuuugacgacagcacccccguccagcggcagcugguggacauccguuacuccaaagacacacguaagcaguuuaaaccgggccuggcuuacgucggaaaaguggaacucucuuacccagacgguucccccgccgagggcguaacugugcaaauuaaagcugaacugacucccaaggauaacauuuacacuuccgaggucgugagucagcgcggucugguuggauuugaaauuccuucgauccccaccagcgcccagcacguauggcucgagacgaaggugauggcucugaacgggaagcccgugggugcacaguaccucccuucauaccugucucuggguucgugguauagcccaagucaaugcuaucuccaguuacagccaccaagccauccacugcaggucggugaagaggccuacuucagugugaagucuacuuguccuugcaauuucaccuuguacuaugaaguggccgcuagggggaacauuguauuaaguggacagcagccagcucacacuacgcagcagcgcuccaagagggcggcaccagcauuggaaaaaccgaucagacugacccaccugagcgaaaccgagccuccucccgcucccgaggcagagguagacgugugugugacgucccuccaucuggcugugacacccucuauggugccacuggggagacuccugguguuuuacgugagagagaauggugaggggguugccgacagccugcaguuugcaguggagaccuucuucgagaaucaagucuccgucaccuacagugccaaugaaacacagcccggagaaguaguggaucugcggauccgcgccgcccguggcaguugcgucugcguugcugcugucgauaagucuguguaucuucuaagguccggauuuagacuaacuccagcacagguauuccaagaauuagaagauuacgaugucucggacuccuuuggggucucaagagaggacggaccauuuuggugggcuggccucacggcccaaaggagaagacgcaguucaguguuuccuuggccuuggggaaucaccaaggauaguggguuugccuuuaccgaaaccggcuugguaguaaugacagacagggucucccugaaccaucggcaagacgguggccuuuacaccgacgaggccgugccugcguuccagccucacacugguucccugguugcuguugcaccaucacggcacccucccagaacggagaagcggaagcggacuuucuucccagagacuuggauauggcauugccuaaacauuucagaccccagcggagaggggacucugucaguuaaggugccggacaguauuacguccugggugggcgaggcuguggcucugagcacuagccagggacucggaaucgcugagccuucucuccugaaaaccuuuaaaccauuuuucguggauuuuauguugccugcccucaucauucggggugagcaggugaagaucccccucuccguguauaauuacauggggacaugcgcagaaguuuauaugaagcucagugugccuaaaggaauccaguuugucggucacccugguaagcgccacgucacaaaaaagaugugcguagccccaggugaggcugaaccaauaugggucguccucucuuuuucugaucuugggcugaacaacauuaccgcuaaggcgcuggcuuacggcgacacaaacuguuguagggauggacggucguccaagcacccggaggaaaaccacgcugauaggagggucccuauuggggucgaucaugugaggagaucagucauggucgaagcugagggcguaccacgugccuacacauacagugccuuuuuuugucccagugaacgggugcauaucuccacaccgaacaaauaugaauuucaguauguucagcguccacugagacuuacacgguucgauguagccgugcgggcccacaacgaugcucggguugcacuuaguuccgggccccaggacacugcuggaaugauagaaauuguccugggcgggcaucagaauacacgcaguuggaucagcaccucuaagaugggugaaccugucgccagugcccauaccgccaagaucuuaucgugggacgaguuuaggacauuuuggaucuccuggagggguggacucauucaaguagggcacggccccgagccuaguaacgaaucaguuaucguggcauggacccuuccacgaccaccugagguccaguuuauuggauuuucuacuggauggggaucaaugggcgaguuuagaauuuggaggaaaauggaaguggacgaauccuacagcgaagcuuuuacucucgggguuccccacggggcgauuccgggaucugagcgcgcaacagccucaaucauuggggaugugaugggcccaacacuaaaccacuuaaacaaccugcugcgguuaccuuuuggaugcggagaacagaacaugauucauuucgcccccaauguguucgugcugaaguaccugcagaagacccaacagcugucucccgaaguugaaagggagacaaccgauuacuugguccaaggauaucagcggcaacugaccuauaagcggcaggacggcucauauucagccuuuggggagcgggaugcaucugguuccaugugguugacugccuucguguuaaaaucuuuugcucaggcucggaguuucaucuucgucgauccucgcgagcucgcugcugcaaaaucuuggauuauccagcaacaacaagcagauggcagcuuccuggcagugggacgcgugcuuaauaaagauauucaggggggaauccacgguacugugccauugaccgccuacgucgugguugcacuuuuggaaaccggcacugcaagcgaagaagaacggggaagcacugauaaagcaagacacuucuuggaaucagccgccccucuggcaauggaccccuacagcugcgccuugaccaccuaugcacugacccuacucagaucaccugccgccccagaggcucucaggaaacuccguuccuuggccauaaugcgcgauggaguaacccacuggucucugagcaauucuugggacgucgacaagggcacauuucucucauucucagaucgcgugucucaguccguagucagcgcugagguagaaaugaccgcuuacgcccuccuaacauacacgcugcugggcgacguugccgcugcgcuacccguggugaagugguugucucagcagcgaaacgcccucggaggcuucucaucgacucaggacacuugcguggcucuccaggcccuugcagaauaugccauucugaguuacgccggcgguauuaaccugaccgugagucuggcauccacuaaucuggauuaccaagagacauuugaacuccauaggacuaaccaaaagguccuucaaaccgcagcaaucccuagucugccaacuggucuguucgucucugccaaaggugauggaugcugucucaugcagaucgacgucaccuacaacgugccggacccugucgcuaaaccugcuuuucaguuacucgugucccuccaggaaccagaagcccaggggcgcccuccgccaaugcccgcguccgccgcugaagguucccgaggugacuggcccccugccgaugaugacgacccugccgcagaccagcaccaccaagaauauaagguaaugcucgaaguuuguacucgauggcuccaugcgggcucuagcaacauggcuguucuggaagucccuuugcugagcgguuuccgggcggacaucgagucuuuggagcagcugcuguuggacaagcacaugggaaugaaaagauaugaggucgcuggacgaagagugcuguuuuauuuugaugagauccccagucgaugucucaccugugugagguucagggcacugcgagaauguguggucggaagaaccagcgcacugcccguauccguguacgacuauuacgagccagcauuugaagccacgagguucuacaacgucagcacucacagcccacuggcaagagaauugugugccggaccugcaugcaaugaggucgagcgcgcaccugccagaggcccuggaugguucccuggggagaguggaccagccguagccccggaagagggcgcggcaauagccagaugcgggugugaucacgacuguggugcacagggcaacccaguguguggcucagacggcguggucuaugccagcgcgugucggcuuagagaggcagccugcagacaagcagccccccuagaacccgccccaccgagcuguugugcgcuagaacagcggcucccugccucaucuaguucaacguacggggaugaccuggccucagucgcacccggaccccuccaacaggacguuaagcuuaacggcgccggccuggagguggaggauucugacccugagcccgaaggugaggcagaagaucgcgugacagcagggccccgcccaccggugucaaguggcaaccuugagucuucgacccagagcgccuccccguuccauagguggggccagacucccgcgccacagagacacagcggucgaguuguuggugcccaccggcccgggcuucugucccccguauuuguguacucgccggcuuuucagucaggcggagaagaaggauuauggaugucuaacacuuguaccuugcgcuag

SEQ ID NO: 11993 - RNA, 1209 nt, Artificial Sequence
  Description of Artificial Sequence: Synthetic coding sequence
augguuugugcgcgugccgcuuuaggaccgggugcucuaugggcagccgcuuggggcgugcugcugcugacugccccagccggcgcccaacgaggaaggaaaaaggugguacacguuuuggaaggagagagugggagcguggugguucagaccgcccccggacagguggugagucaccgcggcgggaccaucguguugccuugccgguaucauuaugaggccgccgcacacggacaugauggggugcgcuugaaguggacaaaagugguggauccacuggcauucacugauguuuucguggcccuaggaccccaacaucgcgcauuugggucauaccgagggagagccgaauuacagggggacgggcccggcgacgccagccuggugcugcgaaacguaacccuccaggauuacggcagguaugagugugaagugacuaacgaacuggaggaugacgccggaauggucaagcucgaucuggaaggugucgucuuuccauaucacccgaggggcggaagguacaaacugacauucgcugaagcacaaagggcaugugccgaacaggaugggauuuuagcauccgccgagcaguugcacgcagccuggcgcgauggacucgacuggugcaacgccggcuggcuucgggauggcuccgugcaauauccagugaaucggccucgugaaccuuguggagggcugggcgggaccggaucugccggcgggggcggagaugccaacggcggccugcgcaacuacggauauaggcacaaugcggaggagcgguaugaugcauuuuguuuuacuuccaaccucccuggaaggguguuuuuccugaagccucugcgccccgucccuuuuucaggcgccgcgagagcuugcgcagcacguggagcagcuguggcaaaggugggccaguuguuugccgccuggaaauuacaacugcuagaccggugcaccgccggcuggcuggcugacggcagcgcucgcuacccuauugugaacccucgggcccguugugggggacggagacccggagugagaucccucggauucccagacgcaaccagaagauuauuugguguguacugcuacagagcuccuggggcgcccgaccccgcucccggcggauggggcugggguugggcuggaggugggggaugggcagggggagcccgggauccugccgcuuggacuccacuccauguuuag

SEQ ID NO: 11994 - RNA, 1740 nt, Artificial Sequence
  Description of Artificial Sequence: Synthetic coding sequence
augucggcucucagacccuugcugcuguuacuacucccucugugcccagggccagggcccggccccgggagugaggccaaagugacucgcuccugcgcugagaccaggcagguccuaggagcaagaggauauucacugaaucugauuccaccugcucugauuagcggugagcaccugagagucuguccccaagaguacacuugcuguagcuccgagaccgaacagagguuaauccgagaaacugaagccacguuccgcggccuggucgaagauucugguuccuuucuuguucacacgcucgccgccaggcauagaaaauuugaugaguucuuucuggaaaugcuaucggucgcacaacauucgcucacccagcucuuuagccacucauauggucgucucuacgcccagcacgcucugaucuuuaacggguuguucucacggcuccgggauuuuuauggggagucuggagagggccucgacgacacuuuggcugacuuuugggcccagcugcucgaacgcguuuuuccccuccuccauccccaauacuccuuccccccagacuaucuguugugucugagccgacuggcgaguucuaccgacgggucccuccagccguucggcgacuccccccguaggcuacggcugcaaauuacacgcacacugguugcagcccgagccuuuguucaaggccucgagaccgggagaaaugugguguccgaggcucugaagguccccgugucugagggguguagucaggcccugaugcgacugaucggauguccucucuguagaggcgugccauccuugaugccaugucagggguucugccuuaaugucguccgaggcugccuuuccucccggggcuuggagccugauugggguaauuaccuggacggccuucuaauucucgcugauaaacuccaggggcccuuuucuuuugaacugacagcugaguccaucggggugaagaucuccgaaggccugauguauuugcaggaaaauucugcuaagguaagcgcccagguauuucaggaaugcggaccaccugacccugugccagcgaggaaccgucgagccccucccccucgcgaagaggccggacgacuuugguccaugguuacagaagaggagcggccaacaacagcagcaggcaccaauuugcaccgccuagugugggaguuaagagagcgacuggcacgcaugagaggguuuugggcaagacucagucugacggugugcggcgacucuagaauggccgccgacgcuagccucgaagcugccccaugcuggacuggcgcaggacgaggacgcuaucuaccgcccgucguugggggcucaccagccgagcagguuaacaauccggaauugaagguugaugccucgggcccagacgugccgacgagacgacggagacuccaguugcgagcugcuacugcucguaugaagacggcugcucuaggccacgaucucgacggccaggacgcugaugaagacgccuccggcagugggggagggcagcaguacgccgaugauuggauggcaggggcagucgcuccuccugcgcguccuccaaggccacccuauccgcccaggagggacggcuccgggggaaagggaggggguggcagcgcacguuauaaucagggcagaucccggagcggaggcgcaagcauuggcuuucacacccagacaauccuuauccugucuuuaucugcacuugcauugcuggggccuagguag

SEQ ID NO: 11995 - RNA, 498 nt, Artificial Sequence
  Description of Artificial Sequence: Synthetic coding sequence
auggcccuguuagccuuacugcugguuguagcucugcccagaguguggacagaugccaaccucacggcaagacaaagggacccagaggauucucagcguacagacgaaggagacaauagaguguggugucacgugugcgagagagaaaacaccuuugagugucaaaaucccaggcgaugcaaguggacagagccuuauugcgucaucgcugcggugaaaauuuucccucgauucuuuauggucgcaaaacaguguucugcugguugugccgccauggagcggcccaagcccgaagagaagagguuccuuuuggaagaacccaugccauuuuucuacuugaagugcuguaagaucagguacugcaaucuggagggcccccccaucaacagcucaguguucaaggaguacgcugggucaaugggugaaucaugcggaggacuuuggcuagccaucuuacuccugcuugcuucuauagccgcuggacugagcuuguccuag

SEQ ID NO: 11996 - RNA, 933 nt, Artificial Sequence
  Description of Artificial Sequence: Synthetic coding sequence
augaacgggcugucccugucagaguuaugcugccuguuuugcuguccccccugccccgggcgaauugccgccaaauuagccuuucuuccacccgaggcuacuuauucauuggugccugagcccgaaccuggaccaggaggugcaggugccgcuccacucggaacccucagagcgucaagcggcgcaccuggaagguggaaacugcaucucacugaacgggccgauuuucaguacucccagcgggaacuggacaccaucgaagucuuuccaaccaaauccgcucgagguaaccgggugucuuguauguaugugcgcugcgugcccggagcccgcuauacaguccuauuuucccauggcaaugccguagaucuggggcagaugaguagcuuuuacaucggauuagguagucggcugcacugcaauaucuucaguuacgauuacucuggauacggagccucauccggcagaccauccgagcggaaccuguacgcagauauugaugccgcuuggcaggcgcugcguacacgcuauggcauaucaccagauagcaucauuuuauacgggcagucuaucggaaccgugccuacaguugacuuagcuucccgauacgagugugcugcaguggugcugcacucuccucuuaccucagggaugaggguggcuuucccugacacaaagaagacauauugcuuugacgcauuccccaacauugaaaaagucucaaagaucacaaguccaguucuaauaauucacggcaccgaagaugaggugauugauuuuagccacggccuagcccucuacgaacgcugcccaaaggccguugagcccuuguggguugaaggggcaggucacaacgauauugagcucuauucccaauaucuugagaggcugcgccgauucauuucccaggaacucccgagccagcgcgccuag

SEQ ID NO: 11997 - RNA, 1905 nt, Artificial Sequence
  Description of Artificial Sequence: Synthetic coding sequence
auggcacagggugugcucuggauccuguuagguuugcuucucugguccgaucccgguacugcuucacucccccuauugauggacucgguaauccaagcccuggccgaacucgagcagaaggugcccgccgcgaaaacacgccauacggcuucagcauggcuuaugucugcucccaacuccgguccacauaaucggcuuuaucauuuccuacucggugcuuggucucugaaugcaacagagcuagauccuuguccacugagcccagaacuguugggcuuaacaaaggagguugccagacaugacguucgcgagggaaaggaguauggggugguucuggccccagauggcagcacuguggcuguggaaccucuacuggcggguuuggaggcuggccuccaaggucggcgcgucauuaaccugccucuugacucuauggccgcuccuugggagacaggggacaccuuuccugaugucgucgccauugccccugaugugagagcuaccucaucuccggggcucagagauggaucuccggacgucacuacagccgacauaggagcuaacacucccgacgcgacuaagggaugcccugacguucaggccucucuccccgaugcgaaggccaaaucaccgccaacgaugguagacucacugcuggcaguuacuuuggcugguaacuugggucugacuuuccugagaggaucccagacucagagccacccugaucucggaaccgaaggauguugggaccaguuguccgcaccgagaaccuucacucucuuggacccuaaggccagucuguuaaccauggccuuccucaauggggcccuggacggugugaucuuaggcgacuaucugucccgcacaccagaaccacggccuucuuuaucucaccuucugucccaguauuacggggccgguguagcucgcgaccccggauucaggucuaacuuuaggcgucaaaauggcgcugccuugaccagcgcuucaauacuggcacaacaaguuuggggaacucuggucuugcugcagcgauuggaacccguucaccuucaguugcaguguaugucucaggagcaacuugcccagguggcugcuaacgcuacuaaggaguuuacagaagccuuccucgggugccccgcaauccauccccgcugccgauggggggccgcaccauacagaggacguccuaagcugcugcagcuacccuugggcuuccuuuauguccaccauaccuacguucccgcgccaccuugcaccgacuuuacuagaugcgccgccaacaugcggucaaugcagcguuaccaccaggauacacagggcuggggugauauuggguauuccuuugugguaggcagcgaugguuacguguacgaagguagaggcuggcacuggguuggggcgcacacacugggacauaauagccggggcuucggaguggcaauugugggcaauuauacugccgcccucccuacggaggccgcuuugcgaacagugagagacacccugccaaguugcgcuguccgggcuggcuuacugcggccagacuaugcguugcucgggcaucggcaacugguuaggacagauugucccggggaugcccuuuucgaccuucuccggaccuggccccacuucacugccgugucccugcgcagccugcacuauaccgcccggagaccgucaguauauaccuccaguacccguccuuugccccccgcguguaacagcugcgcacggaccgcaucugcaaggccgcccaccucacgaagacacgucuauucaggaaaccugggcccagccuucgcaggacacuccgccggaaacauuccugauccggucaccagcgcguaugcugcaucugcccagccucagacucagcccgcuugcccauuuccuagcucauag

SEQ ID NO: 11998 - RNA, 777 nt, Artificial Sequence
  Description of Artificial Sequence: Synthetic coding sequence
auguuagugcuguacggccauucaacacaagaccucccagagacaaacgcuagagucguuggcgggacagaagcaggaagaaauuccuggccaagccagauuucucugcaauaccggaguggaggcagccgauaucauacauguggcggcacccuaauccgacagaacuggguaaugaccgccgcccauugcguggauuaucagaagacuuucagagucguggcuggcgaccacaacuugucacagaacgauggaacugagcaguaugugagcgugcagaaaaucguggugcaucccuauuggaauuccgacaauguggccgccggauaugauaucgcccuguugaggcuggcucagucugugacacugaacucauacguccagcuaggcguguugccucaggaaggugccauacucgcgaauaacuccccuugcuacauuacaggaugggggaaaacuaagacuaacggccagcuugcacagacucuccagcaggcuuaucugccuucuguagacuaugcaauuuguaguucaucaagcuauugggguucuacuguuaaaaauacaauggugugugccgggggagacggcguucguuccgggugccaaggggauucggggggcccuuugcacuguuuaguuaauggaaaguacuccgugcaugggguuacaucauuugucagcuccagggggugcaauguuucucgcaagcccacugucuuuacccagguuucugccuacauaucauggauaaacaauguaaucgcauccaauuag

SEQ ID NO: 11999 - RNA, 993 nt, Artificial Sequence
  Description of Artificial Sequence: Synthetic coding sequence
auggcugcccgcagaagccagaggagaaggggccgacggggugagccgggaaccgcccugcucgugccucucgcuuugggccuugggcuggcccucgcuugccuggggcuccugcuggccguuguuucacugggcucuagagccucacugucugcucaagagccagcccaagaagagcuuguugccgaggaggaccaggacccgucagaacugaacccgcaaacagaagaaagucaggauccagccccuuuucugaauagacugguacguccccgaagaucugcucccaaagggagaaaaacucgcgcucggagagcaauagccgcccauuacgaaguccacccacgaccuggucaggauggugcucaagcaggagucgauggcaccgugagcgguugggaagaagcacgaauuaacucaagcagcccucuacgguacaauaggcagaucggugaauuuauugugaccagagcaggacuguauuaccuuuacugccagucuucagacgcucuagaggccugggaaaacggcgagcgaaguaggaaaagaagagccguccugacccagaagcagaagaagcagcauaguguucuucaccuugucccuauuaacgccacaagcaaagacgacuccgacguuacagagguaauguggcagccagcccuccgucgcggaagaggacugcaggcucagggcuacggugugcggauccaggaugcaggugucuauuugcuuuauagccaaguccuauuccaggacgugacauucacaaugggucagguagugucccgagagggccagggcagacaggagacgcucuuccgcugcauuagaaguaugcccagccacccugaccgcgcguacaacagcuguuauucagccgggguguuccaccuccaccaaggagauauucucucgguaaucaucccccgggcccgggccaaacucaaccugagcccucaugggacguuccuaggauucgugaaacuuuag

SEQ ID NO: 12000 - RNA, 2253 nt, Artificial Sequence
  Description of Artificial Sequence: Synthetic coding sequence
auggccaagccccgccuccugguccuguauuucgcgcuuauuguuguaccugccugggugucuucuaucgugcuaaccggaacaagugaaccuccugacgcucaaaccguggcgccugcagaagacgaaacgcugcagaaugaagcagacaaccaggagaauguacugucccaacugcuuggagauuaugauaaggugaaggcuaugagugaaggaucugacugucagugcaaaugcguugugcgcccacugggcagagaugcaugccagagaaucaaugccggggcgagccgaaaggaagauuucuauacggucgagaccauuaccuccggcaguuccuguaagugugccuguguagcaccuccauccgcuuuaaaucccugcgagggugauuuccggcugcagaaguugagggaggccgacucucaagaucucaagcuaucaacaauuauugacaugcuggagggugcuuucuacggucuagaccugcugaagcuccacagcgucacuaccaaauuagugggaagagucgauaagcuggaggaagaggugucaaaaaaccugacaaaggaaaacgagcagauuaaagaagauauggaggagauccgcacugaaaugaacaagagggguaaggaaaacugcuccgaaaacauccuggacagcaugccagauauccggagcgcauugcagagagacgccgccgcugcuuacgcgcaccccgaauacgaggaacgcuuuuugcaggaagaaaccgugucucagcaaaucaacaguaucgaacugcugcaaaccaggccacuggcuuuaccugagguggucaagagucagcgcccgcugcagagacagguucaccuacgcggccgcccagccucucaaccgaccguaauuagaggaauaaccuauuacaaagcuaaaguaucagaggaggagaaugacauugaggagcaacaggaugaguucuucucaggugacaacgggguggaccugcucauugaggaucagcugcuccgccauaacgggcugaugacaucugugacacgccgacccgccgcaacaagacagggucauucaacggcggugacuagcgaccugaacgcacggacggccccuuggaguagcgcucugccccagcccucgacaucugacccauccaucgcuaaucacgcuagcgugggacccacucugcaaacuacgucaguaucccccgacccuacuagagaaagcgugcugcagccuucgccccaggugcccgcuaccaccgucgcccacacugcaacccagcagccugccgcaccggcuccgccagcaguguccccacgugaggcccugauggaagccaugcacaccgugcccgucccacccacaacagugcggacugacucacugggcaaagaugcgcccgcuggauggggaacuacaccugccucaccuacccugucuccugaggaggaggacgauauucgcaauguuaucggucgauguaaagauacauuaagcacuaucaccggacccaccacacagaacacuuacggccggaacgaaggggcguggaugaaagacccgcuggccaaggacgaaaggauauacguuacuaauuacuauuacggcaacacucuuguagaguuccggaauuuagagaacuuuaagcagggccgcuggucuaauuccuacaaacuuccuuauucuuggauaggcacggggcaugucguuuacaacggcgcuuuuuauuauaacagagcuuuuacaaggaacauaauuaaguacgaucugaagcagagguacguggcagccugggcaaugcuucacgauguggccuacgaggaagcuaccccauggcgcuggcagggccauagugacguggacuuugcuguggacgaaaacggauuguggcugauuuaucccgcccuggacgaugagggauuuucccaggaggugauuguucugucuaaacuuaaugccgcagaucuuucuacgcaaaaggaaacaacguggcggacaggucugcgacgcaacuucuacggaaauuguuucgucauauguggcguccuuuaugcaguagauaguuacaaucagcggaacgcuaacauuucuuacgcuuuugauacucauacaaacacacagauuguuccccgucuguuauucgaaaacgaguauucuuauaccacacaaauugauuauaacccuaaggaccgguuacuguacgcuugggauaacggacaccaggugacauaccacgugaucuucgcauacuag

SEQ ID NO: 12001 - RNA, 678 nt, Artificial Sequence
  Description of Artificial Sequence: Synthetic coding sequence
augaagcuggggugcguguugauggcuugggcgcuauaccugucuuugggcgugcucuggguggcccaaaugcuguuggcugcaggaugucaugccgaauuauuuccugcccccauccugcgcgcugucccgucugccgagccucaagccggauccccaaugacacugagcugccaaacuaaacugccauugcaacggucugccgcaaggcuguuguuuagcuuuuauaaagacggccgaauuguucaaagccgaggucuuaguagcgaauuucaaaucccuacugcuagugaggaucauagcgguagcuacuggugugaggcagcuacugaggauaaucaggucuggaaacagaguccucagcucgaaauuagagugcaaggagcgucaucaagcgccgcaccacccaccuuaaacccagcuccccagaaguccgcagcucccggaacugcaccugaagaagcucccggaccccuuccaccuccaccaaccccaagcucagaagaccccggauucaguagcccauugggaaugccugauccacaccuauaccaccaaaugggcuuguuacugaagcauaugcaggaugugcgggugcugcuuggccaccuguugauggagcuaagagaauuauccggacaccggaaaccagggacuaccaaggcaaccgccgaguag

SEQ ID NO: 12002 - RNA, 891 nt, Artificial Sequence
  Description of Artificial Sequence: Synthetic coding sequence
augucucgccaggaacccaaaauguuugugcugcucuaugugaccagcuuugccauuugcgcuagcggucaaccuagggguaaucagcucaagggcgaaaacuauucaccuagauacauuuguagcauuccaggucuccccgguccaccagguccuccuggggccaacggcucacccggcccccacggcaggaucggacuuccagggagggacggccgggacggucgcaagggagaaaagggcgagaagggcaccgccggccugcgggguaagacuggcccucugggucucgcgggggaaaaaggugaucagggcgaaaccgggaaaaaagggccgauuggaccagagggagaaaagggagagguuggaccgaucggaccgccaggaccgaagggugaccguggugaacaaggagacccuggauugccuggcgucuguaggugcgggagcauuguccugaagagcgcauuuuccgugggaaucaccaccucuuaucccgaagaaagacucccaaucauuuucaacaagguacuguuuaaugagggcgagcauuacaacccugcaaccgggaaguucauuugugcuuuccccgguaucuauuauuuuucauaugauaucacccucgcaaauaaacaccuugccaucggauuaguucauaauggucaauauaggauaaagacauuugacgcaaacacugggaaccaugacgucgccagcggcucaacagugaucuacuuacagccggaagacgagguguggcucgagauauuuuuuacugaucaaaauggauuguucagcgacccagguugggcugacagucuuuuuucuggcuuccucuuguauguugauacagauuauuuggacucgaucagcgaggacgacgaacuguag

SEQ ID NO: 12003 - RNA, 1275 nt, Artificial Sequence
  Description of Artificial Sequence: Synthetic coding sequence
auggggagcuuaguacuaacuuugugugcacuuuucuguuuggccgcauaccucguuucaggaucuccgaucaugaaucuggagcagucaccauuggaggaggauaugucucucuucggugacguuuuuucagaacaggauggcguggacuuuaacacccugcuccaguccaugaaagacgaauuccugaagacacugaaccuauccgacaucccaacccaggauucagcgaagguggacccuccugaauacaugcuagaauuguacaauaaguuugcaacugacagaacuucaaugcccucagccaacauuauccgcuccuuuaagaacgaagaucucuuuucacagccaguuucguucaauggucugcgaaaguacccucugcuguucaacguuucuaucccccaccaugaagaagugauaauggccgaacugcggcuauauacucuugugcaacgcgacagaaugauuuaugacggcgucgauagaaagauuaccaucuucgagguacuggagagcaaaggugauaacgaaggagaacggaacaugcucgugcucgucagcggcgagaucuacgguacaaacucugagugggagacauucgacgugacugacgccauccgcagauggcagaaauccggaagcaguacccaccagcucgagguucacaucgagucaaaacaugacgaggccgaagaugcuuccuccggaagauuagagaucgacaccuccgcccaaaacaagcauaauccacugcugaucgucuucucagacgaccaaucaucagacaaagagagaaaggaggaacucaaugaaaugaucagucaugaacagcucccugagcucgacaaucucggccuggauagcuuuucaucuggcccgggggaggaggcauuacugcagaugagaucuaauaucaucuaugauucuacugcacgcauuaggcggaaugcuaagggcaauuauugcaaacgcacaccacuuuauauagacuucaaggaaauaggcugggacagcuggauuaucgcgccucccggcuacgaggccuaugaaugcaggggaguguguaacuauccucuggccgaacauuugacaccuacgaaacaugcuaucauccaagcacucguccaucugaaaaauucgcagaaggcaaguaaagcauguugugucccaacgaaacuggaacccauuagcauccuuuaccucgauaaggggguggugacguacaaguuuaaauacgagggaauggccguauccgaguguggauguagauag

SEQ ID NO: 12004 - RNA, 381 nt, Artificial Sequence
  Description of Artificial Sequence: Synthetic coding sequence
augcacuugagucagcugcuagcaugcgcacugcugcucacacuccugucucugcguccuucugaagcgaagcccggugcaccuccgaaagugccccgaacccccccagccgaggaacuggcugaaccucaggcagcuggaggcggacagaagaagggagacaaagcgccugguggaggaggugccaaucugaaaggggaccguagccguuuacucagggacuuaagggucgauaccaaaucucgggcggccugggcuaggcuuuugcaggaacauccaaacgcccgaaaauauaaaggugcuaauaagaaggggcugagcaagggaugcuuuggucugaagcucgauaggaucggaucuaugucgggacuuggcuguuag

SEQ ID NO: 12005 - RNA, 423 nt, Artificial Sequence
  Description of Artificial Sequence: Synthetic coding sequence
augagauccccacgcaugagagugugcgcuaaaagcgugcuccugucacacugguuauuccucgcauacgugcugaugguguguuguaaauugaugagcgcuuccucccagcaccugcgcggccaugcugggcaccaccagauuaaacaagggacuugcgaggugguugcugugcaccggugcugcaauaaaaaccgcauagaagaacgcucccaaaccguuaaguguaguuguuucccugggcaggucgcaggcacgacccgagcacagccaucuuguguugaagccucaaucgucauucaaaagugguggugucacaugaaucccugucuggaaggugaagacugcaaagugcucccugauuacuccggguggucuuguucaucuggcaacaaggugaagacaacgaaggugacgagguag

SEQ ID NO: 12006 - RNA, 1332 nt, Artificial Sequence
  Description of Artificial Sequence: Synthetic coding sequence
augcuaaugcuguucguuuucggcguccuuuugcacgagguuucacuuagcggccagaaugaggccccgccgaacacccauucgaucccaggagagcccuuauacaacuaugcgucgauacgccuuccugaagaacacaucccuuucuuccugcacaacaacaggcacauugcuaccgugugucguaaagauucacuguguccauauaagaaacaccucgaaaaacugaaguauugcuggggauacgaaaagagcuguaagccggaguuccgguuuggcuacccugugugcuccuacguugacaugggcuggacugauacccuagaaucggcugaggauauuuucuggaaacaagcagauuucggguacgcuagagagcgccuggaagagaugcaugugcuaugccaaccaaaagagacauccgacucuucucuugugugcucacgcuaccugcaguacugucgcgccacaaaucuguaccuggaucuaaggaauaucaagcguaaccacgaucgguucaaggaggacuuuuuucaaagcggagagauaggcgggcauuguaaguuagauaucagaacacuaacaucggaaggccaacgaaaaagcccccugcaauccugguucgcugaauuacaguccuacacacagcucaauuuucgacccauugaggaugccaagugugauauugucauugagaaaccuacuuauuucaugaagcuggaugccggcgucaauauguaccaccauuucugugauuuuaucaacuuauacaucacacagcacgugaauaacaguuucaguacagacguguacauugugaugugggacacagauggcaaaauucggguuacaauccucgcucggucuacggaguacagaaaaauucugaaccagaacgagcuagugaaugcuuuaaagacagucucgacuuuugaagugcagauaguagauuacaaguaucgagagcugggguuccuggaucagcuucguaucacucacaacacagacauuuucaucgggaugcauggcgcugggcugacacaccuguuguuccuuccagacugggcugcagucuuugagcucuacaauugcgaagacgaaagguguuaucuugaucuugcuagacucagaggggugcacuauaucacuuggcggcggcaaaacaagguuuucccccaagacaaaggccaucauccaacucuaggcgaacaccccaaguuuacaaacuauuccuuugacguggaggaguuuauguauuuggugcuccaagcagcugaucacguccugcaacacccuaaguggccauucaaaaagaagcacgaugagcucuag

SEQ ID NO: 12007 - RNA, 336 nt, Artificial Sequence
  Description of Artificial Sequence: Synthetic coding sequence
augggcccuaguucuugucuucuucugauccuaauuccccuucugcagcuaauaaaccccggaucuacucaauguagccucgacagcgucauggauaagaagaucaaagauguccucaauagccuggaauauagccccagcccaauuagcaaaaaauuaucuugcgcaucagugaaaucccaagggcguccuagcucuugucccgcuggcauggccgugacagggugugcaugcggcuacgguugugguaguugggaugugcaauuggagacaacuugccacugucagugcucugucguggauuggacaacugcacgcuguugccaccuuaccuag

SEQ ID NO: 12008 - RNA, 1965 nt, Artificial Sequence
  Description of Artificial Sequence: Synthetic coding sequence
auggcacccaaaaagcugucgugucuccgaucccuacuguugccacuuagucuuacucugcugcugccacaagcagacacgcgaucauucguaguagaccgcgggcaugaucgcuuucugcuggauggugcucccuuccgguacguuagugggucguugcauuacuuucgcgugccacgaguucugugggcagaccgccuucugaaaaugcgcuggagcggccugaacgcuauccaguuuuacguuccuuggaauuaccacgaaccucaacccggcguguauaacuuuaacggcagucgcgaucuuauugccuuucugaacgaagccgcuuuagccaacuuacuugugauccucagacccgggcccuauaucugcgcagaaugggagaugggcggccuaccuucauggcuucucaggaagcccgaaauacaucugagaaccagugauccugauuucuuggcagcaguugacucaugguuuaaagugcuucugccuaagaucuaucccuggcucuaucauaacggaggaaauauuauuucaauucaagucgagaacgaguacgguucuuacagggcuugcgacuucucguauaugaggcaucuggcaggcuuauucagagcucuccuuggagaaaagauccucuuguuuaccaccgacggccccgaaggccuuaagugcgguagccuacgcggacuguauacgaccguugacuucggcccugccgauaacaugaccaaaauuuucaccuugcugcguaaauacgaaccacacgggccccuggugaauagcgaguauuacacaggguggcuggacuacuggggucaaaaccauagcacuagauccguaucugcugugacaaagggccuggaaaacaugcugaagcugggcgcgucagugaauauguacauguuccacggcggcacaaacuuuggguacuggaacggcgcggauaaaaaggggcgauucuuaccgauuacaacaaguuacgacuacgaugcucccaucucagaggcgggugauccgacucccaaacuguuugccuugagagaugucaucagcaaauuucaggaagugccacuuggaccccugcccccacccucaccaaagaugaugcugggaccaguaacgcugcaccugguggggcaccuucuggcuuuucucgaucuccugugcccuagagguccuauucacagcauccugccaaugaccuucgaggcagugaaacaggaccauggcuucaugcuguauaggacuuacaugacucacacaaucuuugaaccaaccccuuucugggugccuaauaacggcguacacgauagggcuuaugugaugguagacggaguauuucagggagugguggagagaaauaugagggauaaacuguuccugacgggaaagcucggcaguaaauuagauauccuaguagagaauaugggccgucuuucuuucggcuccaacaguagugauuucaaaggacuucugaaaccucccauccuggggcagacaauucugacacaguggaugauguucccccuuaagaucgauaaucuuguaaaauggugguuuccgcugcaacuccccaaauggccauauccucaggcccccagcgguccaaccuucuauucaaagacauucccaauccugggcagugucggggauacuuuccuguaccucccuggguggacuaaaggacaggucuggauuaacggauucaaucuggggagauacuggacaaagcaggggccccagcaaacucuguacguaccgcguuuucuguuauucccccgaggggcauugaacaaaaucacacugcuggaacucgaagaugugccacugcaaccacagguacaguuucuggacaaaccaaucuugaauucuacuucaacccugcaucgaacacauauuaacucucucagcgcugacacucugucagcgagcgaaccaauggagcucagugggcacuag

SEQ ID NO: 12009 - RNA, 2502 nt, Artificial Sequence
  Description of Artificial Sequence: Synthetic coding sequence
augaauauggagauaggucacccacacgaggguaaagacgaucuaggcgacaagagaguaauaaugggcaccaaauuuccuauggagcugggcauucgcgucggucuggguaaggaggauucaaggugcggcgaguccccuguggucucgaauaaaugugaaggaagaauggccccgccugaaacaaaguuuccgcucucgaagggacuggaaaugggucucgaaagacagaacaucucucguaccgucaugcaaaggggcucacugggcgucgacucuguuagcgccucgcaggguacgaaaccaucccuguugccuggaagaauggggcucgaaaacgagucucugcucgccggauauacccacgaaaggauuauacaaccuccccugggcaggguuugugggagcucucaagcggccgggagcaggcgcgcuccacuugcaagcgggccugaaggcguggaggaauuggugggaaaaccggcauuugucauggagccacggcaggagauggaaaaggaauccacuuguguacucaugaagccaaauaccgaaaucaaacuacccgucgaaguugacauuggacucacacaggccgaaggccccgacgaaacaaaaaacacagagccacagaugggacugguuaucgagccaccucaaugccaguucgcccagcaacacgaacagcggaaggaagcuggaaacauugaaagcggcguggaaccccccgauagaauacggccaaucuacaguggcaaauucuuugaucgcacuccuuguuggccuuccgcuggaaaagugaucccuguaggauacagagucgcuacgugcuugaccgaaaagcuuccucggcugauuacaccacccgaagcgaagaaguacuuuaacuuucgcuacccucccgcugguguggaaaggguguuuuacggaagagcaaaugacccccagaucgcaccauaccucacucacgguaucaggagcaaaauuagcgugcuggcuaauacccucauaaauccccagccaaucacaacguuccagcagaaaauuaaggauaaaaaggaauccauuuaccuuucuaaccgcagagcaccacugggcaagucccaugaucaagccccaggcuugccuaagggcauggacaccacuaauacaacauuugggacugcuguuaucaaggaguacagugcgaaagacguugugaacccaccaaagaguuacgaagaggucuuuaaagaggguaaugaggggcaugaccuguacgucgucucgcacaacgacuauuaugcaggcgaagcuaagaacaggaaguauaaccccuccaguuuucaucggugcucuguauauggcgucccuaccccccacuuuaaugauggccgcgcgauggccaagaguuuguacuggcugcaugagcugcagaugaaacgcggagcgaaguucguaucuaagcgggccgaugauuucaaagaaaaauuccaacacaaacuggguagaguguuggaccccaucgcagaaacgaugaacgugccuccagacugcacauucggggcaugcuugaggccugaagaauauggcgugggagaucuuauccauaaccgguuaccugaugaguaucugagggguaaagaccggcagcgugcccugaucgccgccguccgucaccaccugaagaaggucaauuaccagaaauuugacacucuguuagcugcauuccggcauuacgauaaaaagggggauggaaugauugacaaagacgagcugcaggaggcaugcgaucaggcaaaucugucacucgaugauaaacuccuggaccagcuuuuugacuauugugacguugacaaugauggauuuauuaacuacuuggaauucgccaauuuucugaauuggaaagacaagauguugcugaaggaauaugaggagagaguuauuaucaaagggcggaagccagacugugucaacccgaccgaggcaaaugucgaggaacccgaacagacccuauugaucaagcccgaagacaucguccuuaaagaagcuggcucgacugaaaagacuuugagaacccugcugagacccucagauaaaguuagcaacuacuauaaaacaacaucauccgaaaucaacgccaucguaggggcaauucccagcacaugcuauccgaucuguggggucccaacaauacgcuccgacaucccugcgccucguauaaggcgaauuucagauagaacgaacuacggagaggaaggguccgccuauagccuguuguacccaacuauauuugcuaggaaggguguguuugaacgcgacuuuuuuaaaaccagguccaaagaggaaaucgcagagauccuguguaauauugguguuaagcucuccgacgaggaauucgaaaauguuuggaaccuggccaguaaaaagcaccaccgcggagagguguguguggagaacauccgcaauguccuagacgagcuucgacacgccgauagaauuaaaugcaagacccugauguag

SEQ ID NO: 12010 - RNA, 2004 nt, Artificial Sequence
  Description of Artificial Sequence: Synthetic coding sequence
augggcucuuccagguuggcugcacucuugcugccccugcucuugauaguuaucgaccucucggacagcgccggcauaggcuuucgucaccugccacacuggaacacucgcugcccccucgccucucauacugacgacagcuucacagggagcucugcuuauauuccuugccggacauggugggcccuuuuuagcaccaagccauggugcgugagagucuggcacugcucacgcugccucugucagcacuuguugucagggggaagugggcuccaacgcggacucuuccaucuucuggugcagaagucuaagaagucaucuacauuuaaguucuacagaaggcauaaaaugcccgcacccgcucaaagaaagcugcugccacgccgccaccugucagaaaagucccaccauaucucuauacccucucccgacaucucucacaaaggguugcgcuccaaacggacacagccaucggaucccgagacgugggagucacuaccgcgauuagacucucaacggcauggagggccagaguucucguucgaccugcuaccugaggcuagagccauucgugucaccaucucaucagggccagagguaagcgucagacugugucaccagugggcucuggaaugcgaagagcugagcagccccuaugauguccagaagaucguuucuggagggcacacaguggagcuuccauacgaguucuugcuacccugccuaugcauugaggccaguuaccuucaggaagacaccguuaggagaaaaaaaugcccauuccagucauggccagaagccuacgguagcgacuucuggaagucugugcauuuuaccgauuauucccagcauacucaaauggugauggcccucacguuacgaugcccucuuaaacucgaagcugcccugugccagcggcacgacuggcauaccuugugcaaagaucuccccaaugcuaccgcucgagaguccgauggcugguauguauuagagaaaguggaucuucacccucaauugugcuuuaaguucaguuuuggcaauuccucucacguugaaugcccccaucagaccggcagucucacuaguuggaacguuucaauggauacccaagcacagcaguugauucuucauuucuccuccaggaugcaugccacguuuagcgcugcuuggucucuaccuggcuuaggacaagacacacuuguccccccgguguauacugucucccaggcccggggaucuucacccgucagucuggaccugauuauuccuuuccuucguccuggcugcugcguguugguuuggagaucggaugugcaguucgcauggaaacacuuauuguguccggacgugagcuauagacaccuugguuuacugaucuuagcccuccucgcucugcugacauugcucggaguggugcuugcguugacaugccggcggccucaauccggccccggaccagccaggcccgugcugcugcugcaugcagccgacagugaggcccagaggagacuaguuggggcgcuagccgaacugcugagagcugcacugggugggggccgggacgucaucguggaccugugggagggacgccacguagcccgagucggcccguugccauggcugugggcugcucgcacacggguggcacgcgagcaggggacaguucuguugcuguggucuggagccgacuuaaggcccgugucuggaccugacccccgggccgccccccuuuuagccuugcugcaugccgcaccaagaccccuucuguugcuggcuuauuuuucccgccugugugcaaaaggagauaucccccccccacuucgcgcguuaccuagauaccgacuauuaagggaccugccuagacuccugagggcucucgacgcccggcccuuugccgaagcuacuaguuggggacgccugggagcucgccaaaggagacaaagucgguuggaguugugcagccgguuagaacgcgaagcugccagacuggcagaucuuggguag

SEQ ID NO: 12011 - RNA, 609 nt, Artificial Sequence
  Description of Artificial Sequence: Synthetic coding sequence
auggagcuguggggggcauaccugcugcuuugucuuuuuagccucuugacucaggucaccacagaaccaccgacucaaaagccaaagaaaauuguaaacgcuaagaaggauguggucaauacgaagauguucgaagaacuuaaaucgcgguuggauacuuuagcccaagaaguggcacuccugaaggaacagcaggcacuucagaccgugugcuugaaaggaacuaaaguccacaugaagugcuuccuggcauucacccagacuaagaccuuccacgaggccuccgaagacuguauuagcagaggcgggacacugggcaccccccaaaccggauccgagaacgaugccuuauacgaauaucugagacaaagcgugggcaacgaggccgagauuugguugggucuaaaugacauggccgcugaagguacauggguggacaugacaggcgcucgaauagccuacaaaaacugggagaccgagauaacagcucaacccgacggcggcaaaacugaaaacugcgccguguugucaggagcggccaacggaaaaugguucgauaaacgcugcagggaccaacugccauacaucugucaauucggaauaguguag

SEQ ID NO: 12012 - RNA, 1839 nt, Artificial Sequence
  Description of Artificial Sequence: Synthetic coding sequence
auguuggaggggcugggaucucccgcuucaccccgagcugcugcaagcgcgagcguagcugggaguucuggcccagccgccuguucuccaccuucuucaagcgcgccucguagcccugagagcccagccccaagacguggaggggugagggccucaguuccccaaaagcuggcagagaugcuuuccagucaguacgggcugauugucuuuguggcaggccugcugcugcugcucgcgugggcagugcaugccgccggggucucuaaauccgaccugcugugcuuccugaccgcacugauguugcugcagcuguuguggaugcugugguacguagggcguucguccgcacauagacgacuuuucaggcugaaagacacacacgccggggccggaugguugcgcggcucaauuaccuuauucgccgugauuacuguuauucucgguugucugaagaucggguauuucaucgguuucagugagugccugagugcaaccgaaggagucuuucccguuacacauucaguacacacccugcuucagguauauuuuuuguggggccacgccaaggacauaauacaaucauuuaagacgcucgagagauuuggaguuauucauuccguuuuuacgaaccugcugcugugggccaacggugugcugaaugagucgaagcaucagcuuaaugaacacaaggaacgccugauaacucugggauuugguaauauuaccaccgugcuugaugaucacacaccacaguguaauugcacaccuccaacauuauguacggccauuagccaugggauauacuaccuguacccguuuaacauugaauaucaaauacucgcuuccacuaugcuguacgugcuuuggaaaaacauuggacguaagguggacagucaccaacaccagaagaugcaguuuaaaagugauggaguuauggugggagcggugcuuggauuaaccgugcucgcagcaacgaucgccguuguggucguuuaucucauucacauugggcguagcaagaccaagucugaaucugcacugaucauguucuacuuguacgcuauuacccuguuaaugcuaaugggcgcugcaggguuggcuggcauuaggaucuaucguaucgacgagaaaucccuagacgaguccaagaaccccgcucgaaaacucgauucugaucuucuggucggcacagcauccggcucuuggcugaucagcugggguagcauccuggcuauucuuugugcugaagggcacccuagguauacaugguacaaucuccccuacaguauauuagcuaucguggaaaaauauauucaaaacuuauucauauuugagagcauccaucgcgaacccgaaaaauuauccgaggauauacagaccuugcgcgugguuacagucuguaacggcaacaccaugccacucgccaguucuugccccaagagcggggggguugcucgggacguagcuccucaagggaaggauaugccaccagcagccaacgggaacguuuguaugagagagucccacgacaaggaggaagagaagcaagaagagucaaguuggggaggcucuccaucaccugugcgacuaccccgcuuucuucaagguaaugcaaaaagaaaggugcugagaaacaucgccgccuuccuguuccuaugcaacauaucccuguggauuccucccgcguucgggugucgccccgaguaugacaacggccuagaagaaaucguguucgguuucgaaccguggauaauaguggugaaucucgccaugcccuucuccaucuucuaccgcaugcacgcggcugccagccuauucgaaguguacuguaagauuuag

SEQ ID NO: 12013 - RNA, 786 nt, Artificial Sequence
  Description of Artificial Sequence: Synthetic coding sequence
auggagcuccuccaaguaacaauccuuuuccugcugccaagcaucuguucaucuaacucuaccgggguuuuggaggccgccaacaacagucugguagucacuaccaccaaaccaucuaucaccaccccuaacaccgagagcuugcaaaagaaugucguaacaccaacgacaggcacuaccccuaagggcaccauuacuaacgaguuguugaagaugucccuaauguccacagcuaccuuucucacuucuaaggacgaaggcuugaaagcuacuacuaccgauguccgcaaaaaugauagcaucaucucgaacgucacagugacauccgugacgcugccuaacgccguuuccacccuccagaguuccaagccgaagacagagacgcaaucaucuauuaaaacuaccgagauucccgggaguguccugcagcccgaugcuucaccauccaaaacggguacacucaccucuauacccgugaccauuccagagaauacaagucagucacaagugauuggcacggaaggcgggaaaaacgcuucaacaucugcaaccaguaggagcuacucuucaaucauucuccccguagucaucgcacucaucgucaucacucucagcguguuuguguuagucggacuguaucgcaugugcuggaaggccgacccggggacaccagagaauggaaacgaccagccccaguccgauaaggaaagcgugaaacuccucacaguaaaaacuaucucucacgaaagcggugaacacagcgcccaggguaagaccaagaauuag

SEQ ID NO: 12014 - RNA, 6408 nt, Artificial Sequence
  Description of Artificial Sequence: Synthetic coding sequence
augccggcacugggcccugcacuucuccaagcguuaugggcagguuggguguuaacccugcagccccugcccccaacggccuuuaccccgaacggaacauaucuccagcaucuggcgagggauccuaccagugggacacuguaucuaggagcaacaaacuuucuguuccaguugucaccggggcuucaguuagaagccaccgucuccacgggcccuguguuggacucucgugauugucugccucccgugaugccggaugaguguccccaggcacaaccuacgaacaaccccaaccagcuccuacugguuuccccuggcgcccugguggucugugguucuguccaccagggagugugugagcagagacggcuaggccaacuugagcagcuacuguuaaggccagaaagaccaggcgauacccaguacgucgcugcuaacgacccagcuguuagcacagucggccucguugcgcagggacuagcaggcgaaccucuuuuauucgugggcagggguuauaccagcaggggagugggaggugggauuccucccauuacgacacgcgcguuguggccccccgacccccaggccgccuucuccuacgaagaaaccgcaaagcuggcaguuggcagauuguccgaauauucacaucacuuugugucugccuucgcccggggggcaucagcuuacuuucucuuucugcgccgggaucuccaggcccagagccgagcuuuuagggcuuauguguccagagucugucuccgugaucagcauuauuacagcuacguugaauuaccauuagcaugcgaaggaggaagauauggguugauucaggccgcugcuguugcuaccucccgggagguagcacauggugaggugcuguucgccgcguucucuucugccgcgccaccaaccguuggccgaccccccuccgcugccgcaggugccucaggugcuagcgcacugugugcauucccguuagacgagguggacaggcucgccaaccgcacuagggaugccuguuacacccgagagggaagggcagaagacggcacagaagucgcuuacauugaguaugaugucaauucugacugcgcacaauuaccaguggauacacucgacgcuuaccccugcgguucagaccauacgccaaguccuauggcgucaagagucccucuggaagccacaccaauuuuagaauggccuggcauucagcugacagcagucgcagugaccauggaggacggccacacuauagccuuuuuaggcgauucacaggggcagcugcaccggguguaccugggucccgggagugacgggcacccguauaguacucagagcauucagcaaggcagugcugucucucgggaccugaccuucgacggcacauucgaacaccuguaugugaugacccaguccacacugcugaaggugccuguggcgucaugcgcacaacacuuagauugcgccaguugucuggcacaccgagaucccuacugcggauggugcgugcuccugggacggugcucuaggcgguccgaguguaguagagggcaggggccugaacaguggcucuggucauuccagccagagcuggggugucuacaggucgcggcuaugagcccagccaauaucucccgugaggaaacaagagaaguguuucucuccgucccugaucuaccaccacuuuggccaggggagagcuacagcugucacuuuggcgaacaccagucuccugcccuucugaccgguuccggagugaugugcccaucgcccgaccccucugaggcucccguacugccccgcggcgccgauuauguguccguuaguguugagcuaagauuuggggcuguuguuauagcaaagacuagucuguccuucuaugacuguguugcuguaaccgaacuucgaccaucagcccagugccaagccugcgugucuuccagaugggguugcaauugguguguguggcagcaccugugcacucacaaagcgucaugugacgccggccccauggucgcaagucaccagaguccccucgugagcccagacccgccagcuagggguggcccuucccccucuccccccacagcuccuaaggcccuugccaccccagcucccgacacuuugccuguggagccuggugccccaaguaccgccacagccagugacaucucccccggcgcaucccccagccuccugucucccuggggcccuugggcgggcucaggcucuaucaguucuccagguucaaccgggucuccccuacacgaagaacccuccccccccagcccacagaauggcccugguacugcugucccagccccaacugacuuucgaccuuccgcgaccccagaggaucuucuggccucaccucucuccccuagcgaaguggcugcuguuccucccgcagauccuggcccggaggcacuacauccuacagugccccucgaccucccaccagccaccguccccgccacuaccuucccaggggcuaugggauccguaaaaccugcccuggauuggcugacacgcgaaggaggugaguuaccugaagcugacgaauggacuggaggagaugcgccagcauucagcacauccacacugcuuagcggcgauggagauagcgccgaacuggagggcccgccagcccccuuaauucucccaaguucguuagauuaucaguaugacacaccagggcugugggaguuagaggaggccaccuuaggcgcaagcucuugccccugcgucgaguccguucagggaucaaccuugaugcccguccacguggagagagaaauucggcuccuagggcgaaaucugcacuuguuccaagauggaccaggagacaacgaauguguuauggagcuggaaggacuugaaguuguuguagaggccaggguggagugcgagccuccaccagauacccagugccaugugaccugucaacagcaccagcuaagcuacgaggcccugcaaccagaacucagagugggucucuuucugagaagggccggacguuugcgcgucgacucugccgagggccugcauguaguguuauacgauugcagugugggccauggugauugcuccaggugccagaccgccaugccccaguacggcuguguguggugcgagggggagaggccuaggugcgucacuagggaagccuguggugaggcagaagcugucgccacucaguguccugccccuuugauccacagcguggaaccacugaccgguccaguggauggcggcacacgcgugaccauucgggggagcaaucucgggcagcacguccaggacguccuuggaauggucaccgucgcuggugugccuugcgcuguggaugcucaggaguacgaggucucaucgucacuugugugcaucacuggcgcauccggagaagagguugcuggugcgacagcuguggagguuccagggcgaggaagaggggugucugagcaugacuucgccuaccaggaccccaaagugcacaguaucuucccugcucguggcccgcgcgccggcggcacacgacuuacccugaauggcucaaaguugcucacggggaggcuugaggauaucagaguuguugugggagaucaacccugucaucuucugcccgagcagcaaucagagcaacugcguugcgagacauccccucgaccaacaccugcaacccugcccgucgccguuugguuuggcgccacugaacggagacuccagagaggucaguucaaauacacucucgacccaaauaucaccuccgcagggccuacuaaaagcuuccugagcgguggacgggaaaucugcgugagggggcagaaccuagaugugguacagacgccaaggauuagaguaacaguugugucacggaugcuacagccgagucagggauuaggacggagacggcgcguugugccugagaccgcuuguucuuuagggcccagcuguuccagucagcaauucgaagagccaugccacgucaauucaucccaguugauaacgugucguacccccgcacugcccggucucccugaggaccccuggguaagaguggaguuuaucuuagacaaucucgucuucgacuuugccacccucaacccaacucccuuuucuuaugaggcggacccaacauuacagccccugaauccugaagacccuaccaugccauuccgacacaaaccugggucugucuucagcguggaaggagagaaccucgaccuugcaaugucuaaggaagaaguggucgccaugauaggagacgggcccugcguugugaaaacccucacccgucaccaucuguacugugagccaccuguggaacagccucuuccccgacaucaugcgcucagggaagccccggauucccuaccagaauucacagugcagaugggcaaccugcgguuuucucugggccacguacaguaugauggcgagaguccaggcgcauucccagucgccgcgcagguugggcugggggucgguacuucccuccuggcccuagggguaauuaucaucgucuuaauguaucggagaaaauccaaacaagccuugagagauuauaaaaaggugcagauacaguuggagaaccuggaguccagcguaagagaccgauguaaaaaagaauucacugaucucaugaccgaaaugaccgaucuuacaagcgaccuccuugguucagggauaccauuccuugacuacaagguauacgcggagcggauuuuuuucccagggcaccgagaguccccccugcaucgagaccugggugucccagaaucacgccggcccaccgucgaacaagggcugggucaacugagcaaccuccugaacagcaaacuuuuccuuacaaaauucauccauacucuggagucucaacgcaccuucucagccagggauagagcuuacguggcgaguuugcugaccguugcccugcacggaaaacucgaguacuuuacugacauucuacguacccuguuaagugauuugguggcccaguauguugcaaaaaauccuaaacugauguuacgacguacugagaccguaguagagaagcuccugaccaacuggauguccaucugccuguacaccuuuguacgcgauagcgugggagagccacucuacaugcuguuccggggcaucaaacaccaggucgacaaggggccgguggacagcgugaccgguaaggcuaaauacacgcucaacgauaaucggcugcucagagaagacguagaguaccggccguuaacucucaaugccuugcucgccgucggcccuggagcuggcgaggcucaaggugucccugugaaagugcuagacugugacaccauuucccaagccaaagaaaaaaugcucgaucaacuguacaagggugucccauuaacccaaagaccggacccacgaacucuggaugucgaguggcgaagcggcguugcuggccaccucaucuuauccgaugaggacgugacgucugaaguucaagggcuguggcggagacucaauacucugcaacacuacaaagugccagauggcgccacgguggcccucgugccaugccugacuaagcauguccuccgugaaaaccaggacuacgugccuggcgagcguacuccaaugcuggaagacguagaugagggcgggauccgcccauggcaucuggucaaaccguccgaugaaccugaaccuccucguccgaggcgaggaucauugcgggggggcgagagagaacgcgcaaaagcaaucccugaaaucuaucuuacuagacugcucucaaugaaaggaacccugcagaaauuuguggacgaucuauuccaggugauccuaucgacaagccgaccuguaccacuggccguuaaguacuucuucgacuuguuggaugagcaggcccaacaacacggcauuagcgaccaggacacaauccauaucuggaagacuaacucucugccucugcguuucuggaucaauaucauuaaaaauccccaguucguguuugacguucagaccucugacaauauggaugccguucuccuagucauugcucagacuuuuauggacgcaugcacccuugcugaccacaagcugggaagggacagcccuaucaauaaacugcuguacgccagggauaucccacguuauaaacggaugguagagcgauacuacgcugauauacggcagaccgugcccgcauccgaucaagaaaugaacuccguccuggccgaauugucuuggaauuauuccggggacuugggagcucgugucgcccugcaugaacuguauaaguauauuaacaaguacuaugaucagauuaucacugcccucgaagaagauggcacagcccagaaaaugcaguuaggguauagacugcaacagauagccgcagccguagaaaauaaggugacugaucuuuag

SEQ ID NO: 12015 - RNA, 297 nt, Artificial Sequence
  Description of Artificial Sequence: Synthetic coding sequence
augaaacuaaugguccuuguauuuaccaucggacuuacccucuuacugggcguucaagcuaugccggcuaaucgucuguccugcuaccguaaaauacuuaaagaccauaauugccacaaucugcccgaaggcguggccgaccugacucagauugacgucaacgugcaagaucauuuuugggauggaaaaggcugcgaaaugauuugcuacuguaacuucagcgaauuacuuugcuguccuaaagacgucuucuucggcccuaaaaucuccuuugucauccccugcaacaaucaguag

SEQ ID NO: 12016 - RNA, 1443 nt, Artificial Sequence
  Description of Artificial Sequence: Synthetic coding sequence
augaaacgaagcguagcaguguggcugcuaguuggauuaucgcuaggggucccacaguucgguaaaggagauaucugugauccgaaucccugugagaacggcggaauuuguuugccaggguuggccgauggaaguuuuaguugcgagugucccgacgguuucacugacccuaacuguuccagcgugguugaaguggcaagugaugaggaggaaccgacgagugccgggcccugcacaccuaauccaugccauaacggugggacuugugaaaucucugaagcuuacagaggagauaccuucaucggguaugucugcaaaugcccacgcgguuucaaugggauucauugccagcauaauauuaaugaaugcgaggucgaacccugcaaaaacgggggaauaugcacugaucugguggcuaacuauucaugugagugccccggggaauuuaugggucgaaauugccaguacaaaugcuccgguccccugggcaucgaagguggaauuauauccaaccagcagauaacagccuccuccacacauagagcacucuuuggauugcagaagugguauccuuauuacgcacggcugaacaagaaggggcucauaaacgcauggacagcggccgagaacgauagauggccuuggauucaaaucaaucuucagaggaaaaugcgggugaccggcgugauuacucagggcgccaagaggauuggcucccccgaguacaucaagaguuacaagauugcauacaguaacgacgggaaaacaugggcuauguauaaagugaagggaacuaaugaagauaugguuuucagaggaaauauugacaauaauacacccuacgccaauuccuuuaccccgcccaucaaggcucaauauguuagguuauacccucaggucugucgcagacacugcacucuccggauggaacugcucgguugugaguuguccggaugcucugaaccccuugggaugaaguccggccacauccaggacuaucaaauuacugcgagcucuauuuucaggacgcucaacauggacauguucacgugggagccccgcaaagcaaggcucgauaagcagggcaaggugaaugcuuggacuuccggccauaacgaccagucucaguggcuucagguugaccugcuggucccaacaaagguuacaggcauuauuacccaaggggccaaggauuucggccauguucaguucguuggaucuuauaaacuggccuauucgaaugauggugaacacuggacgguguaccaggaugaaaagcagaggaaagauaaaguauuccaggguaauuucgacaaugacacacaucggaaaaaugugauugacccaccaaucuacgcuaggcauauucguauuuuaccauggagcugguacggaaggaucacgcugaggucugaacuucugggaugcacugaggaggaauag

SEQ ID NO: 12017 - RNA, 1323 nt, Artificial Sequence
  Description of Artificial Sequence: Synthetic coding sequence
auggcugucaaacugggaacuuuacugcuggcacuggccuuagggcuugcucaaccagcgucugcucggcgcaaacuauuaguguuccugcuugacggguucagaagcgacuacauaucugacgaagcccuggaaucauuaccuggguuuaaggaaaucgucagccgaggcgucaagguagacuaccugacaccugauuucccuaguuuauccuauccuaauuacuauacacugaugacugguagacacugugaagugcaccaaaugaucgggaacuauaugugggaucccaccacaaauaaaucauucgacauagggguuaauaaagauucuuugaugccccugugguggaauggcagcgagccccugugggucacgcuuacuaaggccaaaagaaaagucuauauguacuacuggcccggcugcgagguagaaauucuagggguacgcccuaccuauugucuggaguacaagaacguccccaccgauaucaacuuugcaaacgcugucucugaugcucuggacaguuucaaguccgggagagcggaucuggcugcaauuuaucacgagagaauugauguugaaggacaucauuaugggccagccaguccccagcggaaggacgcucuuaaagccguggacaccguucuaaaguacaugacuaaauggauacaagaacggggguuacaggauagacucaaugugauuauauucucggaucaugggaugacggauaucuuuuggauggauaaggugauugaacugaacaaguacauuucgcuuaacgacuuacagcaaguuaaagaccggggaccggugguuagucuauggccugcuccaggaaagcauucggaaaucuauaacaaacugaguacaguggagcacaugacaguguacgagaaagaggccauuccaaguagguucuacuacaagaaaggcaaguucgucaguccuuugacccucgucgcggacgagggcugguuuaucacugaaaauagagaaaugcugcccuucuggaugaacagcacuggucgcagggaaggcuggcagcgcggcuggcauggauacgacaacgaacuaauggacaugagagguaucuuccuggccuucggaccggacuuuaaguccaauuuccgcgcagcaccuaucaggagcguggacguguacaacgugauguguaacguggucgguauuacgccacuuccuaauaacgguucauggucccgcguuauguguaugcuuaaaggucgcgccuccacagcccccccggucuggccuucacauugcgcccucgcuuugauccuacucuuucuccucgccuag

SEQ ID NO: 12018 - RNA, 351 nt, Artificial Sequence
  Description of Artificial Sequence: Synthetic coding sequence
auggaaucuucuagagugagacuucucccccugcugggcgcugcccuguuacuuauguuaccucugcuagguacgcgggcacaggaagaugccgagcugcaaccacgcgcccuggauauuuauucugcggucgaugacgccagucacgagaaagaacucauugaggcuuugcaagagguucugaagaaacuaaagucuaaacggguuccuauuuacgaaaaaaaguacggacaagugccaaugugcgacgccggcgagcaaugugccgugcgaaagggcgcaagaaucggaaaauuaugugacuguccucgcggaacuucgugcaauaguuuucugcugaagugccuguag

SEQ ID NO: 12019 - RNA, 1365 nt, Artificial Sequence
  Description of Artificial Sequence: Synthetic coding sequence
auggccagaccaaacaaguucuuacucugguucugcugcuucgccuggcugugcuuccccauuucacuggggagucaggcuaguggaggggaagcucaaauugccgccucggccgaacuggaguccggagccaugccauggagucugcugcagcauauugacgagcgugaucgcgcuggauuguuacccgcccuuuucaagguucucucgguaggccguggaggaagcccuaggcuucagccggacagucgggcccuacacuacaugaagaaacucuacaaaacuuaugcuaccaaggaggguauaccuaagagcaaccguucacacuuguauaauaccguucggcuguucacccccugcacuagacacaaacaggcucccggagaucaggucaccgggaucuuaccuucaguugagcugcucuuuaaccuugaucgcaucacuacaguggaacaucuucuaaagaguguacugcuguacaauauaaacaacucaguuagcuucagcucugccguuaagugcgugugcaaccugaugauaaaggagccaaaaucuucgucaaggacacucggccgcgcaccauauucguucacuuuuaacucacaguuugaauuuggcaaaaagcacaaguggauccagaucgauguuacuagucuccugcagccacucguagccuccaauaagaggucgauccauaugucaauuaauuucacuuguaugaaggaccaacucgagcaccccucugcccagaauggucuguucaauaugacccugguaucucccucauugaucuuguaccugaacgacacgagugcccaagcuuaucacucuugguauagucugcacuauaagcgucggccuucucagggaccagaccaggaacguucccugagcgcuuacccugugggggaggaggccgccgaggauggcagaagcucucaucacaggcauagacgggggcaagaaacuguguccuccgagcuuaaaaagcccuuggguccagccucauuuaaccucagcgaguauuuccgacaguuccuacugccccagaacgagugugaguuacaugacuuuagauugucuuucucccagcucaaaugggacaacuggauugucgcuccucaucgauacaauccaagguacugcaaaggggauugcccaagagccgugggccacagauacggcucaccaguucacaccaugguccagaauauuaucuaugaaaaacucgauucuuccguuccaaggccgucuugcgugcccgcgaaauacaguccguuaagcguacugacaauugaaccagauggaucuauugccuacaaagaauacgaggauaugauugcgacaaaauguacaugucgauag

SEQ ID NO: 12020 - RNA, 234 nt, Artificial Sequence
  Description of Artificial Sequence: Synthetic coding sequence
auguggcacuuaaagcuaugcgcaguguuaaugauauuucugcugcuguuaggccaaaucgacggauccccuauaccagaggugagcucugcuaaaagaagaccucgccggaugacucccuuuuggcgggggguuagccugagacccauuggagcuagcugccgagacgauuccgaaugcauuacucgcuugugcaggaagcgaaggugcucccucucuguugcccaagaauag

SEQ ID NO: 12021 - RNA, 912 nt, Artificial Sequence
  Description of Artificial Sequence: Synthetic coding sequence
augucugagccacagccagaucuugaaccaccucagcauggccucuauaugcuguuuuugcugguucucguuuuuuuccugauggggcugguagguuucaugauuugccacgugcucaagaagaaaggcuacagauguaggacuucccgggggucagaaccagacgaugcgcaguugcagccacccgaagacgaugacaugaaugaagacacgguggaaagaaucgugcgcuguaucauccaaaaugaggcuaacgccgaggcccugaaagagaugcugggcgauucggaaggagagggcacuguccagcugagcucagucgacgccacguccucgcuucaggauggggcucccagccaccaucacacagugcaucugggcagcgccgccccaugccuucacugcagccgaagcaagcgcccuccucuggugagacaagggagaucuaaggaagggaagucacggccccggaccggugagacgacagucuucagugugggcagauuucgcgugacgcacauagagaagcgguacggucugcacgagcacagggacggaucaccaaccgaucggaguugggggucuggcggagggcaagaccccggugggggccaggguaguggaggaggacaaccaaaggccgggaugcccgccauggaacgacugccacccgaaagaccucagccccagguacuggcuaguccgcccgugcagaacgggggccuccgcgauaguagccuuacuccucgggcccuggaaggaaauccccgcgcuucugccgaaccaacccuuagagcgggcgguaggggacccucuccuggccuccccacucaagaagccaauggacagccuagcaaaccagauacuagcgaucaccaagugucccucccgcaaggagccggaucgauguag

SEQ ID NO: 12022 - RNA, 795 nt, Artificial Sequence
  Description of Artificial Sequence: Synthetic coding sequence
augcggacacuguggauggcacucugcgcacuuucucgacuauggccaggcgcccaagcgggaugugccgaagccgggaggugcugucccggacgagacccugcuugcuuugcuaggggauggcggcuugacagaguguaugggacauguuucugcgaucaggccugcagguuuaccggcgacugcuguuucgacuaugauagagcauguccugcaagaccaugcuuuguuggggaaugguccccuugguccgggugugcugaucagugcaaaccgacaacacgcgugcggcgaaggagugugcagcaggagccgcagaauggcggagccccgugcccuccacuugaagaaagagcaggcugccuggaauauaguaccccacaaggucaggacuguggccacacauacguucccgcuuuuauuacgacaagugcuuuuaauaaagagagaacgcggcaggcuacaaguccccacuggaguacccauaccgaggacgccggcuacuguauggaguucaagacugagagccuaaccccccauugcgcccuggaaaacuggccccugaccagauggaugcaauaucugagagaagguuacacaguuugcgucgacugccaaccucccgcuaugaauuccgucucccugagguguucuggcgacggccuggauuccgaugggaaccaaacccugcacuggcaagcaauuggaaauccuaggugccaagggacauggaaaaaagucagacgggucgaccaguguucuuguccagccgugcauagcuuuauauucauuuag

SEQ ID NO: 12023 - RNA, 312 nt, Artificial Sequence
  Description of Artificial Sequence: Synthetic coding sequence
augagacaaaggcuacuaccaucaguuacuucacuccugcugguagcacuccucuucccuggaucuucacaagcacggcacgugaaccacagcgcaacagaagcucuuggcgaacuucgagagagagcaccaggccaggguacaaauggcuuucaauugcugcgacacgcugucaagcgcgaccuacugcccccacgaaccccaccauaucaaguucauaucucccaucgggaagcucgggggccauccuuccgaauuuguguagacuuccuuggaccucgaugggcaagaggcuguuccaccggcaacuag

SEQ ID NO: 12024 - RNA, 3867 nt, Artificial Sequence
  Description of Artificial Sequence: Synthetic coding sequence
auggccucaguggccugggcuguguugaaaguacugcuguugcuaccuacccagacauggucucccgucggcgcgggcaacccaccagacugugacgccccccuagcaucugccuugccccgcuccuccuucuccuccucaagugagcugucuagcagucauggaccuggauucucacggcugaauaggcgggauggcgccgguggcuggacucccuuggugagcaacaaauaucaguggcuucagauugaccugggcgaacgcauggaggugaccgcaguugcuacccagggaggauacgguucuagcgacuggguaacuucauacuugcuaauguucagcgacggaggaagaaacuggaagcaguauaggagagaagaguccauuuggggcuucccaggcaacacuaacgcugacuccgugguccacuaccgacugcagccaccuuuugaagcucgauuucucagauuucucccgcuggcuuggaauccucgaggcagaauagggaugaggauagaaguauacggaugugccuacaagucggaaguggucuacuuugacggccaguccgcgcugcuguaucgacuagacaaaaaaccacucaaacccauccgagacgucauuucacugaaauucaaagccaugcagaguaacgggauuuugcuacauagagaggggcagcauggcaaccacaucacucuggaauuaauaaaggggaaauugguguuuuuccugaacagugggaaugcuaagcugcccaguacaauugccccuguaacgcugacuuugggaucuuugcuggacgaucagcacuggcacagcguacucauugaguuacucgacacucaggugaacuuuacuguggauaaacacacucaccacuuucaagcuaagggcgauuccagcuaccucgaucugaauuuugaaauuucuuuuggaggcaucccuacaccaggccgcucgcgcgcuuucaggcgaaaguccuuccacgguugucucgagaaccuguauuacaacggaguugacgugaccgagcucgcaaaaaagcauaaaccccagauuuuaaugauggggaaugugaguuucucgugcccgcagccucagaccgugccugucacauuucugagcucccggucauaccuggccuugccuggaaauaguggggaagacaaggugagcgucacauuucaguuccgaaccuggaaccgcgcaggacauuuacuuuucggugaacucagaagaggcagcgguucauucguucuguuccugaaggacggcaaacucaaacuuagucuguuucaacccggccagucuccaagaaacgucaccgccggagcugggcuaaaugacggccaguggcacagcgugagcuucucagcuaaauggucucauaugaacgucgucguggacgaugauacggcggugcagccucuuguggcugugcugauugauucaggggacacauacuauuucggugguugccucgauaacagcucaggaaguggcugcaaguccccccucggagguuuucaggguuguuuaaggcuaauaacuauaggcgauaaagcaguggacccuauccugguacagcaaggcgcacuggggucguuuagggaccugcaaauagacaguuguggaaucacugaccgcugucugccuucuuacugugagcaugggggagagugcucucagagcugggauacuuucaguugcgacugucucggaacaggguacacaggggagaccugccauaguagccuguacgagcagaguugcgaagcacauaaacaccguggaaaccccagcggguuauauuacauugaugccgaugggaguggaccucuuggacccuuucugguauacugcaauaugacugccgacgcugcuuggaccgucgugcagcauggaggaccagaugcugugacacuucggggcgcgccaucagggcauccacggucugccgugaguuucgcuuaugcugcuggcgcuggacagcugcgauccgccgugaaucuggcagaaagaugcgaacaacgacucgcccucagaugcggcaccgcacgacggccagacagucgcgacggaacaccauuguccugguggguaggcaggacaaacgaaacucacaccucuuggggcgguagccugccggaugcucagaaauguacuugcggacuggaggguaauuguauagacagccaauauuacugcaauugugacgccgguagaaacgaauggaccucggacacaaucguauugagccagaaagaacaucuuccagugacacaaauaguuaugacugacgcagggcguccucauucggaagccgccuacacauuagggccacugcucugcagaggcgaccaaaguuucuggaacucagcuucuuucaacacggagacuuccuaucugcacuuucccgcauuccauggggagcugaccgcagaugugugcuuuuuuuuuaagacaacaguuucguccgguguguucauggagaaccuaggaauuacugauuucauucgcaucgaacugcgcgcaccuaccgaggucacauucuccuucgacguagggaauggaccuugugaggugacugugcagagccccacuccuuucaaugacaaccaguggcaccauguaagggcugaaagaaacguuaaaggugcaucucuccagguggaccaauugccucaaaaaaugcaaccugccccagcggauggacacgucaggcugcagcugaacucccagcuguuuauugguggaaccgccacgcgucagcgcggcuuuuuaggauguauucgaucauugcagcugaacggagucgcccuugaccucgaagagcgcgccacagugacaccuggcguugaacccgguugugccggucacuguuccacauacgggcauuuguguagaaauggaggacggugccgggaaaagcgacggggagugacaugugauugugcuuucucugcauaugauggucccuucuguucaaacgagauuucggcguacuuugcaacgggcucaaguaugacuuaccacuuucaggagcacuauacccugucugagaauagcaguaguuuagugagcucccuucaccgcgacgucacacucaccagggagaugaucacgcuuaguuucagaaccacgcguaccccgagccuucugcuuuacgugucuucauuuuacgaggaguaccugucugugaucuuggcgaauaaugguagccuucagaucagguauaaacuugaucgccaccagaauccugacgcuuuuacauucgacuucaagaauauggccgaugggcaguugcaucaagugaaaaucaaucgugaagaggcuguuguuaugguggaagucaaccaaucgacaaaaaagcaggugauucuaucaagcgguacugaauucaacgcggugaagagccucauccuugggaagguacuugaggcagccggcgcugacccagauacgaggcgggcggcgacaucagguuucacugggugucucagcgcaguucgguuuggacgcgcagcucccuuaaaagccgcacuucguccuucgggaccuucucgugugaccgugcggggacauguugcaccuauggcccgcugugcugcuggugccgccucaggcuccccugcacgggaacuggcaccucggcuggccgguggggcagggcgaagcgggccagccgaugagggcgaaccauuagucaaugcugacaggcgagauucugcagugauuggcggcguaaucgcaguggugaucuucauccugcugugcaucaccgccaucgcuaucagaaucuaucagcagcgaaaguugcguaaagagaacgagucaaagguuucuaagaaggaggaaugcuag

SEQ ID NO: 12025 - RNA, 369 nt, Artificial Sequence
  Description of Artificial Sequence: Synthetic coding sequence
augguucccggaccucccgaguccguagucagguucuuucuuugguucugcuucuuguuaccacccacucgcaaggccaguugcgaccccagagaccucaagucaugcaaucgcccuugcgucuggagcagacuucuuaagcccaacucaucccugagcaaccuggaaacagcauacuucccccaaauccugagauuccugaggccgugguacuucucuagaucacaccucaauuaucaccaaaaggccccugcgcggugggaaugguuguacucuauuuaucggaaagguacaaaagcccagagacgcaacguguuaagaucucccugugccccuccacagcccagcuggcccugcagcguaauuuag

SEQ ID NO: 12026 - RNA, 1887 nt, Artificial Sequence
  Description of Artificial Sequence: Synthetic coding sequence
auggcuccaagcgcugacccugguaugaguaggaugcuacccuuccuucugcuccucugguuccugccuaucaccgagggaucacagcgagcagaaccaauguuuacugcaguaaccaauaguguguuacccccagauuacgacagcaaccccacccaguugaauuaugggguggcggucacggauguggaccacgauggggauuucgagauuguuguggcuggauauaacggccccaaucuggugcugaaauaugacagagcgcagaagaggcuggugaacauagccguugaugagcgcaguuccccauacuacgcauugagggaccgacagggaaacgcuauaggggugacggcgugcgauauugauggagaugggcgcgaagaaaucuauuuucuuaauacuaacaaugccuuuagcgguguggccaccuauacggauaaacuauuuaaguucagaaauaauaggugggaagauauccuaucagacgaggucaacgucgcacguggcguugccucccucuucgccggacgaucuguagccuguguugacagaaagggcucagggcgauauucaauuuacauagcuaauuaugcuuauggaaacgucggacccgaugcacucaucgagauggauccagaagcaucugacuugucgagaggaauucuggcccugcgagacgucgcugcggaggcgggugucucuaaguacaccggcggccgcggaguaagcguggggccaauucucuccuccucugcuucagauauauucugcgacaacgagaacggccccaacuuccucuuucacaaucgaggagacgggacuuucguggacgcagcagccagcgcuggcguugaugacccucaucagcacggucgagguguggccuuggccgauuuuaaccgggacgguaaaguggacauugucuaugguaauuggaacggcccccacagacuauaucuucagaugucaacccaugggaaagucagguuccgagauauugcaagucccaaguucagcaugccaucucccgugcgcaccgugauaacggccgacuuugacaaugaucaggagcuggagaucuucuucaauaacaucgccuaucggucauccagcgcuaacaggcuuuuccgcgugaucagaagggagcauggugacccccucauugaggaacuuaaccccggcgacgccuuagaaccugaagggcgcgggaccgguggagucgugacagacuucgauggcgacggcaugcucgaucugaucuugagccauggcgagucaauggcacaaccacugucugucuuccgaggaaaucagggcuuuaacaauaauugguugagggugguaccaagaacacgcuuuggagcauuugcgagaggcgcuaaagucguacuuuacaccaagaagucaggggcccaucugagaaucaucgacggcggcuccgguuaccuuugugagauggaacccguagcacacuuuggucuggguaaagaugaagcaagcucagucgaaguuacguggcccgaugguaagaugguguccaggaacguggccucaggcgaaaugaauucaguucuugaaauccuuuaucccagagaugaggacaccuugcaggaucccgcuccacuggagacaccgaugaacgccagcaguucucacuccugugccuuggagaccucccccuacgucagcacgccgauggaggcgaccggggcagguccuacuaggucggcugugggcgcuaccucuccaacuagaauggcucagccagccuggggcuugucagccagccaucgugcacccgcucccccuccuccuccccuccugcucccacugccccuccucuugccacuauuagaauuaccucuccugcaccggucaaguuag

SEQ ID NO: 12027 - RNA, 1008 nt, Artificial Sequence
  Description of Artificial Sequence: Synthetic coding sequence
augcagggccaggggaggagacgaggcacauguaaagauaucuucugcagcaagauggccagcuauuuauauggaguucuuuucgccguaggccuuugugccccaaucuacugcgugucucccgcuaaugccccuucagccuacccccgaccaucaaguaccaaguccacaccggcaucucaaguguacucccugaacacagacuuugccuuccgacuuuaucgacgccugguacuggagaccccuucacagaacauuuucuuuuccccagcgcggaucaauucgcacgugaaaaaaaaaacccagggaaaagucguggauauuauacagggguuggaccugcuaacagcaaugguccuugugaaccauauuuuuuuuaaagccaagugggaaaagcccuuucaccccgaguauaccaggaagaacuuccccuuccucgugggagagcagguuacaguucacgucccgaugaugcaccaaaaagagcaguucgccuuuggaguugacacugaguugaauuguuucgucuugcaaauggauuacaaaggagacgcuguggccuuuuucgugcugccuuccaagggcaaaaugaggcagcucgaacaggcccuguccgcucggacacugagaaaguggucacacagucugcagaaaagauggaucgagguguucauaccccgcuucagcauaagcgccagcuauaacuuggagaccauacuacccaaaauggggauccaaaacgucuuugauaagaacgcggacuucagcgggaucgccaaaagagacucccugcaggugaguaaagccacucauaaagccguccuugacguuucugaagagggaaccgaggcuacugccgcuacaaccaccaaguucaucgugcgaucuaaagacggaccuagcuauuucacagucaguuucaauagaacuuuuuuaaugaugauuaccaacaaagcuacugacggcauccuuuuuuugggcaaagucgagaauccaacgaaaucauag

SEQ ID NO: 12028 - RNA, 768 nt, Artificial Sequence
  Description of Artificial Sequence: Synthetic coding sequence
auggugcuuuuauuggucauccugauucccguguuggucaguucagcuggcaccuccgcccacuaugaaaugcucggaacaugcagaauggugugugauccuuauggugggaccaaagcgccuagcacagcugccacccccgacagggggcucaugcagucccugccaacguuuauccaagggccgaaaggcgaggcugguagaccugguaaggcuggaccucgcggcccccccggagagccgggcccaccuggaccgaugggcccccccggcgagaaaggcgaaccuggaaggcaggggcugccuggaccucccggagcaccuggacugaaugcugcaggggcuauuagcgcugccacauacucaaccgugcccaagaucgcuuuuuacgccggucugaagagacagcacgaaggcuacgagguccugaaguuugaugauguagugacaaaucuaggaaaucacuaugacccgacaacugggaaguucaccuguucuauucccggcauuuacuuuuucacguaucacguucugaugcgaggaggugaugggacaucaaugugggcugaucuuuguaaaaauaaccaaguacgcgccagcgccaucgcgcaggacgccgaccaaaacuaugauuaugcaagcaacuccgugguguuacaccuggaacccggugaugagguguauaucaagcuggauggagggaaagcccauggaggcaauaacaauaaguacaguacauuuucagguuuuauuaucuacgcagauuag

SEQ ID NO: 12029 - RNA, 1617 nt, Artificial Sequence
  Description of Artificial Sequence: Synthetic coding sequence
augagcuuuagcgcaacuauccuauucuccccgcccuccggcucugaagcucgcuguugcugcugugccugcaagucagaaacuaacgggggcaauacgggcucacagggcggaaacccgccuccuucaacuccaauaacagucaccggucauggucuggccguucagagcuccgaacaacuacuccacguaauuuaucagcgagucgauaaggccgugggcuuagcugaagcugcguuaggucuggcuagggccaacaacgaauugcuuaaaagacugcaagaagagguuggagaucugcgucaaggaaagguuagcauucccgaugaggacggcgagucacgcgcacacuccucaccuccagaagagcccggcccucugaaagaaagucccggcgaagcguuuaaagccuugucggcaguggaagaggaaugcgauucaguuggcuccggcgugcagguugugaucgaggaacugagacaguugggcgccgcaucugucggccccggcccucucggcuuuccugcuacgcagcgggauaugaggcucccuggguguacacuggccgccagcgaggcggcuccuuugcuuaacccuuuaguggaugacuacguagcauccgaaggagcagugcaaaggguauuggucccagcguaugcuaaacagcuaucaccugccacccagcuagcaauacagagagccaccccugaaaccgggccagagaacggcaccaagcugccuccaccucgaccugaagauaugcugaaugcugccgccgcccuggauagcgcccuagaggagucaggacccggcucuacaggagaguugcgucauucccucggacuaacgguuucaccuugucguaccaggggcuccgggcaaaaaaacagccgccgcaagagagacuuggugcugucuaaauuggugcacaacguccauaaucacauuaccaacgacaagagguuuaauggcucugaguccaucaagagcagcuggaacauuagcguuguuaaguuucuccuggagaaauugaaacaagaacuugugacaagcccacacaauuauacugacaaagagcugaagggcgcuugcguugccuauuuucuuacuaagcgccgcgaguaucgcaacagucucaacccauucaagggccucaaggaaaaagaagaaaagaagcuucggagucgcagauauagacuguucgcuaaucgcagcucuaucaugagacauuuugguccagaagaccagagacuuuggaacgacgugacagaagagcugauguccgaugaagaagauagccugaacgaaccaggggucuggguugcucggccuccacgauucagggcccagaggcugaccgagcuuuguuaucaucuggacgccaacuccaaacacgguaccaaagcuaaucgcguuuaugggccucccuccgaccgacugcccagcgcagaggcccagcuccugccgcccgaguuguauaacccaaacuuccaggaggaggaagacgagggaggcgacgagaacgccccuggaucacccagcuucgaucaaccucacaaaacaugcugccccgaccugaauucauucaucgagaucaagguugagaaggacgaguag

SEQ ID NO: 12030 - RNA, 2853 nt, Artificial Sequence
  Description of Artificial Sequence: Synthetic coding sequence
augcugcugcuuggcauucugacccuggcuuuugccgguagaacggcgggaggaagcgagcccgaacgggaagucguagugccuauuagguuggacccugacaucaauggucgccgauauuacuggcgagguccugaggauagcggggaucaaggauuaaucuuccaaauuaccgccuuccaagaggauuucuaccugcaucugacuccugacgcucaguuucuagcaccagcauuuucuaccgagcaccugggcguaccucugcagggacugacgggcggcagcagcgaccuccgacguugcuucuauucaggagacgugaacgccgagccagauuccuuugcugccgugagucuguguggaggacuccggggcgccuucggguaccgcggagccgaguaugucauuucaccuuuaccuaaugccagcgcccccgcugcccaacguaacucccagggcgcacauuugcuccagagacguggugugcccgggggcccuagcggagaccccacaagucgcuguggcguggcuucagguuggaacccagcaauucugagagcucuggacccuuacaaaccucggcgugcuggcuucggugaaaguagaucacgaagacgcagcggacgggccaagagauuugugucaauuccuagguacguugaaacuuuggucguggcagacgagagcauggugaaguuccauggcgccgaucucgagcauuaccuacugacacuguuagccaccgcugcgagacucuauagacacccuuccaucuuaaauccuauuaacaucguaguugucaaagugcuacuacuuagggaccgcgauucaggccccaaggugacuggaaaugccgccuugacccugagaaauuuuugcgcauggcagaagaagcugaauaaagugagcgacaaacacccagaguauugggacacagcaauucuguuuacccggcaggaccugugcggcgccaccaccugcgacacucugggcauggcugacguaggaacuaugugcgauccuaaacguucgugcuccgugaucgaagaugaugggcugccaagugcguuuaccacugcccacgaguugggacauguguuuaacaugccucacgauaaugucaaggugugcgaggagguguuugggaagcugagagcaaaucacaugaugucgcccaccuuaauccagaucgaucgggccaauccauggagcgcguguagcgccgcuauaauuacagacuuccuagacagcgggcauggcgauugccugcucgaccagcccagcaagccaauaucuuugccagaggaucugccuggagccucuuauaccuuaagccagcagugugagcuggcauuuggcguggguaguaagcccugcccguacaugcaguauugcacuaaauuguggugcaccgggaaggcuaaggggcagaugguuugucagacccgucauuuuccuugggccgaugggacgaguuguggcgaggguaaauuaugccucaagggugcuugugucgaacggcauaaccuuaauaaacaccgcguggacggaucuugggcuaaaugggaucccuacggcccguguagcagaacuugcggggggggcgugcaauuggccagaagacaaugcaccaauccaacucccgcaaaugggggcaaguauugugaggguguacguguuaaauaucgaaguuguaaucuggagcccugcccuagcucugcaucagggaaaaguuuccgcgaagaacaaugcgaagccuuuaauggauauaaccacucaacuaaccgacuuacucuggcaguggcguggguacccaaauauagcggagucagcccccgcgauaaauguaaacucaucugccgugcuaacggcacuggcuacuuuuaugugcuagccccaaaagugguugauggcacacugugcucuccugauuccaccagcguuuguguacagggaaaguguaucaaggcugguugugauggcaaccuuggaagcaagaaaagguuugacaagugcggcgugugcggaggggauaauaaaucgugcaaaaaggucacaggccuuuucacgaaaccuaugcacggcuauaacuucgugguagcgauuccugcuggggccaguucuaucgauauucgucagcgcggguacaagggauugauuggagaugauaacuaccuagcccugaaaaauucccaggguaaauaccugcuuaacggccauuuugugguuucugccguagagcgggacuuagucgucaaaggcagccuccuucgguacagugguacaggaaccgcaguggagucucuacaggcuagccgacccaucuuggaaccccuuacagucgaggugcucucuguggguaagaugacuccaccgagagugcgcuauuccuucuaucugccaaaggaaccucgugaagauaagagcucacacccaaaagacccaagaggucccucaguacuccacaacucuguccugagccuuucaaaucagguggagcaaccugaugacagacccccggcccgcuggguggcagguucauggggcccuugcucugccuccugcggaucagguuuacaaaagcgggcuguagauugccgaggcagcgccggccagaggacuguuccagcaugcgaugcagcccaccggccuguggaaacucaggccuguggagaaccaugcccuacaugggaauuaagcgcuuggucucccugcagcaaguccuguggccguggcuuucagcggcggagucuuaaaugcgucggacacggcggacgacugcucgcucgagaccagugcaaccuucacaggaagccacaagagcuagacuuuugcguuuuacgaccgugcuag

SEQ ID NO: 12031 - RNA, 1521 nt, Artificial Sequence
  Description of Artificial Sequence: Synthetic coding sequence
augacaagcaagccucauagcgacuggaucccauacucaguccuggacgaugaggggcgcaaucuccgucagcaaaaauuggauagacagagagcacucuuagaacagaaacaaaaaaaaaagcgccaagaaccccugauggugcaggcuaaugccgacggaaggccucguucacgaagggcaaggcagagcgaagaacaagcaccucugguggagucauauuuaagcagcucagggagcacgucauaccaagugcaggaagccgacagucucgcaucaguccagcuuggugcaaccagacccacggcaccggcgucagcaaaaagaacaaaggcagccgcuacagcugggggccagggcggagcagcacggaaagaaaaaaaaggaaaacacaaggguaccucuggcccggccgcccuggccgaggacaaaagugaggcacaaggaccuguucaaauuuugacagugggacagucugaccacgcacaggacgccggugagacugcugccggugggggcgaaagacccagugggcaggaucucagagcuaccaugcagcgcaaggggauuucuucuagcauguccuucgacgaggaugaggaagaugaagaggagaauuccaguuccagcagucaguuaaacucuaacacaaggccaucaucagccacaucucgcaagagugucagagaagccgccagugcgccuagcccuaccgccccugagcagccugucgauguggaagugcaggaccucgaggaguucgcacuuagacccgccccucaaggaauuacuaucaaaugcaggaucacuagagauaaaaagggaauggaucggggcauguaucccacauauuuucugcacuuggacagggaagauggaaaaaaaguauucuugcuggccgguaggaagaggaaaaaaucaaaaaccagcaacuaucuuaucuccguagauccuacggaccucagcagaggcggggacaguuacauuggaaagcuccgaagcaaccucauggggaccaaauuuacggucuacgacaacggugugaauccccagaaagcuaguucaucuacccuggaauccgggacauuacggcaggaacucgcugcuguaugcuacgaaacgaacguucucggguuuaaaggcccaagaaaaaugucagucaucgucccugggaugaacaugguccacgaacgagugagcauccgccccaggaacgagcacgagacucugcucgcccgcuggcagaacaaaaacacagagagcauuauugaacuccagaauaaaacacccguuuggaaugacgacacccaaagcuauguccugaacuuucauggccgggugacccaggccuccguuaaaaauuuccagaucauacacggaaacgacccugacuauauuguuaugcaauuuggaagaguggcugaggauguguuuacuauggauuacaacuaucccuuaugugcacugcaagccuuugcuauugcccugucuaguuuugacucaaaauuagccugugaguag

SEQ ID NO: 12032 - RNA, 594 nt, Artificial Sequence
  Description of Artificial Sequence: Synthetic coding sequence
auggcuaagaaugggcucgugaucugcauccucguuauuacauuacuguuagaccaaacuaccucucacacaucacggcuaaaagcuagaaaacacagcaagcgucggguaagggacaaagauggugaccugaaaacgcagauugaaaaguuauggaccgaggugaaugcgcugaaagagauccaagcucuccagacaguaugccuccggggcacaaagguacacaagaaaugcuaccuagccagugaagggcuaaaacacuuccacgaagcuaaugaagacuguaucagcaaaggugggauauuggugauuccuaggaacucugaugagauuaaugcacugcaggacuacgggaagagaagucucccaggggugaacgauuuuuggcuuggaauuaaugauauggugaccgaaggaaaguuuguagaugugaacgguaucgccaucucuuuccugaacugggauagagcccagccgaauggagguaaaagggagaacugcguccuuuucucccaaucggcccagggcaaauggucugacgaagcaugucgcagcagcaaacguuauaucugcgaguucacuauaccucaguag

SEQ ID NO: 12033 - RNA, 2424 nt, Artificial Sequence
  Description of Artificial Sequence: Synthetic coding sequence
aaaaaaaagcggaaaaucucccugcuaccuaaaccaccuaaacacgacgccccacuuacaauugaauucccaaaccucgacaagacaucagccgaguggcucaaagugaauggacugaaagcaaaaaaacugaguuuauaccaaguucucgcacccaaugcguucagcccuguggaagaauuugugcccauuuugcagaaaaccgucaguucuaccauucacgagaaggcaaugauccaguuugaguggcaugauggcaccguuaaaaacauacauguugauccaccuuuccuauauaaauaucagcaacagcugucccgagccaugcggauguacgaacggagaaucgaguggcucucacuggcguccagacggaucuggggaacugucugcgaaaagcgcguggugguucuguuggacauuucagcuacuaauagcauguauaucauucacauucagcacucucuacgacuccugcuugaggagcagcucucaaauaaggacuguuucaaucucauugccuuuggaucuacaaucgaauccuggagacccgaaaugguaccaguaucccacaauaaucuacagagcgcuuggagaugggcucugaaccuucgauguagagguagccggaaugugcugagcgcacuucgaaaagcaguggagguggauuuuaaagacaaggacaaacaccagucccaagggauuuaccucuuuacgggcgggauuccagaucaggacaugccaacccugagugcguacauggcugaggcuugugguggaugugaccugcagcuaaauguuugcuuguucuaugugggcgagccaaagauggauacuacaccacccgcuagguacgcuucucacacagauaccgccgccgcauacaaggaggugacccgcgccgcgggcgggcgguuccauugguucggcgauacaggcaucuacgaguccgacgauaucaacucaauuaugucugagauggaaaaagcuuugaacuacucucagaagugugcauuucugauggcaucacugaagaaucauucagguaaaguccucggaagcucagcucucccuaaagaaaagccaaagacacugcaacugcggucgcaaccuaagaaguugugcccuccuaggcccaccgucccacugggggcuaggaugucaauuaaagacgauccagaccgagagaagagcccaccccugaaaucuuugaaguggcgaccccugaguagucggguuggcaucaguccagccgcagcgcagccgacgaaggaggguaugauggagcucagacggaaaacuaaaucccgcgaagcugaaaccucucuccuccuguuuuauacugaaaaagguaacgacgucggaaguguauacaaaaaauauccccagggcaggggcuuacggcggacaagcuccucgaucgaccucccucguaaagacacggugugcuccucccaagagugggucgcgaaauacgggcuaaagaagcugaaacuagaaaucucucgcugcaugggccccaauugcacccaucagaagucugggcagcgaucggcaagcgcaaagcauuguucuauuuuccccucuguagagauucacgguguagugcggcauauucaguggacuccaagagaaauggagguauauauccggcaccucgagaagguacugaggagguacguacagcguuugcagugguugcugagcggcagccgaagauuguucgggaccguucuggaaagcaagguguguauucugcuugauacauccggaagcaugggccccuaucuucaacaggugaagacagagcucguucugcugaucugggaacagcugaggaagugcugcgauuccuucaaccuguuaucauuugcugaauccuuccaauccuggcaggauacuuuggucgagacuaccgaugcugcuugucacgaggccaugcaauggguaacacaccugcaggcucagggaagcacauccauucugcaggcucuguuaaaagcuuucucuuuucacgaucucgagggcuuguaucuccugaccgaugggaaaccagacacgaguugcagccuugugcuuaaugagguacagaagcucagagagaagcgugacgucaaaguucacaccaucucucuuaacugcuccgauagagcugcgguagaguuccuccggaaguuggcuucauucacaggcggucgcuaccacugcccugugggcgaagacacucuguccaagauccacucccugcuuaccaagggguucauaaaugaaaaagacccaacacucccgccauuugaaggcgaugaccugaggaucuuggcacaagagauuaccaaggcucgguccuuucuuuggcaggcacagucauucaggucgcaacuccaaaagaagaacgacgcggagccgaagguuacccucuccuag

SEQ ID NO: 12034 - RNA, 639 nt, Artificial Sequence
  Description of Artificial Sequence: Synthetic coding sequence
auggugucacguauggucaguacuauguuauccgguuuacucuuuuggcuagcgagcggcuggacaccugcguucgccuacuccccuagaacucccgacagagugagugaagcugacauacagaggcuguugcacggcgugauggagcaacuugggauugcccggccgagagucgaauacccggcacaccaggccaugaaccuggucgguccccaauccaucgagggcggagcgcacgagggccuucagcaucucggcccuuuuggaaauaucccaaacaucguggcugaacuuacgggcgauaacaucccuaaggacuuuuccgaggaucaaggauaucccgacccaccaaaucccugcccugucggaaagaccgcagacgacgguugucucgagaacacccccgauaccgcagaauucucuagagaauuucaguugcaccaacaccucuucgauccagagcacgauuaccccgguuuggggaaauggaacaagaagcuucuguacgaaaaaaugaagggaggagagagaaggaagagacgaucuguaaauccuuaccuacaagggcaaaggcuggauaacgugguugcuaaaaagucuguuccgcacuucuccgaugaggauaaggacccagaguag

SEQ ID NO: 12035 - RNA, 1524 nt, Artificial Sequence
  Description of Artificial Sequence: Synthetic coding sequence
auguguaccaagacaauuccagugcuuugggggugcuuccugcuguggaaccuuuacgugucgagcucccaaacuauuuacccugggaucaaagcucggauuacucaacgugcccucgauuacggaguucaggcugggaugaagaugaucgaacagaugcugaaggaaaagaagcuaccagaccucucuggaucugagagccuagaauuuuugaagguugacuacguaaacuauaauuucucaaacauuaaaaucucagccuuuagcuucccaaacaccucucucgcauuugucccuggcguuggaaucaaagcauugacaaaucacggcacugcgaauaucucaacagauuggggauucgaaucuccacucuuccaggacacugggggcgcugaccuguucuugagugguguguacuuuacugggauuaucauccugacaagaaacgacuucggccauccuacuuuaaaacugcaagacuguuacgcucagcuuucacacgcccacgugucauuuagcggcgaacucuccguccuauauaauucuuuugccgagccaauggaaaaaccuauccuuaagaacuugaaugagaugcuuugcccaauuaucgcaucggaaguuaaagcccugaacgcuaaucugaguacucuggaaguauugacaaaaaucgauaacuacaccuugcuggauuauucgcugauuucuagcccagagauaaccgagaacuaccuggauuugaaucugaaaggcguguuuuaucccuuagagaaccugacagaccccccguuuucacccguccccuuuguguugccagagagaucaaauucuaugcuuuauauuggaauugccgaauacuucuucaagagcgccuccuuugcacacuucaccgccggaguguuuaaugucacacuguccaccgaggagauuagcaaucauuucgugcaaaauucccagggacuaggcaauguacugagccgcauagcagagaucuacauucucucucaacccuuuauggugagaaucauggccacagagccaccuaucaucaaucugcagccaggcaacuucacccuggacauucccgcuagcauaaugaugcuuacucaacccaaaaacucuaccguggagacaaucgugaguauggacuucguggccucuaccucaguaggcuuggugauucuuggccagcggcuugucuguagucuuagucuuaauagguuucgacuggcuuugccugaaucaaaccggucuaauauugaagugcugcgcuuugaaaauauccugaguaguauccugcauuuuggcgucuuaccgcucgcaaaugccaagcugcagcagggcuuuccucucucuaacccacauaaauuccuguuuguuaauuccgauaucgaggugcuggagggcuuucuucucaucagcacugaucugaaauaugaaacaucuuccaaacagcagccaagcuuucacgucugggaaggacucaauuuaaucagucgucaguggcgugggaaaucagccccauag

SEQ ID NO: 12036 - RNA, 474 nt, Artificial Sequence
  Description of Artificial Sequence: Synthetic coding sequence
augcaucccuggcuggggucugcccuuggcuuuccuaaguguagggggauacaccugugcgcaugcgguaacgguuggacaccuggugaaacacuuucucagaauaagacggaaauaacaaagaauaaggucacauguuggagaccccauggcugugagccuaacacgggccucggcuaucaaggaucccacacuucuaaguauacccugcugccuuggaaccugcucaagacaaagccacugccccccagccacggcaaggaaggcggcaaagaggcuaaaguaccuaguggugauaacaguggcagaggcgaaguaccacgggcacaggaagggcaagccgcuugcggcagagccgcuucuggcgacucccaagagggaaugagaagaggguacgaggaacgcgcuaccgcucagcgucccgccgugagaagcgcagagacuacugcucacgggaccuggaucuaccccuag

SEQ ID NO: 12037 - RNA, 213 nt, Artificial Sequence
  Description of Artificial Sequence: Synthetic coding sequence
auguccaacaauauggcuaagauugccgaggccaggaagaccgucgaacaacucaaacuggaagugaacaucgaccgaaugaagguuagucaggcugcagcagaacuccucgcuuuuugcgagacccaugccaaagaugacccuuuaguuacccccguuccagccgcagaaaacccauuccgcgacaagagacucuucuguguacugcuguag

SEQ ID NO: 12038 - RNA, 645 nt, Artificial Sequence
  Description of Artificial Sequence: Synthetic coding sequence
auggcucuguugcugugucugguuugcuuaacugccgcauuggcccacggaugcuugcacugccauuccaacuuuucuaaaaaguucucauucuacagacaucacgucaauuuuaagucaugguggguaggggauauaccggucucaggggcucuucuaacugacuggucagaugacaccaugaaggaguugcaccuggcuauucccgccaaaaucacaagagaaaaauuagaucagguugccaccgcuguguaccagaugauggaccagcuauaucagggaaaaauguacuuuccaggauauuuccccaacgagcucaggaacaucuuucgggagcagguucaccucauacaaaacgcaaucaucgagagcagaaucgacugccagcacagauguggaaucuuccaguacgagacaaucucaugcaacaacugcacagauagccacguugcauguuucgguuauaauugugagucuuccgcccaauggaaaucugcaguacaaggacugcugaacuauauaaauaauuggcauaagcaggacacauccaugucccuggugagccccgcucuccguugucucgaacccccgcauuuagccaaccuuacgcucgaggaugcagccgaauguuuaaagcaacauuag

SEQ ID NO: 12039 - RNA, 459 nt, Artificial Sequence
  Description of Artificial Sequence: Synthetic coding sequence
auguccccucaccucacugcacugcugggucugguucuuugucuggcacaaacuauccauacacaagagggggcucuaccgaggccauccauuagugcagaaccuggcacagugaucuccccuggcagucaugucaccuuuaugugccgagggccagugggagugcaaacguuucgucuggaacgagaagauagggccaaauacaaagauaguuacaacguguuucgcuugggaccuucugaaagcgaagccagauuucacauugacagugucucugaaggaaaugccggauuauaucguugucuguauuacaaacccccaggauggucagaacacucagauuuucuggaacugcucgucaaagaaagcuccggaggaccagauucucccgacacugagccaggcucaucugcugggacuguaccgggcacagaggcuaguggauucgaugcgcccuag

SEQ ID NO: 12040 - RNA, 900 nt, Artificial Sequence
  Description of Artificial Sequence: Synthetic coding sequence
auggcaccauggucccacccaucagcccagcuucaaccaguagggggcgaugcugucucuccagcucuuauggugcuacugugucucggccuuucacucggaccaaggacccacguccaggcaggcaaucugagcaaagcaacucugugggccgaaccaggaucagugauuaguaggggcaacagcgucacuauccguugccaggguacacucgaggcucaggaguauagacuagugaaggaaggaagccccgaaccuugggacacucagaauccccuagagcccaaaaacaaggcgcgcuucuccaucccgucaaugacugaacaccacgcaggcagguauagaugcuacuauuauucaccagcagguugguccgagccuucggauccauuagaauugguugucaccggcuuuuauaauaaacccaccuugagugcccuccccagcccaguugugaccaguggagaaaaugugacccugcagugcgguagucgccuucgauucgaccgcuucauccuuaccgaggagggagaccauaaguugagcuggacacucgacucacaguuaacaccuucaggucaauuucaagcacuuuuccccgucgguccagucacaccuagucacagauggaugcucagguguuauggcagccgcaggcacauccugcaggugugguccgaacccagugaccuguuagagauaccuguuucgggcgccgccgacaaccuaagcccuagccagaacaaaucugauuccggaacggcuucucaucuccaggacuaugcaguggaaaaccugaucaggaugggaauggccggccuuauccuggugguacugggcauccucaucuuccaggauuggcauucccagaggagcccccaggcagccgcagggcguuag

SEQ ID NO: 12041 - RNA, 618 nt, Artificial Sequence
  Description of Artificial Sequence: Synthetic coding sequence
augaagguucugcugcucacagggcucggugcacuuuucuuugcauacuacugggacgauaauuuugauccaggcggacuggauuaccucgugcugaaccauauuggcggugcucccgccggcacccgugcucgcaguccccaggccacccgauggcugaugcaagugaacuucgucuccuacguccaauugacaucacgugcacucccuagcuuaaccgauucuaagggcucacuaguugucgugucuucccuguuaggccgggucccuaccuccuucucaacaccauauucugcugcuaaauuugcccuggauggcuucuuuggaagccuccgccgggaguuggacguucaagacguaaacgucgcaauuacuaugugugugcuagggcuuagggaucgggcuucagccgccgaagccguucguggcgucacccgcguuaaagccgcuccuggccccaaggccgcacuggccguuauuagaggaggcgcuacccgugcagccggaguuuuuuacccuuggagguuucgucuucuaugccuguuacgacgauggcuaccuaggccucgggcuugguuuauuagacaggaacugaacgugacugccgccgcagcguag

SEQ ID NO: 12042 - RNA, 795 nt, Artificial Sequence
  Description of Artificial Sequence: Synthetic coding sequence
augcugcgcugcggcggccggggccuauugcuuggacuugcuguggcugccgcugcuguaauggccgcucgucuuaugggguggugggggccacgcgcaggcuuuagauuauucauucccgaggagcuuaguagauaucgcggcgggccuggagauccuggacuguaccuggcauuacucgguagaguguacgaugugaguucugggagacgacauuaugaaccuggcagucauuauuccggauucgccggucgagacgccagcagagcauuugugaccggugauuguucagaggcaggccuggucgaugacguaagugaccugucagcagccgagaugcuaacccugcauaacuggcuguccuuuuacgagaagaauuacguuugcgucgggcggguuaccggaagauuuuauggagaggacgggcuucccacacccgcacucacacaagucgaagcagcaaucacgagggggcuggaagcuaauaagcuccaguuacaggagaaacaaaccuucccacccugcaaugccgaguggaguucagcaagaggcucacggcugugguguucucagaagaguggcggcguuuccagggacuggauuggggugccaaggaagcuguacaagccaggagcaaaggagccgcggugugugugcguucgaaccacuggccccccauccgggcaaaugccugacaauccaccccaccgcaaucgcggggaucuugaccacccaaaucucgcugaauacaccgguugcccuccucucgcaauaacauguuccuuuccccuguag

SEQ ID NO: 12043 - RNA, 468 nt, Artificial Sequence
  Description of Artificial Sequence: Synthetic coding sequence
augucuaaacgauuacugcugcugcugcugcuguccaugggagggacaugggccagcaaagaaccacuccgcccucgcugucguccaaucaacgcaacccucgcuguagaaaaggagggaugccccguguguauuaccgugaacacaacaauuugugccgguuacuguccuacaaugacaagaguucuucaggggguacuccccgcccugccccagguugucuguaauuauagggacgugcgguuugaaucuauacgucucccaggauguccuagaggggugaaucccguugugaguuaugcuguugcuuuaagcugucagugcgcauuaugucgcagauccacaaccgauugcggcgggccaaaagaucacccacugacaugcgacgauccaagguuccaagauucaaguucauccaaagcaccaccgcccucacuuccaagcccuucgcgccucccuggaccauag

SEQ ID NO: 12044 - RNA, 498 nt, Artificial Sequence
  Description of Artificial Sequence: Synthetic coding sequence
auggaaauguuccaaggauugcuucugcucuuacugcucaguauggguggcacuugggcuucaaaagaaccucuuagaccuaggugcagaccgauaaaugcuacacuggccgucgaaaaggaaggauguccuguguguauuaccguaaacacaacaauuugcgccggcuauugcccaaccaugacccggguccuccaggguguucugcccgcucugccucaggucguuugcaacuauagagacgugcgguucgagucuauuagauugccuggcuguccccggggagugaaucccgucguaaguuaugccgucgcacuaucuugccaaugcgcccugugcagaagaucgaccacagacuguggugguccaaaggaucacccacugacaugcgacgauccuagauuccaagauagcuccucauccaaagccccacccccuagucugccuaguccaucccgacuccccggcccuagcgacacaccuaucuuaccacaauag

SEQ ID NO: 12045 - RNA, 990 nt, Artificial Sequence
  Description of Artificial Sequence: Synthetic coding sequence
augcugccucuguugcuggggcugcugggcccugcugcuugcugggcccucggaccaaccccagggccaggcucuagcgaguuacguuccgccuucucugcugcuaggacaaccccccuggaagguacaagcgagauggcugucacauucgacaagguuuaugucaauauuggcggcgacuuugauguggcuaccgggcaguucagguguagggugcccggggcauauuuuuuuucuuuuaccgccggaaaggcaccacacaagagucuuucaguuaugcuugugagaaaccgcgacgagguacaggcucuggcauuugaugaacagcggaggccaggugcuagacgugcagccucccaguccgcgaugcugcagcucgauuauggggacacagucuggcucagacuacacggagcaccacaguacgcuuuaggcgcucccggggccacuuucagugguuaucucguguacgcagacgccgaugcagaugccccagcccggggaccccccgccccaccagagccgcgcucugccuuuucugcagcccgcaccagaagcuuggucgguucagacgcuggaccagggccucgccaccagccauuggccuucgacacggaguuugucaauaucggcggugacuucgaugccgccgccggaguguucaggugcagacuuccuggcgccuacuucuuuucuuuuacauuggguaagcugcccagaaaaacucuuuccgugaagcucaugaagaacagagaugagguucaggcuaugaucuacgaugauggggccucccgaaggcgcgaaaugcagagucaguccguaaugcuagcgcugaggcgcggggaugcaguguggcuucucucgcaugaucaugacgguuauggggcuuauuccaaccacggcaaguauaucacauucuccggcuuuuuggucuaucccgaccuggcuccggcugcuccuccagguuugggggcuagugaacugcucuag

SEQ ID NO: 12046 - RNA, 873 nt, Artificial Sequence
  Description of Artificial Sequence: Synthetic coding sequence
augaggagaccugcagccgugccacugcugcucuuacuauguuucggaucucagcgggcuaaagcagcaacagcuuguggccguccucguaugcugaauaggaugguggguggucaggacacucaagagggagaauggccuuggcaggucucaauacaacggaacgggucccauuuuugugguggcuccuugaucgccgaacaguggguucuaaccgccgcccacugcuuuaggaacaccuccgagacaucucucuaccagguucuucugggagcaagacagcuuguucagccuggaccucacgccauguacgcgcggguacggcagguagaaucaaaucccuuauaucaagggacggcuaguuccgcugacgucgcacucgucgagcucgaggcaccuguucccuucaccaauuacauucuccccgucugccuccccgauccuuccguaaucuucgagacaggcaugaauugcuggguuaccggcuggggaucucccucggaagaggauuugcuccccgaaccccggauccuccagaagcuggccguacccauaaucgauacccccaagugcaaccugcuuuauucgaaggauaccgaauuuggcuaucagccuaagacgauuaaaaacgauaugcuuugugcagguuuugaggagggaaaaaaggaugcuugcaaaggugacucgggaggaccauuagugugcuuaguuggacaaaguuggcuccaggcaggagugauaaguuggggagagggcugcgccaggcagaacagaccgggagucuacauucgcguaacagcccaucacaacuggauccaucgcaucaucccgaagcuccaguuccaaccagccagauuagggggacaaaaauag

SEQ ID NO: 12047 - RNA, 792 nt, Artificial Sequence
  Description of Artificial Sequence: Synthetic coding sequence
auggcauucuuauggcuucuguccuguugggcucugcuggguacaacauucggcugcggagugccugccauccauccaguacucuccggcuugucccguaucgugaacggagaagacgcugugccaggaucuuggccauggcagguuagccuccaggacaaaacaggguuucacuucugcggcgggucacuaaucagcgaggauuggguggugacagcagcacauugcggaguuagaacuagcgauguggucgucgccggcgaguucgaccaggguuccgaugaagaaaauauacaggugcucaagaucgccaaagucuuuaaaaauccaaaguucucuauacucacugugaauaacgacaucacucuacucaaguuagcaacucccgcacgauucucucagaccguauccgccgugugucugcccagugcugaugaugacuucccugcuggaacuuuaugugcuacaaccggauggggaaaaacaaaguacaaugccaacaaaacacccgacaagcuccaacaagcggcucuaccccuccugaguaaugccgaaugcaagaaaucgugggguaggcgcauaacugacgugaugauuugcgccggagcuucagggguaucuucguguaugggcgacaguggcggcccauuagugugucagaaagacggggcauggacacucgucggcauugugucuugggguucuaggacuugcaguacaacuacaccggcuguguaugcccgcguggcaaagcugaucccaugggugcagaagaucuuagcagcaaauuag

SEQ ID NO: 12048 - RNA, 228 nt, Artificial Sequence
  Description of Artificial Sequence: Synthetic coding sequence
augggagcugccauaagccagggagcuuuaauugccauaguuuguaacggccuggugggguuccuccuuuugcugcucuggguuauccuguguugggcuugccacucccggucagcugauguugauagcuugucugaaagucgcacacaggaaucugcaugucucgagcuugaucccgccgcccaaucccucgccucauuagccccuaucggugcucaguggcccuag

SEQ ID NO: 12049 - RNA, 762 nt, Artificial Sequence
  Description of Artificial Sequence: Synthetic coding sequence
auggccaggagucuuuuacuuccccuacagauuuugcugcugucacuggcccucgagacugcaggagaagaagcacagggagacaaaauuauugacggagcgcccugugcccgaggaucccacccuuggcaggucgccuuauuguccggcaaucagcuacacugcggagguguacuugugaaugagcguugggucuuaaccgccgcccacugcaaaaugaaugaauacacggugcaucucggcucagauaccuuaggcgaccgccgugcucaacgcauaaaggccaguaagagcuuccgccaucccggauacaguacccagacucacgucaacgauuuaaugcucgucaaacuuaacucgcaggcccgacugaguucuauggugaaaaaaguccgacucccuagccgcugcgaaccucccgguaccaccugcacugucuccgggugggguacaacuacauccccggacguuacuuuuccgucugaccugauguguguagaugucaagcuaauaaguccucaggacugcacuaaaguguacaaggaccucuuggaaaacucaaugcuuugugcuggaauucccgauucaaaaaaaaacgccugcaacggcgauucaggaggcccucuggucugccgaggaacucugcagggccuugugucuugggggaccuuccccugcggacagcccaaugaccccggaguguauacccaaguuugcaaguuuacaaaguggaucaacgauacgaugaaaaagcaucgcuag

SEQ ID NO: 12050 - RNA, 480 nt, Artificial Sequence
  Description of Artificial Sequence: Synthetic coding sequence
augaaggcuugggggacagucguggugacgcuggcuacacuaauggugguuacaguugaugccaaaauuuacgaaagaugugagcuggccgcgcgauuagagagagcugggcucaauggguauaagggauacggcguuggagauugguugugcauggcccacuaugaaucgggguucgacacugccuuuguggaccacaacccagacggaagcagugaauaugggauuuuccagcugaauuccgccugguggugcgauaauggaauaacaccuacaaagaaccugugccauauggauugccaugaucugcucaacaggcacauccucgaugacauacguugugcaaaacaaauuguuuccagucaaaauggccugagugcguggacaaguuggagauugcauuguucuggccacgaucugagugaguggcugaagggcugcgauaugcacgugaaaaucgacccuaaaauacauccuuag

SEQ ID NO: 12051 - RNA, 501 nt, Artificial Sequence
  Description of Artificial Sequence: Synthetic coding sequence
auggcacaaacaaacucuuucuuuaugcugaucuccagucugauguuucuuagcuugucucagggccaggagucgcaaacugaauugcccaacccucgaauuagcugucccgaggguacgaaugcuuaccggagcuauugcuacuacuuuaaugaagauccugaaacuuggguggaugccgaucuguauugucagaacaugaauucagguaaccuuguuagcguucucacccaggccgagggugccuuuguggcuucucugaucaaggaaucuaguaccgaugacucuaacguguggauaggguugcacgauccuaaaaagaaucgccgguggcacuggucgucuggaucucugguaucguacaaaagcugggacacagggucaccaaguuccgcaaacgcaggcuauugcgcuucuuugacauccugcagcggguucaaaaaauggaaggaugaaucaugcgagaagaaguucagcuuuguuugcaaauucaagaauuag

SEQ ID NO: 12052 - RNA, 528 nt, Artificial Sequence
  Description of Artificial Sequence: Synthetic coding sequence
augcuuccuccgauggcgcuaccaagugugucguggauguuacucuccugucuuaugcuauugucccaagugcaaggcgaggaaccucagcgagaacugcccucagcucgcauccgcuguccaaaagguagcaaagcuuauggaucucauuguuaugcacucuucuugagcccuaaauccuggacugacgccgaucucgcaugccagaagcggccauccgggaacuuggucagcguguugaguggugccgaagggucauucguauccucacugguaaagaguauagguaacagcuacucauauguuuggaucggccugcacgacccaacucaggggaccgaaccgaacggagaaggcugggaguggucuuccagugacgugaugaauuauuucgccugggagagaaacccaucgacgaucuccuccccuggccacugugccagcuugucccggaguaccgcguuucugagauggaaagauuauaauugcaacgucagacugcccuauguuugcaaguucacugauuag

SEQ ID NO: 12053 - RNA, 1686 nt, Artificial Sequence
  Description of Artificial Sequence: Synthetic coding sequence
augggggcgcguacaccacucccgucuuuuugggugaguuuuuucgcagagaccggaauucuuuuuccuggaggcacgccauggccuaugggaucacaacacuccaagcaacaccggaaaccugggccucugaagcgaggacaucggagagacaggaggacaacacgcagaaaauacuggaaagaaggccgcgaaauagcaagagucuuggacgaugagggccggaaccugagacagcagaaguuagacaggcaacgagccuugcuugagcaaaaacagaagaagaagcggcaggagccccugaugguacaggccaacgcagacgggcggccccgcuccaggcgagcccgucaauccgaagagcaggcgccgcugguugaaaguuaccucagcagcuccggaucuacaucuuaccaggugcaggaagcagacucacucgcaagcguacagcuuggcgcuacucgucccacagcuccugcauccgcgaagcgcacgaaggcagcugcaacagcgggcgggcaaggcggagccgcccguaaggagaagaaagguaagcacaagggcacgucugggccagcugcucucgcagaggacaagucugaagcccagggaccaguccagauccugacugugggccaaucagaucacgcccaggacgccggggaaacugcugcgggggggggagagcgccccucuggccaggaccuccgcgccaccaugcaacgcaagggaaucagcucaucaaugucauuugacgaagacgaggaggaugaggaggagaauagcagcagcuccucccaacugaauucgaauacccguccuuccuccgcaacaaguaggaaaaguguuagggaggcugcuucugcuccuagccccacugcuccugagcagccuguugauguugagguucaagaccuggaggaguucgcguuaaggccugcuccacaggggaucacaauuaaaugcagaauuacaagggauaaaaaaggaauggaccgcggcauguacccuacguauuuccuccacuuggaccgcgaagacggaaaaaaaguauuucuccuggccggcagaaaacguaaaaaaagcaagaccucuaacuaccugauaucuguugacccuaccgaccugucaagaggcggagauucuuacaucggcaaacuacgauccaaccuuaugggcacuaaguucaccgucuaugauaacggcguaaacccucagaaggcuucuucgagcacgcucgagagcgguacguuacgccaggagcucgccgccguguguuacgagacuaauguguugggcuuuaaaggucccagaaagaugucaguuauugugccuggaaugaacauggugcacgaacgcguuuccauccgaccucgcaaugagcacgaaacucuuuuggcuagguggcagaauaagaauacugagucuaucauugagcugcagaacaagacuccaguguggaaugacgacacucagaguuacgucuugaauuuccauggcagagugacucaagcauccguuaagaacuuccagauuauucacgguaaugaucccgacuacauugugaugcaauuuggccgcguugcggaagauguguuuacuauggauuacaacuacccuuuaugcgcuuuacaagcguuugcuauugcauuaagcuccuucgauucuaagcuggcuugcgaguag

SEQ ID NO: 12054 - RNA, 1272 nt, Artificial Sequence
  Description of Artificial Sequence: Synthetic coding sequence
augauguacagacccgacgugguacgagcaagaaagcgcguuugcugggagccaugggugauuggacuggucauauucauuucuuugaucgugcucgccgugugcaucggauugaccguacacuacgucagguauaaucaaaaaaaaaccuauaacuauuauucgacucugagcuucacaacugauaaacuuuaugcugaguucggccgggaagccucaaacaauuuuacugagaugagccaacgguuggaauccauggugaagaaugcauuuuacaaaucaccccuacgcgaagaguucgugaagucacaggucaucaaauucucucaacaaaaacacggaguccuggcacacaugcugcugaucugcagguuucacuccaccgaggaccccgaaaccguugauaagaucguccagcuagucuugcaugagaaacuucaggacgcgguagggccccccaaggucgacccacacucuguaaaaauaaaaaagauuaauaagacugaaacugacucauaccugaaucacugcugugguacacgccggucaaaaacucuaggucagucacuaagaauugucggggggacggagguagaggaaggggaauggcccuggcaggcuucacuucagugggaugggagucaccggugcggagccacacugauuaaugcuaccuggcuggugucugccgcacacugcuuuacaaccuacaaaaacccagcucgguggacugcuuccuuugggguuacaaucaaaccuagcaagaugaaacgggggcuucgucgcauaaucguucacgaaaaguacaaacauccaucccacgauuacgauauaucccuggcugaauuaagcucccccgugccauacacaaacgcggugcaccgggugugucugccagacgcauccuacgaguuucaaccaggugacguaauguuuguaacuggcuucggcgcuuugaagaacgacgguuacucucagaaccaucuccgccaggcucagguaacacucauagacgccacuacuugcaacgagccucaggcauacaacgacgcuaucacaccaagaaugcugugugcagguaguuuggaaggcaagacggaugccugucagggagacagugggggcccucucguuucuagugacgcgagagacauuugguaucucgccggcauaguuagcuggggcgacgagugcgccaagccaaacaagccuggcguauacacacgcgugaccgcccugagggacuggaucaccucuaaaaccgguauuuag

SEQ ID NO: 12055 - RNA, 282 nt, Artificial Sequence
  Description of Artificial Sequence: Synthetic coding sequence
augaagccugugcugccccugcaauuccucgucguauuuugccuggcccuccagcuugugccuggaucacccaagcaacgcguauuaaaguacauccucgaaccuccuccguguaucuccgcucccgaaaacugcacucaccuguguaccaugcaagaggacugcgaaaaaggauuccaguguuguucaucauucugcgguauuguguguuccagugaaaccuuccagaaaagaaaccgcauaaagcauaaaggcucagaggugaucaugccggcaaacuag

SEQ ID NO: 12056 - RNA, 1530 nt, Artificial Sequence
  Description of Artificial Sequence: Synthetic coding sequence
auggacuuucuccuugcccucguuuuaguguccagucuguaucuccaggcagccgcagaguuugacgggcgcuggccaaggcagauagucucuaguauuggguuaugucguuauggggggaggauugauuguuguugggggugggcuagacagucuuggggucaaugucagccggugugucagccgagauguaaacacggcgaaugcauagggccgaacaaauguaaaugccauccaggcuaugcagggaaaacaugcaaucaggacuugaacgagugcggcuugaaaccccguccuugcaagcaccgauguaugaauaccuaugguuccuacaaaugcuacugccucaacggauauaugcugaugccugaugggucuuguucuuccgcucucaccugcucuauggcuaacugccaguacggaugcgacguugugaaaggccaaauuagaugucagugcccauccccuggucuacagcuggcuccggacgggcgaacauguguggauguggacgagugcgcuaccggcagggccucuugcccacgguuccgacagugugucaauacguucggaucuuauauuuguaaaugucauaaaggguuugaccugauguacauuggagggaaauaccaaugucacgauauagacgaaugcucacucggccaguaccaaugcucaucuuuugcuagguguuauaacauucgcggcucauauaagugcaaauguaaggaaggauaccaaggcgauggcuuaaccuguguguauauuccuaaaguaaugaucgagccauccggcccaauccaugugcccaagggaaacggcacuauucuuaaaggggauacagggaacaauaauuggauaccagacgugggcucaacuugguggccccccaagaccccuuacauuccaccaauuaucacaaacaggcccacuaguaaaccaaccacacguccaacaccaaagccaaccccaauuccuaccccaccgccucccccccccuuacccacggaacugcgcacuccacugccccccaccacaccggagcgaccuacaacugggcuaacaacuauugcucccgccgcuucuacaccaccgggcgggauuacuguggauaaccgcgugcagacggacccucagaagccaagaggagacguauuuuccgugcugguccauucuugcaauuuugaucauggacugugcggauggauucgggagaaggauaaugaccuucauugggagccaauccgggaccccgccggcggucaguaucucaccgugucggcagccaaagcccccgguggcaaagcagcucgccugguucucccauugggcagguugaugcauagcggggaccucugccuguccuuccggcacaaagugacggggcugcauucaggcacccugcagguguucgugcggaaacacggcgcacauggggccgcuuuguggggacgaaacggcgggcauggauggagacagacccagaucacacugagaggcgcugacauuaaguccgagucgcagcgcuag

SEQ ID NO: 12057 - RNA, 381 nt, Artificial Sequence
  Description of Artificial Sequence: Synthetic coding sequence
auggauaagagcuuacugcucgaauugccaauacucuuguguuguuuuagggccuuguccgguagccugucaaugcgcaacgaugccgugaaugaaauuguagcugugaaaaauaauuucccagugauugagauagugcaguguaggaugugucacuuacaauucccuggcgaaaaguguaguaggggacgaggaaucuguaccgccaccacagaggaggcauguaugguuggcaggauguucaagagagacgggaacccuugguugaccuuuaugggaugccuaaaaaauugugccgaugugaaaggaauucgguggagcguguaccuuguaaauuuccggugcuguagaagucacgaccucugcaacgaggaccuguag

SEQ ID NO: 12058 - RNA, 537 nt, Artificial Sequence
  Description of Artificial Sequence: Synthetic coding sequence
auggagcuccuccagguaacuauucuuuuucuccuccccuccauuugcuccuccaauuccaccggcgugcuagaagccgccaauaauagccuggucgugaccacgacaaagccuucgaucacgacaccaaauaccgaaagcuugcagaagaaugugguaaccccgacaacugggacaacucccaaggguaccauaacaaacgaguugcugaaaaugucacugaugaguacugcuacuuuccugacaaguaaggaugagggauuaaaggccacaacaacugauguccgaaaaaaugacuccauuauaagcaauguuaccguaaccagcgugaccuuaccaaaugccguaucaaccuugcaaagcuccaagccuaaaacugagacucagucuuccaucaagacaacugagaucccuggaaccccugaaaacggcaaugaucagccacaguccgauaaagaaagcgugaagcuacugaccguuaagacaaucucucacgaaagcggcgaacauagcgcacaagguaagacuaaaaauuag

SEQ ID NO: 12059 - RNA, 2544 nt, Artificial Sequence
  Description of Artificial Sequence: Synthetic coding sequence
auguuuaaaugcuggaguguggugcucguccuaggguucauuuuucuggagagugagggaagaccaacgaaggagggcgguuacggccugaagucauaccagccacuaaugaggcuacgucauaaacaggaaaagaaucaagaaaguucgagagugaaaggcuucaugauccaggacgggccguucgggucaugcgaaaacaaauacuguggcuugggcagacauugcgugaccaguagagagaccggacaagccgaaugugcaugcauggaucuguguaagcggcacuauaaacccguaugcggcucagacggggaauucuacgagaaucauugcgaagugcacagagccgcgugucuuaaaaaacaaaaaaucacuauuguacauaaugaagauuguuucuucaaaggcgacaagugcaagaccacugaguacagcaagaugaaaaacaugcugcuagacuugcaaaaccaaaaguauauuaugcaggagaaugagaauccaaacggagaugauauuagccgcaaaaagcuacuugucgaccaaauguucaaguauuuugacgcagauuccaauggccuggucgauauuaacgaacucacccagguuauuaaacaagaagagcuaggcaaagaccuguuugauugcacuuuauaugucuugcucaaauacgacgacuuuaacgcggacaaacaccucgcgcuggaggaguucuaucgcgcuuuucagguaauccagcuaagccugccggaggaucagaaacuuagcaucacugccgcuaccguggggcagucagcuguguugucgugugcaauccagggcacccugagaccaccuauuauauggaaaagaaacaacauuauucugaauaaccucgaucucgaagacaucaacgacuucggcgacgauggcucacuguacauuacaaagguuaccaccacucacgugggcaauuauaccugcuacgcagacggcuaugagcagguguaucagacacauauauuccagguaaacgugccuccuguaauaagagucuacccugagagccaggcacgagagccaggaguuaccgcaagccuccgaugucacgcugaagguauucccaaaccucagcugggcugguuaaagaacggcauugacauuaccccaaaacugucuaaacagcuaacccuucaggcuaacggaagugaggugcacaucagcaacgugagauacgaagacaccggggccuacacauguauugcaaagaacgaagccggcguggaugaagauaucucuagccucuuuguggaagauagugcaaggaaaacuuuggcaaauauccucuggagagaggagggacucgguaucgggaacauguucuacguguucuacgaagacggaauuaaggugauccagccgauugaaugugaguuccagaggcacauuaagcccagugagaagcugcuaggauuccaggaugaagugugcccgaaagcagaaggggaugaagugcagaggugcgugugggccucggccgugaacguuaaggauaaauucaucuacguugcgcagccaacauuggaccgagucuugaucguggacguacagagccaaaaaguuguucaggccgucuccaccgacccaguaccuguuaagcuacacuaugacaagucucacgaccaagugugggugcucagcuggggaacuuuagaaaagaccaguccuacacugcagguuauuacccucgcgucuggcaacgucccccaucauacaauucacacucaacccguaggaaagcaguucgaccggguagacgauuuuuuuaucccuacuaccacacugaucaucacacacaugagauuuggauucauucuucauaaagacgaagccgcucuccaaaagaucgaccucgagaccaugucauacaucaaaacuaucaaucuaaaagacuacaagugcguuccccagagucuggccuauacacacuugggcggcuauuauuuuaucggcuguaagccagauuccacaggugccguuucaccccagguuaugguggacgggguuacugauagcguuaucgguuucaauucggacguuaccgggaccccuuauguaucucccgauggacauuaccugguguccauaaacgaugugaaaggccuugugcgagugcaguacauuaccauuaggggcgagauccaggaagcuuuugacaucuacaccaaucuccauauauccgaccuugcauuccagccaagcuuuacagaagcacaucaguauaacauuuacgggaguuccagcacccagaccgacguucuuuuuguugagcucaguaguggaaaaguaaaaaugaucaaaagccugaaggaaccucucaaagcugaggaguggcccuggaaucgcaagaacaggcagauccaggauagcgggcuauuuggucaauaccucaugaccccuagcaaagauagcuuauucauuuuggauggaagguugaacaagcuaaacugugagaucacugagguggagaaagggaacacggucauauggguuggcgacgcauag

SEQ ID NO: 12060 - RNA, 273 nt, Artificial Sequence
  Description of Artificial Sequence: Synthetic coding sequence
augcgacugagcgugugccugcugcuguuaacccucgccuuguguuguuacagagcaaaugccguagugugccaggcgcugggguccgaaauaacaggcuuccugcuggcagguaaacccguguucaaguuucaacuggcuaaguucaaggccccucuggaggccguugcugcaaaaauggagguuaagaaaugcguagauaccauggccuacgaaaaacgagugcugauaaccaaaacauuaggcaaaaucgcugagaaaugcgacagguag

SEQ ID NO: 12061 - RNA, 1044 nt, Artificial Sequence
  Description of Artificial Sequence: Synthetic coding sequence
augaguaguuggucucgccagcgcccaaaaucccccggugggauccagccucacgugucucguacacuguuucugcugcuucugcuggcagccuccgccuggggcguaacauuaucaccaaaagauugccagguuuuuagaagugaucacgguuccucuaucaguugucagccaccugcugagauacccggguacuuaccugccgacaccguccaucuugccguugaauuuuuuaaccucacucacuuacccgcgaaccuccuccagggcgcaucuaagcugcaggagcuacaccugagcuccaauggacuggagagccuuagcccggaauuccugcgcccaguuccccaguugaggguccuggaccucacccguaacgcccugacuggccucccacccggacucuuccaggcuuccgcuacccuugacacccucguucugaaggagaaccaacuugaagugcucgaaguguccuggcugcacggacugaaggcacucgggcaccuggaccugagcggcaaccggcugagaaaguugccuccuggccugcuggcuaauuuuacacuacugagaacccuggacuuaggagaaaaccaacucgaaacauugccuccugaccuguuaagggggccuuugcagcuagagcgacuccaccuugaggggaacaagcuccaggugcuggguaaagaccuucuccuaccacagccggaccugcgauacuuguuucugaaugggaacaagcuugcuaggguagcagcuggcgcauuccagggcuuacgucagcuggacaugcuggacuuauccaacaauucgcuugcaagcgugccggagggccugugggccagucuuggacaaccaaauugggacaugcgugacggauucgauauuagcgguaacccuuggauuugugaccaaaacuuguccgauuuguaucgauggcugcaggcacaaaaggauaagauguuuucucagaacgauacccgaugcgcagggccugaggcgguuaaggggcaaaccuuacuugccgucgcuaaaucucaguag

SEQ ID NO: 12062 - RNA, 1407 nt, Artificial Sequence
  Description of Artificial Sequence: Synthetic coding sequence
augccaccuuggggggcugcucuggcacucauacuugcugugcucgcacuucucggacucuuagguccccggcuccgaggcccauggggucgcgcugugggggagaggacuuugccuggagcccaggauagggacgacggagaagaggccgacggggguggaccagccgaucaguucagcgacggccgggaaccucuccccggugguuguucccuaguguguaagccuagcgcuuuggcccaaugccuccucagggcauuacgccgcucagaggccuuggaggcuggccccaggucaugguucuccggcccucaucuccagacacugugccacuuugugcucccuguagcaccugguccagaacuggcuagggaauaccuucagcuggccgaugacggacugguggcccuggacuggguggucggcccuugcgucaggggacggcgcauuacuucagcaggagggcugccagcaguauuacucgucauuccuaacgcauggggacgacucacacggaauguccucggucucugucugcuggcucuggagagaggcuauuauccagugauuuuucaucgaagggggcaccacggcugcccauuggugucuccucgguuacaaccauucggggauccgucagaccugaaagaagcugugacauacauuagguuuagacauccagcugcuccccuuuuugcagucagcgagggcuccgguucugccuuauuacuaucguaccucggcgaaugcgguagcucgagcuacgucacuggcgccgccugcaucuccccaguccuuaggugucgugagugguucgaagcaggacuucccuggccauaugagagaggguuccugcugcaucagaaaauagcauugucuagauacgcuaccgcucuagaagauacaguagacacaucaaggcucuuucgcucacggucucugcgcgaguuugaagaggcccuguucugccacacaaaguccuucccaaucucgugggauacauacugggaucgaaaugacccgcugcgagacgucgaugaggcugcuguaccugugcugugcauuugcucagccgaugaucccguaugcggcccacccgaccauacauugacaacugaauuguuucauucaaaccccuauuuuuuccuucuacuaaguagacacggaggccacugcgguuuucucaggcaggagccccucccagccuggagccaugaggugaucuuggagagcuuucgagcacugaccgaguuuuuccguacugaagaacggauuaagggccugagcaggcauagggcaucauuccuaggcggccgucgccggggaggcgcguugcaaaggagggaaguuucaagcagcucgaaucuagaggagauuuucaauuggaagagauccuacacucguuag

SEQ ID NO: 12063 - RNA, 423 nt, Artificial Sequence
  Description of Artificial Sequence: Synthetic coding sequence
auguuuuuuacgauuucaagaaagaacaugucucagaaacugagccuguuauugcuaguuuucggacucaucuggggucugaugcugcuacauuauacuuuccagcaaccuagacaucaaucauccgugaaacugcgggagcaaauucuggaucucucaaaaagauacgugaaggcacuugcggaggagaauaagaauaccguggacguggaaaauggagcaucuauggcaggauacgccgaucuaaagagaaccauugcugugcuguuggaugauaucuuacagcgucuggugaagcucgagaauaaaguugacuauaucguggugaauggaagcgcggcaaacacuaccaacggcacaucggggaaucucguucccgucaccacuaacaaacgaacgaauguuucagguuccauccgcuag

SEQ ID NO: 12064 - RNA, 993 nt, Artificial Sequence
  Description of Artificial Sequence: Synthetic coding sequence
cgcggggccuuggugggagcuccccguucugcacgggcaagcugucucaggggaaggagaccuggucggaggcagccuugcgggaggugcccggacccaccucgcucugguccaggccaggcagggcgagcucgcugugcaagagacgucgcugcccaaaccgcccucgcuccacgggcccucgcccuuggagccggagcugcagggccaggauggaggggugccgugccacgaaggccagcagcaagagugagcagagcggcucagaggcaggagcaagaauuggugagauugcaucgcgagcaggaaugugagcuccagcccgaaccugcaccuccgcgccccaguggcccugcaaccgcugaggacccagggcggagaccuguucugccacaaagaccccccgaggagagaccuccacagccuccagguucaacuggggugaucgcagaaaccggacaagcagguccucccgcgggggcagguguuuccggauacccuaaaucacccccaguagcgucuccuggugcucccguucccucccuaguaucauucagcgccggcuugacucaaaaacccuucccuagcgacggcgggguugugcuguuuaacaaggugcugguaaaugauggcgacguguacaacccuucuaccggcgucuuuacggccccuuaugacggucguuacuugauuacugcgacuuuaaccccugagagagaugcauauguugaagccguucugaguguguccaaugcaagcguggcucagcuccacacagcuggguacaggcgugaauuucuggaguaucaccggccccccggcgcccugcauaccugugggggccccggcgcuuuccaucuaaucguacaucuuaaagcuggcgaugccguuaacguggucgucacuggcggaaagcucgcccauacugauuuugacgaaauguacucuaccuucagcggcguuuuccuguauccauuccugucucaccuguag

SEQ ID NO: 12065 - RNA, 585 nt, Artificial Sequence
  Description of Artificial Sequence: Synthetic coding sequence
auguccgcacuguggcuacugcugggacugcuugcacugauggaucugucugagucgucuaacuggggguguuaugggaacauucaaucucuggacaccccuggugcaagcugcggaauagggcgacggcacggacugaacuacuguggggugagggcuuccgaacgacuggcugagaucgacaugccauaccugcugaaauaucagccuaugaugcaaacaaucgggcagaaguauuguauggacccagcugugauagccggugucuuguccagaaagucuccaggugacaagauucuaguuaauaugggcgacagaacuucuauggugcaagauccaggcagucaagcucccaccaguuggauuucagaaucucaggucucacagacaacggagguguugacaacccgaaucaaggagauacagcgcagauuccccacuuggacuccugaucaguacuuaagaggcggacugugugccuacuccggcggcgcaggcuacguucggucuagccaggaucucuccugcgacuuuugcaaugacguucucgcacgcgcaaaauaccuuaaaaggcauggcuuuuag

SEQ ID NO: 12066 - RNA, 273 nt, Artificial Sequence
  Description of Artificial Sequence: Synthetic coding sequence
augaaauucuuagccguucucguucuccuggguguuuccaucuuucucguguccgcccagaacccuacuacugcugcuccugccgauacuuaccccgcgaccgggccugcugaugacgaggcgccugaugccgagacaacugcugccgcaaccacagccacuacugccgcuccuacuacugcuaccacagcggcuuccacuacugcucgcaaagacauuccagugcuuccuaaaugggugggagaccugccaaacggccgcguuugcccuuag

SEQ ID NO: 12067 - RNA, 1914 nt, Artificial Sequence
  Description of Artificial Sequence: Synthetic coding sequence
augagccggaugcugccuuuccuuuuacuucucugguucuugccuauaaccgaggguucucagagagcggaaccgauguuuaccgcuguuacuaauagugugcuaccuccagauuacgauuccaaucccacccaguugaauuaugggguugcaguuaccgacgucgaucacgauggugauuuugaaaucgugguugcgggauacaauggaccaaaccuuguuuuaaaguacgacagagcucagaagcgccuugugaauauugcugucgaugagcgguccucuccauauuaugcccugagagaccgacaggggaacgccauaggaguaacagccugugauauugauggugacggcagggaagaaaucuacuucuuaaauacgaacaacgcuuucagugggguagccacguauaccgauaaauuguucaaauuucggaauaaccggugggaagacauacucucggacgaggucaaugucgcucgagguguggcuagccuguuugccggcaggucuguggccugcguggaccguaagggcucugggcgcuacagcaucuacauagccaacuaugccuauggaaacgucgggccugacgcccucauugaaauggacccagaagcauccgacuugucccgugggaucuuggcccuucgagacguggcugcagaggcuggggugucaaaguacacuggaggucgcggggugaguguugggcccauauugagcuccucugcaagcgacauauucugugauaacgaaaacggcccuaacuuucucuuucauaauagaggcgaugggacauucgucgacgcugccgccagcgcugguguugacgauccacaccaacauggacgagggguugccuuggcagacuuuaaucgggacggaaaaguggacauuguguacggcaauuggaacggcccacacagacuguaucuucagaugucaacucacgguaaagugagauuucgcgauaucgcaagccccaaauucuccaugcccaguccugugaggacagugaucacagcagacuuugacaacgaccaggaacuggaaaucuuuuucaauaauauagcauacagauccagcagugcgaacaggcuauucagagucaucagacgcgaacacggcgauccgcucauagaagaacuuaaccccggagacgcacucgagcccgaaggcaggggcacgggaggcguugucaccgacuucgacggcgacgguaugcuggaucugauucugagucauggagagucaauggcacaaccccugagcguguuucggggaaaucaggguuuuaauaauaacuggcugcgaguggugccucguacucgguucggagcuuucgcccggggcgcaaagguggugcuguacacuaagaaaagcggagcgcaucucaggaucauagauggagggagcggauaucugugcgaaauggaaccuguggcccacuucgggcuaggcaaggaugaagcuagcucgguggaggugacauggccugacggcaaaauggugucaaggaacgucgcuaguggagaaaugaacucuguccuggagauucuauauccccgagacgaagacacucuccaagaucccgcaccccuggaauguggccagggauucucccagcaagaaaacgggcauuguauggauaccaacgagugcauccaauuucccuucgugugcccucgagacaagccagugugugugaauacauacggcucuuauaggugccgaaccaacaagaaguguagucguggcuacgaacccaacgaagacgguaccgccuguguagcucagguggcauuccugggcgguuacucaagugcagcgucuagaauuagcgagcccuugagccgagccaguuaucugucacugggacugggccugugucuccaguuguacgcccuguag

SEQ ID NO: 12068 - RNA, 600 nt, Artificial Sequence
  Description of Artificial Sequence: Synthetic coding sequence
auggcgcugaacggggcagaaguggacgacuuuuccugggaaccuccgacagaagcugagacuaagguguuacaggccagaagagagcgccaggacagaauaucucgacuaaugggggauuaccuccugcgcggguaucgaaugcucggggagacaugugcagauuguggcacgauccucuuacaggauaagcagcgcaagauauacuguguugcuugucaggaguuagauucagacguggauaaggauaacccagcacuuaacgcacaagccgcgcugagccaagcccgcgaacaccagcuggcaagcgccagcgaacugccacucggcagucgacccgccccacagccccccgucccuaggcccgagcauugugaaggagcagcggcuggccugaaagcagcucaaggacccccagcucccgccgugccacccaauacggaugucauggcuuguacucaaacugcccuauugcaaaaguugacaugggcgucugccgaacucggaagcucuaccucucucgaaaccuccauacagcuuuguggccugauaagggccugcgccgaagccuugcgcucccuccagcagcugcaacacuag

SEQ ID NO: 12069 - RNA, 813 nt, Artificial Sequence
  Description of Artificial Sequence: Synthetic coding sequence
augaaacucggaugcgugcugauggccugggcccuauauuugagccuaggaguacucuggguggcacagaugcuacuagcugcuucuuucgagacauugcagugugaggguccaguuugcacagaggaaaguucgugccacacugaggacgaucugaccgacgccagagaggccggauuccaagugaaggccuacacuuuuagugagccuuuccaccuaaucgugaguuacgaguuguuucccgcaccaauucuccgugcagugccauccgcugagccucaggcugguucuccaaugacacuguccugccaaacaaagcucccucuucaacgaagugccgcacgcuuacuguuuuccuucuauaaagacgguaggaucguucagucaagaggccugucuucugaauuucagaucccgaccgcuagcgaagaccacuccgguagcuacuggugugaggccgcgaccgaagacaaccagguauggaaacaauccccacagcuggagaucagggugcaaggugccuccaguucagcggcaccaccuacguugaauccugcuccccagaagucugcugcucccggaaccgcaccggaagaggccccggguccccuuccucccccuccuaccccaucuuccgaggacccaggcuuuagcucuccacuugggaugccagauccgcaccuuuaucaccaaauggggcugcugcugaaacauaugcaggauguccgcguccuguugggacaucugcugauggaauuaagagagcugucuggacaucgcaagccugguacaaccaaagcgaccgccgaauag

SEQ ID NO: 12070 - RNA, 2421 nt, Artificial Sequence
  Description of Artificial Sequence: Synthetic coding sequence
augcgccugucucccgcaccacucaaacugagccggacgccagcucucuuggcacuggcacugccucucgccgcugcacucgccuucucugacgagacucucgacaaggucccaaagucugaaggauauugcagccgcauccugcgcgcucaggggacucgacgagagggguauaccgaauucucccuccggguggaaggggaccccgacuuuuacaagccaggcacaagcuacagaguuacacugucugcagcaccaccgaguuauuuuagagguuucacccucaucgccuugcgcgaaaauagagaaggggauaaagaggaggaccacgcagguacguuccagauaauugaugaagaggagacucaguuuaugucuaacugucccguggcuguaaccgaguccaccccuagaaggagaacuagaauccaaguuuucuggauagcacccccugcugggaccgggugugugauucucaaggcaucuauuguucagaagagaaucaucuauuuccaggacgagggcucccucacuaagaagcucugcgagcaggacagcacauucgacggugugacugauaaaccuauuuuagacugcuguugcggcaccgcuaaauaccggcuaacauucuauggcaacuggucugaaaaaacacacccaaaagacuauccacgcagagcgaaccauugguccgccaucauugguggcagccauucaaaaaacuacguccugugggaguacggagguuacgcaucugaaggcgucaaacagguagccgaacugggcagcccggugaagauggaggaggagauacgccagcagagcgacgagguucugaccguaaucaaggcuaaggcccaauggcccgccuggcagccuuuaaauguccgcgccgcacccuccgcugaguuuaguguagacaggacucggcaucugaugucuuuucugaccaugaugggcccgucucccgacuggaacguaggacugucagccgaggauuuauguacuaaggaaugcgguuggguacagaagguagugcaggaucuaaucccuugggacgcuggaacagacucugggguuaccuacgaaucaccuaacaagccuacaaucccacaggagaaaauccgcccccugacuaguuuggaucauccacagagucccuuuuaugaucccgaggguggcucaaucacacagguggcacgcguggugaucgaaaggauugcaagaaagggugagcaguguaauaucguaccugauaacguggaugacaucguggcugaccuggccccugaagaaaaggacgaagacgacacacccgagaccuguauauauuccaauuggagcccuugguccgcuuguucuaguuccaccugugacaaaggaaagcggaugcggcagcguaugcucaaagcgcagcuggaccugucuguuccaugucccgacacacaggacuuccagccuuguauggggcccggaugcuccgacgaggacgguuccaccuguacuaugagugaauggauuaccuggaguccauguaguaucucauguggcaugggaaugcguagcagggagcgauacgugaagcaauuccccgaggacggauccgugugcacccugccuaccgaagagaccgagaagugcaccguaaacgaagaguguuccccuucuucaugccugaugaccgaguggggagagugggacgaauguucggcaacauguggaauggggaugaagaaaaggcacagaaugaucaagaugaaucccgcagauggaaguaugugcaaagccgaaacuagccaagcugaaaaaugcaugaugcccgagugucauaccauaccaugccugcuuagucccuggagugaauggagcgacugcagcguuaccugugguaagggaaugaggacacgacagcggaugcugaagagccucgccgagcucggcgacugcaaugaggaucuggagcaaguggagaaauguaugcugcccgaguguccaauagacugugaacuuacugaguggucucaguggagcgaguguaauaaaagcugcggaaaaggacacgugauaaggaccagaaugauucagauggagccacaguuugggggagcaccuugcccggaaaccguacagcggaagaaaugucgcauucgaaagugucuuagaaacccaaguauacagaagcuccgauggcgggaggcacgcgagucccggagguccgagcaacuaaaggaagagucagaaggggagcaauuucccgguugucggaugaggccuuggacugcguggagcgaaugcaccaagcuaugcggagggggaauccaggaaagauauaugaccgucaaaaagcgauuuaaaucaucccaauuuacuucuuguaaagauaagaaagagauacgagcguguaauguucacccuuguuag

SEQ ID NO: 12071 - RNA, 4242 nt, Artificial Sequence
  Description of Artificial Sequence: Synthetic coding sequence
augcgccacggugucgcuugggcccuguuaguggcugccgcacugggucuuggagcacgcggcgugcgcggggcuguggcccuagcugauuucuacccuuuuggggccgagcguggcgacgcugugacgccaaagcaggacgacgguggcucgggucugcgcccucuguccguccccuucccauuuuuuggggcagagcacagcggucuguaugugaauaauaaugggaucaucaguuucuugaaagaggugagccaauucacaccuguugccuuuccuauugccaaggaccgcugcgugguugccgcauucugggcagacguggacaacagacgggcuggagacgucuacuacagagaagccaccgacccagccaugcugaggcgagccacggaggacguccggcacuacuuuccugagcuucuagacuucaacgcuacuuggguguucguggcuacuugguauagggugaccuucuucggcggguccucguccucaccugucaauacauuucagacaguguuaaucacugauggaaagcucucauucacaauuuucaacuaugaauccauaguauggaccacuggcacacacgccaguucaggaggaaaugccaccggccuuggcggcaucgccgcucaggcuggguuuaacgccggugacggccaacgguauuuuucgauccccggcagcagaacagcugauauggccgagguggaaacuaccacuaauguuggggucccaggccgcugggccuuccgcaucgacgaugcucaggucagagucggcggaugcgggcacacaaccucagucugccuagccuugcgcccaugucucaauggcgguaaauguauugacgacuguguuacagggaacccuucuuacacauguagcugccuuuccgguuuuacaggcaggcguugccaccucgaugugaacgagugugcuucacagccaugccaaaauggcgguacguguacacaugggauaaauucauuucguugucaaugucccgccgguuuuggaggcccaacgugcgaaaccgcacagucgccgugugacaccaaggaaugucagcacggugggcagugucagguggaaaacggcuccgccgugugcgugugccaggcaggauauacgggagcagcgugcgagauggauguggacgacugcaguccggaccccugccucaacggcggcucaugcguggauuuggugggcaauuauacaugccuuugcgccgagccauucaaaggccugaggugcgagacuggcgaccaucccguaccagaugcuugccuuagcgccccuugccauaauggaggcaccugcgucgacgcagaucaaggauauguuugcgaaugucccgaaggcuucaugggacuggacugucgggaacggguacccgacgacugugagugucgcaacggcggacgcugccuaggagccaacacgacacugugucaguguccauugggcuuuuuugggcucuugugugaauuugagaucacugccaugccuugcaacaugaacacccaguguccagacggaggcuauuguauggaacacggcgggaguuaucucugcguaugccacaccgaucacaaugccucacacagucugccaucccccugcgauuccgaucccugcuucaauggggguuccugcgaugcccacgaugacaguuauaccugcgagugcccacgcggauuccauggaaagcauugcgaaaaagcaagaccacaccuuugcuccucuggaccauguaggaacggcggaacaugcaaagaggcuggcggcgaauaucauuguagcuguccauaccgauucaccgggcgccauugugagaucgggaaaccugauaguugugccagcggacccugucauaacgggggaaccuguuuccacuauaucggaaaguacaagugugacugcccaccugguuucagcggucggcacugugaaauugcccccagccccugcuuucgcuccccaugcgucaacggcggaacgugugaggaccgggacaccgacuucuuuugucauugccaggcuggauauaugggacgcaggugucaagcggaagucgauugcggacccccugaggaagucaagcacgccacacuacgcuuuaauggcacacggcucggggcaguggcauuauacgcuugugauagaggauacucccuuucagccccaagcagaauuagaguuugucagccucauggaguguggucagagcccccucagugccuggagauugacgagugcagaagccagccaugccuccauggcggcucuugucaggaccgggucgccggauaucugugucugugcucaaccggauacgaaggugcucauugcgagcucgagcgagacgaguguagggcacacccuugucgcaauggagguagcugucgcaaccugcccggugccuacguauguagauguccagcuggguuuguggguguacauugcgagacagagguagacgcgugcgacagcucuccgugucagcacggugggaggugugaaucugggggaggagccuaccuuuguguguguccagaguccuuuuuuggguaccacugugaaaccguuucugaucccuguuucucauccccuugcggcggaaggggauacugccuagcaaguaacgggagucacucuugcaccuguaaaguaggauacacaggggaagacugugcuaaagaacucuucccaccaacagcauuaaagauggaacgggucgaggaaucuggggucucuauuucuuggaacccaccuaaugggccagcagcucggcagaugcucgauggcuaugcugugacuuacguuuccagcgauggauccuaccgccgaaccgacuucguagaccgcacacguuccucacaucagcugcaggccuuggcagccggacgcgccuauaauauaaguguuuucuccguaaaaagaaauuccaauaacaagaaugacaucaguagacccgccguucugcucgcaagaacgagaccuaggccuguggaggguuuugaagucacaaauguaacugcauccacuaucucagugcagugggcccuccacaggauucggcaugcuacagucucaggggucagggucuccaucaggcauccugaagcccuaagagaucaagccaccgauguggauagguccguggaccgauuuaccuuccgggcuuugcugccuggaaagcgauauacaauccaguugaccacccucagcggucuaagaggugaagaacacccuacugagagccucgccaccgcaccuacacacguguggacccgcccccugccaccagccaaccuaacagcugcaagagugaccgccaccucggcccacguuguuugggacgcuccuaccccagggucuuugcuggaggcguacgucaucaaugugacuacaucacagagcacgaagagccguuauguccccaaugguaagcucgcauccuacacaguucgcgaucuccuccccggcaggagguaucagcuguccgucaucgccgugcagucuacagagcuaggaccacaacauucggagccggcacaccuuuacaucauuaccuccccuagagacggugccgaucggcgcuggcaucaagggggacaccacccucgcguucuaaagaacagaccaccuccagcacgacugccugaacugcgccugcugaaugaccacucugccccagagacgccuacucagccuccaagauucucugaguuaguggacggccgaggaagaguaagugcuagauucggcgggagccccucaaaggccgccacggugcggagccaaccaacugcgagugcacaguuagagaacauggaggaggcgcccaagcgugucucccuagcccugcaguugccugagcacggcagcaaagacauuggcaacgugccgggaaacugcuccgagaauccuugucagaaugguggcaccugugucccuggagcugacgcacauuccugcgacuguggacccggcuucaagggccggcgaugcgaauuagccuguauuaaggucucucgcccguguacgagacuuuucuccgagaccaaagccuuccccgugugggagggcggcgucugccaucauguguacaaaagaguguacaggguucaccaagauauaugcuucaaagagucuugcgagaguacaaguuuaaagaaaaccccaaacagaaagcaaucuaaaagccagacacuggaaaaaucuuag

SEQ ID NO: 12072 - RNA, 1008 nt, Artificial Sequence
  Description of Artificial Sequence: Synthetic coding sequence
auguuccucgccacccugucuuuccuguugccauuugcacaucccuucggcacaguuaguugcgaauauaugcucggaagcccacugucaagucuagcccaggucaaucuauccccauucagccacccaaaaguccauauggauccaaauuauugccacccaucaaccagucuacaucuguguucacuugccuggagcuuuacgcggcugcuucaucccccucucagcccaggaauuucccaggucguaaaagaccacguaacuaaacccacagccauggcacagggccgcguggcccaucugaucgaguggaagggguggucaaaaccaucagauaguccagcugcccucgaauccgcauuuagcaguuacagugauuuguccgaaggcgaacaagaagcccguuucgcugcuggaguugccgaacaauucgcuaucgcagaagcaaaacuccgggcauggucaagcguggacggcgaagauucuacagaugacucuuaugacgaggacuucgcaggcggcauggacacggacauggcaggacagcugccccuagggccccaccugcaggaccucuuuacaggccauagguuuagcagacccguucgucagggaucaguggaaccggaaagcgacugcucucagacuguaucccccgauacguugugcaguagccugugcucccuagaggacggacuccuuggaagccccgccagacuggcuagccagcuccugggggaugaauugcuauuggccaagcuccccccauccagagagagcgcuuuuagaucucugggaccacuggaagcacaggacucccucuauaauuccccguuaaccgagucaugucuuucucccgccgaagaagaaccugccccauguaaggacugucaaccccugugcccaccacucacggggucgugggagagacagagacaagccucggaucuugcuucguccggcguugugucucuggaugaggaugaagcagagccagaagagcaguag

SEQ ID NO: 12073 - RNA, 828 nt, Artificial Sequence
  Description of Artificial Sequence: Synthetic coding sequence
augcagccgccgggcccccgagauccucucauaagguuauguuucuucagagaggaggggacaaacguaguucagaaaauaugcuucuccacccagauuauuaggcauuucgagucaaagcucucagacacuauugaaguauaccaggaaaggauccaauggcucacggaaaauaguaagaaagcuuucggccugauuaagggagcuagggucagcauucucaucgaugugagcgcaauuucuagcggcccccagaaagaggaguuucagaaggaucuuaugucacuaauagacgagcagcugucccauaaagaaaagcuguuuguacucucguuuggaacaaacgcuggcagcuuguggccggaccccauggaaguaucggcuucuacacuccaagaacucaaguugugggugaaaacauugcaaccagacgggggguccaaccuuuugcaagcacuaaaaaaaauuuuuacccucaaaggacuugauagccugguggcaaucaugaggagcugccccgaucagccuucugaaauccuaucugauuacauacaacaaagcacgaugggcagagaucuuauaauccacuuuauuacauacaggugugacgaucaaaugcccccagcaguucuaaagaaccucgccgaggccguccggggauauuaccacugcuacucacccaaaauggagcauuauaccaguagggacauggacgaacugcucgcggaaauucaaaaggcccaaagccuccugucacaugugcaagcucugcaacauucuucaccaugcgaggccuugaccugcacgauggaggaacccaggaacuag

SEQ ID NO: 12074 - RNA, 438 nt, Artificial Sequence
  Description of Artificial Sequence: Synthetic coding sequence
augcucacgcgacuuguacucagugcacaccucuccagcaccacgucgcccccauggacccacgccgcgauuagcugggaacuggauaacguccugaugcccuccccaaggauuuggccucaagucaccccaacuggcaggagcgcauccgucagaagugaggggaacacgaguagccuguggaauuucucagcagggcaagacguacaugccauuguuacucguaccugugagagugucuugagcagcgcuguauauacccacggauguggcugcgugcgcucagcuacaaauauuaccugccaaucuagcggccagcaaagacaggcagcuagacaagaagaagaaaauucuaucugcaaagcccaugauucccgagaagggcgucugggauacccacuaucagcccaccaaccuggaucuggcggcccuaacuag

SEQ ID NO: 12075 - RNA, 777 nt, Artificial Sequence
  Description of Artificial Sequence: Synthetic coding sequence
augacuccuccuaagcugcgugcaucacucagcccuagcuuacuucuccucuuauccgggugccuguuggcagcugcaagacgggaaaagggagcugcuagcaauguugccgagccugucccgggucccacgggcggcaguucugggcgguuucuaaguccugagcagcacgcaugcaguuggcaacuuuuguugcccgccccggaagccgccgcagguuccgaacuugcccugcgcugccagucuccagauggagcgcgacaccaaugugccuacagaggacacccugaaagaugcgccgcauaugcugccaggcgggcacacuuuuggaaacaggucuugggugggcuucgaaagaagagacguccuugucacgaccccgccccucuucaagccaggcugugugcagggaaaaaaggccacggggcagagcugcgcuugguaccacgcgccagccccccugcuagacccacugucgccggguuugcaggcgagucuaaaccccgcgcccgcaaccgagguaggacccgagagagggcuuccgggcccgcugcggguaccccgcccccacaaucugccccaccuaaggaaaacccaagcgaacgaaaaacgaacgagggcaagcgcaaggcggcccucguccccaacgaagaaagacccaugggaaccggcccugacccagauggucuagacggaaacgccgaauuaaccgagacuuacugcgcugaaaaguggcauucuuuaugcaacuuuuucgucaauuuuuggaaugguuag

SEQ ID NO: 12076 - RNA, 393 nt, Artificial Sequence
  Description of Artificial Sequence: Synthetic coding sequence
auggcuagacgccacuguuuuucauacuggcuccuaguaugcuggcucgucguuacaguggccgagggccaggaagaagucuuuacuccacccggagauucacagaauaaugccgacgccaccgacugucagauuuucacauugacuccaccucccgcccccagaucccccguuacacgcgcccagccaaucacuaaaacaccacguugccccuuucauuucuucccgcguagaccucggauucacuucagguucccgaauagacccuucguacccucuaggugcaaccauagguuuccuuuucaaccuuucuacuggccacaccgcuaucugacauacagauauuuuccaagacgucgacugcagcgggguagcuccagcgaagaaagcuag

SEQ ID NO: 12077 - RNA, 600 nt, Artificial Sequence
  Description of Artificial Sequence: Synthetic coding sequence
auguaccccgccaccgcaguuccacaaaucaauaucaccauacugaagggagaaaaaggggacagaggcgaccguggacuucaaggcaaguauggcaaaacaggcagcgcaggugcccgcggucacaccggccccaagggacagaagggaagcaugggcgccccaggagaacgaugcaagagucacuacgccgccuucagcgugggccggaagaaaccaaugcacagcaaucacuauuaccagacagucauuuucgauaccgaauucguuaaucuuuaugaucauuucaauauguuuacaggcaaguucuacuguuauguucccggucuguauuuuuuuucgcuuaacguucauacauggaaucaaaaagagaccuauuugcauauuaugaagaacgaagaggagguggucauacuguucgcccaggucggggacaggucaauuaugcagagccaaagucugauguuagaguuaagagagcaagaccaggugugggugcgucuuuacaagggagaacgcgaaaacgcaauuuuuagcgaggagcucgacacauauaucacauucaguggguaucuggugaagcaugcuacagaaccuuag

SEQ ID NO: 12078 - RNA, 702 nt, Artificial Sequence
  Description of Artificial Sequence: Synthetic coding sequence
auggcuuuaaaaaacaaauucucuugccuguggauucuaggacuaugccuuguggcuaccaccuccuccaagaucccauccaucacugacccccauuucaucgauaauugcaucgaggcccauaacgaguggcgcgggaaagucaauccaccugcagcggauaugaaguauaugauaugggacaagggccucgcaaaaauggccaaagcgugggccaaucaaugcaaauuugagcacaacgauugucuugauaaaagcuacaagugcuacgcagcguucgaauacgugggugaaaauauuuggcuuggugguauuaagucauuuacuccucggcacgccauuacagcaugguauaacgagacccaguucuacgacuucgacagccucuccuguucccgggugugcggccacuauacucaacuggucugggcgaacuccuuuuaugugggaugcgcugucgcgaugugcccuaaucuaggaggagcuuccaccgccaucuuuguguguaacuacggacccgccgguaacuuugcaaacaugccaccauacgucagaggagagucauguagucugugcucuaaggaagaaaaguguguuaaaaacuuguguaagaauccuuuccucaagcccaccggccgugccccucaacagaccgccuucaaccccuuuagcuugggcuuuuuacuccugagaaucuuuuag

SEQ ID NO: 12079 - RNA, 669 nt, Artificial Sequence
  Description of Artificial Sequence: Synthetic coding sequence
auggcucugcauauucacgaagcaugcaucuuauugcugguuauacccggacucgucacuuccgccgccauaucucacgaggauuaccccgcggaugaaggugaccagauaagcagcaacgacaauuuaaucuuugaugauuaccggggaaaaggcugcguggaugacucugguuuuguguacaaacucggcgagcguuucuucccagggcauuccaacugcccaugugugugugcccuagauggccccgugugcgaucaaccugaaugucccaaaauucacccuaaguguaccaaaguggaacauaacggcuguugcccugagugcaaagaaguuaaaaacuucugcgaauaccacgguaagaacuauaaaauacucgaggaguuuaagccuagcccuugcgaauggugucgcugcgagccuucaaaugaaguccauugcgugguugccgauugugcuguacccgaauguguuaaccccguguaugagcccgaacagugcugcccagucugcaagaacgggccuaacugcuuugccgggacaacgauuauaccugccggaauugaggugaaggucgaugaaugcaauaucugccauugucacaacggcgauugguggaagccugcucaaugcucuaagcgagagugucagggcaagcaaaccgucuag

SEQ ID NO: 12080 - RNA, 957 nt, Artificial Sequence
  Description of Artificial Sequence: Synthetic coding sequence
augcucccccugacaaugaccguucucauucugcuuuugcugccuaccggccaagccgcaccgaaggauggcgugaccagaccagauucagaaguccaacaccaauugcucccaaacccauuucaaccgggucaggagcaguugggguuacuccagaguuaucucaaaggucuaggcaggacagagguucaacuggaacacuuaucucgagagcaggugcucuuguaccucuuugccuugcacgauuacgaccagaguggacagcuugauggccuggaacugcugucuauguugaccgccgcccuggcccccggugccgcuaauuccccgacuacaaaucccgucauacugaucgucgacaaaguguuagagacucaggaccugaacggcgacggucuuaugacacccgcagagcugaucaacuuuccuggaguagcccugagacauguugaaccuggcgagccacuagcaccuuccccccaggagccacaggccguggguaggcagucgcuguuggccaaguccccccucagacaggaaacacaagaagccccaggacccagggaggaggcaaaaggucagguggaagcuaggcgggagaguuuagauccagugcaggaaccaggcggccaagcagaggccgacggagaugugcccggcccacgcggcgaggccgagggacaggccgaggccaaaggcgacgcaccuggcccaaggggugaggcuggaggacaggcagaggccgaaggagacgcaccagguccccggggcgaagccgggggacaagccgaagcggagggcgaugccccuggaccuagaggagaggccggcgggcaggcugaggcaagagaaaauggcgaggaggccaaagagcucccuggagaaacccuggaaaguaaaaacacacagaacgauuuugaagugcacaucguucagguggagaacgaugagaucuag

SEQ ID NO: 12081 - RNA, 393 nt, Artificial Sequence
  Description of Artificial Sequence: Synthetic coding sequence
augcuggccccauuguuucugugcugccuacguaaccucuuccgaaaacuuauaagcuuucagccuccucagcugggcagaacuaauaugcauuacaguaaacucccuagaacugccauugagacagaauuuaagcagaacguugggcccccaccgaaagaucuuaccgcugagguguauuucccaucaauuaaaagccgcucacaccuaccugccgucuuuuacaaccaguacuucaagcaccccaaaugugucggggaguauggcccaaaaaauggcgcggagcggcagaucgaagaacgcaaaguccuccccacuacaaugauguuuuccaugcucgcagacuguguucugaaguccacgccaauccccauccucgggguugccauguag

SEQ ID NO: 12082 - RNA, 4362 nt, Artificial Sequence
  Description of Artificial Sequence: Synthetic coding sequence
augaugcugccgcagaacaguuggcacauugacuuugguagauguuguugucaucagaauuuauuuucugcuguggugacaugcauucugcugcucaauaguugcuuucugaucucuagcuuuaauggcaccgaccuggagcugcgacuugugaacggcgauggacccugcagcgguacugucgaagugaaauuucaaggucagugggguacagucugugacgauggcuggaacaccacugcuagcacuguugucuguaaacagcuaggaugccccuuuucuuucgcaauguuuagguucggccaggcugucacccgccacgggaagauauggcuugacgacgugucuuguuacggaaaugaaucagcccugugggagugccagcacagggaauggggaucccacaauugcuaccacggagaggaugucgguguaaauugcuauggagaagcuaaccucggccucaggcucguggaugggaauaacucguguuccggaagaguggagguaaaguuccaggagcgguggggaaccauuugcgaugacggcuggaaucugaauaccgcugcuguggugugccgucaguuggggugucccucuucauuuauuucauccggcgucguuaauaguccugccguccuccggccuaucuggcuugacgacauauuaugccagggcaacgaacuggcucuuuggaauugucgacacaggggguggggcaaccacgacugcucacauaaugaagaugucacacuuacuuguuaugauagcucagaccuugaauugcgacuggucggcggcacaaacagaugcaugggacgaguggagcugaagauucagggacgcugggggacaguuugccaccacaaguggaacaacgcugcugccgauguggucugcaaacagcugggaugugguacagcacugcacuuugccgguuuaccacaccuacagagcgguucagaugucgucuggcucgacgggguuaguugcucugguaaugaauccuuucuaugggacugccgucauagcggcacugugaacuuugauugucuccaucagaacgacgucucugugaucugcagcgauggagccgauuuggaauugaggcucgcagacgggucuaacaacuguucuggucgaguagaagugagaauucaugaacagugguggacaauuugcgaccaaaacuggaaaaacgagcaagcuuugguagugugcaaacagcucggcuguccauuuuccguguuugggucccgcagggccaaaccaucuaacgaggcacgcgacaucuggauaaacuccaucuccuguacagggaaugaaagugcucucugggacuguacguacgauggcaaggcaaaacggaccuguuuuaggcgcucugaugccggcgugauuugcagcgauaaggcggaucuggaucuuaggcucgucggcgcccacuccccuuguuauggacgacuggagguaaaauaucaaggcgaguggggcacuguuugccacgaccgguggagcacuagaaacgccgccgucgugugcaaacaguugggaugugggaagccccuccacguguucggaaugacauauuucaaggaagcguccgggccaaucuggcuugaugaugugagcuguauagggaacgaaagcaauaucugggacugcgaacauuccgguugggggaaacacaauugugugcaccgcgaggacguuauugugacguguucgggcgacgcaacauggggccugcggcuugugggaggaucgaauaggugcagcgguaggcuggaaguuuauuuucagggaaggugggggaccgugugcgacgauggcuggaacaguaaagcugccgcuguggugugcucccaacuugacugcccuuccucuaucauuggcaugggccuuggcaaugcaaguacaggcuaugggaagaucugguuggaugacgucuccugugauggcgaugagucagauuuguggucaugucgcaauagugguuggggaaacaaugacuguucucacagugaggacgugggcgugauaugcucugaugcaucugauauggagcugagacugguuggaggaagcucacggugcgccgguaaagucgaggucaacgugcaaggcgcugugggaauucugugugcaaauggaugggggaugaauauugcggaggucgugugccggcaguuggagugugggucugccauucgaguaagcagggagccacacuucaccgagcgcacacuccacauucugauguccaauucgggcugcacuggcggcgaggccucucuuugggacugcaucagaugggaguggaagcaaacagccugucaucuuaacauggaagcaucucucaucuguucugcacacagacagccuagacucgugggggcugacaugccuugcagcgggcgcguggaggucaaacaugccgacacuuggagauccguaugugauucugauuucagcuuacacgccgcaaauguucugugcagagaacuuaacuguggcgaugcaaucucucugucagucggagaccauuucgggaaggguaacggccucacuugggcugagaaguuucagugcgagggaucagagacccaucuggccuugugccccauugugcagcauccugaagauacuuguauucacucacgcgaaguggggguggucuguucgcgcuacaccgacgugaggcugguuaacggcaagucacagugugacgggcagguagagaucaauguccuggggcacuggggaucacucugcgacacucacugggaucccgaggacgcccgcguacucuguagacagcuuucaugcggaacugcacuuucgaccaccggggguaaguacauuggcgagcguagcguuagggucuggggccaccgguuccacugccuugggaacgaaucacugcucgacaacugucagaugacugugcugggugcccccccaugcauccaugguaacaccguguccgugauuuguacuggaagucucacccagcccuuauuccccugccucgcaaaugucagcgauccuuaccuguccgcugugccagagggguccgcacugauaugccucgaggauaaaaggcugcggcuggucgauggggauaguagaugcgccggacgagucgagaucuaucacgacggcuuuuggggcacuauaugugacgacggcugggaucugagcgacgcacauguggucugccaaaaacuuggcuguggugucgccuuuaaugccacaguuucggcucacuucggcgagggaagcggcccaaucuggcuggaugaccugaauuguaccgguauggaaucucacuuauggcagugcccuucucggggguggggacaacacgauugcaggcacaaagaggaugccgggguuaucugcucagaauucaccgcacugaggcuauauucugaaaccgagaccgagagcugcgccggccggcuggagguguuuuauaaugggacuugggggucugugggccgaagaaauaucaccaccgccauagcugggaucguaugccgucaguuaggauguggggaaaacgggguggugagccucgcacccuuaaguaagacaggaucuggguucauguggguggaugauauccaguguccuaagacccauauuucaauauggcaguguuuaagcgcaccaugggagcggagaaucaguagcccugcagaagagaccuggaucacaugcgaagauagaauuagggugcguggaggggauacagagugcuccggaagagucgagauauggcacgcuggauccuggggaaccguuugcgacgacucaugggaucuggccgaggccgaaguggugugucaacaacugggaugcggcagcgcucucgccgcgcugcgugaugcguccuuugggcaaggaacgggaacgauuuggcuggacgacaugcggugcaaggguaacgagaguuuucucugggacugucacgccaagccuugggggcagucagauugcggccauaaggaggacgcgggggucagaugcaguggccagucuuugaaaucacugaacgccagcagcggccauuuagcucugauccugaguagcaucuucggcuuguuacugcucgugcuguucauucuguuucugacauggugccguguucagaaacagaagcaccugccacuuagagugaguacuagacgccgggggagucuagaagagaauuuguuccacgagauggaaaccugccuuaagcgcgaagacccccacggaacgcguacuuccgacgacaccccaaaccaugggugcgaggaugcauccgacacuucgcuccugggugugcugccagcguccgaagccacaaaauag

SEQ ID NO: 12083 - RNA, 759 nt, Artificial Sequence
  Description of Artificial Sequence: Synthetic coding sequence
augcugccucccccucgccccgccgcugcacucgcucuucccguucugcuucugcuguuaguggucuugacuccaccgcccacgggugccagaccaucaccaggcccagauuacuuaaggcgagguuggaugcgccucuuagccgagggagaagggugugcuccaugucguccagaggaaugcgccgcuccgcgcggaugccuggcuggccggguuagagaugcuuguggauguugcugggagugugcgaaccucgaaggacagcuuugugaucuugacccgucagcccacuucuauggucauuguggugaacagcuggagugccgccuggauacugguggggacuugucucggggggaagugcccgagccacugugugcauguagaucccagucaccccugugcggauccgaugggcauaccuacucacagauuugccgacugcaagaagcugcaagagcacguccagacgcaaaucugacugucgcucauccaggcccuugugaaucagguccucagauugucucucacccuuaugauacauggcggggaccucgucuucagacucugggcacugaggacaccuugaccacacuggugggcgccggcggcauggcucgggcuguggcuugcggagaggccccuggcgaacaucuggcccugcagguccugugccuguccggcaaacgcagacaccuauggcagguggguuccaccggcuccucggagggcguuccaucuggcggaaguuucugguag

SEQ ID NO: 12084 - RNA, 1323 nt, Artificial Sequence
  Description of Artificial Sequence: Synthetic coding sequence
augaaacucgcucuucugcucccuugggcgugcuguugccucuguggaucugcccuggcaaccggauuucucuacccguucuccgcagccgcccuccagcagcauggauauccugaaccaggagccgguucuccagguucagguuaugcuagccgccgccauuggugucaccacacagugaccaggaccgugagcugccaaguccagaaugguuccgagacagugguccagaggguauaucaaucuugucgauggccuggccccugugcaaaucuggucagcuaucgcacccucauucgaccaaccuacagggugucguaccgcaccgugacggugcucgaguggcgcuguuguccuggcuuuaccggcucaaauugcgaugaagaguguaugaacugcacccgauugagugauaugucagaacggcugaccacuuuggaggcaaagguguuacuccucgaagcugccgagagaccauccagcccugacaaugaucugcccgcaccagaguccacuccgcccacauggaacgaagacuuucuaccagacgcuaucccacuugcccaccccgucccaagacagcggcggcccaccggcccugcggguccgcccggccagacaggaccucccggccccgccggaccucccggauccaagggcgauaggggacaaaccggggaaaaaggccccgcagguccacccgggcugcugggcccaccaggcccccgaggauuaccuggcgaaaugggacguccaggcccccccgguccgccuggcccugcuggaaauccaggccccuccccaaacagcccgcaaggugcucucuacagccuccagcccccaaccgacaaagacaauggcgauucccgauuggccuccgccaucguggauacuguccuggcaggcgugccaggcccccguggaccaccuggcccgccugguccucccggcccaagagguccuccuggcccccccgggacuccagggucccagggacuggcuggagagagaggaacagucgggcccagcggagagccaggcgugaagggcgaggagggagaaaaggcugcaacagccgagggcgaaggcgugcaacagcugcgcgaggcgcucaaaauucucgcggaacgcgugcuaauccuggagcacaugauuggcauccacgauccucuggccucacccgaagggagcggacaagaugccgcacugcgcgcuaaucucaagaugaaacggggaggcgcacaacccgauggagugcuggccgcguuacucggcccugaucccgggcaaaaaaguguggaccaggcaucaucccggaaguag

SEQ ID NO: 12085 - RNA, 1341 nt, Artificial Sequence
  Description of Artificial Sequence: Synthetic coding sequence
augcuccaccccgagaccucuccaggacgagggcacuuacucgccguacuguuggcuuuacuuggcacugcaugggcggagguguggccaccccaguuacaggagcaggccccaauggccggggcucucaaccggaaagaaagcuucuuacugcuuagccuucacaacagacuccgcaguugggugcagccccccgcugcugauaugagacgucuggauuggagcgacagccucgcucagcuagcacaggcaagagccgccuuaugcggcaucccaaccccaagccuggcaucuggccuauggagaacucuccagguuggguggaauaugcagcugcugccugccggacucgcaucauucguggaagugguuucgcucugguucgccgaaggccaacgcuauagccaugcggcaggcgagugugcuagaaaugccaccuguacucacuauacacagcuugugugggccacuucaucacaguuagguugugguagacaucuauguuccgcuggccaagcugccauugaggcuuuugucugcgcguauagcccuagagguaauugggaggucaacgggaaaacgaucgugccauauaaaaaaggugcuugguguucucucuguacagccaguguaucaggcugcuucaaggccugggaccacgcggguggccuaugcgagguaccacggaauccuugcagaauguccugccagaaucacggacgccugaacaucaguacuugccacugucauuguccgccagguuauacgggaagauacugccaggugagauguucccuccaaugcguccacggccgcuuucgggaggaggagugcucaugcgugugugauaucggcuacggcggugcccagugugcuacaaaaguacacuuuccuuuucauaccugugaccugcgcauugauggagacuguuuuauggugagcucggaggcagacacauacuauagagcuagaaugaaaugccagagaaaaggcggcguacuggcacagauuaagucccagaagguacaggauauucucgccuuuuaucuaggucgccucgagacgacaaaugaagucaucgacagugacuucgaaaccaggaauuuuuggauuggucugaccuacaagacugcgaaggauucauuccguugggccacaggcgagcaccaagcuuucaccaguuucgcguucggccagccggacaaccacgguuucggcaacugcguugaacuccaggccuccgccgccuuuaacuggaauaaucaacgcugcaagacgagaaaccguuacaucugccaguuugcgcaagagcauauuagucgcuggggccccggcuccuag

SEQ ID NO: 12086 - RNA, 219 nt, Artificial Sequence
  Description of Artificial Sequence: Synthetic coding sequence
augcagagacuugugcuacugcucgcaauuucucugcuccucuaucaagaccucccgguaagaagcgaauuugaauuagauaggaucugcggcuauggcacagcacguuguagaaagaagugucgcagucaggaguacagaauuggucgauguccuaauaccuacgcgugcugccugcgcaagugggacgaaucccuccugaauagaaccaaaccauag

SEQ ID NO: 12087 - RNA, 2349 nt, Artificial Sequence
  Description of Artificial Sequence: Synthetic coding sequence
uuauggcuccuguugugggcugccgccuggaggcucggcgccuccgccuguccugcucuuugcacauguacuggaaccacugucgacugccacggaacaggacuccaggcuauaccaaaaaauaucccucguaacacggagcgacuugagcuaaauggaaacaauaucaccagaauacacaaaaaugacuucgccggauuaaaacagcuccggguccuucaacucauggaaaaucaaauaggcgccguggagagaggagcuuucgaugauaugaaggagcucgagcggcugcgucugaaccgcaaccagcuucacauguugcccgaacugcuguuccaaaauaaccaagcacuuucccgucucgaccuuuccgagaaugccauccaggcuauuccaagaaaggcauucagaggugcuacugaccuuaaaaaucuucagcuggauaaaaaccagaucaguuguauugaggaaggugcuuuucgggcccuucgcggauuggaggugcuuacguuaaacaacaauaacauuaccacaauuccugucuccagcuucaaucacaugcccaaauugcgaaccuuccggcugcacucuaaccaccuguuuugcgauugccaucuggccuggcugagccaguggcugcgacaacgcccuacgaucgggcuguucacucaguguucaggacccgcaucauuacggggguuaaauguggccgaaguccagaagagugaguucucauguagcggacagggagaagcuggaagaguaccgacgugcacccugucuucaggcucauguccugcaaugugcacauguaguaacgguaucguggacuguagagguaaaggucuuacagcaauccccgcuaaucuaccugagacaaugacugagauuagacuggaacuuaacgggaucaagucaaucccgccgggggcauuuucaccguaccguaaauugcggcggauuuguccccuaagcuucuguagcccuugucgugaucugucuaacaaucaaaucgccgaaaucgcuccggacgcguuucaaggucuccggucucugaacagucucgugcuguauggaaauaaaauaaccgaucuuccgcgaggugucuucggcggacuguacacucugcagcugcuacugcucaacgccaauaaaaucaacugcauccggccugacgcuuuccaggaccugcaaaaccugucucugcugucucuguaugacaauaaaauucagucccuggcaaagggcaccuucaccucccugagagcgauucagacucugcauuuagcccagaaucccuucaucugcgacugcaaucucaaauggcuugccgauuuccuccgaacuaaucccauugaaacuuccggagcacggugugcgagcccuagacgacuggccaauaaaaggaucggccagauuaagucuaaaaaguuccgguguucugcuaaagaacaguacuuuauucccgguacagaagauuaucaguugaauagugaguguaacagcgacguagugugcccgcacaaguguaggugcgaagcaaacguuguagagugcaguucccuaaagcugaccaagauucccgagcgcaucccucaguccaccgcagaacuucggcugaacaacaaugagaucucaauuuuggaggcaaccggcauguuuaaaaaacugacacaccucaagaaaaucaaucucuccaauaacaaagugucagaaaucgaggacggagccuuugaaggcgccgcuucagugucugaacugcacuugaccgcuaaccaacuagagucaauaaggucuggcauguuccguggacucgauggccugcgaacccugaugcuucgcaacaaccgaauaagcugcauccacaacgauucuuucacuggauuacgcaauguucgguuguuaucucucuaugauaaucagaucacgaccguguccccaggugcuuuugacacacugcagagucuguccacuuugaaccucuuggccaaucccuucaacugcaacugccagcuggccuggcucggaggcugguuacgaaagcgaaagauugugacugggaacccuagaugccagaaucccgauuuccuucgccaaauccccuugcaggaugucgcauuuccagauuuucguugcgaagaaggccaagaggagggaggcugcuugccccgcccacaauguccucaagaaugugcuugucuagauacuguugugcgauguaguaacaaacaucugcgugccuugcccaagggaauuccuaagaacgugaccgagcuuuacuuagaugguaaccaguucacucucgugccugggcagcugaguaccuuuaaauaucugcagcugguauag

SEQ ID NO: 12088 - RNA, 411 nt, Artificial Sequence
  Description of Artificial Sequence: Synthetic coding sequence
auguccaacgucccacauaaguccagcuuaccagaaggcauuaggccuggaacgguacuucgcaucagaggguuggugccuccuaaugccagucguuuccaugugaaucugcuguguggagaggaacagggaucagacgcagcgcugcacuucaauccacgucuggauaccucugagguuguguuuaauaguaaggaacagggaucauggggacgcgaggagaggggcccugguguuccauuccagcgcgggcagccguucgagguccucaucauugcaucugacgacggauuuaaagcuguagucggagaugcccaauaccaccacuucaggcacagauuaccucucgcaagagugaggcugguggaagucggcggagacguccagcucgauagcguacgaaucuucuag

SEQ ID NO: 12089 - RNA, 1926 nt, Artificial Sequence
  Description of Artificial Sequence: Synthetic coding sequence
augcccccgccacugccacuccugcuccugacggugcucguggucgcugcugcccgucccgggugugaguucgagcgaaaucccgcugcaacguguguugacuuacagcugagaaccugcagcgaugcugcuuacaaucacacaacauuuccuaaucuccugcaacaccgcucaugggaggugguugaggccuccucugaguacauuuugcuuucuguccuucaucaacuauuagaaggccaaugcaacccagaccucagguugcuggguugcgccguucuugcccccaggugcgaaggggguuggguacggcgaccaugcagacacaucugugagggccuacgcgaagugugucagccugcuuuugacgcuaucgacauggccuggccuuacuuuuuggauugccaccgguacuucacgagagaggaugaaggaugcuacgauccccuggagaagcugcgcggaggacuggaggcugaugaagcccugccgucuggccugccuccuacuuuuauucgguuuagccaucacuccuaugcucagauggugagaguucuccgcaggaccgccagccgcugugcucauguggcgcgcacguacagcaucgggaggagcuucgacggacgcgagcugcuugucauagaauuuagcucaaggccuggacaacacgaacuuauggaacccgagguuaagcuaauaggaaauauccauggaaaugagguagcaggcagggaaaugcugaucuacuuggcacaguaccucuguuccgaauacuuguuggguaauccgcguauucagagguuacuuaacaccacucgcauccaccugcuucccuccaugaaucccgauggcuaugaggucgccgcggcugagggagcaggcuauaacggauggacuucuggcagacaaaaugcucaaaacuuagaucuuaacagaaauuuuccugaccugacaagcgaauacuaccggcuggccgagaccagaggcgccagaucugaccacauuccgauuccucagcacuacugguggggaaaaguggccccugaaaccaaagccaucaugaaauggaugcaaaccauaccguuugucuuauccgccucacugcacggaggugaucucguugugucuuauccauuugauuuuucgaagcacccucaggaagagaaaauguuuaguccuacuccugaugaaaagauguucaaauuacucucaagggcuuaugcagacguccaccccaugaugauggaucggucugagaacagaugcggagguaauuuccugaagcgcggcucuauuaucaauggcgcagacugguauucuuucacuggcgguaugucagacuucaacuaucuacauaccaacugcuucgagauaaccguugagcuugggugugucaaguuuccgccggaagaggcgcuguauauccuuuggcagcacaacaaagaaucccuccugaacuucguugaaacgguacaccgugggauaaaaggcgucgugacugacaaguuugggaaacccgucaagaaugcucguauaucggugaaaggaauucggcacgauaucaccacugcuccagauggcgauuauuggagacuucugccccccgggauucacaucguaauagcacaagcaccuggauacgcaaaagugaucaagaaggugauaauccccgcgcguaugaagagagcaggacggguggauuucauucugcagccccuggguauggggccgaaaaacuuuauacacggccuccguaggacuggcccacaugacccucugggaggcgcaagcucgcuuggcgaggcaaccgagccagacccucugagggcuaggcggcaaccaagcgccgacggcagcaagcccuggugguggagcuauuuuacuucgcucaguacgcaucgacccagauggcuucucaaauauuag

SEQ ID NO: 12090 - RNA, 1305 nt, Artificial Sequence
  Description of Artificial Sequence: Synthetic coding sequence
auggcaagccuaggccuguuacuccuacuguuguuaacugcacucccaccucuguggaguucaagccuccccggacuggacacagcagagucuaaggcgacaauugcugaucuuauccuauccgccuuggagagagcuacuguuuuuuuggagcaaaggcuccccgaaaucaacuuagacggcaugguuggagucagaguccuggaagaacaguugaagagcgugcgcgaaaaaugggcucaggaaccccuccugcagccguugucacucagggucgggaugcugggggaaaaacuggaagcugccauccaaagaucccuccauuaccugaaacugucugauccaaaguaucugagagaguuccaguuaacccugcagcccggcuucuggaagcucccccacgcauggauucacacugacgccucgcucguauacccgacuuuugggccacaggauucuuucucagaagagcgaagcgauguuugccuggugcagcuguugggaaccgguaccgauucuucugaaccauguggacuaagcgaucucugccggagccugaugaccaagccuggguguucugguuauugccugagucaucagcuucuuuuuuuccuuugggcccgaaugcgggguugcacccaagguccuuugcagcaaucccaggauuacauuaaucuuuucugugccaauaugauggaucuuaaccguagagcggaagcgaucgguuacgcuuaccccacgagggacauuuucauggagaacaauguuacuggccaucccguauucuaucucccacugugugauaguuucuugcccccgaaagcugcccccguuacagaauuguacacagacggcccugugauguuuuguggaauggguggauucuccgacuucuauaaacuccggugguuggaggcuauccucucuuggcaaaagcagcaggagggauguuucggcgaaccagaugcggaggacgaagaacuuucaaaggcaauccaguaucagcagcauuucagucgaagagucaaacggcgagagaagcaguucccugauucuaggagcguggcacaggccggcguucaguggcgaaaucucggcucauugcaaccucucccucccggguuuaagcaguuuucgugccugauccucccauccucuugggauuacaggagugugccgccauaucucgcgaacuuuuacaucuuucuugucgaaacuggguuucaccacguggcccaugcgggacuggaauuacugauaucucgagacccccccaccucaggaagccaaucugugggccuuuag

SEQ ID NO: 12091 - RNA, 555 nt, Artificial Sequence
  Description of Artificial Sequence: Synthetic coding sequence
augaugucauuccuucucggagcaauucugacccuacugugggcaccuaccgcacaagccgagguacucuuacagcccgacuucaaugccgagaaguucagcgggcuuugguauguugucuccauggcaagcgauugucgcguguuucucgguaaaaaagaccaccuaucgauguccacccgggcuauucgaccaacagaggaagggggccuucacguccacauggaauuucccggugccgaugguuguaaucagguugacgccgaguaucucaaggucggguccgagggacacuuucggguucccgcgcuuggauaccuagacguacgcaucguagacaccgauuauuccuccuuugcaguccuguauaucuauaaagagcucgaaggggcucugucuacaaugguacaacuuuauucuaggacgcaggacgugucuccccaggcccugaagaguuuccaagacuuuuauccaacccuaggauuaccuaaagacaugaugguuaugcuuccucagagcgacgcaugcaauccggaguccaaggaggccccguag

SEQ ID NO: 12092 - RNA, 219 nt, Artificial Sequence
  Description of Artificial Sequence: Synthetic coding sequence
augcagcgccugguccuguuacuugcuaucucacuacuacuuuaccaagaucugcccguacgaagcgaguucgagcuugaccgcauauguggcuauggaacagcucgcugcaggaaaaagugucggucacaggaguauaggaucgggagauguccuaacacguaugcuuguugucuccgcaaaugggaugagucucugcugaaucguacaaaaccauag

SEQ ID NO: 12093 - RNA, 2247 nt, Artificial Sequence
  Description of Artificial Sequence: Synthetic coding sequence
augggacgggcuggcgcugcagccgucauaccuggccuggcucuccuaugggcgguggggcuggggucggccgccccuccuccgagguugcgccugucuuuucaagaacugcaagccuggcacgggcuacagacauucucuuuggagcguacuugcuguuaccaggcccugcuuguggaugaggagagggggcgcuuauuugugggcgcugaaaaccacgucgccagucugaaccuggacaauauuagcaagcgagccaaaaagcuggcauggccagcaccggucgaauggcgcgaagagugcaacugggcgggcaaagacauuggaacugagugcaugaacuucgucaaguugcuccacgccuacaacagaacacaccugcuugcgugcggaacgggugcuuuucaccccaccugcgccuuugucgaggugggacacagagccgaagaacccgugcugagguuggauccaggaaggaucgaggacgggaaaggaaaauccccauacgaccccagacacagagccgcgaguguucuagugggugaagagcuguauucggguguagcugccgauuuaaugggcagggacuucacaaucuucaggucacuagggcaacggccuucuuugcgaacugagccucaugauaguagguggcucaacgagccuaaguucguuaaaguguucuggauuccugagucugagaauccagaugacgacaagaucuauuuuuuuuucagagagacugcaguggaagcugcuccagcgcugggcaggcugucuguuagucgugucggccaaauuugcagaaaugauguagguggacaaaggucccuggugaacaaguggacaacauuccucaaagcacggcucguguguucaguacccgguguggaaggagacacgcauuuugaucagcuucaggacguuuucuugcuguccagcagggaccaccgcacaccccucuuauacgcaguuuuuucgaccucuuccucgauuuuccaagggucagccgucugcguguacucuaugaaugacgugcgccgagccuuucuggggccuuuugcucauaaagaaggucccaugcaccagugggucuccuaccagggaagggugccauauccacgcccugggaugugcccuucuaagaccuucggcacauucucauccaccaaggacuucccagaugacguuauucaauuugcuagaaaucacccucucauguacaauagcguuuugccuaccggcgggcggccucucuuuuugcaggugggcgcaaauuauacuuuuacgcaaaucgcagcagaucguguagcagcugccgacggucauuaugacgugcuguuuaucggaacugaugucggcaccguuuugaaggugauuagcgucccuaaaggcagucggccaucugccgagggacuccuguuagaagaauugcacguuuucgaagauuccgcagcugugaccucuaugcaaauuucuucuaaaagacaucagcuguacgucgcaaguaggucagcuguagcucagaucgcccugcaucgcugcgcagcucacggacgggugugcacggagugcugucuugcacgagaccccuacugugcuugggacggcguggcaugcaccagauuucagcccucugccaagaggcgcuucagaagacaggacguucggaauggcgauccaucgacucuuugcucuggcgacaguucacgccccgcccuguuagaacacaagguguucggcguugagggaucgucagcuuucuuggaaugcgaacccagaucucugcaggcaagaguugaauggaccuuccagcgggcgggugucaccgcacauacucagguguuggccgaggaaaggacagagagaacagcccggggccugcuguugcgaaggcugcgacgaagagauuccggaguauacuugugugccgcuguggagcaaggauucacccaaccccugcggcgauuaagccuucacgugcucucagccacucaagccgaacgucucgcccgagccgaagaagccgccccugccgcgcccccggguccaaagcugugguaccgagauuuccuccaguuaguggagcccgggggcggggggucagccaauagcuuacgcaugugccguccucaaccagccuugcagagccuuccacuagagagccgacgcaagggccgcaauagaagaacccacgccccagaaccaagggcagagagagggccucgcuccgcaacccacugguag

SEQ ID NO: 12094 - RNA, 369 nt, Artificial Sequence
  Description of Artificial Sequence: Synthetic coding sequence
augguucugcugugccuguuucuggccucucuggccgccacaccucgcgcuggagugacaggggccuggcccaccuccggacuguccauccuugcacaacuccagccuucaugcgagcuacgguggacucagcuguccagaucauccuggcgagaccucgugaugacaaccagucuuuggucucuggccuacuuucaacacuucucucaggaaaccacaacgcaagaacaacuugaugagauggaagaaauaccuagagagagccaauguggaagacaagauuuccaugcccuuucauguccuacagcuuccccuagagaccggguauuguuaugcugucccggcuggagagcuaugguuccuucuuag

SEQ ID NO: 12095 - RNA, 570 nt, Artificial Sequence
  Description of Artificial Sequence: Synthetic coding sequence
auguuauuggggcaacugaguacauugcuguguuuauugucaggugcccugcccacagguagugggcgaccagagccacagucaccccggccacaaucuugggccgccgccaaccaaacuugggcucugggucccggcgccuuaccaccccucguacccgccuccgcccuaggaucauggaaagcuuuuuugggccuacagaaagcacgacagcuggguaugggcagacuucagagagggcaggaugaaguagccgcuguuacuuugccucucaacccccaggaggugauccagggcaugugcaaggccgucccauuugugcaaguguuuucucggcccgggugcagcgcuauacgacuuaggaaccaucucuguuuugggcacuguuccucccucuauaucccaggaucagauccgacuccacucguccuauguaacucuugcaugccagcucgaaaacgcugggcaccuguugugcucuggugccuuacaggcuccucagcuucccgaagacgagucaagaucucuaccaugcugauugagggaugccacugcucccccaaggcauag

SEQ ID NO: 12096 - RNA, 2505 nt, Artificial Sequence
  Description of Artificial Sequence: Synthetic coding sequence
augaagcacacccuagcauugcuggccccccuccuuggccucgggcugggucucgcccugucucagcuggcugcuggagcuacugauugcaaauuccuugguccugcggagcaccugacauucaccccugcagccagggcucgcuggcuggccccucgcguucgugcuccuggacuucuggacagccuauacgggacggugagaagauuucugagcguggugcaguuaaaccccuucccuucugagcucgugaaagcccugcucaacgagcuagcaucagucaaggucaacgaaguuguuagguaugaagcuggguauguggucugcgccguuauugcagggcuauaccugcuuuuggugccuacggcuggacuguguuucugcuguuguaggugucacagacgcuguggcggacgcgucaagacugaacacaaggccuuagccugcgagagggccgcgcuuauggucuuucuccuccugaccacccuccuucuucucauuggcgucgugugcgcuuucguuaccaaccagcgcacgcaugagcagaugggccccagcauagaggcgaugccagagacccuccuuucgcuguggggacuggugucugacgugccccaggaauugcaggcugucgcucagcaguucagccucccccaggaacaggucuccgaggaacuggaugguguuggcguuucaaucgggagugcuauccauacacaacugcgauccagugucuauccgcugcuggccgcagugggcucgcugggccagguucuucagguaucagugcaccacuugcaaacuuugaacgcaacagucguggagcuccaggcugggcagcaagaccuugagccugcaauuagggaacaccgggaucgacugcuggaacuucugcaggaagcaaggugucagggugacugcgccggcgcuuugaguugggcaagaacccuugaguugggggccgacuuuucucagguacccagcguugaucacgugcuacaucagcuuaagggcguccccgaagccaauuucuccucaauggugcaggaggaaaauuccacauucaacgcccucccugcccuugcugcuaugcagacaaguuccgugguacaggaauugaaaaaggccguagcucagcagccagagggggugagaacacuggccgagggauuucccgggcuugaggcugcaagcagaugggcgcaggcuuugcaagaagucgaggagucgucucggccauaucuucaagaggugcagcgcuacgaaacuuaucgauggaucguuggauguguacucugcucggugguacuguucgugguucuuugcaaucuguuagggcuuaaccugggaauuuggggccugucagcccgcgaugacccuucccauccggaagccaaaggcgaggcuggagccagguuccuuauggcuggaguuggacuuaguuucuuauucgcagccccacugauacuccuaguuuucgccaccuuuuuaguggggggaaacguucaaacacucgugugucaguccugggagaauggcgaacuguuugaauucgccgauaccccggggaaccugccccccucgaugaaccuuucccagcugcuuggacugcguaagaacaucucuauccaccaagcuuaucagcaaugcaaggagggugcugcucuguggacuguguugcaacuuaaugauagcuaugacuuggaggaacaccuugauaucaaccaguacacaaacaagcuuaggcaggaacuacagagccuuaagguagacacgcagagccuggaccuacuuuccucagcugcucgucgcgaucuggaggcuuugcagucaaguggacuacaacggauucacuacccagacuuucuuguacagauucaacgccccguggugaaaaccucuauggagcagcucgcacaagaguuacagggccuugcucaggcccaggacaauagcgugcucgggcagcgucugcaagaggaggcccaaggacugcggaaucuucaucaggaaaaaguuguaccacagcagucucuggucgcaaagcuuaaccucucugugcgugcccucgaguccuccgcccccaaucugcaauuagaaacaagcgacguccuagccaauguaaccuaucuuaagggagagcuccccgcaugggcugcuaggaucuuacgcaacguaagugagugcuuccuggcucgagagaugggguauuuuagccaguauguggccuggguccgcgaggaagugacacagcguauugcgacuugucaaccucuguccggcgcuuuagauaacucuagagucauucucugcgauaugauggccgacccauggaacgcauuuugguuuugccucgcuugguguaccuucuuucucauucccagcaucauuuucgcggucaaaacuagcaaauauuuuagacccauccggaagcgacuauccucaacauccuccgaagagacgcagcuguuucauaucccucgugugaccagucugaaacuauag

SEQ ID NO: 12097 - RNA, 2505 nt, Artificial Sequence
  Description of Artificial Sequence: Synthetic coding sequence
augaagcacaccuuggcuuugcuugccccucuguugggacuaggguuaggcuuggcucuuucucaguuggcugccggcgcgacugacugcaaguuucugggacccgccgagcacuuaaccuucaccccagccgcuagggcucggugguuagcuccacgcgucagggcuccuggcuuacucgacagcuuguacggcacuguccggcgguucuugucuguuguacagcuuaacccguuuccuagcgaacuugucaaggcccugcuuaaugagcuggccagugugaaaguuaaugaagugguaagguacgaggcaggcuacgucgucugugcagugauagcuggacuguaccuguuauuggugccgacugcaggguuauguuuuugcugcugccgcugucauagacgcuguggggggcggguaaagacggaacauaaggcgcuggcgugugaaagggccgcgcugaugguauucuugcuccucacuacacuccuuuugcuuauuggaguugugugugccuucgucacuaaucagcgaacccacgagcagaugggcccaucuauugaggcaaugccggagacgcugcuuucauuguggggccugguaucugaugucccucaggaacuucaggcagucgcucagcaguucagccugccucaggagcaagucagugaagagcuggauggggucggcgucaguaucgggagcgcuauucauacgcaguuaagguccuccguuuacccccuauuagcugcugugggcucccugggacagguauugcaagucagcgugcaucaucugcagacucugaacgccacagugguagagcugcaagcuggccaacaagaccucgagcccgccauccgugaacacagagauagauugcuggaacugcuacaggaagcacguugccaaggggauugcgccggggcccucucaugggcgagaacucuggagcuuggggccgacuucagucaggugccuucaguugaccaugugcugcaccagcuaaaaggcguacccgaagccaacuuuuccaguaugguucaagaagagaauucuaccuucaaugcucuuccugcccucgccgcaaugcaaacuucuuccguggugcaggaguuaaaaaaggccguggcgcagcagccugagggugugcguacccuggccgagggauuuccugggcucgaggccgcuucccgcugggcccaggcgcugcaggaagucgaagaaagcucccggccuuaccuccaggagguccagcgauacgaaacuuaccguuggauugugggauguguccucugcuccgugguacuguucgucguguuauguaaccugcugggacuaaaucugggcauuuggggcuugucagcccgggacgaccccagucacccugaggcaaaaggagaagcuggggcuagguuuuugauggccggcguugggcuuucuuuuuuauuugccgcuccacugauucuccucgucuuugccaccuuucuugucggagggaauguacagacucugguaugccaguccugggagaacggagagcuuuucgaauucgccgauacaccagggaaccuaccccccuccaugaacuugucacagcuguugggccuccgcaagaacauuaguauccaccaggccuaccagcaguguaaggagggugcugcccuauggacugugcugcagcuaaaugauucauacgacuuagaggagcaccucgacauaaaccaguacacgaauaagcuacgccaagagcuccagucccugaagguggauacccagucucuggaccugcuuuccagcgccgcacggagagacuuagaggccuugcaguccaguggucuccagcguauccacuaucccgauuuucuggugcaaauccagagaccuguggugaaaacaucuauggagcagcuggcgcaggaauugcaaggcuuagcccaggcucaggauaacagcguccucggacagcggcuccaggaggaagcucaaggccugcggaaccugcaucaggagaagguaguaccucaacagucccucgucgcaaagcucaauuugagugugcgagcccuagaauccagcgcuccaaacuuacaacuugaaacuagugauguccucgcaaacgucaccuaucuaaagggcgagcucccugccugggcagcccggauucugcgcaaugugagcgagugcuuccuagcuagagagaugggguauuucucccaguacguggcauggguucgcgaagagguuacacaaaggauugcgacuugucagccacugaguggagcgcuagauaauagccgaguaauccugugcgauaugauggccgacccguggaacgcauucugguucugccucgcuuggugcaccuuuuuccuuauucccaguauuauuuucgcugugaagacuuccaaguauuucagacccauccguaaaaggcuguccuccacaucuuccgaggaaacucagcuguuucauauaccccgugugaccucgcucaagcucuag

SEQ ID NO: 12098 - RNA, 216 nt, Artificial Sequence
  Description of Artificial Sequence: Synthetic coding sequence
augacccagcuccugcuuuuccuuguugcgcugcuagugcucgggcacguaccuaguggacgcucugaguucaaaagauguuggaaggggcaaggcgccugccagacuuauugcacaagacaggagaccuauaugcacuugugccccgacgccagccugugcugccuuaguuacgcccuuaaacccccgccaguuccgaagcaugaauacgaguag

SEQ ID NO: 12099 - RNA, 1377 nt, Artificial Sequence
  Description of Artificial Sequence: Synthetic coding sequence
auggaagcaacgggaacugaugaaguugacaaacucaagacaaaguuuauaagcgcuuggaauaauaugaaauauucauggguccugaagacgaaaacauacuucucccgcaauucacccgugcugcuacugggcaaguguuaccauuuuaaguaugaggacgaggauaagacuuuaccugccgaguccggguguacaaucgaggaccacguaaucgcugggaauguggaggaguuccggaaagauuucaucucccggaucuggcuuacuuacagagaagaguucccccagauagaggguagugccuuaacuacggauuguggcuggggaugcacacuucgcaccggucagaugcugcuggcacagggccucauucuucacuuccugggaagggcuuggacauggccugacgcacuuaacaucgagaauuccgacuccgaauccuggaccucacauacgguuaagaaguucacagcuagcuucgaagccagucuguccggggaaagagaguucaaaaccccaaccauuucuuuaaaagagaccaucggaaaauacagugacgaccaugaaaugagaaacgaaguguaccaccggaaaaucaucagcugguuuggcgacagcccucucgcacucuuugggcugcaucaguuaauugaauaugguaagaagagcgggaaaaaggcuggggauugguacggccccgccgucguggcacacauacuuaggaaggccguagaggaggcgcgccacccagaucuccagggcauaaccaucuacguggcccaggacuguaccgucuacaauagugacguuaucgauaagcaaagcgcuucaaugacaagugacaacgccgaugacaaggcuguuaucauacuggugccugugcgucuugggggggagaggacaaacaccgauuaccuggaauuuguaaaagggauucugagcuuagaauacugugugggaaucaucggcggcaaaccuaaacagucauauuauuuugccggcuuccaagacgauagccuuauuuacauggacccccauuauugccaauccuuuguggacgucucaaucaaagacuuuccccuggagacuuuccacugucccuccccuaagaaaaugagcuuucggaaaauggauccguccugcacaauuggcuucuacugucggaacgugcaagauuuuaaacgcgcaucugaagagaucaccaaaaugcuuaaguucucuucgaaggaaaaguacccacucuucacauuuguuaauggccauucaagggacuaugauuucacauccaccaccacuaaugaggaggaucuuuuuuccgaggacgaaaagaagcaacuuaaaagauuuagcacugaggaauucgugcugcuguag

SEQ ID NO: 12100 - RNA, 342 nt, Artificial Sequence
  Description of Artificial Sequence: Synthetic coding sequence
augcgucaacgacuccucccuaguguuacaucucugcuacugguggcguugcuguuuccaggaucuucacaggcgagacacgucaaucauucugcgacugaagcuuugggagagcugcgggagagggcaccuggccagggaaccaacggcuuccagcugcugaggcacgccgugaagcgcgaucugcugccaccacgaacaccgccuuaucaggaacccgcauccgaucugaaaguaguagacugucgccggucugaaggauucugccaagaguacugcaacuacauggaaacucaggucggcuacuguucaaaaaagaaagacgcuugcugccuacacuag

SEQ ID NO: 12101 - RNA, 258 nt, Artificial Sequence
  Description of Artificial Sequence: Synthetic coding sequence
augaaaaaaguucuguugcugauaacugccauucuggccguugcuguuggauuccccguuagucaagaccaggagagagaaaagaggaguauuucagacuccgaugaacuggccagcggguucuuugucuuucccuacccuuaccccuuuagaccucuccccccgauuccuuuuccacgauucccaugguuccggcggaauuuucccaucccaauacccgagagugcucccacaacaccacugccuucagagaaguag

SEQ ID NO: 12102 - RNA, 264 nt, Artificial Sequence
  Description of Artificial Sequence: Synthetic coding sequence
auggcaguuucagugcugaggcucacgguaguauugggucuccucguccucuuccugaccugcuacgcagaugacaagcccgauaagccugacgacaaacccgacgacagcgguaaagacccuaagcccgacuuuccaaaauuccucucacugcuugguacggaaaucauagaaaacgccguggaguucauucugcgcucaaugucacgaucaacaggauucauggaauuugacgacaaugaaggcaagcauuccaguaaauag

SEQ ID NO: 12103 - RNA, 945 nt, Artificial Sequence
  Description of Artificial Sequence: Synthetic coding sequence
auguccuccgaagccgagacacagcaaccuccagccgccccaccugccgccccugccuugucagcagccgauaccaagccggguacaacaggcgcucaaggggcuguggccagggcacacauaggaggagcagggggagacaagaagguaaucgcuacaaagguccugggcacaguuaagugguuuaacgugcguaaugguuacggcuucauaaauagaaaugauacaaaagaggacguuuucguucaccaaacagcaauuaaaaagaauaauccgagaaaauaccuuagaucagugggugauggagaaacuguggaguucgacguaguagagggugagaagggggcugaggccgcaaaugugacagguccagggggcguccccgugcaagggagcaaauaugcagcagaccggaaccacuaucgacguuauccgagaaggagaggcccgccucgcaauuaucagcagaacuaucagaauagcgaauccggggaaaagaaugagggcuccgaaucugcaccagagcgcccgaauaaugccgggccgcaggcuaaggugccaacccuguuacacgccgaguaugggcggcguccacaguacucgaauccaccagugcagggugagguuauggagggcgccgacaaccagggggccggagaacaggguagaccugugagacagugcaucggcgacaucgaccaugauucugcuggggcacugcuugccaggcagccucgcgaagacggaaaugaggaggacaaagagaaccaaggcgacgaaacacaggggcagcaaccaccccagcgaagauaccgcagaaacuuuaacuacaggagaagaagaccugaaaacccuaaaccgcaggacgguaaagagacaaaggcagcggauccaccagcagaaaauuccagcgcgcccgaggccgagcaggggggggcugaguag

SEQ ID NO: 12104 - RNA, 636 nt, Artificial Sequence
  Description of Artificial Sequence: Synthetic coding sequence
augguauuccuuaaauuuuuuugcaugaguuucuucugccauuuaugccagggauacuucgauggcccuuuguaccccgaaaugucgaacggaacccuacaccacuacuuugugcccgacggcgacuaugaagaaaaugaugacccugaaaagugucagcugcucuuccgggucucagaccauagacggugcucccagggcgaggguagccaaguagguuccuuacugucacucacuuugcgggaggaguucacuguauuggguagacaaguggaggaugcugggcgagugcuggagggaaucaguaaaaguaucuccuaugaucuggacggagaggaguccuacggaaaguaccuaaggagagagucacaucagauuggcgaugcguacucaaacagcgacaaaagucugacugagcuggaaucaaaauuuaaacaagggcaggagcaagacaguaggcaggaaagcagguugaaugaggauuuccucggcaugcuggugcacacaagaucccuccucaaggaaacauuagauauuaguguaggccugagagacaaguaugagcuccucgcucugacuauaagaucacacggcacuaggcucggucgacugaagaaugacuaucucaaaguguag

SEQ ID NO: 12105 - RNA, 1566 nt, Artificial Sequence
  Description of Artificial Sequence: Synthetic coding sequence
auguugugcgcgcuucugcugcuuccgucccuucuaggggcuacccgcgccucucccaccucaggcccucaggagugugcuaaagguucuacagucuggugccaggaucugcagacggccgcaagguguggcgcuguaggauauugucagggagccguuuggaauaagcccaccgcgaaaagucuacccugcgauguuugucaagacauugcugcugcagcuggaaacggacugaauccagaugcuacagaaagugacauuuuagcauuggucaugaaaaccugcgaguggcuccccucacaagagucuuccgcgggguguaaauggauggucgaugcccacagcuccgcaauucugaguaugcuccggggagcgccagauagcgccccggcucaggucuguaccgcguuaucacugugugaacccuugcagcggcauuuagcuacccugagaccauuguccaaagaagauacauuugaggcaguggccccuuuuauggcgaacgggccucugaccuuccacccuagacaggcgccugagggagcccucugucaagauugugugcgccaggugucaaggcuccaggaggccgugcggucaaaucugacccuggccgaccucaauauccaggaacagugcgaaucccuaggacccggucucgcaguccucuguaaaaauuacuuauuccaguucuuuguacccgcugaccaggcucuaagacuacugccuccgcaggaauuauguaggaaaggggguuucugcgaggaacucggagcuccggcucggcucacacaaguuguagcuauggacgggguuccgucacuggaacuaggccuuccgcgaaaacagucagagaugcagaugaaagccggagugacuugugaaguguguaugaauguggugcagaaguuggaccacugguugaugaguaacucuuccgagcuuaugauuacacacgcacuggagagaguguguuccguaaugccagcuagcauuacgaaggaauguauuauacuuguggauacuuauagcccgaguuuaguucagcuggucgcuaagaucacucccgagaaaguguguaaguucauuagacugugcggaaaucgcagaagagcccgugcugugcaugacgcauacgccaucgugcccagcccggaaugggaugcugaaaaccagggaucuuuuugcaacggcugcaagagacugcugaccgucuccucgcacaauuuggaaucgaagucuacaaaaagagauauacucguugccuucaagggagguugcagcauucuaccccucccauacaugauccagugcaaacacuuugugacacaguaugagcccguacuuauagaaucccuuaaggauaugauggaccccgucgcgguguguaaaaaagugggcgccugucacgggccaagaacaccucuccucgguaccgaccagugcgcacucggcccaucauucuggugccgcucucaggaagccgccaaacucuguaacgccgugcagcauugccagaaacacgucuggaaggaaaugcaucuucaugccggcgagcaugccuag

SEQ ID NO: 12106 - RNA, 2127 nt, Artificial Sequence
  Description of Artificial Sequence: Synthetic coding sequence
auggcggcagcagccguagcagcugccgccgcagccgccgcggcggcgucucugcaggugcuggagauggagucaauggaaacugcggccgcaggguccgcuggccuagcugcugaagugcgcggaucuggaacggucgacuuugggccgggaccugggauuucugcuauggaggccucgggaggugaccccggacccgaagccgaggauuucgagugcucuagucacugcuccgagcugagcuggcggcagaaugaacaacgcaggcagggauuguucugugauaucacgcuguguuuuggaggagcaggggggcgcgaauuuagggcucauagaucugugcuagcugcagccacugaguauuucacuccacuguugucagggcaguuuuccgagagcaggucuggccguguggagaugagaaaauggucaucugagccaggucccgagccagauacagucgaggcugugaucgaauacauguauaccggcaggauccgcgugucuaccggcuccgugcacgagguucuggaacuagcugaccgguuucuacugauuaggcugaaggaguucuguggggaguuucugaagaagaaacugcaccuaaguaauuguguagccauucauagcuuggcccauauguacacucugucccagcuggcucuuaaagccgcugacaugauuaggcgcaauuuucauaaagucauccaggaugaagaauuuuacacucuaccuuuccacuuaauccgcgacuggcucucugaccuagagaucacaguggauagcgaagaggugcuguuugagacaguucuaaagugggugcaacggaacgccgaggaaagggaacguuauuucgaggaguuauuuaagcuacugcgacugucacagaugaagccaacauaccugacccgacauguuaagccagaaagacuaguggcuaauaacgagguaugcgugaagcugguggcagacgcaguugagcgucacgccuuaagagcugaaaacauccagagcggcaccugccagcaccccacuucacaugucucacugcucccucgauacggacagaauauggacgugauuaugguaauuggugguguuuccgagggcggggauuaucucuccgaaugcguagguuauuuuguagacgaagauaggugggugaaucugccacacauccauaaucaccuggacggacaugcugucgcugucacggagucuuauguguaugucgccggcagcauggaaccaggguucgcgaagacgguugagcgcuacaacccaaaucucaacacgugggaacauguguguucgcucaugaccagaaagcacucuuuuggacucaccgaagugaaaggaaaguuguauucaauuggggggcacggaaauuucucaccaggauuuaaagaugucacagucuauaaccccgagcucgauaaauggcauaaccuagagagcgcaccaaagauauuaagagacgugaaggcucucgcgaucgaggacagguucgucuauauugcagcuaggaccccagucgauagggauaccgaggauggacugaaagcagucauuacuuguuaugauacagaaacucgccaauggcaggacguggaaucacugccccucaucgacaacuacuguuuuuuucagaugucaguugucaacucuaacuuuuaucaaacagcaucauguugcccgaaguccuauugccuagagaaugaagaggccgugcguaaaauugcuucgcaaguguccgacgagauauuggagagccucccuccagaaguguuaaguauagagggggccgccauuugcuauuacaaagacgacguauucauuauuggcggauggaaaaauagugaugauaucgacaagcaguacagaaaggaggccuaucgcuacugcgcugagagaaagcgcuggaugcuguuacccccaaugccucagccaagaugcagggcuacagcuugccaugugcgcauaccuuaccguuaucuccauggcacucagagauaccccaugccccaaaaucucauguggcagaaagaucggauucgccagaugcaagagauacaccgucacgcauugaauaugcggagaguacccuccucucagauugagugcuag

SEQ ID NO: 12107 - RNA, 1578 nt, Artificial Sequence
  Description of Artificial Sequence: Synthetic coding sequence
augagcggcaacuggguccauccaggacagauccugaucugggcgauuugggucuuagcugccccuaccaaaggcccauccgccgaaggaccucaaaggaauacccgacuagguuggauucaggguaagcaggugaccguguuggguucacccgucccagugaacguuuuccuuggggucccguucgccgcuccgccccuggggucacuccgauucacuaacccucaaccggccagcccuugggacaaccugagagaggccacuucuuaccccaaucucugucuucaaaauuccgaguggcugcuccuggaccaacacaugcugaaaguucacuauccuaaauucggagucucggaggacugccuguaucuuaauaucuaugcaccagcgcacgcugauacgggguccaagcugcccguucucgucugguucccuggcggagccuucaaaacaggaucagcaucaauuuucgauggcuccgcccucgcagcuuacgaagaugugcucguugucgugguucaauacagacuugguauuuucggguuuuuuaccaccugggaucagcacgcacccggcaauugggcuuuuaaagaccagguugccgccuugucuuggguacaaaagaacauugaauucuuuggcggggacccaucuucggugacaaucuuuggagaaagcgcuggagccaucagcguguccucauuaauucucagccccauggccaaagggcucuuccacaaggccaucauggaguccggaguggcuaucauaccauaccucgaagcacacgauuacgagaagagugaggacuugcaaguugucgcccacuuuugcgggaauaacgcuucugauagugaggcccuguugcguugucuacggacgaaaccgagcaaggagcuccucacuuugucccaaaagacuaaguccuuuacucgagucgucgacggugccuuuuuuccaaaugagcccuuagaucugcucucacagaaggccuucaaagcgaucccuucgaucauaggcguaaacaaucacgaaugcggguuucugcugccaaugaaggaggcucccgaaauucucuccggcagcaauaagagucucgcgcugcaccuaauucagaacaucuugcacauccccccacaauacuugcaccugguggcaaacgaguauuuccacgacaaacacucauugacugagauaagagacagcuuacuggauuuacugggagacguuuuuuucgucguaccugcucugaucacggccagauaccacagggagggcgcuacagaagaagaaaaacuccuuagcagaaagaugaugaaauauugggcuacuuucgccaggaccgggaacccaaaugguaaugaccucagccucuggcccgccuauaaucugacagagcaauaucugcagcuggaucucaacaugucucucgggcagcgguuaaaggagccucgcguggacuucuggaccagcacaaucccucucauacuuucugcaagcgacaugcugcacucgccguugucgagccuaacauuucucagcuuauugcaacccuucuucuuuuuuugugcccccuag

SEQ ID NO: 12108 - RNA, 900 nt, Artificial Sequence
  Description of Artificial Sequence: Synthetic coding sequence
augguaagaugucucggcccugcacugcugcuacugcuccuucuagggucugccuccagcgugggcggaaauagauguguggaugccgcagaggcuuguacggcagaugccagaugccagcgucugagaucugaguacguagcucagugucuggggcgagcugcucagggagguuguccuagggcuagaugccggcgcgccuugcggagguuuuucgcgcggggcccuccagcacugacacacgcgcuccucuucuguccaugcgcuggucccgcgugugcagaacggcgaagacagaccuuugucccuucaugugccuuuucaggaccagggccggcuccaccuuccugccuugaaccccugaauuucugcgaacgaucgaggguauguagaugugcucgcgcagcugcuggacccuggcgaggguggggcaggggacuuaguccugcucaccgcccccccgccgcacaagcgaguccuccagggcuuuccggacugguccauccgucagcucaacgcccaagacgccuuccggcaggacccgggagaccccuuccugcacgacugcgugggccacgaggcguacccgcaggaaccgccgucacaccaaauuacgucgauaaugugucugcacggguggcacccuggugugauuguggcgcuucugguaacagaagggaggacugcgaagcguucaggggccuauucacgcggaacagaugccuggacggagcaauacaagcguuugccagcggguggccaccuguguuguuggaucagcucaacccccagggugacccggaacauucccugcuucagguaucuaguaccggccgcgcccucgaacgccgcuccuuacucucuauucuuccugucuuggcccuuccugcucugcuuuag

SEQ ID NO: 12109 - RNA, 270 nt, Artificial Sequence
  Description of Artificial Sequence: Synthetic coding sequence
augcaagcguguaugguuccaggccuggcucucugcuuauugcuuggcccccuggcuggagcaaagccuguucaggaagaaggagauccauacgcagagcucccugcuaugcccuacuggccuuuuagcacaucagacuucuggaacuacguucagcacuuucaagcgcuuggcgccuacccucagaucgaagacauggcuaggaccuuuuucgcgcauuuuccacuggggaguacacuggguuuucacgugccauaccaggaggacuag

SEQ ID NO: 12110 - RNA, 663 nt, Artificial Sequence
  Description of Artificial Sequence: Synthetic coding sequence
auggccagcgagcgacugccuaauaggccagcuugccuuuuaguugcgucgggcgccgcagagggaguuuccgcucaguccuuucuacacuguuucacaauggcaucaaccgccuuuaaccugcaaguggcuacucccgguggcaaagccauggaauucguagacguaaccgaaaguaaugcccgauggguucaagauuuccgccucaaagcuuacgcuucucccgcaaaacuggagucaauagacggggcaagauaucacgcgcuccugauccccaguugucccggagcccugacugacuuggcuuccagcggcuccuuggcucgcauacugcagcacuuccacagugagaguaagccaauaugugccgucggucacgguguggcagcccugugcugcgccacuaacgaggacagaucguggguuuucgacucuuauagccugaccggaccgaguguuugugaguuaguaagggccccaggauucgcccgucugccucuggucguggaggacuuugugaaagauucgggagcuugcuucagcgcuuccgagccagaugccguccaugugguguuagacaggcauuuaguuacaggacaaaacgcuaguucaacagucccugcgguucagaacuugcucuuucuuuguggaaguagaaaguag

SEQ ID NO: 12111 - RNA, 1158 nt, Artificial Sequence
  Description of Artificial Sequence: Synthetic coding sequence
auguggggguuccgcuuacugagauccccuccucuccuacuacuguugccucaguuaggaauuggcaaugcauccuccugcagccaggcgcguacaaugaauccaggcggaaguggaggagcucgguguucgcuuuccgcugaaguacggcgcagacagugccugcagcuaucgaccgugcccggcgcagacccacagcgaucaaaugaacugcuccugcuagcugcugcuggcgaagggcuagaaaggcaagaucuuccuggugauccugcaaaggaagagccccaaccuccuccucagcaucauguccuguacuuccccggagacguccagaacuaccacgagauuaugacucgucauccugaaaacuaucagugggagaauuggucccuggagaauguggcuacgaucuuagcccauagauuccccaacaguuacauuuggguuauaaaauguucgaggaugcaucugcauaaauucaguugcuacgauaacuucgucaaaaguaacauguucggggcuccagagcacaauacggacuuuggcgccuucaagcaccuguauaugcuguuggucaacgcauuuaaccugagccaaaauucccuuucuaagaagagccuuaaugucuggaauaaggauagcauagccagcaacuguaggagcuccccgucccauacaaccaauggaugucagggggagaaagugaggaccugugaaaagucugacgaaucugccauguccuuuuacccaccaucguuaaacgaugcauccuuuacacugauuggguuuuccaaaggcuguguagugcugaaccaguugcuuuuugaauuaaaggaagcuaaaaaagacaagaauauagaugcguucauuaaaucaauucguacaauguacuggcuugaugggggacacaguggggggagcaauacaugggugacauauccugaaguauugaaggaguucgcucagaccgggauuaucguucauacccacgucacgccauaccaaguccgggauccaaugcguucuuggaucgguaaggaacacaagaaauucgugcaaauucugggugaccucgguaugcaagugacgucucagauccacuucacaaaagaggccccuagcauugaaaaucauuucaggguucacgagguguuuuag

SEQ ID NO: 12112 - RNA, 936 nt, Artificial Sequence
  Description of Artificial Sequence: Synthetic coding sequence
augcggggagccgccagagccgcaugggguagggcuggacagccguggcccagaccaccugcccccggcccucccccuccaccucucccccucuuguuauuacuacucgcagggcuguuggguggagccggcgcucaauacaguucggauaggugcagcuggaaaggcagugggcugacgcacgaggcucacagaaaggagguggagcagguuuaucuccggugcgccgccggagccguggaguggauguacccuaccggagccuugaucgugaaccuucggcccaacacguucaguccugcgaggcauuugaccguauguaucaggucauuuacagacaguucaggggcuaacaucuauuuagaaaagacuggcgaacugagacuccuugugcccgacggcgacggacgcccaggacgcguucagugcuuuggucuagagcagggaggcuuguuuguggaggcuaccccccagcaggauaucggaagaaggaccacaggguuccaguaugaauugguuagacggcaccgcgcaucagaccugcacgaacuuuccgcuccaugucggccauguuccgauaccgaaguccuucuggcuguguguacguccgauuucgcagucagaggaucuauccagcaagugacccacgaaccagagaggcaggauuccgccauccaucugcgcgucucacggcuguaucgucaaaagucgagggucuucgaaccaguuccagagggcgacggccauuggcaggggcggguaagaacauuacuggagugcggcgugagaccaggacacggcgauuuccucuucacaggccacaugcacuuuggcgaggcccgccugggcugcgccccccgguuuaaggauuuucaaaggauguaucgagaugcacaagaaagaggauugaacccgugugaaguuggaacagauuag

SEQ ID NO: 12113 - RNA, 1221 nt, Artificial Sequence
  Description of Artificial Sequence: Synthetic coding sequence
augggaccuagcacaccacuccugaucuuauuccuccugaguuggucuggaccauugcagggccagcaacaucaucugguggaguacauggagaggaggcucgcggcacuagaggaaaggcuugcucaaugucaggaucaauccaguagacaugcagccgaguuaagagauuuuaagaacaagaugcuuccacuucuugaggucgcugagaaagaaagggaggcccuacgaaccgaggcggauaccauaagugggcggguggaccgacuggagcgagagguggauuaccuugagacacagaaucccgcucugcccugcguggaguucgaugagaaggugacaggcgguccaggcaccaagggcaaaggaagaagaaacgagaaguacgacauggugacagauugcggcuauacgauuucucagguucgaucuaugaagauucucaaacgauuuggagggcccgccggacuguggacuaaggauccccucggccaaacugagaagauuuauguguuagauggcacucaaaaugacaccgcauuuguguuuccgcggcugagagauuucacgcuggcuauggcagcccguaaggccuccagggugcgugugccauucccaugggucggaaccgggcagcucguguaugggggguuucuauauuucgccagacggccacccggucgaccugggggaggcggggagauggagaacacgcugcagcucaucaaguuucauuuggcuaacagaacuguuguugacucaucuguguuucccgccgagggcuuaauucccccauacggucugaccgccgacacauacauugacuuagcugcagaugaggaaggacugugggccguguaugcuacucgggaggaugaccgccaccuaugcuuggccaaacucgacccccaaacccuggauacagaacagcaaugggauacgccguguccccgagaaaaugcugaagcagcguuugucauuugcggcacccuguaugucguuuacaauacucgaccugcuucucgggccagaauccagugcuccuuugacgcauccggcacucugacuccggagagggcugccuugccauacuucccacgacgcuauggugcccacgccagccugcgguauaauccucgcgaacgacaacucuaugcuugggaugaugguuaccagaucgucuacaagcuagaaaugcgaaaaaaggaagaagagguguag

SEQ ID NO: 12114 - RNA, 900 nt, Artificial Sequence
  Description of Artificial Sequence: Synthetic coding sequence
auggguggaccaagggcucuguuagccgcacugugggcuuuggaagccgcuggcacagccgcccugaggaucggcgcauucaauauccagucuuucggggacucuaagguuagugauccagcauguggauccauuaucgcuaagauacucgccggcuaugaucucgcccucgugcaggaggugcgcgauccugaccucuccgccguuuccgcccugauggaacagaucaauagcgugagugagcacgaauauaguuuugucaguucacaacccuuaggccgggaucaguacaaggagauguaccuguuuguuuauaggaaagaugcugucuccgucguggacacauaccuuuaccccgacccagaagacgucuuuucgcgggagccauuugugguuaaguucucugcccccggcacgggugaacgagcccccccucuuccuagccgucgggcccuuacaccaccuccuuuacccgccgccgcucagaaucugguguugaucccucugcacgcggccccacaccaagcaguagccgagauugacgcacuuuacgacguguaucuugaugugaucgacaagugggggacugaugauauguuauuuuuaggcgauuucaaugcugacugcucauauguuagggcucaagacugggccgccauccgacuccggucuuccgagguguucaaauggcuaauccccgauucggcggacaccacagugggcaacagugacugugcuuacgacagaauuguagcuugcggggcccgccucagacgcagccuuaagccccagagcgcaacugugcacgauuuccaagaagaguuuggacuugaucagacucaagcccuggcaauuuccgaucacuuucccguggaggucacuuugaaguuucacagauag

SEQ ID NO: 12115 - RNA, 1617 nt, Artificial Sequence
  Description of Artificial Sequence: Synthetic coding sequence
auggguuguuuauggggucuugcccugccauuauucuucuucuguugggaagugggcgugagcgggucuuccgcgggcccaagcacacgucgggccgauaccgccaugacaacugaugacacagaagugccugccaugacacuagccccuggccaugcugcccuagaaacacaaacccucucugcugaaaccucuucuagagcuucaacucccgcaggcccuauaccagaggcggaaacacgcggugccaagcggaucuccccagcaagagaaacaagguccuucaccaagacgucuccuaacuucaugguuuugauugccacaagcguggaaaccagcgccgcgucugguaguccugagggagccggcaugaccaccgugcagaccauuaccggaagcgaucccagagaggcuauuuucgauacccucuguaccgacgauucaagugaagaagccaagacucugaccauggacauucugacccucgcccacaccucgacugaggcuaagggacugaguucggaaucaagcgcaucuuccgacucaccccaucccgugaucacucccagcagggcuucugagucuagcgcauccuccgacgggccgcacccagugaucacacccucccgugcauccgagagcuccgcaucauccgacgggccccauccgguuaucacccccucgugguccccgggcagugacguuacacuccucgcagaggcccucguuaccgugacgaacaucgagguuaucaauuguucaauuaccgaaauagaaacgaccaccaguaguauucccggcgcaucggauaccgaccugauuccuaccgagggcgucaaagcaaguagcacuagcgacccucccgcauuaccugacucaaccgaggcaaaaccacacauuacagaagugacugcauccgcugagacacugagcacggcugggacaacagaaucagcggccccagacgcuacuguggguacccccuugccuacaaacucagcuaccgagagggaggugacugcaccuggugccacuacacucagcggagcccuugugacaguuagcagaaauccgcuugaagaaacgagugcgcucagcguggagacccccaguuaugucaaaguaaguggcgcugccccuguuucuauagaagcugggagcgccguaggcaagacaacuaguuucgccggaagcagcgcgucuucauacagccccagugaggcagcucucaagaacuuuacacccucagagacuccuacuauggauauugcaacaaaaggcccauuucccacaucuagggauccuuuacccagcguaccucccacaacuacaaauucgucuaggggcacgaauuccacccucgcuaagauuaccaccagcgcaaagacaacuaugaaaccgccaaccgccacuccgacuacugccagaaccaggcccacuacagacgugagcgccggggagaacggcggauuucugcuuuugaggcuguccguugcuagcccugaggaccucaccgacccccggguugccgaacgacuuaugcagcaacugcaucgugagcuccaugcccaugccccacacuuccaggucagccugcuccgcgugagacgcggguag

SEQ ID NO: 12116 - RNA, 975 nt, Artificial Sequence
  Description of Artificial Sequence: Synthetic coding sequence
augagcucggaggcggagacacagcagccaccugcagcccccccagcagccccagcacugucagccgcagauaccaaaccugguacaaccggcagcggugccgggaguggaggacccggagguuugacaagugcugccccagcuggcggagauaagaagguuaucgcaacaaagguucuggguaccguaaagugguuuaaugugcgaaauggcuauggauuuauuaaccguaaugauacuaaagaggaugucuucguccaccaaacagccaucaaaaagaauaauccgaggaaguaucugcgcagcgucggggacggagaaaccgucgaguucgauguugucgagggcgagaaaggcgcagaagcggccaaugugacgggucccgggggagucccaguacagggcucaaaguaugcugccgaccgcaaucacuaucggagguauccacggaggcggggaccuccacgcaacuaucaacagaauuaccagaauagugaaagcggcgaaaagaacgaaggcagugagagugcccccgaggggcaggcucagcagcggagacccuaccgcagaagaagauuuccaccuuacuauaugcgccgacccuauggaagacgcccacaguacucuaauccuccugugcagggcgaagucauggaaggggccgauaaccagggagcgggcgagcagggacguccugugagacagaacauguaucguggguaucgacccagguuccggagagguccaccuaggcagaggcagccucgggaagacggcaaugaggaagacaaagagaaucaaggcgacgaaacucaagggcagcaaccuccccagagacgguauagaaggaacuucaacuacagacgaaggcggccugagaacccuaaaccccaagauggcaaagaaacaaaagcggccgaucccccagcagagaacucuagugcgccagaggcagagcaaggaggagcugaauag

SEQ ID NO: 12117 - RNA, 210 nt, Artificial Sequence
  Description of Artificial Sequence: Synthetic coding sequence
augcgcaucuuuuacuaccuccauuucuuauguuacgugacuuuuauccugcccgcuacauguacucuagugaacgcugauagauguacaaagcguuauggccgcugcaagagagacugccuggaaagcgaaaaacagaucgauaucugcucacugccucggaagaucugcugcacagagaaacuguacgaagaggacgauauguucuag

SEQ ID NO: 12118 - RNA, 342 nt, Artificial Sequence
  Description of Artificial Sequence: Synthetic coding sequence
augaaguugcuaacaacaauauguagacugaaacuugagaagauguacucuaagacaaacacuagcucaacgaucuuugaaaaggcacggcauggaaccgaaaaaauuagcacagcuagaagcgagggacaccauauuaccuuuucgcgguggaaauccuguacugcaauuggaggccgcuguaaaaaccaaugcgaugauucugaauuccgcauuagcuauugcgcccggccuacaacucauugcuguguaacggagugugauccaaccgacccuaacaacuggauccccaaagacaguguuggaacgcaggagugguaucccaaggacuccagacauuag

SEQ ID NO: 12119 - RNA, 3030 nt, Artificial Sequence
  Description of Artificial Sequence: Synthetic coding sequence
auggaucuaauccgagguguccuucugagacuuuugcugcucgcaagcucuuugggccccggcgcugugucucugcgggccgccauuaggaagcccggaaaagugggucccccgcuggauaucaaacugggggcacucaacugcacagcuuucucuauccaguggaaaaugccaagacacccugggaguccaauuuugggguacacgguguucuauagugaaguuggcgccgauaagagccuccaggaacaacuccacagcgugccacucucuagagacauuccgacuaccgaggaaguuaucggggaucugaaaccgggaacugaguaucgcguguccauugccgcauauucccaggcugguaagggcaggcucuccuccccgcgacaugugacaacucugucucaggauaguugccugccucccgccgcaccucagcagccucacguuauuguugugagugacucagagguggcccuguccuggaagccuggagccagcgagggaagcgcgccuauacaauauuacuccguugaauuuauuagacccgauuucgauaaaaaguggacaucaauccacgagagaauccagauggauuccaugguaaucaaggggcuagacccugauacaaacuaccaauucgcagugagagcuaugaauagucauggacccagcccuagaagcuggcccuccgauaucauucgaacucuuugucccgaggaggcaggcagcgggagguacgggccaagauacaucacagacaugggugcgggugaagacgaugaaggcuuugaagaugaucuggaccucgauauuagcuuugaggaggucaagccacugccggcgacuaaaggagggaauaagaaguuuuuaguagaguccaagaagaugagcaucucuaacccaaaaaccauaagccggcuuauuccuccgaccuccgcaucuuuaccuguaacuaccguggccccucaaccaauccccauccaacguaagggcaaaaauggcguggcaauaaugucucgccuuuucgauaugccaugugacgaaacucuuugcuccgccgauagcuuuugcguuaaugauuauacguggggcggaucucgcugucagugcacacuggggaaagggggugaaucauguucagaggacaucgugauacaguauccacaguuuuucggacacuccuacgucaccuucgaaccucuuaagaauaguuaucaggcguuucaaaucacacuggaguuccgagccgaagcggaggacggccuacuguuguacugcggggagaaugaacauggucggggcgacuucaugagccuggcgauuauccgcagaagccuccaguuccguuucaacuguggcaccggcguagcaauaauugugagugaaaccaaaaucaagcucggggguuggcacacugugauguuguaucgagacggacugaauggacugcugcaacuaaauaacgguacaccaguaaccggccagucacaaggacaguacagcaagauuacuuuucggacuccccucuaccucgguggcgcccccucggcauacugguuggugcgcgcaacggggacaaauaggggauuccaggggugugugcagucgcuggccgucaacggccgcaggauugacaugagaccuuggccgcucggcaaagcucugaguggggccgauguuggcgaauguuccagcggcauuugugacgaagcaucauguauucauggagguacuugcacggcgauuaaggcagacagcuauauaugucucugccccuuggguuucaaaggcaggcauugugaagacgcauucacacugacgauuccccaguuccgagaaucgcuccguucuuaugcggcuacaccauggccccuggagccacaacauuaccucuccuucauggaauuugagauuacauucagacccgacucuggggaugggguacugcuauacagcuacgacaccggcucaaaggauuuucugucuauaaaccucgccgggggacacguagaauuccgguucgacuguggaagcgggacuggggugcugagaucugaagauccacugacucuagggaacuggcaugagcuccgcguuagucguaccgcuaagaacgggauucuucagguggacaaacaaaaaaucguggagggaauggccgagggaggcuuuacccagaucaaguguaauacagacaucuucauaggcggagugcccaacuacgacgauguuaaaaaaaacucaggaguacugaagccauucucaggcagcauccagaaaaucauccucaaugaucguacgauccacgugaaacacgauuuuacaucaggcgugaacguagagaaugcugcacacccaugugugcgggcucccugcgcccacggcggcagcugccguccuagaaaagagggguacgauugcgacuguccacucggauucgagggucugcacugccagaaggcaaucauagaagccaucgaaaucccgcaguucaucggcagaucuuaccuuacuuaugauaauccugauauccucaagcgggucagugguucuaggaguaacgucuuuaugcgcuucaaaacgaccgcaaaagacggacuccuacuauggcgaggagacuccccgaugagaccaaauuccgauuucaucucucucggauugcgggacggugcacugguuuucagcuauaaccuagggucgggcguugcaucuaucauggugaacggauccuuuaaugacggcagguggcacagagugaaggcugugcgcgauggacaguccggcaagauuaccgucgaugacuauggagccagaacgggaaaaucaccuggaaugaugaggcagcucaauaucaauggcgcauuguacguaggcggaaugaaggaaauugcacuccauacuaaucgccaguauaugcggggacugguggguugcaucucccacuuuacucuuucaacagauuaccauauaucgcuuguggaggacgcgguggacggcaaaaauauuaacaccugcggcgccaaguag

SEQ ID NO: 12120 - RNA, 1272 nt, Artificial Sequence
  Description of Artificial Sequence: Synthetic coding sequence
auguccgugcguggaauccugcgccuaggaacucaggaguauccauccccucuugacccugaagucggccccuacugcgacaccccuacuaugagaacucuguuuaaucuacugugguuggcguuagccugcagcccaguacacaccacccucucuaaaucugaugcuaagaaagccgcaucuaaaacacugcuggagaagagccaauucucugauaaaccggugcaggaucgagggcucguggugaccgaccugaaagcugagucugugguacucgagcaucgcucauauugcagcgccaaggcucgagauagacacuucgcgggcgacguucucggauacgugacaccauggaacagccaugguuacgacguuacgaaggucuucgguucgaaauucacacaaauuaguccugucuggcuccaacuuaaacggagagggcgcgagauguucgaagugacuggauugcacgacguggaucagggauggaugcgcgcaguaaggaagcacgccaagggccugcauauugugccuagauuacuguuugaagacuggaccuaugaugacuuccgcaacgugcuugauagcgaagacgaaaucgaagaacugagcaagaccguagugcaggucgcgaaaaaccaacauuuugauggcuuuguggucgaggucuggaaccaauuacucucucaaaaaagaguaggucucauccacaugcugacucaucuugcugaagcccuacaucaggcaaggcugcuggcccugcuaguuauccccccugcaaucacuccggggacugaucagcuggggauguuuacucauaaagaguucgaacaauuggcuccagugcuggacggauucuccuugaugacauaugauuacuccaccgcccaccaaccagggcccaacgcuccccuguccugggugcgcgcauguguucaggugcuugauccuaaaucaaaguggcggucaaagauuuugcuuggauuaaacuuuuacgggauggauuacgcaacuucaaaggaugcccgcgagccaguggugggagccagauacauccagacucuaaaagaccaucguccuagaaugguuugggauucccaagcaucagagcacuuuuucgaguauaaaaagucaaggucaggccggcacgugguauucuaucccacauugaagagcuuacaaguccgccuggagcuggcccgagagcucggcgugggggucucaaucugggagcucggccagggacuugauuacuuuuacgaucugcuuuag

SEQ ID NO: 12121 - RNA, 1182 nt, Artificial Sequence
  Description of Artificial Sequence: Synthetic coding sequence
augcgaacucucuuuaaucugcuuuggcuagcccuugcuuguagucccgugcacacaacgcuguccaaaucugaugcgaagaaagcggcaucuaagacccucuuagaaaagagccaguucucugacaaaccagugcaagauagaggacuaguggugaccgaccuuaaggcugaaucuguuguccuggagcaccggucauacuguagugcuaaggcacgagauagacacuuugcuggugacguucucggcuaugugacccccuggaacucacacgguuacgaugugaccaaaguuuucgggucaaaguuuacgcaaaucagccccgucugguuacagcucaagcgaagaggcagggaaauguuugagguuacgggacugcaugauguggaccagggauggaugagagccgugagaaaacacgcaaagggccuccauaucgugccaaggcugcucuuugaggacuggaccuacgacgacuuccgcaauguacuugacucagaggaugagauugaggaauuaagcaaaacugucgugcagguugcaaaaaaccagcauuucgacggguucguaguggaagucuggaaucaguuacugucccagaagagagugggguuaauccacaugcucacccaucucgcugaggcacuccaccaagcccgcuugcuugcuuugcuaguuauaccccccgcaaucaccccuggaaccgaccagcucggcauguucacccacaaagaauucgagcagcuggcaccuguccuggauggcuucucucugaugacuuacgacuacuccaccgcccaucagcccggucccaacgcaccccuguccuggguaagagcguguguccaggugcuggaucccaaaucaaaauggagaucaaaaaucuuguuaggguuaaacuucuaugggauggauuaugcaaccuccaaggacgcccgcgagccagucgugggagcccgauacauccagaccuugaaggaucacagaccucgaauggugugggacagucaggccagugagcauuucuucgaauauaagaaaucucgaagcggaagacauguaguauuuuacccuacccugaaaagucuucaggugcgccuggaacuugcuagagagcugggcgugggugugagcaucugggaacucggucagggccuggacuacuuuuaugaucuucuguag

SEQ ID NO: 12122 - RNA, 1959 nt, Artificial Sequence
  Description of Artificial Sequence: Synthetic coding sequence
auggcuucaguggcgugggccguccugaaagugcuucugcugcuuccuacacagacauggucaccaguuggcgccgguaacccuccagacugcgaugccccccuggcuucggcucuaccaagaagcucuuucucaucuuccucugaacuuaguagcucacacggucccggguucaguagguugaaucggagagauggggccggcgguuggaccccccugguaaguaauaaauaucaguggcugcagauugaucucggggagaggauggaagugacagcaguugccacccagggaggguacgggucaucugacugggucacauccuaucuuuuaauguuuagcgaugggggcagaaacuggaagcaguauagacgcgaggaaucgauauggggguuuccgggcaacaccaacgccgacuccgucguccacuaucgguuacaacccccauuugaagcgcgauuccuaagguuucucccccuggcauggaacccacgcgggagaauuggaaugcggauugagguauacggcugugcauacaaaagugaagucguuuacuucgauggacagagcgccuuacuguaccgauuagauaagaagccccugaagccuauuagggaugugaucaguuuaaaauucaaggcuaugcaguccaacgggauccugcugcauagggaaggacagcacggcaaucacauuacauuagagcuaauuaaagguaaguugguuuuuuuucugaacuccgguaacgcaaaacugcccuccacaaucgcaccagugacucuaaccuuggggucccugcuggaugaucagcauuggcauagcguucugauugaguugcuggauacacaagugaacuuuaccguggacaagcauacacaccauuuccaggccaagggcgauuccagcuaccuagaccugaauuucgagaucaguuucggaggaauaccuaccccaggccggagccgcgcguuucggagaaagucauuccacggcugccuggaaaaucucuacuacaacggcguggacguaaccgagcuggcuaaaaaacacaagccccagauccucaugauggguaacguguccuucagcuguccucagccccaaacugugccagucaccuuccucuccagucgcucauaucucgcacuuccuggcaauucaggagaagauaaggucagcgucacguuucaguuccggacuuggaaccgcgcgggccauuuacuauucggagagcugcggcgcgguucugggagcuucguucuguuucucaaggaugggaaacugaaguugucccuguuucagccaggacagaguccgaggaacguaacugcaggagcugggcugaacgaugggcaguggcauagugugucauucucggcuaaguggucccauaugaauguggucguggaugaugacacugcugugcagccccugguggccguucugaucgauucaggcgauacauacuauuucggagcucuguacgaacaauccugcgaggcccauaagcaccgcggcaaucccaguggacuguacuacaucgaugccgacggauccggcccguuaggaccuuuucuggucuacuguaacaugacagaugcagccuggacagucguccagcacggcggaccugacgccgucacgcugcggggggcaccaaguggccauccucguucggccguuucuuucgccuacgccgccggcgcugggcagcugcguucggcagugaaucuggcagaaagaugcgagcaacgcuuagcuuugaggugcggcaccgcccgaaggcccgauagccgugaugguacuccgcucaguugguggguaggccggacuaaugagacacacacaucuuggggaggcagccugccagaugcccagaaguguacuuguggccuugaagguaacuguaucgacucacaguauuacuguaauugugaugccggccguaaugagugguag

SEQ ID NO: 12123 - RNA, 1455 nt, Artificial Sequence
  Description of Artificial Sequence: Synthetic coding sequence
augugguauguauccaccagggguguggccccuagagucaauuucgagggcgcccucuucucuggcuacgcuccugacgggggucucuuuaugcccgaagaacugccccaacuggaucgcggcacgcuuugccaguggucaacucugucauauccugggcugguuaaagaacugugcgcgcuguuuauugggucugaacuccugccuaaagacgagcugaacgacuugaucgauagagccuucagucgguuccgacauagggaggucguccaccuuuccagauuacgcaacggccugaaugugcuagaacuguggcaugguguaaccuacgccuucaaggacuuaucucuuagcugcacuacccaauuccuccaguacuuucuugaaaaacgggagaaacaugucacagucguuguagggacauccggugacaccgggagugcagcgauagaguccguccagggagcgaaaaacauggacauaauuguucugcugcccaaaggucauugcacaaaaauacaagaacugcagaugacgaccguucuaaagcagaauguccacguuuucgggguggagggcaauagcgacgaauuagacgagccgaucaaaacaguuuuugcagacguugcguucgugaagaaacauaaucugaugucucuuaacuccauuaauuggucucggguguuagugcagauggcucaccacuucuuugcuuauuuccaaugcacuccuagucucgacacucaccccuuaccccugguagaggugguagugccaacaggcgcggcaggcaaccuggcagcugguuacaucgcgcagaaaauuggccuuccaauuagguuagucguugccgucaaucggaacgauauaauucacagaacgguucagcagggugacuuuagccucucggaggcaguuaagagcacccuugccagcgcuauggauauacagguucccuauaacauggagcgcguuuucuggcuucuaaguggauccgacucucaggugacccgcgcucugauggagcaauucgagaggacacaguccguaaaccuuccaaaggagcuucacucaaagcucuccgaggccguaaccucuguaucuguuucugaugaagccauuacccagacgaugggaagaugcugggacgagaaucaauaucuucucuguccccacucagccguagcagugaauuaucauuaccagcagaucgauagacagcagccauccaccccuaggugcuguuuagcuccugccucugcggcuaaauuucccgaggcuguccuggcugcagguuuaaccccugaaacuccagccgaaauaguggcgcuggaacauaaggagacacgauguacucugaugaggagaggagauaacuggauguugaugcuccgggauacuauagaggacuuaucucggcaguggagaagucacgcguuaaacaccucccaguag

SEQ ID NO: 12124 - RNA, 264 nt, Artificial Sequence
  Description of Artificial Sequence: Synthetic coding sequence
auggugagccugaugaaacuguggauccccaugcuuaugacuuuuuuuugcacagugcuacugagcguccuuggggagaugagaaagaaacgauacgauagaaaggagcuguuacuagaagagugcuggggaaaaccaaacgugaaggaaugcacaaacaagugcagcaaggcuuuuaggugcaaagauaaaaacuauacuuguuguuggacauacugcggaaauauuugcuggauuaacguggagaccuccggggauuauuag

SEQ ID NO: 12125 - RNA, 453 nt, Artificial Sequence
  Description of Artificial Sequence: Synthetic coding sequence
augcguuucauggcaggucccgcuggcucucagucucugggaccccucugcuuccacagcuccccccaggcacuuuauacgguguugcugaucgugcuugucaugaugagucucguguucggaaaguuugugccggucaacugggagccuccacaaccauugcccuuuccuaaguaucuaagaugcuaucgcuguuuguuggagacuaaagaacuuggcugucuauuaggaagcgauauuugccucaccccagcuggcucaucauguaucacacugcacaagaaaaacucuucagguucggacgugauggucucagauugccgcuccaaagagcagauguccgauuguuccaacacccgcaccucucccguuucuggauucuggaucuuuagccaguacuguuucuuggauuucugcaacgacccucagaaucgggggcucuacaccccuuag

SEQ ID NO: 12126 - RNA, 873 nt, Artificial Sequence
  Description of Artificial Sequence: Synthetic coding sequence
augucagugagaaggggucgccgucccgcccgaccuggaacaaggcucuccuggcuccuuugcuguucagccuugcuuucaccagcugccggguacguaauugugaguucagugagcugggcuguuaccaaugaaguggaugaagagcuagacagcgcaagcacagaagaggccaugccagcucugcucgaggauagcgguucgaucuggcagcagucguuuccagccagcgcgcacaaggaagacgcucaccuuagaccacgagcaggggccgcuagggcacguccacccccagcaccgccuggcauguucaguuaccgcagagagggaggccagaccgcauccgccccucccggaccacguuugcgggcagcaacagcccgcagucuggcucacgcgucuguuuggggaugccuagccaccgugaguacucauaaaaagauccaaggacuacccuuugguaacugucuccccgucagcgaugggccauuuaacaauaguaccgggauccccuuuuucuauaugaccgcuaaggacccagucgucgccgaucuaaugaaaaacccaauggccuccuuaaugcugccugagagugaaggagaguuuuguagaaagaacauugucgaccccgaagacccucguugugugcagcucacccugacagggcaaaugauugccguaagcccggaggaaguggaguuugccaagcaggcgauguuuagucggcaucccggaaugcgcaaguggccucgacaguacgagugguuuuuuaugaagaugaggaucgaacacauuugguugcagaaaugguauggaggcgcgagcuccaucaguagagaagaguauuuuaaagcagucccccggaaagcuuag

SEQ ID NO: 12127 - RNA, 2742 nt, Artificial Sequence
  Description of Artificial Sequence: Synthetic coding sequence
auggguccugaagcccuaucuagcuuacucuuacuacuucugguggccucaggagaugccgauaugaagggacacuuugauccagccaaaugccgauaugcucuggguaugcaagauagaaccauuccugacagcgauauuucagccuccucuucuuggucagacagcacugccgcuaggcauuccagacucgaaagcagugauggcgauggcgcauggugcccagcaggcagcguguuccccaaagaggaagaauaucuccagguugaccuucagcgccuccaucugguagcccugguggguacgcagggacggcacgcgggaggacucgggaaggaguuuucucggucuuacagguugcguuauucccgugacggacgcagauggaugggcuggaaagacagauggggacaggaagucaucagugguaaugaggacccagaaggugugguccugaaggaucugggcccuccuaugguggcgaggcucgugcgcuucuacccgagagccgaccgugugaugucugugugucugcggguggagcuguacggcugcuuguggagagauggauuacugucauauaccgccccaguggggcagaccauguaccucuccgaggccguuuaucugaaugacagcaccuacgauggacauacugucggaggacuacaguacgguggucugggccagcuggcagacggcgucgucggauuagacgauuuuaggaaaagccaggaguugcgaguguggccaggcuacgacuacguuggcuggucuaaucacucuuuuucaaguggauauguggaaauggaauucgaguuugacagacugcgcgcuuuccaggcuaugcaggugcacuguaacaauaugcauacacucggugcccgacugcccggagggguagaaugccgcuuuagaaggggaccugccauggcaugggagggagagcccaugcgucacaaccugggcggaaaccucggugauccacgggcccgggccgugucagugccacuugguggacgaguugcaagguuccugcaauguagauuucuguuugccgggcccuggcuccuuuuuagugagauuuccuucauauccgauguggugaauaacagcagcccugcccugggcggaacauucccgccugcucccugguggcccccuggaccaccgcccaccaauuucucuagucuggagcuggagccacggggccagcaaccggucgcaaaagccgagggcaguccuaccgccauccucauugggugcuugguggcuaucauccugcuucuguuacuuaucauugcccugaugcuguggcgacugcauuggaggaggcuucucuccaaagcugaacggcgcgugcuggaggaggagcucacugugcaucugagcguaccuggagacaccauccugauaaacaaccgcccuggccccagagaacccccgccuuaucaagaaccccgcccaagaggcaacccaccacacucagcuccuugcguccccaauggcagcgccuuguuguuauccaaucccgcuuaccgucucuugcuggccaccuaugcccggcccccccggggucccggcccccccacuccugcgugggcaaaaccuacuaacacgcaagcuuacuccggugacuacauggagccugaaaaaccgggggcaccccugcuaccucccccuccccagaauagcgugccacauuacgccgaggcagauaucgucacauugcagggcguaaccggaggaaacaccuaugcggugcccgcucucccuccgggugccgucggugauggcccuccccggguugacuuuccucggucaaggcuaagauucaaagagaaacucggcgagggccaauuuggggaagugcaucucugcgaagucgacucaccacaggaccucguuucccucgacuuucccuugaauguuagaaagggacacccauugcugguugcagucaagauccuacggcccgacgcgacaaagaaugcccguaacgauuuuuugaaggagguuaaaauuaugucaagauuaaaggauccuaacauuaucaggcuacugggugugugcguucaggacgauccccuaugcaugaucacagacuacauggagaacggggauuugaaucaguuccugucagcccaucagcuggaggacaaggcugccgagggcgcucccggcgacgggcaagcugcccaaggcccuaccauuaguuaucccauguuacugcauguggcugcgcagaucgccagcgggaugagguaccucgcuacccugaacuucguccaccgggaucucgcuacaagaaauugccuagugggugagaacuuuaccauaaaaaucgcagacuucggcaugagccgcaaucucuacgcaggcgacuauuaucgggugcaaggaagggcaguguuacccauuagauggauggccugggagugcauacugauggggaaauuuacuaccgccuccgacguuugggccuucggugugacacuuugggaaguuuugauguugugccgggcucagcccuuuggccagcucacagaugagcaagugauugaaaacgcuggugaauucuuccgagaccaggggcgacagguguaucugucccggcccccugccugcccucagggucuguaugagcucaugcuucgcugcugguccagagagucagaacagaggcccccauucagccagcugcaucgguuccucgccgaggacgcccuaaauacugucuag

SEQ ID NO: 12128 - RNA, 243 nt, Artificial Sequence
  Description of Artificial Sequence: Synthetic coding sequence
augaagcuuucagguauguucuuguugcuuucacuggcccuuuuuugcuuucugacuggaguuuuuagccagggcggccagguugauugcggagaauuucaagacccaaaggucuauuguacacgugaauccaauccucauugcggguccgauggucagacguacggaaacaaaugugccuuuuguaaagccauagugaagucuggaggaaagauuucacuaaagcacccagguaaauguuag

SEQ ID NO: 12129 - RNA, 270 nt, Artificial Sequence
  Description of Artificial Sequence: Synthetic coding sequence
augaaacccuggauccugcuccugguuauguuuaucuccggugucgugaugcuccugccaguucugggaagcuucuggaacaaagauccauuucuggacaugauacgcgaaacagagcaguguugggugcagcccccuuacaaguauugugaaaagagaugcacuaagauuaugaccugcguacgcccuaaucacacgugcuguuggacauauuguggcaauauuugucuugauaaugaagaaccucucaagucuaugcuuaauccuuag

SEQ ID NO: 12130 - RNA, 264 nt, Artificial Sequence
  Description of Artificial Sequence: Synthetic coding sequence
augcucccuugccucgcacuccugcuacucauggaauugucuguuuguacgguugccggggauggcggagaggaacagacuuugucaaccgaagcugagacgugggaaggugcagggccuucaauucaacuccagcugcaggaagucaaaacaggaaaagcuagccaguuuuucggguuaaugggaaagcggguaggcggcagaccacugauccaaccaagaagaaaaaaaggucgagaggaugaggcucagggcuccgaguag

SEQ ID NO: 12131 - RNA, 285 nt, Artificial Sequence
  Description of Artificial Sequence: Synthetic coding sequence
augcaacacagccucguguucuucuuugccguaauacugcaucuuucucacuuguuacaucuggaugcgagcauucaucccuuccgccucccuuucucgagcaaaccauucuuacuuauccccaugucaaauaccacccuuccgcacaccgcuuggccgcugucuuuucuacaccaaaccguuucgacccugaaagcugucgcugucacacauagccuguggcaucuccagaucccuguagacugccaggcuugcaacagaaaaucaaaaaagaucuacugcuag

SEQ ID NO: 12132 - RNA, 327 nt, Artificial Sequence
  Description of Artificial Sequence: Synthetic coding sequence
augcgccagcggcugcucccauccgugacuucccuguugcugguggcacuccuguuucccggcucaagccaggcucgccaugugaaccacuccgccacugaagccuuaggugaacugcgugagagggcccccggacaaggaacgaauggauuccagcucuuaagacaugccguuaaaagagaucuucugccaccccguaccccgcccuaucagggugaugugcccuuggguauccgaaauacuauuugcagaaugcaacaggguaucuguagauuauuuuuuugucauagcggcacuggacagcagcacaggcagagauguggcuag

SEQ ID NO: 12133 - RNA, 807 nt, Artificial Sequence
  Description of Artificial Sequence: Synthetic coding sequence
augcugcugcuggcugcagcuuuucuaguggccuucguucuucuauuguacaugguaucaccacugaucaguccaaagccauuggcccugccuggggcgcacgucguggucacaggaggcuccagcggcaucggcaaauguauugcaauugaaugcuauaagcagggggcuuuuaucacccugguagcuaggaacgaggauaaauugcugcaagccaaaaaggagaucgaaaugcauucuauuaacgauaagcagguaguacugugcauuucaguagacgucucacaggacuauaaucagguggaaaacguaauaaagcaggcucaggaaaaauuggggccugucgauauguugguuaauugcgccgguauggcugucucgggaaaguuugaggaucuagaggucagcacauucgaagugaagccuuacaacguguauauuaccguggccuacccccccgacacugacacuccugguuuugcagaagagaaccgcacuaagccacuugaaacccgguugaucagcgaaacaacaagcguuugcaagccugaacaagucgcgaagcagaucguaaaagaugcuauccaagggaacuucaacucgagccuggggucggaugguuacauguuaagcgcacugacuugugguauggcaccaguuacgucaauuaccgaaggccuccagcaggucgugacuauggggcucuuuagaaccauugcauuguucuaucuaggaucguucgauagcauaguuagaagguguaugaugcaaagggagaaauccgaaaaugccgacaagacagcguag

SEQ ID NO: 12134 - RNA, 1686 nt, Artificial Sequence
  Description of Artificial Sequence: Synthetic coding sequence
augagguggauauuaugcuggagccugacauugugucuuauggcccagaccgcguugggagcccugcacacaaaacggccacaaguggugacaaaauacgggacccugcaggggaaacaaaugcacguggggaaaacucccauacagguuuuccucggagugccuuuuagucggcccccucugggaauucugcgguucgcuccccccgagccuccggaacccuggaaaggcaucagagacgcaacaaccuaccccccaggcugccuccaggagucauggggccaacuggccaguauguacgugagcacucgggaacgauauaagugguugagauuuucugaggacugucuguaucuaaacguguacgcaccugcacgcgcucccggggacccucagcuaccagugauggugugguucccugggggggcauucaucguuggagccgcaaguucuuacgaaggcagugaucuggccgcucgagaaaaggucguucuuguuuuccugcagcaccgcuuaggaauauucggguuucucucaacagaugacucccacgcgcgcggaaauuggggccugcucgaucaaauggcugcccugcgauggguucaggagaauauugcugcauuuggaggcgaucccggcaacguaacuuuauuuggacaguccgccggugcuaugaguauuagcggccugaugauguccccgcucgcuucgggucuguuucacagggcaauuagccagucuggcacugccuuauuucgucuguuuaucacuucuaacccgcugaaaguggcuaagaaaguggcccaccuagcugguugcaaucacaacagcacucaaauucuugugaacugucuacgggcguuaucuggcaccaaggugaugcgagugucaaacaaaaugcgauuccugcagcucaacuuccagagagaccccgaagagaucauuuggucaaugucccccguuguugauggcguagugauuccugaugacccucuuguucugcuuacucagggaaagguuaguagcguccccuaucuucucggcguuaacaaccuggaguucaauuggcugcugcccuacaucaugaaguucccuuugaauagacaggcuaugcguaaggagaccaucacgaagaugcuuuggagcacuaggacucuccuaaauaucacgaaggaacaggugccacuggugguugaggaguaccuggacaaugugaaugagcacgauuggaagaugcugcguaacagaaugauggauaucguucaggacgcuaccuucgucuaugcuacccuccagacugcacauuaucauagggacgcaggguugccaguauaccuuuacgaguucgaacaucacgcuagagggauuauaguuaaaccaaggacagacggcgcggaucacggcgaugagauguacuucuuguuugggggacccuuugcgaccggacucagcaugggcaaggaaaaagcccugucucuccaaaugaugaaauacugggcaaauuuugcucgcaccggcaauccaaacgacggcaaucucccuuguuggccucgcuacaauaaagaugagaaauaccuacaguuagacuucacaaccagagucgggaugaaguuaaaagagaagaagauggcuuuuuggaugagucuguaccagucccagcggccugagaaacaacgacaguucuag

SEQ ID NO: 12135 - RNA, 444 nt, Artificial Sequence
  Description of Artificial Sequence: Synthetic coding sequence
auggcuucaucacucaagaucugggggacacugcuggcauugcucugcauucuaugcacucuccugguucagagcaaggaagucucauggcgugaauuuaugaaacagcacuacuuaagcccaucccgcgaguuccgugaauacaagugugacguccugaugagagagaaugaggcccuuaaagauaaguccucccauauguucauauauauuucgugguauaaaaucgaacacaucuguaccuccgacaacuggauggacagauucagaaacgcuuacguuuggguccagaacccgcucaaagugcucaaaugccaccaagaaaauagcaagaacuccuauaccgaaagucgcaguuuuaauuauauagaauuucacugcuccauggauggcuauguggauucuauugaggaucugaagauggucgaaccuauuggcaacuag

SEQ ID NO: 12136 - RNA, 444 nt, Artificial Sequence
  Description of Artificial Sequence: Synthetic coding sequence
augacuucuucuuuaaaaaucuggggaauccuucuggcacuccucugcauuuugugcaggcucugcguguauagcaauaacauuuauuggcgggaguuuaucaagcugcacuaucuuagcccuagccgagaauuuaaagaguacaagugugacgugcugaugcgagaaaaagaggcucuuaagggcaaaucguuccacauguucauuuacucccucugguucaaaauucagcgagcuugcaucaacgaaaaaggcagcgauagauaucggaaugcguacguuugggcaccuggugcacuuaaagugcuagaaugucacugggaaaaauauaacaacagauacaccgaaucaagaagcuucagcuacaucgaguuccacugugggguggacggcuacguugauaacauugaggaccugcggauuauugagcccaucucuaauuag

SEQ ID NO: 12137 - RNA, 1248 nt, Artificial Sequence
  Description of Artificial Sequence: Synthetic coding sequence
augucgccguuucuuuaucuagugcugcuaguacucggauuacaugccacaauccacugcgcuucaccggaagggaagguuacagcuugccauuccucccagccuaaugcaacucuguacaagaugucuucuaucaaugccgauuucgcauuuaaucuguaucggcgauucacuguugagaccccugauaagaauauuuucuuuuccccagugaguauuuccgcugcccugguaaugcuauccuuuggcgcguguuguagcacacagaccgaaaucguugagacccugggguucaaucuuaccgacacuccuaugguggagauucagcacggguuucaacacuuaauuuguagucugaauuucccaaagaaggaacuggagcuucaaaucggaaacgcucuuuuuauagguaagcaccugaagccguuagccaaguuucucaacgauguuaaaacguuguacgaaacugagguauuuuccaccgauuucucuaacaucagcgccgcuaaacaggagaucaacagccauguagagaugcagaccaagggaaaagucgucggucugauccaagaccugaaaccaaauaccaucauggugcucguuaauuauauccacuuuaaagcucaaugggccaacccguuugauccuucuaagaccgaggacucaucuagcuuucugaucgauaagacaacaaccguacaggugcccaugaugcaucagauggaacaguacuaucaucuaguagacauggaauugaauuguaccguccugcagauggacuacucuaagaacgcccucgcucucuuugugcugcccaaggaaggacagauggaaucgguagaggcagcuaugucauccaagacacugaaaaaauggaaucgguuguugcaaaagggauggguugaucuuuuugugcccaaauuuucuauaagcgcuaccuaugaccuuggggcaacacuguuaaagauggguauccagcacgcuuacuccgagaaugcagacuucagcgggcuuaccgaggacaacggcuugaaacugucuaacgcggcucauaaagcaguccuccauauaggggaaaagggaaccgaagcagcagcaguuccugagguagagcuuucugaucagccugagaauaccuuucugcacccaauuauccagaucgauaggucuuuuaugcucuugauccucgagaggucuacacgauccauccucuuccugggcaaagucguuaaccccaccgaagccuag

SEQ ID NO: 12138 - RNA, 285 nt, Artificial Sequence
  Description of Artificial Sequence: Synthetic coding sequence
augagaacucuagccauacuugccgcgauuuuacuggucgcucugcaggcucaagccgaaccucugcaagcacgggccgaugagguugccgcagccccugaacagauagcagcugacauccccgaaguggugguuucucuggcuugggaugaaucucuugccccuaagcaccccgggagccgcaaaaauauggauugcuauuguaggaucccagcuugcauugcaggugaacggcgauaugggacauguaucuaucaaggucgccuuugggcuuucugcuguuag

SEQ ID NO: 12139 - RNA, 1062 nt, Artificial Sequence
  Description of Artificial Sequence: Synthetic coding sequence
augcgccugccaaggagggccgcauugggauuacugccguugcuccuccuucuuccgccagcuccugaggcugccaaaaagcccacaccuugucaccggugccggggacugguggacaaguucaaccaaggaaugguggacaccgcgaaaaagaauuucggagggggaaauacagcuugggaagaaaagacacucucuaaguaugaaaguagcgagauccgcuugcuagaaauucucgagggucugugcgagucaagcgacuucgagugcaaccagauguuagaagcccaggaagaacaccuugaagcgugguggcuucagcugaagagcgaguauccagaccuguucgaaugguucugcguuaagacccugaagguuugcugcucacccggcaccuacgguccagacuguuuggcaugucaaggagggagccagagacccugcuccggaaauggccacuguuccggcgacgggagccgacagggugacggcaguugccgaugucacaugggcuaccagggcccuuuaugcaccgauuguauggacggauacuuuagcagcuugcgaaacgagacgcauucaaucugcacagcuugugacgaaucauguaaaaccuguucugggcugacaaaccgggauuguggugagugugaaguugguugggugcuggacgagggcgcguguguggauguggaugaaugugccgcagagccaccccccugcuccgccgcucaguucuguaagaaugcaaacggaucguauacgugcgaagagugugacagcucuugcguggguugcacaggugaaggaccaggaaacugcaaggaaugcauaucuggcuacgcuagggagcacggacagugcgcagauguggaugaguguucacuugcagagaaaaccugcguaaggaagaacgagaauugcuauaauacaccuggaucuuacguuugcgugugcccugacggguucgaggaaacagaggacgcaugugucccccccgcugaagccgaagcuacagaaggagagucaccuacucagcugccuuccagagaggaccucuag

SEQ ID NO: 12140 - RNA, 651 nt, Artificial Sequence
  Description of Artificial Sequence: Synthetic coding sequence
augaaacuuaauuuaguccaaaucuucuuuaugcugcugaugcugcugcucgggcugggaaugggucuugggcuuggacugcauauggcuacggcaguucuggaagaaucugaccagccccucaaugaguucugguccucagacucccaagacaaggccgaggcuaccgaggaaggcgacggaacccaaacgaccgagacuuuaguccuuucuaauaaggaaguuguccagcccggcuggccagaggauccaauuuuaggcgaagacgaaguggggggaaacaagaugcugagggcgagcgcacuguuccagaguaauaaagacuaccuccggcucgaccaaaccgacagagaguguaaugacaugauggcucacaagaugaaagaacccagccagucgugcaucgcacaauacgccuuuauacaugaagacuuaaacaccgugaaagccguauguaauucuccagugauugccugugaacucaagggcggcaagugucacaaaaguuccagaccauuugacuuaacacugugcgagcugucccagccggaccaggugacaccaaauuguaauuauuuaacaucagugauuaagaaacauauuaucauaacuuguaacgauaugaagcggcagcugccuacaggccaauag

SEQ ID NO: 12141 - RNA, 222 nt, Artificial Sequence
  Description of Artificial Sequence: Synthetic coding sequence
augcgaauugccgugcuacuguuugccaucuucuuuuucaugucacaaguccugcccgcucgcggaaaauucaaggagauuugugaacguccuaacgggucaugucgcgacuucugccucgagaccgaaauucaugugggacgcugccucaacucacagccuuguugccucccucuaggccaucagcccaggauagagaguaccacaccuaagaaagacuag

SEQ ID NO: 12142 - RNA, 609 nt, Artificial Sequence
  Description of Artificial Sequence: Synthetic coding sequence
auggagcgaggcgcuggggcuaagcugcugccucucuugcuccuucugcgggcuacugguuucacuugugcacaaaccgacggaagaaauggauauacggccgugaucgaggugacuucuggggggcccuggggugauugggcauggccagagaugugucccgauggcuucuucgccagcggcuuuuccuuaaaaguggaaccuccgcaggggaucccuggcgaugacacagcccuuaacggaauucgacugcacugcgcgagggguaacgugcugggaaauacucauguuguagaaagucaaagugggaguuggggagagugguccgagccccuuuggugccgcgguggcgcuuaccuggucgcauucucacuuaggguagaagcaccaaccaccuuaggagacaauaccgccgccaauaacguaagguuuagaugcuccgauggggaggaguugcaagguccaggucucagcuggggagauuuuggcgauuggagugaccauuguccuaaaggagcauguggauuacagacaaagauacaaggcccgcgaggacucggagacgacacggcuuuaaaugaugcgcggcuguuuuguugccguaguuag

SEQ ID NO: 12143 - RNA, 759 nt, Artificial Sequence
  Description of Artificial Sequence: Synthetic coding sequence
augcagcucacccggugcugcuuuguguuucuggugcagggcagccucuaucucgugauuugcgggcaggacgacggcccccccggcagugaagacccggagcgugaugaucaugaagggcagccuagaccacgcguccccaggaagcggggccacauaucacccaagucgaggccaauggccaauaguacccucuugggauugcucgcuccgccuggcgaggccugggggauccuugggcaaccacccaauagaccgaaccauuccccccccccaagcgccaaaguuaaaaaaauuuucgguuggggcgauuucuacucaaauaucaaaacuguggcacugaaucuccuugugacagggaagaucguggaucacggcaacggaaccuuuagugugcauuuucaacacaaugccacuggucagggcaacauuucaauuucuuuaguacccccaaguaaggccguggaauuucaccaagagcagcagaucuuuauugaggccaaagccagcaaaauuuuuaauugccgcauggagugggaaaaaguagaaagaggacggagaacuucucuguguacucaugauccugccaaaaucugcucuagagaccacgcucaguccuccgcaacuugguccuguucucaaccuuuuaaggugguauguguguacaucgcuuucuacaguacagacuaucgacucguucagaaaguuugucccgacuauaacuaccacucugauaccccauauuaccccucuggguag

SEQ ID NO: 12144 - RNA, 555 nt, Artificial Sequence
  Description of Artificial Sequence: Synthetic coding sequence
augaaaaucuuggucgcauuucuaguaguuuuaacuauauucggcauucagucccacggauaugagguuuuuaauauuaucuccccaagcaacaacggaggcaauguccaggagacugucacgauagacaacgagaaaaauacugccauuauuaacauucaugcuggcuccugcuccucuacuacaaucuucgauuauaagcacggauacaucgcaucccgcguucucucccgcagagccugcuuuaucuuaaagauggaccaucaaaauauuccgccucugaacaaccuccagugguacauuuacgaaaaacaggcacuggauaacauguuuaguuccaaguacaccugggugaaguauaacccucuggaaucccuuauuaaggacgucgauugguuucuucucgguagcccaauugagaaacucuguaaacacaucccuuuguauaaaggugaggugguggaaaauacccacaaugugggggcgggagggugugccaaagcagggcugcucgggauuuuggguauaagcauuugugcugacauucauguguag

SEQ ID NO: 12145 - RNA, 651 nt, Artificial Sequence
  Description of Artificial Sequence: Synthetic coding sequence
augggcgcaguuaugggaaccuucucgagccuccaaacgaagcagagacgacccucgaaagacaaaauugaagacgaacuagagaugacuauggugugccaccggccagagggacuggaacagcuggaagcccagaccaauuuuacaaagagggaguuacagguucuguaccgaggcuuuaaaaaugaguguccaucagggguggucaaugaggauaccuuuaaacagauuuaugcucaguucuuuccucacggugaugcguccaccuacgcccacuauuuguuuaacgcuuucgacacuacacagacgggcagugugaaguucgaggacuucguuacagcacucucaauucucuugcgagggaccgugcacgaaaaacuuagguggacauuuaaucuguacgacaucaacaaagacggauacauaaauaaagaggagaugauggacauuguuaaagcaauuuaugauaugaugggcaaauauaccuacccgguucuuaaggaggauacaccucgucagcacgucgacguuuucuuccaaaaaauggacaaaaacaaggacggaaucgugacucuggaugaguuucuugaaagcugccaagaggaugauaacaucaugcguucccuacaacuauuucagaacgugauguag

SEQ ID NO: 12146 - RNA, 2736 nt, Artificial Sequence
  Description of Artificial Sequence: Synthetic coding sequence
auggcacagcuguuccugccacuuuuggcugcccuaguucucgcacaggcaccugcagcucuggccgaugugcuugagggagacaguagcgaggaucgcgcauuccgugugcggauugccggcgaugccccauugcaggguguucugggcggagcucuaaccaucccaugccacguacauuauuugcgacccccccccucccgccgcgccgugcucggcuccccaagggugaaguggacuuucuugagccgggguagagaggccgaggugcugguugcccggggcguaagggucaaggucaaugaagccuacagguucagagucgcacuacccgccuaccccgcaucccucacagauguuuccuuagccuugucagaacugagacccaacgacucaggaauuuaucggugcgaggugcagcauggcauugaugauucuucugaugccguggaagucaaagugaaaggaguuguguuucuguauagagaaggcucagcucgguacgcauucucuuuuaguggagcccaagaagccugcgcccgaauuggagcccauaucgccacaccugaacaguuguacgcugcuuaucugggcggguaugaacagugugaugccggcuggcucucugaccagacugugcgcuaucccauccaaacgccaagagaggccugcuauggcgauauggacggcuuuccaggcguuagaaacuaugggguugucgaccccgacgaucuauaugacguguauugcuaugccgaggaccugaacggagagcuuuuccugggagacccaccagaaaaacucacccucgaggaagcccgcgcuuauugccaggagagaggugcugagauagccacaacuggacaguuauaugccgccugggacggcgggcuggaucauuguucacccggauggcuggcagacggcucagugcgguauccaauugugacacccagucagagaugcgggggcggcuuaccuggagugaagacccucuucuuauuuccuaaccagaccggcuuuccaaacaagcacucccgauucaacguguacugcuuccgcgacuccgcccagccuagcgcuauaccagaagcuuccaaccccgcuucaaauccagcuucagacgggcuggaggcuauugugacgguuaccgagacguuagaggaacuccaguugccacaagaggcuacggaaagcgaaaguaggggcgcaauuuacucuaucccaauaauggaagacgggggcggugggaguaguacgccugaagacccugccgaggcuccccgcacucugcucgaauuugagacccaguccaugguaccaccgacuggauuuuccgaggaggaagguaaagcacuggaagaggaggaaaaguaugaagaugaagaggagaaagaagaagaagaggaagaggaagaaguggaagaugaagcguugugggcguggcccucugagcugucuucgccuggcccagaggccucgcucccuacagaaccggccgcccaggaggagucacucagucaggcaccagccagagcuguccuucagccgggugcgucgccauugcccgacggggagucugaggcaucuaggccaccucgugugcacggcccuccaacggagacacuucccaccccccgggagcggaaucuugcuucuccaucuccaucuacgcuaguggaggcacgggaagucggagaggccacaggaggccccgaacuguccggcguaccuagaggcgagagcgaggaaacagguucaucagagggugcaccaagucuucugccagcgacccgugcuccagaggggacacgcgagcucgaagccccuucugaggauaacagcggccgcaccgcaccagccgggaccaguguucaggcucaaccuguccugccaacagacagcgcgaguaggggcggcguggcugucguuccugccagcggggauugcgugcccaguccuugccauaauggaggcacgugucuugaagaagaggaaggaguucgcugucugugccucccgggauacgggggggaucucugcgacgucggacuucgcuucugcaauccagguugggacgcauuccagggcgcgugcuauaagcauuucaguaccagacgcagcugggaggaggccgaaacccaguguaggauguacggggcccaucuggccagcauuagcacgccagaggagcaggacuucaucaacaauagguaccgagaauaccaguggaucggacuuaaugaucgcacaaucgagggcgauuuccucugguccgacggcgugccucuucuguacgagaacuggaacccaggccaaccagacuccuauuuucuguccggcgaaaauuguguugugaugguguggcaugaccagggccagugguccgacgucccauguaacuaccaccugucuuacacgugcaagaugggcuugguuaguugugggccuccucccgaacucccuuuggcucagguauucggccguccucgcuugcgguacgagguggacacuguucuuagauacagaugccgcgaggggcuggcucagaggaauuugccuuugauucgcugccaggagaacggcagaugggaggcuccacagauuagcuguguuccucgcaggccugcacgcgcgcuccaucccgaggaggauccagaagguagacagggccggcuccucgguagguggaaggcacugcuuaucccucccucaagucccaugccaggcccauag

SEQ ID NO: 12147 - RNA, 852 nt, Artificial Sequence
  Description of Artificial Sequence: Synthetic coding sequence
augggucuaggucuucggggauggggcagaccacugcugacuguggccacugcucucaugcugcccgucaaaccucccgcugguaguuggggagcucagaucauagggggucaugagguaaccccccacucucguccguauauggccuccgugcgauucgggggccagcaucacugcggcggguuccugcugagagcccgaugggucgucuccgcugcccacuguuucucccaccgcgaucuacgcaccggccucguggugcugggggcacauguccuaaguacagcagaacccacgcagcaagucuucggcaucgaugcacucaccacacaucccgauuaccacccuaugacacaugcuaacgauauauguuugcugcgacucaacggcuccgccgugcuaggcccagcugugggccuccugcguccuccuggaagaagagcccgaccaccuacagcagguacaagauguagggucgcugguuggggguuugugagcgauuuugaggaguuaccccccggccuaauggaggcuaagguaaggguguuagauccugaugucugcaauucuucuuggaagggacaucugacccugacaaugcucuguacccgcagcggugauucacacagaagagguuuuuguagcgcagauucuggaggcccacuagugugccgcaauagagcccauggacuggugagcuucucgggacucugguguggcgaucccaaaaccccugacguguacacccaggucucagccuucgucgcuuggaucugggaugugguacgccgguccucaccacagccuggaccacuccccgguacuacaaggccuccaggugaggccgcuuag

SEQ ID NO: 12148 - RNA, 1209 nt, Artificial Sequence
  Description of Artificial Sequence: Synthetic coding sequence
augaugguggcccuccgcggagccucugcauuacuggugcuguuuuuggccgccuuccugccaccuccccaguguacgcaagaccccgccaugguccacuauaucuaccaacgcuuccgggugcuggaacagggucuggaaaaaugcacacaagccacacgagcauauauacaggaguuucaggaauucucuaagaacauuagcguuauguugggacgcugucagacauauacaagugaguauaaaagugcaguuggcaauuuggcacugagagucgaacgggcccaacgcgagauugauuacauccaguaucugcgggaggccgacgagugcaucgagucugaggauaagacacuggccgaaaugcugcuccaagaagccgaagaggaaaagaagaucaggacucuucugaaugcauccugugauaauauguugaugggcaucaaaucccuuaaaaucguuaaaaaaaugauggacacgcauggaaguuggaugaaggacgccgucuauaacagcccaaagguguaccugcucaucggcucaagaaacaacaccgucugggaguucgccaauauacgcgccuucauggaggacaacacuaaacccgcgccucggaagcagauccuuacgcugagcuggcaggggaccgggcaaguaaucuacaaggguuuccuguucuuucacaaccaggcuacuucaaaugagaucaucaaguacaaucugcagaagcguacagucgaagacagaauguugcugcccggcggggugggucgcgcacucgucuaccagcacucuccaagcacuuauaucgaucuggcgguggacgagcacggcuugugggccauucacucaggucccggaacacauucucaccucguccugacaaaaaucgagccaggcacucuuggaguggaacacucgugggacacuccaugccggagccaggacgccgaggcaucuuuucuguuaugugggguucuguaugugguguacucgacaggcgggcaaggcccccaccgaauaacauguauuuaugacccacuaggaacuauuucugaagaagaucugccaaaucuuuuuuucccaaaacggccaaggagucacuccaugauucauuacaaccccagagauaaacagcucuacgcauggaacgaggggaaucagaucaucuauaaacugcagacaaagcgcaaacugccccugaaguag

SEQ ID NO: 12149 - RNA, 1221 nt, Artificial Sequence
  Description of Artificial Sequence: Synthetic coding sequence
augcagcuuuuucugcuacuuugcuugguacugcugagcccccagggcgccuccuugcacaggcaccacccacgcgagaugaagaagcgggucgaagaccuacacgucggagccacagucgccccaucuaguaggcgcgacuuuacuuuugaccuguauagagcccucgccucugcagcccccucccagucaauuuuuuucuccccaguaaguaucagcaugucccuagcuaugcucucccugggugcggguucauccacuaaaaugcagauccuggaaggauuaggccugaaucuucaaaaaucgucugagaaagagcuucaccgggguuuucaacagcugcuccaggagcucaaucagccuagagauggguuucagcugagucugggcaacgcacucuucacugaccuugugguggaccuacaagauaccuucgugagcgccaugaaaacucuauaucuugcugauacauuucccaccaauuuucgcgacagugcaggcgcaaugaaacaaaucaaugauuacguggcaaagcagacgaaagggaaaauuguggauuugcugaagaaucuggauagcaaugcagucgucauuauggugaacuacaucuuuuuuaaggcgaagugggagacaagcuuuaaccauaaaggaacccaggagcaggacuucuaugucacaagcgagaccguuguuagaguccccaugaugagucgugaagaccaguaucacuaucuucuggacagaaaucuguccugcagagugguuggcgugccauaccaggguaacgcaacggcacuuuuuauccuuccgucugaaggcaaaaugcagcagguagagaacgggcugucggagaaaacacugaggaaauggcucaaaauguucaagaaacgccaacucgaacuguauuuaccuaaguucucuauugagggguccuaccagcuggaaaagguccugcccucccuaggaauuucaaaugucuucacuucccaugccgaccugucuggcauuaguaaucauucuaacauccaagucucagagaugguucauaaagcaguuguggagguugaugagagcggaacacgcgcugcugcugccaccgggacuauuuucacuuucagaucagcucgccugaauagccaacgucucguuuuuaacaggcccuuuuugauguucaucgucgauaauaauauucuauuucuuggaaaaguuaacaggcccuag

SEQ ID NO: 12150 - RNA, 1626 nt, Artificial Sequence
  Description of Artificial Sequence: Synthetic coding sequence
augaggcucucuccauuccaccugcagcuggaauuccauaugaaggagaaacgagaagaccugcagauaagcugguccuucauaagcgucccugagauggcugugaauauucaaccuaaggcacugggugaggaucagguggcagagaccucggcuaugagugauguucuaaaagacauacucaaacaccuagcaggcuccgcaagccccagcgucguacugauaacuaaaccgacaacugugaaagaggcucagaaucugcagugcgcagcuucuaccgcucaggagucuuguccucccaaaccgccccgagcccaugaacucaaguuacucguucgaaacauccaugugcuuuugcugucggagccaggagcgucuggccauauuaacgccgugugcgucguucagcucaacgauccuguacagcgcuuuagcaguacccucaccaaaaauacacccgaccugaugugggaggaggaguuuaccuucgaacucaaugcaaagucaaaggaacugcaccugcagauuuccgaagcagguaggucuucugaaggacuccucgcgacugcuaccgugccccuggauuuguuuaagaaacagccuucugguccccagaguuuuacccucacuagcggaagugccuguggaagcucaguucuuggcucagucacugccgaguucucguacauggaacccggugagcuuaaguccuggccuaucccccccccaguccccgcagccaagauugagaaagaucggacuguaaugccaugcggcaccgucgugaccaccguuaccgcuguaaagacuaaaccacgcguagacguuggccgcgcaucuccauugucuagcgauagccccgugaaaacacccauuaaagucaaaguuauugagaaggauaucagcguccaggccaucgccugucgaagcgcuccagucucaaaaacgcugagcucuucagauaccgagcuucuuguauugaacggcagugacccugucgccgagguugcuauccgccaguuauccgaauccagcaagcuaaagcucaagucaccacgcaagaaaucuaccaucaucauauccgggaucucuaaaaccucucuuagucaggaccaugacgcagcccugaugcagggguacacggcaucuguugacucuacucaccaggaggaugcuccaagucauccagaacgagccgccgcaagcgcgccaccagaggaggccgaaucagcacaggcuagucuggcccccaagccacaggaagacgaacuagauagcugggaccuggagaaggaaccacaggcugccgccuggagcagucagguucugcuugaucccgauggggacgagcucuccgaauccucuaugucgguccuugaaccgggaacagcuaaaaagcauaagggaggcaucuuacgcaagggcgcaaagcuguucuuccgaagaagacaucagcaaaaggaucccggcaugagucagagucacaacgaccuuguguucuuggagcagccggagggaucacggagaaaaggcauaaccuuaacgaggauccucaacaagaaacugcucagccggcaucgcaauaaaaauaccaugaauggugccccuguagagcccugcacuuag

SEQ ID NO: 12151 - RNA, 993 nt, Artificial Sequence
  Description of Artificial Sequence: Synthetic coding sequence
auggccuucuuaccaucuuggguaugcguguuaguuggcagcuuuagcgccuccuuggccggaacgaguaaucucagcgagacugagccaccccucuggaaggaaucacccggccagcugucagacuacagagucgagaacagcauguacauuauuaacccuuggguauauuuagagagaaugggaauguauaaaaucauucugaaucagaccgcccgguacuucgccaaauucgcacccgacaaugagcagaacauccuguggggccucccuuuacaauacggauggcaguaucgcaccggcagacucgcggacccgacccgucgcacuaauuguggauacgaaagcggggaucacaugugcaucagcguugacucguggugggccgaucucaauuauuuccucaguagccuuccauuccuggcugcuguugauucuggggugauggguauaaguagugaucagguucgucuccuucccccuccgaaaaacgagcggaaauucuguuaugacguguccagcugccgguccuccuuucccgaaacaaugaacaaguggaauacguucuaccaauaccuccagaguccguucucaaaauucgacgaucuccuuaaauaccucugggcagcucauacauccacucucgcugauaauauuaagaguuucgaagacagguacgacuauuacucuaaggccgaggcucacuuugagcggucgugggugcuagccguugaccaucuggcugccguacuguuucccacuacgcuuauacgcuccuauaaguuccagaaagggaugccuccaagaaucuuacucaacacagaugucgccccuuuuauauccgacuucacagcauuucagaaugucguccugguccuccugaacaugcuggauaauguggacaagucaauuggauaucuuugcaccgaaaaguccaauguuuaucgagaccauucggagucuucuucccgguccuacggaaacaacaguuag

SEQ ID NO: 12152 - RNA, 813 nt, Artificial Sequence
  Description of Artificial Sequence: Synthetic coding sequence
auggacagccuagaauggaacugggcucucguauaugaacuguccggcgaacaccacgacgaggaauggagugucaagacauaucaggaaguggcacagaaauuuguggagacccacccugaauuuaucggcaucaaaaucauauacucugaccaccgguccaaggaugucgccguuauugcugaaucuaucagaauggcuauggggcuuagaauaaaguuucccacaguggucgccggcuucgaccuggucggacacgaggacacgggccauucucuacacgacuacaaggaagcgcuaaugaucccagcaaaggauggagugaaacugccauacuucuuucaugccggcgagaccgacuggcagggaacaucaauugacaggaacauuuuagacgcucuuaugcugaauaccacucggaucggccacggcuuugccuuaucuaagcacccagcugugcgaacuuauucauggaagaaggacauucccauugaggucuguccgaucagcaaccagguacucaagcuugucuccgaccuccgcaaccaucccguagcaacauuaauggccacuggccacccuauggugaucagcagcgacgaucccgccauguucggggccaaaggacucucuuacgacuucuacgaaguuuucauggggaucgggggcaugaaagcugaucuuaggaccuugaaacagcucgcaaugaacagcaucaaauauucuacgcugcuggagagugaaaagaauacguuuauggagauuuggaagaagagaugggacaaauucaucgccgauguggcaacaaaguag

SEQ ID NO: 12153 - RNA, 939 nt, Artificial Sequence
  Description of Artificial Sequence: Synthetic coding sequence
auggguguaauggccaugcugaugcuuccgcugcugcugcuggggauuucuggucugcuuuuuaucuaccaggaaguguccaggcuguggaguaagucugccgugcagaauaagguugugguaauuaccgacgccaucagcgggcuuggcaaggagugcgcucguguguuccauaccgggggcgcacgccugguguugugugggaagaacugggagcggcuugagaaccucuaugaugcacuuauuucuguagcagacccuucuaagcagacuuucacgccaaaguuaguacuucuggaccuguccgacaucagcuguguccccgacguggcuaaggaaguacucgacugcuauggcugcguggauauucugaucaacaaugcaucugugaaagugaaagggccagcccauaagauuucgcuagaacuagacaagaagauuauggaugccaauuauuucggacccaucacacucaccaaagccuuauugccgaauaugauuucuagaagaaccggucagaucguucucguuaacaacauacaggguaaguucggaauuccauucagaaccacuuaugccgcaagcaagcacgcugcacuuggcuuuuucgacugccuuagggccgaggucgaagaguacgaugucguuaucaguacugucaguccuacuuucauacgcuccuaccacguuuaucccgaacaaggaaauugggaagccucaaucuggaaauuuuucuuccgcaagcucacguauggcguccacccuguugaaguggccgaggaagugaugagaacagugagacggaagaaacaagaggucuucauggccaauccaauucccaaagcugccguuuauguccggacuuuuuuccccgaauuuuucuuugcuguuguagcuuguggcguuaaagaaaaguugaaugugccagaggagggguag

SEQ ID NO: 12154 - RNA, 909 nt, Artificial Sequence
  Description of Artificial Sequence: Synthetic coding sequence
augcgcaggugggcuugggcagcaguuguuguucucuuagggccucagcuugugcugcuggguggugucggugcucgcagagaagcccaacguacccagcaacccggccagcgggcagacccuccuaaugcaacagcgucagcaucaucucgugaaggacuacccgaagcacccaagccgucacaggccaguggaccagaauucuccgaugcccacaugaccuggcuuaacuuuguucggagaccugacgacggcgcgcuuaggaaacgaugcggcagucgugacaagaaaccucgggaccuuuucggcccaccuggcccuccgggagcugagguaaccgccgaaacccuguugcacgaguuccaagaacuccugaaagaggccacagagagaagguucuccggucuucuggauccacugcugccacagggagcggguuuaaggcucguaggggaagccuuucacugucggcugcaaggucccagacgcgucgauaagcggaccuuggucgagcuucacggcuuccaggcaccagcugcccagggagcuuuucuccguggauccggccugucuuuggccaguggucgcuucacagcaccuguauccgggauauuccaauucagcgccucucugcacguugaucacagcgagcuccaaggaaaagccagacugcgcgcccgagaugucgugugugucuuaaucuguaucgagagccuuugucagcggcacacaugccucgaagccgugagcgggcuagagucaaacagcagagucuucacauuacagguucagggacugcuccagcuucaggccggacaguacgcaucuguguucguggauaaugguucgggugcagugcuaacuauacaagccggaucuaguuucucuggacucuugcuagguaccuag

SEQ ID NO: 12155 - RNA, 1416 nt, Artificial Sequence
  Description of Artificial Sequence: Synthetic coding sequence
auggauagcgcuccucuguuuccccgaccccaccuguuucagaaucucuuacuguuccucugggccuugcugaacugcggccucggugugagcgcccagggcccaggggaauggacgcccuggguuaguuggacucgaugcagcucuucuuguggcaggggugugucaguccgaagcaggcggugucugaggcugcccggagaggaaccuugcuggggggacagccacgaauaucgucugugucaacugcccgauuguccaccaggcgcuguuccuuuccgcgaccugcaaugcgcuuuguacaauggccgucccguuuuggggacucaaaagacauaccagugggugccuuuucacggcgcaccaaaucagugcgaccuuaauugccucgcagagggccacgcuuuuuaccauuccuucggaagaguucucgauggcaccgcuuguucacccggggcucagggcguaugcgucgcugggcgaugccugucugcugguugugauggacuauuaggaucuggagcacuggaagacagaugugggcgaugcgguggcgcaaacgacuccugucuguuuguucagcggguuuucagagaugccggagcuuucgcgggguacuggaacgugacccugauccccgaaggugcccgccacaucaggguugagcaucggagcaggaaccaccuggcgcugaugggcggagacgggagguauguucugaacggccacugggucgucagccccccaggaaccuacgaggcugcuggaacgcacguuguauauacacgugauacuggaccacaggaaacauugcaggcugccgggcccaccucucaugaucuucugcugcaggugcuauuacaggaaccuaaucccggcaucgaguucgaauuuugguugccucgcgaacguuacagcccuuuucaagcacgugugcaggcauuagguuggccucuuagacagccccagccacgcgguguggagccccagccccccgcggcccccgccgugacacccgcacagacaccaacccucgccccagacccuuguccccccuguccagauacacgggggcgagcccacagauuauugcacuacugcggcuccgauuucguuuuccaagccaggguccuaggacaucaccaccaggcacaggaaacccgguacgaagugaggauccagcugguuuauaagaaccggucaccacugcgagcucgugaguauguaugggcuccugggcauuguccuugucccaugcuugccccccacagagacuaccugauggcaguccagcgguuaguuagcccagacggaacucaggaucagcugcugcucccccacgcuggguacgccagaccuuggucuccggcagaagacuccagaauccgcuugaccgcuaggagaugccccggguag

SEQ ID NO: 12156 - RNA, 222 nt, Artificial Sequence
  Description of Artificial Sequence: Synthetic coding sequence
auggccccucagacauuacugcugguuuugguacugugugugcucuuauugcaagcccagggagguuauagagauaagaugaggaugcagcguauuaagguuugcgaaaaaagaccguccauugaucuauguauucaccauugcaguuacuuucagaagugugaaaccaacaagauaugcugcagcgccuucugugguaacauuugcauguccauucuguag

SEQ ID NO: 12157 - RNA, 2349 nt, Artificial Sequence
  Description of Artificial Sequence: Synthetic coding sequence
auggcacgggcccgggcaggcgcacuguuagcauugugggugcugggcgcugccgcucacccccagugucucgacuuccgaccaccauuccgccccacacagccauugcggcugugugcucaguacuccgacuuuggcugcugugaugagggacgcgaugccgaguugacucggagguucugggcccuggcuucccgcguagacgccgccgagugggcagccugugccggcuaugcccgugaccugcucugucaggaguguucuccauaugcugcccaccuuuacgaugcggaggaccccuucaccccacuccgcacagugccaggguuaugucaggauuacugccucgacauguggcauaaaugccgaggacuuuuccgccaccuguccaccgaucaggaauugugggcccuggaggggaacuuggcgagauuuugccgauauuugagucuggacgacacugacuacugcuucccuuauuugcuagugaauaaaaauuugaauuccaaucucgggcacguaguggcugaugccaaagguugccuucaacucugccuugaggagguggcaaacggccuccggaaccccguggcaaugguucaugcaagagacgggacucacagguucuucguggcagagcaagugggccuugugugggccuaccuccccgauagguccagacucggcaagccuuuuuugaacauuaguagaguggugcucacuagccccugggaaggugaugaacggggcuuccugggcauugcuuuucaccccucauuucagcacaaccgacgccuauacguuuacuacucgguagggaucagaucaagcgaauggaucagaauaucagaauuucgagugagcgaggaugaugaaaaugccgucgaucacucuucagaacggauaauacuagaggugaaagagcccgcgucuaaccacaacgggggacagcuguuguuuggcgaugacgguuaccuguacauuuucacuggagaugggggaauggcuggggaucccuucgggacuuucggcaaugcccagaauaagucagcucugcucggcaaggugcucaggaucgauguggacagaaaggagcgagggcucccauauggcauuccacccgauaacccguuugugggcgacccugccgcacaacccgaaguguaugcucugggcgugcgcaauauguggcggugcagcuucgacagaggagauccauccagcggaacaggcaggggaagauuguucuguggggaugugggccaaaacaaauucgaagaggucgacgugguugaacggggggggaauuacggcuggagagccagagaagguuucgaguguuacgauaggucacugugcgccaauaccagucuaaacgaucugcuccccauuuucgcuuauccacauaccgugggaaaaucagucaccggaggguacguuuacagagggugcgaguacccaaaccugaauggacuuuacaucuucggcgauuucaugucuggacgcuuaaugucacuccaagaaaacccuggaacuggccaauggcaguacuccgaaauuugcaugggccacgggcagaccugcgaguuuccuggucugauaaacaauuacuacccuuacauuaucuccuucggugaggaugaggccggcgagcuguauuuuauguccacuggggagccuuccgccacugccccaagaggaguugucuacaaaauaaucgacgcuuccagacgcgcuccgcccgguaaaugccagauccaaccagcucagguuaagauacguucaagacugauuccauucgugccaaaggagaaauuuauccccaaaacgagguccaccccccgacccacggcccgcgcgccuacuagagcaccgcggaggggcaggccuacugcagcccccccugcuccuaccccaaggccagccagaccgacgcagcaaccuggaagcaggcgaggcgggggccgacgcagaggccgauuaaacagugcgucuagggcuuuucgcgacggugaaguucgacuggugagaccagccggccucaguagcggauccggccgagucgaggucuucguggguggucggugggggacggucugugaugauucauggaauauuuccggggccgcagugguuuguaggcaacuggguuucgccuaugcaguccgagcagucaaacgcgccgaguuuggacagggugggagccugccgauccuacuugaugauguccgcugcgcaggaugggaaaggaaucuccuggagugucagcauaacggcguggguacccauaauugugagcacgaugaggaugcaggagugguauguagccaucagaaccccgaccuuuag

SEQ ID NO: 12158 - RNA, 1317 nt, Artificial Sequence
  Description of Artificial Sequence: Synthetic coding sequence
augcacccauugcccggguacuggucuuguuauugccuucugcuauuguuuucccuggggguccagggaucuuuaggugcccccucugcggccccagagcaggugcaucuauccuaccccggugagccagggucaaugacaguuacuuggacaacaugggucccuaccagauccgaaguucaauucggauugcagccaagugggccucugccucucagggcucagggaacauucgucccuuucguggacggcggcaucuugaggcgaaaguuguacauccauagagugacuuuacgcaagcuauugcccgguguacaguacgucuaucgcuguggguccgcccaggguuggucacgccgguucagauuccgugcccuaaagaauggagcccacugguccccgcgacuggcaguguuuggagauuuaggugccgacaaucccaaggcaguaccuagauuaaggagggacacccagcaggggauguacgaugcugugcugcacgugggagacuuugcauauaaucuggaucaagauaaugcucguguuggcgauagguuuaugcggcuuaucgaacccguugcagcuucauuaccguacaugacuugcccgggcaaucacgaggaaagauacaacuucagcaacuacaaggcccgcuucaguaugccaggagacaacgagggccugugguacagcugggauuugggccccgcccauaucaucuccuucuccacagagguuuauuuuuuucuucauuacgguaggcacuuggugcagaggcaauuccgguggcucgaaucagaucugcagaaagccaauaagaacagagcugcccggccuuggauaaucacaauggggcaccgcccaauguauuguaguaaugcugaucuggacgauuguacacggcaugagagcaaagugagaaaggggcuucaaggaaagcucuacggcuuagaggacuuguuuuauaaguacggcgucgaccugcagcugugggcgcaugaacacucuuacgaacgccuguggcccaucuacaacuaucagguauuuaacggaucacgggaaaugcccuauacuaaccccagaggaccagugcacaucauuaccggauccgcuggcugcgaggaaagacugacgccuuucgcgguguucccucgcccauggagcgccguacguguuaaggaguacgguuauacccgucugcacauccugaacgguacccacauucacauucagcagguuucggacgaucaggacgguaagaucguggacgacgucuggguggugcgaccacuuuucggccgacggauguauuuguag

SEQ ID NO: 12159 - RNA, 411 nt, Artificial Sequence
  Description of Artificial Sequence: Synthetic coding sequence
auggcucggacaaaacaaacagcgcguaagucaacaggcggaaaagcuccuagaaagcaguuggcuacaaaagcugcccgaaagagcgcuccagcaacggggggugugaagaaaccacauagauauagaccgggaacaguggcccugcgcgagauuagacgguaucagaaaaguaccgagcuauugauaagaaaguugccauuucagagacuugugcgagagauugcucaagauuucaaaaccgaccugcgguuccaaucuagcgcggugauggcccuccaggaagccagugaagcauaucuugugggccuguucgaggauacaaaucucugcgcuauccaugccaaaagagucaccauuaugccgaaggacauucaguuggcucgcagaaucagaggggaacgggcauag

SEQ ID NO: 12160 - RNA, 1209 nt, Artificial Sequence
  Description of Artificial Sequence: Synthetic coding sequence
auggcugccaggcccggcccucuguggcuucugggauugacacugugcgcucugggaggaggcggcccagggcuccgacccccaccaggauguccucagcgccgauugggggccagggaacggagagacgugcagagggagauccuggccguccuggggcucccuggccgccccagaccgagggccccuccugccgccucacgguuaccugcgagcgcacccuuguucaugcucgaucuguaccaugccauggccggcgacgaugaugaggauggagcccccgcugaacagagacugggccgagcugaucugguaauguccuuugugaacaugguagagagagacagggcccugggccaccaggaaccucacuggaaggaauuucgcuucgaucuuacgcagauacccgcuggagaggccgucaccgcugccgaauuccggauuuauaaaguccccucuauccaccuccuuaaucggacacugcacgugaguauguuccagguggugcaagaacagucaaauagagagagcgacuuguucuuccucgacuuacagacacuuagagcaggcgacgaaggaugguuagugcucgauguaacggccgcuuccgauugcuggcuccucaaaagacauaaggaccucgggcuuagauuauacguugaaaccgaagacggccacagcgucgacccuggucucgccggucugcucggccagcgugccccccgaagucagcagccauuuguggugacuuuuuuccgagcuuccccuaguccuauccggaccccaagagcagugcggcccuugcgccgacgccaaccaaagaaaucaaaugaauugccccaggcaaacagacuuccgggcauuuuugaugauguacgggguucccacggucggcaggugugucggaggcaugagcucuacguuucuuuccaggaucugggauggcuggauugggugaucgcuccacagggguauuccgccuauuauugugaaggcgagugcaguuuuccauuggacucuuguaugaacgccaccaaccacgcuaucuugcagucuuugguccaucucaugaaaccaaaugcaguucccaaagccugcugcgcccccacaaaacugagcgccacaucugugcuauauuaugacucuucaaauaacgugauccuuaggaagcacaggaacaugguggugaaagccugcggcugucacuag

SEQ ID NO: 12161 - RNA, 957 nt, Artificial Sequence
  Description of Artificial Sequence: Synthetic coding sequence
auggcggccgccgcuuuacccccuaggccccuucugcuccugccucucguccuuuuacucucaggacggccaaccagggcggauagcaaaguuuuuggagaccuggaccagguaagaaugacuuccgaaggcucugacugucgcugcaaauguaucaugagaccccugucaaaggaugccugcucaagagugcgaucaggacgagcaagaguggaagauuucuauacuguggaaacggugucuucaggcacggacugccgaugcagcugcaccgcuccuccauccagucuuaaccccugcgagaaugaguggaaaauggaaaaguuaaaaaagcaggcucccgaacuccuuaagucuaucaaggccaaccugucccgggagaaugagguggucaaagauuccgugagacaccuuucagaacagcugcgacacuaugaaaaucauuccgccauuaugcugggcauaaaaaaggagcugaguagacucggccuucagcuauuacagaaggacgcugcugcugccccugcaacuccagccacagggacagguucuaaagcucaagauacagcacguggcaaagggaaggauauaucuaaauauggaucgguccagaagucuuuugcugaucgcgguuugccaaagccccccaaagagaaacuucuucaggucgagaagcugcgcaaggagagcggaaaagguuccuuucuucagccuacagcaaaaccacgagcacuugcacagcagcaagcugugauccgaggcuucaccuacuacaaggcuggcaagcaagaggugacagaggcagucgcggacaauacccugcaggguacuucaugguuagagcagcugcccccuaaagucgaggggcgaucaaauagcgcagagccuaacagugcagagcaagacgaggccgagcccaggucuucagagagggucgaucucgccuccggaacuuag

SEQ ID NO: 12162 - RNA, 402 nt, Artificial Sequence
  Description of Artificial Sequence: Synthetic coding sequence
auggcccugggagucccuaucuccguguaucuccuguucaacgcgaugacugcauuaacugaggaagcagcggucacugucacgccaccuaucacugcucaacaagccgauaacaucgaagggccuaucgcacucaaauucagccaccugugucucgaggaucacaauuccuacugcaucaacggggcuugcgccuuccaccacgaacuggaaaaggccaucuguagauguuuuacaggcuacaccggcgagcggugugaacacuugacacucaccuccuacgccguugauagcuacgagaaauacauugcgaucggcauugguguuggucuucuucugaguggcuuucugguuaucuucuacugcuacauaagaaaacgauacgaaaaagauaaaaucuag

SEQ ID NO: 12163 - RNA, 651 nt, Artificial Sequence
  Description of Artificial Sequence: Synthetic coding sequence
augucuucagaagccgagacgcagcaaccccccgcagcgccuccggcugcccccgcacuuuccgccgccgacacaaagccagggaccacugggagcggcgccggguccggaggaccugggggauugacauccgcggccccagcagggggugauaaaaaagucauugccaccaagguucuaggaacgguuaagugguucaacgucaggaauggcuauggcuuuaucaaucgaaaugauacaaaggaagacguguuuguacaucaaggcgcugaggccgcgaaugugacugggccaggaggagugccagugcaaggcagcaaauacgcagcggacagaaaucauuaccggagauauccacgucguagagguccuccuagaaauuaucagcagaacuaucagaauuccgaguccggggaaaagaacgaaggaucugaaucugcaccugagggacaggcucagcaaagaaggcccuauagaagaagacgguuuccucccuauuacaugaggcgaccauacggaagaagaccucaauacagcaacccacccguucaaggugaggugauggaaggagccgauaaucagggcgcgggagaacaggggagacccgucagacaaaacauguaccgcgguuacagaccacgauucagauag

SEQ ID NO: 12164 - RNA, 756 nt, Artificial Sequence
  Description of Artificial Sequence: Synthetic coding sequence
aacgacuggucggcggaucaacuuuaucuggagacgaccggaaagucacgcacacugcagucgggacuagcacugcuguacggcuuucugcccgauuucgauuggaagaagaucuauuucagacaucaaccaucugccuuauuuuguucaggcaguugcuauugccccguuagaaaucaguaucucgaaaaggaacagcguaggcaguaucuguugagacugaaaaauucucagcuagaaaagaccuacggcgaaauggcgaagauugucgaugucccuaccaaacaauuacgugcagcgaauccuauagacagcaugcugugucauuucugucacaaugugagcuucccguguaccagaaacggguguguagauauggaacacuucaaggucaucaagacucaccagauagaagacgagagggaacgcagagagaaaaaacuuuauuuugguuacagucugcugggcgcacaccccauacugaaucaaacuauaggccgcaugcagagagccacugaagggcgcaaggaagagcuguuugcacuauauagcgcccacgacgugacacugagcccuguucucuccgcucucggccucucagaggcccgcuuuccucgcuuugccgcaagaguaaauauaccauccggcuuuuucaccauggcuagcaugucgcacucuaccccucuaucagcuaaaacaacuacaaguguuuugccuucucccugcgccagacuuaagacuuggucagcauuauag

SEQ ID NO: 12165 - RNA, 576 nt, Artificial Sequence
  Description of Artificial Sequence: Synthetic coding sequence
auggccgccccaagagguagagcggccccauggaccacagcucugcugcuguugcuggccucacaggugcugaguccaggcagcugcgccgaugaggaggagguuccagaggaaugggugcucuuacaugucguucagggccagaucggagccggcaauuauuccuaccucagguugaaccacgaggguaagaucguacuccggaugagaucccucaaaggagacgccgaccuguauguaagcgcaucaucacuucaucccucguucgacgacuacgagcugcagucugccacaugcggcccagacgccguaucuauuccugcgcauuuucgccgaccaguuggcaucggaguauacggacauccuagccaucuugaauccgaguuugaaaugaaaguuuauuacgacggcaccguagaacaacacccauucggcgaggcagccuauccagccgacggcgccgaugcaggacaaaagcacgccggcgcuccagaagacgcaucccaggaggaagagucugugcuguggacgauccuuaucaguauccugaaacuggugcuggaaauccucuuuuag

SEQ ID NO: 12166 - RNA, 2301 nt, Artificial Sequence
  Description of Artificial Sequence: Synthetic coding sequence
augggcaggagacgguuguuaguaugguugugcgccguagccgcccuccuuagcggcgcccaagccaggggaacaccguuacuggcuagaccugccccccccggcgccuccagauacagccucuacacaaccggcuggagaccuaggcucagaccaggcccucauaaggcccuaugcgcuuauguggugcaucggaaugugacauguauucuccaggagggagccgagucauaugucaaagcagaguacagacaauguagauggggcccgaagugcccuggaacagugacuuacaggaccguccugaggccuaaguauaagguugguuauaagacggugacagacuuggcuuggcgcugcugccccggcuuuaccgggaagcgaugcccagaacaccugacagaucauggcgcagcaaguccacaguuagaaccugaaccgcagaucccaucgggccaacucgaucccggaccuagaccgcccaguuacucccgagcugcacccucuccgcacggaagaaaggguccuggccuguuuggagagagacuugaaagacuggaaggagacguccagaggcuggcgcaaacauaugggacccucuccgggcugguggcaucccacgaggacccuaaccggaugacuggcggaccucgggcucccgccgugccugucggguuuggugugauuccugaagggcucgugggaccgggagaucgugcaagagguccguuaacaccaccucucgaugaaauacuguccaaggugacagagguuucuaauacucugcagaccaaagugcagcuccuagauaagguacauggacuggcgcuaggccacgaagcacaccuucaaaggcuccgcgaggcgccgccuuccccccuuaccucgcucgcccuccuugaggaauacguagauagacgacuucaccgccuguggggcagcuugcuggauggauucgaacaaaagcugcagggcguccagagcgagugugaccugcggguucaggaggugcggagacagugugaggaagggcaagccgcuucacgacggcuccaucaaagccuggacggcagagagcuggcuuuacgccaggaacugucccagcuggggagccaacuccaggguuuaagugucaguggaagggguucaugcuguggccagcuggcccugauuaacgcuaggauggauggucuggagagagcccugcaagccgugacugagacacagcguggccccggcgcaccggccggcgacgagcucacucgccucuccgcggcaauguuggaaggcgguguggauggucuccucgagggccuggaaacgcugaauggaacugaagggggagccagagguuguugucugagacucgauaugggcgguuggggggucggcgguuuuggcaccaugcuagaagaacgagugcagucacuggaggagaggcuagcaacacuagccggcgagcugagccacgacagugccucuccaggcagauccgcccggccacuuguccagacggagcuagcuguccuggaacagcggcuagugagccucgaaaccagcuguacaccuagcacgaccucugcaauauuagacagccuuguagcugaaguuaaggcauggcagucucggucagaagcacucuuaaggcagguggcaucccacgcugcauuacugcagcagcugaacgguacugucgccgaagugcagggucaguuagcggagggcacuggaaguucuuugcagggggaaaucacacuacucaaagugaaucugaauagcguuucgaagagucucacaggccugagcgacagugugucccaauauagcgacgccuuccuugcagcuaacacuucucuggacgaacgcgagagaaagguagaggcggaaguacaggcaauccaggagcagguaucuucgcaaggcucacgguuacaagccggucauagacagguucucaaccuuaggggugagcucgaacagcucaaagcuggggucgcuaagguggccuccggauugagccguugucaggacacagcacagaagcuacagcacacgguugggcacuucgaccagagaguggcacaggucgagggcgccuguagacggcuaggguugcuugcagcagggcuugauucuuuacccaccgaaccgcugcgaccgcgcgagggcuuauggucacauguggaccagcucaauaggacccuggcgcaacacacccaggauaucgcuaggcugcgggacgaucuuuuagauugccaagcccaguuggccgaacaggugcgucccggucaggcaaacuag

SEQ ID NO: 12167 - RNA, 1251 nt, Artificial Sequence
  Description of Artificial Sequence: Synthetic coding sequence
auguauagacaugggaucucuucacagcgcuccuggcccuuguggaccacaauauuuauuuucuuagggguggcagcuauucucggugugaccauuggacuccucguucauuuccuugcaguggaaaagacauacuauuaccagggagacuuucacaucuccggagugaccuauaacgauaacugcgaaaacgcugcuagccaggccucuacaaaccuuucaaaagauaucgagacuaaaaugcugaacgcauuccagaauucaaguauauacaaagaguacgugaagucagaagugaucaagcugcuccccaaugccaacgguucaaacgugcaacuucaacugaaguucaaauucccaccugccgaaggggucuccaugaggaccaaaauuaaagcgaaacugcaucagauguuaaagaacaauauggcaagcuggaacgccgucccugcgucuaucaagcuuauggaaauuagcaaggccgcaucugagaugcuuacaaauaacuguuguggacggcaggucgccaauucuaucauuaccggaaacaagauagugaacggcaagagcucccucgagggggccuggccuuggcaggccucaaugcaguggaaaggcaggcauuacugcggagcaucucucauuucaucuagauggcuucucuccgccgcucacugcuuugccaagaagaacaacagcaaggauuggaccgucaauuucgguauuguugucaauaagcccuacaugacacguaaaguccaaaacaucauuuuucacgaaaacuauucuucaccgggccuccaugacgauaucgcccuaguucagcuagcugaagagguuuccuucaccgaguauauccguaagauuugucugcccgaagcuaaaaugaagcucagcgaaaacgauaacguugucgucaccggcuggggaacccuguauaugaauggcucauuuccaguaauucugcaggaggacuuucugaaaaucauagacaacaagauuugcaaugcuucuuacgccuacucaggauucguuacggacacaauguugugugcaggcuucauguccggggaggcugaugccugccagaaugacagcggcggaccucuggcguacccugacucccgcaacaucuggcaccuuguuggaauuguauccuggggugacgggugcggaaaaaagaauaagcccggcguuuacacacgcgugacuaguuaucgaaacuggauaacuuccaagacaggacuuuag

SEQ ID NO: 12168 - RNA, 639 nt, Artificial Sequence
  Description of Artificial Sequence: Synthetic coding sequence
augcugucauccgucguauucugggggcugaucgcuuuaaucgggaccagccguggaucuuacccuuuuucacacagcaugaagccucaucuucacccaagguuguaucauggcuguuauggagacauuaugacuaugaagacuucuggugccaccugcgaugcuaacagcguaaugaauugcgguauuagaggcucugaaauguuugccgaaauggacuugcgcgccaucaaaccguaucagacucugaucaaagagguaggccaacgucacuguguggacccggcagugauugcagcuauuauuucuagagagucacaugguggcagcgugcugcaggauggaugggaccaccgaggacugaaguucggcuugaugcagcucgauaaacagaccuaccacccuguaggagccugggacagcaaggaacaccucucgcaggccacuggaauucugacugaaagaaucaaggccauccagaaaaaauuccccaccuggucugucgcccaacaucugaagggcggccuuagcgccuucaagucuggaaucgaagccauugcaacaccaucugauaucgacaacgauuucguuaacgauaucaucgcccgagcaaaguuuuauaagagacagagcuuuuag

SEQ ID NO: 12169 - RNA, 378 nt, Artificial Sequence
  Description of Artificial Sequence: Synthetic coding sequence
auggcccgaucagcuacacuggccgcggcggcccuagcgcuuugucugcuccuggcaccucccggacuggcaugguauaaaccagccgcaggccacaguuccuacagcguagguagagccgccggacugcugucuggacuucgucguuccccauacgcccgcaggagucaaccguaccgcggagcagaaccaccugggggcgccggcgcuuccccugaauuacagcugcacccacgauuacgcucucucgcugugugcguucaggacguggcgccuaaucuucaaagaugcgagcgacugcccgauggccgugguacuuaucaaugcaaagccaacguuuuccugucacugagagcagcagauugccuagccgccuag

SEQ ID NO: 12170 - RNA, 867 nt, Artificial Sequence
  Description of Artificial Sequence: Synthetic coding sequence
augaauaaucugucauuuagugaacuuugcugccuguuuuguugucccccuugcccuggcaaaaucgcuagcaagcucgccuuuuuacccccggauccaaccuauacccugaugugugaugagucugguaguagauggacccuccaccuuucugaaagagcggacuggcaauacuccucuagagaaaaagaugccauagagugcuuuaugacccgaacaucuaaagggaaucggauugccugcauguucguuagauguagucccaacgccaaauacacccuacuguucagccacggcaacgcaguggaucugggccaaaugagcagcuuuuacaucggccuaggaucaagaaucaauuguaauauuuucuccuacgacuauuccgguuacggcgcuuccagcggaaaaccuaccgaaaagaaccuuuacgccgacauugaggccgcuuggcuggcgcucagaacacguuacgggaucaggcccgagaacgugaucauuuauggacaguccaucgguacgguaccauccguggaucuagcagcuagguacgagucugcugccgugauccuacacagcccacucaccucaggcaugcgaguggccuuccccgauacuaagaagacauauuguuucgaugcauuuccgaacauugacaaaaucucuaagauaacuagccccguccugauuauucacggcaccgaggaugaggugauugauuuuagccacggucuggcucuguucgaaaggugucagcguccaguggaaccuuuguggguggagggagcuggacauaacgacguggaacuguacgggcaauaucuggaaagacugaaacaguucguuagccaggagcucgugaaccuguag

SEQ ID NO: 12171 - RNA, 417 nt, Artificial Sequence
  Description of Artificial Sequence: Synthetic coding sequence
augguugcacccgcugcuagaguguuucugagagcaguuagagcagcuuuaacaucuaccgugccagaucugcucugucuacuggcuagaggcucucccaggggcuuagcaucggggcgguuaccgcuugcgguacacucggcacagcacggacccggaucaggugccccuuggcuuagaauugcgaggagagcacugcgcuucguacugucgaaacacuggggcgacgacugcuaccuuacgaaucgccuguggcaggauuugaaacccccaucucacguggagaauggucaggagcugcgguuggcccccccgguacagugggcucuucagguccagggcaaccagcugcaaacggcuguccuuugucucagaauggcaccucccgaacccgcuggcucaagacagagaaucuag

SEQ ID NO: 12172 - RNA, 1332 nt, Artificial Sequence
  Description of Artificial Sequence: Synthetic coding sequence
augggaggcccaagggcuugggcacuguugugccugggucuccuacuaccaggcggcggcgcagcaugguccauuggagccgcaccauucucaggucgaagaaacuggugcucauaugucgugacgaggaccaucucuugccaugugcagaacggaaccuaccuccagaggguucugcagaauugucccuggccuaugucaugcccgggguccagcuacagaaccgugguuaggcccacuuacaaagugauguacaaaauuguuaccgccagagaauggcgauguugucccgggcacagcgggguguccugcgaagaaguggcugccaguagugcuucccuugagcccauguggucuggaucaacaaugcggcgaauggcccugcgcccaacagcauuuucaggaugucugaacugcucaaaggugagcgagcugaccgaacggcucaaaguccucgaagccaagaugacuaugcuaacagucaucgagcagcccgucccucccacaccugccacucccgaagaccccgcgccacuaugggggccaccucccgcacaagggucgccaggugauggcgggcuccaggaccaggugggcgcauggggucuccccggaccaacgggcccuaagggggacgcugguagucgcggcccuaugggcaugaggggcccaccuggcccccagggacccccugggagcccuggaagggcuggggcugugggcaccccaggcgaaagagguccaccuggccccccagguccuccugggcccccagggccccccgcgccagucgggcccccgcaugcucguaucucccagcacggggauccauuacugucaaacaccuucacugaaaccaauaaucacuggccacaggguccuacuggcccccccgguccgccaggacccaugggcccaccggggccucccggcccgacuggcgugccaggaucaccaggccauaucggccccccaggaccuacuggaccuaaagggauuuccgggcauccaggagagaaaggagaaaggggcuugcggggggaacccggcccucagggcagugcagggcagcguggagagcccggaccaaaaggagaucccggugaaaagucccauuggggcgagggacugcaccaacuccgugaagcacugaagauucuagccgagcggguccugauucuagagacuaugauugggcuguaugagccagaacucggcagcggagccgguccagcagggacaggaaccccaucauugcugcgagguaaaaggggcggacacgcgacuaauuacagaaucguggcaccaaggucgcgcgaugagagagguuag

SEQ ID NO: 12173 - RNA, 717 nt, Artificial Sequence
  Description of Artificial Sequence: Synthetic coding sequence
augguacuacugcugcuggucgccauuccgcugcuggugcauaguucacgcggacccgcccauuacgagaugcucggucggugcaggauggugugugacccgcacggacccaggggaccugguccagacggagcaccugcuuccgugccuccuuuuccuccuggcgccaagggcgaaguaggcaggagagguaaagccggacuucgaggcccuccaggaccuccggggccacgaggaccuccgggagagccaggaaggccggggccaccagguccacccgguccaggcccaggaggaguugcuccagcagcaggguauguucccagaauugccuucuacgccggccuaaggaggccacacgagggcuacgagguucucagguucgaugacguggucacuaacguugggaacgccuacgaagccgcuagcgggaaauucacaugcccuaugccugguguauacuuuuucgccuaccacguguuaaugaggggaggggauggaacaucaaugugggcagaucugaugaagaauggacaggugcgcgcuucagcuauugcacaagacgccgaucagaacuaugauuacgccagcaacucaguaaucuugcaucuggauguaggggacgaaguguucauuaaacucgaugguggaaagguucacggaggaaacacaaacaaauauagcaccuuuaguggguuuaucaucuaccccgauuag

SEQ ID NO: 12174 - RNA, 282 nt, Artificial Sequence
  Description of Artificial Sequence: Synthetic coding sequence
augaagcucuuucuaguuuuaauaaucuugcuguuugaagucuuaacugauggagcacggcugaagaaauguuuuaauaaaguaaccggauacugcaggaaaaaguguaagguaggugaacgcuaugagauuggaugccucagcggaaagcugugcugcgcaaaugacgaagaggaaaagaaacauguuucuuucaaaaaaccccaucaacauagcggcgaaaaguugaguguacuucaggacuauauuauccugccaacaaucacgauuuuuaccguguag

SEQ ID NO: 12175 - RNA, 609 nt, Artificial Sequence
  Description of Artificial Sequence: Synthetic coding sequence
augguuaggauuuggaccacuaucaugauuguccugauucuccuguuaagaauuggcccuaauaagcccucccucaguggaagacaagccccagcucaagcacagacauccgaucuuguaccuucucucuucccacucggguuaugggcacccggguuuuguaccuggucuagcccggaugaggacaaaguguggagaccggcuugggagcagggaccuaaaggugagccggacccaagaggacugcggcccagaaaacccgucccuggaacaggaaaccgcgacagcgggacccggcggcggcugcaggacgccacagagcaagacccacgcccuggaaacgacgucgcaucugcugaaaccgccgggccccccucccccuccggaauuagagcacaggaccgcgcgccccggcaccgccgagcacccccagcccgaaugccaguggccccagcgccuucagccgauggugagccccuccaggaacaaggcggcggacucuuucacaggacucgguccgucuacaaugguuuagagcugaacacuuggaugaagguugagcgguuauucguggagaaguuucaccaaucauuuagccuugacaauuag

SEQ ID NO: 12176 - RNA, 342 nt, Artificial Sequence
  Description of Artificial Sequence: Synthetic coding sequence
augcugcccugcuuagcucuacugcugcugauggaacugucugugugcacaguggccggugaugggggcgaagaacagacucugagcacugaggcagagacgugggugauuguggcccuagaagaaggagcaggaccuucaauucagcuccagcuccaggaagucaagacaggaaaagcaucucaguuuuuuggacucaugggcaagagagugggggggaggccacuaauucagccuaggcgcaaaaaggcauaucagcuugaacauacuuuucagggauugcugggcaaaagaucccuguuuacggaagggagagaggaugaagcacagggauccgaauag

SEQ ID NO: 12177 - RNA, 1269 nt, Artificial Sequence
  Description of Artificial Sequence: Synthetic coding sequence
auggggcccgccugguugugguuacugggaacugggauccuugccagcguacacugucagccacuucuggcucacggagauaaaucauuacaagggccacaacccccuaggcaccagcucucugaaccagcccccgccuaccauaggauaacacccacaauuacaaauuuugccuuacgccucuauaaagaacucgcagcugacgcacccgguaauauauucuucagcccuguaaguaucucaacuacucuugcauuguuaagucuuggggcccaggcgaauaccuccgcgcucauccuggaaggacucggcuuuaaccuuaccgaaacccccgaagcggauauccaccagggcuuccgaucucugcuacacacucucgcccuuccuucccccaagcuugaguugaaaguggguaacagccuguuccuagauaagcgucugaaaccacggcaacauuacuuggauucaaucaaagagcuguauggugccuuugcauucagugccaauuucacggauuccgucacuacggggcgccagauuaacgacuaccugagacgccagacauauggccagguaguugauugcuugcccgaguuuucccaggacaccuucauggugcuggcuaauuacaucuucuucaaagcgaaguggaaacauccuuuuucuagguaucaaacccaaaagcaggaaagcuucuuuguggacgagcgcacaucucugcaggugccuaugaugcaucaaaaggaaaugcacagguuucuguacgaccaagaccuagccuguaccgugcugcagaucgaguauagagggaacgcccuggcacuccuggugcucccugaccccgggaaaaugaaacagguggaagcugcccugcaaccucaaacccucaggaaauggggacaacucuugcugccgucacuccuugaucuucacuuaccucgguuuucaaucucagggaccuauaaccuggaggacauucugccacagaucgggcugacuaauauucuaaaccucgaagcugauuuuucuggagucaccggccagcucaacaagaccauuagcaaaguaagccacaaagccaugguugauaugagugaaaagggcaccgaggcaggggcugcauccggauugcuaucccaaccuccaagccugaauaccaugagugauccacacgcucacuucaacaggccuuuucuccuucuucucugggagguuaccacccaaagccuccuuuuccugggcaagguugugaauccgguggcuggguag

SEQ ID NO: 12178 - RNA, 237 nt, Artificial Sequence
  Description of Artificial Sequence: Synthetic coding sequence
auggcccugauuaggaaaaccuuuuauuuucuuuuugccauguuuuucauccucguucagcuccccagcgggugccaagcaggacuggacuucucacaaccguuuccuucaggagaauucgccgucugcgagucuugcaaacucggucgcgggaaaugcaggaaggaguguuuagaaaaugaaaaaccagauggaaacugcagacugaacuuccugugcuguagacaacgaauuuag

SEQ ID NO: 12179 - RNA, 2139 nt, Artificial Sequence
  Description of Artificial Sequence: Synthetic coding sequence
auggcugccgcugggcucguagcugucgcugccgcagcugaguacuccggcaccguggcuagcgggggcaauuugccuggcguacacugcgggccuaguagcggcgcuggucccggguucgggccaggcucuuggucccgcucucuagaucgugccuuggaagaggcagcugucacuggggugcuaagccuuucgggccggaagcugcgggaauucccacgcggcgcugcuaaucacgaucuuacagacaccacacgcgcugaccugucuagaaaccgccugucugagaucccaaucgaggccugucacuuugucagccuagagaaccugaaccuuuaucaaaacuguauccgcuacaucccggaggcgauccugaaucuccaggcccuaacauuucucaauaucagucggaaucaguuaucaacacugccuguccaucugugcaaccugccacuuaagguuuugaucgccagcaauaacaagcuuguuagcuugcccgaagagaucggacacuugcgucaccuuauggaguuagacguuagcuguaacgaaauccagacuauuccuucccagaucggcaaccucgaagcucuuagggacuugaacgugcgucgcaaccaccugguucaccucccugaggaacucgcagaacucccacuuauccgauuggacuucaguugcaacaaaauuaccaccaucccuguauguuacaggaaucugaggcaucugcaaacgauuacacuggacaacaauccacuccaauccccuccugcacaaauuuguauuaaaggcaagguucacauuuuuaaauaucuuaacauccaggcguguaaaaucgcgcccgacuugcccgacuacgacagaaggccuuuagguuuuggaucuugucacgaggaacucuauagcucaaggccuuacggcgcucuggauuccggcuuuaauucuguggauucuggagauaagcguuggagcgguaaugagccaaccgacgaauucucagaucuucccuuacggguggcggaaauuacuaaagaacagaggcuacgucgcgaaucacaguaccaagagaauagaggaucgcucguggucaccaauggcggcguugagcaugauuuagaccagauugauuauauugauucuuguaccgccgaggaggaggaagccgaagucagacagcccaaggggcccgauccagacagccucagcagucaguucauggcuuauauugaacaaagacguauuagccacgaaggguccccagugaaacccguggcaauccgagaguuccaaaagaccgaagauaugcggagguauuuacaucagaaccgcgugccugcagaaccaagcagccuuuugucucugucagcaucacacaaucaauugagccacaccgacuuggaacuccaccaaaggagggagcaacugguggagcguacccggcgcgaagcccagcuggccgcccugcaguacgaagaggaaaagauuaggaccaaacaaauucaacgggacgccguccuggacuucguaaaacagaaagcuagucagucuccccaaaagcagcauccccugcuagaugguguugauggcgaaugcccuuuccccucucgucgaucccaacacaccgacgauagugcuuuaugcaugucccugagcggucugaaucagguggggugugcugccacucuaccccauagcuccgcuuucacaccucugaagucugaugaucggccuaaugcccugcugagcagcccggccaccgaaacaguccaucauaguccagcauauuccuucccugccgcaauccagagaaaccagccucagagaccggagucuuuccucuuucgggcggggguucgcgcugaaacaaacaaaggccacgccuccccucucccacccuccgccgcucccaccaccgauuccaccgauucaaucacuggccaaaauagccggcagagagaggaagaacucgagcuuauugaccaacugaggaagcauaucgaguaucgacugaaagucucccucccuugcgauuuaggcgcugcguugacagacggagugguucuuugucaccuagccaaccacgugcgaccaaggagcguuccuaguauucacgugccuucuccugcuguggugucuuag

SEQ ID NO: 12180 - RNA, 213 nt, Artificial Sequence
  Description of Artificial Sequence: Synthetic coding sequence
augcgcguacuuuuuuuuguguucgguguucugagcuuaauguuuacugugccacccgcucgcucuuucaucucuaacgacgaaugcccuucugaauauuaccacugucgucucaaguguaacgcugaugagcacgccaucagauauugugcugacuuuaguaucuguuguaagcuuaaaaucaucgagauagacggccagaaaaaaugguag

SEQ ID NO: 12181 - RNA, 789 nt, Artificial Sequence
  Description of Artificial Sequence: Synthetic coding sequence
auggcagcagcaucagcaggggcuacccggcugcuacuacuccuucuaauggcgguugccgcuccaaguagagcucgaggaagcggaugccgagccgggaccggggcccggggcgcaggagccgaaggucgugagggcgaggcuugugggacagucggguugcuccuggaacauaguuuugagaucgacgauagcgcuaauuucaggaaaagagggucccuacuguggaaucagcaggaugguacgcugucccucagccaaagacagcugucugaagaggaacggggcaggcuccgggacguagcugccuugaaugggcuauacagaguuaggauuccaaggcgacccggugcacuggacggucuagaggccggagguuaugugagcagcuucgucccugcuugcucgcugguggagucgcaccucucggaccagcuuacccuucauguagacguagcugggaauguagugggcguuagcgugguuacccaccccggggguugccgagggcaugaaguugaggauguugaccuugaacuguuuaauacaucaguacaauugcaaccacccacgacagcucccggccccgaaacugccgcguuuauagaaagauuggaaauggaacaggcacagaaggccaagaacccacaagaacagaagagcuuuuuugccaaauauuggauguacaucaucccuguuguucuuuuucugaugaugaguggagcgccagauacaggcgggcaaggcggcggcggcgguggcggcggggguggggggucagggcgguag

SEQ ID NO: 12182 - RNA, 150 nt, Artificial Sequence
  Description of Artificial Sequence: Synthetic coding sequence
auggacucuucucgagaaccuacccuggggcgccuggaugcugcggguuuuuggcaaguguggcaacgguucgacgcagacggccacgggcaugagagcaaguucgcccaaggagagaccgcuguauaugauuaucccagaugcuuguag

SEQ ID NO: 12183 - RNA, 213 nt, Artificial Sequence
  Description of Artificial Sequence: Synthetic coding sequence
augccuggcgcgaugaaaaucuuugucuucauccuggcugcccucaucuugcucgcacaaauuuuccaggcccgcaccgcuauacauagagcccucauuaguaaaaggauggaaggccacugcgaagccgagugucucaccuucgaagugaaaaucggcggaugucgagcagaacucgccccauucugcuguaagaaccggaagaaacacuag

SEQ ID NO: 12184 - RNA, 711 nt, Artificial Sequence
  Description of Artificial Sequence: Synthetic coding sequence
augaugccagccgaacguaggcucccacucucuuuuguucuugacguccuggagggacgugcccaacaucccggugugcuuuauguacaaaaacaguguucuaaucugcccuccgagcuuccccagcuccuaccggaccuugagucucaugucccaugggccucugaggcucugggcaagaugccugaugcuguuaacuucuggcugggcgaagccgccgcugugaccucacugcacaaagaucauuacgaaaaccucuauugcgucguuucaggcgagaagcauuuucucuuccacccaccuucggaccgcccauucaucccauacggacugagggucccaggaugccugcaauucccucauacccugcugcccugggccccagaauuguacacuccugcaacuuaucagcugaccgaagaagggacguucaaaguggucgaugaagaagcaauggaaaaaguaccauggaucccuuuggacccacuugcccccgaucuagcccgcuauccauccuauucacaagcacaagccuuaagauguaccguuagggccggcgagaugcuguaccuaccagcacucugguuccaucauguucagcagucucaaggcugcaucgccgucaacuucugguaugacauggaguacgaccucaaguacucuuacuuucaguuauuggauagcuuaaccaaagccucuggguuagacuag

SEQ ID NO: 12185 - RNA, 1098 nt, Artificial Sequence
  Description of Artificial Sequence: Synthetic coding sequence
auggccccuaaacugaucacuguucucugccuuggcuuuugucucaaucagaagauuugcccucacgcaggagcccaagauaaguuuucucuuagcgcuuggccaagucccguggucccacuagggggucgcgugacccucucaugucauucucacuugagguucgucauuuggaccaucuuucaaacuacaggaacccguagucaugaacugcauaccggccucaguaacaauaucacuaucucaccagugacucccgagcacgcaggaacauaucguugcgugggcaucuauaagcacgcaagcaaguggucagccgagucuaauagccugaagauuaucguuacaggccuguucacaaaaccuucaaucuccgcucaccccaguagccugguccacgcaggugcaagggucucucugcgcugucauucugaguuagccuucgacgaguucauuuuguacaaagaagggcacauacaacacucacagcaauuagaccagggaauggaagccgggauacauuauguugaagcuguauuuuccaugggacccgucacacccgcccacgccggugccuaucgcuguugcggcugcuuuucacacuccagauacgaauggagcgccccgagugacccgcuggauauugugaucaccggcaaguauaagaagccuagucuuucaacacagguggaucccaugaugcggcugggagaaaaacugacccucuuuugcucuuccgagaucucauuugaucaguaccaccuguucagacacgguguggcgcauggccaauggcugagcggcggucaaaggcacagagaagccuuccaggcaaauuucucuguggggcgggcuacaccagucccaggaggaacauauagauguuacggauccuucaaugauuccccuuauaagcccccaguuacccggugcaacuuuaccccccaggagacuuugcggguacucuuaugucacagccagaacccuccccugaaccucaccccgcccuggcagacccagagcccaagaaaggcuaaugggcgcaugaagagaucccuccagcaaaaacggcauagaagaaguuacaugcccucauag

SEQ ID NO: 12186 - RNA, 198 nt, Artificial Sequence
  Description of Artificial Sequence: Synthetic coding sequence
augcgaacuuuccuguuuuuauuugccguguuauucuuccuaaccccugcuaaaaaugccuuuuucgacgaaaaauguaacaaacugaagggcacaugcaaaaacaauuguggcaaaaacgaagaacugaucgcucuuugccagaaaucccugaaaugcugccguacgauacaaccuugugggucaauaaucgauuag

SEQ ID NO: 12187 - RNA, 198 nt, Artificial Sequence
  Description of Artificial Sequence: Synthetic coding sequence
augagaaccuuucucuuccuauucgccguccucuucuuucucacccccgcaaagaacgcuuuuuucgacgaaaagugcaacaaacucaaggguaccugcaagaauaacuguggaaaaaaugaagagcucauugcucugugucaaaaaaguuugaaguguugucgcacaauucaacccugugggucaaucauugauuag

SEQ ID NO: 12188 - RNA, 237 nt, Artificial Sequence
  Description of Artificial Sequence: Synthetic coding sequence
auggcucugauucgcaaaaccuucuacuuccuguuugccauguuuuuuauucugguacaauuaccgagcggaugucaagcuggucucgauuuuucacagccguucccaucaggagaguucgccgugugugagaguugcaagcuaggaaggggcaaauguagaaaagaaugcuuagagaacgaaaagcccgacggaaauugcaggcugaauuuccuguguugucgccagcgcauuuag

SEQ ID NO: 12189 - RNA, 2868 nt, Artificial Sequence
  Description of Artificial Sequence: Synthetic coding sequence
augugggccggucuccucuuaagagcugcgugugucgccuuauuacugccuggagcucccgcacgagguuacacaggcaggaaaccucccgggcacuuugcugccgagcguagacggcucggaccucaugugugucuaagcggcuuugggaguggcugcuguccaggaugggcccccagcaugggaggaggacacuguacacugccuuugugcucauucggaugcggaucuggcauaugcaucgcuccaaacguuugcagcugccaagauggggaacagggcgccaccuguccugaaacccacggccccugcggcgaauacgggugcgaucuaacuuguaaucacggcggcugucaagaaguggcuagggugugucccgugggcuuuucuaugacggaaacugcaguuggcauuagaugcaccgauaucgacgagugugucaccagcuccugugagggccauugugugaacacagagggaggcuucguuugcgaaugcggucccggaaugcaacuuagcgccgaucgccacuccugucaggauacagacgagugucuggggacuccgugucagcagcgcuguaagaauaguauugguucauacaagugcagcuguagaacuggcuuccaucuccauggaaaucgucauuccugugucgaugucaaugaguguagacggccccuagagcguagggugugccaucacagcugccauaacacugugggcuccuuccugugcaccugcagaccuggauuccgccucagagccgauagagugucuugugaagccuucccaaaagcuguacucgccccaagugccauccuacagccacggcagcaucccaguaagaugcuccugcuucuccccgaggccggccgacccgcccucucacccggccacucccccccaaguggggcgccggggcccccagccggugugcgaaccaccaggcugcccagcccaacaccacgcuugcccacauccucacccagugcccccgugugguugcuuuccacgcuccuugccaccccagucccaacagcgagccugcuuggcaaucucaggccgccuucucuccuacagggcgaaguuauggguacacccagcucuccccguggucccgagucaccucgucuugcugcgggcccguccccuuguuggcaucuuggcgccaugcacgagucucgcuccagguggacagagccuggcuguucucaguguuggugugaagacggaaaagucacaugcgagaaagucagaugcgaggcugcaugcucacaccccauuccgagucgggauggagguuguuguccgucuuguacgggcuguuuccacuccgguguugugcgcgccgagggcgauguguucagucccccgaacgagaacuguaccguaugcguuugccucgcuggaaacgugagcuguaucagcccggaguguccuucagggccgugucagacaccaccccagacagacuguuguacgugcguuccugugagauguuauuuucacggaaggugguaugcagauggagccguuuuuagugggggcggggaugaaugcaccacuugcgucugccagaauggcgaagucgaauguagcuucaugccuugucccgagcuagcauguccccgagaggaauggcggcuggggccgggacaaugcuguuuuacaugccaggaaccaacaccuucuacagguuguucacuugacgacaaugguguugaguuucccaucggccagauuugguccccaggcgauccuugugagcuuuguauaugucaagcagaugguucugucagcuguaagagaacugauuguguggacaguuguccccaucccaucagaaucccuggacagugcuguccagauugcuccgcugguugcaccuacacuggccguauauucuauaacaacgagaccuuucccaguguucucgacccaugucugaguugcaucugucuuuugggaagcguggccuguagcccuguugauugucccauuacguguaccuauccauuccaucccgacggugaguguugccccgugugccgcgauugcaacuacgaagguaggaagguggccaauggacaaguauuuacccucgacgacgagccuugcacgcgaugcaccugucagcugggagaggucucuugcgagaaggucccaugucagagagccugcgcggauccagcguugcuccccggugauugcugcagcaguuguccugacagccucuccccccuggaagagaaacaaggacuuagcccgcacggaaauguggcguuuucaaaagccggcagaagucuccauggggauaccgaggcacccgucaauugcucaagcugccccggcccacccaccgcuucuccaucgaggccaguuuugcaccuucugcaacuccuucugcggaccaaccucaugaaaacucagacucucccuacgucccccgcaggggcccauggcccucacucucuggcacucggacuuacggcuacuuuccccggggagccaggggcuucaccccgguuaucuccuggaccaagcacaccuccaggcgccccuacccugccacuggccaguccaggagcaccucagcccccgccuguuacaccugaaaggucuuucagcgccagcggcgcacaaaucgugucacgguggccuccccugccagguacacuucuuacagaggcuagcgcccugagcaugauggaccccuccccguccaagacuccaauaacccucuuggggccucggguguugaguccaaccacuagucggcuuucuacagcccuggccgccacaacgcacccugguccacaacagccaccagugggcgccagucgaggcgaggagucuaccauguag

SEQ ID NO: 12190 - RNA, 270 nt, Artificial Sequence
  Description of Artificial Sequence: Synthetic coding sequence
auggugagcugugagcgccgggcuucaaaauccgugggucagauccuccucugggacuucgguuacacuugucgauugucucaucguaggcguaauucuaccgagauucucucucguaauuugcccgcuuuguacacuggaauuaagguaugcgaaaaaagaccgucuauagaccuauguauccaccauugcucuuauuuccagaaaugugaaacgaauaaaauuugcuguagcgcuuuuuguggaaacauauguauguccauccuguag

SEQ ID NO: 12191 - RNA, 600 nt, Artificial Sequence
  Description of Artificial Sequence: Synthetic coding sequence
auggaaacuuucccucuccuccuacucucccugggccugguauuagcagaagccucugaaagcacgaugaaaaucauuaaggaagaauuuacugacgaagagaugcaauaugacauggcaaaaagcggucaagagaaacagacuaucgagauacugaugaacccuaucuuacuuguuaagaauacaagcuuaagcauguccaaggaugauaugucuaguacccuguugacuuuuaggagccugcacuacaaugauccaaaggggaauucuaguggaaaugacaaggaguguuguaaugauaugacuguguggcgaaaggucucagaagcgaauggcucuuguaaaugguccaauaauuuuauccgcaguuccaccgaggugaugcgccgagugcaucgcgcuccuucuugcaaauucgugcaaaauccuggcauuagcugcugcgaaagucuugagcuagaaaauacugucugccaguucacaaccggcaaacaguucccgcgcugccaauaccauuccgugaccucucuggaaaaaauccuuaccguccucacaggacacagccuaaugucuuggcucgugugcggcuccaagcuguag

SEQ ID NO: 12192 - RNA, 729 nt, Artificial Sequence
  Description of Artificial Sequence: Synthetic coding sequence
auggcugccgccaccaggggguguagaccuugggguuccuuguuaggacuguugggccugguauccgccgcggccgccgcaugggaccucgcgucucugagaugcacguuaggggcauuuugugaaugugacuucagacccgauuuaccaggccucgagugcgaccucgcgcagcaccuggcgggacagcacuuagccaaggcuuuggucguuaaggcacuuaaagcguuuguccgcgacccagccccaaccaaaccauuaguacuaagccugcacggguggaccggcacagggaaaucauacguauccuccuugcuggcccacuaccucuuccagggugggcugcgaagcccaaggguucaucacuucagucccgugcuccacuuuccacacccuagccacaucgagcgguauaaaaaggauuugaaaaguuggguacagggaaaucugaccgccuguggccgcucccuguuucuguuugaugaaauggacaagaugccaccuggacucauggaggugcugcgaccuuuccuaggcuccaguuggguugucuauggcacuaacuaccgcaaagcaauauuuauuuuuaucagguggcuucuaaaacuuggacaccacggacgggccccccccagacgcaguggugcacuuccuccugcaccugcagcaccucgccccgcguuaagagcacaaagggcugggcccgcaggcccuggcgcgaaaggcuag

SEQ ID NO: 12193 - RNA, 627 nt, Artificial Sequence
  Description of Artificial Sequence: Synthetic coding sequence
augcuuggguugcugguugcucugcuggcccuuggccuggccguguucgcccucuuagaugugugguaucuggugcgccuacccugugcuguccugcgcgcucgccuucugcagccacgcguaagagaucuucuugccgagcagagauuccccggaagaguucugccuucagaccuggaucuuuuacugcacaugaacaacgcaagguauuuacgggaagccgacuuugcaagagucgcccaucugacccguuguggggugcugggagcccucagggaguugcgcgcacacacaguccucgccgcgagcugugcacgccacaggcgcucacugcgccuucuggagcccuucgaagucaggacucggcuauuaggcugggacgaucgagccuucuaucucgaggcaagauuuguaagucugagggacgguuuuguaugcgcacucuugcguuuucgccaacaucugcuaggaaccagcccagagagaguagugcagcaucugugccaaagacgcgucgaaccuccagaacugccugccgauuugcaacacuggaucaguuacaaugaggcaucuagucagcuuuugcgcauggaaucagggcugucagaugucacuaaggaucaguag

SEQ ID NO: 12194 - RNA, 423 nt, Artificial Sequence
  Description of Artificial Sequence: Synthetic coding sequence
augcuagucaaacucaauucacaggcaagacuuaguuccauggucaagaaagugcgacugccaucuagaugcgagcccccagguacgacaugcacgguuagcgguugggggaccacaacgucgccagaugucaccuuuccuucagauuugaugugcguggacgucaaguuaauuaguccucaggauugcacuaaaguuuauaaggaucuucuugagaacucuauguugugugcagguaucccagauagcaagaagaaugccuguaacggagauagcggcggaccucucguaugucgcgggacacugcaaggccuuguguccugggggaccuuucccuguggacagcccaaugaucccggcgucuacacccaggugugcaaguucacuaaauggauaaacgauacuaugaagaagcauagguag

SEQ ID NO: 12195 - RNA, 354 nt, Artificial Sequence
  Description of Artificial Sequence: Synthetic coding sequence
augcucagcaaagcucauggcugcaagaccgcgcuuucauuaggccgcugcccgaagauccgugaggagugcgaguuccaggagagagaugugugcacuaaagaucgucagugccaggauaacaaaaagugcugugucuucucauguggaaaaaaaugccucgaccuaaaacaagauguaugugaaaugcccaaagagaccggccccugccucgccuauuuccuacauuggugguacgauaaaaaggacaauacauguagcauguucguuuacggaggaugucaaggcaacaacaauaacuuucaaucuaaggccaacugccuuaauaccuguaagaauaagagauuuccauag

SEQ ID NO: 12196 - RNA, 2328 nt, Artificial Sequence
  Description of Artificial Sequence: Synthetic coding sequence
augcaucccgggcccgaagaagccggaucaggacguuaugggcccagauauaucacugacaugggugcuggggaggaugacgaaggguucgaagaugaccuugacuuagauauuucauuugaggaagugaagccucugccagcaaccaaaggagguaacaagaaguucuugguggagagcaaaaagaugagcauuucuaaucccaaaacaauuagucggcuuauuccuccuacauccgccucuuugccggugacgaccguugcaccucaaccuauacccauucagaggaagggcaaaaacggcguugccauaaugucgaggcuguuugacaugccuugcgaugagacccuaugcucggccgacagcuucugugucaacgacuauacuuggggugguucuagaugucagugcacucuggggaaaggaggcgagucauguuccgaggacauagucauucaguauccucaguuuuucgggcacagcuaugugacguuugaaccucugaagaauucguaccaggcauuucagaucacccuugaguuucgcgccgaagcggaagacggacuccugcucuacuguggugaaaaugagcauggccgaggcgacuucaugucacuugccauuauacgucguucgcuacaguucagauuuaauuguggcacuggcguagcgaucaucgugucugagacgaaaaucaaacuugggggcuggcauaccgucaugcuuuaucgcgauggacucaacgggcuauugcagcugaauaacggcacucccgucacuggacagucgcagggacaguacucaaagaucaccuuccguacuccucucuaucuggguggagccccauccgcauauugguuagugcgagccacagguacgaauaggggguuccagggaugcgugcaaagccucgcuguaaauggcaggcgaaucgauaugcgccccuggccuuugggcaaagcccuguccggcgccgaugucggcgaauguucuucagggauaugcgacgaggcgucuuguauccaugguggcacauguacugcuauaaaggccgauucuuacauaugccucuguccacugggauucaaagggagacauugcgaggaugcauucacacuuacuaucccacaguuccgugaaucccugagaucauaugcugcuacacccuggccuuuagaaccucagcauuaucucucguuuauggaguucgagauuacauuuaggccugauuccggagauggagugcugcuauacagcuacgauaccgguucuaaagauuuccucagcaucaaucuggccggcgggcaugucgaguuccgauuugauuguggauccgguacugguguucugcggagugaagacccccugacacuggggaacuggcaugaauugaggguuaguaggacagccaaaaacggcauacuccaaguggacaaacaaaagauuguugaggguauggcugagggaggcuuuacccaaauuaaauguaauaccgauauuuucauaggaggagugcccaauuacgacgacguuaagaagaacucagguguccuuaagcccuuuagcggcucaauccagaagauaauccucaacgauaggacuauccaugugaaacaugacuucaccucuggggugaacguagagaaugccgcacaccccugugugagagcucccugcgcccauggcgggucgugcaggccuaggaaagagggauaugacugcgacuguccacuuggauucgaggggcuacacugucagaaagccaucauagaagcaaucgaaauuccacaguucaucggcagauccuaccuuacguacgacaaucccgacauucuaaagcgagugucugggucucgcucuaacguguucaugagguucaagacaaccgccaaagauggacuauuguuguggcgaggggauucuccuaugagaccuaacucagauuucauuucucuggggcugagagacggcgcacucgucuucuccuauaaucuuggcucgggcguggccuccaucauggugaacggaucguucaacgacggucgguggcacagggucaaagcgguucgggacggacagucuggaaagauuacuguggacgauuacggagccaggacaggcaagucaccagggaugaugcgccaacugaacauaaacggggcuuuauaugugggaggaaugaaagaaauugcgcugcacaccaauagacaauacaugcgagggcuuguggguugcauuucccauuuuaccuuaagcacugauuaucauaucucuuugguggaggacgcugucgauggcaagaacaucaacaccugcggggcgaaauag

SEQ ID NO: 12197 - RNA, 1257 nt, Artificial Sequence
  Description of Artificial Sequence: Synthetic coding sequence
augcgcacucuuuuuaaucuucuguggcuggcccuggcuuguagcccaguacacacuacgcugucaaagucagacgcuaaaaaggcagccaguaaaacuuugcuugaaaaagugaaauucugcucauguugcccaggguggagcgcgauggccagguccuggcucaccgccacgucugcuacccaaucccaguucucugauaagcccgugcaagaccguggccucguggugacagauuugaaggccgaauccgucgugcuggaacaccguucuuauuguuccgcaaaggcgagagaucgacauuucgccggagacguucuuggauacgugacaccuuggaauucccacggcuaugauguuaccaagguguuuggaucuaaguuuacgcaaauuucuccagucuggcugcaacucaaaaggcggggccgggaaauguuugaagugacgggacugcaugauguggaucagggguggaugcgagcagugaggaaacacgcuaagggacuccauaucgugccgcgccuccucuuugaggauuggaccuaugaugauuuccgaaacgugcuggacucugaggaugagauugaagagcucucaaagaccgugguucagguggcuaaaaaccagcacuucgauggcuucgucguggaaguuuggaaccagcuccugucucaaaaaaggguggguuugauccacaugcugacacauuuggcagaagccuuacaccaggccagacuacucgcucuguuggucaucccaccagcuaucaccccuggcacagaucagcugggaauguucacgcauaaagaguucgagcaauuggcucccgugcucgaugguuucucuuuaaugacuuacgauuacucuaccgcucaucagcccggaccuaaugccccccuuucgugggucagagccuguguucaaguacucgacccuaagagcaaauggagaucuaaaauacuucucggauugaacuucuacggaauggauuaugcaaccuccaaagacgccagggaaccugugguaggcgcaagguauauccaaacccugaaggaucaccguccaagaauggucugggacucucaggccagugaacacuucuucgaguauaagaaaaguagaucaggcagacauguggucuuuuaccccacacugaagagccugcagguccgacuggagcuggcaagagaacucggcgucgggguaucaauuugggagcugggucaggggcuagauuauuucuacgaucuucuauag

SEQ ID NO: 12198 - RNA, 813 nt, Artificial Sequence
  Description of Artificial Sequence: Synthetic coding sequence
augaugcuccgacuguugucgucucugcucuugguugccguggcgagugguuauggacccccaaguagcaggcccuccucccgaguggugaacggugaagacgcagugcccuauucguggcccuggcaaguuagccugcaguaugagaaauccgguucauucuaccacaccugcggcggauccuugauugcaccagacuggguugugacugcuggucauuguauuucaucauccaggacauaccaggugguucucggcgaguacgaucgcgcuguuaaagagggaccagaacaggugaucccuaucaacaguggcgaucucuuugugcacccacuguggaaccgguccuguguggcauguggcaaugacaucgcucugauuaagcugagucgcagugcacaguuaggcgaugccguacaacucgcuaguuugccuccagcuggagauauucugccuaaugagaccccguguuauauaacagguuggggacgccuauacacuaacgggccgcucccggacaaacugcaggaagcucugcucccaguugucgauuaugaacauugcagccgcuggaacugguggggcucaagugucaaaaagaccauggucugcgccggaggagacaucagaaguggaugcaauggggacagcggggggccuuugaacugcccuacagaagacggaggguggcagguucacggcgugacuuccuucgugucugccuuugguuguaauacccgaagaaaacccaccguguuuacucggguuagcgcguuuauugacuggaucgaagaaacaauagcaagccacuag

SEQ ID NO: 12199 - RNA, 585 nt, Artificial Sequence
  Description of Artificial Sequence: Synthetic coding sequence
augaccaugagacauaauuggacacccgaccuuucuccccuaugggugcuauugcuaugugcccacguagugacucuguuggugagagcaacuccugucucccagacuaccacugcagcuaccgcuagcgucagaagcacuaaagauccaugcccuagucagccuccuguuuuuccagccgccaagcagugucccgcucuagagguuacuuggccggaaguagaggugccccugaacggcacacugagccuuaguuguguagcuuguagcagauuuccgaacuuuucaauucuguacuggcucgggaacggauccuucauagaacauuuaccgggccggcugugggagggcucuaccaguagggaaaggggaucuacaggaacucaauuaugcaaagccuuggucuuggagcagcucacaccugcacugcacucaaccaauuucucauguguucucguagacccugaacagguugugcagagacacgucguguuagcucagcugugggcuggacuucgcgcaacccuuccuccuacacaagaggcacugcccaguucucauaguuccccccagcagcaaggauag

SEQ ID NO: 12200 - RNA, 1308 nt, Artificial Sequence
  Description of Artificial Sequence: Synthetic coding sequence
augcagggucaggggaggagaagagguacaugcaaagauaucuucugcucuaagauggcuucuuacuuguauggaguccuguucgcuguaggacucugcgcaccuaucuacugugucagccccgccaaugcccccagcgcuuauccacggcccucuucaacaaaaagcacgccagcuagccaagucuacucucugaacacagauuuugcuuuucgucuguaccguagacucguucuggaaacucccucacagaacauuuucuuuucuccgguguccgugucaacaucucuggccaugcucuccuugggagcucacaguguaacgaaaacccaaauucuacagggccucggauuuaacuuaacccauacacccgaaagugcuauucaccagggauuucagcaccucguccauucgcucacgguuccuagcaaggaucugacauugaaaauggguagcgccuuguuugucaaaaaagaacuccagcugcaggcuaauuuucuaggcaacgugaaacgacuuuaugaggcagagguguucucuacugauuuuagcaacccuaguaucgcccaggcaaggauuaacucacaugucaagaagaaaacccagggaaaggugguggauauuauucaggggcuggaucugcucacugccauggugcuugucaaccacaucuuuuuuaaagcgaaaugggagaagccauuccacccagaauacacaagaaagaacuuccccuuucuaguuggagagcaggugacuguccacgugccuaugaugcaucagaaagagcaauucgccuucgggguggauaccgaacugaauuguuucgugcugcaaauggacuacaaaggcgacgcugucgcuuuuuuugugcugccaaguaaaggcaagaugaggcagcuugagcaggcucugagcgcucggacccugagaaaguggagucacucgcugcagaagcgauggaucgaaguuuucauccccagauucagcauuagugccaguuacaacuuggaaacaauccuucccaaaaugggcauucagaauguguucgauaaaaacgcagauuuuuccggcaucgcaaagagggacucucugcagguguccaaggccacacacaaagccguacucgacgugagugaggagggaaccgaagccacugcagcaacuaccaccaaauuuauugugcgaucuaaagauggccccucuuauuucacugugagcuuuaaccgcaccuucuuaaugaugaucacgaacaaagcaacagauggcauucuguuccuggggaagguugaaaauccuacuaagagcuag

SEQ ID NO: 12201 - RNA, 393 nt, Artificial Sequence
  Description of Artificial Sequence: Synthetic coding sequence
auggcuuccgacuugauacgaacuauccucgccgucgcuuuaaucucaaaacuggggaccgccguugaugcggagcuuaugccuaguggagcgauccugcagaacaaacgcgagaaucuuccuagaguuugucacgcacucgccuuucuugguauggcgcguugucaagaccuguuucuuguccgauugcagggauggaaauuggguaccagguuccaggauggccccagaucaacuccacaggaggaggggggcucuccacaaagaaagagagggaugccugugcagauucacuuccuguuaaagagcuuccugagcuccccgauaacauucgcuuuuauaagcuuagcucguacgguuagucuugcuacagccaucuguaagaucgucuag

SEQ ID NO: 12202 - RNA, 837 nt, Artificial Sequence
  Description of Artificial Sequence: Synthetic coding sequence
augcaguggcugagggugcgagaaucuccaggcgaagccacggggcaccgcguuaccaugggcacagcugcgcuagggcccgugugggccgcccuguugcuauuucugcucaugugugagauucccaugguggagcuaacauucgacagggcuguugcuucuggcugucagagaugcugugauagugaggauccacucgauccugcgcacguuucuucugcuagcucuuccggacggccacacgcacugcccgaaauuagacccuauaucaauaucacaauucuuaaaggggacaagggugauccaggaccuaugggccuuccaggcuauaugggaagagaagguccucaaggagaaccaggcccacagggcucuaaaggggauaaaggcgagauggguucuccuggugcucccugccagaaaagguuuuuugccuuuagcgugggacggaagaccgcccuccacucuggcgaggauuuccagacauugcucuuugagcgcguguuugucaauuuggauggguguuuugauauggcuaccggucaguuugcagcuccucuccgcggcauuuacuucuuuagccucaacguucauucuuggaauuauaaagagacguauguccauauaaugcauaaucaaaaggaggcugugaucuuguaugcacaaccuucagagcggagcauuaugcaaucacaguccgucaugcuggaucuagccuacggugauagagugugggugcgucucuucaagagacagagggaaaacgccauuuacuccaacgauuuugacacauauaucacuuuuuccggucaccugaucaaagcagaggacgauuag

SEQ ID NO: 12203 - RNA, 1635 nt, Artificial Sequence
  Description of Artificial Sequence: Synthetic coding sequence
auguguacagugguugaucccagaauuguuagacgauaccuucugagacggcaacugggucagggagccuacggcaucgucuggaaggcagucgaccgucgaacaggggaagucguugcaauuaaaaaaauauuugacgcuuuccgcgacaaaaccgaugcgcagcguaccuuccgcgagaucacccuccugcaagaauuuggcgaucacccaaauaucauuucucuccuggacgugauucgggccgaaaaugacagagacaucuaccuuguguuugaauucauggacacugaucugaaugcagugauacgaaaaggcggccuccuccaggacguucacgugcggaguauuuucuaccagcuguuacgggcgacucgcuuucuccauagcggccaugugguccaucgcgaucagaagccuuccaauguucuccuugaugcaaauuguacaguaaaacucugugacuucggcuuagccaggagccuuggagaucuuccagagggaccggaggaccaagccgugacggaguaugucgcaaccaggugguaucgugcccccgaaguguuacugucuucucacagauacacucugggcgucgacauguggucacugggcugcauacucggcgaaaugcuuagaggucgcccucuguuccccggcacuuccaccuugcaccagcuagagcuaauacucgaaacgaucccacccccuucugaagaggauuugcuugcccuugggucgggaugccgagccagcgugcugcaucagcugggcucucguccuagacagacacuugacgcacuccugccuccagauaccucacccgaagcacuggaccucuuaaggagacuccugguauucgcccccgacaaaagguuaucggcgacacaggcucuacagcacccauacgugcagcguuuccacuguccuuccgaugaaugggcccgcgaagcugacguccggccccgugcccacgaggggguucaauugucagugccagaguacagaagucggguguaucaaaugauccuggaauguggugguucuucgggaaccuccagagagaagggaccagaaggcguuagcccuagccaagcccaucugcauaagccuagggccgacccucaacugccuucccguacaccaguccaaggaccccgaccuaggccacagucaaguccaggacacgacccagcugaacacgagucacccagggccgccaaaaacgugccacgacagaauagcgcuccauuacuccaaacagcccugcucgguaacggcgaacguccacccggugccaaggaggcucccccauuaacccugagccucgugaagcccagcggccgaggggccgcgccaagcuugacuucucaagccgcagcccaaguggcuaaucaggcccuuauuagaggcgauuggaaucgugggggggggguaagaguggccuccguucagcagguuccuccacgacuuccuccagaagcuaggccagggaggcgcauguucaguaccagcgcccuacagggagcucaggggggugcacgcgcucugcuagggggcuauucacaggcauauggaaccgugugucacucagcucucggccaccugccucugcucgaaggacaccacgucuag

SEQ ID NO: 12204 - RNA, 399 nt, Artificial Sequence
  Description of Artificial Sequence: Synthetic coding sequence
augaaaucgaguggauuauucccauuucuuguacucuuggcucucgggacacuggcucccugggcugucgagggauccggaaagucauuuaaagccggagucugccccccuaagaaguccgcucagugucuucgauauaaaaagccugagugccagucagauuggcaguguccagggaaaaagagaugcugucccgauacuuguggcaucaagugccuggacccaguugauacuccuaacccuacgcgacgcaaaccuggaaaaugucccguuacuuacggacagugccugauguuaaacccuccaaacuucugcgagauggauggccagugcaagcgggaccugaaaugcugcaugggcauguguggcaaaucuugcgugagcccaguuaaggcuuag

SEQ ID NO: 12205 - RNA, 1401 nt, Artificial Sequence
  Description of Artificial Sequence: Synthetic coding sequence
augaaacccccacugcuggucuuuauugucugucugcuauggcuaaaggauagucauugugcgccuacguggaaagacaagacagcgauaucagaaaaucucaagagcuucuccgaagugggagagauugacgcagaugaggaagucaaaaaagcucuuaccggaauuaaacagaugaagauuaugauggaaagaaaagaaaaggagcauaccaacuuaaugaguacacugaagaaaugcagagaggagaaacaggaggcacugaaacugcucaacgaagugcaggagcaucuggaggaggaagagcggcucuguagagagucccuagccgauuccuggggcgagugccgcucuugucuggagaauaacugcaugcgaauuuauacuacuugccagccaaguuggucgucugucaagaacaaaaucgaacguuucuuuagaaaaaucuaucaguuccuuuuucccuuucacgaagacaacgagaaagaccuuccgaucagcgagaagcuuaucgaagaagacgcacagcuuacccagauggaggacgucuuuagccaguugacuguggacguaaauagccuuuucaaucggucauucaacguuuuuaggcaaaugcaacaggaguucgaccaaaccuuccagagucacuuuaucagcgauacggaucugacugagccauacuucuuucccgcuuucuccaaggagcccaugacuaaggcagaucuugaacaguguugggauauccccaacuuuuuccaacucuucugcaacuuuucagugaguauuuacgagagugucucugaaaccaucacuaagaugcugaaagcaauugaggaccuccccaaacaagacaaagccccugaucacgggggacugaucaguaaaaugcugccagggcaggauagaggucuuugcggagagcuggaccaaaaucucucacgguguuuuaaguuccacgaaaaaugucagaagugccaggcccaucugucagaggauuguccagauguuccagcacuccacacugaacuugaugaagccaucagacugguaaacguuucaaaccagcaguauggucagaucuugcagaugacucgcaaacaccuggaagacacggcuuaucugguagagaagaugagagggcaauuuggguggguguccgaauuggcaaaucaggcucccgagacugaaaucauuuucaacucuauucaaguaguuccaagaauucacgaaggcaacauuucuaagcaggacgaaacaaugaugaccgaucucaguaucuuaccgagcagcaacuuuacccugaaaaucccgcuggaggagucagccgagagcaguaauuucauugguuaugucguggcgaaggcucugcaacauuucaaggaacacuucaaaaccugguag

SEQ ID NO: 12206 - RNA, 522 nt, Artificial Sequence
  Description of Artificial Sequence: Synthetic coding sequence
augcacuggaagaugcuccuucuucugcuucuguacuauaacgccgaagcuagcaugugccaucguuggagcagagccguacucuucccugcagcgcauagaccuaagcgcucaucauccuugccacugaaucccgugcuucagacuucucuugaggagguggaacuccuauaugaauuccuccuggcugagcucgagaucuccccugaucugcaaauuaguaucaaagacgaggaacucgcuucacuuagaaaagcauccgauuuucgcaccguuugcaauaacgugaucccgaaauccauucccgauauaagacgccuaagcgcaucacugucuucucacccugggauucugaagaaggaggacuuugaacggaccgugcuuacacuugccuacacagccuaucggacagcacucucucacggucaccaaaaggacaucugggcacagucuuuaguaucucuguuucaggcccuacgacacgaccugaugcgcuccucacagccaggugucccgccauag

SEQ ID NO: 12207 - RNA, 1473 nt, Artificial Sequence
  Description of Artificial Sequence: Synthetic coding sequence
auggaggauuccgauucugcugcgaaacagcucggguuggccgaagcagcagcaguugcugcagccgcugccgucgcagcagccgccgcugcagcggccggcggcgaagcugaagaacccguccucuccagggacgaggacagcgaggaggacgcugacagugaagccgagcgagaaaccccacgugugacagccguagcagugauggccgcugagcccggccacauggauaugggggcggaagcccugcccggacccgaugaggcagcagcugcugcagccuuugccgaagugacaacagugacuguggccaauguuggugccgcugcagauaacguauuuacaacuucugucgccaacgcagcaucuaucucaggacacgugcugucugguagaaccgcacugcagauuggcgauucacugaauaccgagaaggcuacucugaucguugugcacacggacggaucaaucgucgagacuacaggccugaaagguccggcagcaccucucacacccgguccucagucaccccccaccccacuggcgccaggacaggaaaagggugggacaaaguacaacugggaucccucagucuacgacagcgaguugccagugagaugucgcaauaucuccgguacucuuuacaagaacaggcuugguucuggaugggaccugaaacccucccgaugccugcuacaucucugcugccuccugaggcgccaugauuugauaaccguuacacccuccggccagaucaccacuaguggcgcccuuaccuucgacagggccuccacgguugaggcuacagcugucauaucugagucacccgcccagggcgauguuuuugcaggugccaccguucaggaggcuuccgugcagccaccuugucgcgcaucucaccccgaaccucacuacccaggcuaucaagauagcugucagauagcacccuuuccggaagccgcccucccgaccucucacccaaagaucguccucaccagccucccggcgcucgccgugccaccccccacuccaacuaaggccgcuccccccgcacucgugaacgggcuagaacucagcgagcccaggucauggcuguaccuagaagaaauggucaacucccugcucaauaccgcccagcagcuuaagacccuguucgaacaggcgaaacacgcuuccaccuacagggaagccgccaccaaucaggcuaaaauccacgcugacgccgagcguaaagaggucauccacccgcccaggcucccuaaggucuugggacuucagcagucgugcgugaauugcggacgggaagccaugagcgaauguacagggugccacaagguaaacuacugcucuacauucugucaacguaaagauuggaaagaucaccagcauauaugcggccagucagcagcugugacaguucaagcugacgagguccacguagcagaaucaguaauggaaaaggucacuguuuag

SEQ ID NO: 12208 - RNA, 1476 nt, Artificial Sequence
  Description of Artificial Sequence: Synthetic coding sequence
augccuaguaccguacucccuucuacaguacugcccucgcugcugcccacugcuggugccggcugguccaugcguuggauccuuuguuggagccucaccuuguguuuaauggcucagacagcccucggugccuugcacacuaagaggccucaagucgugacaaaguaugggacacugcaggguaaacagaugcaugucgggaaaacaccaauccagguguuuuugggugugcccuuuaguaggccaccccuggguauacuuagauucgcuccuccggagccuccagaaccauggaagggaauucgcgaugcuacuacuuacccccccggaugucugcaagagagcuggggacaguuggccucaauguacguuagcacucgagagagauacaaguggcuaagguuuagcgaagacugcuuauacuugaacguguaugcaccggcacgagccccaggugacccacaguugcccguaauggugugguuccccggaggcgcuuuuauuguaggggcugcuuccagcuaugagggauccgaccuggccgcacgagagaagguugugcuaguguuccuacagcaccggcugggcaucuuuggguucuugaguacugaugauucccaugcgagaggaaacuggggacuucuggaucagauggcagcucuccgcuggguacaggagaauauugcugccuucggaggagauccaggcaacgugacucuauucggccaaucagcaggcgccauguccauuuccggccugaugauguccccucuggcgucaggccucuuucacagagcuaucagccaguccggcacagcacuuuuccgacuguuuauuaccuccaacccuuugaaagucgccaaaaaaguugcccauuuggcaggcuguaaucacaauucuacacagauccuggucaacugucugagggcccuuuccggcacgaagguuaugagaguaucaaauaaaaugcgguuucuucagcucaauuuccagcgggauccggaggagauuauuuggagcaugucucccgugguagacggcgucgugaucccugaugacccacucgugcucuuaacccaaggaaagguuaguagugugcccuaucugcugggagucaauaaccuugaguuuaauugguuacuaccuuacauuaugaaauucccucuaaaucggcaggcgaugaggaaggaaacuaucacaaaaaugcuuugguccacacgaacucuucuuaacaucacaaaagagcaagugccucucguugucgaagaauacuuggacaauguuaaugaacacgauuggaagaugcugcgcaaccgcaugauggacauuguccaggacgcaacuuucguguacgcuacacugcagacugcccacuaccaucgagagacccccaugaugggcaucugucccgcgggacaugcaacaacuaggaugaagagcacaugcucauggauccugccccaggaaugggcguag

SEQ ID NO: 12209 - RNA, 753 nt, Artificial Sequence
  Description of Artificial Sequence: Synthetic coding sequence
augccagcuucuaguccuuuccuuuuggccccaaaaggcccuccuggaaacauggguggcccugugcgugaacccgcucugagcguggcacucuggcuuuccuggggcgcugcacuaggagccgucgcuugugcuauggcauuguugacacagcagacugaauugcagagucucagaagggaagucucccgacuccaagggacaggagguccaucucagaacggggaggguuaucccuggcagucucugccugagcaguccagcgacgcacucgaagccugggaaaacggugagcgcuccagaaagcgaagagcgguacuuacacaaaaacaaaagaagcagcauagcguccuucaucuaguuccaauuaacgcaacgucaaaggacgauagcgauguuacugagguuauguggcaaccugcccuaagaaggggacgcggccugcaggcacagggguacggugugcggauccaggacgccgguguuuaucuacuauauagucagguccuguuccaggauguaacauucacuaugggccagguuguaaguagggagggucagggaagacaagaaacacuguucagguguauccgcucgaugccuucucacccagaucgcgcuuacaacagcuguuauagugcgggaguguuucaccugcaccagggcgauauucugucggugaucauuccucgggcgcgugccaaacugaaucugucuccucauggcaccuuucuagguuuugugaaacucuag

SEQ ID NO: 12210 - RNA, 1437 nt, Artificial Sequence
  Description of Artificial Sequence: Synthetic coding sequence
augucaccaccccuccugaaauugggcgccgugcucucgaccauggccaugaucuccaauuggaugucccagacucugccaucacuggugggccugaacacuacucgucugucaacaccagauacgcugacucagauuuccccaaaagagggcuggcagguuuauucuuccgcacaagacccagaugggcgaugcauuugcacugugguggcuccugaacagaaccuguguucccgggaugcaaagucgcgucagcuucgccagcuucuggagaaagugcaaaacaugucccagaguauugaaguuuuaaacuugcggacacagagggacuuccaguauguccuaaaaauggaaacacagaugaaaggccugaaagcgaaauuuaggcaaauagaagaugaccgcaaaacacugaugaccaaacacuuccaggaacugaaagaaaagauggacgaacugcugccccugauuccugucuuagaacaauauaaaacagaugccaagcugaucacccaauucaaagaggaaauaagaaaccuuuccgcuguacucaccggaauccaagaagagauuggggcuuaugauuacgaggaauugcaccaaagaguguugaguuuagagacccgucugcgggauuguaugaagaaacuuaccugcggcaaguuaaugaagaucaccggccccgugaccgugaagacaagcggcacacgguuuggagcauggaugacugauccccuugcuucagagaagaauaaucgaguaugguacauggauaguuacacaaacaacaagauagugagagaauacaaaagcaucgccgauuuugugucgggcgccgagaguaggaccuauaaucugcccuuuaaaugggcgggcacuaaucauguggucuacaaugggucauuguauuucaauaaguaccagucaaacauaauaaucaaguacucuuuugacaugggccgagugcuggcccagagaucauuggaguacgcugguuuccacaauguguauccauauacuuggggcggcuuuucugauauagaccugauggccgaugagauuggacucugggcaguuuacgcaacaaaccagaaugcaggaaauauaguuaucagucagcucaaccaggauacucucgaagugaugaagucauggagcacgggcuacccaaaacgaucugccggagagucuuuuaugauuuguggaacguuauaugugaccaauagccaucucaccggggccaagguuuauuacagcuauucuacaaagaccucuacauaugaauacaccgacauuccuuuccacaaccaguauuuccauauuagcaugcucgacuauaaugcaagggauagagcacuguaugccuggaauaauggccaccaaguccuguucaacguuacucuguuccauauuaucaagacugaggaugacacuuag

SEQ ID NO: 12211 - RNA, 1101 nt, Artificial Sequence
  Description of Artificial Sequence: Synthetic coding sequence
auggcacgggaacggccuccaggaagaggcuguggcgugcuccgccgcugucuacucggagcugugcugcucuucggccucagauugugcgcugaauugcggagggccggcccugggucuccuacuagguccgcuccaccaggaccugcauggcgcccacccggaccccacuugcccccggcccccggacaacccagaggggcuagcaggcgccaagugacuuacgugaggucgggacgccgagcaccaccagggggcgguggauccggcacacccgagcccggaugcugcgccccucguggcaggccuagacgaaaaggcccccgguggcacauugaccuccaacccugggcggggagcgcucaaagccuggacgaagaagccuggagauuucuccgguacaucagcaccacacaaauugcuugcaaucauaugaacaccgacucauuggccacagauagcagucccacccacaaaccuuggucagucugcuuggaugauagauucaaucucgcucaccagaucagaaacaaacagugucgccuguacucacuggggcuuggaucugacgacacacauuucgaaguaagcauggcaaacaaugguugcgaagugcaccgauucgacccuucagugaaguccgcacauauacuugaaagucagcaccugugguaucaccggcucagcauugauuggcgugacccgcauccagcgguggcagcucagaaaccccauagcaauacccgcaaauuaggcagcauccucaacgaguuugggcaccauaagauugacguauuaaaggcagauuuggagagcgccgaauggaaaguucuggagaaucugauccucgaagacguacuggagcagaucggacagcuaauuuuugagauacaccugcauuggccgggguucgaaguauccgggucugacagcucuguugugagauucugguauagucuccugaaggaacucgagcaaaaggacuuucggcucuuucacagcuacaaagaccugagcaaaccccaacuguuucuuaaaaaagacaucuucaaugccagcucuuguuauacccuuucuugggucaacaccagauggaaauag

SEQ ID NO: 12212 - RNA, 300 nt, Artificial Sequence
  Description of Artificial Sequence: Synthetic coding sequence
augaaaauccccgugcugcccgccgugguacugcucucauugcucgugcugcauagcgcucagggcgccacacugggaggacccgaggaggaguccacaaucgaaaacuacgccagccguccggaggccuucaauacaccguuccuuaauaucgacaaguugagaagugcuuucaaagccgaugaguuccuuaacuggcaugcccucuuugaauccauuaaaagaaaacuuccguuccugaacugggacgccuucccaaaacugaaagggcuuagaagcgcuaccccugacgcucaauag

SEQ ID NO: 12213 - RNA, 618 nt, Artificial Sequence
  Description of Artificial Sequence: Synthetic coding sequence
augaugcgaacccugaucaccacacacccacuuccucuccuucuacucccacagcagcuccugcagcuugugcaguuucaggaggucgacaccgacuucgauuuuccugaggaggauaagaaagaagaauucgaggaaugccuggagaaauucuuuagcaccgggcccgcuaggccaccuacuaaagagaaggucaagaggagaguuuugauugaaccuggaaugccacugaaccacauugaauacuguaaucacgaaaucauggguaagaauguauauuacaaacaucguuggguggccgagcacuauuucuuacugaugcaauacgacgaacuucagaagauuuguuauaauagauucgucccuuguaaaaauggcauuagaaagugcaaccguucuaaagggcuugucgagggcguguauugcaauuuaacugaagcauucgagauuccugcuugcaaguacgaaagccucuauaggaaaggauaugugcugauuacuugcaguuggcagaaugagaugcagaaacgaaucccucacacaaucaacgaucuugucgagccuccagagcaccgauccuucuugagugaggaugguguauuugucaucuccccauag

SEQ ID NO: 12214 - RNA, 402 nt, Artificial Sequence
  Description of Artificial Sequence: Synthetic coding sequence
augcucgacuggagacuggcaagcgcucacuuuauacucgcaguaacacuuacccuuuggagcaguggaaaaguucuauccgucgauguuacuacaacugaagccuuugauuccgguguaauugaugugcagucuacuccuacggugagggaggaaaagagcgcuaccgaucugaccgcuaaacuucuucugcucgacgagcuggucagccuugaaaaugacgugaucgaaacaaagaaaaagcgaucuuucaguggcuuuggaagcccccucgauaggcucucagccggguccguggaucauaaagggaaacagcggaaaguuguggaucacccaaagcgacgauucgggauacccauggauagaaucggccgaaaccgccuguccaacagcaggggguag

SEQ ID NO: 12215 - RNA, 846 nt, Artificial Sequence
  Description of Artificial Sequence: Synthetic coding sequence
auggggucuagggggcaaggccugcuccucgccuauugccugcugcucgcuuucgcuucugguuugguucugucaaggguuccccacgugcagggcgagcagcaggaaugggaaggcacggaagagcugcccaguccaccagaccaugcugaacgagcugaagagcagcaugaaaaauaucgucccucacaggaccagggccuccccgcgucgagaugucuaagauguugcgaucccgguacauccauguauccugccacagcaguaccccagauuaauaucaccauccuuaaaggcgagaagggagauagaggggacagaggacuccagggcaaguacgggaagacaggcucagcaggcgccagaggucacacugguccaaaaggacaaaaagggagcaugggugcgccuggcgaacgcugcaagagccacuacgccgcuuuuagcgucggccgcaaaaaaccaaugcauucuaaucauuacuaccaaacaguuauuuuugacaccgaauucguuaauuuauaugaucacuucaauauguucacagguaaguuuuacugcuauguccccggucuauacuuuuucaguuuaaaugugcacacuuggaaccagaaggaaacuuaucuccauaucaugaagaaugaagaagagguagugauccuguuugcccaagugggcgauaggucuauaaugcagucccagucucugauguuagagcuccgcgagcaagaucagguguggguccgauuguacaagggggaaagagagaacgcuauauuuucugaagaacuugacacguacaucaccuuuucgggcuaccucgucaaacaugcuaccgaaccuuag

SEQ ID NO: 12216 - RNA, 132 nt, Artificial Sequence
  Description of Artificial Sequence: Synthetic coding sequence
augaaacuccuuuaccuguuccuagccaucuuauuagcaaucgaagaaccuguuauuagcgcacucguucggaccgucggcugcugccuggacacagcuagacagacuccccacccuagcaugcaugguuag

SEQ ID NO: 12217 - RNA, 861 nt, Artificial Sequence
  Description of Artificial Sequence: Synthetic coding sequence
augaaaguauuacuacuuaccgggcucggugcauuguuuuucgcuuacuacugggacgauaauuuugauccagccucauugcagggagcuagggugcuguugacaggagcuaaugcagggguaggcgaagaguuagcuuaucacuacgccaggcuuggcagccacuuaguacugaccgcccacacagaggcucuguuacagaaaguaguggguaacugccgaaaacugggcgccccuaaaguuuuuuauauugcagcagauauggcuucaccugaggcaccagaaagcguugugcaguuugcauuagacaaacucggcgggcuggacuaccuuguguuaaaucauauagguggcgccccugcaggaacacgcgcccguagcccccaggcuacccguuggcucaugcaggucaacuucguaucauacguucaguugacuagccgugcccuucccagccuuaccgacagcaaaggaucucuaguagugguguccucacugcugggcagggugcccacaucuuuuaguacaccauacuccgcagcgaaguuugccuuggacgguuuuuucgguucucugcgcagggagcuggaugugcaggacgucaacguugcaauuacuaugugcguccugggucuucgugacagagcuagugcagcugaagcaguucgugguguuacccgagugaaggccgcuccuggcccuaaggccgccuuagcagucauacgcggcggcgccaccagagcugcuggcguuuuuuauccuuggcgguuccgacuucuuugucuccugcguagauggcugccuagaccgcgcgcuugguucauuaggcaagaacuuaacgugacugcggcugccgcauag

SEQ ID NO: 12218 - RNA, 1326 nt, Artificial Sequence
  Description of Artificial Sequence: Synthetic coding sequence
augagagucgucacuauaguaauccugcuguguuuuugcaaagcugccgagcucagaaaggccagccccggcagcgugcgaagccgagugaaucacgggcgggcaggcgggggccgccgcggcucaaaccccgugaagcgauacgccccaggacucccaugugacguguacacuuaccuacacgaaaaguauuuagauugccaggaacggaaacugguauaugugcucccuggauggccccaggauuuacugcacaugcuccuagcucggaacaaaaucaggacuuuaaagaacaacauguuuucuaaguuuaagaaacuuaagucccucgaucugcagcagaaugagauuuccaagauugaauccgaggccuuuuuuggauugaacaagcuaaccacacuccuuuuacagcauaaccagauaaagguccucaccgaggagguuuucaucuauacgccgcucuugucuuaucuucgccuuuacgauaaucccuggcacuguaccugugaaauagaaacccugauuucuaugcugcagauccccagaaaccgaaaucucggcaauuaugcaaaaugcgagucaccacaagaacagaaaaacaagaaguugcgccaaauuaaaucugaacaguuauguaacgaggaggaaaaagagcagcucgacccaaaaccccaaguguccgggcgcccuccugugaucaaacccgagguggauucgaccuuuugccacaacuacguguuuccgauccagacucuugauuguaagcggaaggaacugaagaaaguucccaacaauauaccuccugacauugugaagcucgaccuuaguuauaacaagaucaaccaacuucguccuaaggaauucgaggaugugcacgaacuaaaaaagcucaaucugucgucuaacgguauugaguucaucgacccagcugccuuucucggacugacccaccucgaagaacuggaccucagcaauaauucacuacagaauuucgacuacggagugcuugaggaucucuacuuucugaagcucuuauggcuccgcgauaauccauggaggugugauuacaauauccauuaucuguacuauuggcuuaagcaucacuauaaugugcacuuuaaugggcuggaauguaaaacgcccgaggaguacaagggguggagugucggaaaauacauccgauccuauuacgaggaauguccaaaggacaaguugccggccuauccugaaucuuucgaccaagacaccgaggaugacgagugggaaaaaaaacauagagaucauaccgccaagaaacaaucugugauuauuacaauuguaggcuag

SEQ ID NO: 12219 - RNA, 1539 nt, Artificial Sequence
  Description of Artificial Sequence: Synthetic coding sequence
auggcagaaagcggacucgcgauguggccuagucucuugcugcuccuuuugcucccuggcccucccccaguggccggacucgaggaugccgccuucccacaccugggcgagucucugcagcccuuaccuagggcuuguccacugcgcuguucaugcccucggguggacaccguggauugcgacggccuugaccuucgcguauuucccgacaacauuaccagagcugcgcagcaccugucucuucagaauaaucaauugcaggaacucccauauaacgagcucucccgccugaguggacugcggacccuuaacuuacacaacaaccugauuagcuccgaaggccuacccgacgaagccuuugaaagucuuacacagcugcaacaucuaugugucgcgcauaauaaacucuccguggcgccacaauuuuugccgaggucucugcgcgucgccgacuuggcagccaaucagguuauggaaaucuucccauuaaccuuuggugaaaagccugcacuuagaucugucuauuugcauaauaaucagcuuuccaaugccggccuaccuccagaugcguuucgaggcucugaagccaucgcuacccugucauugucaaacaaccaacugucauaccugccgccgagucuccccccaucucuggagcguuuacaucuacagaacaauuugauuucuaaagugccaagaggagcgcucucaagacagacgcaauugcgggagcucuaucugcagcauaaccagcucaccgacagcgggcuagacgccaccaccuuuaguaaguugcacucccuugaauaccuggaucuuucacacaaucagcugacuacugugccugccggucugccacggacacucgccauucuacacuuaggccggaaccgaauaaggcagguggaagcagcucgccugcacggagccagagguuugcgcuaucuccuucuccaacacaaucagcuggggucuuccgggcuaccggccggggcccugcgcccacuucggggacuacacacucugcaccuguacggcaauggucuggaccgggugccaccugccuugccccgucgccugagagcucugguauugccacacaaucauguugccgcacugggcgcgagagauuugguugccacgcccggccucaccgagcucaaucuggccuauaacagacuggcaucggccaggguccaucacagagcguuccguagacugcgagcuuugcggagucucgaccuggccgggaaucagcucacacggcugcccaugggguuaccgacagggcugcggacucuccagcugcaaagaaaucagcuuagaauguuggagccagaaccucuggcggguuuggaucagcuccgggagcucuccuuggcucacaacagacuucgcgucggugauauuggcccaggcacguggcacgaguugcaggcucuccagguccgucacagacugguaucccauaccguuccccgggcacccccgagcccuugucuuccuugucacgugcccaacauccuggugucaugguag

SEQ ID NO: 12220 - RNA, 2328 nt, Artificial Sequence
  Description of Artificial Sequence: Synthetic coding sequence
augaaggagggcccagaggaagccggaucaggacgcuauggcccaagauauauuacugacaugggagcuggcgaagaugaugagggcuucgaagacgaucuggaccuggacaucagcuucgaggaagucaaaccccuaccagccacuaaagggggaaacaagaaguuucucguggagucgaaaaagauguccaucuccaacccuaagacuaucagcaggcuaaucccccccaccucagcaagucuacccguaaccaccguugccccgcaacccaucccaauacagaggaaagggaaaaauggaguggcaauaaugaguagguuguuugacaugccuugcgaugagacucuaugcucagcagauucguucugcguuaaugauuacacaugggguggcaguagaugucagugcacucucgggaaaggaggugaaagcuguucugaggacauagugauccaguacccacaguuuuuuggucauuccuacgucacauuugagccucucaaaaacuccuaucaggccuuucagaucacacuggaauuuagagcugaagccgaagacggccugcuucuguauuguggagagaacgaacacgguaggggcgauuuuaugagucuggcaauuauucgcaggucacugcaauuucguuucaacugcggcacagggguggccauuauaguaagcgaaaccaaaaucaaacucggugguuggcacacggugaugcuauaccgggauggcuugaauggacuguuacagcucaacaacgguaccccggugacugggcagucccagggacaauacucuaagauaacuuuuaggaccccucucuaccugggcggagcaccuagugccuacugguugguccgggccacaggcacgaauaggggcuuucaggggugcgugcaaagccuggccgugaaugggagaaggauugauaugcggccuuggccccucgguaaagcacucucuggggcagacguaggagaaugcagcuccgggaucugcgacgaagcgaguugcauacauggaggaacauguaccgccauuaaagcggauucuuacaucugucugugcccacuggguuucaaggggcgacauugcgaggaugccuucacacucacuaucccccaguuucgggaaucccuuagaaguuacgcugcuacccccuggccccuggaaccccagcacuaucugucuuuuauggaauucgaaaucacuuucaggcccgauucuggggacggcguccugcuauauucauaugacacaggguccaaagacuuccuguccaucaaucuggcugguggccacgucgaauuucgguucgacuguggcuccggaacuggcguccuccgaucggaggacccccugacccuugggaacuggcacgaacugcgcguuucgaggacagcaaagaacggcauccuccaaguggauaaacagaaaaucgucgagggcauggcagagggcgguuuuacucagauuaagugcaacaccgacauuuucaucggcggagugccuaacuacgaugaugugaagaagaauuccggggugcucaagccuuucagcggcucaauccaaaaaauaauucugaaugauagaacgauccauguaaagcacgauuucaccagcggcgugaacguagaaaacgcagcccaccccugugugcgggccccuugcgcacauggagggucuugucgaccuagaaaagaaggcuaugacugugauugcccccucgguuuugaaggguugcacugccaaaaagccauaauugaagcuauagagaucccacaguuuaucggccgcucuuaccucacauacgauaauccugacauucugaagagaguauccgggagccgauccaauguauucaugcguuucaaaaccacagcuaaggauggacugcuacuguggcgaggcgauucccccaugcggccaaacagcgacuucauuucuuugggguuaagagacggagcccuugucuucuccuacaacuugggcagcggaguggcuagcauaaugguaaacggcuccuuuaacgacgggcgcuggcaccgggugaaggccguccgugacgggcaauccgggaagauuaccguagaugauuacggggcccggacuggaaaaucgccgggaaugaugaggcagcugaacauuaacggugcccuguaugucggcggcaugaaggaaauugcgcugcauacuaaccgacaguauaugcgggguuuaguugguugcauaagucauuuuacacugucuaccgauuaucacauuucucuuguggaggaugcaguugacggcaaaaauaucaacacuugcggcgccaaauag

SEQ ID NO: 12221 - RNA, 1431 nt, Artificial Sequence
  Description of Artificial Sequence: Synthetic coding sequence
augaaauuucaaggaccacuugccugucuucuacuggcuuugugccuugguagcggugaggcuggccccuugcagucuggggaagagucuaccggaacuaauaucggggaagcacuagggcauggacuaggggaugcccucagcgaaggaguuggcaaggccauugguaaggaggcaggcggugccgccggcagcaagguauccgaggcucugggccagggaacccgugaggcgguaggcacgggcgucaggcagguaccgggguucggcguggccgaugcgcuuggcaaccgggucggagaagccgcccacgcucugggaaauaccggacaugagaucggucggcaggcugaagaugucauucgccacggggccgacgcaguuaggggcucauggcagggggugccuggucauaauggcgccugggaaacauccggaggccacggaauuuucgggucccaaggcgggcucggaggacagggccaaggcaaccccggugggcucgggacgccaugggugcacggauaccccggcaauucugccggcucuuuuggaaugaauccccagggggcgcccugggggcaggggggcaacggcggcccgcccaacuucggaacgaacacucaaggagcgguggcgcaaccuggcuaugguucuguccgcgcuaguaaucagaacgagggaugcacaaacccaccuccuagugguuccggaggcggcucaucuaauuccggcggugggagcggcucccaaagcgguuccagcggguccgggaguaauggggacaauaauaauggcucgagcucagguggaagcagcucugguaguuccucaggugguuccucuggcggcucaaguggaggcucaaguggaaauagcgggggaucaaggggagauaguggcuccgaaagcucguggggcucaaguacggguuccaguagcgguaaccauggcggcucaggcggcgggaacgggcacaaacccgggugcgagaaaccgggcaaugaggccagggguagcggcgaauccgggauccaaaauuccgagacaucacccggcauguuuaacuucgauacuuucuggaagaauuucaagucaaaacuuggauuuauuaacugggacgcuauuaacaagaaccaggucccuccccccucuacucgcgcccucuuguauuucaguagacucugggaagauuucaaacaaaauacucccuuccugaauuggaaagcaaucaucgaaggcgccgaugcauccucguugcaaaagagagcgggacgcgaugaucagaacuacaacuauaaccaacaugcuuaccccacggcuuacggagggaaauacucagugaaaacgccagcgaagggggguguuucccccaguaguagcgcuagccgggugcaaccaggauuauuacaauggguaaaauuuugguag

SEQ ID NO: 12222 - RNA, 1911 nt, Artificial Sequence
  Description of Artificial Sequence: Synthetic coding sequence
augacaacaugguccuuaaggaggcgcccggcucgcacacucggacuccucuuacucguagugcucggauuccuaguucugcgcagacuagauuggagcacucuagugccccugagauuacgucacagacaguuaggccuccaggcuaaaggguggaauuuuaugcuggaggacucuaccuucuggaucuuugggggaagcauccacuauuucagaguaccgcgcgaauauuggcgggaucgcuugcugaaaaugaaggcauguggccugaacacacucaccaccuaugugccauggaauuugcacgaaccagaacggggcaaguucgacuuuucuggcaaccuggaccuggaagccuucguccugauggcugccgaaaucgguuuguggguaauccuucgaccugggccuuacaucugcagcgaaauggauuuagguggucugccaucauggcuccugcaagacccagguaugcggcugcggacgacuuacaagggcuuuacagaggcaguugaucuauauuucgaccacuuaaugaguagaguugugccccuccaguacaaaagaggcgguccuauaaucgcagugcagguggagaaugaguauggcaguuacaacaaggaucccgccuacaugccauacgugaaaaaggcacuagaagaucgcggcaucguagaacuucugcuuaccucugacaauaaagacggguugagcaagggcauagugcagggcgugcuggcaacgaucaaccugcaaagcacacaugaguugcaguuguugacuacauuccuguuuaacguucagggaacccagccuaaaauggucauggaguauuggacugggugguuugauuccuggggcgguccgcauaauauccuggacagcucugaaguccugaagacaguuagcgccaucgucgacgcaggcuccuccaucaaccuauauauguuucacggagggacaaacuuuggauucaugaauggagccaugcauuuucacgauuacaagucagacgugaccagcuacgacuacgaugcuguccuuacugaggcuggggacuauaccgcuaaauacaugaagcuacgggauuuuuucggcucaaucuccgggaucccacugcccccucccccugaucucuuacccaaaaugccauacgaaccccuaacuccugugcuuuaccuuucccugugggacgcccugaaauaccucggcgaaccuaucaaguccgaaaaaccaaucaauauggagaaucugccagucaacggcggaaauggacaaagcuucgguuacaucuuauaugagacuucuaucacuucuucuggaaucuuguccggucacguucaugaucgcggacagguguucgugaauaccgucagcauuggauuucuggacuauaagaccacaaagauugccgugccucugauucagggauacacuguguuacgcauccuuguagaaaaccgggggcgcgugaauuacggcgagaauaucgacgaucaaaggaaaggcuugauagggaaccuguaccugaaugacucuccacugaaaaacuuccgcaucuacagucucgacaugaagaaaucauucuuucaacgauucggcuuggacaaauggagcaguuugccagagacacccacccugccugcguuuuuuuuggguagucucucuaucucgagcacuccuugugacacuuuccuaaagcucgagggaugggaaaagggaguaguguuuaucaacggacagaacuugggccguuacuggaacaucggaccccagaagaccuuguacuugcccggacccuggcugaguucuggcaucaaccaagugaucguguucgaagagacaauggccgguccagcccuccaguuuaccgagacuccucauuuagggaggaaccaguauaucaaguag

SEQ ID NO: 12223 - RNA, 672 nt, Artificial Sequence
  Description of Artificial Sequence: Synthetic coding sequence
augacacgguggaguucuuauuuacugggcuggaccacuuuuuuguuauacaguuacgaaaguuccggcggcaugcaugaggaauguguuuuccccuucaccuauaagggguccgucuacuuuacuugcacucacauucauagucuuaguccuuggugcgcgacgagggccguauacaauggucaauggaaguacugccagucagaggacuacccaagguguauuuucccauucaucuaccgcggcaaggccuauaauaguuguaucucacagggcuccuuuuugggcagucucuggugcucaguaacaucuguguucgacgaaaagcagcaauggaaguuuugcgaaaccaacgaguacgggggaaacucuuugagaaagccauguaucuuccccucaauauauaggaauaaugugguaagcgauugcauggaggacgaaucuaacaagcucuggugcccuacgacugagaauauggauaaggauggcaaauggagcuucugugccgauacccgcauuagcgcuuuagugcccggguucccuugccacuucccuuucaacuauaagaauaaaaacuacuuuaacuguacgaacgagggaagcaaagaaaaucugguguggugcgccacgucuuauaauuacgaucaagaucauaccuggguguauuguuag

SEQ ID NO: 12224 - RNA, 1368 nt, Artificial Sequence
  Description of Artificial Sequence: Synthetic coding sequence
augcuucaccccgagacuuccccaggacgaggacaucugcucgccgucuuacuggcccuguuagggacuaccugggcugagguguggcccccccaguuacaggaacaggcccccauggccggcgcccuaaaccggaaagaaucuuuccugcuucucagccuccauaacagauugagaucuugggugcagcccccagcugccgacaugaggaggcuggauuggucugacucucuggcucaguuggcccaggccagagccgcuuugugugggaucccaacccccaguuuagcuucagggcuguggcgcacucugcaggugggguggaauaugcaauugcucccagccggauuggcuucauuuguugagguagugucucugugguucgccgaggggcagagguauucccacgccgcuggagaaugcgcucggaacgcuaccuguacucacuacacacagcuggugugggccaccagcagccagcuugggugcggcagacaccugugcucugccggccaaaccgccauugaagccuucgugugugccuauucccccgggggaaauugggaagugaacgguaagacuauaauacccuacaagaagggagcauggugcagucuguguacagccuccgucucaggaugcuucaaagccugggaucacgccggagggcugugugagguuccaaggaacccaugccgaaugucuugucagaaccaugggcggcucaauauuucuacaugccauugccauuguccuccuggguauaccgggcguuacugccaaguuagguguucgcuacaauguguucacggccgauuuagagaggaggaauguagcugugugugugacauagguuauggcggcgcacagugcgcuaccaagguucacuuuccguuucauacgugcgacuugcguauagacggugacuguuucauggugaguucagaagccgauaccuauuaucgcgccagaaugaagugccagaggaagggcgggguccuugcacagaucaaaucccagaaagugcaagauauccuugccuucuaccugggucgucuugagaccacgaaugagguuauagacuccgacuucgagacacgaaauuuuuggauuggccugacguacaaaacggcuaaggauaguuuuaggugggcgaccggagagcaccaagccuucacuucauucgccuucggacaaccagauaaucacggucugguuuggcugucugcagcaaugggauucggaaacugcguugaacuucaagcauccgccgcauucaauuggaacgaucaacgcuguaagacccgaaacagauacauuugucaguuugcccaggaacacaucaguagauggggccccggaaguuag

SEQ ID NO: 12225 - RNA, 1425 nt, Artificial Sequence
  Description of Artificial Sequence: Synthetic coding sequence
auggccgauaugcagaaccucguggaacgacuugagagagccgucgggagacuagaagccgucagccacacaucagauaugcauagagguuaugccgauaguccuaguaaaggggccgcuccauacguccaggcauucgacucuuugcuggccggcccuguggccgaauaccuuaagaucuccaaagagauugggggggacguacagaaacaugccgagauggugcacaccgggcugaagcucgagcgggcgcuccugguaaccgcuucucagugucagcaacccgccgaaaacaaacuaagugacuugcuggcccccaucuccgaacaaauuaaagagguuauaaccuuuagagagaagaauagaggcucaaaacuguucaaccaccuguccgccguuagcgaauccauucaggccuuaggauggguggcaauggcuccuaaaccaggcccauacgugaaggaaaugaacgaugcagccauguuuuacacaaacaggguccugaaggaauacaaagacguggacaaaaagcacguagacugggugaaggccuaccugaguauuuggacagaacugcaggcguauaucaaagaauuucauacuacggggcuggcguggagcaagacaggcccuguugccaaagagcuuuccggccucccgucuggcccaucugcuggcuccugccccccaccaccaccgccauguccaccgccaccgccaguuagcacuauuucgugcucauacgaguccgcaucgcgcucuagccuuuucgcccaaauuaaucagggugaauccauuacucacgcgcugaaacacgucucugaugauaugaaaacccauaagaauccagcacuuaaggcacagucaggccccguacgcucugguccgaagccauucuccgcuccaaaaccgcagacaucacccucgccuaagcgcgcaacuaagaaagaacccgcuguacuggaacuggaaggcaagaaguggagggucgaaaaucaagagaaugugucaaauuuggugaucgaggacaccgagcugaaacaaguagcuuacaucuacaaauguguuaauacaacgcuccagaucaagggcaagaucaauagcauuacugucgauaauugcaaaaagcugggccuuguauuugacgauguagucggcauuguagaaaucaucaauaguaaagaugugaagguucaggugaugggaaaagugcccacaaucucaauaaauaagacggacgggugccacgccuaccucucaaaaaacucgcuggauugugaaauugugagcgcaaagucuucugagaugaauguacuaauccccacagagggcggagauuuuaacgaauuccccgugcccgaacaguuuaagacucucuggaacggacagaaacuuguaacuaccgucacagagaucgcaggguag

SEQ ID NO: 12226 - RNA, 360 nt, Artificial Sequence
  Description of Artificial Sequence: Synthetic coding sequence
augaacaagauucuuucuucaacggucugcuuuggauuacuuacauugcuguccguccucucauuucugcagagcgugcauggccgaccuuauuugacccaagguaaugagaucuucccagacaaaaaauacaccaauagagaggaauuacuccucgccuugcugaacaagaauuucgacuuucagcgcccguucaacacugaccucgcccucccuaacaaguuagaggagcugaaucaauuggagaagcuuaaagaacagcugguugaagaaaaggacucugagacuucauaugcuguagacggacuguuuaguucucaccccagcaagcgagcauguuucuggaaguacugugucuag

SEQ ID NO: 12227 - RNA, 3756 nt, Artificial Sequence
  Description of Artificial Sequence: Synthetic coding sequence
augagacugcuguugcuggucccucucuuguuagcacccgcccccggcuccagcgcuccaaaagucagaagacagagcgacacuuggggaccuuggagccaguggaguccaugcucacgaaccuguggaggcggagucucuuuccgugagaggccuuguuacucucagcgcagagauggagggucaaguugugucggcccugcuaggagccacagaucuugucgcacggaaucaugccccgacggcgcuagagauuuuagagcagaacagugcgcagaguucgacggagccgaguuccaaggacggcgguauagauggcugccuuacuacuccgcgcccaacaaaugcgagcugaauuguauuccaaagggagagaauuuuuacuauaagcacagagaagcagucguggacggcacaccuugugaacccggcaagcgggaugucugcguggacgguagcugccggguagucgggugugaucacgagcucgauuccucuaagcaagaagauaagugccugcgaugcgggggugaugguacgacaugcuaccccgucgccggcaccuuugacgcuaaugacuugucacgugccgugaagaacguaagaggcgaguauuaccugaauggacacuggacaaucgaagcagcaagagcucugcccgcagcuuccacaauucugcacuaugagcgcggcgcagagggugaucuggcgcccgagcgucugcaugccagagguccuacgagcgagccccuggugaucgaacugauuucucaggagcccaacccgggcgugcacuacgaguaccaccugccccugagacggccgagccccggauuuucuuggucccacggaagcuggucagauuguucggcggaaugcggcgggggccaccaaucacgucugguguucugcacaauugaucacgaggcauauccagaucacaugugucagaggcaaccucguccugcggaccggagguccugcaacuuacaccccuguccagaaaccaaaagauggaaggcgggcccuugggccccuuguagugccuccuguggcggagggagccagagucggagcgucuacugcauuaguucagauggagccgggauccaggaagccguggaggaagcagagugugcuggacugcccggcaaaccucccgccauccaagcguguaacuuacagcgaugugccgcuuggucucccgagcccuggggagaguguuccguuucaugugggguuggcgugaggaaacgcagcgugaccuguagaggggaaaggggcucccuucugcauacugcggccuguucuuuagaagaccguccuccucuaaccgaaccgugcgugcacgaagauugcccccugcugagugaccaagcauggcauguggggaccuggggacuuuguagcaaauccuguagcucaggaacgagaaggagacaggucauaugugcaauaggaccuccuucccauugcgggagccuccaacacucgaagcccguggauguggaaccaugcaauacccagccuugucaccugccucaagagguucccuccaugcaagaugugcauacaccagcaagcaauccuuggaugccacugggaccacaggaguccccagcaucggauagucgcggucaguggugggccgcccaggagcaccccucagcaaggggggaccaccggggggaaagaggcgacccuagaggggaccaaggcacccaccuaagugcccuaggcccugcuccuucacuacagcaaccacccuaccagcaaccacugagaagcgguagcgggccgcacgauuguagacacuccccacacgguuguuguccugauggccauaccgcuagucucggcccacaguggcagggaugcccgggagcaccuugucaacaaucaagguacggaugcugcccggauagagucagcguugcagaaggcccccaccacgcuggcugcacuaaaagcuauggcggcgauagcacgggagguaugccaaggucucgggcugucgcaucaacugugcacaacacucaccagccucaggcccagcagaaugagccaucugagugccgcggcagccaguucggauguugcuaugacaauguugcuacggccgccggcccacugggggaggggugugugggacaacccagccacgcauacccaguuagguguuuguugccuagugcccacggguccugugcugauugggcugcaagaugguauuucguggccagcguggggcagugcaauagguucugguauggagggugucauggaaacgcuaacaauuucgccagugagcaagagugcaugagcucaugccaaggcucucugcacggcccgaggaggccgcagccaggcgccaguggacgaucuacucacacagaugguggugggagcucaccagcuggcgagcaggaaccuagucagcaucggacgggagcugcgguccagcggaaacccuggcccuccgguggauuauggcgacaggaccagcagccuggacccggagaggcuccgcauacucaggccuuuggggaauggcccugggggcaggagcuggguuccagagccccaggccucggaggagacgccggcagcccagcgccaccuuuucacucuaguucuuacaggaucucccuggcaggcgucgaaccaucauuggugcaggcggcucuuggccagcugguacgccucaguugcagugacgacacggcacccgaaucucaggccgcguggcagaaggacggucagccaaucaguucggaccggcauagacugcaguuugaugggucucugaucauucauccucugcaagccgaagacgccgggacauacucuugcggaucaacacgccccggccgugauagccaaaagauucagcugaggaucaucggcggugauauggcugugcuuagcgaggccgagcuuucacgcuucccucaaccccgcgaucccgcccaggacuuuggucaagcaggugcugccggaccacuaggagccauuccaucaucccacccucagccugccaacagacuuagguuggaccagaaccagccacgagugguggacgcgagcccuggccagagaauccggaugaccugccgcgccgaaggcuuucccccgccagccauugaguggcagcgagacggucagcccguaucuucaccuaggcaucagcugcagccagacggaucuuuggugaucagccgagucgcugucgaggauggcggguuuuauaccuguguggccuucaauggucaggaucgcgaucagcgguggguccagcugcggguacugggggaacucaccauuagcgggcugcccccaacagugacuguaccugaaggggacacggcgcgucugcuuugcguggucgccggggagucggugaacauacgauggucgaggaacggucuaccuguacaagcggaugggcauagaguccaucagucucccgacgggaccuuauugauuuacaaucugagagcccgggaugaagggucauacaccugcucagcauaucaaggcucccaggccgugucuaggucaacugaggugaagguggugaguccagccccaaccgcccaaccacgggacccuggcagagauugcguggaccagccagaacuugcaaacugcgacuugauccuacaggcccaguugugcgggaacgaauacuacucauccuuuugcugcgcaaguugcucgagguuucagccccacgcccaacccauuuggcaauag

SEQ ID NO: 12228 - RNA, 1731 nt, Artificial Sequence
  Description of Artificial Sequence: Synthetic coding sequence
auggcucagggcguguuguggauucugcugggacuguuguuguggucagacccugguacagcuagucuaccccuccucauggauagcguuauacaagcacuugcugagcuggaacagaagguaccagcugcuaaaacaagacauacagccuccgcuuggcuuaugagugcucccaacagcggcccacacaaucgacuuuaucauuucuuauugggggcuuggucucucaacgccacugaacuugauccaugcccucugucaccugagcuccugggccuaacuaaagagguggcacgccaugacguucgagaaggcaaggaauacggcguggugcuggcccccgaugguucaacaguggccguggagccucuucuggcuggguuggaggcuggccuccagggcaggcgaguuauuaaucugccucuugauaguauggccgccccaugggaaacuggggacacauucccggaugugguugccauugcccccgacguacgggccaccuccaguccuggccugcgcgaugguucucccgacgucacaacagccgauaucggagcaaacacuccugaugccacaaaaggcuguccagauguucaggcaucccugcccgacgccaaggcaaaaucucccccuaccaugguggauagucuucuagcaguaacucuagccggcaauuuggggcugacuuuucuucggggcucucagacucaaagucacccagacuugggcacugaagggugcugggaccagcucuccgcgcccagaacuuucacacugcuagacccuaaagcaucccuguugacaauggcuuuccucaacggggcccuggauggcguaauucugggcgauuaucucucacgcacuccagaaccccggccuagccugagucaccugcugagccaguauuauggagcaggcguugcacgggacccuggcuucagaagcaauuuucgcagacagaacggagccgcccuuaccucagccagcauucucgcacagcaaguuuggggaacccucguccuguugcagcgccuggaacccguucacuuacaguuacaauguaugucucaggaacaacucgcccagguggcggcaaacgcgacgaaagaauuuaccgaggcuuuccugggaugcccugccauucauccaagaugucgcuggggggccgccccuuaccguggccgcccgaagcuguuacaacugccauuaggauuucuguacgugcaucauaccuacguuccggcacccccaugcacagacuucacuagaugugcagccaauaugaggagcaugcagcgguaccaucaagacacccagggcuggggcgauauuggguauagcuuugugguggguucagacggcuaugucuacgaaggccgaggcuggcauugggugggugcccacacuuugggucacaacaguagaggguuugggguggcuauaguuggaaacuacaccgcagcucuuccuaccgaggcagcacuuaggacagugagggacacccucccuucgugcgccguaagggccggcuugcugcguccagauuacgcacuccugggacaucgccagcucguacggacggacugccccggggacgcguuguucgacuuauugaggacguggccucauuuuacugcaacaguaaagccgcgaccagcacgaucggucucuaagcguuccagacgugagccuccaccaagaacacuacccgcaaccgaucuccaauag

SEQ ID NO: 12229 - RNA, 846 nt, Artificial Sequence
  Description of Artificial Sequence: Synthetic coding sequence
auguugccuaaaucacggcgugcccugacuauucaggagauugcugcccucgcgcgcucuucucuccauggcaucucacagguagucaaagaucauguuacgaaaccuacugcgauggcccaggggcgggucgcacaccugauugaguggaaaggguggagcaaacccucggauuccccugcagcucucgaauccgcuuuuaguagcuauagcgaucucagcgagggggagcaggaggcuagauucgccgcaggaguagcugaacaguuugcuaucgccgaagccaaauuacgugcuuggagcuccguggacggugaagacucuacugacgacaguuacgacgaagauuucgcuggcgggauggacacugauauggccgggcagcugccucuagguccacaucuccaggaccuauuuacuggucaucgguuuagccggcccgugaggcagggcucuguugaaccugagucggauugcagccagacugucagcccagacacacuuugcagcucccucuguagccucgaggaugggcuucuuggaucuccugccagacuugccucccaacuguuaggcgaugagcucuuauuagccaagcugccuccaaguagggaaucugcauuccgcagucucggaccccuggaggcacaagacucucuguacaacagcccacugaccgaaagcugccucuccccugcagaagaggagccagccccgugcaaagacugccagccacuaugcccuccucugacuggcucaugggaaaggcagcggcaggccuccgaccuggccuccucuggcgucgugucucuugaugaagacgaagccgaaccugaagaacaguag

SEQ ID NO: 12230 - RNA, 2619 nt, Artificial Sequence
  Description of Artificial Sequence: Synthetic coding sequence
auggguaucguuuggauucugaugucaguauugccaugguggggucggugugcugaucuggcaauugcuucuacucagcuggugcccucaaccgcaucugcucguauggcacugucuucucagcucaugggucgcacagucuggacaccuauguccgcauccgcccuucaggaacccgcuuauccagcuuuggcuagaaccucaagggcuccaagcgcugcauccguuccucuggccagccgcugcagggucacaacagcccugaucucuaccagugcccagcgcucccccacaucagcuucccucgcaccuguaccuacugcccuaggcgcauccuccgccucagcccauuuggccuuaaguucacucacuaugggaacgguggcacugacccacgggagagucagcgcauccccaguacuacgguugggguccgcccggugccccaaguuaagcacaccuccuaggccugccgccgccgcagugcgagggcugggccgagccggcgagacaccugccaacugcgugccaagaagagcuguacccggccccgaugauucaagagaagacgugaacgagugugcagagaacccugggguguguacgaauggggugugugugaacaccgauggcuccuuccgcugugaaugcccuuuuggguauucucuggacuucacagggaucaacugugucgauaccgacgaguguuccguuggccacccuugugggcaaggcacguguaccaauguuauugggggauuugagugugcgugugccgauggcuuugaacccggccugaugaugacaugcgaggauaucgaugagugcucccugaacccuuuguuaugcgcuuuccggugccauaauaccgagggaaguuaucucuguacgugccccgcgggcuacacucuccgagaggacggcgcgaugugccgagauguggacgagugcgccgacggucagcaagacugccacgcucgcggaauggaauguaagaaccuuaucggaacuuucgccuguguuuguccuccgggcaugaggccccuuccaggcaguggugaaggaugcaccgacgacaaugagugccacgcccagcccgaccuuugugugaacggccggugcgucaauacagcuggcuccuuuagaugcgauugugaugaaggcuuccaaccuuccccaaccuuaaccgaaugccaugacauccggcagggaccuuguuuugccgaggugcugcagaccaugugccgaucuuuguccucaagcagcgaggcugucacaagagcagagugcugcugcgguggggggcgaggcugggggccccggugcgaguugugcccacucccagguacaagcgcguaucgcaaacugugcccucauggcucuggguauacagcggaagggcgcgacgucgacgagugcaggauguuagcccaccucugugcccacggggagugcaucaauucacuggguaguuuuaggugucauugccaggccggauacaccccagacgccacugcgaccaccugucuggacauggaugaguguagccagguucccaagccaugcacguuccugugcaaaaauacuaaggggucuuucuuguguuccugcccacggggcuaccuuuuggaggaagacggccguacuugcaaagaccuggacgaguguaccuccaggcagcacaacugccaguucuuaugcguaaauacagugggagcguucacguguagaugcccuccagguuucacccagcaucaucaagcuugcuuugaugucaaugaaugugacggcccucaccggugccagcauggaugccagaaccaguugggaggauacagaugcuccugcccccaaggauuuacacaacauucccagugggcucaguguguugacgaaaacgaaugcgccuugucgccgccaaccuguggcucagcuucaugucgcaacacuuuaggcggguuuaggugcguauguccauccggauucgacuucgaccaggcacugggaggaugccaggaagucgacgaaugugccggacggagaggccccuguucguauagcugcgcuaauacgccugguggauuuuugugugguugcccucagggcuacuucagagcuggccaggggcacugcgugaguggccucggauuuagucccggcccacaggacaccccagauaaagaggagcugcuuucuuccgaggcuugcuacgagugcaagauaaauggucuuagcccccgggacagaccacgccgaucggcccacagagaucaccaagucaaccuggcaacacuggacagugaggcccuccugacgcugggucucaaccucucgcaccucggcagggccgaacguauucuagaacugagacccgcucuggaagggcuugaggggcgaauucgcuaugugaucgugcgcgguaaugagcagggcuuuuuuagaaugcaccacuugcguggagucucuucucugcaacuugggcgcagacggccuggaccagggacguaucggcuggaggucguuucucacauggccggcccguggggaguacaaccagagggacagcccgggccguggggucaggcccugagacuaaaaguccagcuucaacuacucuag

SEQ ID NO: 12231 - RNA, 1368 nt, Artificial Sequence
  Description of Artificial Sequence: Synthetic coding sequence
auggcucguaaggcucuaaaguuggcauccuggacuuccauggccuuggccgcaagcggcauauauuuuuacaguaacaaguacuuagacccaaacgacuucggggcagugagagucggaagagccgucgcuacaacugcagucauaaguuaugauuaccugacaucccuuaagucagugccauauggaucugaggaguaccuccagcugcgcucuaaaauucaugaccuguuucaaaguuucgacgauaccccauuaggcaccgccucuuuggcccagguccacaaggcuguucugcacgaugggcguacaguggcaguuaaggugcaacacccaaaagugagagcccaaucuucuaaagauauccugcugauggaaguguuaguacuggcaguaaagcaauuauuuccugaguuugaauuuauguggcuaguagaugaggcaaaaaaaaaucugccauuagaacuggauuuccucaacgaaggacguaacgccgagaaagucucacaaaugcugcgacauuuugacuuccuuaagguaccucgcauucacugggauuugucuaccgaacgcguauugcuaauggaguucguggacggcgggcaggugaaugacagagauuauauggagcguaacaaaaucgacgugaaugaaauuagcagacaccucgguaagauguacagcgagaugauauuuguuaacggguuugugcauugcgauccucacccgggcaacgugcuggugcgcaagcacccuggaacgggaaaggccgagaucguucugcuggaccacggccuguaucagaugcugacagaggaauuuagacugaacuauugucaucuguggcagucuuugaucuggacggauaugaaaagaguuaaagaguacucgcagagacucggcgcuggcgaccuuuacccucucuucgcuuguaugcugaccgcuaggaguugggacagugugaauaggggcaucucccaagccccaguaaccgcaacagaagaucucgaaauucggaacaacgccgcuaacuacuuaccccaaauuagccaccuucucaaccauguaccccggcaaaugcugcugaucuugaagacuaaugaucugcucaggggcauugaagcagcccucgggacucgcgcauccgccucuucuuuucugaacaugucucggugcugcauucgcgcccuggccgagcauaagaagaagaacacuugcucguucuucaggaggacucagaucagcuuuagugaagccuuuaaccuuuggcagauuaaccugcacgaacuaauccuacggguuaagggacuaaagcuggcugacaggguccuugcccuaauuugcuggcuauucccggcgccccucuag

SEQ ID NO: 12232 - RNA, 1245 nt, Artificial Sequence
  Description of Artificial Sequence: Synthetic coding sequence
augaacccuacacucggauuggcuaucuucuuggcaguccuccuaaccguaaaggggcuccuaaaaccuagcuucucuccacgaaacuacaaagccuuaagcgaagugcagggguggaaacagcgcauggcagcgaaagaauuagcgagacagaacauggauuuaggcuucaaguugcuuaaaaagcucgccuucuacaacccuggccgcaauaucuuccuuucuccacugucuauuucaacagcuuucagcaugcugugcuugggugcacaggauucuacacuagacgaaaucaagcagggcuuuaacuuccgaaagaugccggagaaggaccuacacgaaggauuucacuacauaauucaugaacucacacagaagacucaggaucugaagcuaucuaucggcaauacacucuuuauugaccagagacugcaaccacagaggaaguuucuggaggacgcuaagaacuucuacagcgcagaaacgaucuuaacaaauuuucagaaucuagaaauggcucagaaacagaucaacgacuucaucagccagaagacucauggcaaaaucaacaaccucauagagaacaucgacccaggaaccgugaugcuccuggcuaauuacauuuucuucagagcccgguggaaacaugaauuugacccuaaugugaccaaggaggaagacuuuuuucucgaaaaaaacucguccgugaaggugcccaugauguuccgcucagguaucuaccagguaggauacgaugauaaacugagcugcacaauccuggaaauuccuuaucagaagaauauuacagccaucuucauucugccagaugagggaaagcucaaacaccuugagaaaggccugcaggucgacaccuucuccagguggaaaacacugcuuucaagacgagucgucgacgucucagugccgagacugcauaugacgggcacuuuugacuugaagaagacacucuccuauaucggaguuucaaagauuuuugaggagcacggagaccucacaaagauagcaccccaccguucucugaaggugggagaagccgugcacaaagccgaauugaaaauggacgagcggggaacugagggagcagcugggacaggagcacagacccugcccauggaaaccccccuaguggugaaaauugacaagccuuaccuccuccugauauacagcgaaaaaauacccucaguguuauuucucggcaaaauugucaauccaauuggcaaguag

SEQ ID NO: 12233 - RNA, 942 nt, Artificial Sequence
  Description of Artificial Sequence: Synthetic coding sequence
augagcgaucuccugcuguuagggcucauuggcggucugacucuucuacuauuauugacccucuuggccuuugcuggguacucagguuuacucgcuggaguggaggucucugccgguagcccgccaauuaggaacgugacgguagcuuacaaauuucacaugggccuguauggagaaaccgggagauuauucacagagucauguucuauaucgccaaaauuaagaucaaucgccgucuacuacgacaauccacacaugguccccccggauaaaugcagaugugcagugggauccauccugucugagggugaggaguccccuagccccgagcugaucgaccuuuaucagaaguucgguuuuaaagucuuuuccuuuccugcucccucacacguagugacugcaacauuuccuuacacgacuaucuugagcauuuggcuugccaccaggcgcguccauccugcauuagauacauacauaaaggagcggaaacuuugcgccuauccccgguuggagauauaucaggaggaucagauucacuuuauguguccucuggccagacagggagauuucuacgucccugagaugaaggaaaccgaauggaaauggagaggcuuaguggaagccauugacacgcagguggauggaaccggagcagacacuaugucagacacgucuucuguuucucuggagguuagcccuggcucacgcgagacaucagccgccacccugagccccggagcuagcucacgcggaugggaugacggcgauacgaggagcgagcacucguauucagaauccggagcgucuggauccucauucgaagaacucgaccuagagggcgaggggccucuuggagaaucuaggcuugauccgggcacggagccccuugguaccacgaagugguuaugggagcccacagcuccagagaaaggcaaagaauag

SEQ ID NO: 12234 - RNA, 603 nt, Artificial Sequence
  Description of Artificial Sequence: Synthetic coding sequence
auggccuggggaggagugcauaccugcuguuuccaccuuugcugcugcugcaguuggccucaaggcgccguuccagaggagcuacacaagcaucccgggcaaacucuucuucuccaaugccaauacucucccaaaagagggcccuaccagccuaaaaguuggugucagcagacaucucccucucgaugcacauuguugguaacuaguucgaaaccauggaccgccguucaaaaaucccacuacacgaucugggauaaaccuaacgcuggcuucuuuaauaucacaaugauccagcuuacgcaaaaugacucagguuuuuacuggugcgggaucuacaaugccucugagaacaucaucacuguccuacgaaacauauccuuagucgugucuccagcacccacuacuuccccuauguggaccuuaccauggcuuccaacuagcaccgugcuuauuacuaguccagaaggcaccuccggccauccuuccaucaaugggagcgagacucgcaaaucuagggcccccgcuugucugggaaguggcggaccacguuuucugguguuggugcuguguggacugcugcuggcuaagggucuuaugcucuag

SEQ ID NO: 12235 - RNA, 1035 nt, Artificial Sequence
  Description of Artificial Sequence: Synthetic coding sequence
acaacacccucucgagcacugccuggcuggagcaauugucgaccucgcuggcgugcuggcccaacaccucagucacccacuccucaguccagaaugcgcuugaguccagguccccccucugaguggaccuggcuccugccccacuucaaccccugucaucaccaucaccgccaccaucacccaaauccuaccaccagucuuuugccuacagaaccgccauccggacccgaaguaucaagccaagggcgggaagcaaguugugagggcacacugagagcuguagacccuccugucagacaucacagcuacggaagacaugaaggcgccuggaugaaggaucccgcugcucgggacgacagaauauacguuaccaauuauuacuauggcaacucgcucguggaguuucggaaccuggagaauuucaagcagggaagguggucgaacauguauaagcugccauauaacuggaucggcaccggacacguaguuuaccagggugcauuuuacuacaaccgagccuucacgaaaaacaucauuaaguacgaucugcggcagagguuuguggcuucuugggccuuauugccggacguugucuacgaagauacgacaccuuggaaauggcgcggacauagugacauugacuuugccguagaugagucuggcuuguggguaaucuauccagcgguggacgacagagacgaagcccagccugaagugauuguccugucuaggcuggaccccggagaccucucaguucauagagaaaccaccuggaagacaagguugcgccgaaacuccuaugggaauugcuucuuggucuguggcauuuuauaugccgucgauacuuauaaucagcaggagggccaggucgccuacgccuucgacacccacacagggaccgaugcccgaccucagcugccuuuuuugaacgaacaugcuuauaccacucagaucgacuacaacccaaaagaaagaguacuguacgccugggacaacggccaccagcugacauacacacugcauuucgucguguag

SEQ ID NO: 12236 - RNA, 2682 nt, Artificial Sequence
  Description of Artificial Sequence: Synthetic coding sequence
auggccgaggccgcccucgaagcuguccggagugagcugagggaauuuccugcugccgcucgcgagcuguguguuccucuugcagugccuuacuuggauaagccuccaacuccucuccacuucuaccgggacuggguuugucccaauaggccuugcauaauucgcaaugcauuacagcacuggccugcccugcagaaguggagucuccccuauuuccgagcaacuguugguucaacggaagugagcguggcagucacaccugauggauacgcggacgcugugcgaggagacagauucaugaugcccgcugagaggcgguugccccucuccuuuguuuuagaugugcuagaaggucgggcccagcaccccggagugcucuacguccaaaagcagugcagcaaccucccaagugaguugccucaguuacuuccagauuuggagagucaugugcccugggcgucugaggcucucggaaagaugccugacgccguuaauuuuuggcucggagaggccgcagcugugacuaguuugcauaaggaucauuacgaaaauuuguauugugugguuuccggggaaaagcacuuuuuauuucacccgccaagcgauaggccuuucauccccuacgagcucuacacacccgccacguaucagcucaccgaggaaggcaccuucaaaguugucgacgaggaagcuauggaaaaggcugaagugucaagaacuugcuuguuaaccguaagggugcuucaagcccacagacucccuagcaaggaccuagugaccccguccgauuguuauguaacacucuggcuuccuacggccugcagucaccgccuucagacgcgcacagugaaaaacucauccucccccguguggaaccagucguuucacuucagaauccacagacagcugaaaaaugugauggagcugaaagucuuugaccaggaccucgugacuggcgacgauccugucuugucuguacuuuucgaugcaggcacucuucgggcaggcgaauuccguagggaauccuucuccuuguccccccaaggcgagggaaggcuggaaguggaauucagacugcagaguuuggcagaucggggcgagugguugguuuccaaugggguauugguggcaagggagcuuucaugccuacacgugcaguuagaagaaaccggggaucagaagucuagcgagcaccggguacagcuggucgucccaggcagcugugaaggaccccaagaagccaguguagguaccggcacuuuucgcuuccauugccccgcuugcugggagcaggaguuauccauaaggcuacaagacgcuccagaggaacagcucaaagcuccacugagugcucugccuagcggucagguuguccgccugguguucccaacaucucaggagccucucaugcggguugaacuuaaaaaagaagccggucuccgagagcuggcgguccgccuggguuuuggcccaugcgccgaggaacaggcuuuucuaucuagacggaaacaggucguggccgcugcgcucagacaggcuuugcaacuagacggcgauuugcaggaagacgagauccccgucguggccauuauggcaacaggagguggaauucgcgccaugaccagucucuacgggcagcuggccggccugaaggaacugggauuauuggacugcgugucguacauuacuggcgcuaguggauccacuugggcuuuagccaaucuguacgaggaucccgaguggucucagaaagacuuggccgggccaacagaauugcucaaaacacaaguaacaaaaaauaaacucggugugcuggcuccuucacagcuucagcgcuaccgacaagaacucgccgagcgcgcacggcuaggauaucccuccugcuucaccaaucugugggcacugauaaacgaagcucuucuacaugacgaaccacaugaucacaaacugagugaccagcgugaagcacugagccacggccagaauccucuccccaucuauugcgcucucaacaccaaaggacagagcuuaacaaccuuugaauuuggcgaguggugugaauuuagcccuuacgaggugggguucccuaaguauggugcuuuuaucccaagcgaacuuuuuggcucagaguucuuuaugggccagcugaugaagagguuaccagagucuagaaucugcuuucuggaggggauuugguccaaccuuuaugcugcuaaucuccaggauucacuguacugggccucugagccgagccaauucugggaccgaugggugagaaaccaggcuaaucuggacaaagaacaggugccgcugcuuaagauagaggagccucccuccaccgccggucggauugcagaguucuuuaccgaucuucuuacauggagaccacucgcccaggccacucauaauuucuuacgagggcugcacuuccauaaagacuauuuccagcacccccacuuuagcacuuggaaagccacaacucuugauggccuacccaaucaacugaccccaucugaaccccaccugugcuuguuggaugugggauaccucaucaacaccaguugucuuccucuacugcaaccaacaagagauguggaccuaauucucucuuuggacuauaauuugcacggcgcuuuccaaggcucugguggacacccaagacggcgucaacuggggagauag

SEQ ID NO: 12237 - RNA, 354 nt, Artificial Sequence
  Description of Artificial Sequence: Synthetic coding sequence
augauuauagacagcagucggaucccaucauucacccaacuccauagcacuaugacuagggcgccccugcuuuuguuguguguagcacugguccugcuuggacacgucaauggcgcaacugucagaaaugaagauaaauggaaaccucugaacaacccacgaaaucgagauuuauucuucagacgccugcaagccuauuucaagggacgcggacucgaucuuggcaccuuucccaaucccuuuccuacaaacgagaauccgaggcccuuguccuuccagagcgaauugacagcuagcgcuuccgccgacuaugaggaacaaaagaacucauuucacaacuauuuaaaaggcuag

SEQ ID NO: 12238 - RNA, 4143 nt, Artificial Sequence
  Description of Artificial Sequence: Synthetic coding sequence
augcgucaugguguggcaugggcucuccugguugccgcugcccucgggcucggugcgaggggcgugcgcggcgcugucgcuuuggccgauuucuacccuuuuggcgccgagagaggcgacgcugucacaccaaagcaagacgacggugggucaggccugcgaccgcugucggugccauucccuuuuuuuggcgcugagcacucgggauuauacgugaauaacaauggcaucauaucuuuccugaaagaggugagccaguuuacccccguggccuucccuauugcgaaggauaggugcgucgucgcugcauuuugggcugauguggacaauaggcgugccggagauguuuacuaucgugaagcaacggacccggcuaugcuccggagggccacggaggacgugcggcacuacuuccccgagcugcucgacuucaacgcaaccuggguguucguugccaccugguacagggucacuuuuuuuggagggagcuccuccuccccggugaacacauuccaaacaguacuaauuacugaugggaaacugucuuucaccauuuucaacuaugaaucuauuguguggaccacagggacacacgcuagcucugggggaaacgcuacuggguuagguggcauugcugcacaggccggcuucaacgcuggggaugggcagcgauacuucucuauuccuggcagccggaccgcggacauggcggaagucgagaccaccacgaaugucggugugccaggacguugggcuuuucgaauugaugacgcgcaaguacgcguaggaggcugcggacauaccacuaguguuugccucgcccucagaccaugccugaauggugguaagugcauugacgauugugugaccggaaacccaagcuauacaugcuccugucuaucuggcuuuacuggaaggagaugccaccucgacgugaacgaaugugcaagucagccuugucaaaauggcgguacuuguacacacggaaucaauaguuucagaugccagugucccgcugguuuugggggacccacaugcgaaacggcucagagucccugugacacuaaggaaugucagcauggagggcagugccagguggagaauggcuccgcugucuguguuugccaggcuggcuacaccggagcugcuugcgagauggacgucgacgauugcuccccggacccaugccugaauggggggucuugcguggaccuugugggcaauuauacuugucuuugugcagaaccuuucaaaggucuacgcugcgaaacuggugaucaucccguucccgacgcaugcuuguccgccccuugucacaauggcggaaccuguguggacgcagaccagggcuaugucugcgaauguccggaaggcuuuaugggauuagacugccgagagagagugccagaugauugcgagugucgcaauggcggccgaugucugggcgccaauacuacuuugugccaguguccucucggcuucuucggucugcugugcgaguucgaaauaacagcaaugcccuguaauaugaacacucagugucccgacgggggauacuguauggagcacggcggcagcuacuugugugucugccacacagaucauaaugccucgcacucacucccaagcccaugcgacucugauccauguuucaauggcggcaguugcgaugcacaugaugacuccuacacgugugagugcccaagaggauuccacggaaaacacugcgagaaggcacguccccaccucuguagcagcggacccugucggaacggaggcacuugcaaggaagccggaggugaguaucacuguucauguccguauagauuuacuggucgacauugugagauuggaaagccugacuccugcgccuccggacccugucacaacggcggcaccugcuuucacuauauaggcaaguacaaaugcgauugcccucccggauucagcgggcgccauugugaaaucgcgccgagcccuuguuuuaggucgccaugcguuaauggaggcacgugcgaggauagggauaccgacuucuuuugccacugccaggccggcuacauggggcggaggugccaggccgaagucgacugcgguccccccgaggaggucaagcaugccacacugcgcuuuaaugguacuagacugggugccgucgcacuguacgcaugcgaccgugguuacucuuugagcgccccgucacggauacgggugugucagccccacggcguguggucagaaccaccucagugccucgagaucgacgaaugccgcagccaaccuugccugcauggcgguuccugccaagaucgcguggccggcuaucugugucuuugcuccaccgguuacgagggagcgcauugcgagcuugaacgagacgaguguagggcccauccuugccgcaacggugguucuugccggaaucuccccggggccuacguaugcagauguccugcagguuuugucgguguccauugcgaaaccgagguggacgcuugugacaguucaccaugccagcacggcgggcgaugcgaaucaggagguggcgccuaccuuugcguguguccagaaucauucuucggcuaccauugugaaacaguuuccgaucccuguuucuccuccccuuguggaggccgcggcuauugccuggcaucgaacgggucgcacucaugcacauguaagguaggcuauaccggcgaagauugugccaaggaguuauucccuccuacagcccuaaagauggaacgggucgaggagucgggggugucgauuuccuggaauccccccaauggaccagcugcccgccaaaugcucgacggauaugcagucaccuaugugucuucagacgguuccuaucgcagaaccgacuuugucgaccguaccagaaguucucaccagcuucaggcccuugccgcuggucgugcauauaacauuucaguuuucucuguuaagcgaaacaguaacaauaagaacgacaucucgcggccagcugugcuucuagcacgaacaaggccaagaccugucgaaggauuugagguaacgaacgugaccgccaguacaauuaguguucagugggcccuccacaggauucgacacgccacagugucugggguccgcguguccauucggcacccggaagcccuuagagaucaagccacagauguugacagaagcguggacagauuuacauuccgcgcccuuuugccuggaaagcgguauacuauccagcucacuacccucucugggcuccggggcgaagagcacccaacggaaagccuggccacggcacccacgcauguguggacucgcccacugccucccgccaaucugacugccgcucgggucaccgccaccuccgcacacgucguaugggaugcaccaacucccgguucauugcuggaggcuuacgucaucaacgugacaacuagucagucuacaaaauccagauacgugccaaauggaaagcuggccagcuacacuguccgcgaccugcuccccggccggagguaucaguugucggugauugcaguucagucuaccgagcuugggccacaacacuccgagccggcacauuuguauaucaucaccuccccucgcgacggcgcagaccgaagauggcaucagggcggacaccacccucgcgugcucaagaaccgaccaccaccugcuagauuaccugagcuacgacugcugaaugaccacagcgcccccgaaacgccuacacagccuccaagguucagugaacuugucgacgggaggggccgggugucugcuagauucgguggcagcccaucuaaggcagcuacagugcggucucacguucccggcaauuguuccgagaacccuugccaaaacggcgguacuugugugcccggggccgaugcucauucuugcgauuguggaccaggguucaaggggagacggugugagcuugccuguauuaaggucagucgaccuuguacgcgucuguuuagcgagaccaaggccuuuccagucugggaagggggagucugucaucacgucuauaaacgaguguaccgaguucaucaggauauaugcuucaaagaaucaugcgaaaguaccagcuuaaaaaagaccccaaacagaaagcagucuaaaagccagacccuugagaaaagcuag

SEQ ID NO: 12239 - RNA, 474 nt, Artificial Sequence
  Description of Artificial Sequence: Synthetic coding sequence
auggaggcccuccggagagcacaugaaguggccuuacgccuccuccugugcagaccaugggcuagcagagccgcugccaggccuaaacccagugcaucugaaguuuuaacaagacaucuucuacagcgucggcuaccacauuggaccaguuuuugcgucccauauucugccguccgaaaugaucaguucggccuuucccauuuuaauuggcccgugcaaggugccaacuaucacguucugcggacaggauguuucccuuucauuaaguaccacugcucuaaggcuccguggcaggaccuugccagacagaaucgcuucuucacggcacugaagguugucaaucuagguauuccuaccuugcuguacggauuagggucauggcucuucgcccgggugacugagacaguccacacuucauacgggcccaucacuguauauuuucugaacaaagaggacgagggcgcgauguauuag

SEQ ID NO: 12240 - RNA, 288 nt, Artificial Sequence
  Description of Artificial Sequence: Synthetic coding sequence
augaaaggaucucgugcauuguuauugguggcccuuacuuuauuuugcauuugcagaauggcaaccggagaggauaacgaugaauucuucauggacuuucugcaaacucugcuuguggggaccccugaagagcuguacgaaggaacccugggcaaauacaacgugaaugaagacgccaaagccgcaaugaccgagcuuaaaaguugcauagacggccugcaacccaugcacaaagccgaauuagucaagcuucugguucaggugcugggaucacaggacggcgcuuag

SEQ ID NO: 12241 - RNA, 1053 nt, Artificial Sequence
  Description of Artificial Sequence: Synthetic coding sequence
augaaauguucuuugagaguaugguuucugaguguggcuuuucuccugguguuuaucaugagccuucucuuuacuuacagccaccacagcauggccacccucccuuaccuggacagcggugcccucgaugggacacauagggugaaacucguuccuggcuaugcaggccuccaacggcugaguaaagagagauuaagcggaaaaaguugugccugcagaagaugcaugggcgaugcaggagccagcgauugguucgacagucauuucgauggcaacauuagucccgucuggacccgagaaaacauggaucuacccccagauguucagcgaugguggaugaugcuccagccacaauuuaagucccacaacacgaacgagguuuuagagaagcuguuucagauagugcccggcgagaaccccuaucgcuuuagagauccacaccagugucgacgaugugcaguggucggaaacuccggaaaccuuagggggucuggauauggacaggacgucgacggccauaauuucaucaugaggaugaaucaagcuccuaccgugggcuuugagcaggacgucgggagcagaacaacucaccacuucauguacccugaguccgccaaaaaccugccugccaacguaucuuuugugcuggugccauuuaaaguacuggaccuucuguggaucgcaucagcccucuccacuggacagauacgguucaccuaugcaccagucaaguccuucuugagaguugauaaggagaaaguucagauauauaauccggccuuuuucaaauacauucaugaucgauggacugaacaccauggacgauacccuucuacagguauguuaguucucuucuucgcucuacacguuugcgaugaaguaaaugucuacggauucggggcugacucccgaggcaacuggcaccacuauugggagaacaacagauaugccggugaauuucguaagacaggcguacacgacgcagacuuugaggcucacauaauugacaugcuggcaaaggcaaguaagauugagguauaucgcgggaacuag

SEQ ID NO: 12242 - RNA, 600 nt, Artificial Sequence
  Description of Artificial Sequence: Synthetic coding sequence
auggccucucccgaggcccccgaaaguguugugcaauucgcacuggauaagcuggguggacucgauuacuuaguacugaaccauaucgggggugccccggccggaacacgcgcgagguccccucaggcaacaagauggcuaaugcaagucaacuucgugucauacguucagcugacuucuagggcgcuucccuccuugaccgauucaaagggaucuuuggucguugugucuucccugcugggcagggugcccacgaguuucucuaccccauauucagcagccaaauuugcccucgacggauuuuucggaucucucaggcgagaacuggacgugcaggaugucaacguggccaucacaaugugcguacugggccuucgugacagggcaucagccgccgaggcagugcgcgggguuacucgagugaaggccgccccgggcccaaaggcagcccuggcggugauucguggaggggcaacaagagccgccggcguuuuuuacccuuggagauuuaggcugcugugccuguuaaggaggugguugccaagacccagagcaugguuuauccggcaggaguugaauguuaccgcugcugcagcguag

SEQ ID NO: 12243 - RNA, 411 nt, Artificial Sequence
  Description of Artificial Sequence: Synthetic coding sequence
auggugcggccauacccucugaucuauuuucuguuccuaccccucggggccuguuuccccuuguuggauagaagagagccuaccgaugcgaugggcggucugggagcaggcgaaagaugggcggaccuggccaugggcccgcgaccucacucagucugggggagcuccagaugguugagggccucccaaccccaggcuuuauuggugauagcuagaggacugcaaacuuccgguagggaacaugcuggcuguagauucagguuugguagacaggaugagggauccgaggcuacugguuuucuaccagccgcuggggagaagaccuccggaccucugggcaaccuggccgaagaacuuaacgguuacucccgcaagaaggguggauuuagcuucagguuugggagaagauag

SEQ ID NO: 12244 - RNA, 663 nt, Artificial Sequence
  Description of Artificial Sequence: Synthetic coding sequence
augcgaggccagggcagaaaagaaucucugucagauucuagggacuuggacggguccuaugaucaacucaccgauucagucgacgaugaguuugagcugucaaccguuugccacaggccagaaggacuugaacaguuacaggaacagacaaaauuuacccggaaggagcugcagguucucuacagagguuucaaaaaugagugcccuucuggcauugugaaugaggaaaauuuuaagcagaucuacagucaguucuuuccacagggagauucuagcaccuaugcaaccuuucuuuucaacgcauucgauaccaaccacgaugggucugugagcuucgaagacuuugucgccggcuugucugugauacugagggggacgguggacgauagacucaacugggccuuuaaccucuaugaucuaaauaaagacggaugcaucacuaaagaggagaugcuugauauuaugaaaucuaucuacgacaugaugggcaaauauacguaucccgcauugagggaggaagcuccaagggaacauguggagaguuucuuucaaaagauggacaggaauaaagacggugugguaacaauugaagaauuuaucgagucuugucagaaggacgagaacauuaugcggagcaugcaacucuuugauaacguuauauag

SEQ ID NO: 12245 - RNA, 2175 nt, Artificial Sequence
  Description of Artificial Sequence: Synthetic coding sequence
augcucagaacaagcacccccaaucucugcgggggauugcacugucgcgccccuuggcuuucuagcggcauccugugccugugccugaucuuccuccugggccaaguggggcuucuucaaggccauccucagugccuugauuacggaccgcccuuucagcccccucugcaccucgaauucuguucugacuaugaaaguuuuggauguugcgaccagcauaaggaucgacggauugcagcucgcuacugggauauuauggaauauuucgaccugaagcgacaugagcugugcggggacuacaucaaagauaucuugugucaggaauguagcccguacgccgcucaccucuacgaugccgaaaauacccagacuccccugagaaacuugccugggcugugcagcgacuauuguagcgcauuucauagcaauugccacagcgccauuagucugcugaccaacgacagaggacuucaggaaucacacggccgcgacgguacccgcuucugucacuuacucgaucugcccgauaaagauuauuguuuuccuaacgugcucagaaacgauuaucugaaucgccaccuugguaugguugcacaggauccucaagggugccuucaauugugucuuucugaggucgccaacgggcugagaaacccaguauccauggugcaugcaggcgacggcacccacagauuuuucguggcugagcaggugggcgugguguggguuuacuugcccgaugguucucgucuggagcagccauuccuggaccucaagaacauaguccucacuacucccuggaucggcgacgaaagagguuuucugggacuggcuuuucauccuaaauuuaggcacaacaggaaauuuuauauauauuacucaugccuugacaagaaaaaaguugaaaaaauucgaauaucagaaaugaaagucucucgugcugacccuaacaaagcugaccuaaagagugaacgagugauccucgaaaucgaagagccugcauccaaccacaauggggggcagcuguuauucggacuugacggguauauguauauauucacgggcgauggugggcaggcuggggauccuuucggacuguuugguaacgcgcaaaauaagagcagucuacucggcaaaguauuacguaucgacgugaaccgcgcuggcucccacggaaagagguauagggugcccuccgauaaccccuuugucucagaaccaggagcacauccugcgauauacgcguauggcauacggaacauguggaggugcgccguggauaggggugauccaauaacuaggcagggucgcgguagaauuuuuugcggcgacgugggucagaaucgcuucgaggaaguggaucucauucugaaagggggaaacuacggauggagggccaaagagggauuugcaugcuaugauaagaagcuuugccacaacgcgucacucgaugacguucucccuauuuaugcuuacggacacgcuguagggaaaagcgugacaggcggcuacguauaccgcggcugcgaaagcccuaaucuuaacggucuguacaucuuuggagacuuuauguccggacgccugauggcucuccaggaggaucguaaaaauaaaaaauggaagaaacaggauuugugccucggcagcaccacaucuugcgcuuucccuggucucauuagcacccauucgaaauucaucaucuccuuugcugaagacgaggcaggagaacuauacuuuuuggccaccuccuaucccuccgccuacgccccacgaggcucuaucuauaaguuuguggacccaucaagacgggcaccuccagguaaaugcaaguauaaaccaguccccgugcggacuaaaucgaagagaaucccguuccgcccacuugccaaaacaguauuggaccugcucaaggaacaaagcgagaaagcagcccgcaagucuucuagcgcaacccucgccucugggcccgcccaggggcugucggagaagggcagcucaaaaaaacuggccuccccaaccuccucaaaaaauacguugcgggggccugggacaaagaaaaaggcaagggucggcccacacguacggcagggcaaaaggcggaaaucgcuuaagucccacucugguaggaugcggccuucggcugagcaaaagcgugcuggccgcagcuugcccuag

SEQ ID NO: 12246 - RNA, 1218 nt, Artificial Sequence
  Description of Artificial Sequence: Synthetic coding sequence
augugguaugugagcacacgaggggucgcaccaagggugaauuuugagggagcacuuuuuucugguuaugcacccgauggcggucuauuuaugccugaagaacugccucaguuagacagggggacccugugucaauggucaacacucaguuaucccggacuugugaaggagcucugugcccuguucauagguucagaguugcugccuaaagaugaacuuaacgaccugaucgaucgggcauuuuccagguucagacacagagaggucgugcaccuuagucggcuacguaauggacucaacgugcucgagcuguggcacggugucaccuacgcguucaaagaucuuagucuguccuguacaacacaauucuuacaguacuuccuggagaaacgcgaaaaacauguaacugugguuguuggcacauccggagacacuggcagugccgcaauugaaagcguacagggcgcgaaaaauauggauauuauaguucugcucccuaagggacacuguacaaaaauacaggagcugcagaugacuaccguccuuaagcagaauguacacguguuuggaguggaaggcaauuccgacgaauuggacgagccuauuaaaaccguguuugcagauguagcauuuguuaaaaagcacaauuugaugucccucaacagcaucaacuggucaagggugcuaguccagauggcccaucauuucuucgcauauuuccaguguacuccuagucucgacacacacccccuaccccucguggaggucgucgugcccacuggagcugcaggaaacuuggccgccggauacauugcucagaagaucggccucccuauccguuuagucguagcaguaaaccguaaugacaucauacaccgcacagugcagcagggagacuuuagcuugucagaagcaguuaagagcaccuuagcuagugcuauggacauucaaguucccuacaauauggagcgugucuuuuggcuucugaguggauccgacagccaagugacacgggcccuaauggaacaguuugaacggacgcaaaguguuaaucuucccaaggagcuccacucgaagugggagagacaggacuaugaaaaaauggcagucauggaaugugacgguuguugcguagagcugugcuugggcaacugugguccccgacggggauccgugaccgacaucccugggacagcuauggucaggggcggcggguag

SEQ ID NO: 12247 - RNA, 492 nt, Artificial Sequence
  Description of Artificial Sequence: Synthetic coding sequence
augacuaugcgacauaacuggaccccugaccuauccccccucugggucuuacuuuugugcgcccauguggugaccuugcugguaagggccaccccaguuucucagacgacgaccgcugcuacggccucagugcgcucaacaaaggauccaugcccaucccaacccccugucuucccugcugccaagcaaugucccgccuuggaggugacguggccagaaguggaaguaccucuuaacggaacucugucccucucgugcguggcguguucucgguuuccaaauuuuagcauucuguauuggcuaggaaauggaaguuuuaucgagcaucugcccgggaggcucugggaagggaguacaucacgagagagaggauccacaggcugggccgaaggcaaccuggcaccccacccccggucaccagcccuacagccucagcagucuaccgcggcaggacugcgucugucuacaggccccgcugcagcucagcccuag

SEQ ID NO: 12248 - RNA, 1590 nt, Artificial Sequence
  Description of Artificial Sequence: Synthetic coding sequence
auggcaccagcaagaacuauggcucgggcccgacuggcucccgccggcauuccugcgguggcauuguggcuucuuuguacccugggacuucaaggcacccaagcaggcccuccuccugcuccgccaggcuuaccagcaggcgcugauugucucaauucuuuuacagcaggagucccuggauucgugcuggauacaaacgcuucugucucaaauggagcuaccuuucucgaaucucccacuguuagacguggcugggacugcguccgggcaugcuguaccacacagaauugcaaccuggcacuuguggaguugcagccagaccguggggaggaugcaaucgccgccuguuuccuuauuaacugccucuaugagcagaacuucguuugcaaguucgccccuagagaagguuuuauuaauuaccugacgagggaagucuacagaucuuaucgucagcugagaacucaggguuuuggagggagcggaauacccaaggcgugggccgguaucgaucugaaagugcagccccaagaaccucuggugcugaaggacguggagaacacugacuggagacugcugagaggugacacggaugugcgcguggaacggaaagaucccaaccaaguugagcucuggggccugaaggaggguacuuaccuguuccaguuaacaguuacuucauccgaucauccagaggacaccgcaaaugugaccgucaccgugcugucuacaaagcagacagaagacuauugucuugccuccaauaaagucggccgcugccggggcagcuucccuagaugguauuaugauccuacagaacagauuugcaagucauucguauauggcggcugccucggaaauaaaaacaacuaucugagagaagaagaauguauccuggccuguagaggugugcaaggcggaccccugagagguaguucgggggcucaggcuacuuuuccccaaggcccauccauggaacggcggcauccaguuugcuccgggacgugucagccuacccaauuccgcuguuccaacggguguugcauagauucauuucuugagugcgaugauacgcccaauugcccugaugccagcgaugaggcugccugugaaaaguauacaucaggguuugacgaguugcagagaauccauuuccccagcgacaaaggacacugcguugaccugcccgacaccggacuuuguaaggagucgauuccgagaugguacuacaaccccuucagcgaacauugcgcccgguuuacuuacggggggugcuacgggaauaagaacaacuuugaagaggagcaacagugccuggaauccugccgagggaucucuaaaaaggacguuuucggacuucgacgagagauccccaucccuuccacuggcuccgucgagauggccgucgcuguguuucucgugauaugcauuguagugguaguggccauucugggcuacuguuucuuuaagaaucagcgaaaggauuuucaugggcaucaucaucaucccccgccgaccccugcuuccagcacagugucaaccacggaggacacagaacacuuaguguacaaccacacaacgcggccacucuag

SEQ ID NO: 12249 - RNA, 1803 nt, Artificial Sequence
  Description of Artificial Sequence: Synthetic coding sequence
augcaggggccccugcuucugccaggucuuuguuuccucuugucgcucuucggcgcagucacgcaaaagacuaaaaccucgugcgcuaaaugcccuccaaacgccuccugcguaaauaauacacacugcaccugcaaucacggcuauaccaguggcaguggacaaaaacuguucacauucccucuggagacaugcaacgauaccacauccucaaagaccaccgaagguagaaaggaguuacagaaaaucguagauaaguucgaaucacugcugacgaaccaaacgcuauggagaaccgaaggcagacaggaaaucucguccacagccacaacgaucuugagagacguggaaucaaaaguccuggaaacugcauugaaggauccugagcagaaaguucugaaaauucagaacgacucaguagccauugagacacaggcuaucacagacaacuguagugaagaaaggaagacauuuaaccucaacgugcagaugaacucgauggacauuagaugcagcgacauuauucaaggggauacccaaggacccagcgccauugcuuucauuagcuacagcagccucggaaauaucaucaaugcaacuuuuuucgaggagauggacaaaaaagaucagguauaccuuaacucccagguagucuccgccgcuauuggcccgaaaagaaaugucagucugucgaaguccguuacucugaccuuucagcacgugaaaaugaccccaucgacaaaaaaaguauuuugcguuuauuggaaaucaaccggucaaggcucacaauggucaagggacgggugcuuucugauccacgugaauaaaagccacacaauguguaacugcagucauuugagcagcuuugcugugcugauggcccugacaucacaagaggaagauccugugcugacaguuaucaccuaugugggacugucuguuucccuucuuugccugcuucuggccgcucugaccuuucugcuuuguaaagcuauccguaacaccucaaccagucuccaccuacaauugucccugugccuguuuuuagcacaccuucuuuuucugguaggcauugaucggacagaaccgaaggugcugugcaguaucauugccggggcccugcauuaccuguaccucgccgcguuuacuuggaugcuccucgagggugugcaucuguuucugaccgcacgaaaccucacaguggugaacuacagcucuaucaaucgucuuaugaaguggaucauguuuccugugggguacggcgugcccgccgugacgguugccaucuccgcagcuucuuggccacaccucuacggcaccgccgacaggugcuggcugcaucucgaucaaggcuucaugugguccuuucugggcccaguuugugccauauuuagcgcgaaucucguccuguuuauucucguguuuuggauuuuaaaacgcaaguuauccucauugaacagugagguuagcacaauacaaaauacgcgaauguuggccuucaaggcaaccgcucagcuuuucauccuugguuguaccuggugccucggcuuacuacagguuggacccgccgcccagguuauggcuuaucuguucaccauuauuaacagucuccagggguucuucauuuuucuggucuauugcuugcugucucaacagguucaaaaacaauaucaaaagugguuucgagagaucgucaaaucuaaauccgagucagaaacauacacuuuaucuucgaagaugggcccugauagcaagccgagugagggggacgucuuuccaggacagguuaaacgcaaguacuag

SEQ ID NO: 12250 - RNA, 660 nt, Artificial Sequence
  Description of Artificial Sequence: Synthetic coding sequence
augaaacuccugcucugggccuguauuguuuguguggcauuugccagaaaacgccguuucccuuuuauuggcgaggacgauaaugacgacgggcauccacuccauccaucucugaauauccccuacggcauucgcaaucugccucccccacuguauuaucgaccagugaacacuguuccuaguuaccccgggaauacuuauacugacacaggccuuccuuccuaucccuggauccuaacaagcccuggguuuccguacguuuaucacaucaggggguuuccccuugccacucaacucaaugucccuccccugccaccacguggguuucccuucgucccccccagccgguuuuuuucagcugcugcagcuccagccgccccuccuauugcagcagaaccagcagccgcagcuccccugacagccacucccgucgccgccgaaccagccgccggagcucccguggcagcugaaccagcugcugaagcuccuguuggagcggaaccagcugcggaagccccagucgccgccgaaccagccgcagaggccccagugggaguugaaccugcugccgaggagccaucaccagcagagccagccaccgcaaaaccugccgccccugagccccauccuuccccaagccuugaacaagcuaaccaguag

SEQ ID NO: 12251 - RNA, 1743 nt, Artificial Sequence
  Description of Artificial Sequence: Synthetic coding sequence
augcaucucagugcaguguucaacgcacugcucguuagcguacuugcagccgugcuguggaagcaugugaggcugcgggagcacgcggccacacuagaggaggaacucgcacugucaaggcaggccacggagccugcaccggccuugagaaucgauuauccuaaagcccuucaaauucuaauggaagggggcacacauaugguuuguacagggcggacccauaccgacaggaucugucgauucaaguggcugugcuauucaaaugaagcagaggaauucaucuuuuuccacggaaauacuucugucaugcugcccaacuugggaucccgaagauuccagccagcucuucuggaccugucaacagucgaggaucauaauacacaauacuuuaauuuuguugaacugccugcugcugcacuucgcuucaugcccaaaccgguguucguacccgacgucgcccuaauugcaaaucgguucaauccagauaaccucaugcauguuuuucaugacgauuuauuaccgcucuuuuacacgcugagacaauuuccaggucuggcccaugaggccagauuguuuuucauggaggguuggggcgagggugcccauuucgaccuguauaagcuucuuagccccaaacaaccgcugcucagagcccaguuaaagacacucgguagacuucuaugcuuuagucaugcuuuugugggccuuagcaagauaacuaccugguaccaauacggcuucgugcagccccaggggccuaaggccaacauucuaguuucuggaaaugagauaaggcaguucgcacgguuuaugaccgaaaagcugaacgucucccacacuggggugccauugggggaggaauauauuuugguuuucagccggacacagaacagacugauacucaaugaagcagagcuacugcuugcacuugcacaggaauuucagaugaaaacaguaacugucucacuugaagaccacacuuucgccgaugucguuaggcugguaucuaaugcaucaauguuaguuagcaugcauggcgcacagcucgugacuacgcucuuccugcccaggggggcaacaguuguugaacucuuuccuuacgcagucaaccccgaccacuauacaccguauaagaccuuagcuauguuacccgguauggaucuccaguacguagcuuggagaaacaugaugccagagaauacuguaacacauccugaacggccgugggaccagggcgggauuacucaucucgauagggccgaacaagcaaggauacuccagucacgagaagugcccaggcauuugugcugccgcaaccccgaguggcuguuucgcauauaccaagauacaaaaguugauauaccuucucugauucagacgauccgaagaguggucaagggcagaccgggcccuaggaagcagaaauggacuguuggucuguaucccgggaaagugagagaggccagaugucaggcauccgugcauggcgccagugaagcgcggcugacaguaaguuggcagauuccauggaaccucaaauacuugaaggucagagaggugaaauaugaggucuggcugcaagagcagggggagaacaccuaugucccauauaucuuggcacuucagaaccacacuuucacagagaacauuaagccguucaccaccuaccucgucuggguucgcuguaucuucaacaagaucuuacuuggaccauuugcagacguccuagugugcaauacauag

SEQ ID NO: 12252 - RNA, 5130 nt, Artificial Sequence
  Description of Artificial Sequence: Synthetic coding sequence
auggguuucuugccgaagcuauugcugcuggccagcuuuuuccccgcuggccaagccagcuggggcgucucuucaccgcaggacgugcaaggcgucaaaggaucuugucuccuuauccccuguauuuuuucauuccccgccgauguggagguucccgacggaauaacugcaaucugguacuacgauuauuccgggcagcggcagguggucucccacuccgccgaccccaaacucguggaggccagauuccggggcaggaccgaguucaugggcaacccggagcauagggugugcaacuuacuucuaaaagaccuccagcccgaagacagcgguucuuauaacuuuagauucgaaauauccgaagugaacagguggucugaugugaaggggacucuggucacagugacagaagagccccgugucccuacaauugccaguccuguggagcuucuugaggguaccgaagucgacuuuaauugcucaacucccuacgucugccugcaagaacaggugcggcugcaguggcagggacaggacccggcaagaagcgugacuuucaauagccagaaauucgaaccuacaggugucggucauuuggagacuuugcacauggcuaugucguggcaggaucauggccgcauccugaggugccagcugagcgucgcuaaccaucgugcccaauccgagauacaccuccaggucaaauaugcacccaagggagucaaaauccugcucuccccauccggacguaauauccugccuggcgaauuaguuacacugacgugccaggugaacaguuccuacccugccgugagcaguaucaaauggcugaaagauggcguaaggcugcagacuaagacagggguauugcaccucccucaggcugccuggucagaugccggagucuauacgugucaggcugaaaacggcguuggaucucucgucuccccucccaucagccugcauaucuucauggccgaagugcagguguccccagcggguccuauuuuggagaaucaaacggugacacuggucugcaauacaccgaacgaagcaccuagcgaucuuagguacucuugguacaaaaaucacgugcugcuggaagacgcacauucacauacacuuaggcugcaccucgccacgcgggccgacacuggcuuuuauuuuugcgaggugcagaacgugcacgggucggagcgguccgggccaguuuccguuguagugaaucacccuccucucaccccuguccugacugccuucuuagagacacaagcuggccuggucggcauacuucauugcucaguggucucugaaccucuagcaacacugguccuaucacauggagggcacauccuggcaagcacaaguggcgauagcgaucacuccccccgauucucaggaaccucuggaccaaauucauuaaggcuggaaauucgcgaccucgaagaaaccgauagcggcgaauauaagugcucugccacaaacucauuggggaacgccaccucuacguuagacuuccaugccaacgcggcuagacuucuuauaagcccagcagcagaagugguggaagggcaggcagugacguugucuugucggucaggauuaagcccuacaccagacgcacgguuuaguugguaucugaacggugccuuguugcaugagggucccggcuccagucuucuacuucccgccgccuccuccacugaugcuggcaguuaucacuguagggcccgggacggacacagugccagcggcccuuccucaccagcagugcugacugugcuguauccaccaaggcaaccuaccuucaccaccagacuugaccucgacgcugccggcgcuggggccggucggcgcggcuugcuacuuugccggguggacucugauccaccugcuagacugcagcuccugcacaaggacagagucguugccacaagccuuccaagcggaggcggguguucaacuugcggagggugcuccccuagaaugaagguuacaaaagcuccuaaucuccugagagucgaaauucauaauccgcuacuggaggaagagggacuauaccucugugaagccucaaacgcucucggaaacgccucaaccucggcaacuuuuaacgggcaggcuacgguacuggcaauugccccaucucauaccuugcaagaggggaccgaggccaaccugacuuguaacgucucacgggaagcugcgggaucgcccgcaaauuucucaugguucagaaauggugugcugugggcccagggaccguuggagacuguuacucugcugcccguggcacggacugaugcagcucuuuacgcuuguagaauucugacagaagcgggggcucagcucuccacgccaguguugcucucugugcuguacccccccgaucgaccaaagcuaagugcuuuacuagauauggggcagggucauauggcacuauucauuuguacuguggauaguagaccccuggcgcuccucgcccucuuccacggugaacacuugcuggcuaccucacuuggaccgcaggugccgucucacgggcgauuucaggccaaggcugaggcaaauucucugaagcuggaggugcgggaacucggccugggagauucaggauccuacagaugcgaagccacuaauguccuggguucaaguaauacaucucuguuuuuccaggugagaggcgcuuggguccaggucucuccgucuccagagcugcaagagggacaagcuguggugcuguccugucaagugcauaccgguguaccugagggaacaagcuaccguugguauagggacggucaaccacuucaggaauccacaucugccaccuugcgguucgcugcaaucaccuuaacccaagccggugcuuaccacugccaggcacaggcgccaggcagcgcuaccacaucucuugccgcuccaauuaguuugcacgucuccuaugccccuagacaugugacccugacaacucugauggacaccggaccagggaggcugggccuguuguugugccggguagacucugaccccccggcucagcuaagacugcugcacggcgaucgccuaguggcgagcacacuccagggcgugggaggcccugagggcuccagcccacgucugcaugucgcuguggcgcccaacacccucagguuggagauucacggagcgauguuagaggacgagggcguuuauauaugcgaggcuuccaacacguuggggcaagcuucagccucagcggauuucgacgcacaggcagugaacgugcaagucuggccaggcgccaccgugagagaaggacaguugguaaaccugacgugcuuaguguggacuacacaccccgcccaacucaccuacacaugguaucaggaugggcaacagcgccuugacgcccacuccauaccuuugccaaaugugacuguacgcgacgcgaccuccuauaggugugguguugguccccccgggagggcuccaagauugucucggccuaucacacuagacgugcuuuacgcaccacgcaaccugcguuuaacauaccuccuggagagucacggaggucagcuagcacuggucuuguguaccguggacucucggcccccugcucagcuggcccucagccacgcagguagacuccuggcaucuucuaccgcagccucggugccaaacacauugagacuggagcuaagagggccccagccucgggacgagggcuuuuacucaugcagcgcacguucuccacugggucaggcaaacaccaguuuagaauuaagacuggagggggugcgagugauuuuagcucccgaggcggccgucccagaaggggccccuaucaccguuacuugugcagauccugccgcacaugcgccgacgcuguacaccugguaucacaacgggagauggcuccaggaaggccccgccgcuucguugagcuuccugguugccaccagagcacacgcaggagccuacagcugccaggcacaagaugcgcaggguaccagguccagucgccccgcagcauuacaggugcucuacgcgccccaggaugccguacuguccucuuuccgagacucuagagcuagaaguauggcuguuauccaguguaccguggauuccgaaccacccgccgaguuggcacuuucucaugauggcaaaguguuggcuacgucaagcgggguucauagccucgcuucggggaccggacacguccagguggcccgcaacgcucuuagacugcaaguccaggacgucccugcgggcgacgauacauaugugugcacagcucagaaucugcugggcagcauuagcaccauaggucgcuugcagguggagggcgccagaguaguugccgaaccaggccucgaugugccugaaggggccgcucuuaaccuuaguugccgacuccuugggggccccggcccuguagggaauuccacauuugcaugguuuuggaaugaucgcagauuacacgccgaaccugugcccacuuuggcuuuuacgcauguagcccgcgcucaggcugguauguaccacugucucgcugaacuuccaacaggggcagcagccagugcgccugugaugcugaggguucuuuaucccccuaaaaccccuacaaugaugguguucgucgaaccagaagggggacuccgaggcauccuggacugccgcguugauuccgaaccgcuggcaaguuugacacuccacuuagguaguaggcucgucgcuaguucacagccccagggcgcucccgcugaaccgcauauucauguucuugcuagucccaaugcacuuagagucgauaucgaggcucuuaggcccuccgaucagggagaguacaucuguagcgcaagcaauguucuuggaagugccucuaccucuacguauuucggagugcgagcccugcaucgcuuacaccaguuucaacagcuccuaugggugcugggacugcuggucggccucuugcuacuccugcugggguuaggcgccuguuacacauggagaagacguagagucuguaaacagucuaugggggagaauagcguggagauggccuuucagaaggaaaccacgcagcucauugacccugaugcugcuacuugcgagacaucgacuugugcuccgccgcugggguag

SEQ ID NO: 12253 - RNA, 693 nt, Artificial Sequence
  Description of Artificial Sequence: Synthetic coding sequence
augugcgugacuuaucauaacggcacuggauacuguaaaugccccgaaggauuccucggggaauacugucaacaccgcgaucccugcgagaagaauaggugccagaacggagggacuuguguugcccaggcaaugcuugguaaggcuacaugccggugcgccucgggguucacgggagaggauugccaauauuccaccagccacccauguuucguguccaggccuugcuuaaauggugggacgugccacaugcugucucgggauaccuaugaaugcacuugucaggugggguuuaccggcaaagaaugucaauggacagacgcgugucuaucucaucccugcgccaacggcucaaccuguacaacuguagcaaaucaguucagcugcaaaugccugaccggcuucacuggacagaaaugugagaccgauguuaacgagugcgauaucccagggcacugucaacacggagggacuugucuuaauuugccaggcucuuaccaaugucagugucugcagggcuuuacgggccaauacugcgauucucuguacguucccugugcccccagcccaugcgugaacggagggacaugcaggcagacuggcgauuuuacuuuugaaugcaauugccuuccagccacauggcccauuuucccuaaacuucugagucugcaggaaaaggagucuuacuguuag

SEQ ID NO: 12254 - RNA, 660 nt, Artificial Sequence
  Description of Artificial Sequence: Synthetic coding sequence
auguucguaagcuaccucauucucacucuccuccacguucaaacagcagugcuggcgaggccaggcggagaaucuaucggcugugacgauuaccucggaagugacaaggugguggauaaaugcggcguguguggaggcgauaauacaggcugccaagucguguccgggguguuuaagcacgccuuaacaagcuugggguaucaccgugucgucgaaauaccagagggagcgaccaagauuaauaucaccgagauguauaagagcaacaagaagaagucccaucucaaaccagcuacaaggggaucacaauucagcucugugaagguuugcucagugccugccgcgugcaaacuccuuggaaccccagguagagccagacagccaguuccagcccccagagaacuugagcaugacaagaacuccccccauugugccuauuugucacuguaccucacaucacucgcacagucaucuuggcgcguguucuccuuguucuccuaugugcugaucuauuuauucagcaaguaccuggccuuuaauacucuguuugcauugaagcggauggcccugcagagagaccguaaagagaagacacgcgcaugguguauuuuuauuaagcuguguggaagggagauccagauccuaccagggcccgucuag

SEQ ID NO: 12255 - RNA, 363 nt, Artificial Sequence
  Description of Artificial Sequence: Synthetic coding sequence
auggauaacguacagccuaagaucaaacaucgcccauuuuguuuuucugugaagggccacgugaaaaugcuuaggcuugcccugacaguaacgagcaugaccuuuuuuauaaucgcccaggccccagaacccuacauuguaaucaccggcuucgagguaacugucauccucuuuuuuauuuuacuauacguuuuaagacucgauagacucaugaaauggcuuuucuggccucuauuagucuuugcacucguuacugcuguuugcugccuugccgauggagcauugauuuaccguaaauuacucuucaauccguccggaccuuaccagaaaaaaccgguccaugagaagaaggagguccucuag

SEQ ID NO: 12256 - RNA, 864 nt, Artificial Sequence
  Description of Artificial Sequence: Synthetic coding sequence
auggcacccuggucccacccuuccgcucaguuacaaccagugggaggcgaugcaguuagccccgcccugaugguguuacugugccuaggaaaccugucgaaagcuacucugugggccgaaccaggcucagugauuucacggggaaacuccgucacuauccgaugccaaggcacccucgaagcccaggaauacagauuagucaaggagggguccccagaaccaugggacacccaaaauccucuggaaccaaaaaacaaagcacgguuuagcauuccuagcaugacugagcaccaugcaggccgcuauagguguuauuauuauucccccgccggcuggagcgaaccaagugauccuuuagagcucguggugacgggauuuuacaacaaaccuacacuuagcgcgcucccaucaccgguagugacuucaggagagaacguaacccuccaaugcggaucgcgccugagauucgaucgguucauccugacagaggaaggugaccacaagcuuucguggacauuggauucgcaacuuacacccucuggacaauuccaggcacuuuucccugucggucccgucacacccagucaucgguggaugcuaaggugcuacggcucccggagacauaucuugcaaguuuggucagagccuucggaccugcucgaaauaccaguuaguggagcagccgacaaucuguccccaagccagaacaaaagugacuccgggacugccagucaccuucaagacuaugccguggaaaaucugauuagaauggguauggccggacuuauucugguaguucuggguauuuugaucuuccaggacuggcauagccagcgcucaccacaggcugcugccggcagauag

SEQ ID NO: 12257 - RNA, 438 nt, Artificial Sequence
  Description of Artificial Sequence: Synthetic coding sequence
augggaaucgguuguuggcgcaauccuuuacuuuuacuuaucgcacucguccugucagccaaguuaggccacuuccaaaggugggagggcuuccagcagaaguuaaugagcaaaaagaauaugaauucaacccuuaacuuuuucauacaaucguauaacaaugccuccaaugacacuuacuuguacagagugcagagacugauucgaucccagaugcaacucacaaccggcguagaauacauaguuacggugaaaaucggguggacaaaauguaaacggaaugauaccucgaauucauccugcccucugcaaucuaagaaacucaggaagagccuuaucugcgaaucgcugaucuacacuaugccuuggauuaacuacuuucagcucuggaacaacuccugccuggaggcugagcacgugggaaggaaccugagauag

SEQ ID NO: 12258 - RNA, 1776 nt, Artificial Sequence
  Description of Artificial Sequence: Synthetic coding sequence
augcaacaagauggacugggaguggguaccagaaacggaagcggaaaagguagaaguguccacccaucuuggccauggugugccccccgcccccucagguauuuugguagggaugcacgggccagaagggcccagacggcugcuauggcucuggcuauccaagucacagugaguaauccauaccacgucgugauucucuuccaaccugucacccugccaugcacuuaucagaugacaagcaccccuacccaacccaucgucaucuggaaauauaagucuuuuugcagggauagaauugccgacgcguucucaccagcaagugucgacaaccaguuaaaugcucagcucgccgccgggaacccuggcuacaaccccuacgucgagugccaggauucagugcggacugugagagucguagccacaaaacaggggaaugccgucacacucggcgauuacuaccaaggaaggcggauuacaaucacuggaaacgccgaucugacauucgaccagaccgcauggggagacucaggcguauacuauugcaguguaguuucagcccaggacuugcagggaaacaaugaggcauacgccgagcuuaucguucucggcagaacaucuggaguggcggaacugcugccuggcuuucaggccggcccuaucgaagauuggcuuuucguagugguugugugucuggccgcuuucuuaaucuuucuucugcuggggauaugcuggugccaguguuguccacacacauguugcugcuacgugagaugucccugcuguccagacaaguguuguugccccgaggcccuuuaugcugcaggaaaggcagccacauccgggguuccuuccaucuacgccccuucgaccuacgcucacuugucucccgccaagacuccucccccccccgcuaugauucccauggguccugccuacaacggguaccccggcggcuacccuggagauguagacagauccagcucugugagaagcgguuauagaauccaggccucucagcaagacgauagcaugcgggugcucuacuacauggaaaaagaguuggcuaauuuugacccgucgcggcccggaccaccuagcggcagaguugaacgcgccauguccgaagugacaagccugcacgaagaugauuggagaucaagacccucaagagggcccgcccugacucccauuagggacgaggaauggggggggcacagcccgcguuccccccgcgggugggaucaggagccugcaagggagcaagccggcggcggguggagagccagacggcccagggcucgaagugucgaugcccuagaugacuugacuccuccuuccacagccgagucuggcucaagaucuccuacuucaaauggaggacgaucacgagcuuacaugccaccucgcucuaggucccgcgacgaucuguaugaucaggacgacaguagagauuucccucgaucucgcgauccccacuacgaugacuuucgaagccgagagcggccaccugccgacccccgaucacaccaccauaggaccagagauccccgcgacaacgggucucgaagcggagacuuaccguacgacgggcgccuccucgaggaagcggugcgcaaaaaagggagugaagaacgccgucgaccucacaaggaggaggaagaagaagcauacuauccucccgcuccacccccauacuccgagaccgacucucaggcgagucgggaacgucgguuaaaaaagaauuuggcccucagccgggaaagccuggugguuuag

SEQ ID NO: 12259 - RNA, 678 nt, Artificial Sequence
  Description of Artificial Sequence: Synthetic coding sequence
augaauagauguccccggcgaugccgaucuccccuugggcaagccgccaggagucucuaucaacuugugacagguaguuugucccccgauuccguggaugaugaguuugagcugucaacaguuugccacagaccagaaggacucgagcaacugcaggagcagacuaaauucacuaggaaagagcuucaggugcuauaccgcgguuuuaagaacgagugucccuccggaauaguaaacgaggaaaauuuuaaacagauuuacucucaguuuuucccucagggcgauucgucuaccuaugcaacauuccuguuuaacgcauucgauaccaaucacgacgggucagucaguuuugaggacuuuguggcuggccuuucugugauccuuagaggaacagucgaugaccgucugaauugggccuucaaucucuacgaccuuaacaaagauggauguaucaccaaggaggaaaugcuggauaucaugaagucaauuuaugacaugaugggaaaguacacuuauccggcguugagagaagaggcaccucgcgagcauguggagagcuucuuucagaaaauggacagaaauaaagacggcguuguaacuauugaggaauucauugagucuugccaaaaagaugagaauaucaugcgauccaugcaacuauucgacaaugugaucuag

SEQ ID NO: 12260 - RNA, 705 nt, Artificial Sequence
  Description of Artificial Sequence: Synthetic coding sequence
augccugcuagcucaccauuucuacucgcacccaaggggccacccgguaauauggggggaccugugagggaacccgcccucagcgucgcccuguggcucucuuggggggcugcauuaggagcaguggcuugugcuauggcccuguuaacacagcagaccgaacugcaaucccucaggcgagaagucucuagacuacaaggaaccggcggaccuagccaaaacggcgaaggcuaccccuggcaaucccugcccgaacagucgagcgaugccuuagaggcaugggagaacggcgaacggaguaggaagaggagggcaguuuugacucaaaagcagaaaaaugacuccgacguaaccgaagugauguggcagcccgcucucagaagaggucggggccugcaagcccaaggauacggcgugcgaauccaggacgcggggguuuauuugcuguauucucaggugcucuuucaggauguaacauucacgauggggcagguugucagccgggaaggucagggcaggcaagagacucucuuucgguguaucagaucuaugcccucucauccagaucgagcauauaacuccuguuacagugcaggcguguuccaccugcaccaaggcgauauccuaucugugauuaucccccgcgcacgcgcaaagcugaauuugagcccacaugguacauuccucggguuuguaaaacuuuag

SEQ ID NO: 12261 - RNA, 2400 nt, Artificial Sequence
  Description of Artificial Sequence: Synthetic coding sequence
augaagccuaugcugaaagauuucuccaaccuguugcugguugugcugugcgacuauguucugggagaagcagaauaucugcucuugagagaaccuggacauguggcucugucuaacgauacuguauacguggauuuccaguacuuugauggugccaacggcacacugaggaacgugaguguuuugcugcuagaagccaauacaaaccagaccgucaccacaaaauaccuacuaaccaaucaaagccagggcacacugaaguuugagugcuucuacuuuaaagaagccggagauuacugguuuacgaugaccccagaggccaccgacaauaguacaccauuucccuggugggagaaaucagccuuuuugaaggucgaauggccugucuuucacguagaccuuaacagauccgcuaaggcagcagaggguacguuccagguuggguuguucaccagccaaccgcucugcccuuucccaguggacaaaccaaauauagugguggaugugaucuuuacaaacucuuuaccagaggcacgcaggaacucacggcagccccuggagauaaggacaucuaagcgcacugaauuagcccaagggcaauggguggaguuuggaugcgccccuuuggggccagaggcguauguuacugugguauuaaaguugcugggacgggacagcgugauuacaaguaccggaccuauugaccucgcccagaaauucggcuauaagcucgucauggugccagagcucacaugugaaucagguguggaagugaccguccucccacccccaugcacuuucguucagggggucgugacaguguucaaagaggcucccagguaccccggcaaacgaacuauucauuuagccgagaauucauugccccugggagagcgccgcacaauuuucaacugcacucuguuugauaugggaaagaauaaguacugcuucgauuucgguaucaguucucggucucacuucucugcuaaggaggaaugcaugcucauccagcguaacaccgccuuccagccgucauccccaagcccucuucagccacaaggaccagugaaaucuaacaacaucgugaccgucacugggaucucucuuugucuguuuaucauuaucgcaacagugcuaaucacguuguggcgcagauucggaaggccagcuaagugcuccaccccagcuagacacaauucaauacauuccccaaguuuucgcaaaaacagcgacgaggagaacauaugugagcuuuccgaacagagggggucuuucucugauggcggagaugggccaaccggcucccccggagacaccggaaucccucucaccuaucgcaggucugguccuguaccgccugaggacgaugcauccggcagugaaagcuuucaaagcaacgcacagaagaucauucccccucuguuuagcuaucggcuugcacagcaacaacugaaagagaugaagaagaagggcuuaaccgaaacuaccaaagucuaucaugugucacaguccccucugacagauacggccaucgaugcggcucccagcgcaccauuagaccuggagucccccgaagaagcagcugccaauaaguuucgcaucaaaagcccauuuccugaacaaccugcuguuagcgccggcgagcgcccucccucccgacuugaucucaaugugacccaggccagcugcgccaucucccccucucagacccugauacggaagagccaggccagacacgucggaagcagggguggcccuagcgagcgcagccacgcccguaacgcccauuucaggcgaaccgccuccuuucacgaggccaggcaggcccggccuuucagagaacgguccaugucuacacuaacaccccgccaggcucccgccuacucauccaggacccggacuugcgagcaggcugaggaccgauucaggccucagagucgaggagcacaccuuuuucccgaaaagcucgaacacuuccaggaagccagcgguacgcgcggcccucugaaucccuuaccuaagaguuauacccugggacaaccuuuacggaagcccgaucugggcgaucaccaggccggacuggucgccgguauugagaggacagaaccccaccgugcacggagaggcccaucgccuucucauaagagcgucucucgcaagcagagcucaccaauuuccccuaaagacaauuaccaacgcgucucguccuugagccccucccagugccggaaagacaagugucaaucauuuccaacucacccggaauuugcauuuuacgauaauacuucuuucggucugaccgaggccgagcaaagaaugcuggaucuacccggguacuucggaagcaacgaggaggaugaaacuacaaguaccuugucugucgagaagcugguuaucuag

SEQ ID NO: 12262 - RNA, 927 nt, Artificial Sequence
  Description of Artificial Sequence: Synthetic coding sequence
augagacugcuccccgagugguuucugcugcucuucggcccgugguuguugcgaaaagccgugagcgcucaaauucccgaaaguggccgcccccaauaucuggggcugcgcccagcagccgccggagccggcgcuccuggacagcagcugcccgaaccuagaucaucugauggacuuggcgucggacgcgccuggucaugggccuggcccacuaaccauacaggggcacuagccagagcuggggcagcaggcgcucuuccagcccaaagaacaaaacggaaaccaucuaucaaagcagcucgagcuaagaagaucuucggcuggggcgauuucuacuuccgcguucacacacugaaguucagcuugcuggugacggguaaaauagucgaucacguuaauggcacauucagugucuauuuccgccacaacuccuccagccugggaaauuugucagucucuaucguccccccuucuaagaggguugaguuuggcggugucuggcuucccggacccgugccccauccauugcagucaacacuggcucuugagggcgugcugccaggucuuggacccccauugggaauggcagcagcugccgcaggacccgggcugggcggaaguuuggguggcgcgcuggcuggcccacugggaggcgcccuggggguccccggagcuaaggaaaguagggcuuuuaacugucacguggaguaugagaaaacaaaucgagcccgcaagcaccggccaugccucuaugauccuucccagguaugcuuuacagagcacacucagucacaggccgccuggcuaugcgcaaagcccuucaaggugauuuguaucuucguuucauuucuuucguuugauuacaagcugguucaaaagguguguccugacuacaacuuccagucggaacaccccuauuucggauag

SEQ ID NO: 12263 - RNA, 795 nt, Artificial Sequence
  Description of Artificial Sequence: Synthetic coding sequence
augaaacuagguugcguucuuauggccugggcccucuacuuaucccuugguguacuguggguggcucagauguugcuggccgcgaguuucgaaacgcugcagugcgaaggcccugucuguacagaagaaagcucaugucacaccgaagacgaucuuacggacgcuagggaggccggguuccaggugaaggcauauaccuucagugaaccuuuucacuuaaucgucucuuacgacugguugauccugcagggccccgcgaaaccaguuuucgagggcgaucuucuaguguugagaugucaggcuuggcaagacuggccucucacccaggucaccuuuuaucgagauggaagcgcacuagguccuccugggcccaaccgcgaauuuucgaucacugugguucagaaagcagacaguggucacuaucacugcaguggcauuuuucaaagcccuggacccggcaucccugagacagccucagugguagcaaucacagugcagggagccucaucuuccgccgcccccccuacccucaauccagccccccagaagucagcagcucccggcacagccccagaggaggccccuggaccauugccaccuccgcccaccccuuccuccgaggaccccggcuucuccucuccgcuaggcaugccagauccucaucuuuaccaucaaaugggccuauugcuuaaacauaugcaggauguccgaguccuacuuggccacuuacucauggagcuaagggaacugucuggucaccgcaagccgggaacaacaaaagccacugcugaauag

SEQ ID NO: 12264 - RNA, 1362 nt, Artificial Sequence
  Description of Artificial Sequence: Synthetic coding sequence
augcugcggauucugugccucgcucucugcucccuacugaccggaacuagagccgacccaggggcacuguugaggcuggggauggauauaaugaaccaggugcaaucugccauggaugagagucacauuuuggagaagauggccgcugaagccgggaaaaaacagccugguaugaagccgauuaaaggaauuacuaaucucaagguuaaggauguacagcucccaguuauaacauugaauuucgugccugguguggguaucuuucaguguguuuccacaggaaugacagugaccgguaagucuuucaugggcgggaauauggaaauaauagucgcucuuaacaucaccgccaccaaucgucuacugcgggaugaggagacgggccugccggucuuuaagagugagggaugcgaggugauucuggucaacguaaaaacaaaucugccgucaaauaugcucccaaagauggucaacaaguuccuggauucaacccugcacaagguucuccccggcuugauguguccugcuaucgaugcuguccucgucuacgugaauaggaaguggacaaaccugucggaucccaugccugucggacagauggggaccguuaaguacguuuugauguccgcccccgccacaaccgcaagcuauauacaguuagauuucagcccagucgugcaacagcaaaagggaaagaccauuaaacuggcagaugcaggcgaagcucucaccuuccccgaggguuaugccaaaggcuccucucagcuccugcugcccgccacauuccucucagccgaacucgcccuucugcagaaaagcuuucaugucaauauacaggauaccaugauuggagaguugcccccacagacaaccaaaacgcuggcuagauuuaucccugaagucgcgguggcauacccaaaaaguaaaccacugacuacccagaucaaaauaaagaagcccccuaaagugacaaugaagaccgguaaaucccugcugcaucugcacuccacccuggagauguucgcagcccguuggcgcuccaaagcuccuaugucccuuuuucugcuggaaguccacuuuaaccugaagguacaguacagcguucaugaaaaccaguugcagauggccaccucccuagaucgacuacuaagccugucucggaagucaucuuccauagguaauuuuaaugagcgcgaauugacaggcuucaucacuagcuaccuugaggaggccuacaucccugugguuaaugauguguugcagguggggcuuccccuucccgacuuucucgcaaugaauuauaaccucgcugaacuugacaucguggagaaugcccuaaugcuggaucugaaacugggauag

SEQ ID NO: 12265 - RNA, 1323 nt, Artificial Sequence
  Description of Artificial Sequence: Synthetic coding sequence
auguccgcucgcggcagaugggaaggagguggccggagagcaugccgagguucgcugggguuagcccgugcacagggagcagaacgugugacaaguagugaacagcgccccgcaauggcuucucuuggacugcucuugcugcugcugcuaacugccuugcccccacuguggagcucaucccugcccggccucgacacagcagagagcaaagccacuauugcugaccugauacugucugcacuggagcgagccacaguguuccucgagcagcgacuuccagagaucaaccuggacggaauggucggcgugcgcguccuagaggaacaacucaagucuguaagggagaaaugggcgcaggaaccccuauuacagccguuaucuuuacgcgugggaaugcugggugagaagcuggaggccgccauucagagaagccugcauuaccuuaaacucagugacccaaaguaccugcgggaguuucaacugacacuccagccagguuucuggaaauugccgcacgcuuggauccacaccgaugcaucucugguauauccuacuuuugguccacaagacucuuuuagcgaggaaagauccgaugugugccucgugcaguuacucggaaccggcacagacucaagcgaacccugcggucuuagcgaucugugucgaucucugaugaccaagcccgguuguagcggauauuguuugucacaucagcuucuauucuuucugugggccagaaugagaggaugcacucaaggccccuuacagcagucucaggauuacauuaaucuuuuuugcgccaauaugauggaccugaaucggcgugccgaggcaauuggcuaugccuaccccaccagagacaucuucauggagaauaucauguuuugcgguaugggcggcuuuucagacuucuacaaacugcgauggcuggaagcuauucugucuuggcagaagcagcaagagggcuguuuuggcgagccagacgccgaggacgaagaacucagcaaagcaauacaguaucagcagcacuuuagucgaagggugaagcgacgcgaaaaacaguuccccgauucucgcucuguugcccaggcuggaguucaguggaggaaccugggaagccugcagcccuugccuccuggauuuaaacaguucucaugccucauucugccuaguaguugggauuacaggagugugcccccauaucuugccaauuucuauauuuuucucgucgagaccggauuccaccacguggcacacgccggccuggagcucuugauuucccgggacccuccaacauccgggucucaaagugugggcuuguag

SEQ ID NO: 12266 - RNA, 708 nt, Artificial Sequence
  Description of Artificial Sequence: Synthetic coding sequence
augaaauauguguucuaucuuggagugcuggcugggacuuuuuuuuucgcugauagcaguguccagaaggaggaucccgcacccuaccucguguaccugaaaagccacuuuaauccaugugucggcguccugauuaaacccucauggguacuugcuccggcucacugcuaucuaccgaaucuuaaagugaugcuaggcaacuuuaaauccaggguacgggauggcacugaacagaccauuaacccuauccagauuguuagguacuggaauuacucucauagugcaccucaggaugauuuaaugcugaucaagcucgccaagcccgcuaugcugaaccccaaggugcagccacugacauuagccacaacgaauguuagaccaggaacuguguguuuauuaagugguuuggacuggucacaggagaauucgggcaggcacccagaucugcgccaaaaccuagaagcaccugugauguccgauagggagugccagaaaacagaacagggcaagagucacagaaauagccugugcgugaaauucgucaaaguguucaguagaauuuucggagaggucgccguugcuacagugauuugcaaggacaaacugcagggaaucgaggucggccacuuuaugggaggugacgugggaaucuauaccaacguauacaaauacguaucuuggaucgagaacacagccaaggacaaguag

SEQ ID NO: 12267 - RNA, 426 nt, Artificial Sequence
  Description of Artificial Sequence: Synthetic coding sequence
augcugaaaaaaauuucuguugggguagccggugacuuaaacacugucaccaugaagcuuggcugcgugcucauggccugggcucuguaucuuucccuaggugucuuaugggucgcucaaauguugcucggcgccucauccagugcugcuccucccacucuaaauccagccccccaaaaauccgcagcaccuggcacggcuccagaggaagcaccuggcccacugccacccccgccuacaccuucuucagaagaccccggguuuaguucaccacuugggaugccagacccucaucucuaccaucagaugggccugcuacucaagcacaugcaagacgugcguguguuauuaggccacuugcuaauggaauuacgggaacugucaggacaucgcaaaccugguacuacgaaggccacagcugaguag

SEQ ID NO: 12268 - RNA, 2886 nt, Artificial Sequence
  Description of Artificial Sequence: Synthetic coding sequence
augcuugcuccccgaggggcugccguacuuuuacuucaccugguccugcaaagauggcuggccgcuggugcgcaggccaccccccagguauucgacuuguuacccucauccucucagcgacugaaccccggagcccuucugcccguccuuacugauccugcacucaaugaucuguacgucaucucuaccuucaaacugcagaccaaaagcagcgcaaccauuuuuggcuuauacagcagcacugauaacucgaaguacuuugaguuuacugugaugggcagacuuaauaaagcgauccugcgcuaucucaaaaaugacgguaaaguccaccuugucgucuucaauaaccugcagcuugccgaugggcgcaggcaccgcauucuccugcgucucagcaaccuacaacgaggggcuggaucccuggaacucuacuuggauugcauucagguggacucgguucacaacuuaccuagagcauucgccgggcccagccagaagcccgagacuaucgaacuacggacauuucaacguaaaccacaggauuuccuggaggagcugaaacuggugguccgaggcucccuguuccaagucgcuagucuacaagauuguuuucuucagcagucugaaccacucgcugcaaccgggacaggugauuucaaccgccaauuccucggucagaugacucaguuaaaccaacuacuuggcgaagucaaggacuuauugcgucaacagguaaaggagacuucuuuccugagaaacaccauugccgagugccaggcuugcggcccacuuaaauuccaaagccccaccccaagcacuguggucccgccggcgccucccgcaccccccaccaggccuccgcgucgcugcgacucuaauccguguuuccgcggaguucaaugcaccgauuccagagauggguuccaauguggcccauguccugagggcuacaccggaaauggcauuacuuguaucgaugucgacgagugcaaguaucauccguguuaucccgggguucauuguauuaaucuuagccccggguuucguugugacgcaugcccaguggguuucacgggccccaugguccaaggcguugguaucuccuucgccaaauccaauaaacagguuugcacagacauagaugaaugcagaaauggagcuugcgugccuaacaguaucugcgucaacacacuggggaguuaccgcugugggccuuguaagccuggauauacaggggaccagauucgagggugcaaagcugaacgaaacugucgcaauccugagcugaaucccugcucggugaaugcacagugcauugaagagcggcagggagaugucaccugcguuugcggcgugggaugggcaggagacggcuacaucugcgggaaggaugucgacauugacucuuauccagacgaagaguugccaugcucagcccgcaauugcaaaaaagauaauuguaaguaugugccuaauuccggacaggaagacgcugaucgagauggaaucggggacgccugcgacgaagacgcugauggugacggcauacucaacgagcaggacaauugcgugcuuauucauaauguggaucagcggaacucagauaaagacauuuucggagacgcuugcgauaacugccugucugugcucaauaaugaucagaaggacaccgacggagauggccgcggcgaugcuugugacgacgauauggauggcgauggcaucaagaauauucuagacaauuguccaaaguucccuaacagagaucagagagacaaagauggagaugggguuggcgacgcaugcgacucuugccccgaugugucaaauccaaaccaguccgacguagacaacgacuuagugggcgauaguugcgacaccaaucaggauagugauggcgauggccaccaggacucaaccgacaauugucccacagugauuaacuccgcucaacuagacaccgacaaggaugggaucggggacgaaugugacgaugaugaugauaacgacggcauuccugaucuuguuccuccaggcccagacaauugcagacuggugccuaauccugcacaagaggacagcaauagcgauggggugggggacauuugugagagugacuucgaucaggaucagguuauugacaggauagacgugugucccgagaaugcagaagugacccucacugacuuuagggcuuaucaaaccguuguccuagauccugaaggggaugcacagauagauccuaacuggguggugcucaaccaggguauggagauugugcaaacuaugaauucagaucccggccucgccgucggauacacggcuuucaacgggguggacuuugaaggaacauuucaugucaauacgcaaacagacgacgacuacgcaggcuuuauauuugguuaucaggauuccagcuccuuuuacguaguuauguggaagcagacugagcagaccuacuggcaggcgaccccuuuuagagccguggcagagcccggcauccaacucaaagcuguaaaauccaagacaggaccuggggaacauuuacggaacucauuguggcacacaggcgauaccuccgaucaagucaggcuacuguggaaggauagucguaaugucggcuggaaagauaaggucucauaccgaugguuccuccaacacaggccacaggucgguuacauucgaguaagauucuaugagggcuccgaacuaguggcugacucugguguuacaaucgauacaacaaugcggggcggaagacucgggguguuuuguuucucccaggaaaacauaauuugguccaaccugaaguaucggugcaaugauaccauaccugaagauuuucaggaauuucagacacagaauuucgauagauucgauaacuag

SEQ ID NO: 12269 - RNA, 300 nt, Artificial Sequence
  Description of Artificial Sequence: Synthetic coding sequence
auggauaacguucagccaaaaauaaaacaucguccuuucuguuuuucagucaagggacacgugaaaaugcugagacuggauauuauuaacucacuuguuacaacgguuuuuaugcugaucgugagugugcuggcuuuaauccccgaaacgaccaccuuaacaguuggaggcgguguuuuugcgcuugucacagccguuuguugucuagcugacggggcacugaucuaccgaaaauuauuauuuaacccuucaggcccguaccaaaagaagccugugcacgaaaagaaggaaguguuauag

SEQ ID NO: 12270 - RNA, 408 nt, Artificial Sequence
  Description of Artificial Sequence: Synthetic coding sequence
augucuccacaccuuacugcacuccugggccuugugcucugucucgcccaaacaauacauacacaagagggggccuuaccucguccgucuauaucagcugagccaggaacagugaucaguccaggaagccacgugaccuucaugugcaggggcccuguggggguccagacauuucgacuggaacgagaagaccgggcgaaauacaaggauagcuacaauguguuucgguuggguccaagcgagagcgaagcacguuuucacauugacuccgucagcgaaggcaacgccggccucuacagaugucuuuauuauaagccuccaggcuggucugaacauagcgauuuucuggaauugcucgugaaggggaccguuccagguacagaagcaucuggcuuugaugcucccuag

SEQ ID NO: 12271 - RNA, 231 nt, Artificial Sequence
  Description of Artificial Sequence: Synthetic coding sequence
augcuuccuugccuugccuugcuuuuacuuauggaauugucugucugcacaguugccggugauggaggggaagaacagacucugagcacggaggccgagacgugggagggggcaggucccagcauacagcuacagcuccaagaagucaaaaccggcaaagcaucccaguuuuuuggacuuaugggaaaacgggugggagggagagaggacgaagcccaggggucugaauag

SEQ ID NO: 12272 - RNA, 684 nt, Artificial Sequence
  Description of Artificial Sequence: Synthetic coding sequence
augagaggccagggaagaaaagagagccugagugacagucgugaucuggacggauccuacgaccagcuaaccgauaguguggaugacgaguucgaacugagcacgguuugccacaggcccgaaggacuggaacaacuccaagagcagacaaaauuuacaagaaaggaauuacaagugcuguaucgcggauuuaaaaacccaggugcgcuuaguuuccaggaaugcccaagcgguaucgugaacgaggaaaacuucaaacagaucuauagccaguucuuuccacagggggacaguagcacauacgccaccuuucucuuuaaugcuuuugacacaaaccacgauggcucuguguccuuugaagauuucguugcugguuugagcgugauacuccggggcacugucgaugaccgccucaauugggccuucaaccuuuacgaucugaacaaagacggcugcaucacaaaggaggagaugcuggacaucaugaaaagcauuuacgacaugauggggaaguauaccuacccagcgcugagggaggaggcaccuagagagcauguggaaucuuuuuuucagaaaauggacagaaacaaggaugggguggugaccauugaagaguuuauugaaucaugucagaaggaugaaaauauuaugagaagcaugcagcuuuuugacaacgugaucuag

SEQ ID NO: 12273 - RNA, 876 nt, Artificial Sequence
  Description of Artificial Sequence: Synthetic coding sequence
augaugucagccacugggccgggaagaaagaugggauccagaggccaagggcuucuucuggcuuauugccuccuuuuagccuuugccaguggccucgugcugagccgugucccgcacgugcaaggugagcagcaagagugggaagggacagaggaauuaccaucgccuccugaccacgccgagagggcagaagaacagcaugagaaauaccgaccaucacaggaccagggauugccagcuagccguuguuuaagaugcugugauccgggcacgucaauguacccagccaccgccgucccccaaaucaauaucaccauacucaagggcgagaagggagaucgaggcgacaggggccuacagggcaaguacggcaagaccggauccgccggggccagaggccacacuggacccaagggucagaaaggaagcaugggcgcaccuggcgaaaggugcaagucccacuaugcagccuucucagucggacggaaaaagccaaugcauuccaaccauuacuaucagacggucaucuucgauaccgaauucgucaaucuauaugaccauuucaacauguuuacuggaaaauucuauugcuauguaccugggcuguauuucuuuucauugaacguucacacauggaaccagaaggagacguaucuccauaucaugaaaaacgaagaggaggucguaauauuguuugcacaggugggagacaggaguauaaugcagucucagucccugauguuggagcuaagagagcaggaccagguguggguucgauuauacaagggggagagagagaaugccaucuucagugaagaacuggauacguauaucacuuuuagcggguaucucgucaagcacgcaaccgaaccuuag

SEQ ID NO: 12274 - RNA, 213 nt, Artificial Sequence
  Description of Artificial Sequence: Synthetic coding sequence
auggaacggggugcgggagccaaacugcugccuuuguuacuccugcugcgagcuacagguuuuacaugcgcgcagaccgauggacggaauggauauaccgcagucaucgaaguuacauccgguggaccuuggggggacugggcguggcccgaaauguguccggacggguuuuucgccagcggguuuagcuuaaagcuggggaggauggaauag

SEQ ID NO: 12275 - RNA, 402 nt, Artificial Sequence
  Description of Artificial Sequence: Synthetic coding sequence
augggcucaucaggccugcugagucugcugguccuguuugugcugcuggccaacgugcagggaccaggacugacugacuggcucuucccucguagaugcccuaagauccgcgaggaaugugaguuccaggaacgcgacguuugcaccaaagacagacagugccaagacaauaagaaaugcugugucuucaguugugggaagaaaugcuuagacuugaaacaggauguaugcgagaugcccaaagaaaccggaccaugucuggccuauuuccuccacuggugguacgauaaaaaggauaacacuugcucaauguucgucuacgggggaugucaagguaacaacaacaacuuccaaucuaaagccaacugccucaacacaugcaaaaauaaaagguuccccuag

SEQ ID NO: 12276 - RNA, 771 nt, Artificial Sequence
  Description of Artificial Sequence: Synthetic coding sequence
auguuccagacuggagggcucauuguuuuuuauggacugcuugcccagaccauggcccaauucggagggcucccugugccccuggaucagacccucccgcugaacgugaaucccgcuuugccucucuccccaacuggauuagccgggagucuaacuaacgcacuuuccaaugggcuccugucuggaggucuuuuaggaauccucgagaaccuuccacuauuagacauacuuaaacccggcggcgggacuagcggaggcuugcugggcggucuacuagguaaaguaaccagcgugauacccggcuuaaacaauauuaucgauauaaaagucaccgacccacaguuguuagaacucggccucguccaaagucccgaugggcaucgacuguacgugacaauuccucuaggaauaaaacugcaggugaauaccccccugguuggagcaucucuacugcgcuuagcaguaaaacuggauaucaccgcggagauuuuagccguccgggacaagcaggagaggauucaccugguucugggugacuguacgcauucucccgggucccuucaaaucagccuucuagauggacuggguccccucccuauccagggccuacuugacagcuuaacuggaauccucaacaagguguuaccugaacucgugcagggcaacgugugcccacuugugaacgaaguccugcgaggacucgauaucacccucguucaugacaucgugaacauguugauccacggauugcaguuugugauaaagguguag

SEQ ID NO: 12277 - RNA, 1386 nt, Artificial Sequence
  Description of Artificial Sequence: Synthetic coding sequence
auguccuuggacauucagagucuugacauccagugcgaagaguuauccgaugccagaugggcagaguuacuuccacuucugcagcaaugucaggugguuaggcuggacgauuguggguugacugaggcucgaugcaaagacaucucuagcgcucugcgaguuaaucccgcgcuagccgaacugaauuuaaggucaaaugaacugggcgaugugggugugcacugugugcuucaagggcugcagacucccagcugcaaaauucagaaguuaucccugcagaauuguugucucacaggggcuggcuguggcguuuugagcuccacucugagaacucuuccgacucugcaggaacuccaccugucugacaaucugcucggcgacgccggccuacagcuccugugcgaaggccuguuagacccccagugcagacuggaaaaauugcagcucgaauacugcuccuuaagugcugcuucuugugagccacucgcuucugugcugcgugccaaaccggacuucaaggaguugaccgugucaaacaacgauauuaacgaagccggagugagggugcucugucagggccucaaagacucuccuugucagcuagaagccuuaaagcuggagucaugcggcgucaccagcgauaauugucgugaccuaugcggaaucguggcauccaaagcaagucuacgcgagcuggcucugggcucgaauaaacucggcgauguuggaauggcugagcucugcccuggacuacuucauccaagcucucggcugcggacccuguggaucugggagugcgguauaaccgcgaaagggugcggugacuuaugccggguuuuaagagcuaaggagucccuaaaggaguuaagucucgcuggcaacgagcugggugaugaaggugcccgucuuuugugcgaaacguugcucgagccugggugucaacuugagagccugugggucaagucuugcucauucacagccgccugcuguucucacuuuagcagcguucucgcacagaaccgguuucugcuagaacugcaaaucagcaauaacaggcuggaggacgccggggugcgggaacuuugucaagggcuggggcagccugguuccguacucagaguucuuugguuggcggauugugacgugucugauucaagcugcucuuccuuggcagcaacucugcuggcaaaccacucccugcgugaacucgauuuauccaacaauugcuugggcgaugcuggcauucuucaguuggucgagucagugcgccaacccggauguuuacuggagcaacuuguucuuuaugacauuuauuggucagaagaaauggaggaucggcuucaggcccuggaaaaagacaaaccaucacugcgaguuaucagcuag

SEQ ID NO: 12278 - RNA, 534 nt, Artificial Sequence
  Description of Artificial Sequence: Synthetic coding sequence
augaggcuguugauacucaccuguuugguugcugucgcacuagccaggccuaaacucccccugcgguauccugaacgccuccagaacccgucagagucuucagaacccaucccauuggaaucucgcgaggaauauaugaacggcaugaaucgccagagaaacauacuucgagagaaacagacugaugaaaucaagaauugugucguugccgaaccugagaagauggaaucuucaaucuccucauccuccgaagagaugucguugucuaagugugcugagcaguuuugcagauugaacgaguacaaucaguuacagcuccaaaagaugucaaagcaggagcagauucgccguaugaaugaaaacagccaugugcagguucccuuucagcaguugaaucaguuggccgccuauccauaugccgucugguauuacccacagauuaugcaguauguucccuucccacccuucagcgacauaucgaauccuaccgcccacgagaauuaugagaaaaacaauguaaugcuccagugguag

SEQ ID NO: 12279 - RNA, 3054 nt, Artificial Sequence
  Description of Artificial Sequence: Synthetic coding sequence
auggaucugauccgcggggugcugcuaaggcugcugcuccuagcuagcagcuugggucccggugcuguuucucugagggccgcaauaaggaagccugguaagguuggcccaccccuggauaucaaacucggagcuuugaacugcaccgcauuuucaauccaguggaagaugccaagacacccuggauccccgauccuggguuacacaguguuuuacagcgagguuggagccgacaagagccuacaggaacagcugcacucagugccacugucaagggauaucccaacaaccgaggaaguaauaggagauuugaaaccgggcaccgaguaucgggugagcauugcugccuauucccaggcuggaaaggggaggcugucuucuccacgacauguuacgacccuuucccaggauaguuguuuaccuccagcugcgccccaacagccccaugucauugucgucuccgauucugaggucgcccugaguuggaagccaggggccucagaggguagugccccuauccaguauuauagcguggaauucauucgaccggauuucgauaagaaguggaccagcauacaugagagaauucaaauggacucuaugguaauuaagggcuuagaucccgauaccaauuaucaguuugccgucagggcaaugaacucacauggcccaucgccgcgcucauggccaagcgacauuauucguacacuuugccccgaggaagccggaucggggagguauggaccuagauacaucacagauaugggggccggagaggacgacgagggauuugaagaugaucuggaucucgauauuucuuucgaggagguuaagccuuugccagccacgaaggguggcaacaaaaaauuucugguagaaucuaagaagaugaguauuucaaacccaaaaaccaucucacguuugauuccaccgacaucugccucucuccccgugaccacaguggcaccgcagccgauccccauccagcguaagggaaagaauggagucgcaaucaugagccgccucuuugacaugccuugcgacgaaacccuguguucagccgacagcuucuguguuaaugauuauacaugggguggcuccagaugccagugcacacuuggaaaaggcggugaaagcugcucagaagauaucgugauacaguauccccaguucuucggccacucuuauguaacauuugaaccccuuaagaauuccuaccaggcuuuccagaucacacuggaauuccgcgcggaagcugaggaugggcugcuauuguacugcggcgaaaaugaacacggucggggagacuuuaugagucucgcuaucauccggagaucacugcaguuuagauuuaauugugggaccggagucgcuaucaucgugucagaaacaaagaucaaguuggguggauggcacaccgugaugcucuacagagauggacugaacggacuucugcaauuaaacaacggaacccccgugaccggacaaagccagggccaauauuccaagauuaccuuucgcaccccacuguauuugggcggggcuccgagcgccuauuggcuaguucgggcgaccgguacgaaccguggauuucaagguuguguccagagccucgccgugaacggaaggcggauugacaugcgacccuggccccuuggaaaagcuuuguccggggcagacguaggcgagugcucgucaggaaucugcgacgaggccaguuguauucacggaggaacgugcacggcuauuaaagccgacucuuauauuuguuugugcccgcugggauucaaaggccgccacugcgaggacgccuucacacuaacgauuccccaauuucgggagucgcugaggucauacgcggcuacccccuggccguuggagccccagcacuaccucagcuuuauggaguuugagaucaccuuuagacccgauucaggagaugguguguugcucuauucuuaugauacuggaucaaaagacuuucuuucgauaaaucucgccgggggacacguggaguuucguuuugacugcggaucaggaacaggcguacuuaggucagaggacccguugacacucggaaacuggcacgaauugagggugaguagaacagcaaagaacggaauccugcaaguggauaagcaaaagaucguggagggcauggcugaaggcggguuuacucaaaucaaaugcaauaccgauauauuuauuggcggaguaccuaacuaugaugacguuaaaaaaaacucugguguguugaagccuuuuuccggcucgauacagaaaauuauacugaacgauaggaccauacacgugaaacacgacuucacgagcggcgucaacguggagaaugccgcacaccccugcgugcgcgcccccugcgcucacggcggcucuugccgccccaggaaagagggauaugacugcgacuguccacuaggauuugaagggcuucauugccaaaaagaaugcggaaauuacugucugaacacuaucaucgaggccauugaaaucccucaguucaucggccggucuuaucuuacuuacgacaaccccgauauuuugaagaggguguccgggucaagguccaaugucuucaugcgguuuaaaacaacagcaaaagauggccuacuguuguggcguggagacagcccuaugagaccaaauuccgauuuuauuagccuuggcuugagggauggagcucuggucuucucuuauaauuuggggagcggugucgccaguauuaugguuaaugguuccuucaaugaugggcgcuggcacaggguuaaagcuguaagagauggacaaagcggaaagauuacaguggacgacuauggggcaagaacuggcaagucgccuggaaugaugcggcaauugaauaucaauggugcccucuacgugggaggcaugaaggaaaucgcuuuacacacuaaucgccaguauaugcggggucuggugggaugcaucagccauuuuacccugucaacggauuaucacaucaguuuaguagaggaugccgucgauggaaagaacaucaauacuugcggcgccaaguag

SEQ ID NO: 12280 - RNA, 1893 nt, Artificial Sequence
  Description of Artificial Sequence: Synthetic coding sequence
augcagcaagacgggcuggggguugggaccagaaacggauccggcaaaggcagaucugugcacccaucauggcccuggugcgccccacgaccacuaagauacuuuggcagagacgcacgggcucgacgcgcccagacugcugccauggcucuucuugccgggggccuaucccguggauuggggagccacccugcugcggccggacgcgacgccgugguauuuguguggcugcugcuaucaacuugguguacggcaccugccagggccauccaggugacaguaucuaacccauaccacguggugauccuguuccagccagucacccucccaugcacauaucagaugacguccacucccacccagccaaucguaauuuggaaguauaagucguuuugucgcgacagaaucgcugacgccuuuaguccagcuuccguggauaaccagcuuaacgcacaauuggcggccggaaauccuggauacaacccauacguugagugccaggacuccguacgcaccguucgcgugguugcaacuaagcagggaaaugcugugacgcucggggacuacuaucaagggcgucgcaucacaaucaccgguaaugccgaccuuacuuuugaccagaccgccuggggagacuccgguguguacuacugcaguguugucucggcccaggauuuacagggaaauaaugaggccuacgccgagcugaucgugcuggauuggcuuuucguugucguggucugccuugccgcuuuuuugauuuucuugcugcucggaauuuguuggugucaguguuguccacauacuuguuguugcuaugugcgcugcccauguugucccgacaaauguuguuguccugaggcuuuguacgcugccgggaaagcugcgacauccggggucccuuccaucuaugcaccaagcacuuaugcccaucucuccccugccaagacaccaccgccuccugcaaugauuccaauggggccugcauauaauggauaucccgguggguacccgggagacguugaccggucuagcagugccggagggcaaggcucauaugugccucuccuccgggauacggacucaucuguggccuccgaggugcguaguggauaccgcauucaggcgucacagcaggacgauucaaugcgaguucucuauuacauggaaaaggagcuggccaauuuugacccuagcaggccaggaccaccuagcggaagaguggaacgagcuaugucagagguuacgucacugcaugaagacgacuggcguucuaggccaagccgugguccugcacuuacgccaauaagagaugaagaaugggggggacauucuccacguagcccucggggaugggaccaggagcccgccagggaacaggcuggcggaggcuggcgugcaaggcguccccgcgcuaggaguguggaugcccuggacgaucuuaccccuccuucuaccgccgaauccggaucucgaucucccacauccaacgggggcaggucuagggcuuauaugcccccaaggagccggaguagagaugaccucuacgaccaagaugauaguagagacuucccacgaagccgcgacccacauuacgacgauuuucguagccgcgaacgcccucccgcugauccacggucgcaccaucaucgaaccagggaccccagggacaauggaucgcggagcggggaccuuccuuacgaugguagauuacucgaggaggccguacgcaaaaaggguagugaagagcgcagacgaccacauaaagaagaagaggaagaagccuacuacccaccugcaccaccaccuuauagcgaaacagauucgcaggcuucccgugagagacggcugaaaaagaauuuagcgcugucuagagagucacugguagucuag

SEQ ID NO: 12281 - RNA, 750 nt, Artificial Sequence
  Description of Artificial Sequence: Synthetic coding sequence
augcuccagcucuggaagcuaguauuacuguguggagugcugaccggcacguccgaaucccuucucgauaaccugggaaacgaccugaguaacguggucgacaaguuagaacccguccuccaugaaggcuuggagacuguggacaacacccugaaaggcauacuugagaagcucaagguggaccuaggaguacugcaaaaaucuucagcauggcagcucgcuaaacaaaaggcacaggaagccgagaaguuacugaauaaugucaucucuaagcuguuaccaaccaacaccgacauuuuuggacugaagauaaguaauucccugauccuagaugucaaagccgaaccuaucgacgacggcaaaggacugaaucugaguuuuccuguaaccgccaacguuaccguugcagggccuaucauuggacaaaucauuaaucuuaaagccucucuugauuuguugacggcugucacaauagagaccgacccucaaacucaucaaccagucgcugugcugggagagugcgcuucagacccgacaaguaucucucucucuuuguuggacaagcacagucaaaucauuaacaaguuugucaacagcguaauaaacacucuuaagucuacugucuccucccugcugcaaaaggaaauauguccuuugauccgcaucuucauucacucucuagacgucaaugugauucagcagguugucgauaauccacagcauaagacacaacuucaaacccucaucuag

SEQ ID NO: 12282 - RNA, 3057 nt, Artificial Sequence
  Description of Artificial Sequence: Synthetic coding sequence
auggugucucauuucauggggagucucaguguacuuuguuuccugcugcugcucggauuccaguucgugugcccacagccuucgacgcaacauaggaaggucccacagcgaauggcugcugaaggagcuccagaagacgacggugggggaggggcccccgguguuuggggggccuggggcccgugguccgccugcucacgguccugcagcggaggggugauggaacaaacgagaccguguuugccucgcucuuaccgucuaagagggggacagcggcccggcgcacccgccagagcauuugcugaccaugucgucucugcagucaggacuucaguaccucuccauaggucccgggaugagacccccgcccucgcgggcaccgacgcuucaaggcaaggcccgacaguacugaggggaucccggcacccacaaccucaggggcuggaagugaccggugacagaagaagccggacucgugggacuaucggaccuggaaaauacggauauggcaaagcucccuacauacuaccucugcagacggauaccgcccacacaccucaaagacuuagacgacagaagcuauccagcaggcauucucgcucucagggggccaguuccgcucggcaugguuauucuuccccggcccaucaggucccacagcacggcccccuguaucaaucagauucagguccuaggucuggccugcaggccgccgaggcucccauauaucagcucccccuaacccacgaucagggcuacccagcggcaucaagccucuuccauucacccgagaccagcaauaaucacggcgucggcacucacggcgcuacacaaucguuuucccagccagcccgguccacugcgaucagcugcaucggcgccuaccgucaguauaagcuaugcaacaccaauguguguccagagagcagccguucuauccgggaaguucaaugugccaguuauaauaacaagccuuucaugggucgcuucuacgagugggagcccuucgccgaggugaaagggaacaggaagugugaacugaacugucaggccaugggguaucgguuuuacgugcgccaggcggaaaaggucauugacggaaccccuugcgaucagaacggcaccgccaucugcgugagcgggcaauguaagagcauuggcugcgacgauuauuuagggucugauaaagugguagacaagugcgguguaugcgggggagacaauacuggcugucaaguuguuagcggaguguucaaacaugcucuuacuagucucggcuaucaccgcguugucgaaaucccagagggagccaccaaaauaaacaucacagaaauguacaagucuaauaacuacuuggcccuccggucucgcaguggccgcagcaucaucaacggaaacugggcaaucgaucggccuggaaaguacgaaggcggaggcaccauguucaccuauaaaagaccuaacgaaauaucuaguaccgccggcgaauccuuccucgcugaggggccuaccaacgaaauucuugacgucuauaugauacaccagcaaccuaauccaggaguucauuacgaguacgugaucauggggacuaacgcuauuucaccucaaguccccccccaucgaaggccuggcgagccguuuaauggucagaugguaacugagggacgcucccaagaggagggcgagcaaaagggacguaacgaagaaaaggaggacuuacgcggcgaagcgccugaaauguucacaagcgagagcgcucaaaccuuuccagucaggcaucccgaucguuucagcccucaccggcccgacaaccucguaccccccgcaccucagcccccacgcagaucccgugaccauaacuggaagcagcugggcaccacugagugcucaacgacuugugguaaggggucccaguacccaauauuccgcuguguucaccgguccacucacgaggaggccccagagagcuauugugauaguuccaugaagccaaccccagaggaggaaccaugcaacauauuuccuugccccgccuuuugggacaucggagaguggagcgagugcagcaagaccugcggccucggcaugcagcauagacaggugcuuuguagacagguguaugccaauagaucacugacggugcaacccuacaggugccagcaccuggagaagccagagaccacuuccacaugccaacugaagauuuguagcgaauggcagaucagaacagauuggaccuccugcuccguuccuuguggugugggccagcgcacucgcgaugugaaguguguuucuaacaucggagacgugguggacgaugaggaaugcaacaugaaguuaaggcccaaugauauugagaacugugacaugggcccaugcgcuaaauccugguuuuuaacagaauggucugagcggugcucugccgaaugcggagccggggugcggacacgauccgucguuugcaugaccaaucacgucaguagccugccccuugaaggaugcggcaacaaccggccugcugaagccaccccaugcgacaacgggccuugcacaggcaaaguggaaugguuugcuggcuccuggagucaauguucgaucgaguguggcucagggacucagcagagggaggugaucugugugagaaaaaaugcugacaccuucgaaguuuuagaccccucagagugcaguuucuuggagaaaccucccagccagcagucuugucaucuuaaaccgugcggugcuaaaugguucucaacggaauggucaaugugcagcaaaagcugucagggcggauuucgugucagggaaguccgcugcuugucugaugacaugacccugucuaaccuaugugauccccagcucaagccagaagaacgugaguccuguaacccucaggauugcgugccggagguggacgagaacuguaaagacaaguacuacaauuguaaugucguugugcaggccagacuauguguuuauaauuacuacaagacugcgugcugugcauccugcacaaggguagccaaucgucaaaccggcuuucuuggcagucgauag

SEQ ID NO: 12283 - RNA, 1311 nt, Artificial Sequence
  Description of Artificial Sequence: Synthetic coding sequence
augcagggaacuccugguggagggaccagaccaggcccuucuccugucgaucgaagaacgcuccuugucuucaguuucauucuugcggcugcucuggggcagaugaauuuuaccggugaccaggugcugagagugcuugccaaagaugagaagcagcuaagccuccucggcgacuuggagggguuaaagccccaaaagguagacuuuuggcgagggcccgcccgucccucuuuaccaguggacaugcgggugccguuuuccgaacuuaaggauauuaaagccuaccucgaaucacauggauuagcuuacaguauuaugaucaaagacauacaggugcuuuuagaugaggaaagacaggcaauggccaagucccgaaggcuggaacggagcacgaacuccuuuaguuauuccucuuaccauacauuagaagaaauuuauucauggaucgacaauuuugugauggaacauucugauaucguguccaagauucagauugggaauagcuucgaaaaucaaaguauccugguuuugaaauuuucgaccggagggucucgccauccggcuaucuggauugacacaggaauucauagcagagaauggaucacccacgccacaggcaucuggaccgcaaacaaaaucgugagugauuauggaaaggauagaguucugacugacauccuaaaugcaauggacaucuucauugagcucguaacuaacccugacggguucgcuuucacgcacagcaugaaccgacuguggagaaaaaauaagucuauuaggccagggaucuucuguaucggaguggaccugaaccgcaacuggaagagcggcuuuggcgggaauggaucuaacucuaaccccugcagcgagaccuaucaugguccauccccccaaucugagcccgaaguggcggccauugugaauuucauaacggcucacggaaauuucaaggcccugauuagcauucauaguuacagccagauguugauguauccauacggacgauugcuggaacccgucaguaaccaacgggaauuguacgaucucgcgaaagaugcaguggaggcccuauauaagguucauggcauugaguauauauucgggucgauuaguacuacauuguacguugcaaguggaauuacagucgauugggccuacgauucaggcaucaaauaugcauuuuccuuugaauuacgcgacacaggacaauacggcuuucuauugcccgccacccaaaucauucccaccgcccaggagaccuggauggcccugagaacuauaauggagcauacucucaaccaccccuacuag

SEQ ID NO: 12284 - RNA, 492 nt, Artificial Sequence
  Description of Artificial Sequence: Synthetic coding sequence
auguuccaaggccuucuccuguuacuccugcucucaaugggcggcacgugggcaagcaaggaaccucuuaggccuagauguaggccuaucaacgcgacucuugcugucgaaaaggaaggcugcccuguuugcaucacugugaacaccaccauuugugcaggcuacugcccgaccaugacacggguacuucaagggguguuaccugcucuuccacagguuguauguaacuaccgggacguccgcuucgagaguaucaggcuacccggauguccuaggggcgugaacccaguugucagcuaugcuguggcacuuagcugccagugugcacugugccgaaggucaacuacagacugcggcggaccuaaagaccacccacuaacaugugaugauccaagguuccaggauucuucgagcucuaaagccccuccuccaucucuaccgagcccuucccgccugccagguccgagcgauacacccauucugccccaguag

SEQ ID NO: 12285 - RNA, 213 nt, Artificial Sequence
  Description of Artificial Sequence: Synthetic coding sequence
augccaggggcuaugaagauauuuguguuuauccucgcugcauuaauacuacuggcccagauauuucaagcuaggacagccauacaucgggcccugauaucgaaaagaauggaaggacacugugaggcagaaugucuaacuuucgaagugaagauuggagguuguagagcagaacucgcaccuuucuguugcaagaaccgcaaaaaacacuag

SEQ ID NO: 12286 - RNA, 1098 nt, Artificial Sequence
  Description of Artificial Sequence: Synthetic coding sequence
augugguugcuacugacuauggcaucccucaucucuguucucgguacaacucacggguuauuuggaaaguuacaucccggcagccccgaagugaccaugaacaucucacagaugaucaccuacuggggguacccaaaugaagaguaugaagucgugacagaagauggauauauucuggaggucaauagaauuccauacggcaaaaagaauucaggcaauaccgaugccgguuaugacgucuggcugggcaacuccagagguaauaccugggcacggcggaaucuguauuauaguccagauagcgucgaguuuugggcuuuuaguuucgaugagauggcaaaguacgauuugcccgcaacuauugauuuuauagucaagaagacgggccagaagcaguuacauuauguaggccauucacaggggacuacaauuggauucaucgcuuucagcacuaacccaagccuugccaaacggaucaagacuuucuaugcccucgcuccaguggcuacuguaaaauacacaaaauccuuaauaaacaaacugcgcuuuguaccccaaucuuuauuuaaguuuauauuuggagacaaaauauucuauccucacaauuucuuugaucaauucuuggcaacagaagucugcucucgugagaugcucaaucugcucuguaguaacgcccuguucaucauauguggcuuugauucuaagaauuuuaauaccucuagguuagauguuuaccugucucacaauccagcagggacaucuguucagaauauguuucauuggacacaggcuguuaagucaggaaaauuucaagccuaugauuggggaagccccgugcagaacagaaugcacuacgaucaaucacagccaccuuauuacaauguuaccgccaugaacguuccgaucgcgguguggaauggggggaaggaccuacuggccgauccucaggauguuggacugcugcugcccaaacucccaaaccugaucuaccauaaggaaauaccuuuuuauaaucaucuggauuuuaucugggcaauggacgcuccucaggagguuuacaaugauauugugaguaugauaagugaagacaagaaauag

SEQ ID NO: 12287 - RNA, 2535 nt, Artificial Sequence
  Description of Artificial Sequence: Synthetic coding sequence
augggcccuggcgcucccuuugccagagucggcuggccucuuccgcucuugguaguuauggccgcuggcguugcuccagucugggcaucccauagcccacacuugccaaggccccauagcagggucccuccgcacccuucuuccgagagacgugcagucuauauaggggcccuguucccaauguccggaggcuggcccggcggacaggcuugucaacccgccguugagauggcccuagaagacgugaacagcaggagagacauucugccagauuacgagcugaaauugauucaccaugauagcaagugcgacccuggccaagcuacgaaguaccuguacgaacuccucuauaacgacccgaucaaaaucauccucaugccuggcuguuccagugucuccacucugguggcugaggcugccagaauguggaaucuaaucguucugagcuacggcuccuccuccccagcccugaguaaucgccaacguuuucccacuuucuucagaacacaucccuccgcaacucugcauaacccuacucgggugaagcuauuugagaaaugggguuggaagaagaucgcaaccauacagcaaacaacugaagucuuuacaagcaccuuggacgaccuggaagagcgcgugaaggaggccggcauagagaucacauucaggcagagcuucuucucugacccagcaguccccgugaaaaaccugaagcgccaggacgcacgaaucauugucggcuuguucuaugagaccgaagcacgcaaaguguucugcgaaguuuauaaagagagacuguucggcaagaaguacguuugguuccugauuggcugguacgccgacaacugguuuaagauuuaugaccccucaauuaauugcacaguagacgagaugaccgaggccguagagggacacauaacuacagagauuguaauguugaauccggcaaauacaagaaguauaaguaauaugaccucacaagaauuugucgaaaaacuuacaaaaagacugaaaagacacccagaggaaaccgggggcuuucaggaggcaccacucgcuuacgacgccaucugggcccucgcucucgccuugaauaagaccaguggcggcggcggacguucaggugugaggcuugaggauuuuaauuauaacaaccaaacgauuacagaccaaaucuaucgggcaaugaauagcucauccuuugaagguguuagcgggcacguggucuucgacgcuagugggucucgcauggccuggacacucauagaacaguuacagggugggagcuacaaaaagaucggauacuacgauucgacuaaagacgaccuaucguggucaaaaaccgacaaauggauuggugggucccccccagcagaccagacccugguuaucaagaccuuuagguuccucagucagaagcucuucaucucagucagcguuuuguccagucucggaaucguccuggccgugguuuguuugagcuuuaauaucuauaacagccauguccgauauauucagaacucucaaccuaaccuaaauaaccuuacagcugucggguguagccuggcacuggcugcgguguucccacugggacucgauggcuaccauaucggacgcaaucaguucccuuucguuugccaagcucgccucugguuacucggauugggcuucucccuggguuaugguuccauguucaccaaaauuugguggguacacaccguauucacgaaaaaagaggagaagaaagaauggaggaaaacauuagaacccuggaaacuuuacgcuacgguaggacugcucgugggaauggaugugcucacacuggcgaucuggcagaucguggacccccugcaccggaccaucgagacuuucgccaaagaagaaccuaaggaggacaucgauguaucaauccucccucaguuagagcacuguucuucucgcaaaaugaacaccugguuaggcaucuuuuacggauacaaaggucuccugcugcuucugggcaucuucuuggcuuacgagacuaagagcguuucaacugagaagaucaaugaccaucgugccgucgggauggcuaucuacaacgucgcaguccuuugcuuaauuaccgcucccguuacuaugaucuugaguagccagcaagaugcugcuuucgccuucgccucucuggcuauuguuuucucuuccuauauaacccuugucguacuguuuguccccaagaugcgacgccucauuaccagaggagaauggcaauccgaagcucaggauaccaugaaaacagguucaucuacuaacaacaacgaagaggaaaagucucgccugcucgagaaggagaaccgcgaauuggagaagaucaucgcagagaaagaggaacgggucagugagcugaggcaccagcugcaaucucggcaacagcugcgcucgcgcaggcauccaccaacccccccagaaccaucugguggcuugcccaggggcccccccgagcccccagaucgccucucgugcgacggcagccguguucacuugcuguauaaguag

SEQ ID NO: 12288 - RNA, 1020 nt, Artificial Sequence
  Description of Artificial Sequence: Synthetic coding sequence
augguaucaaaauccagauggaaauugcuagccaugcucgcgcuuguucuggugguaauggugugguacucaaucagucgagaggaucgguauaucgagcuguucuacuuccccauucccgagaaaaaggagcccugucuacaaggcgaggccgaauccaaggccagcaaacuguuuggcaaacugucaccacuauguaguuacucacgggaucagccuaucuuucugagauuggaagauuacuuuugggucaaaacccccucugccuacgagcucccguacggcaccaaaggcucugaagacuugcugcuucgaguucuggccauuacauccuccagcauccccaagaacauccagucacugcgcugcagacgguguguugugguggguaacggacacagguugcguaacagcagccugggcgacgccaucaacaaauacgacgucgucauucgacugaacaaugcccccguggccggguaugaaggugaugugggaucaaaaacaaccaugcgucuguuuuacccggaaagugcacauuucgauccuaagguggaaaacaaucccgacacccuauugguucuggucgcguuuaaagcuauggacuuucacuggauagagacgauacuauccgauaaaaagcgcgugagaaaagguuucuggaagcaaccuccucucaucugggacgucaacccaaagcagauacgcauccugaaccccuuuuuuauggaaauagccgccgacaagcuucuaucgcucccuaugcagcaaccccggaagauuaaacagaaaccuaccacuggguuacuugccaucacgcucgcucuucacuugugugaucugguccacauagcugguuucggcuacccugacgcauauaauaaaaaacagaccauucauuacuaugagcagauuacacuaaaauccauggccggcuccggacacaacguuagucaagaggcguuggcgaucaagcguaugcuggagaugggcgccaucaagaaucugacuucuuucuag

SEQ ID NO: 12289 - RNA, 1386 nt, Artificial Sequence
  Description of Artificial Sequence: Synthetic coding sequence
augagucuggauauacagucacuggacauucaaugugaagaacucuccgaugcacggugggccgagcuucugccuuuacuccaacagugucaagugguuagauuggacgacuguggucugacugaggccagaugcaaggacauaaguucugcccugagagugaaucccgcccuagccgaacugaaccuccggucuaacgaauugggagaugugggcguccauugcgugcugcaggguuugcaaacaccaagcuguaagauucagaagcugucacugcaaaacuguugcuugacaggggccggcugcggcgugcucagcucuacccuacguacccugccaacccuucaggaauugcaccuauccgauaacuuacucggagaugcaggauugcaacugcugugcgagggucuccucgacccccaauguagauuggagaaacuacaguuggaauauuguagccuguccgcggcaucaugugagccucucgcuucuguucugagggcaaagccagauuuuaaggagcugacuguguccaacaacgacaucaacgaagccgggguccgcguccugugccagggacugaaggacucucccugccagcuggaggcccuuaaacucgaaucaugcggcguaacaucagacaacugucgggaccugugcggcauugucgcuucuaaggcgucucucagagaguuggcacuggguagcaauaagcugggcgaugugggaauggcugagcuuuguccgggacuucugcaucccuccagccgacuacguacccuguggauuugggagugcgguaucacugcuaagggcuguggcgacuuaugccggguacuucgcgcuaaagagucccuaaaagagcugucucuggcuggcaacgagcuaggggaugaaggcgcccgccuacugugugaaacccugcuggagccaggcugccagcucgaaucccuaugggugaagucguguucuuucaccgccgcaugcuguucacacuucucaucugugcuugcucaaaaucgauuucugcuggagcuacagauuuccaauaauagacuugaggaugccggagucagagagcucugccagggacucgggcaaccuggcagcgugcuacgggugcuguggcuggcagacugugaugucuccgacucgagcugcucuagucucgcugccacccuccuugcgaaccacuccuuacgugaguuggaccucagcaauaacugccucggggaugccggcauacugcagcugguugagagcguccgacagccgggaugccuccuggaacagcuugugcuguaugauaucuacuggagcgaagaaauggaagauagacugcaggcucucgagaaggauaaaccaucccuccgagugauaaguuag

SEQ ID NO: 12290 - RNA, 1695 nt, Artificial Sequence
  Description of Artificial Sequence: Synthetic coding sequence
auggcucccaagaagcuguccugucugaggucuuugcuccugccucuaucacuaaccuugcuccugccucaggcugauacgcgcucguucgucguugauagaggacacgacagguuccuacuagacggagcuccauucagauacgucucuggguccuugcacuacuuuagggucccccguguuuugugggcugaucgucuccugaaaaugagaugguccggccuaaacgcuauucaguucuaugugccguggaacuaccaugagccacaaccugggguguacaauuuuaacgggucccgcgaucugauugccuuccucaacgaggccgcucuagcuaaucuguugguaauauuacggccugguccuuauaucugugcagaaugggagaugggcgggcuaccuagcuggcuacuacguaaaccagagauccaucuuaggacaagcgacccugcagacaauaugacaaaaauauuuacacuacuccgcaaauaugaaccacacggaccucuaguaaauucagaauacuauacaggcuggcucgauuacuggggucagaaucauucgacgagaucuguaucggcagucacaaaggggcuggagaacaugcugaaguugggagccucagugaauauguacauguuccauggcggcacaaacuucggauacuggaacggcgcggacaagaaaggaagguuccucccaaucacuacuucauacgauuacgaugcaccaauauccgaggccggagacccuaccccuaagcuguuugcucugcgggauguaauaagcaaauuucaggaggugccucuagguccucugccaccuccuucucccaaaaugaugcuuggcccuguaacucugcaccugguaggccaucugcucgcuuuucuugaccugcuuuguccuagaggcccgauucacaguauacugccaaugacuuuugaggccguuaaacaagaucauggguucauguuauaccgaacauacaugacccauacuaucuucgagccuacuccauucugggugccaaauaauggcguccaugacagagccuacgucaugguugacggagucuuucagggcguggucgaaaggaacaugagggauaaacuauuuuugacaggaaaacuagggucaaagcuggacauacuuguggaaaacauggggaggcugucuuuuggcagcaacucaucggacuucaagggacuguuaaagcccccgauauuaggccaaacaauauuaacucaauggaugauguucccacugaaaaucgauaaccucguuaaguggugguuuccucuccagcucccuaaguggcccuacccucaggcccccucugggccuacguuuuauaguaagacuuucccuauauuaggaagcgugggagauaccuuucuguauuuaccaggguggaccaaaggucagguuuggauuaauggauuuaauuuaggucgcuauuggaccaaacagggaccucagcagacccuguacgugccaagauuccuguuguucccccggggcgcguuaaauaagauuacacugcuggaguuggaagacgucccccugcaaccucaaguucaauuucuggauaagcccauccucaauucuacgucuacccugcaccgcacccacaucaauucccucucagccgacacucuuucagcuagcgagcccauggagcucucaggccacuag

SEQ ID NO: 12291 - RNA, 1317 nt, Artificial Sequence
  Description of Artificial Sequence: Synthetic coding sequence
augauguaugcucccguggaauucucagaagcagaguuuaguagggcagaguaccaacgaaagcaacaauucugggacuccgucaggcuggcacuguuuacgcucgcaaucguggccauaauagggaucgccauugguauuguuacucacuucgucguggaggacgauaagagcuucuacuaccuugcuagcuuuaaagugacgaacauuaaguauaaagagaacuacggcauaagguccucucgggaauuuaucgagcgcucucaucagauugagagaaugaugucuaggauuuuccgucauuccuccgugggcgggcgguuuaucaagucucauguuauaaagcugucaccagacgaacagggugucgacauucugauuguacucaucuuucgcuauccuuccacugacucugccgagcaaauuaaaaaaaaaaucgaaaaagcuuuauaccagucucugaagaccaagcaacugucccuaaccauaaacaaacccucuuuccgccuuacuccuauugacucuaaaaaaaugcgaaaccugcugaauuccagaugcggaauucgaaugaccucaucaaacaugccacucccagcaucuucgaguacucagcgcauagugcagggccgggaaacggcgauggaaggcgaauggccuuggcaagcaucucuucagcugauuggguccggucaucaguguggagcuucauugauuucaaacacaugguuauuaacagccgcucauugcuuuuggaagaauaaggaccccacccaguggauugcaaccuucggggcaacaauuacuccgccugcggugaagagaaacgucaggaaaauuauacuucacgaaaacuaccauagagagaccaaugagaacgauauugcucuggugcagcucaguacaggaguugaauucucuaauaucguacagcgaguuugccuucccgacuccaguauaaagcucccuccaaaaacuuccgucuucgugaccgguuucggaucuauuguggacgaugguccuauucagaacacucugcggcaagccaggguugaaaccauaagcacagacguuugcaacaggaaggacguguaugacggacugaucacuccugguaugcugugugcgggcuucauggagggaaagauagaugcauguaagggagacuccggcggaccacuuguguaugacaaucaugacaucugguauauuguggguauuguguccuggggucagagcugcgcucucccaaaaaagcccggcguauacacccgggucaccaaauaucgcgauuggaucgcgagcaaaacuggaauguag

SEQ ID NO: 12292 - RNA, 4392 nt, Artificial Sequence
  Description of Artificial Sequence: Synthetic coding sequence
auggaacccagacuguuuuguuggaccacccucuuccuccuggccggauggugucucccugggcugccaugucccucccggugucugugcuuuaaaagcaccguccgaugcaugcaccugaugcuggaccauauaccucaggucccccaacaaacuacagugcucgaccuucgauucaauagaaucagagaaaucccuggcuccgccuuuaagaaguuaaagaaccuuaauacccuuuuguuaaacaacaaucauauccgcaaaaucucuaggaacgcauucgaaggccucgaaaaucuccuguaucuauaucuguacaagaacgaaauucacgcccuugacaagcaaaccuuuaaaggccuaaucagucuggaacaccuauacauucacuucaaccagcuggaaaugcuacagcccgagaccuuuggugaccugcuccgccucgaacgucucuuccuccauaauaauaagcucuccaagauuccagcaggcucauuuucuaaucuugacucacugaaacggcugcgccuugauucuaaugcucuggucugugacugcgaucugauguggcugggagaauugcugcagggcuuugcccagcacggacauacucaggccgcggcuaccugugaguauccacggcgccugcauggacgugcaguagcuuccgugacaguagaagaguuuaacugucaaagcccgaggauuaccuuugaaccacaggaugucgaaguacccaguggaaacaccgucuacuucaccugccgggccgagggcaauccuaagccugagaucaucuggauucacaauaaucauucccuggaucucgaggacgacacaaggcugaacguauucgaugaugggacuuuaaugauccgaaacacacgagagagugaucagggugucuaucaaugcauggcuagaaauucagccggagaagcaaaaacccagucagcaaugcuccgcuauucaucacugcccgccaaaccuucuuuuguuauccaaccccaggacacagagguucugauugggacaagcacuacacuggaaugcauggcaacuggacacccccacccauugaucacauggacuagggauaacggucuggaguuagaugggagucggcacguggcaacgaguucuggccuguaccugcagaauauuacacaaagggaccauggacgguuuacgugucaugcaaacaauagucauggcacaguacaagccgccgcuaacauaauugugcaggcccccccccaguuuacagugacucccaaagaccagguaguccuggaggagcaugcaguggaguggcugugugaggcagauggcaauccaccaccugugaucguguggacuaaaacggggggccagcugccuguugagggacagcacaccgugcucuccucuggaacccucaggauugaucgcgccgcacaacaugaccagggucaguacgaaugucaggccgugucuagucugggcgugaaaaaagugagcgugcagcugacuguaaagccgaaggcucuugccgucuuuacacaacuaccgcaggacaccuccguggagguuggcaaaaacaucaacaucucaugccacgcccagggugaaccccaaccaauuaucacauggaacaaggaaggcgugcaaauuacugaauccgggaaguuccauguggaugaugaaggaacucugaccaucuaugaugccggguuuccggaucaaggccguuacgagugugucgcaagaaacucuuucggucucgcuguaaccaauauguuucucacuguaacugccauccaagggcgacaggccggggacgauuuuguggaaaguuccaucuuggacgcuguccagcgaguggacuccgcuaucaauucaacuaggagacaucuguucagccagaaaccacauacuucuagcgaccugcucgcccaauuucauuacccccgagacccccuuaucguggagauggcucgggcaggcgagaucuucgaacauacgcuucagcugauaagagagaggguaaagcagggccugaccguggacuuagagggaaaggaauucagguacaacgaucucgucucacccagaucuuuaucucucaucgcuaaucugucagguuguacugcaagacggccccugccgaauuguucuaaucgguguuuucacgccaaguaccgcgcucacgaugguacguguaauaauuugcagcagccgacuuggggcgcagccuuaacagccuucgccagauuacugcagccagccuaccgagacggaauuagagccccccgggggcuuggacuccccguuggaagcagacagccucucccgcccccccggcugguagccacagucugggcuagagcagcagcaguuacccccgaccacuccuacacacgaaugcuuaugcacuggggcugguuucuggagcacgaccucgaccauacaguccccgcccuuagcaccgcccgcuuuucagauggaagaccgugcagcucuguguguaccaaugaucccccaugcuucccaaugaauacgaggcacgccgacccccggggaacgcacgcuccgugcauguuauucgcuaggucuaguccugccugugccucugggcggcccagcgcaaccgucgacucggucuaugcaagagagcagauaaaccagcaaaccgcuuauauugacggcuccaacguuuacgguucauccgagagggagucucaggcacugcgagacccuagcgucccuaggggacugcugaagacaggauucccauggccuccaucugguaagccucucuugccguucaguacaggacccccuacagagugcgcccgacaggaacaggagucacccugcuucuuagccggugaccaucgcgccaacgagcaccuugcguuggcagcuaugcacacacugugguucagagagcacaacaggauggccaccgaacuauccgcccuuaauccacacugggagggaaacacaguuuaccaagaggcgaggaagauuguaggggccgagcugcagcacaucacauacucacacuggcuccccaagguacuaggcgaucccgguaccagaaugcuccggggguacaggggguauaacccaaacgugaaugcuggaaucauuaacagcuucgccaccgcagccuuuagguuuggucacacccuaaucaauccuauacucuacaggcucaacgcaacauugggggaaaucagcgagggacaccuuccuuuccacaaggccuuguucuccccaucgcggaucaucaaggagggcggcauugauccuguccuuaggggccuguucgguguggccgccaaguggcgugcucccagcuaucugcugagcccagagcuuacccaaaggcuauuuucugccgcuuacucugcugccgucgacagcgcagcaaccauaauccagaggggccgagaccacggaauccccccuuauguugacuuccgcguguuuugcaaccucacuuccgugaagaacuuugaggacuuacagaacgagauuaaggacucugaaauaagacagaaacugaggaaacuauacggcucuccuggagauauagaucuauggccugcuuugaugguggaggacuuaauccccggcacuagaguaggcccaacgcuuaugugucuguuugucacgcaguuccaaaggcucagagacggagaccgguucugguacgagaauccaggggucuucacucccgcccaauugacgcaacucaaacaggcuucauugaguaggguuuugugugauaacggggacaguauccagcaaguccaggccgauguguucguaaaggccgaauauccacaagauuauuugaacuguuccgagauuccuaaaguggacuugcguguguggcaggauugcugugccgauugucgcagcagggggcaauuccgagcugucacgcaagagagccaaaagaagcggagcgcccaguauaguuaucccguggacaaagauauggaauugagccaccugagaucccggcagcaggauaagauuuacgugggagaagaugcaaggaacguaaccgugcuagccaagacaaaguuuagccaggacuuuucuacauucgcagccgaaauucaagaaacaaucaccgcucuccgggaacagaucaauaaguuagaggcuaggcuacgacaagccgggugcacagacguccgaggagucccccgcaaagccgaggaacgauggaugaaagaggacuguacacauugcauaugugagucgggccaaguuaccuguguggucgaaauuugucccccugcacccuguccuucuccugaacucgucaagggaacauguuguccuguuuguagagacaggggaaugcccucagacuccccggagaagcgcuag

SEQ ID NO: 12293 - RNA, 1206 nt, Artificial Sequence
  Description of Artificial Sequence: Synthetic coding sequence
augggacucaaagcacuuugcuugggcuuacuaugcguccucuucgucucccacuucuacacgccgaugccugauaauaucgaggagaguuggaaaaucauggcacucgaugccauugccaaaacaugcacguuuacugcaauguguuuugaaaacaugagaauuaugcgcuacgaagaauucaucucuaugauuuuuagacucgauuacacucagccccuuuccgaugaauauauuacggugacugacacaaccuucgucgauaucccugugcgauuauaccuucccaagcgcaaaucagagacaaggcggcgggccgugaucuacuuccauggcgguggcuucugcuucgggagcaguaagcagagggcguucgauuuccugaauagguggacugccaacacucuugaugcuguuguggugggcguagacuacagguuagccccgcaacaucacuucccugcacaguucgaggacggucuugcggccgugaaauuuuuccuccuggaaaagauccugacgaaguacggggucgauccuacccgcaucuguaucgccggcgacucuucagguggcaaucuggcaaccgccguuacccaacaggugcaaaaugacgcggaaaucaaacauaagaucaaaaugcaggugcuccuguaccccggccuccagauuaccgauucuuaccuucccagucaucgggaaaaugagcacgggaucguuuugacacgcgauguggccauuaagcuugugucacuguauuuuacgaaagaugaagcccugcccugggcuaugaggaggaaccagcacaugccucuagagucuagacaccuuuuuaaguucguuaacuggucaauccuucugccagaaaaauauagaaaagacuauguguacacugaaccaauacuagguggacucagcuacagccucccuggacugacagauaguagagcacucccccuuuuggccaaugauucccaacugcaaaaucugccacugacuuauauccuuacuugccagcacgacuuguuaagagaugauggcuugauguaugugacucgccugcggaacguuggcguacaggugguucaugagcauaucgaagacggaauccacggcgcucucagcuuuaugacuuccccuuucuaucuucgccugggccugaggauacgugauauguaugugucuuggcuggauaaaaaccuguag

SEQ ID NO: 12294 - RNA, 264 nt, Artificial Sequence
  Description of Artificial Sequence: Synthetic coding sequence
auggugagcuugaugaaguuguggauucccaugcugaugacuuuuuucugcaccguccuccucuccgugcuaggcgaaaugagaaaaaagagguacgaccgcaaagaacuuuuauuggaggaaugcugggggaagccuaacgugaaagaguguaccaauaaauguagcaaagcguuuagaugcaaagauaagaauuacacauguuguuggaccuauugcgggaauauauguuggaucaaugucgaaaccuccggggacuauuag

SEQ ID NO: 12295 - RNA, 813 nt, Artificial Sequence
  Description of Artificial Sequence: Synthetic coding sequence
augaggggucaagggcgaaaagagucucucucugacuccagagaucuugauggcuccuacgaucagcugaccggccaucccccaggccccacaaaaaaagcucugaagcaacgguuucuuaaacuucuuccgugcugcggaccucaggcccugccuucaguaagcgagacccuggccgcuccggccucacuaagaccacaccgcccccgguuacucgacccagacucuguagaugacgaguuugaacugucuacugugugucacagaccggaaggacucgaacagcuucaggaacagacaaaguuuacuagaaaagaauuacagguccuguaccgggguuucaaaaacgagugccccuccgggauugucaacgaggagaauuucaagcagauuuacucacaguuuuucccgcaaggcgauagcucaacguaugcaacauuccuguucaaugcuuuugauacaaaccacgacgguucuguguccuucgaggacuucguggcaggccuuuccgugauccugcgcgguacagucgaugauaggcucaauugggcauuuaaucucuacgaccucaacaaagacgggugcaucacgaaggaggagaugcuugacaucaugaaaagcauauaugauaugaugggaaaguacacuuacccagcacugcgcgaagaagccccacgagagcauguggaaucuuuuuuucagaagauggacagaaacaaggaugggguagugacgaucgaagaauucauagagucaugucagaaagacgagaacaucaugcguucuaugcaacuauucgacaacgugauuuag

SEQ ID NO: 12296 - RNA, 819 nt, Artificial Sequence
  Description of Artificial Sequence: Synthetic coding sequence
augcaucugcggcucaucuccuggcuuuuuaucaucuugaacuucauggaauacaucggaagccaaaacgcuucaaggggacguagacagagacggaugcacccaaauguuagccagggaugucagggggguugcgcuacauguucggacuacaacgguugccuaucuugcaagccacgacuguucuucgcguuggagcgcauuggcaugaagcaaauuggaguuugccucagcagcuguccaagcggauacuauggcacccgcuacccugacaucaauaagugcacgaaaugcaaagcagacugcgauaccuguuucaauaagaauuuuuguaccaaauguaaauccggcuucuacuuacaucucgggaagugccuggauaauugcccugaaggccuggaagcaaauaaucauacuauggaaugugugucuaucguccacugcgagguuagugaauggaaccccuggucacccuguacuaagaaagggaagaccuguggcuuuaaaagggguaccgagacucgcguucgcgaaauaauucagcauccaucagcuaaagggaaccugugccccccuacuaaugaaacccgcaagugcaccgugcagcguaaaaaaugccagaaaggagaaagggggaaaaaaggacgugaaaggaagaggaaaaagcccaauaagggugagucuaaggaggcaauaccagacucaaagucacuggaguccuccaaagagauuccagagcaacgggagaacaagcaacaacagaaaaaacgcaaaguucaggacaagcagaagagcgugaguguguccaccgugcacuag

SEQ ID NO: 12297 - RNA, 294 nt, Artificial Sequence
  Description of Artificial Sequence: Synthetic coding sequence
auggcuaaaaguuucccaguauuuagucuccuuucuuuuauccuuauucauuuaguucucagcaguguuucaggcccucgacauugguggcccccccgaggaaucaucaaaguuaaguguccauaugaaaaagucaaucucagcugguauaacggcacagugaacccuugcccaggcuuguaucagcccaucugcggcacuaacuuuaucacauaugauaauccauguauccuauguguugagucauugaagucucacggucgcauaagauuuuaccacgauggaaagugcuag

SEQ ID NO: 12298 - RNA, 726 nt, Artificial Sequence
  Description of Artificial Sequence: Synthetic coding sequence
auguggacuguuagaacagaggggggucacuucccacuccauagcccuaccuucagcuggagaaacguugcguucuugcugcuguuguccuuggcccuugaguggacuagcgccauguugacaaagaaaaucaagcacaaacccgggcucuguccuaaggaacggcucaccuguacaacggaacuuccugauucuuguaauacugacuuugacuguaaagaguaccagaagugcuguuucuuugcuugccagaagaaaugcauggacccuuuccaggagccauguaugcucccuguuagacacgguaacugcaaucacgaagcacagcgcuggcacuucgacuuuaaaaacuacagaugcaccccauucaaguaccgcggcugugaaggcaacgccaauaacuuucucaacgaggaugccugcagaacggcguguauguugauugugaaagacggccagugcccucuguuccccuucacagaaaggaaagaaugcccgccguccugccacucugauaucgacugcccccaaacagacaagugcugugaaucccgcugcggcuucgugugugcacgugcauggacugucaaaaagggguuuuguccacggaagccuuugcuguguacaaagaucgauaaacccaagugccuucaagacgaagaaugucccuugguagaaaaguguuguucucauugcggucuuaaauguauggacccaagacgcuag

SEQ ID NO: 12299 - RNA, 1827 nt, Artificial Sequence
  Description of Artificial Sequence: Synthetic coding sequence
auggcccgggcucgggccggggcucuacuugcacucugggucuugggcgccgccgcucauccucagugccuggauuuucgcccaccuuuucguccaacgcagccauugagacugugcgcucaguauucugauuuuggaugcugcgacgagggccgcgacgcugagcuaacgcgcagauucugggccuuggcuucacgcguugaugcagcugaaugggcugcgugcgcaggcuaugcgcgagaccuacugugucaggaauguucacccuacgccgcucaucuuuacgaugccgaagacccauucacuccacuccgcacuguaccaggccugugccaggauuauugucucgauauguggcacaagugccgcgggcuuuuccggcaucugucuacugaucaggaacuuugggcccuugaaggcaacuuagcucgauucuguagguaucuaagccuugaugauacugacuauuguuuccccuaucugcugguaaacaaaaaucugaauaguaaccucgggcacgucgucgcggacgccaagggcugucuacaguugugcuuggaagaaguagccaacggccuuagaaaccccgucgccaugguucacgcgcgggauggaacccaucgauucuuuguggcugagcaggugggccuggugugggccuauuuacccgaccggagccgccucgggaagccauuccuuaacauuucccgcguugucuugacgagccccugggagggcgacgaacgcggcuuccucggaaucgccuuucaucccaguuuccagcauaauaggcgccuguacguguacuacuccgucggcauacgcuccagugaauggauccggaucuccgaauuccgcgugagcgaagacgacgagaacgcuguggaucauucuuccgaacgcauuauccuggaggugaaggagccugcuucgaaccauaauggcggacagcuucucuucggcgacgacggguauuuauauaucuucacuggagacggcgggauggcaggagacccauucgguaccuucggcaaugcucagaauaaaucugcucuccugggaaagguguuacgcauugauguugaucgaaaagagcgaggacugcccuacggaauucccccagauaauccuuucgugggcgacccugccgcucagccagagguguacgccuuaggaguacgcaacauguggagaugcuccuucgaccggggugauccuaguucaggaacugggagaggccgacuuuuuuguggggacgugggccagaacaaguucgaagaagucgacguaguugagaggggcggaaauuauggauggcgggcaagagaaggcuucgagugcuaugaccgaucucuaugcgccaacacauccuuaaaugaccuccugccuaucuucgcuuauccucauaccguaggaaaguccguuaccggggguuauguauacagagguugugaguauccaaacuugaacggucuguauauuuucggugauuucaugucuggacgguuaaugucucugcaagagaacccgggcacaggacaguggcaguacagcgagauuuguaugggccacggacagacuugcgaguucccuggucugaucaauaauuauuacccuuacaucaucucuuuuggagaggaugaggccggggagcucuacuucaugucgacuggcgaaccaucugcaaccgcaccacggggcgugguuuauaaaauaauugaugccucuuccugcaaggcucgauccgcaaugccaggauaugugccagccccuagcgucugcuccucccucaccucccagccuuuuauucuccagugguggaaguag

SEQ ID NO: 12300 - RNA, 351 nt, Artificial Sequence
  Description of Artificial Sequence: Synthetic coding sequence
auggccccuccuagugugccacuugugcuccugcuuguccugcugcucagucuggccgaaacuccagccagcgcacccgcccaccgaggccgcggcgguuggacgcucaauucugcgggcuauuuacuaggcccaguacuacaccugccgcagaugggugaucaagacgggaaaagagagaccgcacuugaaauucuggaccucuggaaggcaauugacggucugccauacucgcacccaccccaacccaguaagagaaacgugauggagacauuugcuaagccugagaucggagaucuugggaugcuguccaugaagauaccaaaggaggaagacguauuaaaauccuag

SEQ ID NO: 12301 - RNA, 3618 nt, Artificial Sequence
  Description of Artificial Sequence: Synthetic coding sequence
augcgcaagccacgcaggaaaucgcgucaaaacgcagagggacggagaaguccuuccccauauucucucaaauguucccccacaagagaaacacugacguacgcucaagcacagagaauuguggaaguugacaucgaugggcggcugcacagaauuucuaucuaugaccccuuaaagaucauuacggaggaugagcugaccgcccaggauaucaccgaaugcaacaguaauaaagagaacagugaacaaccccaguucccagggaaaucuaaaaaaccuuccagcaagggcaaaaaaaaggaaucuuguuccaagcaugccucuggaacuagcuuucaccucccucaaccaucauuccgcaugguugauuccggcauucagccugaggcacccccauugccggcugcuuauuaccgauauauagagaaaccuccugaagaucuggacgcagaaguggaguaugacauggacgaggaggaccuggcguggcuugauauggugaacgagaaaaggagaguggauggccacucacugguuucugccgauacuuucgagcugcugguugaucgucuggaaaaggagucuuaccuugaaagucguuccaguggcgcgcaacagucacucauugacgaagaugcuuuuugcuguguaugucuagacgacgagugucauaacaguaauguaauccuuuucugcgauaucugcaaccucgccguucaucaggaauguuauggaguccccuacaucccagaaggacaguggcuaugucgguguugucuccagucucccucgcggcccguggacugcauccugugcccuaauaaagguggagccuuuaagcagacuucugacggccauugggcucaugugguaugcgcuaucuggauaccugagguaugcuuugcaaauaccguguuucucgagcccaucgaaggcaucgauaacauaccuccggcgcgcuggaaacugacauguuacauauguaagcagaagggacugggcgcagcuauacagugucacaagguuaacugcuauaccgcauuucaugugaccugcgcucagcgcgcugggcuguucaugaaaaucgagccaaugagagaaaccucgcugaauggcacgaucuucaccguucgaaaaacagcauauugugaggcacacagcccaccuggagcugcgacagcacgaaggaaaggcgacuccccaagguccaucagcgagaccggugacgaagaaggacucaaagaaggcgacggagaggaggaggaggaggaggaaguugaggaggaggagcaggaggcccaaggagggguuagcggcucuuugaaaggugucccuaaaaaguccaagaugucccugaaacaaaagauuaagaaagaacccgaggaagcuggucaggauacaccuucuacucugccuaugcucgcugugccccagaucccgucuuaccgccugaacaagaucuguagcggucuuucuuuucagaggaaaaaucaguuuaugcagagguugcacaauuauuggcuguuaaagcggcaggcccguaacggagugccccuuauacggaggcuucauucccacuugcagagucagcggaaugccgaacaacgagaacaggaugaaaagacgucugccgugaaggaggaauuaaaauacuggcagaagcugaggcaugaccuggagagggcccgguugcuaaucgaacugauucguaagagagagaaauugaagagagagcagguaaagguacagcaagcugccauggaauuagaacugaugccuuucaaugugcuucuccggaccacccucgaucuucugcaggagaaagacccagcccacauuuucgcugaacccguaaaccugagcgaggugccugacuaucuggaauuuauaucgaagccuauggacuucagcacuaugaggaggaaacuggaaucacaccucuaccguacauuggaggaguuugaggaagauuucaaccucaucgucacuaauugcaugaaauacaaugcaaaggauacaauuuuucaccgggccgcggucaggcugcgcgaucuggguggugccauacucagacacgcucgucgccaggccgagaacauuggguacgaccccgaaagaggcacccaccuacccgagucccccaagcuggaggauuucuaccgauucucaugggaagauguugacaacauucuaauuccugagaacagagcccaccugucuccggaaguucaacugaaagagcugcuggagaagcuugaucuggugagcgcuaugaggaguucaggcgccaggacucgccgugugaggcuguuacgacgcgaaauuaacgcucuccggcagaagcucgcucagccuccuccuccccagccaccgagccuuaauaagacuguuaguaacggagaacugccugcgggcccucagggagaugcugccguacucgagcaagcccugcaggaggaaccagaagacgauggugauagagaugauuccaagcuaccaccuccucccacgcucgaaccaacgggacccgcaccauccuugagcgaacaggaaucuccuccugagccgcccacacugaaaccgaucaacgacagcaagcccccuagccgcuuucugaaaccacggaagguagaggaagacgaguugcuggaaaagagcccucugcaacuggguaacgagccccuccagcgccugcucuccgacaacggcaucaacaggcuuucccugauggcuccugacacccccgcuggcacuccuuuguccggagugggacggcgaacuaguguucucuuuaagaaagcaaagaacggcguuaaacuucagaggagcccagaucguguccucgaaaacggagaagaucacgggguggcaggaucucccgcuagcccagcguccauagaggaggagcgccauucuagaaaacggccuagaucuagaaguuguuccgaaucugagggcgaacggagcccacagcaagaggaagagacgggcaugacgaauggcuuuggaaagcauaccgagucugggucggauuccgaguguucuuugggucucucggggggacucgcguuugaagcuugcagcggccucaccccucccaagcggucccgggguaagccagcccugagcagaguucccuuuuuagaaggagugaauggcgacagugacuacaauggaucuggccgaagucugcugcuucccuucgaggauagaggggaccuggaaccacuggaauugguuugggccaaaugccgcggauaccccucuuauccagcucugauuauagauccaaaaaugccuagggaagggcuccuucacaacggggugcccauccccgugccaccucuggauguccuuaaguugggggaacagaaacaggcagaggcuggugagaagcucuuccucgugcucuucuucgacaacaaaagaacuuggcaguggcugccccgggauaaggugcugccccuaggaguugaagacacugucgauaaacucaagaugcuugaaggccguaagacaucgauuagaaagucuguucaggucgccuacgacagggcaaugauccaccugucacgcgugaggggaccacauucuuucguuaccuccaguuaccuuuag

SEQ ID NO: 12302 - RNA, 1977 nt, Artificial Sequence
  Description of Artificial Sequence: Synthetic coding sequence
auguucgugucuuaccugauacuuacccuacuucaugugcagacagccguccucgcccgucccggcggagaaagcaucgguugugaugauuaucuagggucagacaaggucguggauaaguguggggugugcggaggggauaauaccggcugccagguggugucuggagucuucaagcacgcacuuaccucacugggguaccacagggucguggaaauccccgagggagccaccaaaaucaacauaaccgagauguacaagaguaacaacuaucucgcucuccgaucucguucaggcagaucaauuaucaacgggaauugggcaauugaucggcccggaaaauaugagggaggcggcacaauguucacuuauaaacgaccuaacgagauaucuuccacagcuggagagaguuuuuuagcagaggggcccaccaaugagauacuagacguguauaugauccaccagcagcccaaccccggcguccacuacgaauauguuaucaugggaacaaacgcaauaucgccccaggugccaccccacagacguccuggcgaaccauuuaacggacagauggugaccgaagguaggucacaagaagagggcgagcaaaaaggacguaaugaggaaaaagaggaccuucggggggaggccccugagauguucacaucugaauccgcucagacauuucccguccgacacccugauagguuuucaccacauagaccagauaaucuggugccaccugcaccccagccaccccgccggucacgggaucacaauuggaaacagcugggcaccacagaguguucuacaacaugcggaaaaggaagucaguauccuaucuuucgguguguacaccgaucgacacaugaagaagcaccggagagcuacugugauucauccaugaaacccacacccgaagaagagccauguaauauuuuuccuugcccggcauucugggauauuggcgagugguccgaaugcucuaagacuuguggccuagggaugcagcaucgccaggucuugugccgccaggucuacgcuaaccguucacugacugugcagccguacagaugccaacauuuagagaaaccggaaaccaccagcacuugccagcugaagauuugcucugaguggcagauuaggacagauuggaccuccuguucagugcccuguggaguugggcaaagaacccgggacgucaaauguguguccaauauuggugacguggucgacgaugaggagugcaauaugaagcugaggccaaacgacauugagaacugugauauggguccuugcgccaagagcugguuccuaaccgaauggucagagcgguguucugccgaauguggugcuggggugcggaccagauccgugguuuguaugacgaaccacguguccucucucccacuggaaggcuguggcaacaaccgccccgcagaggccacacccugugacaacggcccaugcacaggaaagguggaaugguuugcuggguccuggucacagugcucaauugaaugcggcagugguacacagcagagggaaguuaucugcgugagaaagaacgccgauaccuucgaaguucuggaccccagugaauguagcuuccuggaaaaaccaccaucccagcaaucuugccauuugaaaccuuguggggcuaaaugguucucuacagaaugguccauguguagcaaguccugccagggcggguucaggguacgcgaagugcgcugucuuagcgaugacaugacccugucaaaccucugcgacccacaacuaaagcccgaagaacgggaguccuguaauccccaagauuguguuccggaaguagaugaaaacuguaaagauaaguacuauaacugcaauguaguuguccaagcacguuuauguguguacaauuacuacaaaacagcauguugugccucuugcacgcguguggcuaacaggcaaaccggguuccuaggaagccguuag

SEQ ID NO: 12303 - RNA, 708 nt, Artificial Sequence
  Description of Artificial Sequence: Synthetic coding sequence
augcgaccuuuagccggggguuuacuuaaagugguguucguaguuuucgcgucucuaugugccugguauagcgguuaucuccucgccgaacuuauuccagacgccccucuuagcucugcagcauauucaauuaggucaaucggagagcguccaguacugaaagcuccagucccuaagcggcagaagugugaccauuggaccccuugucccucugacacuuacgccuaccggcugcucuccggcggcggacgcucuaaguaugcgaaaauuuguuuugaggauaaucugcugaugggcgagcaacucgggaacguggcccggggaauuaacauugcuauugugaacuaugugacuggcaaugucacggccacucgguguuuugacauguaugagggagacaacucuggacccaugacgaaguuuauccaguccgcugcaccuaaaagcuugcuguuuaugguuacauaugacgacggcuccacacgauugaacaaugaugccaaaaacgccauugaagcccugggaaguaaggaaauuaggaauaugaaauuuaggucaucauggguuuuuauugcggcaaagggccuugaacuaccaucagaaauucagcgcgagaagaucaaccacucugaugccaagaauaauagauacucugguuggccagcugaaauccagaucgaggggugcauuccgaaggaacggaguuag

SEQ ID NO: 12304 - RNA, 759 nt, Artificial Sequence
  Description of Artificial Sequence: Synthetic coding sequence
augcguggacagggcaggaaagaaagccugucugauucccgugaccuugacgguuccuacgaucagcucaccggccacccuccaggcccuaccaagaaggccuugaaacagcgcuuccuuaaacugcucccauguugcggaccacaggcccugccguccgucuccgagaauuccguggaugaugaauuugaacucucaacuguaugucaucgaccugaggggcuggaacagcuccaagagcaaacaaaguuuacgcgcaaagagcugcagguccuguacagggguuucaaaaacgaauguccgagcggcauagugaacgaggaaaauuucaagcaaaucuacagucaguucuuuccccagggugacucguccaccuacgcaaccuuccuguuuaacgcauucgacaccaaccaugauggcucugucuccuucgaagacuucgucgccggacucagcgugauuuuaaggggaaccguugacgaucggcugaacugggccuuuaaucucuacgacuugaauaaagauggcugcauaaccaaggaggagaugcuggauaucaugaagucuaucuacgacaugauggggaaauacacauacccugcccucagagaggaagcaccucgagaacacguggaguccuuuuuccagaagauggauaggaauaaggauggagucguaacuauugaggaauucaucgaaucaugccagaaagaugaaaacauaaugaggucaaugcaacuguucgacaaugugauuuag

SEQ ID NO: 12305 - RNA, 312 nt, Artificial Sequence
  Description of Artificial Sequence: Synthetic coding sequence
auguccggaagagggaagggcggcaagggcuuagguaagggcggagccaaaaggcauagaaagguucuuagagacaauauucaaggaauuacaaaaccugcuauuagacggcuugcccgaagagggggggugaagcggaucagcggauugauauaugaggagaccagagggguguugaaaguguuuuuagagaacguuaucagagaugcugugacguacacggagcaugccaagcgcaagacugugacggcaauggacgugguguacgcccugaaaagacaagggagaacccuguauggauuuggcggguag

SEQ ID NO: 12306 - RNA, 3120 nt, Artificial Sequence
  Description of Artificial Sequence: Synthetic coding sequence
auggaagugacugcaguggcuacacaaggcggcuauggaucuagugacugggucacuucguaucugcucauguucucagacggugguagaaauuggaagcaguauaggcgugaagagucaauuuggggcuucccaggcaauacaaacgccgacucaguggugcacuaucgccugcagccgccguucgaagcccgauuucugagguuccugccacuggccuggaaucccagggggcguaucggcaugcguaucgagguuuacgggugugcauacaaguccgaagucgucuauuucgaugggcagucagcacugcuguauagacuggauaagaaaccguuaaagcccauucgcgacguuauaucucugaaauucaaggcaaugcagagcaacgggauccuucugcaucgcgaggggcagcauggaaaucacaucacacucgaacuuauaaaaggcaagcucguauucuuucucaauuccggaaaugccaagcugccauccacgauugcacccgucacacuuacacuggggucuuugcucgacgaccaacacuggcauucuguccuuaucgaacuucuggauacacaggugaacuucacaguggacaagcauacucaucacuuucaggcuaagggugauuccucuuaccuugacuugaacuucgaaauuucguuuggcgguauaccaaccccagggaggucucgggcguucagaaggaaaagcuuucauggcugccucgaaaauuuauacuacaauggaguugacgucaccgagcuggcaaaaaagcauaaaccacagauccucaugaugggaaauguuucuuuuucuugcccgcagccucagacaguucccgugaccuuucucuccagccgcagcuaucuugcucuccccgggaauaguggagaggacaagguuucuguuacauuccaauuuagaaccuggaaucgagcaggacaucuucucuucggcgagcugaggagaggcuccggaucauucgucuuguuuuugaaagauggaaaacucaaauugagcuuguuccagccaggccagaguccucgcaacgucaccgccggcgcggggcucaaugacgggcaguggcauucagucuccuuuuccgcuaaguggucgcacaugaacguaguuguugacgacgacacagcuguacagccacugguagcaguccugaucgacaguggagauacuuauuacuucggcggcugccucgacaauuccagcggaucuggcuguaaaaguccucucggaggguuccagggaugucuucgacugauuacaaucggggauaaagcuguagaucccauucuggugcaacaaggggcacugggaagcuuucgcgaccuucaaaucgauagcugcggcauuacugacagguguuuaccuagcuacugugagcacggaggugaguguagucagagcugggacaccuucuccugugacugucucggcacgggauauaccggggagacuugccacucuucccuuuacgaacaguccugugaggcccacaaacauagaggcaacccuaguggacucuauuauauugacgcagauggcagcggcccccuaggaccauuccucguuuauugcaauaugacugcagacgcagccuggacagugguucaacaugggggacccgaugcggugacacugagaggggcacccaguggacacccucggagugccguaaguuucgcauacgcggccggcgcuggucaacuccgcucggcaguuaauuuggcugaaaggugcgagcagaggcuugccuuacguuguggcacggcgcgucgaccagauagcagggacggcaccccucugucgugguggguugggagaacaaacgaaacacacaccucauggggggguucucucccagacgcucagaagugcacaugugggcuugaggggaauugcauugauagccaguauuauuguaauugugacgccggaaggaaugaguggacuuccgauacuauuguccucucccagaaggagcaucugccggucacacagaucguuaugacggaugcuggccggccacacuccgaagcagccuacacccuagguccacuacugugucgaggagaccagucauuuuggaacucagccucauucaacacagaaaccuccuaccugcacuuuccugcguuccacggcgaauuaacagcugacguguguuuuuucuuuaaaacuacagucuccagcgggguauucauggaaaacuugggaaucaccgacuuuauccggaucgaacugcgugcaccaacugaaguaaccuucagcuuugacguggggaaugguccaugugaggugaccgugcaguccccaacacccuuuaacgauaaccaguggcaucaugugcgugcagaacggaacgugaaaggagccucacuccagguugaccagcuuccacagaagaugcagccugcaccagcagauggacacguuagauugcagcugaacucucagcucuucaucggcgguacugccacacgacagaggggcuuucugggcugcauccgcucucugcagcucaacggaguggcccuggaccuggaggagcgggcaacagugaccccgggcguggaacccggcugcgcaggacacuguuccaccuaugggcaucuguguagaaacggaggucgauguagagaaaaacgcagaggcgugacuugugacugugccuucuccgcuuaugacgggccauuuuguuccaacgagaucucugcauauuucgcuacuggaaguucgaugacuuaccauuuccaggagcacuacaccuugagugaaaauucaagcagccuggucucuucccuccaccgcgacgugacacugacucgagaaaugauuacucuuucuuuucggaccacccgaaccccgucccuacugcuguauguuaguucguuuuaugaggaauaucucagcgucauucuggcaaauaacggaucucugcagauucguuacaaguuggacaggcaccagaaccccgaugcauuuacguuugacuucaaaaauauggccgacggccagcugcaucaggugaaaauuaaucgggaggaagcuguagucaugguggagguaaucccccagaugcaaaaaucuaauuag

SEQ ID NO: 12307 - RNA, 1257 nt, Artificial Sequence
  Description of Artificial Sequence: Synthetic coding sequence
augagaagccuccugcuacucucagcuuuuugcuugcuggaggcagcacuggccgcagaaguaaagaaaccagcggcugccgcagcgcccggcacagccgagaagcugagccccaaagcggcuacauuggcagagagaucggcuggacuagccuucagccucuaucaggcuauggcaaaggaccaagcagucgagaauauacugguuucucccgucguaguggcauccagucucggacugguuaguuuaggagguaaagcaaccacagcaagccaagcaaaggcgguuuuaucagcagagcaacuacgggaugaagaggugcacgcaggacugggggagcuguugcguucauuaucuaacuccacagccaggaaugugacauggaagcuaggcucaagacuuuauggaccuuccucggucuccuuugccgacgauuucguccggucaagcaagcagcacuacaauugugaacacucaaagaucaacuuuagggauaagaggucagcacugcagagcaucaacgagugggccgcccagacaaccgacggcaaacucccagaagucacuaaagacguggaaagaacagacggcgcuuuacuggugaaugccauguuuuucaagccccauugggacgagaaguuucaccauaagaugguggacaaccgagguuucauggugaccagauccuacacuguuggcguuaugaugaugcacagaacugguuuguacaacuauuaugaugaugaaaaggaaaaacuucagaucguugagaugccgcucgcucacaagcucucaucacugaucauuuuaaugccccaucacguggaaccucuggagcgguuagagaaguugcugacuaaggagcagcuuaagauuuggauggguaagaugcagaagaaagccguggcuauuagccuaccuaaaggggucgucgaagucacgcacgaccugcagaagcaucuggccggacugggcuugacggaagcaaucgauaagaauaaagcugaucuaagccgcaugucuggaaaaaaggacuuguaccuugcgagcgucuuccaugcaaccgccuucgaacucgauacugauggaaauccauuugaucaggacauuuacggaagggaggaauugcgaagcccuaagcuauucuacgcugaucacccauuuauuuuucuagugcgggacacucaaagugggucccuguuguucaucggacgguuagugagaccaaaaggagacaagaugcgcgaugaauuguag

SEQ ID NO: 12308 - RNA, 378 nt, Artificial Sequence
  Description of Artificial Sequence: Synthetic coding sequence
augcagcuguugaaagcgcugugggcacuugccggcgccgcccugugcuguuuccuaguauuaguaauccacgcucaguuucugaaagaaggccagcuugcggcuggcacuugugaaauugugacccuggaccgagauaguucccagccuaggaggacgaucgcaagacaaacugcacgcugcgccugccggaaaggccagauugccggcacuacuagagcuagacccgcaugugucgaugcgagaauaaucaaaacaaaacaguggugugacaugcugccgugucuugagggagagggcugugaccugcuuauaaacaggucaggguggacaugcacucagccagggggaagaauaaaaacaacuaccgugucauag

SEQ ID NO: 12309 - RNA, 5859 nt, Artificial Sequence
  Description of Artificial Sequence: Synthetic coding sequence
augccugcccugggccccgcguuguugcaggcccugugggccgggugggugcugacacugcagccacugccuccgaccgcuuucacaccuaauggcacauaccuacagcaccuugcucgggauccgacgagcgggacccuuuaccugggagccacaaacuucuuguuucaauuguccccuggacugcaguuggaagcgacaguuuccaccggucccguuuuggauaguagagacuguuugccuccggugaugcccgaugaguguccccaggcccagccuaccaauaacccaaaccaguuguugcugguuagcccgggggcccucguugucugugggagcguucaccaggguguaugcgagcagagacgucugggacagcuggaacagcuccuccuccggccugaaagacccggagauacacaguacguggcagcuaacgaucccgccgucucgacagucggauuaguugcccaagggcuggcaggcgagccacugcuuuuugucggaaggggguauacgucacgaggggucgguggaggcauaccaccaaucaccacaagagcuuuguggccacccgacccucaagcugcauuuucauaugaggaaacagcgaagcuggcuguggggagacugucggaguauagccaucauuucgugucagccuucgcgagaggcgccucugcuuauuuccuguuucuccgccgggaucuccaggcccagucccgcgccuuucgugcauaugugucuaggguuuguuuaagagaccaacacuacuacagcuacguagaacuuccccuggccugugaaggcgggcgauauggauuaauccaggccgccgcuguggccaccucacgggagguugcccauggggaggugcuuuucgcugcuuucagcucagcagcccccccuacuguugggaggcccccgucugcugccgccggcgcauccggagccagugcccugugugcauucccacuggacgaaguugaccgccuagcaaacagaacucgcgacgcaugcuacacucgagaaggcagggccgaggacgggacagagguggcguacaucgaauaugacgugaauucagacugugcucaguuaccaguagacacucuggacgcauaccccugcggaucugaucacacaccauccccgauggcuucacgggugccacuugaggccacuccaauucuugaauggccuggcauacagcuuaccgccguggccgucaccauggaagauggucacacuaucgcuuuccucggcgauagccaggggcagcuccauagagucuauuuagggccagggagugauggucacccuuauagcacacaaucaauucaacagggcucugccguuucgcgggaucugacuuuugacgguacuuucgaacaccuguaugugaugacucagucuacccugcugaaaguuccaguggccuccugcgcccagcaccucgacugugcaaguuguuuggcucaucgugaucccuacuguggauggugcgugcucuuaggucgauguagccgacggucggaauguagucgcggacaggggccugaacagugguugugguccuuccaacccgaacuggggugucugcaggucgccgcuaugucccccgcaaauauaucccgggaggaaacacgagagguguuucugucugucccagaucucccuccccucuggccgggagagucuuacucaugccacuuuggggagcaucaaagccccgcccugcugacugguaguggggucaugugcccaagcccagaucccucugaggcacccgugcugccucgcggagcagauuacguaagcguguccgucgaacuccgguucggggccgucgugaucgccaagacaagucuaagcuucuaugauugcguugcgguaacagagcugcgaccgucugcacagugccaggcuugugugucuucccgauggggcuguaauugguguguguggcagcacuuaugcacccauaaggcguccugugaugcuggucccaugguggcaucucaucagucuccucuggugucucccgauccacccgcacgaggagauggagacuccgcugagcuugaaggccccccagcacccuugauucucccuuccucacuggacuaucaauaugacaccccaggcuuaugggagcucgaagaggccacccuuggcgccaguucaugcccuugcguggaaaguguucagggauccacccucaugccugugcacgucgagcgugagauacgccuucucgggcgcaaucugcaucucuuccaagacggccccggggacaacgagugcgugauggagcuggagggacuggaaguggugguggaagcacggguggagugcgaaccacccccugauacccaaugucacgugacuugccagcagcaccagcugaguuacgaggcccugcagccagagcuacgcgugggucuuuuccuucgccgagcuggccgauugcggguggauagcgcugagggauuacacgugguacucuaugacugcuccgugggacacggcgauugcucgagaugccagacggccaugccacaauacggcuguguguggugugaaggagagagacccagaugcgugacccgcgaggcgugcggagaagccgaggccguggccacccaguguccagccccgcugauccacuccgucgagccuuuaacaggucccguggauggggguacccgaguuaccauacgcggcagcaaccuaggccaacauguucaggaugugcucgggauggucaccgucgcaggagugccgugugccguagacgcucaggaauaugaagucuccuccucccuuguuugcauuaccggagcgaguggcgaagaagucgcuggggccacugcaguggaggugccuggcagagggaggggagugagcgagcacgacuucgcauaucaggaccccaaggugcauuccaucuuuccagcgagagguccccgagcugguggaaccagacuaacccuuaauggaucuaagcugcucaccgggcgccuggaggacauuagggucguagucggcgaccagccuugucauuuacuuccagagcagcaaucggagcagcugcggugugagacaucucccagaccaacacccgccacgcugccagucgccgugugguucggagcuacagagagaagguuacagcgcggacaguuuaaguauacgcucgacccaaacaucacauccgcuggcccaacuaagagcuuucugagcggggggagggagauaugugucagaggucagaaucuggacguagugcagacaccuaggaucagagugacugucguuucaaggaugcuccagccaucgcagggcuugggucgcagaaggcgagucguuccagaaacagccuguucccuuggcccuuccuguuccucacagcaguuugaagagcccugccacguaaacuccagccagcugauuaccugucguacuccugcccugccuggauugccugaggauccaugggugaggguagaguucauucuugacaaucuggucuuugauuuugccacccuaaacccgacaccuuuuuccuacgaagcagaccccacccuccagccucuaaacccugaagaucccaccaugccuuucagacacaagccuggcucaguguuuucuguugagggcgagaaccuugaucuggcaaugucuaaagaggaaguuguugccaugaucggagacggaccaugcgucguaaagacccugacccggcaucauuuauauugugaaccaccuguggaacaacccuugccacgacaccacgcccugagagaggcuccugauagccuucccgaauuuaccgugcaaaugggcaacuugagauuuucauuaggacauguacaguaugacggagaaucuccaggggcguucccuguggcagcucaggugggccuggguguuggaacaucccuuuuggcucuggguguaauuaucaucguguugauguaccgaagaaagucaaagcaggcccugcgugauuauaagaaaguacagauccaguuggagaaccuggaguccucagugcgcgacagguguaaaaaggaguucacugaccuaaugaccgaaaugacggaucuaaccuccgaccugcuggguucaggaauccccuuuuuggacuacaagguguaugcugaaaggaucuuuuuuccgggacacagggaaagcccuuuacauagagaucuagguguuccugaaucacgacgcccaacuguggagcagggccuggggcagcuauccaaccuccucaauagcaaacuauuccugaccaaguucauucauacccuagaaucgcagcgcacauuuagugccagggauagggcauauguggcuucucuccugacgguggcucuccacggcaaacuggaguauuucacggacauccugagaacccugcuauccgaccucguggcgcaauauguugcaaagaacccaaagcucaugcuccgccggacugagaccgugguggagaagcugcugacuaauuggaugagcauuugucuguauacauuuguucgcgacucagugggugagccacuguauauguuauuccgggguaucaaacaccagguggacaaagggccugucgauagcgugacuggcaaggccaaguacacucucaaugauaacagacuccugagagaggauguggaguacagaccgcuuacucuaaaugcucugcucgcugugggaccaggcgccggcgaggcccagggagugccggugaaggugcuggauugugacacuaucucacaggcuaaggagaaaaugcuagaccagcuauauaaaggcgucccacucacgcagaggccagacccccggacauuggacguggaguggcggucaggcguggccggacaccuuauccugagcgacgaggacgugaccagcgaggugcaggggcuguggagaagacugaacacccuccagcauuacaaggugccugauggugcuacuguggcucucguccccugucugaccaagcacguauuacgagagaaccaggauuacgugcccggcgagcggacccccaugcuggaggacguggaugagggcgggauuaggccauggcaucuggucaaaccuucggaugagccggagccaccacgaccacgccguggcagccucagaggaggcgaacgcgagagggccaaggccauacccgagauauaucugacuagacugcugaguaugaaagggacacugcaaaaguuuguagaugauuuauuccaggugauccugucuacaagccgcccuguucccuuagcagugaaauauuuuuuugaccuguuagaugagcaagcccagcaacacgggauaucagaccaggacaccauucauauauggaaaaccaauucccuuccgcucagguuuuggaucaacauaaucaagaauccgcaguucguguucgacguccagacaagugauaauauggacgcaguccugcuggucauagcacagaccuucauggaugccuguacucuggcugaucacaaacuaggcagagacucuccgaucaacaagcugcucuaugcacgagacauaccgagguauaagagaaugguggaaagguacuacgccgacaucagacagacagucccagcuagugaccaggagaugaacucggucuuggcggaauuauccuggaauuacuccggagaucucggcgcccgagucgcauugcaugaauuguauaaauacauaaacaaguauuacgaucaaauuauaaccgccuuagaggaggacggaaccgcccagaagaugcaacugggguaccguuuacagcagaucgcagcugcaguugagaauaaaguaacugaucuguag

SEQ ID NO: 12310 - RNA, 342 nt, Artificial Sequence
  Description of Artificial Sequence: Synthetic coding sequence
auguugguacuuuuccucuuaggaacgguuuucuuacugugucccuacuggggggaacugcacgauccuauuaaagccacugaaauuauguguuaugaguguaagaaauaccaucucggguuaugcuauggcgucaugacuucuuguucucugaaacacaagcagagcugcgcuguugagaacuucuacauucuaacaaggaaaggacagucuauguaccacuacuccaagcuuucuuguaugaccaguugcgaagacauuaacuuccugggauucacuaagcgaguggagcugaucuguugugaccauagcaacuacuguaacuuaccugaagggguuuag

SEQ ID NO: 12311 - RNA, 6408 nt, Artificial Sequence
  Description of Artificial Sequence: Synthetic coding sequence
augccggccuuagggccugcucuacuucaggcccuaugggcaggcuggguccuuacgcugcagccacugcccccuaccgccuuuaccccuaacggcaccuaucuccaacaccuggcuagagacccuacgagcggcacccucuaucugggcgcaaccaauuuuuuguuucaauuaaguccugggcuucagcuggaagcaaccguaagcacuggcccggugcuugacuccagagauuguuugcccccggucaugccagacgaaugcccacaggcgcaaccuaccaauaauccaaaccagcugcugcuugucagcccuggugcccugguaguuugcggcagcguucaucagggugugugugaacagcgacgccucggacagcucgagcaauuacuacugcgucccgagcgcccaggugacacucaguauguugcugcuaacgacccugcagugucuacagugggccuggucgcucagggccuggccggggagccuuuauuguuuguuggacgggguuacacuaguaggggcguaggugguggaaucccaccgauuacuacuagagcucuauggcccccugacccacaagcagcauuuagcuaugaggaaacugcgaaacuagccgucgguagacucucugaguacucccaucacuucgugucugcuuuugcuaggggugcaucagccuauuuccuguuucugcggcgggacuuacaggcucagucccgggccuuccgcgccuacgugucgcgagugugucugagggaccagcacuacuacagcuacguggaacugccauuggcgugcgagggcggaagauacgggcugauucaggcggccgcuguggccacaagccgggagguggcccauggcgagguuuuauucgccgcauucagcuccgcggcaccucccacagugggccgaccucccuccgcugcagcuggggcaucaggugcaucagcucucugcgcuuuuccccucgacgaaguagaucgccuggcuaacagaacacgcgaugcguguuauacccgagaaggaagagcggaggauggaacagaaguagccuacaucgaguacgacgucaacagugacugcgcacagcugcccguggacacgcuggaugccuacccuuguggcagcgaucacacucccagucccauggcaagucgcgugccgcuagaggcaacaccaauucuagaguggccuggaauccaacuuaccgcagucgccgugacaauggaagacggucacacaaucgccuuucugggagacagccaaggacagcuucauaggguguaccugggaccaggguccgauggacauccuuacucgacucagucuauucagcaggguagcgcugucucaagagacuugaccuuugauggcacuuuugagcaccuauacgugaugacacagucuacccugcuuaaggugccggucgcuuccugcgcccagcauuuggauugcgcaagcugccuggcacacagggauccauauugcggguggugcgugcuguuggguaggugcuccagacgcucugaauguucucgcggccaggguccugaacaguggcuguggaguuuucagcccgaacuagggugucuucagguggcugcuauguccccugcuaauauaagucgcgaagaaacaagagaggucuuucuuagcguacccgaccuuccaccucuguggcccggggaguccuacaguugccauuuuggagaacaucaaagcccagcacuccuuaccggaucaggcgucauguguccaucuccagacccuuccgaagccccagugcugccuaggggggccgacuacguaagugucagcguggaauuaagguucggugccguagugauugcgaaaacaagccugaguuucuacgauugcguugcuguuaccgaguuacgcccuagcgcucagugccaagcuuguguuaguucucgauggggauguaacuggugcguuuggcagcauuuauguacucauaaggccucuugcgacgccggccccaugguggcuucccaucagaguccuuuggugagcccugaccccccugcacggggcggaccgagcccaagcccccccaccgccccaaaggccuuagcuaccccggcucccgacacccugccaguggagccaggggcccccucuaccgcaaccgcgucagacauaaguccgggggcuucuccaucacuuuugucucccuggggaccaugggcagggaguggguccauuuccucccccggcuccacugguaguccccugcaugaagaaccgucuccuccaagcccucagaaugggccgggaacagccgugcccgcaccaacugauuuccggcccuccgccacuccagaagaccuccuggcaucaccucucucucccagcgaggucgccgccguaccaccagcugaucccggcccagaagcguugcacccuacagugcccuuagaucuuccucccgcuacaguccccgcuacaacuuucccaggagcaaugggcuccgucaagccagcgcuggauuggcugacccgggaaggaggcgaacucccugaagcagaugaguggacaggcggggacgcucccgcauuuagcacaaguacucuccuauccggcgauggagauuccgcugagcuggaaggcccgccagcaccccugauucugccuaguagccuggauuaucaguaugacacccccggacucugggaauuggaggaggccacccugggcgcuuccaguugccccugcguugaguccgugcagggaucuacucucaugccuguccacguggaacgggaaauacgccuccucgggaggaaccuucaucucuuccaggacggcccaggugauaaugaauguguuauggaguuggaggggcuggaagucguggucgaggcuagaguggagugugagccucccccagacacgcagugccacguuaccugccagcagcaucaacugagcuaugaagcccugcagcccgaacugagggucgggcuguuccuuagaagagcaggcagguugcggguggauucagcugaggggcuccacgugguguuauacgacuguaguguaggacauggugacugcucucguugucaaacggcaaugccacaguaugguugcguguggugugaaggcgagaggccccgcugugucaccagagaggcgugcggcgaggccgaagcuguggccacccaaugccccgcaccacugauucacagcguggaaccucugacuggacccguggacggcggaacacgagugacaauccguggcaguaaccucggacagcauguacaggacgugcuggggauggucacaguggccggagugccgugugccguugaugcgcaggaguacgaggucucgucuagucuuguguguaucacgggcgccucuggagaggagguugcuggugcaaccgcaguggaagugcccgggcgcggaagaggcgucagugaacaugacuucgcuuaccaggaccccaaagugcacucuauuuucccggcgaggggaccccgcgccggaggaacuaggcuuacauuaaacggaaguaaacuuuugacuggccgacuggaagacauucgaguggucgugggggaucagcccugucaucugcugccugaacagcagucugaacagcugcgaugugagaccagcccacgcccgacgccugccacacugccuguggcagugugguuuggagccaccgaacggaggcuccagaggggccaauucaaauauacccuagacccuaacauuaccucagccgggcccacaaagaguuuuuuguccggcggucgggagauuugcgugaggggccagaaucucgauguggugcagacacccagaauuagggugacagucguaagccgaauguugcagccgucucaaggccugggaaggcgucggagagugguuccugagacagcauguucucucgggccuucuugcaguagucagcaguuugaagaacccugucacguuaacucgagccaacugaucacaugccgcacgccagcacugccuggccucccagaggaccccuggguacgaguagaguuuauuuuagacaaucugguuuucgacuuugcuacccuaaacccuacacccuuuucguaugaagcugauccaacacuacagccccuaaaccccgaagacccuaccaugccguuucgacauaagcccggcucuguuuuuaguguggagggagagaaccuugacuuggcuaugucgaaggaggaggucguggccaugauaggagauggaccuugcgucgugaaaacucugacuaggcaccaucucuacugcgaaccuccaguggagcagcccuugccucgacaccaugcacuccgcgaagcuccggacagccugccugaguucacagugcagauggggaacuuaagauuuucccucggccacgugcaguacgauggcgaaucuccaggcgcauucccagucgccgcccaggucggacugggagucggcaccagccuguuggcccuuggcguuauaauuaucgugcuuauguaucguagaaaaagcaaacaggcucucagagauuacaaaaaggugcagauucagcuggagaacuuggaaucuucugugagagaucggugcaagaaggaauucacagauuuaaugaccgaaaugacugaccucacauccgaccugcugggguccggaauuccuuuucuggauuauaagguguacgccgaacgcauauuuuuuccggggcacagagagagcccauugcaucgcgaccugggugugccugaaagcaggcgaccaacgguggagcagggacucggccagcucucaaaucuguugaacagcaagcucuuccuuacaaaauuuauccacacucuggaaucccagcggaccuuuagcgccagagaccgcgcuuacguugcaucacugcugacuguagcccugcacgggaagcuggaauauuuuacagacauccuccggacucuccugagcgaucucguggcccaguacgucgcgaagaaccccaaacuuaugcugaggcguaccgagaccgugguggagaagcugcugacgaauuggaugucgauuuguuuauauacguucgucagagacucagucggugagccacuguacaugcuguuucgcggcauaaagcaucaggucgacaaaggaccaguggauucaguaaccgggaaggccaaauauacucucaacgacaacaggcuucuucgggaggacgucgaguacaggccgcucacacugaacgcucuccuagcaguugggccuggcgcuggcgaagcacaaggagugccuguaaagguucuggacugcgacaccauuucccaagcuaaagaaaaaaugcucgaccagcuguacaagggcgucccacugacccagaggcccgacccucgcaccuuggauguagaguggagaucaggcguggccgggcaccuuauccugagcgacgaggaugugaccagugaggugcagggccuauggaggagacucaacacacuucagcacuacaagguuccagauggcgccacaguugcccuuguaccauguuugacaaagcauguacuucgagagaaccaagauuacguccccggugaacggacucccaugcucgaagacgucgaugaaggcggcaucagaccauggcaccucgucaagcccagcgaugaaccagagccccccaggccucgaaggggaucccugagagggggcgagcgcgaaagagcaaaggcuauuccagaaauuuaucuuacccgccuauugucuaugaagggaacucugcagaaguucgucgaugauuuauuccagguaaucuugucuaccaguaggcccgugccccucgccgugaaguacuucuuugaucucuuagacgaacaggcgcaacagcacggcaucuccgaccaagacaccauucacauuuggaagacuaacagccuuccucuccgauuuuggaucaacaucauuaagaauccacaauuugucuucgaugugcagacuuccgauaacauggacgcagugcuucucgugaucgcgcagaccuucauggaugccuguacucucgcggaccacaagcucgggagagauucacccaucaacaaguuguuguacgccagggauauccccagauauaaaagaauggucgagagguauuaugcagacaucaggcagacugugccagcuuccgaccaagagaugaacaguguacuggcagagcugagcuggaauuacucuggugaccuuggcgcccgcguggcacuucaugagcuguauaaauacauaaauaaauacuacgaucagauuaucacugcccuggaagaagacgguaccgcucagaagaugcaacugggguacagacugcagcaaauugcagcugcugucgagaauaaaguuacagaccuguag

SEQ ID NO: 12312 - RNA, 390 nt, Artificial Sequence
  Description of Artificial Sequence: Synthetic coding sequence
augagaccucugaaaccuggagcuccuuugccugcacuuuuccugcucgcacuggcccugucaccccacggugcgcauggaaggccccggggucgcagaggcgcgagagucacagauaaagagcccaagccucugcucuuccuuccagccgcaggcgccgggcgcacaccauccggaucccgcuccgcagaaauauucccacgagacucgaaucugaaagauaaauucauuaagcacuucaccgggcccgucaccuuuucucccgaauguucuaagcacuuucaucguuuguauuauaauacucgagaguguagcacaccugccuacuacaagcguugcgcucggcucuuaacaaggcuagccgugagcccucuguguucucagaccuag

SEQ ID NO: 12313 - RNA, 252 nt, Artificial Sequence
  Description of Artificial Sequence: Synthetic coding sequence
augcggcuguccgucugucugcucaugguguccuuggcccuguguugcuaccaagcccaugcgcuugugugcccugcugucgccagcgagaucacuguuuuucuguuucuuuccgacgcagccgugaaucugcaaguggcaaaacuuaaccccccuccugaagccuuggcagccaagcuggaaguaaaacacuguaccgaucaaauaagcuucaaaaaacgccugagccuuaagaagucaugguggaaguag

SEQ ID NO: 12314 - RNA, 1455 nt, Artificial Sequence
  Description of Artificial Sequence: Synthetic coding sequence
augugguacguuucaacucgcggagucgcgccccgcgugaauuuugagggcgccuuguuuuccggauacgcccccgacggaggccuuuuuaugcccgaagaacucccccagcuggauaggggaacgcuuugucaauggucaacuuuaucuuaccccggccugguuaaggaacuuugcgcccuguuuaucggaagugaauuauugccuaaggaugagcugaacgaccugaucgaccgagcuuucucacguuuccgucacagggaagucgugcaccucucaagacuccggaacggauugaaugugcuggagcuguggcacggcgugacauacgccuucaaagaccuaucccucuccuguacuacucaguuccuccaauacuuuuuagagaaaagagaaaaacacgucacaguagucgugggaaccucuggggacacagggucagcugccauagaaucuguccagggagcuaagaacauggacaucauaguucugcugcccaagggccacuguacaaagauccaagagcugcaaaugaccacaguccuaaagcagaacguccacgucuucggggucgagggaaauucugaugaacuggaugagccuaucaaaacagucuuugcggauguggccuucgugaagaaacacaaccucaugucccugaauaguauaaacuggagucgggugcuggugcagauggcccaccacuuuuuugcuuacuuccagugcacucccagucucgacacucacccucugccucugguggaggugguaguaccuaccggcgcagcuggcaaucuggccgcaggcuauaucgcucaaaaaauugggcuacccaucaggcucgugguggccgugaaccguaaugacaucauccaucgcaccguccagcaaggagacuuuucacucucagaagcagugaagucuacucucgcuagugcuauggauauccaggugccauacaacauggaaagagucuuuugguugcugucgggauccgauagccaagugacccgggcccucauggaacaguuugaacgcacucagucagugaaccugcccaaagaacuucacaguaaacugagugaagccgugaccagcguuuccgucuccgacgaagcuauaacccagacuaugggacggugcugggacgagaaucaguacuugcuguguccacauuccgcagucgccgucaacuaucauuaucagcagaucgaccgccagcaaccaaguacaccucgguguugucuggcuccagcuuccgccgcuaaauucccagaggcaguccuggccgccggacugaccccggagacucccgcugagaucguggcucuagaacacaaagagacacgcugcaccuugaugagacggggcgauaacuggauguuaaugcugagggauacgauagaagaucucucacggcaguggcggagccaugcucugaacaccucacaauag

SEQ ID NO: 12315 - RNA, 159 nt, Artificial Sequence
  Description of Artificial Sequence: Synthetic coding sequence
augaagcuuugcguuaccgugcugucacugcuuguccugguagcugccuuuuguucacucgcacuauccgcgccgucuaacaaaccucuggaagccaguaaguccgcccugacucccguaagcccaggcucuaggaguaccugcaugacauggaauuag

SEQ ID NO: 12316 - RNA, 675 nt, Artificial Sequence
  Description of Artificial Sequence: Synthetic coding sequence
augcgggucagcgguguucugcgacuucuggcucuuaucuuugccauuguuacaaccuggauguucauucguuccuauaugucuuucucaaugaagacaauacgccugccacgauggcucgcagccucaccuacaaaagagauccaagugaaaaaguauaaaugcggguugauuaaaccuuguccugcuaauuauuuugccuucaaaauauguuccggcgccgccaacgucguugggccuaccauguguuucgaagaucgcaugauuaugagcccugugaagaacaacguaggcaggggccugaacaucgcacuggucaacgguacaacgggagcuguccucggacagaaggccuucgacauguauagcggcgacgucaugcaucuggugaaguuucucaaagagauccccgguggcgcccugguacuuguggcuuccuacgacgaucccgggacuaaaaugaaugaugagagcaggaagcucuucagcgaccucggauccuccuaugccaaacaauuaggauuucgggauucuuggguauuuauuggugcaaaagaucugcgaggcaagagcccuuucgaacaguuuuugaagaauuccccagacacaaacaaauacgaaggauggcccgagcuccuggaaauggaaggaugcaugcccccaaagcccuucuag

SEQ ID NO: 12317 - RNA, 1404 nt, Artificial Sequence
  Description of Artificial Sequence: Synthetic coding sequence
auguugaucuuuuggaccauuacgcuauucuugcucggugcugcuaaggggaaggaagucugcuaugaggacuuggguugcuucuccgacacugagccaugggggggcacagccauccgaccucugaagauccugccguggucucccgagaaaaucggaacucgguuccuccuguauacaaacgagaacccuaacaacuuccagauacugcugcugagugacccuucaaccaucgaggcgagcaauuuucagauggacaggaagacuagauucauaauacauggcuuuauugauaagggggacgaaucaugggugacagauauguguaagaaacuguucgagguugaagagguaaacuguauuugcgucgauuggaagaaagggucccaagcgacuuacacacaggcggccaacaauguaagggucguaggagcgcaagucgcucaaaugcucgauauccuacucaccgaguauucuuaccccccuaguaaggugcaucugauuggccacagucugggcgcgcacgucgccggggaggcggguucuaaaaccccgggguugagccgaauaacgggccuggaucccguggaagcguccuuugaauccacaccugaggaaguacguuuagaucccuccgacgccgauuucguagacgugauacacaccgacgcugcuccacucaucccuuuccucggguucgggacuaaccagcagaugggucaccucgauuucuuccccaacggcggugagaguaugccuggcuguaagaaaaacgcacuuagucaaaucguggaucuagacggcaucugggccggcacacgggauuucgucgccugcaaccaucuuaggagcuauaaauauuaucucgagucaauccugaaucccgacggcuucgcugcauacccuuguacgucguauaagucauuugaauccgauaaauguuuccccuguccagaccaaggcugcccccagaugggccacuacgccgacaaguuugcaggcaggacguccgaggagcagcagaaguuuuuucugaacacaggagaggccucaaacuuugccagauggcgguaugggguuucgauuacauugucgggaaggaccgcgaccggucagaucaaggucgcucuguucggcaauaaaggcaauacucaccaguauaguaucuuuagggggauucugaaacccggauccacacauaguuaugaauuugacgcgaaauuagauguagguacuauugaaaaagugaaguuucuguggaacaauaacgugauuaaccccacacuuccaaaggugggcgcuacaaaaauuacuguccagaaaggagaggaaaagacugucuacaacuucugcuccgaggauacagugcgagaagauacucuacuuacuuuaacuccaugcuag

SEQ ID NO: 12318 - RNA, 237 nt, Artificial Sequence
  Description of Artificial Sequence: Synthetic coding sequence
augggcucuggcuugccucuagugcucuuauuaacucuacuggggucuucucacgggaccggcccagguaugacccuccagcucaaauuaaaagaaucuuuucugacuaacagcucauaugaguccucuuuucucgaauuacuugagaagcucugucuguuacugcaucugcccuccggcaccagcgucaccuuacaccaugcaagaagucagcaccacgucguguguaacacuuag

SEQ ID NO: 12319 - RNA, 291 nt, Artificial Sequence
  Description of Artificial Sequence: Synthetic coding sequence
auggaacauaaggaaguuguccugcuacugcuccuguucuugaaaagcggucagggggagccgcuagaugacuauguuaauacacaagguccaucuuuauuuagcgugacuaagaagcaacugggugcaggaucccgcgaagagugugccgccaagugugaagaggacaaagaauuuaccugccgggccuuucaguaccauucuaaagagcaacaguguguaauuauggcugagaaucggaaaaguucuaucauuauuagaaugagggaugccgugcuguuugaaaaguag

SEQ ID NO: 12320 - RNA, 1083 nt, Artificial Sequence
  Description of Artificial Sequence: Synthetic coding sequence
auggggcuucugcuccuugugccucuccuucugcuccccgggucauacggcuuacccuuuuauaacgguuuuuacuacucaaauuccgcuaacgaucaaaaccugggaaacggucacggcaaggauuugcuuaacggggugaaguugguuguggaaacccccgaagaaacucuauuuacauaucagggcgccucgguaauccuucccugccgauauagguaugaacccgccuugguguccccccgaagagugaggguuaagugguggaagcuaucugaaaacggggcuccagaaaaagacguguugguagccaucggccugcggcauaggagcuucggagauuaucaggggcggguucaccugagacaggacaaggagcacgacgugucucucgagauacaagacuugagauuagaggauuacggucgguaccgcugcgaaguuauugauggauuggaggaugaaucaggcuuggucgaauuggagcuccgcggcgugguuuuuccuuaucagaguccaaacggacgcuaucaguucaacuuucacgaggggcaacaggugugugccgaacaggcagcgguagucgccagcuuugagcagcucuuucgggcgugggaggaaggucuggacugguguaacgcggguuggcugcaggacgcuacggugcaauauccgaucaugcuuccuaggcagcccugcggcggcccuggacucgcgcccggggucagauccuacgggccaaggcauagacgccugcacagauaugauguguucuguuuugccacagcacuuaaaggccggguuuauuaucucgaacacccagagaagcuuacacugacugaagcacgagaagccugccaggaagaugaugccaccaucgcuaaagugggacagcuauucgcugcguggaaguuucauggcuuggaccgcugcgaugcaggauggcuagcggacgguuccgugagguacccugugguucauccgcaccccaacuguggaccuccggaaccugguguucggagcuucggguuuccagacccucagucucgcuuauauggcguguauuguuaucgccagcauuag

SEQ ID NO: 12321 - RNA, 810 nt, Artificial Sequence
  Description of Artificial Sequence: Synthetic coding sequence
augauucguacccugcugcucucaacacuuguggccggagcucuaagcuguggggaucccaccuauccccccuacgugacucgcguuguuggcggagaagaggcaagacccaauucuuggccguggcaggucucauuacaauacagcucuaauggaaaaugguaucauacgugcggcggaucccuuauugccaauagcuggguuuugaccgcugcucacugcaucagcuccucacguacguacagaguugggcucggcagacauaaccuuuauguggcagagaguggaucacuggccguguccgucucaaaaaucguugugcacaaggacuggaacucuaaucagauuaguaagggcaaugauaucgcccuucuuaaguuggcgaauccugugucucucaccgauaaaauccagcucgccugccuuccuccagccggaaccauccuuccuaacaacuacccauguuacguuaccggauggggccgccuccagaccaacggugcugugccugacguucuccaacaggggcgcuuacugguuguugauuaugccacauguucaagcucagccuggugggguucuucagucaagacguccaugaucugugcugguggggauggagugaucucaagcuguaauggggauucagggggaccucugaacugccaggccucagauggacgguggcaggugcacgguauugucucuuuuggcagucgacuggggugcaacuacuaccacaagccaagcguguuuacgcguguaucgaacuauaucgauuggauuaauagcgugaucgccaauaauuag

SEQ ID NO: 12322 - RNA, 1122 nt, Artificial Sequence
  Description of Artificial Sequence: Synthetic coding sequence
auguuaccuuggcucuuggucuuuuccgcgcucggcauucaggcuuggggggacagcaguuggaauaagacucaggccaaacagguuagcgaaggacuucaguaccuguuugagaacauuucacaacugacggagaagggacucccuacggacguauccaccacaguauccaggaaagccuggggcgcggaggccgugggaugcagcauucagcuaacaacuccaguuaaugugcuggugauacaccacgugccagggcuggaaugucaugaucagacuguguguagccagcgccugagagaguugcaggcacaccauguucacaacaacagcggaugcgacgucgccuacaacuucuuggucggcgaugauggacggguguacgagggcguggguuggaacauacaaggaguucacacccagggauacaauaacaucagccugggcuucgcauuuuucgggacgaagaagggucacucuccgagccccgccgcacucagugccauggaaaaccucaucacuuaugcagugcagaaaggacauuugucuagcucuuaugugcagccacugcucggcaaaggcgagaauugccuagccccaagacagaagacaucccucaaaaaggcgugcccaggggucguuccaagauccguuuggggagcacgggagacccacugcccuagaaugacgcugccugccaaauacggaauuaucauccacacugcuggccgcacaugcaacaucucugaugaauguaggcugcuggugcgcgauauccaguccuucuacauugacaggcuaaaaagcugcgacaucggcuacaauuuucugguggggcaggauggcgcuaucuaugaaggcgucggguggaacgugcagggaucgaguacacccggauacgacgauauugcgcuagguaucacuuucauggggacuuucaccgggauuccuccaaaugccgccgcccuggaagccgcccaggauuuaauacagugcgcuauggugaaagguuaccuuaccccaaauuaucugcuggucggacauucagauguagcaaggacacugucucccggccaagcgcuuuacaacauuauuuccacuuggccacauuuuaagcauuag

SEQ ID NO: 12323 - RNA, 327 nt, Artificial Sequence
  Description of Artificial Sequence: Synthetic coding sequence
augcggcagcgauuacugccuagcgugacuagucuccucuuaguugcccuccuguucccaggguccucccaggcaaggcauguuaaccacuccgcgacagaggcccuuggagaauugagagaaagagcaccaggccagggaaccaacggcuuccagcuccugcggcaugcugugaagcgagacuugcuuccacccagaaccccaccuuaccaaggggacguacccccaggcaucagaaauacaauuugucauaugcagcagggaauuugcagacuuuuuuucugucacucaggcacgggacagcagcaucgccaaagaugcggcuag

SEQ ID NO: 12324 - RNA, 708 nt, Artificial Sequence
  Description of Artificial Sequence: Synthetic coding sequence
augucaccacccuugcucaaguugggcgcagugcuuuccaccauggcaaugauuucaaauuggaugucgcaaacacuuccaagccuugugggacugaauacuacuaggcugucuacccccgauacacuaacacagaucaguccuaaagaagguuggcagguuuacuccucugcucaagaucccgacggccgcugcaucuguacuguugucgccccugagcagaaccuguguagcagagaugcuaaaagucggcaacuuagacagcugcuggaaaaagugcaaaacaugucgcagucuaucgaggugcuuaaucuucggacacaaagagacuuccaauaugugcuuaaaauggaaacucagaugaaagggcugaaagcuaaguuuagacaaauagaagaugacaggaagacucuuaugacaaaacauuuccaggagcucaaagagaaaauggacgaguugcugccacugauucccguguuagagcaauacaaaacagaugccaaacucaucacacaguucaaggaagaaauaaggaaccugagcgcugugcucaccgguauacaggaagaaauuggggccuaugauuacgaagagcugcaucaacgggugcugaguuuagagacccgccuaagagauugcaugaaaaaacugaucgaucugaagaagaggaaagaggaggaaaaacgacaacagaaaggagaagccuag

SEQ ID NO: 12325 - RNA, 606 nt, Artificial Sequence
  Description of Artificial Sequence: Synthetic coding sequence
augaaucuaaacugcccccccugugucaccgggcugagaguaugguccagcugucgcuccaaacccaauucuagggcgcguagcuguaggaguuguaccggagcuucucgaacauuaccaagccaccacaugucucauguugaaugcccaagcggcaucgucaaugaagaaaauuuuaaacagaucuauucucaauucuucccacagggugacucaaguacguacgccacauuucucuucaaugcauucgauaccaaucaugaugggaguguauccuuugaggacuucguggccggacugucuguaauauugagggggacuguugacgauagguugaacugggccuuuaaucuguacgaccugaauaaggauggguguaucacaaaagaagaaaugcucgauaucaugaaauccaucuaugauaugauggguaaguauaccuacccggcucuccgcgaagaggcaccaagagagcacgucgaguccuuuuuucagaaaauggaccggaacaaagauggaguugucaccauagaggaauucauugagagcugccagaaagaugaaaauauaaugagauccaugcaguuguuugacaacgugaucuag

SEQ ID NO: 12326 - RNA, 693 nt, Artificial Sequence
  Description of Artificial Sequence: Synthetic coding sequence
augcgcuuggcuggcccccuaagaaucgugguuuugguggugucugucggggugacauggaucguggugucaauucuccucggaggcccugggucaggauuuccucgaauucaacaacuauucaccucccccgaaucauccgucaccgcagcccccagagccagaaaguacaaauguggacugccacagccaugcccagaggagcaucuggccuuucgugugguuagcggcgcagcaaauguuauaggaccgaagauaugucucgaggacaaaaugcuuaugucaagugugaaggacaacgugggccgcggacuuaacauugccuuggugaauggggucucuggcgaacucauugaggcccgggcauucgacaugugggccggggacgucaaugaucugcuuaaguuuauucgcccucuucacgaagggacccucguguucguagcuucuuaugacgacccggcuacuaaaaugaaugaggagacccggaaauuguucucugaauuagguucccggaaugcuaaagaacuggccuucagggacucuuggguauuugucggcgcaaagggagugcagaauaagucccccuuugagcaacauguuaagaauucuaaacacaguaacaaguaugaaggauggccagaagccuuggagauggagggcuguauccccaggagaucaacagcgucauag

SEQ ID NO: 12327 - RNA, 684 nt, Artificial Sequence
  Description of Artificial Sequence: Synthetic coding sequence
augagaguugccggcgcugcuaaacuggugguggcugucgcgguguuucuccuuaccuuuuauguuauuagucaggucuucgagauuaagauggacgccucgcucggcaaucuguuugcucgaagcgcccuagacacagccgcaagaaguacaaaacccccacguuacaagugcggaaucagcaaagcauguccagaaaagcacuuugcauucaagauggcgucaggugcggccaacgugguggggccuaaaaucugcuuggaggauaauguguugaugagcggggucaaaaacaacguaggcagagggauuaauguggcgcuggcuaacggcaagacuggagaaguguuggacacaaaguacuucgacauguggggcggggacguugcuccguuuaucgaguuccugaaagcgauccaggacggaacgauugugcugaugggaaccuacgacgacggggccacgaaauugaaugaugaagcuaggcgacuuaucgcagaccugggcagcacuaguauuacuaaccugggcuuuagagacaacuggguguucugcgggggaaaaggaauuaagaccaagucaccuuucgaacagcauaucaaaaacaauaaggauacaaauaaauaugagggguggccagaagucguugaaauggagggguguauuccgcagaagcaagauuag

SEQ ID NO: 12328 - RNA, 1656 nt, Artificial Sequence
  Description of Artificial Sequence: Synthetic coding sequence
auggaggauagugauucugcagccaaacaacugggguuagcggaggccgcugccgcaggaggcgaggccgaagaaccugugcugucccgugacgaagauagugaggaagacgcagacuccgaagcugagcgugagaccccccgcguuaccgcaguugcggucauggcugccgagccuggacauauggacaugggcgcugaagcccucccagguccugaugaagcugcugcagccgccgcuuuugcugaaguuacaacagucacaguggcgaaugugggggccgccgcagacaacguuuuuacuacuucugucgcuaaugcagccuccaucagcggucacgucuugucugggcgcaccgcccugcaaauuggagauaguuugaauaccgagaaggcaacccucauagucguucauacagauggauccauuguugaaaccaccggacugaaggguccggcagcccccuugacaccaggaccucagucaccccccacaccccuggccccaggacaggagaaaggcgggaccaaauauaauugggacccuucgguuuaugauucagaacugccuguccgaugcagaaacaucaguggaacccuuuacaagaaucgccugggaucaggcggccgcggaagauguaucaaacagggugaaaacugguauuccccaacugaguucgaggcaauggcugggagagcaagcaguaaggacuggaaacguucuauccguuacgccgggaggccucugcaaugccugauccaggacggaauacuuaauccccacgcugcaaguugcacaugugccgccugcugcgacgacaugacccuauccgggccaguuagacuguuuguaccuuacaagcggaggaagaaagaaaacgaacugccaaccaccccggucaaaaaggacucacccaaaaacaucacucugcuaccagcaacagcugcuacgacauuuacugugacuccuucaggccagaucacaaccucuggggccuugacauuugaucgugccucaacaguugaagcaaccgcgguaaucagcgaaucuccugcucagggggacguguuugcaggugccacagugcaagaggcuucuguucagccuccaugucgggcuucacaucccgagccucacuacccuggauaccaagacagcugccagauugcccccuucccugaagcggcccugcccacuucccauccaaaaaucgugcuaacaagccuaccugcccuagcaguucccccuccuacaccaaccaaagcggcucccccagcccuggucaacggccuggagcuuagcgaaccacguucuuggcuuuaccucgaggagauggugaauagccuguugaauacggcucagcagcugaagacucuauuugagcaagcuaagcaugcaucaaccuauagagaggccgccaccaaccaagccaagauucaugcagacgcagagagaaaagagcagucaugugucaacuguggaagggaagcaaugagcgaaugcaccggaugccacaaaguaaauuacugcuccaccuuuugucagcgaaaggauuggaaggaccaccagcacaucugcggccagucggcugccgugaccguucaggcugaugaagugcacguggcagaguccgugauggagaaggucaccgucuag

SEQ ID NO: 12329 - RNA, 2022 nt, Artificial Sequence
  Description of Artificial Sequence: Synthetic coding sequence
augaagcccgguggguucuggcugcaccugacgcugcucggcgccagucugccugccgcccugggauggauggaccccggaaccucccguggaccugacgucggcguuggagagucccaagccgaagagccaagaucuuucgaagugacgcgaagggagggccugucuagccacaacgaacugcuggcgagcugcgggaaaaaguuuugcagccgcgggucuagaugugugcuuuccuuggcccccgaagaccgagugagcgugaccacugucacuguuggacugagcaccguuuuaacaugugcuguacauggcgaccugagacccccaaucaucuggaagcgcaacggccugacccugaacuuucuggaucucgaggauauuaacgauuucggagaggaugauucucuguacaucacaaaaguaacuaccauccauaugggaaacuacacuugucaugccagcgggcacgagcagcuguuucaaacccaugugcugcaggugaacgugcccccugugauucggguguacccugagucucaagcacaagaacccgggguugcugccucccuuaggugucacgccgagggaauuccuaugcccaggauuaccuggcuuaagaauggagucgacgugaguacacagaugagcaagcaacuuucacuguuggcuaacggauccgaacugcacaucucuucugugagguaugaggacaccggggccuauacuuguauugcuaagaaugaggucggggucgacgaggauaucucuucccuuuuuauagaggacucugcucgcaaaacgcuggcuaacauccuuuggcgugaagaaggauugagugucggcaacauguucuaugucuuuucugaugaugggaucaucgugauccacccuguugauugcgagauccagagacaccuuaagcccacggagaaaauuuuuaugaguuaugaagagaucugcccgcaacgugaaaagaacgcgacccagccaugucaaugggugagugcaguuaacguaaggaacagauacauuuacguggcacagcccgcacugagucgcgugcuugucgucgauauccaagcucagaaggugcugcagucuauagggguugaccccuugcccgcuaaacucucauacgacaaaucgcacgaucaagucuggguguuaagcuggggcgacguucacaaaagccgucccucccuccaggugauuacagaagcauccacuggacagagucagcaucugauucgaaccccauuugcgggaguggaugauuucuuuauccccccuacaaaccugauaauuaaucacauccgauuuggauuuaucuucaauaaaagugaucccgcugugcauaaggucgaucuggagacaaugaugccccugaagacgaucggccuucaucaucauggaugcgugccccaggcuauggcucacacacaccuaggugguuauuucuucauccaauguagacaagacagccccgcguccgccgcccgacagcuucucguggacagcgugacugauucgguccucggaccuaacggcgaugugacaggaaccccccauacaucuccugaugggagguuuauugugagugcagccgccgacucaccuuggcuccauguacaggaaaucacagugaggggugaaauccagacauuauacgaccugcagaucaacucggguauuuccgaccuggccuuucaacguaguuucaccgaauccaaucaauauaacaucuacgcugcacuccauacagagccugaccuucucuucuuggaacuguccacuggcaagguuggaaugcucaagaacuugaaggagccuccugccggccccgcacagccaugggggggcacacauagaauuaugagagacucuggacucuuuggccaguaccuucugacuccugcaagagagaguuuauuccuuauuaaugguagacagaacacacugaggugugaaguaagugguauaaagggugggaccacagugguuugggucggcgagguguag

SEQ ID NO: 12330 - RNA, 2007 nt, Artificial Sequence
  Description of Artificial Sequence: Synthetic coding sequence
auggauuuggugcucaagcgcugucugcugcauuuggccguaaucggcgcucuguuggcggugggagcuaccaaaguuccaagaaaucaggacuggcucggugugagcagacaacucaggacaaaagcuuggaacaggcagcuguacccugaguggacagaagcucagaggcuggauugcuggaggggaggccaggugagccugaaagucucuaaugaugggccaacacuuauuggugccaacgcuaguuuuucuauugcguuaaauuuuccagguagccagaaaguucuuccugacggacaggugauuugggugaauaacacuauuaucaauggagaucaggugugggguggacagcccguuuauccacaggagacagacgaugcaugcaucuuccccgaugggggacccuguccuaguggcagcuggagucaaaagaggaguuucguguauguuuggaagaccugggggcaguauuggcaagugcugggcggcccuguuuccggacuuagcauaggaaccgguagagccaugcugggcacccacacaauggaagugacaguguaucacagaagaggcucccggagcuacgucccucuggcucacagcaguucagccuuuaccauuaccgaccagguccccuucucugucagugucucacagcuccgcgcgcuggacggaggaaauaagcauuuccugagaaaccaaccgcuaaccuuugcuuuacagcuccacgauccaucuggcuaccuggccgaagcagaucuuuccuacacuugggauuuuggugauagcuccggcacgcuuaucucacgggcccucguggucacccauacuuaccucgaacccgggccagugacugcccagguuguuuugcaagccgcuaucccucuuacauccugcggcaguucaccuguuccagggacuacagacggucacagacccacagccgaggcaccuaacaccacagcaggacagguuccgaccacggaggucgucggcacuacucccggucaggccccaaccgcagagcccucagggacuacgucagugcagguuccaacgaccgaagugauuucaacugcuccagugcaaaugccaacagccgaguccaccgguaugacaccagaaaaaguuccuguaagugaggucauggggacuacguuagccgagauguccacccccgaggccacaggcaugacacccgccgagguaaguauuguggugcuuucaggaaccaccgcugcucagguuacaaccaccgaauggguggagacaacagcucgagaacugccgauacccgaacccgaggguccugacgcuucuuccaucauguccacagagaguauuaccggcucucucgguccucugcuggaugggacugccacccuccgccuggucaaacgccaagucccccuggacugcgucuuauaucgcuacgguucuuuuagcgugacucuggauaucgugcagggcauugaaucugccgagauucuccaagcuguccccuccggcgaaggugacgccuucgagcuaacugugaguugucaagguggccuaccgaaagaagcuugcauggaaauuaguaguccuggaugccagccacccgcacagcggcugugccaaccugugcucccuucuccagccugccagcuggugcuucaucaaauccugaaaggcgguaguggaacauauugcuugaauguuagccuggcugacaccaacucauuggccgucguuagcacccagcugauuaugcccgugcccggcauucuguuaacgggucaggaggccggccuagggcagguaccccugaucgugggcauccuucucguucucauggccgucgugcuggcuucacugauuuaccgcaggagacugaugaaacaggacuucuccgugccacaacuuccacauucuagcucucacugguuacggcugccuagaauauuuuguaguugcccgauuggugagaacuccccucuucugucuggacagcagguguag

SEQ ID NO: 12331 - RNA, 1746 nt, Artificial Sequence
  Description of Artificial Sequence: Synthetic coding sequence
augcagcaggacggacuuggagucggcacucgcaacgguucaggaaaagggagaagcguccaucccucuuggcccuggugugccccaagaccauugcgauacuucggccgugaugcucgugccaggagagcacagaccgccgcgauggcuuuauuggcugguggccuaucuagaggacugggcucccaccccgcugcagccggacgagacgcagugguguucgucuggcuucugcuguccacauggugcaccgccccagcccgcgcuauccaggucaccgugagcaauccuuaccacgucgugauccuguuccaaccuguuacuuugccuugcacauaucagaugacuaguacacccacgcagccuauugugaucuggaaguacaaauccuucuguagagaucgcauugccgacgcauuuucaccagccagcguggauaaccagcucaacgcccagcuggccgcggggaaucccggcuacaauccuuacguugagugccaggacuccgugagaaccguuagggugguagcaaccaaacaggguaacgcaguaacccugggggauuacuaccagggucggagaauuacaauuaccggcaaugccgaucucaccuucgaucagacagcuuggggugauagugguguauacuacugcuccguggucuccgcccaggaccuccaagggaauaacgaagcuuaugccgagcugaucguacuugucuacgcagccggcaaggcugcaaccagcggcgucccaagcauuuacgcuccgucgaccuacgcucaucuauccccggcgaagacccccccuccccccgcgaugauaccuauggggccugccuauaacggguacccgggcggcuaccccggagacgucgacaggaguucuuccgcuggcggccagggcucuuaugugccccucuugagggacacagauucaucgguagcuagugaggugagauccgguuaccguauacaagcuucucagcaggacgauagcaugcgggugcuguauuacauggagaaggaacucgcaaacuuugacccaaguagaccuggucccccuucgggucgaguugaaagggcaaugagcgaagucaccagucugcacgaggacgacuggagaagccggcccucucggggcccggcucuuacccccaucagagacgaggaguggggaggacauucccccagguccccuagagggugggaccaagagccugccagggaacaggcuggcgguggauggagggcccggagaccgagagcaaggagugucgaugcucucgaugaucucacucccccaaguacagcugaaucuggcucccggagcccaacuagcaacggcggcagaucgagggccuauaugccgccacgcucuagaucccgggacgaccuguacgaccaggaugacucccgcgacuuuccccgaucccgagacccccacuaugacgauuuccgguccagggaacgcccgccagcagacccccgaucacaucaucacagaacacgagauccacgggacaaugggucuaggucaggcgaccugcccuaugacggccgucuacuugaagaggcaguucgcaagaagggaucagaggaacggagacggccccacaaggaggaagaagaggaggcuuauuaccccccugccccuccacccuauagcgaaacggauucucaggcuucucgcgaacggaggcugaaaaaaaacuuagcacugucuagagagucacuugugguuuag

SEQ ID NO: 12332 - RNA, 1959 nt, Artificial Sequence
  Description of Artificial Sequence: Synthetic coding sequence
augcccccaccccugccucugcuguuacuaacaguccugguuguagcugccgcucgcccaggaugcgaauuugagcggaauccagccggagagugucauagaccuccagcugccgacucugcuacaugcguggaccuacaacugcgcaccuguagcgaugccgccuacaaucauacgacauucccuaauuuguugcagcauaggucaugggaggugguagaagcaucauccgaguacauuuugcuguccguccuccaccaguugcuggaaggacagugcaauccugaucuuagacuccugggaugcgcgguccuugcaccuaggugcgagggaggcuggguuagacggccaugucggcacauuugcgagggacugagggagguuugccagcccgcauucgacgccauugacauggccuggccauacuuccuagauugucaucgguauuucacaagagaagaugaaggcuguuacgacccauuggaaaagcugaggggaggguuggaggcggaugaagcccuaccuuccggacucccaccaacauuuauccgauuuucacaucauuccuaugcccagauggugaggguguugcgaagaaccgccagccguugcgcccacguggcuagaacuuacaguaucggucggucauuugacgguagagaauuacuggucaucgaauuuagcagccgccccggccaacacgaacugauggagcccgaagucaaacuaaucggaaauauacauggaaaugagguggcuggacgggagauguuaauuuaccuagcgcaguaucuauguucugaguaucuccuggggaaccccagaauucaacgcuuacugaauacaacccggauccaucuucucccuucuaugaaucccgauggguacgaggucgcugcagcagaaggugcaggauacaauggcuggaccucugggcgucagaacgcucaaaaucuugacuugaaucguaacuuccccgaucucaccucugaauauuacagacuggcugaaacaagaggcgcccgaucugaccauauccccaucccucaacauuacuggugggggaagguggccccagaaacaaaagcgaucaugaaguggaugcagaccauccccuuuguccugagugcaucauuacaugggggugaucucguaguguccuauccuuuugauuuuucuaagcauccucaggaggagaagauguucucucccacuccugacgagaaaauguucaaacuguugaguagggcuuacgcagacguccacccaaugaugauggacagaucagagaaccggugcgggggaaauuuucuuaagcggggaucaaucauaaauggcgcagauugguacucauucacgggggguaugucugacuucaauuaccuccacacaaacugcuuugagauuacuguugagcugggcugcguaaaauuccccccggaagaggcccuguacauacuguggcagcacaauaaagaaucucugcuaaacuuuguagaaaccguccaucgggggauaaagggcguggugacggacaaauuuggcaagccuguaaaaaacgcccgcauuuccguaaagggcauucgacaugauauuaccacagccccagauggcgauuacuggaggcuccuaccucccgguauccauauugugauagcucaggcgccaggguaugcuaaggugauuaaaaaggucauuauucccgcccgcaugaagcgcgcuggaagggucgacuuuauauugcagcccuuaggaaugggaccuaagaacuucauucauggacucaggaggacggguccacaugacccauuggguggcgcaucaucccugggagaggcuaccgagccugacccauugcgagcgcgacggcagcccucugccgacggcuccaagccuuggugguggucauauuuuacuagcuuauccacgcaccgcccacgcuggcuccucaaguacuag

SEQ ID NO: 12333 - RNA, 279 nt, Artificial Sequence
  Description of Artificial Sequence: Synthetic coding sequence
augaaauuauguguaacuguccuuucacuccuugugcuaguugccgcauucuguucccuggcccucuccgcuccuaugggaagugaccccccuaccgcauguuguuuuaguuacacagcucggaaacuuccuaggaacuucgugguggacuauuacgaaacaucuucacuuuguagccagcccgcagugguuggguuuuuggguaggaaggguaaacaaguaugcgcugaucccagugaaucguggguccaggaauauguuuaugaucuggaguuguag

SEQ ID NO: 12334 - RNA, 249 nt, Artificial Sequence
  Description of Artificial Sequence: Synthetic coding sequence
augaggcagcgauuacucccuuccguuacgagccugcuccucgucgcgcucuuguucccuggaucaucccaagcccggcacgugaaucacuccgcuacagaggcccugggugagcugcgggagagagcuccagggcaaggcacaaauggcuuucagcugcucaggcacgccguaaagagggaucuucuuccccccagaacacccccuuaccaaggaacaggccaacagcacagacaaaggugugguuag

SEQ ID NO: 12335 - RNA, 411 nt, Artificial Sequence
  Description of Artificial Sequence: Synthetic coding sequence
auggacaaugugcaaccgaagaucaaacaccgaccauuuuguuuuuccgucaagggccaugugaaaauguugagacuugcccugaccgugacaucaaugacguucuuuaucauagcgcaggcgccugaacccuauaucgugauuaccgguuuugaggugacuguaauccucuucuucaucuuauuauacguucugaggcuggaucgccugaugaaauggcucuuuuggcccuuacuggacauuauaaacucacuggugacuacuguuuucaugcucaucgugucaguccucgcccugauuccugaaacuacgacacucacagugggcgggggcgucuucgcacugguaacugcuguuuguuguuuggcagauggagcucuuaucuacaggaaguugcuauuccucagauag

SEQ ID NO: 12336 - RNA, 1068 nt, Artificial Sequence
  Description of Artificial Sequence: Synthetic coding sequence
augcagcucacuacaugucugcgggaaacucucuucaccggcgccagucaaaagacaucccugugguggcugggaaucgcuuccuucggagugccagaaaagcuggguugcgccaauuugcccuuaaacagccgacaaaaggaauuguguaagcguaagccguaccugcucccaucuauuagggaaggggcuagguuggggauacaggagugugggucacaauuuagacaugagcgauggaauugcaugauaacagcagccgcuacuaccgcuccgaugggggccaguccucuguucgguuaugagcucuccagcggcacuaaggaaacugcguuuaucuacgcuguuauggccgcagggcugguccacucaguaacucgcucaugcuccgcagguaacaugaccgagugcucaugcgacacaacacuccagaacgggggaagugccagcgaaggcuggcacuggggggggugcucugaugauguccaauacggcaugugguuuaguaggaaauuucuagauuucccaaucgguaauacaacugguaaggagaauaaaguacuguuagcuaugaacuuacauaauaacgaagcuggccggcaagccguggcuaaacuaaugagcguugauugccgaugccacggcgugagcggcuccugcgcagugaagaccuguuggaagaccaugucuagcuucgaaaaaauaggacacuugcucaaagauaaauaugaaaacucuauucaaauuuccgauaaaacuaagcguaagaugcgaagaagagaaaaagaccagagaaagaucccgauccauaaagacgacuugcuguaugugaacaagucuccuaacuacugcguggaggacaagaaauugggaauuccggguacacaggggcgggaauguaacaggaccagcgaaggggcugacggguguaaucuuuuguguugcgguagaggguauaauacgcaugucguccggcacguggaaagaugcgaauguaaauuuauuuggugcugcuacgucagaugucgcagaugcgagucuaugacugacguccauaccuguaaauag

SEQ ID NO: 12337 - RNA, 2916 nt, Artificial Sequence
  Description of Artificial Sequence: Synthetic coding sequence
auguugcguagacccgcacccgcgcucgccccagcugcccgguuguuacuugccggccugcugugcgguggcggugucugggcagccaggguaaauaaacacaagccauggcuggagccaaccuaccacgguauugucacagaaaaugacaacaccguacuacuugaccccccccugaucgccuuggacaaggacgccccccugagauucgcaggagagaucugcggcuuuaagauccauggucagaacguucccuuugacgccguuguaguggauaagucaacgggagaggguguaauuaggucuaaagagaaguuggacugugaacuccagaaagacuacucauucacuauccaggccuacgacuguggaaagggaccagacggaacaaacguaaagaaaucucacaaggccaccguucacauccaggugaacgacguuaacgaauaugcccccguguucaaggagaaguccuauaaagcaacggugauugagggcaaacaguaugauuccauucuaagaguagaggcgguugacgcagacuguaguccucaguucucucagaucugcucuuacgagauuauuacccccgacguccccuucacagucgauaaggacggauacaucaaaaauaccgaaaaacucaauuacgggaaggagcaccaauacaaacuuacugucacggccuacgacuguggcaaaaaacgcgccacggaggacguccugguuaaaauaaguaucaaaccuacaugcacgccuggcuggcaaggcuggaacaaccggaucgaauacgagccgggaacaggcgcacuagcaguauuccccaauauacaccuggagaccugcgacgaacccgucgcaucagugcaggcuacuguggaauuggagaccagucacauuggcaaagguugugacagggauaccuacucagagaagucacuucaucgauugugcggcgccgccgcuggaacagccgaguuacugccuucuccuucagguagccuaaauuggaccauggguuugccuacggacaacggacaugauucugaccaggucuucgaauucaauggaacccaggcugugcgaauccccgauggcgugguguccguaagcccuaaagagccuuuuacuauuuccgucuggaugcggcauggcccauuuggacguaaaaaagagacaauccugugcucaagcgauaagacugauaugaauagacaucacuacagucuguacgugcacggcuguaggcuuauauucuuguucagacaggacccuagcgaggaaaagaaguauaggccugcugaauuccauuggaaacugaaccagguuugcgacgaagaauggcaucacuacgugcugaacgucgaguuccccaguguuacauuguacguggauggaacaucccaugagcccuucaguguaacagaggacuacccacugcacccaagcaagaucgaaacccagcugguggugggagcuuguuggcaggaauuuaguggaguggaaaacgauaacgagacugagcccgucacaguggcaucggccgggggagaucuucacaugacgcaguuuuuuagagggaacuuggcagggcugacccugagauccggcaagcucgcugauaagaaggugauugauugucucuacacauguaaggaaggucuggaucuucaggugcuggaagacuccggaagaggagugcagauucaagcacacccgucccagcuugugcugacucucgagggggaggauuugggugagcucgauaaggcuaugcagcacauuaguuaucugaacucccgacaguuccccacaccugguaucaggagacuaaagaucacuuccacaauuaaaugcuucaacgaggccacuuguaucuccgugcccccuguggacggguacgucauggugcugcagccagaggagccaaaaauuucucucucgggcguccaccauuuugccagagcagcuucugaguuugaguccagcgaaggcguuuuucuguuucccgaacugaggauaauuaguaccauaacccgggaaguggaaccagaaggugacggugcugaagacccuacgguccaagaaucccucgucucagaggaaauuguacaugaucuggacacaugugaagugacaguggagggcgaggaacugaaucacgagcaggagagccuggaaguggacauggcccgacuccaacagaagggaauugaagugagcaguagcgaacugggaaugacauucacaggcguggacacaauggcuucauaugaggaagugcuucauuugcugagauaccggaauuggcacgccaggagccuccuggaucggaaguucaagcuaauauguagugaacugaauggcagauacaucagcaaugaguucaaagucgaggucaacgugauucacacugcuaaccccauggagcacgccaaccacauggccgcgcaaccucaauucgugcauccugaacacagaucauuuguggaucucuccggucacaaucuggccaacccgcaccccuuugcaguugugccuuccaccgcaacugucgucauugucgugugugugucguuucugguauucaugauaaucuugggcgucuuucgaauucgagcugcacaccgucggacaaugcgugaccaggacaccggaaaagagaaugaaauggacugggaugacuccgcccugacuaucaccguuaauccaauggaaaccuaugaggaucaacacucaucagaggaagaggaagaagaagaagaggaggaagaaucugaagacggagaagaggaagaugacaucacauccgccgagucagagaguucagaagaggaagagggagaacagggcgauccucagaaugcaacgaggcaacagcaacuggagugggaugauagcacccuaagcuauuag

SEQ ID NO: 12338 - RNA, 564 nt, Artificial Sequence
  Description of Artificial Sequence: Synthetic coding sequence
auggucgcugcuacaguggccgccgcuugguugcucuugugggccgccgcuugugcgcagcaagaacaggauuuuuacgauuucaaagcagugaacauccggggaaaguuggugagccuggagaaauacaggggcagcgugucauugguggucaauguggccagugaauguggguucaccgaucagcauuacagagcccugcagcagcuacagcgugaucuuggcccucaccauuuuaauguccuggcguuccccugcaaucaguucggacagcaggagcccgacagcaauaaggaaauugagucguuugcccggaggaccuauagcguaaguuucccaauguuuagcaagauugcgguuaccgggaccggagcacacccagcguuuaaauaucucgcucagaccucugguaaggaacccacguggaauuuuuggaaauaucugguagccccagacggaaaagucgucggugcaugggacccuacagugaguguagaagaagugcguccccagauuacagcccuggucagaaaacucauucuccucaagagagaggaucucuag

SEQ ID NO: 12339 - RNA, 303 nt, Artificial Sequence
  Description of Artificial Sequence: Synthetic coding sequence
auguggggcuuuuuaguauuaaaggcacguuggcugguuacaccaguucgcacucucgcaaccgaggccggccagaagccgucacuccguggacugcuagacguggggaauauacagcaccgcgccgcuagagcaaggggauugacacggggagucauucggguuuccccccaggaacgcucccagcagaaccaguccgcacccaagggaccaacuccauccacgcgcccuaaaccgaggacauuaggcccccaagcacacucucuggcgcuacaauccgucgaucugcucuucagacccuag

SEQ ID NO: 12340 - RNA, 2352 nt, Artificial Sequence
  Description of Artificial Sequence: Synthetic coding sequence
augcgcuggcagugcgguacuagauucaggggccuccgucccgccguggcuccauggaccgcuuuacuggcccugggccuuccaggaugggugcuggccgugucggcuacugcagcugcgguugucccugaacaacacgcaagcguggccggccagcauccccuugacuggcugcugacagaccgagguccauuccacagggcacaggaguacgccgauuucauggagcgcuaccgccaaggguuuaccacaagguauagaauuuaucgcgaguucgcuagguggaaaguuaauaaucuggcauuggagcggaaagacuuuuucagcuuaccuuuaccucuagcacccgaguucauccgcaacauaagacugcucggccguagacccaauuuacagcagguuacagaaaauuugaucaagaaauacgguacacacuuccuauuaagugcuacacugggaggcgaggaaagccuaacaaucuucguggauaaacaaaagcucggucggaagacagagaccacugggggcgcaaguaucaucggaggcagcggcaacagcacagccgugucacuugaaacacugcaccagcucgccgcgagcuauuucauagaucgagaaagcaccuugcgcagacugcaccauauucagaucgccacaggggccauuaaagugaccgagaccaggacuggcccuuuaggaugcagcaauuaugauaaccuagacagcgugucuagcgugcuaguccaaucuccagagaauaaagugcagcugcucgggcugcagguguuguuaccagaguacuuaagagaacgcuuuguugcagcugcuuuauccuauaucacgugcagcucugaaggggaacuggucuguaaggagaacgacugcugguguaagugcucaccgacuuucccugaaugcaacugccccgaugcagauauacaggccauggaagacagcuugcugcaaauccaggauagcugggcaacccauaaccgucaauuugaggagagcgaggaauuccaagcauugcugaagaggcuaccugacgacagguuccugaacucuacugccaucucucaguucugggccauggauacaucucuccaacaucgcuaccagcaacugggagcugggcucaaaguguuauucaaaaaaacucaccgcauuuugaggcgacuguucaacuuguguaaacgcugccacaggcaaccccguuuuaggcuuccaaaggaacggagucucucuuauugguggaaccgcauucaaucacuuuuguauuguggcgaaagcaccuucccuggcaccuuucuggagcagucccauucauguacaugcccauaugaucaguccucuugucaggggccaauccccugcgcuuugggagagggacccgcuugcgcgcacugcgccccggacaauucaacaagauguggaucuuguaaccccggauauguacucgcccagggacugugucgaccagaggucgccgagucacuggagaauuuccucggacuugagacagaccuacaagaccuagaauuaaaguaucugcugcagaagcaagacucucgcauagagguucauucaaucuuuauuagcaaugacaugcgccuggguaguugguucgaccccuccuggcggaagcggaugcuuuugacccugaaaucuaacaaguauaagcccggccugguccacgugaugcucgcccuuagccuucagaucugucuaacuaagaauagcaccuuggagcccgucauggcgaucuacgugaaccccuucggcgggucucauucugaguccugguuuaugccggugaacgaaggaucguuccccgauugggagagaaccaacgucgaugccgcagcucaaugucaaaauuggacuaucacccuaggcaacagauggaagaccuuuuucgagacgguccacguguaccugaggagccguauuaagagccuggaugauagcagcaaugagaccauuuacuacgaaccacucgagaugaccgacccauccaaaaaccucggcuacaugaagaucaauacgcuacagguguuuggcuacagucugcccuucgacccagaugcuauccgagaucuaauauugcagcuugauuaucccuacacccaggguucacaggacuccgcacugcugcagcugaucgaguuacgagacagggugaaucagcuuuccccccccgggaagguccggcuggacuuguucagcugucuccugcgucaucgauugaagcuggcaaacaacgagguggggcguauccagucuucacuucgugccuuuaacaguaagcuaccuaauccagucgaauaugaaaccggcaagcucugcuccuag

SEQ ID NO: 12341 - RNA, 2016 nt, Artificial Sequence
  Description of Artificial Sequence: Synthetic coding sequence
auggcucagcuguuccugcccuugcucgccgcgcuggugcucgcacaggcaccagcagcacucgccgauguacuggaaggagauucuuccgaggaccgugcauuccgagugcgcauugcaggggacgcaccgcugcagggcguccucggcggcgcacugacuauaccuugccacguucacuauuugcgccccccgccaagccgaagggcugugcuggguuccccacgagugaaauggacuuucuuaagccgcgggcgggaagcggaggucuugguggcacggggaguucgagugaaaguuaaugaagccuaucgcuuuagaguggcguugccugcauacccugcgucccugacugacgucucucuggcccuuucagaacugcgaccuaaugacaguggcaucuaccguugcgaaguccagcacgguaucgaugacucuucugacgcuguugaagugaagguuaaaggagugguauucuuguauagagagggaucagcucgguacgcauucuccuuuucuggggcucaggaggcaugcgccaggauaggagcccauaucgccacuccagaacagcuguacgccgcuuaucuggguggauacgagcagugcgacgcuggguggcuaucugaccagacuguccgguacccgauccaaacccccagggaagcauguuacggugacauggacggauuucccggggugcgcaacuacggaguaguggauccagacgaccuuuacgacguguacuguuaugccgaggaccuaaauggugaguuguuucugggggacccgccagaaaagcugacccuggaggaggcacgcgccuauugccaggagagaggagcugaaaucgcaaccacgggacagcuguacgccgccugggacggcgggcuggaucauugcagcccuggcuggcuggccgaugggucuguuagauaccccaucgucacuccaucacagaggugugggggaggucuucccggagugaaaacccucuuccuguucccaaaucaaacaggcuuccccaacaaacacucaagauuuaacguguacuguuuucgugacucagcgcagccuucagccauccccgaagcaagcaaccccgcuaguaacccagcaagcgauggacuggaagccaucgugaccgugacggagacccuggaggagcuccagcugccccaggaagcuaccgagucagagagucguggcgcgauuuacucuaucccuauuauggaagacggaggagguggaagcucuacacccgaagaccccgccgaggccccacguacccuccuugaauuugagacccagucaaugguucccccuacgggcuucucugaggaagaaggcaaagcucucgaggaagaggaaaaauaugaagacgaagaggagaaagaggaagaagaggaagaggaggaagucgaagacgaggccuuaugggccuggccuagugaacuuuccucaccgggacccgaagcgagccuaccuacagaacccgcagcgcaggaggaaucucugucucaagcacccgcaagggcuguguuacaaccuggugccucaccccucccagacggagaaagcgaggccucuagaccuccaagggugcacggccccccaacagaaacacugccaaccccgagagagagaaauuuggccuccccaucuccuaguacucucguagaagccagggaagucggcgaggcuacaggugggccagagcucuccggagucccgagaggcgaaagugaagagaccggaagcucugagggagccccgucacuccugcccgcaaccagggccccagaaggaacgagagaacuggaagccccuagcgaggacaacuccggccguaccgccccugccggcaccuccgugcaggcucagcccguccugccuacagauucagccuccaggggagggguggccgucgugcccgcuagcgggaauucugcccaagguucuaccgcccugucaauauuauuacuauuuuuuccuuuacagcucuggguuaccuag

SEQ ID NO: 12342 - RNA, 375 nt, Artificial Sequence
  Description of Artificial Sequence: Synthetic coding sequence
auguauaaauuggccuccuguugccugcuguuuaucggauuucucaacccccuucucucucugccccucuuagacucucgagaaauuucuuuccaacuuucugccccacacgaagaugccaggcugacuccugaggagcuugagcgugcgagucuuuugcaaauucugcccgaaauguuaggcgcugaaaggggcgacauccugcgcaaagcugacagcuccacaaauauuuucaaccccagagggaaucuacggaaauuucaggacuucucuggccaggacccaaacauucuccugucucaucuucuggcaagaaucuggaaaccuuauaagaagcgcgagacccccgacugcuuuuggaaauacugcguguag

SEQ ID NO: 12343 - RNA, 1326 nt, Artificial Sequence
  Description of Artificial Sequence: Synthetic coding sequence
auggaguucgaguucgacagacugagggcguuccaggccaugcagguccauugcaauaauaugcauacauugggcgcccgguuaccuggaggaguggagugucgauucagacgcgggccugcaauggcaugggaaggagagccaaugagacauaacuuaggugguaaccuuggcgacccgagagcuagggccguuucaguuccucugggcgggagaguugccagauuccuucagugucgcuuucucuucgccggcccuugguugcuuuuuagcgagauuagcuuuaucagugaugucgugaauaacucuagcccagcucuuggagggacauuccccccggcccccugguggccuccugguccucccccgacaaauuucucuucguuggagcucgagccuagaggacagcaaccagucgcaaaggccgaaggaucuccaaccgcaauccucauuggcugucuugucgccauuauccugcuguuacuucuaauuauagcguugaugcuauggcgucugcauuggcgcagacucuugucuaaaguacucgagagccacccacgaaccagaucacccggccucguaggcauaagaccaacuccauugcccgugagccccauggcacuucgauguuguagucccauccagccuacggcuaguuucuggccacugacuccuguuccucuagaagcccgggcacccccacauccucccggaccuaacccaccuacuccacgaggagugaccggcgguaauaccuacgcagugccugcccuucccccuggagccgugggggacggaccaccuaggguggacuucccacguucuagacugagguuuaaggagaaauugggagagggccaguuuggugagguacaccuaugcgaggucgauucuccucaggaccuggugagccuggauuuuccuuugaacgugagaaaaggucauccacuguugguugccgugaaaauucuacgcccagacgcuacuaaaaacgcccggaacgauuuccugaaggaggugaaaauuaugucccggcucaaagaccccaacaucaucagauuacugggaguaugcguucaggacgacccacugugcaugauuaccgauuauauggagaacggagaccuuaaccaguuucuaagugcacaccaacucgaggauaaggcugcugagggcgcuccaggugauggacaggcggcacagggcccuacuauuucuuacccuaugcugcuacauguggcggcucagaucgcgagcgggaugcgcuaucuggccacgcuaaacuuugugcauuucuggggcgagcgccaccgcuuccuacacuag

SEQ ID NO: 12344 - RNA, 1950 nt, Artificial Sequence
  Description of Artificial Sequence: Synthetic coding sequence
augcagcaggacggacucggaguuggcacgcggaauggguccgguaaggguagaagugugcauccuucauggccuuggugugcaccuagaccucucagauacuucggccgcgacgccagggccaggcgcgcucagacugcggcaauggcccugcuggccggcggacucucgcgcggucuaggaucucauccagccgcugcuggacgagaugccguaguuuucgucuggcuccuucuuagcaccuggugcacugccccugccagagcaauucaaguuaccgucucaaaccccuaucauguagugauucucuuccagccagucacacuaccauguacauaccagaugaccaguacucccacccaaccuaucgugauauggaaauauaaauccuucugcagggauaggaucgccgacgccuucucuccugcguccguggauaaccagcuuaacgcacaacuggccgcaggcaauccuggguauaauccauacguagaaugucaggacaguguucggacaguucgaguagucgccacaaagcaaggcaacgcugugacccugggugauuauuaccaagggcggagaaucacaaucacaggaaacgcugaucuaaccuuugaccaaaccgccuggggcgauucagguguuuauuauuguaguguggucagugcccaggaucuucaggggaacaaugaggccuaugcugaauugauuguccuuggccgaacaucuggcgucgccgaacuucucccaggauuccaagccggccccauugaggauugguuauucguggucguagucugcuuggcugccuuucugauuuuccucuuauugggcauuugcuggugccagugcugcccacacacguguugcugcuauguucggugcccuuguugucccgauaaaugcugcugccccgaggcccucuacgcagcggggaaagccgcgaccucgggaguuccaagcauuuacgcuccguccacuuacgcccaccucucuccugcaaagacgcccccccccccggcuaugauccccauggggccagccuacaacggguauccaggcggcuaucccggggacguagaucggucaaguagcgccggaggacaaggcaguuauguccccuuacuacgagacacugacagcuccguggcaagcgaagugcgguccggcuauagaauacaggcuagccagcaagaugauuccaugagagugcuguacuauauggaaaaagaauuggcuaauuucgacccuucuagacccgggcccccuagugggcgaguggagcgggcaaugucugaggugacgagccuccacgaggacgauuggaggagucggccaucacggggcccagcacugacaccaauccgugacgaggaauggggaggccauagcccccgaagcccucgugguugggaucaagaaccggcaagagagcaggccggagggggauggagagcucgcagaccccgcgcuaggaguguggaugcucucgaugaccugacgcccccuucuacagcugaaagcggaagccggucucccaccaguaauggggggcgaagcagggccuacaugccuccucgguccaggucucgggaugauuuguaugaccaggacgacucacgggacuucccuagaucuagggauccccauuacgacgauuuccgcucucgggaaaggccaccagccgaccccagaagucaccaucaccguaccagggaucccagagacaacgggucccgcuccggcgaucuccccuaugauggucgccugcuagaggaggcggucaggaagaagggguccgaggagcgaagaagaccacauaaagaagaagaggaagaggccuauuaccccccugcacccccuccuuauagcgaaaccgauagucaggcuucccgugaacgaagacugaaaaagaaucuggcccugucacgcgaaagccucguggucuag

SEQ ID NO: 12345 - RNA, 402 nt, Artificial Sequence
  Description of Artificial Sequence: Synthetic coding sequence
augagcgagagagucgaacguaacuggucuaccggugguuggcugcucgcucucugccuggccuggcuuuggacacaucuuacccuggcagcacuccagcccccgacagcgacuguguuagugcagcaaggaacaugugaggucauugcugcccaucgguguugcaauaggaaucgaauugaggaaagaagucaaacagugaagugcucauguuuuuccggucagguggccggaaccaccagagccaagcccaguugcguggaugcuuccauuguucugcagagaugguggugccagauggagccuugccucccuggugaagaguguaagguucuuccggaucucagcggcugguccuguucgagugggcauaaaguaaagacaacaaaggugacucguuag

SEQ ID NO: 12346 - RNA, 699 nt, Artificial Sequence
  Description of Artificial Sequence: Synthetic coding sequence
augguagccgcaaacacucgcgcacccgaagacacucgagccccugcaggccccaaaccauccuccugugaaugggcagugugcugggcaccagcacguugucgcauuucugccacagccugugguaacucgugggaccgcccugccggccgcacccaguuacuguggacgccugccgcuccgacugcuauggcugaaguuggcccaggacauacccccgcacauccuagucagggagcagucccccccucacgagccgcggccgaaccccaccucaaaccaagccccagugagcuucagacugcaggccccgccgcuacuauaccggcacggcugugcacaaggaaacccaggcucguguauacucaauguugguacgucaaggagccaaagcacccugagauugucacaccguggggcaccgcugcuaggcauucguggcggcaacaccaaauguuguccgcaucagaacgaagauguuuaccacgggauguugagcagaaguuaggaccugagcacaccggaccuugccucgaugaacagggccgagaagcagaacuggcgcgcagcgguccuuccgcagcaggcccaguccgccugaaaccaggucuggugccaggacucuuccuauuaucuuguaccacauccccaagcacgugccucccggugggccaagaaggcgaaagggguaugcuguag

SEQ ID NO: 12347 - RNA, 711 nt, Artificial Sequence
  Description of Artificial Sequence: Synthetic coding sequence
augugcguaaccuaccauaauggaacaggcuacugcaagugucccgagggauuucuuggcgaauauugucagcaccgugauccuugugaaaaaaauagaugucagaauggcgggacauguguugcccaggcuaugcugggaaaggcaacuuguagaugugccucaggcuucacaggagaagacugccaauauaguaccucacauccauguuuugugaguaggccaugccugaacggaggcacgugccacaugcuuucacgcgauaccuacgagugcaccugccaaguugguuucacaggcaaggaaugccaguggacugacgcuugucugagccaucccugugcaaaugguuccacguguaccaccguggcuaaucaguuuagcugcaaaugccuaacaggcuucacgggccagaagugcgagacugauguaaaugaaugugauauccccggacacugucagcauggggggaccugcuugaaucugcccgguucuuaccagugucagugccuacagggcuuuaccggccaguauugcgauucccuguacgugccaugcgcucccagcccuugcgucaacggaggcaccugccgccagaccggugauuuuaccuucgaguguaacugccugcccgagacugucagaagagggaccgagcucugggaacgagauagagagguguggaacggcaaggagcacgacgaaaacuag

SEQ ID NO: 12348 - RNA, 204 nt, Artificial Sequence
  Description of Artificial Sequence: Synthetic coding sequence
auggauaacgugcagcccaagaucaagcauagaccuuucugcuucucugucaagggacaugugaaaaugcuucgacuaguguucgccuuaguuaccgcaguguguugucuugcagacggcgcccucaucuaucguaaacuacucuucaacccaagcgguccguaccaaaaaaagcccgugcaugaaaagaaagaagugcucuag

SEQ ID NO: 12349 - RNA, 75 nt, Artificial Sequence
  Description of Artificial Sequence: Synthetic coding sequence
augcucguugauggacccuccgaaaggcccgcgcucuguuuccuacuccucgccguagcaaugucuuucuucuag

SEQ ID NO: 12350 - RNA, 3345 nt, Artificial Sequence
  Description of Artificial Sequence: Synthetic coding sequence
augcucgccuccuccucucggauacgugccgcuuggacucgagcucugcugcucccucucuuacuggcuggaccuguggggugccucucuagacaggagcuguuucccuuugggcccggucagggcgauuuggaacuugaagauggggacgauuuuguuucacccgcccucgagcucagcggagcccugcgcuuuuaugaucggagcgauauagaugcugucuaugugaccaccaacggcaucauagcgaccucugaaccgcccgcaaaagaaagccaucccggccucuuuccuccaacauuuggugccguagccccauucuuggcagaccucgauacuacagacggccuggggaagguuuauuaccgugaagaucucucaccgaguaucacgcagagagcugcugaaugcguucaucggggcuucccagaaauuaguuuccagccauccucggccgucguggugacaugggaaaguguggcaccauaucagggcccuagccgugaccccgaucagaagggaaaacgcaacacuuuucaagccguacuugccuccagcgauucaagcucuuacgcuauuuuccucuauccagaagauggacugcaguuucauacaacuuucagcaaaaaagagaacaaucaggucccugcagugguggccuucucacaaggauccgucggguuucucuggaagaguaauggggccuacaauauuuucgcuaaugaccgcgagagcguugagaaucuagccaagucaucaaacagcggacagcagggaguguggguuuuugagauuggaagcccagcaacaacuaacggggucguaccagcagacgugauccugggaaccgaagauggcgccgaguacgacgacgaagacgaagacuaugaucuggccaccacccggcuugggcuugaggacguuggaacgaccccuuuuagcuacaaggcccuucgacgugguggcgccgauacguacucuguuccaaguguccucucuccacggagggccgccaccgaaaggccccucggcccgccuacagaacggacgcgaaguuuccaacucgccgucgaaacguuccaccaacagcacccccaggugauugauguagaugaaguggaggaaacuggagucgucuuuucuuauaacaccgauagcagacaaaccugcgcgaacaacaggcaccaguguagugugcacgcugagugucgggauuacgcaacaggguuuugcugcuccugugucgccgguuacaccggcaauggccgccaauguguggcugaagggagcccacagagagucaacgguaaggugaaaggccggauauuugugggaucgucucaggugcccaucguguuugaaaauacugaucugcacagcuacguugucaugaaucacggccggagcuacaccgcgauuucaacuauacccgagaccguuggcuauucucugcuaccucuggcuccuguagguggaaucauaggcuggauguucgcagucgagcaagauggguuuaagaacggcuuuuccaucacggguggcgaguucacacgacaggccgaggugacuuucgucggacacccuggaaaucugguuauuaagcaacgguuuaguggcauugacgagcacggucauuuaaccauugacaccgaguuagagggacgcgugccacagauuccuuuugguagcucaguucauaucgaacccuauaccgagcuuuaccacuauagcaccucagugauuaccagcuccucuacuagggaguacaccgugacggaaccugagcgggacggcgccucuccaucccguauuuauaccuaucaguggcgucagaccauaacauuccaagagugcgugcacgacgacagcaggcccgcuuugccuuccacacagcagcuauccgucgauucugucuuugugcuguacaaccaggaagaaaaaauccuuagguaugccuugaguaauucuauuggaccggugagggaagggaguccagaugcccugcagaaucccugcuacaucgguacacaugggugugacacaaacgcagcuugucguccagggccgagaacgcaauuuacaugcgaguguucuaucggcuuuaggggagacggacgcacaugcuacgagguugaaaagacuagaugccagcaugagagggaacauauacugggcgccgccggagcgacugacccccagagaccuaucccacccggacuuuuuguacccgaaugugaugcgcauggacacuacgccccgacacagugucaugguucuaccggguauugcuggugugucgaccgggacggccgggaaguggaagguaccaggacucggccagguaugacuccucccugucugagcacaguggcaccccccauccaucaaggcccugcagucccaacagcugugauuccccuucccccuggcacccacuuacuuuuugcccagaccgggaagauugaacgguuaccucuugaggggaacacaaugagaaaaaccgaagccaaggccuuccuacacgugccugcgaaaguaauaauuggcuuggcauuugacuguguggacaaaaugguguauuggaccgauauuaccgagccaagcauuggaagagccucauuacacggcggugaacccaccacuauuauucggcaggaucucggaaguccggagggcaucgccguggaccaccugggccggaacauuuucuggaccgacuccaauuuggaucguauugagguugccaaacuggacggcacccaacgacgggugcuauucgaaaccgacuuagucaacccgagagggauagugacagacuccgugcggggcaacuuauacuggacggauuggaacagagauaaucccaaaaucgagacuuccuauauggaugguaccaaucggagaauccucguucaagacgaucugggccuucccaauggucugacauucgaugccuucucaucacagcuuuguugggucgacgccgguaccaaucgcgccgagugucuaaauccuucccagcccucccguaggaaggcgcuggagggacuccaguaucccuucgcaguuacaaguuauggaaagaaccuguacuucacggauuggaaaaugaauuccguaguggcacuagaucuagcgauauccaaagaaaccgacgcauuucagccacacaaacagacccggcuguauggcaucacaacagcucuaucucaauguccucagggacauaauuauugcucagucaacaacggaggcuguacccaccugugucuugcgacccccggaucccguacuuguaggugucccgacaauacucuuggaguggacugcaucgagcaaaaguag

SEQ ID NO: 12351 - RNA, 2172 nt, Artificial Sequence
  Description of Artificial Sequence: Synthetic coding sequence
augggcucccgcugugcucuggcgcuugcuguccucucagcccugcucugucaagugugguccucagguguguuugaauugaagcugcaggaguucguuaauaaaaaggggcuccucggcaaucgaaauugcuguagaggcggggcagggcccccuccaugugccugcagaacuuuuuuccgaguuugccucaagcacuaucaggccucugucuccccagaaccuccuuguaccuacggaagcgccguuacaccagugcugggcguggacucauucagccugccugauggcgggggagccgauucagcuuucucuaaucccauccgguuucccuuuggcuucacauggcccggcacuuucagucugaucauagaggcacuucauaccgacucucccgaugaucuggcaaccgagaacccugagagacugauuucuagauuggccacccagaggcaccuuaccguuggcgaggaauggagccaagaucuacacagcaguggcagaacugaucuaaaauauucauaccgguucgugugcgaugaacacuauuauggagaggguugcuccguguucugucgcccuagggacgacgcauuuggccacuucaccuguggcgagaggggcgagaagguguguaaccccggcuggaaaggaccauacuguaccgagccuaucugccucccaggaugugaugagcagcacgguuucugugacaagccgggggaguguaagugccggguuggguggcagggcagauacugugaugaguguaucagguauccagguugccuccaugggacaugucagcaaccauggcagugcaacugucaggagggcugggggggccuguucugcaaccaggaccugaauuacuguacacaucacaaaccaugcaaaaauggagccacauguacaaacacgggccagggaagcuauaccuguucaugucgacccggcuauacuggcgccaccugcgaguugggcaucgacgagugugauccgucgccuuguaaaaacggagggaguuguaccgaccuagaaaacagcuauucaugcaccugcccucccggauuuuaugggaaaauuugugaacuguccgccaugacuugugcugaugguccguguuuuaacggagggcgguguucugauucuccagauggcgguuauucauguaggugcccggugggcuauuccggauucaacugugaaaagaagauugauuauuguaguucauccccauguuccaacggagcaaagugcguggaucugggcgacgccuaucuuugccgaugccaggccggauucuccggacgacauugugacgauaacgucgaugacugugccucgagucccugcgccaauggcggaacuuguagggauggggugaaugacuucucguguacuugucccccagguuauaccggaagaaacugcagcgcuccuguuucucguugugagcacgcucccugccacaacggugccacuugucacgagcggggccaccguuaugugugcgaaugugcucgcggcuacggagggccaaauugucaguuucugcugccugagcugccccccggaccugccguggucgaccucacagagaagcucgaaggacaaggcggcccauuuccguggguggcagucugugcuggcgugauccuugucuugaugcuccugcucggcugugccgcugucgucgucuguguuaggcuucgacugcagaaacaccguccacccgcagauccuugcagaggcgaaaccgagacaaugaauaacuuggccaacugccagcgggaaaaggauauaucuguuuccaucauaggcgcgacgcagauaaaaaauaccaacaaaaaggcagacuuucauggcgaccacagcgccgacaaaaacggguuuaaagcaagguauccagcuguggacuauaaucuugugcaggacuugaaaggugacgauaccgcuguccgcgaugcacacuccaagcgagauacuaagugccagccgcagggauccucaggugaagaaaagggcacgccuaccacgcugcgggggggugaggcauccgaaaggaaaaggcccgacuccgguugcucuacaagcaaagacaccaaguaccaaucgguguacgucaucagugaagaaaaagacgagugcgugauagcuacagaaguguag

SEQ ID NO: 12352 - RNA, 981 nt, Artificial Sequence
  Description of Artificial Sequence: Synthetic coding sequence
auggccgcccccgcuucuguuaugggcccucuuggccccagugcguugggccugcugcuguuauuacuugugguagcucccccacgcguugccgcauuaguccauagacaacccgaaaaccaggggaucucgcugacgggcuccgucgcaugcggaagacccuccauggaaggcaagauucuuggcggcguucccgccccugaaaggaaguggcccuggcagguaucgguccauuaugccggacugcacgucugugguggcagcauauuaaacgaguauuggguucucuccgccgcucauuguuuucaccgugauaaaaacauuaaaauuuacgacauguacgugggcuuagucaaucuacgaguggcagguaaccauacccagugguacgagguuaacagagucauccugcauccgacauacgaaauguaucacccgaucgguggagacguggcccucgugcagcucaaaaccaggaucguguuuagugagucugugcugcccgugugucucgcuacuccagaagucaaucugaccuccgcgaacugcugggcaacuggcuggggacuugucuccaagcagggggagacaagcgacgaacugcaggagaugcaguugccacugauccuugaaccuuggugccacuuacuguacggccacauguccuacauuaugcccgauaugcugugcgcaggggacauccugaacgccaaaacugugugugagggagacucaggcggaccgcuggucugugaguuuaauagaagcugguuacagaucgggaucgucagcuggggcagaggcuguaguaauccccuuuauccaggcguguacgcaucgguaucauacuuuuccaaguggauuugcgauaacauugagaucacacccacccccgcucagccagcaccugccuuaucuccugcccuuggccccacucuuucuguccugauggccaugcuugcaggauggagcgugcucuag

SEQ ID NO: 12353 - RNA, 1596 nt, Artificial Sequence
  Description of Artificial Sequence: Synthetic coding sequence
augucucuggcagccuauugcgugauuugcugcaggcgaaucggcaccucuacaucaccaccaaaguccgggacucacuggcgggauauucguaacaucaucaaauuuacaggaucgcugauucugggcggaagcuuauucuugacguaugaagugcuugcuuuaaagaaggccguuacacuggacacucaagucguggaaagagaaaagaugaaguccuauauuuauguccacaccgugagccuugauaaaggcgaaaaucacggaaucgccuggcaggcaaggaaagaacuccauaaagccgugagaaaagugcucgcaacaagugccaaaauuuugcggaaccccuucgcagauccauuuucuacaguggacaucgaggaccaugagugugcuguguggcugcuccuccgcaaauccaagagcgacgacaagacaacaaggcuugaggccguucgggagaugucagaaacacaucacuggcacgauuaucaauaccggaucaucgcgcaggcaugcgaccccaaaacucugauuggcuuggcgcgaagcgaagagucugauuuacgauuuuuccuauuaccuccgccucugccaucauuaaaagaggauucauccaccgaagaagagcuccgccagcucuuagcgucccuaccgcagacagaacuggaugaguguauucaauacuuuaccucucuugcccugucugagucuagucagaguuuagcagcacagaaagguggacuuuggugcuucggcgggaaugggcuuccauaugcagagucuuuuggcgagguaccauccgcuaccguagagauguucugccuggaggcuauagugaagcauagcgaaaucuccacccauugcgacaagauagaggcuaacggcggguugcaguugcuucaacggcucuaucgauugcauaaagauugcccuaagguucaacgaaauaucaugcgagugauuggaaauauggcccugaaugagcaccuucacuccucuaucgugcgaucaggauggguuucaaucauggccgaggcuaugaagagcccccacaucauggaauccucccaugcugcucggauucucgcaaaucucgaucgagagacaguacaggagaaauaccaggauggaguauacguuuugcacccccaguacaggaccagccaaccuauuaaggccgauguguuguuuauccacggccugaugggagcagcuuuuaagaccuggcgccaacaagauucugagcaggccguaaucgaaaagcccauggaagacgaagacagauacacaacuuguuggccgaaaacguggcucgcaaaagacugcccugcucugcgcauuaucucaguugaguacgauaccagcuuaucugacuggcgggcaagguguccuauggaacgaagauccuugcugagcaucagcucuggaaucgucgaaggauuagagucuccucuacauagugaggccacgaauuuuuuaggaucuuccgaacuucuugugcucggcauaggccagugguuuggcuaucacauugccugggaaguguuucugagcaaacggugcugcuggaagccccuacguucucagaaguag

SEQ ID NO: 12354 - RNA, 1596 nt, Artificial Sequence
  Description of Artificial Sequence: Synthetic coding sequence
augucccuggccgccuacugugucaucugcugucgcagaauagguacuuccaccucuccaccaaaaucuggcacccacuggcgugauauucgcaacauuaucaaguucaccggcucacugauucuuggcggaagccuuuucuuaacuuacgaaguccuggccuuaaaaaaagcuguaacacuagacacucagguaguagaaagggagaaaaugaagaguuauaucuacguucacaccgugucacuggacaagggagagaaucacggaauugcauggcaggccagaaaggagcugcacaaagcagugcggaagguccuggcaacuagcgcuaagauccuuaggaacccauuugccgacccguuuucaacuguggauaucgaagaccacgagugugccgucuggcugcuguugcggaaauccaaaucagacgacaaaacaacgcgacucgaggcuguaagggagaugucugagacucaccauuggcacgauuaucaguaucgaauuauugcacaggcuugcgaccccaagacacuuauugggcuugcacguuccgaggaguccgaucugagauuuuuucuccuccccccuccguuaccuagucucaaagaggauagcuccacagaagaggaacugagacagcuccuggcaagccugccacagacagagcuggacgaaugcauucaauacuucacgucauuagcucuguccgaaucuucucagucucuugcugcgcagaagggaggacuguggugcuucggcgggaaugggcucccuuacgccgaaagcuuuggugagguuccaagcgcaaccguggagauguucugucucgaagcgauugugaaacauucagagauaucaacgcauugcgacaaaaucgaggcaaacggcggucugcaacugcuccagcgccuguaccgguuacacaaggauuguccuaaaguucagaggaacauuaugcgcguuauugggaauauggcccugaacgagcaucugcauucuucaauagugcgcucagguuggguuaguauuauggcagaggcaaugaagucuccccauauaauggaauccagucacgcugcccgcauacucgccaaucucgauagggaaacgguccaggagaaauaucaagauggggucuacguccuucauccccaguaccgaacuagccagccaaucaaagccgacgucuuauuuauucauggccugaugggugccgcauucaagaccuggcgccagcaggauucugagcaggcuguuaucgagaagccuauggaagaugaagaucgauacacaacaugcuggccuaagacauggcuggcuaaggacugcccagcccuuagaauuauuaguguugaauacgauacuagccuaucugacuggcgugcaagauguccaauggagcggcggaguuugcugagcauuucaagcgggaucguggaggguuuagaauccccccugcauuccgaggcuaccaacuuucuuggcuccuccgagcuucuugugcuugggaucggucagugguuuggguaccauauugcuugggaaguauuuuugucuaaacgcuguuguuggaagccuuuacgcagccagaaauag

SEQ ID NO: 12355 - RNA, 1965 nt, Artificial Sequence
  Description of Artificial Sequence: Synthetic coding sequence
augucucuggccgcuuacugcguuaucugcugcaggaggaucgggaccucuacaucucccccaaaauccggcacucacuggcgggauauacgcaauauuauuaaauucaccgggucucuuauucugggagguucucuguuccucacuuacgagguguuggcccugaaaaaagcuguuacucuugacacccaaguuguggagcgagaaaagaugaagucauauauuuacguacauacaguuagccuggacaagggcgagaaccaugguauagcguggcaggcaagaaaagaguugcacaaagcagugcguaagguucuggccacuucugccaagauccugcggaacccguucgcagaccccuuuuccaccguggacaucgaggaccacgaaugugcugucuggcucuugcuccggaagucuaagagcgaugauaagacaacacgccuggaggcagugcgagaaaugucagaaacccaccauuggcacgacuaucaauaccggauuauugcucaggccugcgaucccaaaacacucaucggucucgccagaagugaggagagugaucugcgguucuuccuucuaccaccaccacugccuagucugaaggaagacagcucuaccgaagaggagcucagacagcugcuggcaagccugccacaaacggaacucgacgaaugcauucaguauuuuacgucacuugcacucagcgaauccucucagagucucgcagcccaaaaagggggucugugguguuucggugguaacggguugccguaugcagaguccuuuggggaagugccguccgccacgguggaaauguucugcuuagaagccaucgugaaacacagcgagauauccacccacugcgauaagauugaagccaacggcgggcuucagcuucuacagcgccuguaucgacuccacaaggacugucccaaaguccagagaaauauaaugcgcguuaucgguaacauggcucuuaacgagcaucuccauuccagcaucguacgcagcggcugggugucuaucauggcugaagcuaugaaaucuccucacauuauggaaucuucccacgccgcucguauucuugcuaaucucgaccgcgagacaguucaggaaaaauaucaagacggaguuuacguuuugcauccucaguaccgaacaagucagccuauuaaggcagacguuuuauucauucacggacugaugggugcggccuucaagacguggcgacaacaggauagcgaacaagccgugauugagaaaccaauggaggacgaggauagauacacaaccuguuggccaaagacauggcuugcuaaagauugccccgcccugcgaauaauuucaguugaguacgauacuucucucuccgacuggcgugcuagauguccaauggagcgaaaauccauagcauuuagaaguaaugagcuacugagaaaguugagagcagccgggguuggagaucguccugugguauggaucucccacagcauggguggccugcuaguaaaaaaaaugcuccuugaagcuagcacgaagccagaaaugaguacaguaauuaacaacacacgagguauuauuuucuauaguguuccacaccauggcucaagacuggcagaguauuccguuaauaucagguaucuguuauucccuucccuggaagugaaagagcugagcaaggauagccccgcucuaaagacuuuacaggacgacuuucuggaguuugccaaagacaaaaacuuccaggugcucaacuuuguugaaacccuucccacauauaucgguucaaugaucaagcugcacgucgugccagucgaaagcgccgaccuaggaaucggagaccugauacccguggacgugaaccauuuaaauaucugcaagccgaagaagaaggacgccuucuuauaucagcggacucuccaauucauucgugaggcucuugcuaaagaucucgagaacuag

SEQ ID NO: 12356 - RNA, 1509 nt, Artificial Sequence
  Description of Artificial Sequence: Synthetic coding sequence
auggcccagcguugcguuugcgugcuugcccuggucgcuauguuguuacuugucuuuccuacaguaucaagaagcauggguccacggagcggcgagcaccagcgagcgagcagaauccccagccaauuuagcaaagaagaaagaguggcuaugaaggaagcgcuuaaaggcgcaauucagauuccuaccgugacauucucgucagaaaaguccaauacaacagcucuagccgaguucggcaaguauauccacaagguauuuccuacggucgugagcacuucauuuauacaacaugagguaguggaagaguacagccaucucuucaccauccagggcucugacccuucccuccagccauaccugcugauggcucauuucgacguaguaccggcccccgaggaagguugggaggucccgccauucagcggguuggaacgagacggaaucaucuacgggcgcggcacauuggaugauaagaacagcgugauggcccuuuuacaggcacuggagcuguuauugauccggaaauauauaccucggaggagcuucuuuauaagccucggccacgaugaagaaucgucuggaaccggggcucagcgaauauccgcucuucugcagucccgaggaguccagcuugccuucauaguggaugaaggcggauuuauucuagaugauuucauucccaacuuuaagaagccuauagcucuuaucgccgugucagaaaaaggcaguaugaaucuuauguuacaggugaacaugacaaguggucauucaagcgcccccccaaaggagacaagcaucgguauucuugcggccgcagugucuaggcuggagcaaacuccaaugccuauaauuuucgguagcgggacaguugugacaguacugcagcaauuggcuaacgaguuucccuuuccagugaacaucauccugagcaaccccugguuguuugagccucuuauuagucgcuuuauggagcguaauccucuuaccaaugcgauuauuagaacuacuacggcacucaccauuuucaaggccggggugaaguuuaaugucauuccaccugucgcucaggccacagucaauuucaggauccacccgggucagaccgugcaagaagugcuugaauuaacaaaaaauauuguugccgauaauagggugcaguuucacguacucuccgccuucgauccccugcccgugaguccaucugacgacaaggcucuuggcuaucagcuacuacggcagacaguucagaguguguuuccagaaguaaacauuaccgcaccugugacaucaauuggcaauacagacucacgauuuuuuaccaaccucacaacagguauuuaccgguucuacccuauuuauauucagcccgaagacuucaagcgaauccauggggugaaugagaaaauaagugugcaggccuacgaaacacaggugaaguucauuuuugagcugauucagaacgccgauacagaucaggaaccagucucccaccuccacaaacucuag

SEQ ID NO: 12357 - RNA, 999 nt, Artificial Sequence
  Description of Artificial Sequence: Synthetic coding sequence
augaggcuccuggcauuucugucccuguuagcuuuaguccuucaggaaacaggaaccgcaucucuuccccggaaagaaagaaagcggagggaagagcagaugccucgcgaaggcgacagcuucgaggugcuaccacugcgcaacgacgugcuaaacccagacaauuacggcgaggugauugaccucagcaauuacgaagaauuaaccgacuauggcgaucagcugcccgaagugaaagucacaagccuugcuccagccaccucaauuucacccgccaagucaacuacugcuccaggcacccccucuaguaacccuacgaugacucgcccuacuacagcuggccuccuguuauccucacaaccuaaccauggcuuaccaacuugcuugguguguguuugucugggcucauccguguacugcgacgacaucgaucuagaggacauccccccuuuaccccguagaaccgccuaucuguacgcucgguucaaccgcauuucccguaucagagcagaagauuuuaagggcuugaccaaguugaaacggaucgaucucucaaauaaucuuaucaguucuaucgacaaugacgcuuuucgguugcuccacgcccugcaggaucuaauucucccagaaaaucaacucgaagcccuuccaguccugccuaguggcauugaguuccuggacgugagacugaaccgucugcagucaagcggaauccagccagccgcauuuagggcaauggagaaacugcaguuucuuuaucuaucagauaauuugcuugauaguaucccaggcccccuuccccucucucuuagaucugugcaucugcagaacaaucucauugaaacuaugcaacgagacguguucugugauccugaagaacauaagcauacacggcggcaguuggaagacauaaggcuugacggcaauccgaucaauuugucuuuauucccaucagccuacuucuguuugccacggcugcccaucggcagauuuacauag

SEQ ID NO: 12358 - RNA, 1401 nt, Artificial Sequence
  Description of Artificial Sequence: Synthetic coding sequence
auggugagaucaguugcaugggccggauucaugguucuucugaugauaccaugggguucagcagcaaaguuaguuuguuacuuuaccaacugggcgcaauauagacaaggcgaagcaagauuucugcccaaagaccuggauccuucccuguguacucaccuuaucuaugccuucgcuggaaugacaaaucaccaguugaguaccacggaauggaacgacgagacgcuuuaucaggaguuuaauggccugaaaaaaaugaacccaaagcucaaaacuuuacucgcgauuggcggauggaauuuugguacacagaaguucacagacauggucgcuacggccaauaaccggcagacauuuguaaauagugcuaucagauuuuuaagaaaauauuccuucgacggucucgaucuggauugggaauaucccgggagccagggaagcccugccguugacaaggaacguuuuaccacuuugguccaggauuuggccaaugcuuuccaacaggaagcccagacauccggcaaagagagacuucuacugagugcagccgugcccgcugggcagacuuauguggaugccggcuacgagguugacaagauugcucagaauuuggauuuugucaaucugauggcguaugauuuccacggcuccugggaaaaagugaccggucacaacuccccccuguauaagcgccaagaggaauccggugcagcugccagucuaaaugucgacgcagcuguucaacaguggcuccagaaggggacaccagccagcaagcuuauacugggcaugccaaccuacggcaggagcuuuacuuuagccucuucaagcgacacacgcgucggcgcgccugcaaccgggagcggcacucccgggccauucacgaaagaaggaggcauguuagcauauuacgaagucugcucuuggaaaggcgcaacuaagcagcggauccaggaccagaagguaccauacaucuuccgugacaaucaguggguuggauuugacgacguggaauccuucaaaacaaaaguaagcuaucugaagcaaaagggacucgguggcgccauggucugggcgcuggacuuggaugauuucgcuggcuuuuccuguaaucagggaagguacccccuuauucaaacguuaaggcaggaacugagucuucccuaucugccaagcgguacgccugaacucgaagugccaaagccuggacagccuuccgagccggaacacggcccaaguccggggcaagacacauucugccagggcaaggcugacggccuguacccaaacccacgcgagagaucaucauucuacucaugcgcagccgggcgcuuguuccagcagagcugcccaaccgggcugguguucaguaacuccuguaaguguugcacuuggaauuag

SEQ ID NO: 12359 - RNA, 1596 nt, Artificial Sequence
  Description of Artificial Sequence: Synthetic coding sequence
augcgguugugucugggacgcccacacccaagaggucacuccaggguugguaaaucagaacgcggucgaggagcacguggucuggccaggcagaggacccucgaagaugaagaggaacaggagagggaaagaagacgccgucauagaaauuuaucaagcacgaccgaugacgaggcuccucgucuuucacaaaacggugacagacaggcaucagcuuccgaacgccuucccucaguugaagaagcugaagugccuaagccccucccaccugccagcaaggaugaagacgaggacauccagucaauacucaggacucgacaggaacgcagacagcgcaggcagguaguggaagcagcacaagcuccaauccaggagcggcuggaggccgaagaaggccgaaacucucuaagcccaguucaggcaacgcaaaagccucuugugagcaaaaaggaacucgagaucccuccccggcggcgucugaguagagaacagaggggccccugggcccuugaagaagagagccucguugggcgagaacccgaagagaggaaaaagggugugccugagaaaucuccugugcuagagaaaucaucuaugccuaagaagacagcaccagaaaaaucucuggugucugauaaaaccucuauuucagaaaagguuuuggcgucggaaaaaacaucccugucugagaagaucgccgucagugaaaaacgcaacucuuccgagaagaaaagugugcuagagaagaccucagucuccgaaaaaucuuuggcacccggaauggcauuagggucaggccggcgccuggugagugaaaaagccagcauuuuugagaaagcccuggccucagaaaagucuccuacagcugaugccaaaccagcccccaagagagcuaccgcuagugagcagccucuagcucaagaaccacccgcaucaggcgguagccccgcgacuacuaaagagcaacggggcagagcauugccagggaagaauuuacccucccuugccaaacaaggcgcaucugacccaccgacugucgccucaagacugccucccgugaccuuacaagugaagauaccgucaaaggaggaggaggcggacaugucuagcccuacgcagcguacguauuccuccagucugaaacguucaaguccaagaacgauauccuuuagaaugaaacccaaaaaagagaauucggaaacuacccugacccgcucugccucgaugaaacuucccgauaauacaguuaagcucggggagaaauuggaaagauaccacaccgcaaucaggagauccgagagcgugaaaucuaggggucugccauguaccgaacuauucguggcgccuguugguguagcaaguaaaaggcaccuguuugagaaggagcuggcgggccagucacgggccgaaccugcaucuucucggaaggaaaaccugagacuuucuggugugguaacuucgagacugaauuuguggauuagccggacccaggaaaguggagaucaagacccccaggaggcccagaaagcuucuagcgcuaccgaaaggacacaauggggacagaaaucagauaguagccuggacgcugaaguguag

SEQ ID NO: 12360 - RNA, 1782 nt, Artificial Sequence
  Description of Artificial Sequence: Synthetic coding sequence
augaaagccgaccuaaagcagcaucaucaccauuggagcauuuucuccuacauccgucucagguugccuucaaugcuucuucucuucucgguuauccucauaucuuggguuucuaccguggguggggaggguacacuuugugacuuuccuaaaauucaucacgguuuucuguaugaugaggaggauuacaaccccuuuucccagguacccacaggggaggucuucuauuauuccugcgaauacaacuucgucagccccucuaagaguuuuuggaccagaaucaccugcacugaagagggcuggucuccaaccccaaagugucugaggauguguagcuucccauucgucaagaacggacauuccgaaaguucaggacuuauucaucuggaaggugauacagugcagauaauaugcaauacaggcuacagccuccagaacaaugaaaaaaacauaaguuguguggagagagguuggucaacgccacccaucuguucuuucacaaagggagaaugccaugugccuauucuggaggcgaacguggacgcacagcccaagaaagagucauacaaggugggcgaugugcugaaguucucuugccggaaaaaucuuauaagaguaggaucugauucugugcagugcuaccaauuuggcuggagcccgaauuuuccuacguguaagggacaaguucgcagcuguggcccgccuccacaacugucaaauggagagguuaaagaaauccguaaagaggaauacggacacaacgagguugucgaguacgauugcaaucccaauuucaucaucaaugguccuaagaagauccaauguguugauggagaauggaccacccuaccgacaugugucgaacaggugaagaccugcggcuauaucccggaguuggaguauggcuaugugcaacccucagugccccccuaucagcacggggugucgguggaagugaauuguagaaacgaauacgccaugauugguaacaauaugauuacuugcaucaauggaauauggacugaguugccaaugugcguggccacacaccagcuuaagagguguaaaauagccggcgugaauauaaaaacccucuuaaaauugucagggaaagaguucaaccacaauagccgcaucagguaccgcugcuccgauaucuuucgcuaccggcauagcgucugcaucaaugguaaguggaauccagaaguggauuguacagagaagagagaacaguuuugccccccgcccccacagauuccuaacgcucagaacaugaccacgaccgugaacuaccaggacggagagaaagucgccgugcugugcaaagagaauuaccugcuccccgaggcgaaagagaucguauguaaagacggacgauggcagucacuuccaagauguguugaaaguacggcuuacugugggcccccaccaucuaucaauaauggcgauacaacaaguuucccgcuguccguguauccucccgggagcaccguuaccuaucgcugucagagcuuuuacaaguugcaaggcuccgucacgguuacaugcagaaacaaacaguggucagagcccccacgcugcuuggauccguguguggugucagaggagaacaugaacaagaauaacauucaguugaaguggcgcaacgauggaaaacuguacgcgaagacaggggaugcgguagaauuccaaugcaaguuuccccacaaggcuaugauaagcucgccuccauuuagagccaucugccaggaggggaaauucgaguacccuauaugugaauag

SEQ ID NO: 12361 - RNA, 2301 nt, Artificial Sequence
  Description of Artificial Sequence: Synthetic coding sequence
augaucuggaggagucgugccggugccgaacuguucucauugauggcccuaugggaauggauugcccuaaguuugcacuguuggguccucgcuguggccgccgugagugaucagcacgcuacaucuccuuucgacuggcuacuguccgacaaagggcccuuccaccggagucaggaauauacugauuuuguggaccgcucuaggcagggguuuuccaccagguacaagauuuaccgcgaguuuggacgguggaaagugaauaaucuggcugucgagaggcguaauuucuuaggguccccccugccccucgcaccagaauucuuccgcaauaucaggcuccuaggccgccgaccaacguuacaacagaucaccgaaaaucugauuaagaaauacggaacacauuuccugcucucugcuacucugggaggagaagaaucauugaccauuuucgucgauaagaggaaacuuucuaagagggccgagggaucugauucuaccacaaacucuagcucagugacccuugagacacuucaucaguuagccgccagcuacuucauugacagagacaguacgcugagaagauugcaccauauucagaucgccucuacagccauuaaagucaccgaaacccggacggguccacuagggugcuccaacuacgauaauuuggacucuguguccucuguucuugugcagucucccgagaauaaaauacagcuacaaggccugcagguccuccuucccgauuauuugcaggaacguuucgugcaggcggcucucucguauaucgcaugcaacagcgagggugaauucauauguaaagaaaacgauuguuggugucauugcggcccaaaguuccccgagugcaacuguccgucaauggacauccaggcaauggaggagaaucuccuuaggauuacagaaacauggaaggcuuacaauuccgauuucgaagaauccgaugaguucaagcuguucaugaaacgucugccaaugaacuacuuucugaacaccucuaccauaaugcaccuauggacgauggauuccaacuuccagcgcagauaugagcaauuggagaauucaaugaaacaguuauuccugaaagcccagaagauugugcacaaguuauucucccuuuccaagcgaugccacaagcaaccccucauuuccuuaccccgccaacgaacuucaacauacuggcuuacccguauccaaucauuccucuacugcaaugagaaugggcugcuggguucuuucagcgaagagacccauucuuguaccugccccaaugaucaaguugugugcacggcuuuccuuccuugcaccgugggggacgccagugcuugucuuaccugugcccccgacaaucgaacuaggugcggaacuugcaacacuggcuacaugcugagccaaggucuuugcaagcccgagguggcagaaucgacagaucauuacaucggguucgagaccgaccuccaggaucuugaaaugaaauaucuauugcagaaaacagaccgucgcauugaaguccacgccaucuuuaucucuaaugauaugaggcuaaauuccugguucgauccaagcuggcgaaagcgaaugcuacuuacacucaaaucuaauaaauacaaaucuucucuggugcauaugauucuaggacugagccugcagauaugucucacuaaaaauucuacccuggaaccugugcucgcuguguacgugaauccuuuuggcggcucacacucugaguccugguuuaugccugugaacgagaauucauucccagacugggagcgaaccaagcuggauuugccccuucaguguuauaauuggacguugacccuugggaauaaguggaaaacuuucuucgagacuguucacauauaucucagaagccguaucaagucaaauggccccaauggaaaugagucuaucuacuacgagccucuggaauucaucgacccauccaggaaccuggguuauaugaagauuaauaauauccagguguuuggcuacucuaugcauuucgacccugaagccauccgcgacuuaauucugcagcuggauuauccguacacccaaggaucccaagauucagcacuccugcagcugcuggagauucgugacagagucaacaaacugucaccccccggccagaggcggcuggacuuauucucuugcuuacuccgucacagacuuaaauuaucaacuagcgaaguggugcgaauccaaucagcccuccaggcuuuuaaugccaaacuucccaacacaauggauuaugauacuaccaaacuguguucuuag

SEQ ID NO: 12362 - RNA, 1815 nt, Artificial Sequence
  Description of Artificial Sequence: Synthetic coding sequence
augcggcguugcaauuccgggagugggccucccccauccuugcuccugcuacucuuauggcugcuggccguaccaggcgccaacgcagcaccacgcagugcuuuguauucaccuagcgacccccuuacccuccuccaggccgacaccguucguggggccguccucggauccaggagugccugggccguugaguucuuugcaagcuggugcggccacugcaucgcguucgcaccuacguggaaggcacuggcugaagacgugaaggccuggcgcccagcuuuauaccuggcagcucuagauugugcugaggaaacaaacucggccguaugccgagauuucaauaucccugguuuccccaccguacgguucuuuaaagcuuuuaccaagaauggauccggcgccgucuucccagucgcaggugccgaugugcagacauuaagagagcgacugauugacgcauuggagagccaccaugacacuuggccucccgcaugccccccacuggaaccagcaaagcuagaagagauugacggguuuuucgcacggaacaacgaggaguaccuggcacuuauuuuugagaaaggcggaagcuaccucggcagggagguggccuuagacuugucucagcacaaaggaguggccguucgacggguacugaauaccgaggccaacguaguccguaaauuuggcguuacggauuucccuucaugcuaccugcuguucaggaacgggucuguuucuagggugccgguuuugauggaaucucgcucauucuacacggccuaucugcagaggcucuccgggcugacaagagaagccgcucaaacaacaguggcccccacaacagccaauaaaauagcaccuacaguuuggaaacuggcagacagaagcaagauuuacauggcagaccucgaaucggcacuucauuauauucugaggaucgagguggggcgauucccaguguuggaggggcagaggcuaguggcccucaaaaaauucguggccgugcuugcuaaauauuucccaggccgaccgcugguacaaaacuuccuucacucugugaaugaauggcugaagagacagaagcgcaauaagaucccguacucuuucuuuaagacugccuuggaugauagaaaggaaggcgcagucuuagccaagaaagugaacuggaucggcugucaagggagugagccacauuuuagaggguuuccuugcagccuauggguccucuuccacuuccuuacuguucaggccgcaaggcagaaugucgaccauagccaggaggcagccaaagcaaaagaggugcuaccugccauccggggcuauguccacuauuucuuugguugucgcgauugugccagucauuucgaacagauggcagccgccucaaugcaucgcgucggcagcccuaaugccgccguucuuuggcuguggucaagucacaaucgcgugaacgcacgucuugccggagcaccaagugaagauccgcaauuucccaagguucaauggccgccucgcgagcugugcagugcuugccacaaugagagguuagauguuccgguuugggacgucgaggcaacguugaacuuucugaaagcacacuucagcccuuccaauauuauucuggacuuuccagccgcgggauccgccgcgagaagggacgugcagaauguugccgcagccccugagcuggccaugggugccuuggaacuggaaagcaggaacucuacauuggauccuggcaaacccgaaaugaugaagagcccaacuaauacuacuccacacguacccgcugaaggaccugaacugauuuag

SEQ ID NO: 12363 - RNA, 2244 nt, Artificial Sequence
  Description of Artificial Sequence: Synthetic coding sequence
augagacgguguaauucagggucugggccuccuccaagucugcugcuucugcuacucuggcuccuggccguuccaggcgccaacgcagccccuagaagcgccuuguauuccccuuccgacccccucacgcuguuacaggccgauacaguaaggggggccgugcuaggaucacgguccgcuugggcugucgaauucuuugcgagcugguguggacacugcauugccuucgccccgaccuggaaggcgcuggcagaggaugucaaagccuggcgcccagccuuguaucuugcugcgcuggacugcgccgaagaaacaaauagugccguuugcagggauuucaauauacccgguuuccccacagugagauucuucaaagccuucacuaaaaaugguuccggcgccguguucccaguggccggggccgaugugcagacucugagagagagacucauugacgcacucgagagccaucaugauacauggccgcccgccuguccaccccuagaaccggcuaaauuggaggaaauugaugguuuuuucgcucggaauaacgaagaguaucuggcacugaucuucgagaaaggagggucuuacuugggacgggaaguggccuuggaucuaagccaacauaaggguguagcagugcgccgcgugcugaacaccgaagcgaacgucgugcgaaaguucggagugacggacuuuccaagcugcuaucuucuguuucgcaacggaagugugucccgggugccuguguugauggaaucaagauccuucuauacagcuuaccugcaaagacuaagcggacugacgagagaggcugcccagacuacugucgccccgacaacagccaauaaaauugcgccaaccguguggaagcuggccgaucgcucaaaaauauacauggcagacuuagagagcgcccugcacuauauccugagaauagaaguaggacgguuuccagugcuggaaggacaaagauuagucgcccuaaagaaguuuguggcagugcucgcuaaguauuucccaggccgcccccuggugcagaauuuccuccacagcguuaacgaauggcucaagaggcaaaagcgaaauaaaauaccuuacucauuuuucaagacagcacucgacgacagaaaggagggcgccguacuugccaaaaaaguuaauuggaucggcugucaggguuccgagccucacuuuaggggauuuccauguucacuauggguacuguuucacuuccucaccgugcaggcagcacgucagaacguugaccauagccaagaggccgccaaagccaaggagguauugcccgcaauucggggguacguucacuacuuuuucggaugcagagacugugccagccacuucgagcagauggccgcagccagcaugcacaggguuggaaguccuaaugccgccguccuguggcugugguccagccacaaccgcgugaaugccagacuggccggggccccuucugaagacccgcaguuuccgaaggugcaguggccgcccagagaauuguguagugcaugucacaaugagcgucuugauguaccugugugggauguggaagccacccuuaacuuuuuaaaggcacauuucagucccucaaauaucauccuggacuucccugccgcuggaucugcggcuaggcgcgauguucagaaugucgcugcggcaccagaacuugcuaugggagcacuggaacuggaaucucgcaacucgacauuggauccuggcaagccugaaaugaugaaauccccgacuaauacaaccccucaugugccagccgaagguccagaggcaucccggccccccaagcuucaccccggcuuacgugcugcccccggacaagagccgcccgaacacauggcagagcuccagcgcaaugagcaggaacagccccugggccaguggcaucuuaguaagcgagacaccggggccgcguuauuagccgaaagucgugcagaaaagaaucgguuguggggcccacucgaagugcgcagagugggacguaguagcaaacaacugguagacauacccgagggccaguuagaggcucgcgccgggagaggucgggggcaauggcuccagguguugggcgguggauucuccuaucuggacauuucccucuguguaggacuauauagccuuaguuucaugggucugcuggcaauguauacauauuuucaggccaagauacgugcacucaagggucaugcgggucaucccgcggccuag

SEQ ID NO: 12364 - RNA, 1476 nt, Artificial Sequence
  Description of Artificial Sequence: Synthetic coding sequence
augaagaccuucacuuggacacuugggguacucuuuuuccuguugguggacacgggucacugcaggggcggccaauucaaaauuaagaaaaucaaucagcggcguuauccuagagcaacagaugguaaagaagaagcaaaaaaaugugccuauaccuuccucgucccagagcagagaaucacuggccccauauguguuaacaccaaagggcaagaugcaagcaccaucaaggacaugauuacccgaauggaucuggagaaccuuaaggaugugcucagcagacaaaagcgagagauugaugucuugcaguuaguuguagauguggaugggaauaucgugaaugaggucaaacuguugcggaaggagucuaggaacaugaacucccgggucacacagcuuuauaugcaguugcugcacgagaucauucguaaaagggauaacucacucgagcucucgcaacuggagaacaagauccuaaaugugacaaccgaaaugcugaagauggccacacgcuacagggagcucgaagugaaauacgcaucuuugaccgaucugguuaacaaccagagcguuaugaucacacugcuggaggaacagugccugcguaucuuuuccagacaagauacacaugucucucccccacugguccaggucguaccccagcauauucccaauucccagcaguauacuccaggacuccucggcggcaacgaaauccaacgggaccccggguacccucgcgaucucaugccuccuccugaccucgcaacuaguccgacaaagagucccuucaaaaucccuccugucacauucaucaacgagggcccauuuaaagauugucagcaagcuaaggaggcaggacauuccgucaguggaaucuauaugauaaaacccgagaacagcaauggaccgaugcagcuguggugugagaacuccuuagauccagggggcuggacaguuauccagaaaagaacugacggaagcgugaauuuuuuccggaauugggaaaacuacaagaagggcuucgguaacaucgauggcgaauacuggcugggacucgaaaauaucuacaugcucaguaaucaagauaauuacaagcuccugaucgaacuggaggacuggagcgacaagaagguuuacgccgaauauagcucauuucgacucgaacccgaauccgaguuuuaucgauugcgcuuggggaccuaccagggcaaugcaggagauucaaugauguggcauaacggcaagcaguucacgacauuagauagagauaaggauauguaugcugggaauugcgcucacuuucauaagggcggcuggugguacaaugccugugcccacucuaaccuuaacggggucugguaccgggggggacacuauaggaguaagcaucaggacggaauauuuugggcagaauaucggggcggaucguacagccugagagcggugcaaaugaugaucaagcccaucgacuag

SEQ ID NO: 12365 - RNA, 2484 nt, Artificial Sequence
  Description of Artificial Sequence: Synthetic coding sequence
augaugugccugaaaauccugcguauuagucuugcuauucuagccggcugggcacugugcuccgccaauucggagcuuggguggaccagaaagaagaguuuaguggagcgcgagcaucugaaucagguccugcuggagggggaaagauguuggcucggcgccaagguucgcagaccacgcgcaucgccccagcaccaccuguucggggucuaccccuccagagccggaaauuaccucagaccauauccagucggagaacaagagauccaccauacgggccgaucuaaaccagauacagaaggcaaugccgugucccuugucccacccgaucucacagaaaauccugccggucugcggggcgcuguggaggagccugcggcaccaugggugggugauucaccuaucggccaaagcgagcuuuugggcgacgacgacgcuuaucuugggaaccagaggagcaaagagucacugggagaggcggguauccagaaaggauccgcgauggcggcuacuacaacaacugccauauucacuaccuuaaaugagccaaagccagagacacagcgccggggaugggccaaaucaagacagcggcggcagguguggaagagaagagcugaagacggccagggagacuccggaaucucgagccacuuucagccuuggcccaagcauagucugaaacaccgcguuaaaaagucaccaccugaggaauccaaucagaacgggggugagggaucauaccgggaagccgagacauuuaauucccaggucggacugcccauucucuacuuuaguggccgucgugagcgccugcuucugcgacccgaagugcuggccgagaucccccgagaggccuucaccguugaggccugggugaagccugaaggaggacaaaacaaucccgccaucaucgcugguguguucgauaauuguucgcacaccguuagcgacaaagggugggcucucggaaucagaagcgggaaagacaagggcaaaagggaugcccguuuuuucuucagucuuugcacagaccggguuaagaaagcgaccauuuugaucucacauucuagauaucaaccugguacauggacccauguggcagccaccuacgacggccgccacauggcacuguaugucgacgguacucaggucgccuccucuuuagaccaguccggcccgcugaacagccccuucauggcgucgugccgcucacugcuguugggaggagauagcagcgaggauggccauuacuucagggggcaucucggaacuuuaguguuuuggucaacggcucuaccccagucacacuuccagcacucuucacagcacucgagcggcgaagaggaggcuacugaccuagugcugacagcaucauuugaacccgucaacaccgaaugggucccuuuccgcgaugaaaaauacccucgguuagaagugcugcagggauucgagcccgaaccggagaucuugagcccacugcagccgccacuuuguggacagacagucugcgauaaugucgagcucauaucccaauauaacggcuauuggccccugagaggcgagaaagucaucagauaccagguggugaacauaugugacgacgagggucuaaauccuauugucucggaggaacagauaaggcugcagcaugaggcuuuaaaugaggcuuuuucccgcuauaacaucuccuggcagcugucagugcaucagguucauaacaguacgcuuagacaccgcgucgugcucgugaauugugagccauccaaaaucgggaaugaccauugcgauccugagugugagcauccuuugacaggguacgaugguggcgacugcaggcuccagggaaggugcuacuccuggaaccgccgggauggucugugccaugucgagugcaauaacaugcuuaacgauuucgacgauggcgauugcugcgacccucagguagcagaugugcgcaaaaccuguuucgaccccgauucuccgaaaagagcauauaugucugucaaggagcugaaggaagcacugcaauugaacucaacacauuuucucaacaucuacuucgccuccuccguuagagaggaucucgcuggcgcugcaaccuggccaugggauaaagaugcggucacucaccuuggaggcauugugcuuucuccagcauacuacggaaugcccggacauacagauacaaugauucacgagguaggucaugugcucggucuguaucauguauucaagggugucuccgagagagaauccuguaacgacccuuguaaagaaacaguccccucgauggagacuggggaccuuugugccgacaccgccccaaccccuaaaucagagcucugcagagaaccagagccaacaucagacacuugcgguuucacacgguucccuggggcaccauucacuaauuauaugucuuacaccggcaucacgaccgugcuguuuuguuuuuugcugcggauccacggugggcuuuag

SEQ ID NO: 12366 - RNA, 5376 nt, Artificial Sequence
  Description of Artificial Sequence: Synthetic coding sequence
augaugugcuugaaaauucugaggauaucccuagcaauucucgcugggugggccuugugcucugcaaacucagaacuagguuggaccagaaagaaaucccuggucgagcgggagcacuugaaucagguguuacucgagggcgagcgcugcugguuaggagccaaagugcgccggccacgagcuuccccacagcaccaucuguuuggaguguacccuagucgagccgggaauuaucugcggccguaucccguaggcgagcaagagauucaucacacuggaagaaguaagcccgacacagagggcaacgcugugucacucgugccccccgaucugacagagaacccugccggcuugcgaggggccguggaggagccugcugccccuugggugggcgacuccccuaucggucagucagagcugcugggggacgaugaugccuaucucggcaaucagcgaagcaaagagucgcugggcgaagcagguauacagaaaggcuccgcuauggcugcuaccacuacgaccgcaauauucacgaccuugaacgagcccaaacccgagacccaaaggagaggcugggccaaaaguaggcagcggaggcaaguuuggaaacggcgcgcugaggacggacagggcgauagcggcauuuccucccacuuccagcccuggcccaaacacucccuuaagcacagggugaagaagucuccccccgaggaaucuaaccaaaacggcggcgaggguucuuaucgggaagcagaaaccuucaauagccagguggguuuacccauccuuuacuuuucuggcagacgcgaacgucugcugcugcgccccgaagugcuggcagagaucccuagggaagcauucaccguggaggcauggguaaagccagagggcggccagaauaacccugccaucaucgcugggguauucgauaauugcucacacacaguauccgacaaggguugggcccuaggcauucgaagcgguaaggauaagggaaaacgagaugcuagguuuuucuuuucucuuuguacugaucgcguuaagaaggcuacaauccucaucucgcauucgcgcuaccaaccaggaacauggacccacguugccgccacauacgacggccggcacauggcccuguacguugacggaacucagguggccaguucccucgaucaaagcgguccuuuaaacagcccauuuauggcuucgugcagaucucuuuuacuaggaggagauucuucagaggauggccacuacuuccggggccaccugggaacucugguauuuuggucuacugcccuuccccagucgcacuuucagcacagcagccaacacagcagcggggaagaagaagcuacggaucugguacuaaccgcgagcuuugaaccugugaacacagaauggguuccuuuccgggaugaaaaguacccccggcuggaaguauuacaaggauucgaaccagagccugagauucuuucaccacugcagccaccccucugcggccagaccguuugugacaacgucgagcuuauaagccaguacaacggcuauuggccccucagaggggaaaaggucauccgguaccaggucguuaauauuugugacgaugaagggcugaauccuaucgucucugaagagcaaaucagauuacaacaugaagcucugaaugaagcuuucucccgauauaauauuucuuggcagcuguccgugcaccaagugcacaacuccacucuccggcaccgcgugguccugguuaauugugagcccucuaaaauuggaaacgaccacugcgaucccgagugugaacacccccugaccgguuaugacggcggagauugcagauugcaaggcagaugcuauaguuggaauagacgcgauggccuuugucauguggaaugcaauaauauguuaaaugacuucgacgacggugauugcugugacccccaggucgcagaugugcggaaaaccuguuucgacccagacagucccaagagggccuacaugagcgugaaagagcugaaggaggcucuucaacuuaauuccacccauuucuuaaacauuuacuuugcauccaguguccgagaagaucuugcgggagcggccaccuggccuugggauaaagaugcuguaacucaucugggcggcaucgugcugucccccgcuuauuauggaaugcccgggcauacugacacuaugauccacgaagugggccacguccugggacuauaccacguguucaaaggcgugagugaacgagaguccuguaaugaucccuguaaagagacugugccuuccauggaaacaggggaccuaugugcagauaccgcacccacacccaagucggagcuguguagagagccggaaccuacaucugauaccuguggguucacgcguuuuccaggcgcuccauucacgaauuauauguccuauaccgacgauaacugcaccgacaauuucacucccaaucaagucgcccggaugcacugcuaccuagaucucguauaucagcaauggacagaaucuaggaagcccaccccuaucccuaucccaccaauggugaucggucaaacaaauaaaucacucacaauucacuggcuacccccaaucucaggggucguguaugaucgugcaagcggcagucucuguggagcaugcacggaggacggcacauuuagacaguaugugcauacugcuucaucucgacgaguaugugauuccagcggcuauuggacuccugaggaagccgugggcccccccgacguggaccagcccugugaaccaucacugcaggcuuggagccccgaagugcaccuguaucauaugaauaugaccguuccauguccaaccgagggcuguucccuggaauuguuguuucagcacccuguacaggccgauacucugacuuuauggguaacaucuuucuucauggaaucuucccaggugcucuuugauacagagauucugcuggaaaacaaagagagcgugcaccucggcccucuugacaccuucugugacauacccuugaccaucaaguugcacgucgacgguaaaguguccggcguuaaaguuuacaccuucgaugagcgcaucgagaucgacgcagcgcugcucacaagccagccccacagcccacugugcuccggguguaggcccgugagguaucaggugcuucgcgaucccccuuuugcgagcggccugccuguggucgugacgcacagucauaggaaguucacugauguugaagugaccccuggccagauguaccaguaccagguccuggcugaggccggaggagaacugggggaggcuucuccacccuuaaaucauauccauggcgccccguacugcggggacggcaaaguuucugagagacuaggcgaagaaugcgaugacggcgaccuugucucgggagauggauguagcaaagucugugaacuggaggagggguucaauugcgugggagagcccucucugugcuacauguaugaaggcgacgggauuugcgaaccauucgagcgcaaaacuuccaucguggauugcggcauuuacacuccaaagggguaucuggaucaaugggcgaccagagccuauucaagccaugaggauaaaaagaaaugcccaguaagccucgugacuggggagccacacucacucaucuguacgaguuaccauccggaccuuccaaaucaccggccguugaccgggugguucccgugcguggccucagagaacgagacccaggacgauagaagcgaacaaccugagggguccuugaagaaggaggaugaaguguggcugaaggucugcuucaaccgcccuggcgaagcaagagccaucuuuauuuuuuuaaccaccgauggccucgucccgggggagcaccaacagccaacugucacgcuguaccucacagacgugcgugggagcaaucauucucugggaacauacggccugagcugccagcacaacccauugauuaucaaugugacccaccaccagaacguguuauuucaccacacuacuagcguguugcucaauuucaguucgccuagaguugguaucuccgccguggcguuacgaacuuccucgagaauugggcuauccgcgcccucuaacugcaucucagaggaugagggucagaaucaucaggggcagagcugcauccaccguccuugcgguaagcaagauaguugcccaagccugcugcuugaucaugccgacguggugaacuguaccuccauaggacccggcuugaugaagugugccauuacgugccaacgugguuuugcacuacaggccuccucgggacaguauauaaggcccaugcaaaaggaaauccugcuaaccugcagcuccggacacugggaucaaaauguaucaugucugccaguugauuguggugucccagauccuagucucgucaacuacgcgaacuucuccuguucagaagggacuaaauuucugaaacgcugcagcauaucuuguguccccccugccaaacugcaggggcuuagcccguggcucaccugccuggaggacggacuguggucccugccggagguguacuguaagcucgaaugugacgccccuccaaucauucugaaugccaauuugcuacugccacauugccuccaagacaaccacgaugugggaaccaucuguaaguacgaaugcaagccaggcuacuacguggcagaguccgccgaggguaaagugagaaauaagcuguugaaaauucagugucuggaggguggaauuugggagcaaggauccugcauuccugucguaugugaaccucccccccccguguuugaggggauguacgaauguacaaacggauucucucucgacucccaauguguccuaaauuguaaucaggagagagagaaacugccuauacuguguaccaaagaaggacuguggacgcaggaauucaagcugugugagaauuuacaaggagagugcccuccuccucccucugagcugaacuccgucgaauacaagugcgagcagggcuacgguauuggagccguguguucccccuugugcguuauuccacccucggauccaguuaugcuuccagagaacauaacggcugacacccuugaacauuggauggaacccgugaaaguacaguccaucguuugcaccggcaggcgacaauggcacccagacccugugcuggugcacugcauacaauccugcgagccuuuccaggcagacggguggugugacacuauaaauaauagggccuacugccacuacgacggaggagauuguugcagcaguacccugucuaguaagaaggugaucccauucgcugcugauugcgaucuggaugagugcacaugucgagacccaaaagcagaggagaaucaauag

SEQ ID NO: 12367 - RNA, 702 nt, Artificial Sequence
  Description of Artificial Sequence: Synthetic coding sequence
augaaggacccccucgcuaaggaugaacgaauuuaugugacaaacuauuauuacgguaauacucuuguagaauuccggaaucucgagaacuucaagcaggguagauggagcaauucauacaaacucccuuauucauggaucggcacaggccauguggucuacaauggcgcuuucuauuacaauagagccuucacaagaaauauuauuaaauacgaucugaaacaaagauauguggcugcuugggcuauguuacaugacgucgccuaugaggaggccacgccauggcguuggcagggacacuccgacguugacuucgcgguggacgagaauggccuauggcucauauaucccgcccucgacgaugagggauuuagccaggaagugauagugcugagcaaauuaaaugccgccgaucugagcacacaaaaagagacaacuuggaggaccggacuccgucgcaacuuuuauggcaauugcuucguuauuugcggcgugcuuuacgcuguggauaguuauaaccaaaggaacgccaacauuagcuaugcuuucgacacccacacuaauacccaaaucgugccgcgcuugcucuucgaaaacgaauauucuuacaccacacagaucgacuauaaccccaaggauaggcuucuguacgccugggauaacggccaccagguaaccuaucacguuaucuucgcuuauuag

SEQ ID NO: 12368 - RNA, 579 nt, Artificial Sequence
  Description of Artificial Sequence: Synthetic coding sequence
auguugaagaaaauauccguaggcguugcaggcgaucuaaacaccguuacaaugaaguugggaugcguacucauggccugggcccuuuacuuaucacuuggcguccuguggguggcccaaaugcugcuggcugcuuccuuugaaacucugcagugcgaggggcccgucuguaccgaggagaguagcugucacacggaggacgacuuaaccgaugccagggaagcagguuuucaggugaaagcuuauacguucuccgaaccauuccaccugaucgucuccuauggcgccuccaguuccgcagccccaccgacccugaauccggcaccccaaaaguccgccgcucccggaacagcgcccgaggaagccccaggcccccugccuccaccuccuacucccuccuccgaggacccaggcuuuucauccccccucggcaugccagacccacauuuauaccaccagaugggucuacugcucaagcauaugcaggauguucggguguuacuaggacaucuccugauggaacucagagaacugucuggccacagaaaacccggcacuacuaaggccacugcugaguag

SEQ ID NO: 12369 - RNA, 459 nt, Artificial Sequence
  Description of Artificial Sequence: Synthetic coding sequence
auguuacuggcugcauccuuugaaacccugcaaugcgaggggcccgugugcaccgaggaaucaucaugucauaccgaagacgaccuaacagaugcacgugaggcugguuuccaagugaaggcauacaccuucuccgaacccuuucaccugauugugagcuauggcgccagcucaucagcagccccuccuacgcucaauccugcuccccaaaaaucagccgcacccgggacagcuccagaagaggcuccagggccgcucccgcccccaccgaccccaaguagcgaggacccaggcuuuucuucgccucucgggaugccugauccccaucuuuaucaucagaugggccugcugcucaagcacaugcaagaugugagagugcuauugggccauuuacucauggaguuacgagaacucuccggacaccggaagccuggaaccacaaaggcgaccgcugaauag

SEQ ID NO: 12370 - RNA, 1098 nt, Artificial Sequence
  Description of Artificial Sequence: Synthetic coding sequence
augaagcuuggaugcguacucauggccugggcucuuuacuugucacucgguguccucuggguugcacagauguuacuggccgcaggaugccaugccgccgccucuuuugagacacuccagugugaaggccccguguguaccgaggaaaguucaugccauaccgaagacgaucuaacugacgcacgagaggccggcuuccaagugaaggccuacacuuucagugagccuuuccaccuuauugugaguuaugauuggcugauacugcagggaccugcgaaaccuguguucgaaggcgaccugcucguucugcguugccaggcguggcaggacuggccgcuuacacaggugacuuucuaccgagacgggucagcccugggaccaccuggaccaaaucgcgaguucucuaucacugucguacagaaagcugacagugggcacuaccacugcucaggaaucuuucaauccccagggccuggaaucccugaaaccgcauccguaguagcuauuaccguucaggaacucuuccccgcgcccauacuccgggcagugccgagugccgaaccccaggcuggcucccccaugaccuuaagcugucagaccaaacugccuuuacagagguccgccgcaagacuucucuucagcuuuuauaaagaugggcgcauuguccagagucggggccucagcuccgaguuccaaauccccacggccucugaggaucauucaggaaguuauuggugugaggccgcuacugaagacaaucaggucuggaaacaaucuccacagcuagagauccgcguacagggggccaguaguagcgccgcacccccaacccucaaucccgccccccaaaaaucugcugcuccuggcaccgcccccgaagaggccccuggcccccuuccccccccaccuacuccguccagcgaggaucccggauuuaguuccccucugggcaugccugacccacaucucuaucaccagaugggacuuuugcuuaagcacaugcaggaugugaggguccuccucggucauuuauugauggaguugagagaacugagcgggcaccguaaaccaggcacuaccaaggcgacggcugaauag

SEQ ID NO: 12371 - RNA, 711 nt, Artificial Sequence
  Description of Artificial Sequence: Synthetic coding sequence
augcuuaaaaagaucucugucggaguugccggggaucucaacaccgugacuaugaaacuuggaugcguucuuauggccugggccuuguaucugucucuugggguacugugggucgcccagauguuguuagagcuguucccugcccccauacuucgcgccgucccguccgccgagccucaagcagggagucccaugacucuuucaugucagaccaaacugccccuccaacgcucugccgcacggcugcuguucuccuucuauaaagacggacgcaucguccaaucaagaggacuuagcucagaguuccagaucccuaccgcaucugaagaucacaguggcagcuacuggugugaagcugcaaccgaggacaaccagguguggaaacagagcccccaauuggagauucggguucagggggcuucaucuagugcagcgccuccuacauugaauccugccccccaaaagucugccgcaccuggcacugccccugaggaggccccuggaccacuacccccgcccccuacucccucgucugaagauccaggcuuuuccagcccacucggaaugcccgauccccacuuguaucaccaaaugggccuucuguugaagcauaugcaagacgucagaguguugcugggccaccugcuuauggagcugcgggagcuguccggccacaggaagccaggaacaacaaaagcaacugcugaguag

SEQ ID NO: 12372 - RNA, 1149 nt, Artificial Sequence
  Description of Artificial Sequence: Synthetic coding sequence
auguugaagaagauuagcguaggaguggcuggcgaucugaauacugugacaaugaaacuggguuguguguuaauggccugggcacuguaccugaguuuaggcgugcucuggguugcccagaugcuccuggccgcuggcugucacgcugccgcuuccuuugagacccuacaaugugaagggccuguuugcaccgaagagucaaguugucacacugaagacgauuuaacagacgcucgugaggcgggcuuccaggucaaggccuacacguuuuccgagccauuucaccuuaucgugaguuaugauuggcugauucugcaggguccagcuaaaccuguguuugagggggaucuguugguucuccgaugucaggccuggcaggacuggccucugacccaggugaccuucuauagggauggcagugcgcugggaccccccggaccgaaccgcgaauuuuccauuaccguagugcaaaaggccgauucaggccauuaccacuguucagggauuuuucagagcccaggcccagggauuccagaaaccgcauccgugguggcaauuaccguucaggaacuguuucccgcucccauacugcgcgccgugccgucugccgaaccucaggcuggaaguccuaugacccuuucuugccagacuaaacucccgcuccagcgcuccgcggcuagacuucucuucuccuuuuauaaggaugggcgcaucguccaaucccggggccuaucaucagaauuccaaaucccuaccgcgagcgaagaucacucuggaagcuacuggugcgaagcugcaacugaggacaaccaaguguggaagcagucuccucagcuugagauuagaguacagggugcuagcaguagcgcugcaccccccacccugaaccccgcaccgcagaaaagcgcugccccagggaccgcuccugaggaagcuccugguccucugccaccuccgccuacuccuuccucugaggacccagguuucucaagcccacuugggaugccugacccccaccuguaucaucagaugggauuguugcugaagcauaugcaggacguccggguccuacuaggccaucugcucauggagcuuagagaacucuccggacauagaaagccagggacaacaaaggccacagcugaguag

SEQ ID NO: 12373 - RNA, 738 nt, Artificial Sequence
  Description of Artificial Sequence: Synthetic coding sequence
augagccggcuacgugcgcugcuggggcugggacuauugguggcagguucgagggugccccgcaucaagagucagaccaucgcaugcagaagcggacccaccuggugggggccacagcgacuaaauaguggaggccggugggacagcgagguuauggccucaacuguggugaaguaccuuucccaggaggaagcgcaagccguugaucaggagcuuuuuaaugaauaccaguucuccguagaccaguugauggaguuggcaggccuguccugcgcuaccgcgauugccaaggcauacccuccaacaucaaugagucgcagcccuccgaccgugcuggugauaugcggcccagggaacaacggcggggaugggcuugugugugcccgccaccugaaacuguucggcuaugagccuaccauauauuauccaaagcgcccuaauaaaccccucuucaccgccuuagucacccaaugccagaaaauggauauuccuuuccucggggagaugccugcugagcccaugacgauagaugagcuguacgaacuaguuguggaugccauuuucgguuuuuccuucaaaggugaugucagagaaccuuuucauuccauucugaguguccuaaaaggccugaccgucccaauugccaguauugacaucccgaguggcgcgggcauccagaaaguuggcugggggcggcucggcccuuacccuccagacuccugcccccaucaaguguag

SEQ ID NO: 12374 - RNA, 783 nt, Artificial Sequence
  Description of Artificial Sequence: Synthetic coding sequence
augucacgacugcgugcgcugcuuggacugggucugcuaguagccgggucucgcgugccaagaaucaagucccagacuaucgccuguagguccgggccgaccuggugggggccacaaaggcuuaauagcgggggccgcugggacagcgagguuauggcuucaacgguuguuaaauacuugagucaggaggaggcacaggcaguggaucaagaacucuuuaaugaauaccaguuuucaguggaucagcugauggagcuggccggccuguccugugcuaccgcgauugccaaagccuaccccccuacaagcaugucuaggucccccccaacuguccuugucauauguggucccgguaacaauggaggagauggccucgugugcgcccggcaucuuaaauuauucggcuaugaacccacgauuuauuacccaaagcggcccaacaagccauuguucacagcccuugugacccagugccaaaaaauggauauaccuuuucugggagaaaugccagccgagcugcaaggcagauguagcgggacaguuccucagcaucccgagugucccgagggaacccauugcgcacauugccagcacagacacucguugcgcaugggccguggcgaaggaaaaugcuggcgcgauccugcucgacuggcucacauuccgcauaguccucagaagauuuguaaccccguauacaggagcuuaccccugccuggugguucuuucugcgcuacuuguucaggagaagaggugccagcagaacccgcaacacuucccuag

SEQ ID NO: 12375 - RNA, 867 nt, Artificial Sequence
  Description of Artificial Sequence: Synthetic coding sequence
augucaagacuacgcgcucuccuuggccuggggcugcugguggccgguuccagaguuccucgcaucaagucucaaaccaucgcaugcagaagcggccccacauggugggguccccagagguuaaauagcggcggacguugggauagugaggucauggcaagcaccgugguuaaguauuugucccaggaggaggcgcaagcaguggaccaagagcucuuuaacgaauaccaauuuagcguugaccagcucauggaacuggccggacuuagcugugcaaccgcuauugcuaaagccuacccgccaacaucuaugucaagaucuccacccaccguccuagugaucuguggcccugguaauaauggaggcgauggcuuggucugcgcaaggcaccugaaacuguucggauaugaaccaacgaucuauuauccuaaaagaccaaacaaaccacucuucaccgcgcuggugacucaaugucagaagauggauaucccguuucugggcgaaaugcccgccgaaccuaugaccaucgacgagcuuuacgaauugguagucgaugcaauauucggauucucuuucaaaggcgacguuagggaaccauuccacagcauuuuaagcguacuaaagggauugacagugccaaucgcgucuauagauaucccuucugguugggauguggagaaaggcaacgcuggugguauacagcccgaucugcuuaucucccucaccgcucccaagaaaagugccacacaguucacuggaagauaucauuaccuggguggacgcuuugugccucccgcccucgaaaagaaauaccagcucaaucuucccccguacccugauacagaaugcguauaccgcuuacaguag

SEQ ID NO: 12376 - RNA, 879 nt, Artificial Sequence
  Description of Artificial Sequence: Synthetic coding sequence
augcaucuuagauugaucucauggcuguuuaucaucuuaaauuuuauggaauauaucggcucccaaaaugccucaagaggaaggaggcagagacgaaugcaccccaaugugagucaggguugucagggcggcugcgccacauguuccgauuacaauggcugccucucuuguaaaccucgccuuuucuucgcccucgagaggaucggaaugaagcagauaggggugugucugucguccugucccucuggcuacuacggcacacgguaccccgacaucaacaaaugcacuaaguguaaagccgacugcgauacaugcuuuaacaagaauuucugcacaaaauguaagucuggauuuuaucuccacuuagguaagugcuuggacaauugcccagagggccuugaggccaauaaucauacgauggagugcguuagcauaguucacugcgaggugagugaguggaacccauggucuccuuguacaaagaaggggaagaccugcggguucaagaggggcacagagacgcgagucagagaaauuauucagcauccuucagcaaaagguaaucuauguccgccaacgaaugagacacguaagugcaccguccagcguaaaaaaugccaaaaaggagagaggggaaaaaaaggccgcgaacgcaagaggaaaaagccuaacaaaggcgagagcaaagaagcgauuccagauucaaaaucucuggaauccaguaaggaaauuccagaacagagggaaaacaagcaacagcagaagaagagaaaggugcaagacaaacagaaaagcggcaucgaaguaacccuggcugaaggcuuaacaagcguuucccagcgcacacagccuacgcccugccgccgaagauauuuauag

SEQ ID NO: 12377 - RNA, 2871 nt, Artificial Sequence
  Description of Artificial Sequence: Synthetic coding sequence
auggagacucaggaacuacggggcgcacuggcucucuugcuccucugcuuuuucaccuccgccucucaagacuugcaaguuaucgaccuucuuacagugggagaaagcaggcagaugguagccgucgccgagaaaaucagaaccgccuugcucacagccggggauauauaucuguuaagcaccuuuagacugccccccaagcagggcggcguguuauucgggcuguacucuaggcaggauaauacuaggugguuagaggcgagcguagugggcaaaaucaauaaaguucuagugcgguaucagagggaagacggaaaaguacacgcagucaaucuccagcaggcaggccuugcugacggccguacgcacacuguacuguugaggcuuagagguccaucacggccuagcccagcucuucaccuguauguggacugcaaacuaggcgaucaacacgccggucuuccugcucuggccccuaucccacccgccgaaguagauggauuagaaauuagaacgggacaaaaagcauaccuccggaugcagggcuucguggagagcaugaaaauuauucuaggcggcaguauggcucgagugggagcauugucagaguguccguuucaaggagaugagaguauucacagcgcuguuacuaacgcccugcacucaauccugggugagcagaccaaagcccuugucacacaauuaacacucuucaaccaaauacugguugagcuuagagacgacaucagggaccaagucaaggagaugucccugaucaggaacacaaucauggaaugccagguguguggguuucacgaacagaggucucauuguucucccaaucccugcuuuaggggaguggacuguauggagguguaugaguaucccggcuaccgguguggcccuugccccccaggucugcaagguaauggcacucacugcucagauauuaaugaaugcgcacacgcugacccuuguuuuccuggcucuucuugcaucaacacaaugcccggcuuccacugugaggcaugcccucggggcuacaagggcacgcaggucuccgggguaggcauugauuaugcacgcgcauccaagcaggucuguaacgacaucgacgaaugcaacgacgguaauaacggcggaugugacccaaauuccauuuguaccaauacaguggggucuuuuaagugcgggccuugucgauuaggauuucuggggaaccagucccagggcugucuccccgccagaacaugccacagcccggcccacagucccugccauauccacgcacauugccuguuugaacggaacggagcugucagcugucaauguaaugugggcugggcgggaaaugguaaugucuguggcaccgacaccgauauugacggauauccagaccaggcacugccauguauggacaacaacaagcacugcaagcaggauaauugucugcugacaccaaacaguggacaagaggaugcugauaacgacggggugggagaucagugcgaugacgacgccgacggcgaugggaucaagaauguagaagacaacuguaggcuguuccccaauaaggaccagcaaaacuccgacacagacucuuucggcgacgcaugugauaacuguccuaauguucccaacaaugaucagaaggauaccgauggaaauggggaaggugacgcuugugacaaugacguggacggagacgggaucccaaauggucuggauaacuguccuaagguccccaauccucuucagacagacagagacgaggauggagugggagacgcuugcgauagcugccccgagaugaguaacccaacccaaacagacgccgauucggaccuaguuggugacgucugcgacaccaaugaggacucugauggcgauggccaucaggauaccaaagauaacugcccgcagcucccaaauaguucccaguuagacagugauaacgacgggcucggagaugagugugacggcgaugaugacaaugauggcauacccgauuacgucccccccggcccugauaacugccggcugguucccaauccaaaucagaaggauagcgacggaaauggcgucggcgaugugugcgaagacgauuucgauaaugaugcugugguggacccacucgaugugugcccagagucagcugagguaacacuaaccgacuucagggcauaucagacaguugugcuggaucccgagggagacgcccaaaucgauccaaacuggguggugcugaaccaaggaauggagauugugcagacuaugaacagugacccagggcuagccgucggauacacagccuucaaugguguggauuuugaaggaacuuuccacgugaauaccgucacagacgacgacuacgcuggauuccuguucuccuaucaggacucuggcagauuuuaugucguuauguggaaacagacagagcagaccuauuggcaggcuacuccuuucagggccguugcccagcccggcuugcagcugaaagccgugacaagugucucagggcccggcgagcaucuccgaaacgcauuguggcauaccgggcauaccccugaucagguacguuugcuguggacagacccucgcaacgucgguuggcgagauaagaccagcuauagauggcagcuguugcauagaccacagguuggguacauucgcgucaaguuguaugagggaccgcagcuaguggcugacaguggcguuaucauugauacuagcaugcgcggcggcaggcugggcguuuucugcuuuagucaggaaaacauuauuuggagcaacuuacaguauagaugcaaugacacuguacccgaggauuuugagcccuuccgccgucagcugcuucagggaaggguauag

SEQ ID NO: 12378 - RNA, 1110 nt, Artificial Sequence
  Description of Artificial Sequence: Synthetic coding sequence
auguuaccauggcuccugguuuuuagcgcacugggaauucaggccuggggggacuccucuuggaauaagacucaggcaaagcaggugucagaggguuugcaguacuuauuugagaauauuagucagcugaccgaaaaggacgugagcacaacagugagccguaaggccuggggggcggaggcuguggggugcucaauucagcucaccacccccguuaacguuuuggugauucaccauguuccgggccuugaaugucacgaccagacgguuugcucccagaggcuucgugagcugcaagcacaucauguucauaacaauucaggcugcgacguugccuauaauuuucucgugggggacgacggacggguuuaugaaggaguuggcuggaacauccaaggcgugcacacccagggcuauaacaauaucucauuaggcuuugccuucuucggaacgaaaaagggacauucucccucuccugccgcguugucugccauggaaaaccugauuacuuacgcuguccagaagggacaccuuaguuccagcuacgugcaaccccuacuaggaaaaggagaaaauugucuggccccacgucaaaagacgucucuuaaaaaggcaugccccggagucguucccagaaguguguggggugcuagagaaacacacuguccccgcaugacacucccggcuaaauauggaauuaucauacauaccgcaggccggacuuguaacauaagcgaugaaugcagacuccuggugagggacauucaaucuuucuacauagaccggcucaagucuugugauauuggauacaacuuucugguuggccaagauggugccauuuacgagggaguaggauggaauguucaggguucuucuacucccggcuacgacgacaucgccuuagggauaacuuuuauggguacauuuaccggcauuccgccuaaugccgcugcucuggaggccgcucaggauuuaauacaaugugcuaugguuaaggguuacuuaacuccuaacuaccuucuggugggacacucagacguggcuagaacacucaguccuggacaggcccuguacaacauaauuucaacuuggccgcacuucaagcacuag

SEQ ID NO: 12379 - RNA, 675 nt, Artificial Sequence
  Description of Artificial Sequence: Synthetic coding sequence
auggagaagaucccuuucguuuugggaggcaaucugcaggguggcgagcuugugguggcuuacccuuaugaccuggugcggucccccuggaagacccaggagcauacaccuacgcccgacgaucauguguuuagaugguuagccuauucguacgcuagcacccaccgauuaaugacugaugcaagacggcgcguuugccacacugaggauuuucagaaagaggagggaacuguuaauggcgcaucuuggcacaccguagcuggcagcuugaaugacuucuccuaccuacauaccaauuguuucgagcucagcaucuaugucggaugugacaaguauccccaugaaucccaauuacccgaggagugggaaaauaaccgcgagagcuugauaguuuuuauggaacagguccaucguggcaucaagggauugguuagggacagucacggcaagggcauuccuaacgcuaucaucucugucgaggguauuaaucacgacauccgcaccggacgugucucauugcaaaaacugucauuagcuugucggaggguucguugcgccuuugcucucaguaguagcaguacaaugauuguccgccccccgcagccuuaugguaccguuccccauaguuccccugaucccguaacuaccaaaaucucaccuuugagaaacuuuuag

SEQ ID NO: 12380 - RNA, 285 nt, Artificial Sequence
  Description of Artificial Sequence: Synthetic coding sequence
augcccgucaucgcagggggaaucuuggcugcccucuugcuacucaucguggugguguugugccuguacuuuaaaauccacaaugcccugaaagccgccaaagagcccgaggccguugccguuaaaaaccauaaucccgacaaaguguggugggcuaagaauagucaagccaaaacaaucgccacagagaguugccccgcucugcaguguugcgagggauaucgaaugugugcaaguuucgacucgcucccuccaugcugcugugauaucaaugaaggucuauag

SEQ ID NO: 12381 - RNA, 285 nt, Artificial Sequence
  Description of Artificial Sequence: Synthetic coding sequence
augccugugaucgcuggaggaauccuggcugccuuacugcuuuuaaucguggucguucucugcuuguacuuuaaaauccacaaugcucucaaggccgccaaggagccugaagcugucgccguuaaaaaucauaacccagacaagguauggugggccaagaacucccaagcaaagacaauugcaacugaaagcuguccugcacuacagugcugcgagggauaccguaugugugcaucguuugacucacugccccccugcuguugcgacauuaaugaaggccuguag

SEQ ID NO: 12382 - RNA, 1026 nt, Artificial Sequence
  Description of Artificial Sequence: Synthetic coding sequence
augguccccgcagcuggcgcccucuuguggguacugcuccucaauuuggggccucgcgccgcuggcgcgcagggacuaacucagacucccacagagaugcagcgugucucccuccgguucggcggcccaaugacucgcucuuaccgcucuaccgcucgcaccggccucccuagaaagacaagaaucauacuggaagacgaaaacgacgcaauggccgaugcagaccgacuggccgguccggccgcagcugaguuauuggcagccacugucuccacuggcuucucacgguccagugcuaucaaugaagaggauggcucuuccgaggaagguguagucauuaacgcaggcaaggacucuacaagccgagagcuuccaucagccacccccaauacugcuggaucauccagcacucgauucaucgcaaacucucaagagccagaaauaagacuuaccuccucgcugccucgaucgccggggaggucuacagaggaccuuccaggaucucaggccacccugucccaguggucaacuccagguuccacuccaagccgguggccuuccccuagcccuacagcuaugcccagcccagaggaucugcgccuuguucuaaugccaugggggccauggcacugccacugcaaauccggaacgaugucucggucuagaaguggaaaguuacacggauugaguggaagguugcgagucggcgcguugagccaacuucgaaccgaacacaaacccuguaccuaccaacagugucccuguaaucgacuucgcgaagagugcccgcucgauacaucuuuguguacugacacuaauugcgcuucacagaguaccaccagcacacggacgacaaccaccccuuuucccacaauccauuugcgauccuccccuucccuuccucccgcuucacccugccccgccuuagcauuuuggaaacgaguuaggaucgggcuggaggauaucuggaauagccuuuccucgguguucaccgaaaugcagccuaucgaccgcaaccagcgcuag

SEQ ID NO: 12383 - RNA, 366 nt, Artificial Sequence
  Description of Artificial Sequence: Synthetic coding sequence
auggaugucuuguuuguagccauauuugcuguaccauugauccugggacaagaguaugaggaugaggaaagacucggagaggaugaauacuaccagguaguguacuauuacaccguaacaccuagcuaugacgauuuuuccgccgacuucacaaucgauuauagcauuuuugaaucugaggacagauugaacagacuagauaaggacaucaccgaagcgauugaaaccacuauaucccuggaaacggcccgggccgaccacccaaagccugucacuguuaagcccguuaccaccgaaccagucgaagaaggcuguuaugacucccucgauggcagccuggcacgcggaaauuggaagauuaaauag

SEQ ID NO: 12384 - RNA, 396 nt, Artificial Sequence
  Description of Artificial Sequence: Synthetic coding sequence
auggacguccuguuuguugcgaucuucgcggugccucuaauccuagggcaagaguacgaggaugaggaaagacugggcgaagaugaauauuaccaggugguguacuacuacacuguuacuccuuccuaugaugacuuuagugcagauuucacaauagacuauagcauuuuugaaagcgaggaccggcucaaucggcuggacaaagacaucacagaggcuauugaaacuaccauuucucuagaaacagcccgagcagaucaucccaaacccgucaccgucaaaccugucacuaccgaaccuucccccgaccugaaugacgccgugucaagucucagaagcccuauuccccuguugcucucuugugccuucguccagguggggauguacuucauguag

SEQ ID NO: 12385 - RNA, 396 nt, Artificial Sequence
  Description of Artificial Sequence: Synthetic coding sequence
auggacguucucuuuguugcaauuuucgccgugccacugauucucggacaggaauaugaagacgaagaaaggcuuggggaagaugaguacuaccagguuguuuacuacuauaccgugaccccgucuuaugacgacuucucagccgauuuuacaauagacuauuccauuuuugaguccgaggaccgccugaauaggcuagauaaggauauaaccgaggcgaucgagacgacgauuaguuuagaaacagcacgcgcggaucaucccaaacccgugacugugaagccuguuaccaccgaaccaucgccugaccucaacgacgccgucuccucacugagauccccaaucccccuucuccuuucaugcgccuuuguucaagugggcauguacuucauguag

SEQ ID NO: 12386 - RNA, 312 nt, Artificial Sequence
  Description of Artificial Sequence: Synthetic coding sequence
auguccggaagagggaagggaggcaaaggacuggggaaaggaggcgcgaaaaggcaucggaaagugcuucgggacaauauacagggaaucacaaagcccgccauuagacgucucgcuagacggggaggggugaaaagaaucaguggauugaucuacgaagagacucgaggcguacugaaaguauuccuggaaaacgugauccgcgaugcagugacuuauacagagcacgcuaagagaaaaacuguuaccgcuauggaugucguguacgcucugaagcgccaagggcgaacccuguauggauuuggaggcuag

SEQ ID NO: 12387 - RNA, 312 nt, Artificial Sequence
  Description of Artificial Sequence: Synthetic coding sequence
augucugguaggggcaaggggggaaaagggcugggaaagggaggagccaagaggcaccggaaagugcugagagacaacauucaagggauuaccaaaccagccauucgcagacucgcgcgccgcggaggaguaaagagaauuagcggacucaucuacgaggaaacaaggggggugcucaagguguuccucgaaaaugucauucgggaugcugucacauauacagagcaugcaaaaagaaaaaccguuacagccauggacguggucuaugcacucaagagacagggacgaacacuguacggauucggaggauag

SEQ ID NO: 12388 - RNA, 1404 nt, Artificial Sequence
  Description of Artificial Sequence: Synthetic coding sequence
augcucggcauuuggauaguggccuuucucuucuucggcacaagucgaggcaaggaaguguguuacgagcgacugggcugcuucaaagauggacugcccuggacuaggacauucucuacagagcuagucggacugcccuggucucccgagaagauuaauacccgauuccucuuguacaccauucauaauccaaacgccuaccaggaaaucuccgcaguuaauagcucaacgauucaggcaucauacuucggcacugacaagauuacgcgcauaaauaucgccggguggaaaacagacggaaaguggcaacgggauauguguaacguguuacugcagcuggaggacauuaacuguaucaaccucgacuggauuaauggaagccgcgaauauauccacgccgucaauaaucugagagucguuggugcagagguugccuacuucauagacguacugaugaagaaguuugaguacucccccaguaaggugcaucugaucggccacucgcuaggagcgcaccuggccggcgaggcaggcagcaggaucccagggcugggcaggauaacaggucucgauccagcugguccauuuuuccacaauacacccaaggaggugagacuggacccuucagaugcaaacuuuguggaugucauacacacgaacgccgcccggaucuuguucgagcuuggcgucggaaccauugaugccugcggucaccuagacuuuuacccaaacggcggaaagcauaugcccgggugugaggacuuaauuacgccacuguugaaguucaauuucaacgcauacaaaaaagaaauggccucuuuuuucgacugcaaucaugcccgcucauaucaguucuacgcagaaucaaucuuaaauccugaugcuuuuaucgccuauccaugccguagcuacaccucuuuuaaggccggcaauuguuuuuuuugcucaaaagaaggcuguccgacuaugggucauuuugccgaccgcuuccacuucaaaaacaugaagacaaauggcucucauuauuuccucaauacaggcucccugucacccuucgcgagguggaggcacaaacugaguguuaaguuaagcggcucugaaguuacacagggcacaguauuucugagaguagggggugccgugcgcaaaacgggggaguuugccauaguuagcggaaaacuggaaccugguaugaccuauacuaaacucaucgacgcggauguuaacguuggcaacaucacauccguucaguuuauuuggaaaaagcaccucuucgaagauucacagaauaaacuaggagcugagauggucauaaacacaagcggaaaguacggauauaagucaacauucugcucccaggauauaauggggccaaauauucugcaaaaccugaaaccgugcuag

SEQ ID NO: 12389 - RNA, 1287 nt, Artificial Sequence
  Description of Artificial Sequence: Synthetic coding sequence
augauuacugguguuuuuucuaugcgucuguggaccccugucggcgucuuaacuucacuugccuauugccuucaccagagacgaguugcccucgcugaguugcaggaagcugauggucagugccccguggaccgguccuugcugaagcugaagauggugcaggugguuuuucgucacggggcucgguccccccucaaaccccugccacuggaggagcaggucgaauggaacccccaguuacuagaggucccgccacagacucaguucgacuacacugugaccaaccuggccgguggaccuaaaccauacucaccuuaugauucccaguaccacgagaccacucuuaaggguggaauguucgcuggccagcuaacuaaaguggguaugcaacagauguuugcucuaggcgagcgacuccggaaaaauuacguugaagauaucccauuucugucaccuacauucaacccucaggagguguuuauccggucuacgaacaucuuucgcaaucucgaaagcacaagaugucugcuggccggcuuauuucagugucaaaaagagggaccuauaaucauccauaccgacgaagcugacagcgagguacuguacccuaacuaccaguccugcuggucucuccgccagcggaccagaggcagaaggcagacugcuagucugcagccuggaaucucugaagaucugaaaaagguuaaggaccgcauggggauagauagcucugauaaaguggacuuuuuuauucuccuggauaauguggcagcugagcaagcccacaaucugccaagcuguccuaugcuuaagagauucgcacgcaugaucgaacagcgcgcaguggauaccagucucuauauccucccaaaagaggacagggaaagccuucagauggcagucggacccuuccugcacauucuagagaguaaccuguuaaaagcugucgacagugccacagcaccugauaaaauaaggaaacucuacuuguaugcugcucaugacguuacauuuauuccacuucugaugacuuuagggaucuuugaccauaaauggccuccuuucgccguugaccucacuauggaguuauaccagcaucuggaaucaaaggaaugguucguccagcuguacuaucacggcaaggagcaagugccgcgggguugcccugauggacugugcccuuuagauauguucuuaaacgccauguccguauacacucuuucgcccgaaaaguaucacgcccuauguagccagacacagguuauggaagucggcaacgaggaguag

SEQ ID NO: 12390 - RNA, 711 nt, Artificial Sequence
  Description of Artificial Sequence: Synthetic coding sequence
augugcgugacauaccacaaugggaccggcuacuguaagugucccgagggcuuucugggagaguauugccagcaccgggaucccugcgaaaaaaacagaugucagaaugggggcaccugcgucgcucaggccaugcuggggaaagccacuugucguugcgcuagcggcuuuacgggggaggacugccaguacucaacuucgcacccuugcuuugucucaaggcccugccugaacggagguacaugccacaugcuuucacgugacacauacgaauguaccugccaggugggcuucaccggaaaggagugccaguggacugacgcaugccucucucauccuugugccaacgggucuaccugcaccacugucgcuaaccaauuuaguuguaaguguuugaccggauucacuggacaaaaaugugagacggauguuaaugaaugugacaucccaggccacugucagcauggaggaaccugccuuaaucugccuggcagcuaucaaugucaauguuuacagggcuuuaccggacaauauugugacucacuguacgugccgugcgcccccucucccugcgucaauggaggaaccugccggcagacaggugacuuuacuuucgaauguaauugucugccugaaacuguaagacggggaacugaguuaugggagcgagauagagagguuuggaaugggaaagagcaugaugagaauuag

SEQ ID NO: 12391 - RNA, 990 nt, Artificial Sequence
  Description of Artificial Sequence: Synthetic coding sequence
augguaaccaaagccuucguucugcuagcuaucuuugcggaagcgucugcuaaaucuugcgcgcccaacaaagccgacguaauauugguauucugcuacccaaaaacgaucauuaccaagauccccgaaugccccuacggcugggaggugcaccagcuggcccucgggggccuguguuauaacggagugcacgagggcggauacuaccaguuugugauuccugaccuuucccccaaaaauaaaucauacugcggcacccaguccgaguacaaaccacccaucuaucacuuuuacagccauauugucagcaaugacacaacaguaaucgugaagaaccaacccgugaauuauucauuuucaugcacuuaucacaguacuuaccuggucaaucaagccgcguuugaucaaagagucgcgacugugcacgucaaaaauggaucaauggguaccuuugaaucucagcucagccugaacuuuuacacaaacgcuaaguucucuaucaagaaggaggccccguuugugcuggaagcgucagagaucgguucggacuuauucgcaggcguagaagccaaaggacuuagcauacgguuuaagguuguguugaauuccugcugggccacacccucugcugauuucauguacccacugcaguggcagcuaauuaacaaaggauguccuacagacgagaccgugcugguacacgagaaugggagagaccauagagccaccuuucaguucaaugcuuucagauuccagaacaucccgaaacuuucuaagguuuggcugcauugugaaaccuucaucugugauagcgaaaaacuuucgugccccgugacaugcgauaaaaggaagcggcuucuuagagaucaaacuggaggaguuuuggucgucgagcuuucccugcgcucuagggguuucuccucccuuuauaguuucagugacguacuucaccauuugauaaugaugcucggaauuugugccgugcuauag

SEQ ID NO: 12392 - RNA, 1161 nt, Artificial Sequence
  Description of Artificial Sequence: Synthetic coding sequence
auggcccaauggcacugcucccagaggacccaggcaggaggucacggcgucggagaacgccuggcccagugccaggaccaaucuagccggcacgccgcugagcugcgagacuucaaaaauaaaaugcucccacugcuagagguggcggagaaagaacgugaagcccugcgcaccgaggcagauacaaucucagggagggucgauagacuagaaagggagguggauuaucucgagacccagaacccggcucugccuuguguggaguucgacgagaagguuacgggaggacccggaaccaaagguaagggccgcaggaacgagaaguaugacaugguuaccgacuguggcuacacgaucagccaaguaagaucuaugaagauccucaaacgguuuggcggacccgcaggauuguggaccaaagacccuuuaggucagacagaaaagauauacguucucgacgguacgcaaaaugacaccgcuuucguguuuccccgccuccgcgacuucacccuugcuauggcugcccgaaaagccagccgaguccggguccccuuuccguggguuggaacuggacagcuuguauacgggggauuccuguauuuugcccggagacccccaggccgcccuggcggaggaggagagauggagaacacccuucagcugauuaaguuccaucucgccaacaggacagucguggauagcucuguguuccccgccgaagggcugauuccaccauacggacugaccgccgauacauacauugaccucgccgcugaugaggaagggcugugggcgguauaugcuacccgggaagaugauagacacuuaugccucgcaaagcuagacccucagacucucgauaccgagcagcagugggauacuccgugccccagagagaaugcagaagccgcauuuguuaucugcggaacacuguacguagucuauaauaccaggccugcuuccagggcuagaauucagugcagcuuugacgcuuccggcacacuaacaccggaacgagccgccuugcccuacuuucccaggagauauggcgcccacgcaucccugagauauaaccccagagagagacaauuguacgcaugggacgauggcuaucagauuguuuacaaguuggagaugcgcaaaaaggaggaggagguguag

SEQ ID NO: 12393 - RNA, 510 nt, Artificial Sequence
  Description of Artificial Sequence: Synthetic coding sequence
augucagagcgaguggaaaggaacuggagcacaggcggauggcuguuggccuugugccuggcuuggcuguggacacaucucacacucgcggcccugcagccucccaccgcuacaguauuagugcagcaaggaacaugcgaaguuauagccgcccaccguuguuguaaucguaaccggaucgaggaaagaucacagaccguuaaguguucuugcuuuuccgggcaagucgccggaacuacccgugcaaagcccaguugcguggaugaccuccuacuggccgcacacugcgcuagaagggacccccgugcagccuuacgucuucuguugccccaaccccccaguaguugucgggacggaggcgugcgcuggagccccgcuuguagagggaggagcgugaggugcagccggacaugucgagacggagcugccgccguagauacuaagaguaagccuccuaggagucacgauaguagcuggggcagccguccagggcaggagcgucuugacuag

SEQ ID NO: 12394 - RNA, 693 nt, Artificial Sequence
  Description of Artificial Sequence: Synthetic coding sequence
augagacucgccggaccauugcggauuguggugcuuguggugagcgugggcguuacauggauuguggugucaauucuguugggugggccgggcuccggguucccccggauucagcagcucuucacuucuccagaauccucagugacugcggcaccccgugcucgcaaguacaaaugugggcuuccacagcccugcccagaggaacauuuagcauuccgcguuguuagcggcgccgcuaaugugaucggccccaaaauuugccucgaagacaagaugcucauguccagcgugaaggauaacguaggaagaggacucaacauugcuuuggugaaugguguaucaggugaguugauagaggcaagagccuuugauaugugggcaggagacguuaacgaucugcuuaaauuuauuaggccacugcaugaaggcacacuggucuuuguugcgagcuacgaugacccagcaacuaagaugaaugaagaaacgagaaagcuguuuagcgaacucgggagcagaaacgccaaagagcuggcauuuagggacucauggguuuuuguuggagccaaaggugugcagaacaagucaccguucgaacagcacgugaagaauucaaagcauucaaauaaauacgagggauggccggaagcacucgagauggaaggauguaucccucggcgauccacggcuucauag

SEQ ID NO: 12395 - RNA, 1176 nt, Artificial Sequence
  Description of Artificial Sequence: Synthetic coding sequence
augcugagaccaggcggagcugaggaggcagcccagcucccacuccgaagggcauccgcuccuguacccgugccuagccccgcagcaccagauggcucucgggccucugcaaggcuaggauuagccugcuuguugcuacuacuucuccugacuuugcccgcucgcguugauacaagcuggugguacauuggcgcacugggugccaggguuauaugugacaauauccccggccucgugucccggcagagacagcuaugccaaagauacccagacaucaugcgcagugucggagaaggggcuagagaguggaucagggaaugccagcaccaguuuagacaucaucguuggaauugcacuacacuggauagagaucacacuguguucgggagggucaugcugcgcucuagcagagaggccgccuuuguguacgccauaaguucugccggcguuguucacgccaucacuagagcauguucacagggagaacugagcguuuguucuugcgaucccuauacccgugggcgucaucaugaccaacggggcgauuuugacuggggcgguuguucugauaacauccacuauggaguuagguuugccaaggcuuuuguggacgccaaagagaagaggcugaaggacgcuagggcucugaugaaccugcauaauaauagaugcggaagaaccgcagugcgaagauuuuuaaaacucgagugcaagugccaugguguaagcggauccuguacccugaggaccuguuggagagccuuguccgauuuucggaggaccggagauuaucucagacgaagauacgacggagcagugcaaguaauggcuacgcaagacggugccaauuuuaccgccgccagacagggguaucggcgugcuacccguacagaucuuguuuacuucgauaauucuccagacuacugcguucucgacaaggcugcagggucacuggggaccgccggccgcguauguucuaagaccucuaagggcaccgacgggugugagaucauguguugugguagaggcuaugacacaacgagaguuaccagagugacacagugcgaaugcaaauuccauugguguugugccgugagaugcaaagagugccguaacacgguagacguccacacauguaaagccccaaagaaagcugaaugguuggaccagaccuag

SEQ ID NO: 12396 - RNA, 1119 nt, Artificial Sequence
  Description of Artificial Sequence: Synthetic coding sequence
augcucgacgggcuuggugugguggcuaucucaauuuuugggauucagcuaaaaacagaaggaucauuaaggaccgcaguaccuggcauaccuacacagagcgccuucaacaagugucuucagcgcuacauuggugcgcucggagcuagggucauuugcgauaacaucccugggcuggugucccgacaaaggcaacucugccagagauauccagauaucaugcgaucagucggcgagggggcccgcgaguggauccgcgagugccagcaucaguuccgccaucauagauggaauuguaccacucuugaccgcgaucacaccguauucggaagagugaugcuccguucaagcagggaggcagcauucguguaugccaucucuuccgcuggcgucgugcacgcaaucacucgcgcuugcucccagggcgaacuguccgugugcuccugcgauccauauacacgaggacggcaucaugaccagagaggcgauuucgauuggggcgggugcagcgacaauauucauuauggggugagauuugcuaaggcguuuguugaugccaaggaaaaacgauugaaagacgcccgggcuuuaaugaacuuacacaacaaccgguguggcaggaccgccgucaggagauuuuuaaaauuagaaugcaagugucacggggugucugggaguugcacccuacguaccuguuggagggcccugagcgauuuuagaaggacgggugacuaucugcggagacgauacgauggggcaguccaggugauggcuacccaggacggcgcuaacuuuacagcugcucggcaggguuacaggagggcaacaagaaccgaccuagucuacuuugauaauucuccagacuacugcguccucgauaaggcggccggcuccuugggcaccgcagggaggguuuguaguaaaacuagcaaagguaccgauggaugcgaaaucaugugcugcggaagaggauaugacacuacuagaguaacucgggugacgcaaugcgagugcaaguuccacuggugcugcgcagugagaugcaaggaauguagaaacaccguggaugugcauacuuguaaagcaccuaagaaagccgaguggcuggaucaaacauag

SEQ ID NO: 12397 - RNA, 1242 nt, Artificial Sequence
  Description of Artificial Sequence: Synthetic coding sequence
auggagaacaugcugcucuggcuaauauucuuuaccccuggauggacacuaauugacggcagcgagauggagugggacuuuauguggcaccugcgaaaagugccucgcauugucagcgagagaaccuuucaccuuacuucucccgcuuuugaagcagacgcaaagaugauggugaauaccgucugcggaauagaaugccagaaggagcuuccgaccccuucacucucugaacucgaggacuauuugucuuacgagaccguguuugaaaaugguacaagaacauuaacgaggguuaaagugcaagaccucgugcuggagccaacccagaacauuacaaccaaaggaguuagcgugagacgcaagaggcaaguguauggaacagacucacgauuuucuauccuugacaaacgauuccugacgaauuuuccguuuucuacugcugugaaacuuucaaccggcugcuccgguauucuuauaucaccccagcacguguugaccgccgcccacugcguucacgacggcaaagauuauguuaaagggucaaaaaagcugcgcgugggacugcugaagaugaggaacaaaucugguggcaaaaagagaagaggguccaaaaggagucgucgggaggcuuccgggggagaucagcgugaaggaacucgggaacaccuccgagaacgugccaaagggggccgaaggaggaaaaagucaggaaggggacagcgaauugcugaagguaggccauccuuucaguggacacgggugaagaacacacauauuccaaaggggugggcacguggggggaugggggaugcaacuuuggacuacgauuacgcucugcuugaacugaaacgggcucauaagaagaaauacauggagcuggggaucucacccacuauuaaaaaaaugcccgggggcaugauacauuucagcggcuucgauaacgaucgagcagaccagcugguguaccgcuucuguucagugagcgacgaaucaaaugaccuucuguaucaauacugcgacgcugaaucaggcucuacagggucagguguauaucuccgccugaaggaucccgacaaaaagaauuggaagaggaaaauuaucgcuguguauucaggacaccaaugggucgauguucauggcgugcagaaagauuauaauguggccgugagaaucaccccacugaaguacgcgcagauuugucucuggauucaugggaaugaugcuaacugugcauacggauag

SEQ ID NO: 12398 - RNA, 1143 nt, Artificial Sequence
  Description of Artificial Sequence: Synthetic coding sequence
augggcgcaacaacuauggaucagaaaucauuaugggcuggcagcgcauauaaacuugucugcuauuuuaccaauuggucgcaggaucggcaggagccugggaaguuuacaccugagaacaucgacccauuccucugcucucaucugauuuacucuuuugcauccaucgaaaauaacaaagugauuauaaaagacaaaucagaggucauguuguaccaaaccaucaacuccuugaagacaaaaaaucccaagcugaaaauucucuugucuauuggagguuaccuguucggcuccaaaggguuccaccccaugguggacucguccacuuccaggcucgaauucauaaauagcauuauccuguuccugcguaaucacaacuuugacgguuuagacguguccuggauuuaccccgaucagaaagaaaacacccauuuuacuguccucauucacgagcuggcagaggcauuucagaaagacuuuacgaaguccaccaaggagcgccuccugcucacugccggcguuucagcgggaaggcagaugaucgauaauucuuaucagguugagaaacuugcuaaggaucuugacuuuauuaaccuucuuuccuucgacuuccaugggucuugggagaaaccucugauuaccggucacaacagucccuugucuaaaggauggcaggaccggggaccgagcagcuacuacaauguagaguacgccguaggcuauuggauacauaagggaaugccauccgaaaaagucgugauggggauccccacguacggccauucauucacucuggccucugcugaaacaacuguuggagcacccgccuccggacccggugcugcggggcccaucacugagagcucaggcuuucuggcguacuaugagauuugccaguucuuaaaaggugccaagaucacuagacuucaggaucagcagguuccuuaugcaguaaaaggcaaccagugggucggauacgacgaugugaaaucaauggaaacaaaaguccaauuccucaagaacuugaaccucgggggagcaaugauauggagcauugacauggacgacuucacugguaaaaguugcaaucagggaccuuauccacuugugcaggcugugaagcggucucuggguucucuguag

SEQ ID NO: 12399 - RNA, 1173 nt, Artificial Sequence
  Description of Artificial Sequence: Synthetic coding sequence
augggcgcuacuaccauggaucagaaaagccucugggcgggugugguggucuuacugcuucuucaggggggaucagccuacaagcugguguguuauuucacaaauuggagccaagauagacaggagccuggcaaauucacuccagagaacauugauccuuuccugugcucucaucugauuuauuccuuugcaucuaucgagaauaacaagguaauuaucaaagauaaauccgaggugaugcuuuaucagacgauuaacucccuaaagacuaaaaacccuaaacuuaaaauucuacugaguaucggcgguuaccucuucgggucuaaaggcuuccauccuaugguugacuccucgacgucucgucucgaguucauaaacaguauaauccuguuccuccgcaaccauaacuucgacggccuggacgugucauggaucuauccggaccagaaagaaaacacccauuucacuguccucauucaugaacuggccgaggccuuucagaaagauuuuacaaagagcacaaaggaaaggcugcugcuaaccgcuggggucucggcuggccgacagaugaucgauaauucuuaccaggucgagaagcuggccaaagaucucgacuuuauaaaccuacucaguuucgauuuccacggcucaugggagaagccgcugauuacaggucacaacagcccccugaguaaagguuggcaagaucgggguccaucuagcuacuauaacgucgaguacgccguuggguacuggauucauaagggaaugcccucugagaagguaguaauggguaucccaaccuacggacauucuuuuacccuagcaucugcugagacuaccguuggagccccugccucuggcccuggcgccgcugggccuaucacugaaaguucaggauuccuggcuuacuacgaaauuugucaguuccugaaaggcgccaaaauaacaagacuccaagaucagcaagugccuuaugccgugaaagguaaccaaugggugggguaugacgauguaaagucuauggagacuaaagugcaguuccucaagaaucugaacuuggguggugccaugauuuggaguaucgauauggacgacuucaccggcaaauccugcaaccagggcccauauccacucgugcaggcugugaagcggucucuggggagccucuag

SEQ ID NO: 12400 - RNA, 2202 nt, Artificial Sequence
  Description of Artificial Sequence: Synthetic coding sequence
auggcagggggaagggaaacaugucuaccgcuaauaggcuucauuuugaucugccugaagaugguagccagugccaagucugcuccagagaucccaacaauugaucaggcuuauagcaagcugucaaauaguauuaccguggaaugggccaccgugccaggggccacuucauaccuccuuacugccgaggauggagauacuguuauugagaccaccgucgcaaacagcccaggcacaguuacuggccucaaagcagccaccugguaugagauaacuauucggagcauaucugcagcaggcaggucccaggccucgccucccaaacaagcuaagacugugcuggcagcccccauacucgagguguccagccccucgucggauagcauacugguccaaugggaggcgguguauauggcuauugccuuuucagugucuauuaugcgggcuaacgggcuagggaguaucuggaaagagaacacgaccaauacaucccugacguuuacaucuuuggaggcagggacacuuuauacaaucaaagcuuaugccuggaacgcuaaccgcauccccggcgacgacucaacauguaaccagcgaaccucgccucgcgcgcccgcuaacauacaagugucuuuugacucaggcgcgcuaaaggcuagcuucaguugggcaagggcugaaggcgccuuuaauuauaccgugauggcauuaagcgacucuagugagcucaccugcagcacaacuuuuucuuccuguacuaucagcucucuucaauguggcacggaauaccuaauuucugucuuagcuucgaacgaugcaggaucauccaagucauccagcgccaugacacuaaagaccguggcuugugccccggggcgaguuacuauucaggaagacccaccuggucaccugucuguggccugguccuccguggaccugggagacuacuacguaguguucgugaagagcgacgacggauuggagguacacuguaauacuagccucacacagugcaauuuucuguccgaguguggguucaccuacuuuaucucuguauucguguauaacaaagcuggucagaguccacuuggcgauaucuucaacuauaccaccgcgccauguugccccucggacauuaauccuguucucgugaguagcgaccgcguagaaauuguuuggucccccgugagaggcgcagagcuuuacgagacaaaggcuguggauggauauaauaugguggagugcaaugauacaaccccugccugcacucugagcgcccuagaaugugacacaaaguauaauauuacaguguacucuuucaaugaagugagaggcuccaacaugucaugcacaccucaguucauuacaacagcucccugcucaccagaaaucaagaacgugagccgcgaugccuucagcaugauuaacguccacuggagauccacaaaugaugacgcaacuuauacggugaccgcacagggggaaaaaggucuguaccaaugcuccagcacuggcgagaguuguacuaugagaggucugccuugcggcagcguuuuuucugugacagcugucgcugagacccaggccggccggucucuucccagcuauucugugccucucgagaccguaccauguugcccaacuggcuugacagugacccagaucacacagucugucauaaacgucucguggaccaucgggcgcgucgcucaaacccauguagccguauuagagucucauacgggacagaguaagugccauacucaccagaaccauugccuccuuggguguauaacaugcggaaucaacuacacagugacucuaaaagcuaucucggcgacaggacucaccgcugacugcucauaucagagcuauuucucaggggcuugcugcccuuuggggguuaaacuguacagacugggaccaaacgguauucgcauuuauuggcaagcaagcaggggcagcgcaaauuacuccaccgaucucuauggaucaaaaggaauuuucacuuguacaccaagugccggccucucguuuugcgaugugaccgagauaccuugcggcgacguguauacuguuauggucucuccgguugcaaagacuggacucaaguugaccuuuugcccaaagaaaaucuacagcgugacauguuccgguucgacccucgggaugguaauauaucgagguaagaggaacgaggaauag

SEQ ID NO: 12401 - RNA, 555 nt, Artificial Sequence
  Description of Artificial Sequence: Synthetic coding sequence
augcggggccagggaagaaaggaaucccuuagcgauucuagggaucuugauggcagcuaugaucagcuuaccgacucugucgaugaugaguucgagcuuucaacagucugucaccggccagagggacuggagcaacugcaggaacaaaccaaguuuacacggaaagaacugcaagugcuguacaggggauuuaagaacgaauguccuaguggaauaguuaacgaagagaacuucaagcagauuuauucccaguuuuuuccacagggcgauagcaguaccuaugccacauuccuguuuaacgcauuugauaccaaucaugacggcucaguuaguuuugaggaaaugcuugacauuaugaaauccauuuacgacaugauggggaaguauaccuaucccgcccugcgcgaggaggcacccagagaacauguugagucuuucuuucagaagauggauagaaacaaagauggggucgugaccauagaagaauuuaucgaaucuugccagaaggacgagaacaucaugcguagcaugcagcuauuugauaaugugaucuag

SEQ ID NO: 12402 - RNA, 759 nt, Artificial Sequence
  Description of Artificial Sequence: Synthetic coding sequence
augaggggccaaggccgaaaggaaagccuuuccgacucgagggaccuggacggcucauacgaccagcugacugggcacccucccggccccacuaaaaaagcguugaaacagagauuccugaagcuauuaccuuguugugggccccaggcacugccaucagugagugaaucaaacguagacgacgaguuugaacucaguacagugugucaccggcccgaaggccuugagcagcuucaagaacagaccaaguucacucgcaaagagcuccaggugcuguacaggggcuuuaaaaaugaguguccaagcggcaucgugaaugaagaaaacuuuaaacagauuuauucccaauuuuucccacagggagacaguuccacauaugcaacauuuuuguucaacgcguucgauacaaaucacgacggaagcgucagcuuugaagauuuuguggcuggucucagcguaauucuccgcggcacagucgacgaccguuugaauugggcuuucaaccuguaugacuuaaacaaggacgguugcauuacuaaagaagaaaugcuugauauuaugaaaucaauuuacgacaugauggggaaguauacauacccagcccugagagaggaggcuccgagagagcaugucgaaucauuuuuccaaaagauggauaggaauaaggaugggguagugacaauagaagaauucauagagagcugccagaaagacgagaauaucaugcgaucaaugcaacuuuucgacaacgucauuuag

SEQ ID NO: 12403 - RNA, 1377 nt, Artificial Sequence
  Description of Artificial Sequence: Synthetic coding sequence
augcaggcuacaagcaacuugcugaacuugcugcuguugagcuuguuugccggacuugacccaagcaaaacacaaauaucgccaaaggagggcuggcaggucuauaguucagcgcaagaccccgaugggcgguguaucugcacgguuguugcuccugaacagaaucuuuguagccgggacgccaagagucgucagcugcggcaguuguuagagaagguacagaacaugucucagagcauugaaguacugaaucucagaacucagagggacuuucaauaugucuugaaaauggaaacccagaugaagggacugaaggcuaaguuucggcagaucgaggacgaucgcaagacacugaugacgaaacacuuccaggagcugaaggaaaagauggaugagcugcucccccuuaucccgguguuggagcaguauaagacagaugcaaaacuaauuacgcaguuuaaagaggaaauccggaaccugucagcuguauugacugguauucaggaagagaucggggcuuaugacuaugaagaacugcaccagcgugucuuaucucuggagacccgccuuagggacuguaugaagaagcuuacuugcggcaagcugaugaaaauaaccggaccagucaccguuaagacaagcggcacaagauuuggugcauggaugacugacccucucgcuuccgaaaaaaauaacagggugugguacauggacucguauaccaacaacaaaaucguccgagaguauaaaaguaucgcagauuuugucagcggcgcggaaagccggacauauaaccuuccauucaagugggccgguaccaaucacguuguguacaauggcucccuuuacuucaauaaauaccagagcaauauaaucaucaaguacucauuugacaugggcagagucuuggcccaacgcucucucgaguaugccgguuuccauaacguuuaccccuacaccuggggaggauucucagauaucgacuuaauggcugacgaaaucggacugugggccguguaugcgacuaaccagaacgccggcaauaucgucaucucccagcugaaccaagauacucuggaggugaugaagagcugguccacuggauauccuaaaagaucggccggggaguccuucaugauuugcggcacacuuuacgugaccaauucucaccuuacaggagccaaaguuuacuacuccuauagcacaaagacaucaacguaugaguauacugauaucccauuccacaaccaguauuuccacaucaguaugcuagacuacaacgcgagagauagagcacucuacgcguggaacaacggacaucaaguucuguuuaacguuacauuguuucauauuauuaagacugaggacgacacauag

SEQ ID NO: 12404 - RNA, 915 nt, Artificial Sequence
  Description of Artificial Sequence: Synthetic coding sequence
auguuacccccccccagacccgcagcggcgcucgcucucccugugcugcucuuguuacuagucguucucacaccacccccuacaggagcccggccuucaccaggccccgauuaccugcggcgaggauggaugcggcugcuagccgaaggcgaaggaugugcuccuugccgaccugaggaaugugcagcuccuaggggcugucuggcuggucgaguccgggaugcuugcggcuguugcugggagugcgccaaccuggagggucagcugugugaucuggaucccucugcccacuucuacggacacugcggggaacaguuggagugucgccucgacaccggaggcgaccucagccgcggagaagugcccgagccauugugcgccugcagaagccaaaguccucuaugcgggucagacggccacacuuauucccaaauaugucggcugcaggaggcugccagagcccgccccgacgcaaaucuuacugucgcccauccuggcccaugcgaguccggcccucagauugucucacauccauaugauacauggaacgugacuggccaggaugugaucuuuggcugcgaaguguuugcauauccaauggccaguaucgaguggcgaaaagacggccuugacauccagcugccuggcgaugacccccacauuagcguucaguuucgcggugguccccagagguucgaggugacgggcuggcuacagauccaggcgguaagaccuucugacgaggggacauaccgcugccucggcaggaaugcccugggccaggucgaagcgcccgcuuccuugaccguccucacuccagaucagcuaaacucuacagguaucccucaacugaggucccugaauuuagucccugaagaagaagccgagucagaagaaaaugacgauuacuacuag

SEQ ID NO: 12405 - RNA, 327 nt, Artificial Sequence
  Description of Artificial Sequence: Synthetic coding sequence
augacuccaagccgauuaccguggcuguuguccuggguaucugccacggcauggcgagcugccagaucgccccuccugugucacucacuacgcaaaacauccaguucccagggaggcaagagcgaacuggugaagcagucauuaaaaaagccuaaauuaccagaagggcgcuucgacgcacccgaagacucacaccuggaaaaggaaccucucgaaaaauucccggacgacguuaacccaguaaccaaggagaaaggggguccucggggaccagagccaacccgguacggagacugggagcggaaaggaagguguauugacuucuag

SEQ ID NO: 12406 - RNA, 663 nt, Artificial Sequence
  Description of Artificial Sequence: Synthetic coding sequence
auggcaggauuaagccguggcagcgcaagagcacuguuagcagccuugcuggccucuacacugcuugcccucuuaguuagcccugcaagaggccgcggcggcagggaucauggagauugggacgaggcuagcagacucccuccucugcccccccgcgaagacgcagcucgcguggcuagauucgugacacaugucagcgacuggggcgccuuagcuacuauuucuacacuagaggcaguacgaggucguccauuugcugacguucucucccuuucggaugguccucccggggccgggucuggagugccguauuuuuaccucagcccauuacagcuuagcgucucgaaucuccaggagaauccguacgccacccucacaaugacacucgcucagacuaacuuuuguaagaagcacggcuucgauccacaauccccacucuguguccacaucaugcuuagcgggacggugacuaaagugaacgaaacggagauggacauugccaagcauuccuuguuuauccgccaucccgaaaugaaaaccuggccaucuucacauaacugguucuuugcgaaacucaacauaaccaauaucuggguccuagacuacuuuggcgguccgaaaauuguuaccccagaagaguacuacaauguaacuguucaauag

SEQ ID NO: 12407 - RNA, 2760 nt, Artificial Sequence
  Description of Artificial Sequence: Synthetic coding sequence
augggccuguuuaggggcuucguguuucuucuggugcugugccugcugcaucaaaguaacacuucuuucaucaaacugaacaacaauggauuugaagacaucgugaucguuauagaccccucaguuccagaagacgaaaaaauuaucgagcagaucgaggauauggugaccacagccucaaccuaucuguuugaggcuaccgaaaaacgcuuuuuuuuuaaaaaugugagcauuuugauucccgagaacuggaaggagaauccccaguacaaaagaccuaaacacgaaaaccacaaacacgcugaugugaucguggccccuccaaccuuacccggucgcgaugaacccuacacaaagcaauucacagaaugcggggaaaaaggagaauacauacauuuuacgcccgaucuccugcucggaaaaaaacaaaacgaauacggaccucccgguaaacuguucguucacgaaugggcacaucucagauggggaguguuugaugaguacaacgaagaccaaccauucuaucgagccaaaucuaaaaagaucgaagcuacccgcugcagugccgggauuucuggccggaacaggguguauaaaugccaaggggggagcugucucucacgggcuuguagaauagacucaaccacaaagcuguaugggaaggacugccaguucuucccagauaagguccaaaccgaaaaagccucaaucauguuuaugcagagcauugauucugucgucgaauucuguaaugagaagacucacaaccaggaggcucccucccugcaaaacauuaagugcaauuuccgcaguaccugggaagucaucaguaauuccgaggacuuuaagaauacuaucccuaugguaacuccuccuccuccaccuguuuucuccuugcuaaagauaucgcagaggauugugugccugguguuggauaaguccggcucaaugggcggaaaggaucgucuaaaucggaugaaucaggccgcuaagcauuucuugcuccaaacagucgaaaauggaaguugggugggcauggugcacuuugauuccaccgccacuauuguaaacaaauugauacagauuaagucuucagaugagagaaacacacugauggccggacuccccaccuauccauugggaggcaccuccauuuguaguggcaucaaguacgccuuccaggucauuggagaacugcauagccagcuggacggcuccgaaguucuucucuugacugacggugaggacaacacagcauccagcugcauugaugaaguaaagcagucuggcgccauugugcauuuuauugcccugggcagggcagcagacgaggccgugaucgagaugaguaagauuacgggaggaagccacuucuacguauccgacgaagcacagaacaauggacucaucgacgcuuucggagcucugacuaguggcaauaccgaccuuagucaaaagagccuucagcuugaaaguaagggacugacgcucaacuccaacgcguggaugaacgacaccgugauuauugacucuacaguuggaaaggacacguuuuuccucaucaccuggaauucucugccucccaguaucucacuuugggacccuucagggaccauuauggagaacuuuaccguugaugcgaccucuaagauggcuuaucugucaauccccggcaccgcaaaggugggcacaugggccuacaauuugcaagccaaagcuaaucccgagacucugaccaucaccgugacgaguagagcggccaacucuucagucccaccaaucacaguuaaugccaagaugaauaaagauguuaauucuuucccuuccccuaugaucguguaugcugaaauucuccagggguacgugcccgugcugggugcaaaugucacugcguuuaucgagagucaaaacggccauaccgaaguguuggagcuguuggauaauggggccggugcagacucauucaagaaugauggggucuacagucgauacuuuaccgcauacaccgagaacggaagauacucacucaaggucagagcucacgguggggcuaacaccgcaaggcugaaacugcgccccccauuaaauagggcagccuauauaccuggcuggguggugaacggcgagaucgaggcuaacccaccgagacccgaaaucgaugaggacacucaaacuacacucgaagauuucucccgcacagccucggguggugcauuugugguaagccaggugccaagucuccccuugccugaccaguaccccccuucacagauuacagaccuggaugcaacuguucacgaagauaagaucauucuuaccuggacagcuccuggagauaacuucgacguggguaaggugcaaagauauauuauacggaucucugccagcauccuugacuuacgagauaguuucgaugaugcccuacaggucaauaccacagaccugucucccaaggaagcuaacuccaaagagucuuuugccuucaagcccgaaaacauuucugaagaaaaugcuacccacauuuucauugcgauaaaguccaucgauaagucuaaucuuaccaguaaggugucuaacaucgcucaagugacauuauuuauaccccaggcaaauccugacgauaucgacccuacccccacccccacuccuacucccaccccagacaaaucccauaauaguggcguuaacauaucaacacugguccugucuguuauuggcucagugguuauagucaauuuuauccuaagcacuacaauauag

SEQ ID NO: 12408 - RNA, 1938 nt, Artificial Sequence
  Description of Artificial Sequence: Synthetic coding sequence
auggccccauccgcggacccggggaugucacgcaugcugcccuuucuuuuacuauugugguuucugccuaucaccgaggguucccaacgugcugagccuauguucaccgccgucaccaacuccgugcugcccccugauuaugauuccaauccuacacagcuaaauuauggcgucgcugugaccgauguggaucacgacggggauuucgagauugugguugccggauauaauggcccuaauuuaguacugaaguaugauagagcucagaagcggcuagugaauaucgcuguagaugaacgcucaagcccuuacuacgcccugcgggauagacaagguaaugccaucggggucacagcuugcgacaucgauggcgauggaagagaagagaucuauuuccugaacacaaacaaugcuuucaguggcguggccacuuauacugauaagcuguuuaaauucagaaauaauagaugggaagauauauugucggacgagguaaacguggccagagggguggccucuuuauuugcaggucggucaguugccugcguugaucgcaaaggcagcggcagauauagcaucuacauagcuaacuaugcuuaugguaacguuggucccgacgcccucaucgaaauggauccagaagccagcgaucuaucucgcggcauccuagcucugcgagacguggccgccgaggcuggugucagcaaguacacggguggcaggggcgucuccgugggcccaauacugaguaguagcgcaagcgacauuuuuugugauaaugagaacggcccgaacuuucuguuucauaaccgcggagaugguacguucguggaugcugcagcuagcgcaggcguagacgauccucaccagcacggccguggugucgcucuggcagauuuuaaucgagaugggaaggucgauauagucuacgggaacuggaacgggccucacagacuuuauuugcagauguccacccacgggaaagugcgauuccgagacaucgcgagucccaaauucucuaugcccuccccaguccgcacugucauuacggcugauuucgacaacgaucaggaguuagagauauuuuuuaauaacauugcauaccgaucauccagcgcaaauagacucuuccgcgugauacgacgugaacacggcgauccuuugauagaagagcugaauccaggagaugcccuggagccagagggccggggcaccggcgggguuguuaccgacuucgauggcgaugggaugcuugaucugauuuuaagucacggcgagucuauggcgcagcccuugucaguguucagaggcaaucagggguuuaacaacaacugguugcggguggugccaagaacaagauuuggggccuuugcucgaggugcaaagguggugcuguacaccaaaaagucaggcgcacauuugcggauaaucgacggcgggucuggauacuugugcgagauggagccaguagcccacuucggccucggaaaggacgaagccucgucaguugaaguuacuuggccugacgguaagauggucucucggaacguggcuaguggugagaugaauaguguucuggaaauucuguauccacgggaugaggauacuuuacaggaccccgccccucucgaauguggccagggguuuagucaacaggagaauggccauugcauggauacaaaugaauguauccaauucccauucguguguccacgcgauaagccggucugcguuaauaccuacggauccuaucgaugccggaccaauaagaaaugcagucgcggcuacgaaccuaaugaggacgggacugccuguguugcacaggucgccuucuuggggggcuauuccuccgcagccagcaggauuagugaaccgcugucucgagcaucauaucugucacugggucuggggcuuugcuuacaacucuaugcucucuag

SEQ ID NO: 12409 - RNA, 1986 nt, Artificial Sequence
  Description of Artificial Sequence: Synthetic coding sequence
auggcuccuuccgccgaccccggcaugagccgaaugcucccguuccugcugcuucucugguuucuucccauuacggagggcucucagcgcgccgaaccaauguuuacugcagucacuaacucaguccugccaccagacuaugauucuaaccccacacaacugaacuauggcguggcugugacagauguggaucacgacggggauuucgagauugucguugcuggguacaacggucccaaucuuguucucaaauacgaccgcgcccagaagcgucuagugaacaucgcaguggaugagaggucuaguccuuacuaugcucuaagagaccgccaggggaaugcaauugguguuaccgcaugcgacauagauggcgacggaagggaggaaaucuacuuucuuaauacaaacaaugccuuuagugggguugccacauacaccgauaaacuguucaaauuuagaaauaauaggugggaagauauucuaagcgaugagguaaauguugcccggggcguggcgucacuauuugccggcaggucuguggccugcgucgacagaaaaggcucgggccgguacagcaucuauaucgcuaauuacgccuauggcaauguaggaccagacgcccugauugaaauggauccugaagccuccgaccugucacggggaauuuuagcccugcgcgauguggcggccgaggcuggugucucuaaguauacggggggcagggguguaucuguugggccuauucugucaucaagcgcuucggauauuuucugugacaacgaaaacggaccgaauuuucucuuucacaaucguggugauggcaccuucguagaugccgccgccuccgccggcguugacgacccccaccagcauggcaggggaguggcacuugcggacuuuaaucgugacggcaagguggauauugucuacggcaauuggaacgguccucaucgccuguaccuccagaugagcacccaugggaaagugcgcuucagggacaucgcaagucccaaauucagcaugccuagcccugugaggacugugaucacagcugacuuugacaacgaccaagaguuagaaauuuuuuucaauaacaucgcauauaggagcucgagcgcaaaccgguuauuccgugugauccgccgggaacacggggacccccuaaucgaggaacuuaaucccggagaugcucuggagcccgaagggcgaggaacggguggugugguaaccgacuucgauggcgaugggaugcuggacuuaauccugucccauggagagaguauggcccagccccucuccgucuuccgcggcaaccagggcuuuaacaacaacuggcuccggguugucccuagaacgcgguucggugcguuugcucgcggggccaagguugugcuguacacuaaaaagucaggggcccaccuccguauaauugauggcgggucaggcuaucugugcgagauggagcccgucgcacauuucggcuuagggaaggacgaagccaguucaguugaggucacauggccugauggcaaaaugguuaguagaaauguugcgaguggggaaaugaauagcguucuggaaauccuguacccgcgagacgaagacacucugcaagaccccgccccucucgagugcggccaaggguucucucagcaggaaaacggacacugcauggacacuaacgaaugcauucaguucccuuuuguaugcccgcgagauaaaccuguuugcguuaauaccuacggauccuacagauguagaacuaacaagaagugcucgagagguuacgaacccaaugaagacgguaccgcguguguaggaacccucggacagucaccagguccccggcccacuacccccacugcugccgccgccacugccgccgcugcugccgccgccggagccgcgacugcugccccuguguugguggacggagacuuaaaucuuggaagugugguuaaagaaagcugcgagccaaguugcuag

SEQ ID NO: 12410 - RNA, 1230 nt, Artificial Sequence
  Description of Artificial Sequence: Synthetic coding sequence
auggcauugacuccaggauggggcucuagcgcagguccaguucggccagagcuuuggcuacugcugugggccgccgcguggcgauuaggugccagugcguguccugcccuaugcaccugcaccgggaccacuguggacugucauggaacuggguugcaggccauuccaaagaacauaccuagaaacaccgagaggcucgaacugaacgguaacaauauaacaaggauucauaaaaaugauuucgccggccugaagcaacuuagagugcugcagcucauggagaaucagauuggcgcuguggagcggggcgccuucgacgauaugaaagagcuggaacgccuucgucugaauagaaaucagcugcauauguugcccgagcugcuauuucagaacaaccaagccuugagccgccucgaucuguccgaaaacgccauucaggcuaucccucguaaagcauuuaggggcgcuaccgaccucaaaaaucuccagcuggacaagaaccagauuucgugcaucgaggaaggggcuuucagagcccugagagggcucgaaguuuuaacgcuuaauaacaacaauaucaccacuauuccuguauccuccuucaaccacaugccuaagcuucgaacuuucagguugcacuccaaccaccucuucugcgacugucaucuggcuuggcuuucccagugguuaaggcagcggccaacuaucggccuguuuacccagugcaguggccccgcuagucuccgggguuugaauguugcugagguccagaaguccgaauuuaguugcucuggacaaggggaagcuggacgcgugccuaccuguacccugucauccgguuccugcccugccaugugcaccugcagcaacgggaucgucgauugucgaggaaaaggucucacagcuauccccgccaaccucccugagacuaugacagagaucaggcuggaacugaacggcauuaagucuaucccgccaggcgccuuuaguccauauagaaagcuccgccgcaucgaccugaguaacaaucagauugcggagaucgcuccugaugcuuuccagggucuucgcagucucaacuccuugcauaccgggcccgucacaugcccacauacaacaggcacgcacuccagucacugcagagcguuugcuguggccgucccucacucucgcaaugaucuugaggcuauguuugaagaggaagugccucggauuuucuauucagcguag

SEQ ID NO: 12411 - RNA, 1143 nt, Artificial Sequence
  Description of Artificial Sequence: Synthetic coding sequence
auggccuuaacuccaggaugggggucaagcgcuggaccugugcggccugagcucuggcuucugcucugggcagcggcuuggcggcugggcgcaucugcaugucccgcucugugcacaugcaccggcacgaccguggacugccaugguaccgggcugcaagcgauuccuaagaacauuccgcggaacaccgagcgacuggaauugaacgggaacaacaucacacggauacacaagaacgacuucgcggggcugaaacaguugagaguacugcagcugauggaaaaucagauaggcgcaguagagagaggcgcauuugacgauaugaaggaguuggagagacuggaccugagcgaaaacgccauucaagcuauacccagaaaagccuuucgcggcgcgacggaccugaaaaauuugcaacuggauaagaaccaaaucucuugcauugaagagggggcauuccgagccuuacgcggacuugaagugcucacauugaauaauaacaauaucacuaccauaccuguguccucuuucaaucauaugccaaaacugaggacauuucggcugcacagcaaccaccucuucugcgauugucaccucgccuggcuaucacaguggcucagacagcgccccacuauaggauuguuuacacaauguucuggcccugccagccugagaggccuaaauguggcggaggugcagaaauccgaauucucuugcucaggacagggggaagcuggccgggugccgaccuguacccucucuucaggaagcugucccgcuaugugcacauguucuaaugguauuguugauugccgugguaaaggacuaaccgccauccccgcuaaccucccggagacaaugaccgaaauuaggcuugagcucaacgggaucaaauccauccccccaggcgcauucucacccuaccguaaacuucgaaggauugaccugagcaacaaucagaucgccgaaauugccccugacgcauuucagggauugaggucucucaacagcuuggugcuuuauggcaacaaaauuacugauuuacccaggggcguuuuugguggguuauauacguugcagcuuuuacuuuuaaacgcaaacaaaauuaauugcauacgaccugaugcuuuccaggaccucuag

SEQ ID NO: 12412 - RNA, 2448 nt, Artificial Sequence
  Description of Artificial Sequence: Synthetic coding sequence
auggcacucacacccggguggggcuccuccgccggacccguucgcccagaacuguggcugcuuuugugggcagcugccuggcgccuuggagcaagcgccugccccgcucuguguacuugcacagggaccacaguggacugucauggcaccggguugcaggcuaucccuaagaauaucccacgcaauaccgaacgucuggaacugaauggaaauaauauuacucgcauccacaaaaaugauuucgcuggccuuaagcaacucaggguacuacagcugauggaaaaccagaucggugcaguggaacgaggcgccuucgaugauaugaaagaauuggagcgacugcggcucaaccggaaucagcugcauaugcuucccgaacuccuguuccaaaauaaucaagcccugucuagacucgaucuuagugagaaugcaauucaggccauaccacgcaaagcauuucgcggggcaacugaucucaagaaucugcagcuagacaaaaaccagaucaguugcauugaagagggugcauuuagggcuuugcgcgggcucgagguucucacacuaaauaacaacaauaucaccaccaucccuguaucguccuuuaaucauaugcccaagcuuagaacauuuaggcuucauagcaaccacuuauuuugugacugucaucucgcauggcucucccagugguugcggcaacggcccacuaucggcuuguucacucaaugcucuggcccagcuucccuacgcgggcugaauguagcggaggugcagaagucagaguucucaugcucaggccagggggaagcaggacgugugcccaccuguacccucucaucaggguccuguccugcaaugugcaccugcagcaauggaaucgucgacugccgcgggaaaggacugaccgcuauuccugcaaaccugccagaaacuaugaccgagauccgacucgagcucaauggaauuaagucuauuccaccgggcgccuucucccccuaccgcaaacugaggcgcauuugcccucuuagcuucugcaguccaugcagggaucucucgaacaaucagaucgcagaaaucgcccccgacgccuuucaaggucugagaagucucaacagcuuaguucuguacggcaacaagauaaccgaccugccuagagguguauucggagggcuguauacacugcaacuucuccugcuuaacgcaaacaaaauuaacuguaucagaccugacgcauuucaagaucugcagaacuugucucugcugucucuguaugacaacaagauccaguccuuagcgaaaggaaccuuuacuucacugcgggcgauccagacucuccaccucgcucagaaucccuucauuugugauuguaaccugaaguggcucgccgacuuccugaggacaaacccuauugaaacaucaggcgcuaggugugcaucucccagacgacuggccaacaagcguauagggcagauuaaauccaagaaauucaggugcagugcuaaggagcaauauuucaucccagggaccgaagauuaucaacugaacagugaauguaauuccgaugucguguguccucacaagugcaggugcgaagcaaacguuguugagugcucaucuuuaaaacuuacuaagaucccagaaaggaucccccaguccacggcugagcucaggcuaaauaauaaugaaauuaguauccuggaggccacugguauguucaaaaagcucacgcaucugaaaaagauaaaucugagcaauaacaaagugucagaaaucgaagauggggcuuuugaaggcgcugccuccgugagcgaguuacaccuuacugcuaaccaacuagagucaaucagguccggaauguuucggggccuugauggcuuacgaacucuaaugcugcguaacaaucggaucucuuguauacacaacgauaguuuuacuggguuacguaacguccggcuccuguccuuguacgacaaucagaucaccacaguaagccccggggccuucgauacucuucagagucucuccacgcugaacuuacuggcaaauccuuuuaacugcaauugccagcuugcauggcugggaggcuggcuucguaagagaaagauugugacaggaaauccccgcugccagaacccugacuucuugcgccagauuccucuccaagacgucgcuuucccugacuuucggugugaagaaggucaggaagaaggagguugucucccccgcccccaguguccucaagagugcgccugucuggacacuguagucagauguaguaacaagcaccuuagggcccugcccaagggcauuccaaaaaaugugaccgaguuauaucuggacggcaaccaguuuacgcuaguuccuggucaacugucgacuuuuaaguaccugcagcuaguaauccucuccuacaacgcacuccaguguauuccgccgcuggcuuuucaauag

SEQ ID NO: 12413 - RNA, 4386 nt, Artificial Sequence
  Description of Artificial Sequence: Synthetic coding sequence
auggcuuugacaccaggcuggggaucaagcgcgggccccguucgacccgagcuuugguuacugcugugggcugccgcauggcgacuuggagcuagugcuuguccugcgcugugcacauguacagggacuacuguggacugccacggcaccggacuacaagcaauuccuaagaauauucccaggaauaccgagcgacucgaacuaaacgggaauaacauaacccggauucacaagaaugauuuugccggauuaaagcagcuccgcgugcuucagcuuauggagaaucagaucggagcuguggagcgcggcgccuuugaugacaugaaggaacucgaaagauugagacugaacaggaaccagcugcauaugcucccugagcuccuguuccagaacaaucaagcucuuagucgacucgauuugagugaaaacgcaauacaggcuaucccucgcaaggccuuccggggcgcuacugaucugaagaaccugcagcucgauaagaaccaaauaucaugcaucgaagagggagcauucagggcccugcggggccucgaggugcugacgcuaaacaauaauaauauuaccacaaucccuguguccuccuuuaaccacaugccgaaguuacggacauuuagguugcauucgaaucaccucuucugcgacugucaccuggccugguuaucccaguggcugcgacagcgccccaccaucggacuauucacccagugcuccgggcccgccucccugcgcggccugaacguggccgaaguucaaaaaucugaguucucuuguucuggacaaggcgaggcuggaagaguucccaccuguacucuuuccucagggagcugccccgccauguguaccuguucaaacggcauuguggauuguagaggaaaaggccucaccgcuauccccgccaacuugcccgaaacuaugaccgagauccggcuggagcugaacggcaucaagucuauuccuccaggcgcguuuuccccauauagaaaacuuagaagaauugaccucagcaacaaucagauugccgaaauagccccugacgcuuuucaaggccugagaucccugaacucacugguucuuuacggaaacaaaauuaccgaccuuccuagaggggucuuuggcggccuguacacccuucagcugcuguuacuuaacgcaaacaagaucaacugcauccgcccugaugcauuccaggacuuacagaaucuuucacuuuuaucuuuguacgacaauaagauacagucccuggcgaaggggaccuuuacuucccuucgggcgauccagacacugcaucucgcccagaacccuuucauuugugacugcaaccucaaaugguuagcugauuuucuucggacaaaucccauugaaacgagcggggcgcgcugugccuccccgaggagacucgcuaauaagagaaucgggcaaauaaagucaaagaaguuuagaugcagugcuaaggagcaguauuucauucccggcaccgaggauuaccagcuuaauuccgaguguaauucagacgugguguguccacacaagugucggugugaggcaaauguuguugaaugcaguucccugaaacugacuaaaaucccggagcgaaucccgcaaucaaccgccgagcugaggcuuaacaauaacgagauaucaauucucgaagcuaccgguauguucaaaaaacugacucaucucaagaaaaucaaccugucaaacaacaaggucucagagauugaggauggagcauuugagggugcugcaucaguuagcgagcuucauuuaacagcaaaccaguuggaaagcauucgcuccggcauguuuagagguuuggacgggcuaaggacccuuaugcugcggaauaaccguaucucuuguauacauaaugauuccuucacgggucuuagaaacguccgccuccugucuuuauaugacaaucagauuacuacagucagccccggcgcguuugauaccuuacaaucucucagcacccuaaauuugcuggccaaccccuucaauuguaacugccagcucgcaugguuaggcggguggcugcgcaaaagaaaaauagucaccgggaacccgcgcugccagaacccugauuuuuugcgccaaauuccacuucaagacguugccuuuccugacuuccgaugcgaggagggacaggaggaaggggggugccuaccucgcccucaaugcccucaggaaugcgccugccuggacacagucgucagauguuccaacaaacaccuaagagcacuucccaaaggcauaccaaaaaaugucacugaacuauaccuggacggaaaucaguucacccucguucccggucaguugucuacauucaaauacuugcaacucgucgaccuguccaauaauaaaauuucuagucugagcaauucaagcuucacaaauaugucucaguugacuacauuaauuuuaucguacaacgcgcuucaguguauccccccucuggccuuccaaggcuuacgauccuugagacugcucucccuccacggaaacgauaucucuacccugcaggaaggaaucuucgcugaugucacgagccuuucacaccucgccauaggugccaauccacuguacugcgauugccauuugcgguggcuuucgagcugggugaagacggguuauaaagagccggguaucgcccgcugcgcaggaccacaagacauggaagggaaacuccugcucacaacuccugcaaaaaaauucgagugccaaggcccaccuacacuggccguucaagcaaaaugugaccuauguuuaucgucccccugucagaaccaaggcacuugccacaacgaccccuuagagguauaccggugcgcuugcccuagcggcuauaaagggagagacugugagguuucgcucgacaguuguagcucuggcccuugcgagaauggaggaacaugccacgcacaagaaggggaggaugccccguuuacguguagcuguccuacaggguuugaaggcccgacguguggcgugaacaccgaugauuguguagaucaugccugugccaacggugggguauguguugacggagucggcaauuacaccugccagugcccuuugcaguacgagggcaaggccugcgagcagcuuguggaccucugcucaccagaucuuaacccaugucagcaugaggcccaauguguugggacuccagacgggccuaggugugagugcaugccagguuaugccggcgacaauugcucugagaaucaggacgacugccgcgaccaucguugccagaauggcgcacaauguauggacgagguuaauagcuacagcugccugugugcugagggauacucuggccagcucugugaaauuccaccgcauuugccugccccgaagucccccugcgaagggaccgaaugccagaauggggcgaauuguguagaccaagggaauaggcccgugugccagugccugccgggcuuugggggucccgagugugagaaguuacuuagcguaaauuuugucgacagggacacuuaucuccaauuuacagaccuccaaaacuggccgagggcuaauauuacacugcaaguguccaccgcugaagacaacgggauccuccuuuauaacggcgauaacgaucacaucgcaguugagcuuuaccagggccacgugcgaguaucauacgacccuggcucguaccccucuucagccauauauagcgcagagacgaucaaugacggacaguuucauacaguagagcugguugccuuugaccaaauggucaauuugagcauagauggcgggagccccaugacaauggauaauuuuggcaaacauuauacacuuaacucggaggcaccgcuauaugugggggggaugccggucgaugugaauuccgcugcauuucgccuguggcaaauuuugaauggcacaggauuccacggcugcauaaggaaucuuuacaucaacaacgaauuacaggacuucacaaagacccagaugaagcccggggugguuccuggcugcgagccaugccgaaaguuguacugccuccacgggauuugccaaccaaacgcaacaccuggaccaaugugccacugugaagcugguugggugggccuucauugugaccagccggcagaugggccuugccauggucacaagugugugcacggacagugcgugccacucgaugccuuguccuacaguugccagugccaggacggcuacucuggcgccuugugcaaccagucuccuucggcgggcggcacacucucugggacguucacgcgaucccggggggccaugccauccgcucgaccacgugccccuugccacggcuggagcgccggagcccgagcucaggcccgcgcagccgcccgggcuuuuggauag

SEQ ID NO: 12414 - RNA, 570 nt, Artificial Sequence
  Description of Artificial Sequence: Synthetic coding sequence
auggaggccacugggacagacgaggucgacaaacugaagacaaaauuuauauccgccuggaauaauaugaaauauagcugggugcugaaaacaaagacuuacuuuucuagaaauucaccaguucuucucuugggaaaaugcuaccauuucaaguaugaggaugaggauaaaacucuucccgcagagucugggugcaccaucgaagaucacgucaucgccgggaauguggaggaauuccgcaaagacuuuauaaguagaauuuggcucaccuacagagaggaauucccucagaucgaggguagugcucugaccacggacuguggauggggaugcacgcuucgaaccggacaaaugcugcuggcccagggacugauucugcacuuucuuggccgcgcuuggaccuggcccgacgcccugaacauugaaaauucagacucugaaucguggacaucacacacugucaaaaaguucacagcaagcuucgaagccagucugucuggugaacgcgaauuuaagacgccaaccaucagccuuaaggagacaaucgggaaauacagcgaugaucacuag

SEQ ID NO: 12415 - RNA, 1377 nt, Artificial Sequence
  Description of Artificial Sequence: Synthetic coding sequence
auggaggccacagggacagaugaaguggauaaacugaagacuaaauuuauaagugcguggaacaauaugaaguacucuuggguucugaaaacuaaaaccuacuuuucaagaaauagccccgugcugcuccuugggaaaugcuaccacuucaaauacgaagaugaagacaaaacccuaccagccgaguccggauguaccaucgaagaccaugucaucgcagguaaugucgaggaauucaggaaagauuuuaucucccgaaucuggcugaccuacagagaggaauuuccucaaaucgaaggaucagccuuaacgaccgacuguggauggggcugcacacugcgaacaggucaaaugcugcuggcccaggguuuaauccuccauuuccucgguagggccuggaccuggcccgaugcgcucaacaucgagaauuccgacucugaguccuggacaucacauacagucaagaaauucacggcaaguuucgaagccucccuuuccggcgagcgggaauuuaaaacccccaccaucucucugaaggagaccauaggaaaguauagcgacgaucacgagaugaggaaugagguguaccaucgaaaaaucauuaguugguuuggcgacagcccucuggcucucuuuggacuccaccagcuuauugaauacgguaaaaaaagcggaaagaaagcuggcgacugguauggucccgccgugguggcucauauccugcgaaaggccguggaggaggcaaggcacccagaccuucagggaaucacuaucuacguagcccaagauuguaccguuuauaacuccgaugugaucgacaagcagagugccaguaugacuagugacaaugcagacgacaaagcggugaucauucuagugccagugcgccuuggaggagaacgcaccaacacggauuaucuggaauucgugaagggcaucuuguccuuagaguacugcgugggaaucauuggcggcaaaccuaagcagucuuacuacuucgcuggauuucaggaugacagucuaauauauauggauccccauuacugccaaucauucguggaugugucuaucaaagacuucccucuagagaccuuucauugcccgucaccaaagaaaaugagcuuccggaagauggacccaaguugcacuaucggauuuuauugccggaacgugcaagacuucaagcgggcauccgaggagauaacaaagaugcuuaaguuuucuucgaaagaaaaauauccucuguucaccuucgugaacggucauagcagagauuacgacuuuacaucaacaaccacaaacgaagaggauuuauucuccgaagacgaaaaaaagcaacuuaaacguuuuuccacagaagaguucguucucuuauag

SEQ ID NO: 12416 - RNA, 8178 nt, Artificial Sequence
  Description of Artificial Sequence: Synthetic coding sequence
auggagcagacagacuguaaaccauaccagccgcugccgaaagugaagcacgagauggaucuugcuuacacaaguagcagugacgagagugaggacggaagaaaacccagacagucuuauaauaguagggagacgcuccaugaguauaaccaagaacugcgaaugaacuauaacucacaaucuagaaagaggaaggagguggaaaagaguacccaggaaauggaguucugcgaaacuucccauacccuuugcuccggguaccagacagauaugcacuccgucucucgacaugguuaccagcuugagaugggcagugaugucgacacagagacagagggugcagccucaccugaccacgcccugagaauguggauaagaggaaugaagucagaacacucgucuugcuuguccucccgggccaacucagcacucagucuuaccgauacugaccaugagcguaaguccgauggcgaaaacggcuucaaauuuagcccuguguguugugacauggaagcucaggccggaucuacccaggauguucaguccucgccucacaaucaauucacauuucgcccucugccaccaccacccccuccaccucaugcuugcaccugcgcucggaagcccccccccgcggccgacagccugcagcgcagaagcaugaccacucguucccaaccuagcccagcagcucccgcaccuccaacuagcacucaggacaguguucaucuucauaacagcuggguccucaauaguaauauaccuuuggaaacucgccacuuucuguucaagcacggauccggcucaagugcgauuuucagcgcugcaucacagaacuauccacuuacuucuaacacuguguacagccccccaccacggccccugcccagguccacuuucagucgcccugcuuucacuuucaauaaaccuuauagaugcuguaacuggaaguguacugcucucucagccacagccauaaccgugacucuugcacuccuauuggcuuacguuauagcagugcaccucuuuggacugacuuggcagcuucagcccguugagggggaacucuaugcgaacggggugagcaaggggaaucgaggaacagaaaguauggauaccacuuacucaccaauagggggcaagguuagugacaagagugagaagaagguguuccaaaaaggccgcgccaucgacacuggcgaggucgacaucggagcacaggucaugcagacgaucccccccggucuauuuuggagguuucagaucaccauccaccacccuauuuaucucaaauucaacaucucuuuagcaaaggauucucuguuaggcaucuacggccgcagaaacauaccaccgacucacacccaguuugauuucgugaaauugauggacggcaagcagcugguuaaacaagauagcaagggcuccgacgacacucagcacagcccccggaaucugauacugaccagcuugcaagagaccggcuucauugaauacauggaccagggaccuugguaucuggcuuuuuauaacgacggcaaaaagauggaacagguuuuuguacuaacuaccgcaaucgagaucauggaugacuguucgacuaacugcaaugggaauggggagugcauaucuggacacugccauugcuucccugguuuccucggaccugauugcgccagggacuccuguccgguacuaugcgggggcaacggagaguacgaaaaaggucauugugugugccggcauggcuggaagggcccugaaugugaugugccagaagaacaauguaucgaucccacuuguuucggccacggcacgugcauuaugggugucugcauauguguuccuggauacaagggagagaucugcgaagaggaggacugccuugauccuaugugcucuaaucacgguaucugcguuaagggagaaugucauugcuccacuggcugggguggaguuaauugugagacaccacugcccguaugucaggagcagugcagugggcacggaacuuuucuccucgacgcugggguguguucuugugacccuaaauggacaggcagugauuguagcaccgaauuaugcacaauggagugcggcucccacgguguuugcucuaggggaaucugucagugugaagagggcugggucggccccaccugcgaggaacgcucaugucacucucauugcaccgagcacggccagugcaaggauggcaaaugcgaaugcucgcccgggugggagggugaucauugcaccauugcucacuauuuggaugccgugagagacggcugccccggacugugcuuugguaacggcagaugcacauuggaucaaaauggcuggcauugugucugccaggugggcuggagcggcacuggcugcaauguggugauggagaugcuguguggcgacaauuuggacaacgacggggaugguuugacagauuguguugauccugacugcugccaacaguccaauugcuauauuuccccuuugugccagggcagccccgacccccucgaccucauccagcagucucagacccuuuucagucagcacaccagccgccuuuuuuacgaucggaucaaguuucugauugggaaggacagcacucacgugaucccacccgaggucagcuucgacucgaggagagccugcgugauuagaggccaggucgucgcuauagacggcacaccgcucgugggcgucaaugugucuuucuugcaccacuccgauuacggcuuuacuauuuccagacaggaugggaguuuugauuuagucgcuauuggcgggaucagcgucauucucauauuugacagaucuccguuccuacccgaaaaacgaacccucuggcugccguggaaucaguuuauagucguagagaagguaaccaugcagcgagucguaucugacccacccaguugugacauaucuaacuucauuaguccaaauccgauugugcugcccuccccucuuacaucauucggcgggagcuguccugagaggggcacgaucgugccugaacuccagguagugcaagaagaaauucccauaccuuccaguuuugugagacucucuuaucucagcucccgcacuccaggcuauaagacucugcugcgcauacuccugacacacagcacgaucccaguugggaugaucaaaguccaucugaccgucgccgucgaaggacgucugacccagaagugguucccagcagcaaucaaccucguauacacuuuugcauggaacaagacagacauuuauggacagaaaguauggggacuugccgaagcgcuggugucggugggauacgaguacgaaacuuguccugauuucaucuuaugggagcagcgaaccgugguguugcaggguuucgaaauggacgcauccaaucuugguggguggucccucaacaaacaccacauccugaauccccagagcgguaucauucacaaggggaauggagagaauauguuuaucucccagcagccaccaguuauuaguacgauuauggguaacggacaucagcgauccguggcaugcacgaacugcaacgggccugcccacaauaauaaacuauuugccccugucgcacuugcaagcggcccggaugggucagucuaugugggcgacuuuaauuuugugcgccgcauauuucccagugggaauagcguaaguaucuuagagcuuucuacaucacccgcucacaaguauuaucucgcaauggacccagucucugagucucuuuaucugagcgacacaaauacgagaaagguguauaagcugaaaagccucguagaaacaaaggaucugucuaagaauuuugaggugguagcugguaccggugaucaaugucugcccuucgaucagucacacugcggagaugguggacgagcauccgaggcaagccugaauagcccuagggggaucacagucgauagacauggguuuauuuauuuugucgacggaaccaugauacgcaaaaucgacgaaaacgccgugauuacaacugugauaggcagcaacgggcuuaccuccacacaaccgcugucuugcgauucuggcauggacaucacgcagguacgucuagaauggccgacugacuuggccgugaauccuauggacaacuccuuguacgugcuagacaacaauauuguacugcagaucucugagaauaggcgcgugcggauaaucgcuggacgaccaauucacugccagguucccggaauagaucacuuucucguguccaagguagcaauacauuccacucuugaguccgcgcgcgccauuucugugagucacagugggcuuuuguucaucgcagagacagaugagaggaagguaaaccgaauccagcaagugaccacuaauggggagaucuacaucaucgcgggagcacccaccgacugcgacugcaaaaucgauccuaacugugacugcuuuucuggagacgguggcuacgcaaaggacgccaaaaugaaggcccccaguucucuagcugucagcccggacggcacuuuguauguggcagaucucggcaauguacguauuagaacuaucagcaggaaccaggcccauuugaaugacaugaauauuuaugagauagcgucaccugcugaccaggaacuguaccaguucacaguuaauggaacucaucuucauacccucaaccucaucaccagagacuacguuuauaauuucacuuauaacucugagggagaucugggagccaucacaaguucgaauggcaacuccguccauauaaggcgggacgccggcgggaugccucuguggcuaguagugccgggugggcaggucuacuggcugacaauuucuaguaacggcgugcucaaacgagugagcgcgcagggcuacaaucuugcccuuaugacuuacccaggaaacacagggcuccuggccacgaaauccaaugaaaauggauggacaaccguguacgaauacgacccugaaggacaccuaacuaaugccacauuuccuaccggugaagucucuagcuuccacuccgaucucgaaaaacugaccaaaguggaacuggauaccuccaaccgggagaauguucugaugagcacaaaucugacugcgacaucuaccauauacauacuuaagcaagagaacacacaauccacuuaccggguuaauccagauggaucuuugcgggugacauucgcuucaggcauggaaaucggguuauccucugaaccccacauacuggcuggcgcagugaaucccacucuuggcaaaugcaacauuagccuuccgggggagcacaacgcuaaccucauugaguggcgacagcgcaaagagcagaauaaggggaacguuuccgcauuugaacgaagacuucgggcacauaaccgcaaucuccugaguauagauuuugaucauauuaccaggaccggaaaaauauaugacgaucaucguaaauuuacgcugagaauccuguaugaucaaacuggccgacccauucuuuggucaccuguuucuagauacaaugaggucaauaucacguacagucccagcggccucguuaccuucauccagaggggaaccuggaacgagaaaauggaauaugaccaguccggcaaaauuaucucgcgcaccugggccgacgggaaaauuuggagcuauaccuaccuggagaagucugugaugcuccugcugcauagccagcgccgguacaucuucgaauacgaucagccagauugccuucucagugugaccaugccgaguaugguacgucacucacugcagacuaugcugagcgucggauauuaccgcaacauuuacacuccacccgauuccucuacuucauucauccaagauuacucucgggacgggcgucuccuucaaacacugcauuuagggacuggccguaggguacuguauaaguauaccaaacaggccagguugagcgaaguucuauacgacacgacucaagucacgcugaccuaugaagagagcucagggguaauaaagacgauccaucugaugcacgacggguuuauauguaccauccgguaccgucagaccgguccgcuuauagggcgccagauuuuccgauuuucggaagaagggcugguuaaugcgagauuugacuacagcuauaauaacuucagggugaccuccaugcaagcagugauuaaugaaacaccucuuccaaucgaucuauacagguaugucgaugugagcggcagaacggaacaguucggaaaauuuuccguaaucaacuaugauuugaaccaagugauuacgaccacagugaugaaacacacaaaaaucuuuagcgcuaacgggcaggucauugaggugcaguaugaaauuuuaaaggcgaucgccuacuggaugaccauacaauaugacaacguugggaggauggucaucugugauauaagagugggagucgacgccaacauuaccagguauuucuacgaguaugaugccgacggccaguuacagaccgugagcguaaacgacaagacccaguggagauacagcuacgauuugaaugggaacauaaaccuauugagccacggcaaaucagcuagacuaacuccuuuacgcuaugaccucagggacagaaucacacgacucggagagauccaauacaagauggacgaggaugguuucuuaagacagcgcggcaaugacaucuuugaauacaacaguaaugggcugcuacagaaagcauacaauaaagcuaguggguggacaguucaauauuauuaugacggucuaggucgaaggguagcuucuaagagcucucugggacagcaccuucaauucuuuuacgcagaccugaccaaucccauccggguuacacaccucuauaaucauacuuccagcgaaaucacgucccuguauuaugaccugcaggggcaucugauugcuauggagcucucuucuggagaagaauacuacgucgcuugcgacaauacuggaacuccacuggccguguucucuaguagaggccagguuauuaaggaaauucuuuacacccccuacggcgacaucuaucacgauacuuauccagauuuccaagugaucaucggauuccaugguggacucuacgauuuucugaccaaacuggugcaccuuggccagcgggacuaugacguaguggcugggcgcuggaccacaccuaaccaccauauuuggaaacagcugaaccuuuuaccuaagccuuucaaccuguacucauucgagaacaauuauccggugggcaagauacaagacguggcgaaauacacgacagauaucaggaguuggcuugagcucuuuggcuuucaauuacauaauguguugccaggcuuuccaaagccugaguuggagaauuuggaguuaacauacgagcugcuucgccugcagaccaaaacucaagaaugggaucccggcaaaaccauccucggcauccagugcgaacuccagaagcagcugcggaacuucaucagccuagaucagcuaccaaugacuccacgcuauaacgacggaagaugccuggaaggaggaaaacagccccgcuuugcggccgugccguccguguuuggcaagggcaucaaguuugccaucaaagauggaauuguaacugcggacauuauaggaguugccaacgaagacagucgaagguuggccgcaaucuugaauaaugcucacuaucucgagaaccugcacuucaccauugagggacgcgacacacacuauuuuaucaagcugggaucccuggaggaagaccuaguucugauuggcaauacggggggcaggcgcauccuggaaaacgggguuaaugugacugugucccagaugaccucagugcugaauggccggacuagacgauuugcugacauucagcugcagcacggcgcccuuugcuuuaacauaagauaugggacaaccgucgaggaggaaaagaaccacgugcuagaaaucgcccgucagagagcuguggcccaggccuggacaaaggagcagcgccgccugcaagagggggaagaaggaauacgcgcguggaccgagggcgagaagcaacagcuccucaguaccggaagggugcaaggcuaugacggauauuucgugcugagcguugagcaguaccuggagcugucugauuccgcuaauaacauccacuucaugcgccagucugagauugggaggagauag

SEQ ID NO: 12417 - RNA, 204 nt, Artificial Sequence
  Description of Artificial Sequence: Synthetic coding sequence
augaaaauucaauuauuuuuuuucaucuuacauuuuugggugacuauucugccagcaaagaaaaaguaccccgaauaugguuccuuagauuugcggagagaguguagaauaggcaauggacaaugcaagaaccagugccaugaaaacgaaaucaggauagcauacugcaucagacccgggacccauugcuguuugcaacaguag

SEQ ID NO: 12418 - RNA, 831 nt, Artificial Sequence
  Description of Artificial Sequence: Synthetic coding sequence
augaaacagauucugcacccggcucuagaaacuacagcuuguaccaaccauuucaaugcugaucccuguucaaccggcuuuguguuuccugcuaugacacuguuuccuguacugcuuuuucuuguggcaggccuucucccguccuuucccgcaaaugaggauaaagauccugccuuuacugcucuacuaacuacgcaaacacaagugcaacgagaaauuguuaauaaacacaacgaguugcgcagggcaguuucuccaccagcacgcaauauguuaaagauggaguggaacaaggaagccgcugcgaaugcucaaaaaugggcuaaccaguguaacuacagacauucuaaccccaaagacagaaugaccagccuaaaauguggagagaaucuguacaugucauccgccaguagcagcuggucucaggccauccaguccugguucgaugaauacaacgauuucgacuucggcguggggccgaagacuccaaaugcgguagugggucacuauacacaagugguuugguauagcucuuaccuggugggcugcgggaaugcuuacugccccaaucagaaaguccugaaauacuauuacguuugccaguacuguccugcagggaauugggccaacagacucuauguucccuaugaacagggcgcucccugcgcaaguugcccugacaacugugacgauggacugugcaccaauggaugcaaauacgaagaucuuuauagcaauugcaagagccugaaacucacucucacaugcaaacaccagcuugugcgcgacuccuguaaagcgucauguaacugcagcaauucuauuuauuag

SEQ ID NO: 12419 - RNA, 1350 nt, Artificial Sequence
  Description of Artificial Sequence: Synthetic coding sequence
augcuggccgaguggggcgcaugccugcugcuugccgucgcacugcuggguccgggucugcaggcucaggcuauggagggcgugaaaugcggaggugugcugucugcccccucuggcaacuuuuccucacccaauuuccccagacuguacccauacaacacugagugcucuugguugaucguuguggcugagggcucauccguguuacucaccuuucaugcuuuugauuuggaguaucaugacacaugcuccuuugauuuuuuggaaauuuacaacggggcaucucccgauaaagggaaucuuuugggucgcuuuugcggcaaagugccaccaccuccuuucaccaguucuuggcacguuauguccgugauuuuucacucagacaagcacguggccucacacggguucagugcgggguaccagaaggacgucugcggcgguguccugacugggcucucagggguucugaccucccccgaauacccuaacaacuaccccaauucaauggagugucacugggucauaagggccgcaggcccugcccaugucaaauugguguuuguggacuuucagguggaaggcaacgaggaauguaccuacgacuacguggccgugcucggcggcccggggcccacacggggccaucauuauuguggcagcacucggcccccuacuuuggugagcuuaggucaugagcugcaagugguguucaagucagacuucaacauuggcggccgcgguuucaaagcguauuacuuuaguggggagugccaggagguauauauggcaaugaggggcaacuuuucuucaccucaguacccuagcucuuacccuaauaacauuagaugucacuggacuauucgccugccuccaggauaucagguaaaggucuuuuucuuggaucuggauuuggaagagccuaauaguuuaacaaagacuugugacuucgaucaucucgccgcauuugacggcgccuccgaagaagcaccacugcuagguaacuggugcggucaucaucuccccccccccgugacuucaucucauaaucaauuacugcuuuuguugcacacggaccgcagcaccaccaggcgggguuucagugucgcauauaucggcgggcagcuggggugugggagcggcaguaccgaaggcgagggugaagcccuccagccacagagucuccaauccccuuccucuauuccacccguaugcccugcaccgccuaugaauggacuccuccaacuucuccuucacugguuacacccuugcccacuguccgggccccugcguuuggacgggaccgcaccagccuguuuucauuacugcagagcuucuuuuccaucuuuuuag

SEQ ID NO: 12420 - RNA, 1434 nt, Artificial Sequence
  Description of Artificial Sequence: Synthetic coding sequence
augacuucuaaguucuuacucgugaguuuuauucuggccgcacugagccuuucuacaaccuuuuccuugcagccagaccagcaaaagguauugcuggugucuuucgaugguuucagaugggauuaccuguacaaaguucccacgccacacuuucacuacaucaugaaguaugggguucacguaaaacaagucaccaauguuuucauuacaaagacuuauccaaaccauuacacacuggugacaggacuguuugcugagaaucauggaauaguggcuaacgauauguuugaccccauucgaaacaaaagcuuuagucucgaccacaugaacaucuaugacucuaaguuuugggaggaagccacccccauuuggauaacaaaucagagggccggucacaccucgggugccgcgauguggcccggaacagauguuaagauucacaagcgguuucccacucacuauaugccguacaaugaaagugugaguuucgaagacagaguugcaaagaucauugagugguuuaccucaaaagaaccgauaaaccuugggcuguuguacugggaagauccugacgauaugggccaccaccucggcccagauuccccacuuaugggcccuguuauaucggacaucgauaagaagcugggcuaucugauccaaaugcucaaaaaagccaaacuguggaauacucugaaccuaaucauuaccucugaucauggcaugacccaguguucagaggaacgucucauugagcuggaccaguacuuggacaaggaccauuacacccugauugaucaaucaccagucgccgccauuuuaccgaaagaggguaaauucgaugaagucuaugaagcucugacccacgcccauccuaaucucacugucuacaagaaagaagaugugccugaacgcuggcauuauaaauauaauucucgaauacaacccauaaucgccguggccgacgaagguuggcacauccugcagaacaagucugaugacuuucuguuaggaaaucauggauacgacaacgcucucgcugacaugcaccccauuuucuuagcccacggaccugccuuccgaaagaauuuuaguaaggaagccaugaacucaacagacuuauacccuuuacugugccaccuuuuaaauaucacugcaaugccucauaaugguucauucuggaacgugcaggacuugcugaacagcgcaaugccccgagugguuccuuauacacagucuaccaucuugcugccaggaagugugaagccggccgaauaugaucaagaggggagcuaccccuauuuuaucgggguuagucucgguucgaucaucgugaucguguucuuugucaucuuuauuaaacaccugauacauagccagauuccggcauuacaggacaugcacgcagaaauagcucagccccugcugcaagcauag

SEQ ID NO: 12421 - RNA, 1479 nt, Artificial Sequence
  Description of Artificial Sequence: Synthetic coding sequence
auggguuccgcaccuugggcccccgucuugcuguuagcucugggacugaggggccugcaggcuggggccagaagagcccccgacccaggauuccaggagcgcuucuuccagcagagacuggaccauuuuaauuuugaacgguuugggaacaaaaccuuuccacagagauuucucgugucggaucguuuuugggugcggggagaggggcccaucuucuucuacacaggaaaugaaggagacgugugggcuuucgcuaauaauucugccuucgucgcagaacucgcagcagaaagaggcgcgcugcucguuuucgccgaacaucgauauuacggcaaaucauuaccauucggugcucaaucuacccagcgcggccacacugagcuccugacgguagagcaggcccuggccgacuuugccgaacugcuucgcgcgcuuaggagagaccugggggcccaggaugcuccugcgauugcauucggcgggucauacggagguaugcugagcgcuuauuuaagaaugaaauacccacaucuugucgcgggagcccucgcugcauccgcccccguccuagcagucgccgggcugggagauucuaaucaguucuuucgagacguaacugcagauuucgagggccagagccccaaauguacccaggggguacgggaggcuuuuagacagauuaaagaccuuuuccuccagggggccuaugauaccgugaggugggaauuugggacgugccagccccugagcgaugaaaaagaucugacccagcuauuuauguucgcucggaaugccuuuacaguucucgcgaugauggacuauccauacccuaccgacuuucugggaccucugcccgcuaaccccguuaaggucgguugcgauagauuguugucagaggcgcaaagaaucacaggacugagggccuuagccggccugguguauaaugccaguggcagugagcauuguuaugacauuuaccgcuuauaccauucaugugcugacccgacuggaugugguacugggccagacgcgagggccugggacuaucaagcgugcacagagaucaaccugaccuuugcauccaacaacguaacagacauguucccugaccugcccuucacagaugagcuucgucaacgguacugccuggacacaugggggguuuggccgagaccugacuggcuauugacuuccuuuuggggcggggaccuucgcgccgcaucaaacaucaucuucuccaacgggaaccuagacccgugggcuggcgggggaauaagaaggaaucuuuccgccuccgucauagcuguuaccauccaaggcggcgcccaccaccucgaucugcgggccucccaucccgaagacccggccuccgugguggaagcucgcaagcuggaagcgacuauaaucggugaauggguuaaagccgcuagaagggagcagcagcccgcgcugcgagggggaccccgguuaucccuguag

SEQ ID NO: 12422 - RNA, 2850 nt, Artificial Sequence
  Description of Artificial Sequence: Synthetic coding sequence
augauccuaagccuguuguuuucacuuggcggaccucugggcuggggucuguuaggggcuugggcucaggcaucuagcacaucacuuucggaccugcagucuagccgcacacccggaguguggaaggcagaggcggaagacaccggcaaggauccaguugggcggaauugguguccguaccccaugucuaaauuagucacacugcucgcccuguguaagacugagaaauuucugauccacucucagcaaccuugcccacaaggugcgccugacugucagaaagugaaaguuauguacagaauggcccauaagccugucuaccaagugaagcaaaagguucuuacuagccucgccuggcguuguugucccgguuauaccggccccaauugugaacaccaugauuccauggcaauucccgagcccgccgaucccggagauucucaccaggagccccaggacggacccgugucauucaagcccggacacuuagcugcagugaucaacgaggucgagguacaacaggaacagcaggagcaccugcugggggauuugcagaacgauguccauaggguugcagauucacucccuggacucuggaaagcgcugccggggaaucuuaccgcugcagugauggaagccaaccagacaggucacgaguucccggauagaucguuagaacagguccuguugccccacguagauaccuuccugcaaguucacuuuucaccaauauggcggagcuucaaucaaucccugcacagcuuaacucaggccauucggaaucuuuccuuggauguggaggcuaaucgucaggcuauaucacguguccaagauagcgcaguugccagggcugacuuccaggaguugggagcuaaauuugaagccaaaguccaggaaaauacacaacgggugggacagcugaggcaggauguagaggaccggcugcacgcccagcacuucacacugcacagguccauuagcgaguugcaggcagacguugauaccaaacucaaaagauuacacaaggcccaggaagccccuggaaccaacggaucuuuggugcuggccaccccgggcgccggggcacgccccgagcccgacagccuccaggcaagacugggccagcugcaaaggaauuuguccgaguuacacaugacaacugcucgucgcgaagaggagcuucaauacacucucgaggacaugcgcgccacuuugacccggcacguggacgaaauuaaggagcuuuauucagaaucugacgaaacuuuugaccagauuucaaagguugaaagacagguggaggaguuacaggugaaccacacagcacuaagagaacuucgggugauccugauggaaaagucccugaucauggaagaaaauaaggaagaggucgaacgucagcugcuggaacugaauuugacccugcaacaccuccagggggggcacgcggaucucaucaaauaugugaaagauugcaacugccaaaagcucuaccuagaccuggaugucauucgcgaaggccaacgagacgccacaagggcacuggaggagacgcagguguccuuggacgagaggcgucagcuggauggcucaucacuacaagccuugcagaacgccguggacgccguuucucucgccguugacgcccacaaggcugaaggugagcgggcucgggcugccacaagucgauugcgaucucaggugcaagcauuggacgaugaagucggggcacucaaggcugcugcugcagaagcacgccaugaagugcgacagcuacauuccgccuuugccgcauugcucgaggacgcccuccgccaugaggccguccuggccgcacuuuucggcgaggagguguuagaagagaugucugagcagacuccgggaccucucccacuguccuacgagcagauccggguggcccugcaagacgcugcaagcggucuccaggaacaggccuugggcugggaugaacucgccgcucgugucacagcacucgaacaggcuucagagcccccccggcccgcugaacaccuugagccaagccacgaugcuggccgggaagaagcugccacuacugccuuagccggucucgccagggaacuucaaagccuaucgaacgacguuaagaauguuggacgcugcugcgaggcagaggcgggggccggcgcugcuucucugaaugcgagccuccaugggcuucacaaugcacuguuugcgacccagcgcucgcuggaacaacaccaaaggcuguuccauucccuguucggcaauuuucaaggguugauggaggcuaaugucagucuggaucugggcaaacuccagacaauguuaucucgaaaggggaaaaagcagcagaaagaucucgaggcaccccggaagcgcgauaagaaggaggccgaaccccuagucgacauaagagucaccggcccugugccuggagcucugggagccgcccugugggaagcaggauccccuguagcauuuuaugcaucguucagcgaagggaccgccgcuuugcaaaccgucaaguuuaauaccaccuauaucaacauugguaguuccuacuuuccugaacauggcuacuuucgagcaccugaacgcgguguguaccuguucgcugugagcguggaguucggaccuggacccgggacgggccagcuggucuucggcggacaucauaggacaccuguguguacgacugggcagggaaguggcuccacugcuacagucuucgccauggccgaacuccagaaaggggaacgcgugugguuugaacugacacaaggcucaauuaccaaacgcucccugucugguacugcuuuugggggcuuucucauguucaaaaccuag

SEQ ID NO: 12423 - RNA, 246 nt, Artificial Sequence
  Description of Artificial Sequence: Synthetic coding sequence
augcgccuguuaguccuuuccucuuugcuaugcauacugcugcuuuguuucucuauuuuuucaacagaagggaagcguagacccgccaaggcuuggucaggccgucggacccgccuguguugccacagagugccaucgccaaauagcaccaaccucaagggccaucaugugagacuguguaagccuugcaagcuagaaccagaaccgaggcuguggguuguuccuggugcucucccccaggucuag

SEQ ID NO: 12424 - RNA, 690 nt, Artificial Sequence
  Description of Artificial Sequence: Synthetic coding sequence
augucuuuccugcaggacccauccuucuucaccauggggauguggagcaucggagccggagcauugggugcggccgcacuggcucugcucuuagcgaauacugacguguuccuaucaaaaccucagaaggccgcucuugaguaccuagaagacauugaccuaaaaacccuagaaaaggagccaaggacguucaaggcaaaagaacugugggagaagaacggagcuguaaucauggccguacggagaccagggugcuuccucugcagagaagaggcagccgaucuguccucgcucaagaguaugcucgaucaacuggggguuccucuguaugcugugguuaaagaacacaucagaacagaggugaaagauuuccagcccuacuucaaaggcgagaucuuucuggacgagaagaaaaaguucuaugggccccagaggagaaaaaugauguuuaugggauuuauuaggcugggcgugugguacaauuucuuucgcgcauggaacggcggcuuuucugguaaccuggaaggggaaggauuuauucugggcggcguauucguagucggaucugguaagcaagguauccuguuagagcauagggaaaaagaauuuggggauaaaguuaacuuguugagcgugcuggaggcugcaaagaugaucaaaccacagacacucgccuccgaaaagaaguag

SEQ ID NO: 12425 - RNA, 657 nt, Artificial Sequence
  Description of Artificial Sequence: Synthetic coding sequence
augggaauguggucuauuggugccggcgcccucggggcugcagccuuagcucugcuacuggcgaauaccgauguguuccugagcaaaccucagaaagccgcauuagaauaucuggaggacaucgaucuaaaaaccuuggaaaaagaaccacgaacauuuaaagccaaagaacugugggaaaaaaacggugccgucauuauggcggugcgcagaccugguugcuuccugugccgcgaagaggccgccgaucuuucgaguuuaaaaagcaugcuggaucaauuaggcgucccacuguacgcuguggugaaggaacacauucgcacagaagugaaggauuuccaaccuuauuuuaagggagaaauuuuucuggacgaaaagaagaaauucuaugguccucagagacgaaaaaugauguucaugggcuuuauucgucugggggugugguacaauuucuuucgggcguggaacggggguuuuuccggcaaucucgagggggaaggguuuauccuuggaggaguuuuuguggucggaagugguaagcaagggauuuugcuagagcauagagagaaagaguuuggagacaaagugaaccugcucagcguguuggaggccgcuaaaaugaucaaaccccagacacuugcgucugagaaaaaguag

SEQ ID NO: 12426 - RNA, 690 nt, Artificial Sequence
  Description of Artificial Sequence: Synthetic coding sequence
augagcuuucugcaagaccccucauuuuuuacaauggggaugugguccaucggagccggggcccugggcgccgccgcauuggcccuccugcuggcuaacaccgacguuuucuuguccaaaccucagaaagccgcgcucgaauaccuggaggacauugaucugaagacccucgagaaagaaccuagaaccuucaaggccaaggaguuaugggaaaaaaauggcgcugucaucauggcuguccggagaccaggcuguuuucuuugccgagaagaggccgcugaccugagcuccuugaaauccaugcucgaucagcugggcgugccacuuuaugccguggucaaagagcacauccgaaccgaggucaaggacuuccagccuuauuucaaaggagaaaucuuucuggacgaaaagaaaaaguuuuacggaccccagagaagaaagaugauguuuauggguuuuauacgguuaggagugugguauaauuuuuucagagccuggaauggcgguuucucagguaaucuugagggcgagggcuucauucugggcggcguguucgucgucgggagcgguaagcagggaauuuuacuggaacaccgagagaaggaauucggggacaaagugaaucuucuuagcguauuagaagcggccaaaaugauaaagccucaaacucuggccagcgagaaaaaguag

SEQ ID NO: 12427 - RNA, 690 nt, Artificial Sequence
  Description of Artificial Sequence: Synthetic coding sequence
augucuuuccugcaggaucccuccuucuuuaccauggggauguggucuaucggagccggcgcucucggagccgcagcuuuagcacuucuucuggccaauacugaugucuuucucagcaaaccucagaaggccgcacuggaauacuuggaggacauugaccugaaaacucucgaaaaggagccccggacauucaaagccaaagagcugugggaaaagaacggcgcagucaucauggccguccgacgaccagguugcuuucuaugcagggaggaggccgcagaucugucuucacucaagagcaugcucgaccagcuaggaguuccccucuacgcugucguaaaagagcacauaaggacagaaguuaaagacuuccagccuuacuucaagggcgaaaucuuuuuggaugaaaaaaaaaaauucuacgggccucagagaaggaagaugauguucaugggauuuauucggcucggcguuugguauaauuuuuuuagggcguggaauggcggauuuucuggcaaucuggaaggagagggauucauacuuggugggguguuuguuguugggagcgguaagcaggggauucugcucgagcaccgcgagaaagaauucggggacaaagugaaccuauuaagugugcuggaggccgccaagaugauuaagccccagacacuggcgagcgagaagaaauag

SEQ ID NO: 12428 - RNA, 1248 nt, Artificial Sequence
  Description of Artificial Sequence: Synthetic coding sequence
augagcccauuucuguaccuagucuuguuaguauuaggcuuacaugccacgauccacugugccucuccagagggcaagguuaccgcgugucacucuucccagcccaaugcuacccuguacaaaaugagcuccauuaaugccgacuuugcguuuaaccuguauaggcgcuuuacaguggagaccccugacaaaaacaucuucuucucccccguuagcaucagugccgcccucgucauguugaguuucggggccugcuguucgacacaaaccgagauagucgagacucucggauuuaacuuaaccgauacucccaugguggaaauccagcauggcuuccaacaccuuauauguagucuuaauuuuccuaagaaagaacuugaacuccagaucggaaacgcucucuucauuggcaagcaccucaagccccuggccaaauuccuuaacgauguaaagacucuguacgaaaccgaaguguucucaacugacuuuagcaacaucucagcggccaagcaggaaaucaacagccacguggaaaugcaaacuaagggcaaggugguuggcuugauccaggaccuuaaaccgaauacaaucaugguacucgucaacuauauucacuucaaggcacagugggcgaauccauuugaucccaguaaaaccgaagacucgucauccuuucuuaucgauaaaacuaccacagugcaggugccgaugaugcaucagauggaacaguauuaucaccuuguggacauggaacuaaauuguaccguucugcagauggauuauucuaaaaacgcacuugcucuguuugugcugcccaaggagggccagauggaauccguagaagcugccaugagcaguaagacacugaaaaaguggaacaggcucuugcagaagggaugggucgaccucuuugugccuaaauuuagcauaucugccacauacgaucuaggcgccacucugcuuaaaauggggauccagcacgccuauucugagaacgcagauuuuagcggucugacagaagauaacggccucaagcuauccaaugccgcccauaaggccgugcugcacaucggugagaagggcacagaggccgcagccguucccgagguggaauuaucagaccagccagaaaacaccuucuugcaccccaucauccagauugaccguucuuucaugcugcuuaucuuagaacgcucuaccagauccauucuguuuuuagggaagguggucaauccgaccgaagccuag

SEQ ID NO: 12429 - RNA, 240 nt, Artificial Sequence
  Description of Artificial Sequence: Synthetic coding sequence
auggccccccagacccugcugccagucuuggucuugugugugcuccuacugcaggcucaagguggguacagagacaagaaacgcaugcaaaaaacacaguugagucccgaaauuaaagucugucagcagcagcccaagcuauaucuguguaagcaucucugugaaucccaccgcgacugccaagcaaauaauaucuguugcucuacguauugugguaauguuuguaugucuauccuguag

SEQ ID NO: 12430 - RNA, 486 nt, Artificial Sequence
  Description of Artificial Sequence: Synthetic coding sequence
augggucucucagguuuacugccuauauuagugccuuucauucuccucggagauauucaggaaccaggucacgcugagggaauccucgggaaaccuugccccaaaauuaagguagagugcgaaguagaagaaaucgaccagugcacaaaaccucgagacugccccgaaaacaugaaauguugcccauucucuagagguaaaaaaugucuggacuuccgcaaaaucuaugcagucugucacagaagauuagcuccugccuggccgccguaucauacagguggaaccaucaaaaaaaccaaaaucugcagcgaguuuauuuacggugguagccaagggaauaacaauaacuuccaaacagaggcgauuugccuggucaccugcaaaaaauaucauaaaagcgcauugcuuuacacuaucaggagaucccugaauaauuugcaagaucuugcccacaauccaggauugagcccucgaguucccgauuag

SEQ ID NO: 12431 - RNA, 261 nt, Artificial Sequence
  Description of Artificial Sequence: Synthetic coding sequence
augggacugagcgggcuccuuccuauacuggugcccuuuaucuugcugggugauauucaggaaccuggccaugcagaaggcauuuuaggcaagccuuguccaaaaauaaaaguggaaugugagguggaggagauugaucaauguacaaaacccagagacugcccugaaaauaugaaauguugcccuuuuaguaggggaaaaaaaugccucgacuuuaggaaagugaguuuaacacuguaucauaaggaagaacuagaauag

SEQ ID NO: 12432 - RNA, 375 nt, Artificial Sequence
  Description of Artificial Sequence: Synthetic coding sequence
augcccgcgugccgccuuggcccgcucgccgcugcccugcugcuguccuuacugcucuuuggcuucacuuuagugucaggaacaggagccgagaaaaccggagugugucccgaacugcaggcugaucagaacugcacacaggaaugcgugagugacagugagugugcggauaaucuuaagugcugcagcgcugguugcgcgacauuuugcucccuccccaaugacaaggaagguaguuguccucaagugaacaucaauuucccccaguuggggcuguguagagaccagugccaggucgauucccagugucccggacaaaugaaaugcugucguaacgguugcggaaagguguccugugucacccccaacuuuuag

SEQ ID NO: 12433 - RNA, 1428 nt, Artificial Sequence
  Description of Artificial Sequence: Synthetic coding sequence
auggccgacaugcagaaucugguagagcgcuuagaacgcgccguugggcgccuggaggcugugagucacaccucagacaugcacagagguuaugccgauaguccaaguaaagcgggcgcagcccccuauguucaggccuucgacucacugcuugccgggcccgucgcugaauaccugaaaauuucaaaggaaauuggaggagauguucagaaacaugccgagaugguccacacggggcuaaaguuggaacgggcccucuugguaaccgcaucccagugucagcagcccgcggagaacaaauugucugacuugcuggcucccauaucugaacagaucaaggaagucauuacguuucgcgaaaaaaacagaggauccaaacuauucaaccaccuguccgcuguuuccgagagcauccaggcauuggguugggucgcaauggcccccaagccugggccguaugugaaagaaaugaacgaugccgcaauguuuuacacaaaccgugugcuaaaagaguacaaggacgucgacaagaagcacgucgauugggugaaagccuaucugaguauuuggaccgaacugcaggcauauauaaaggaguuccauacaacuggacuugccuggucgaaaaccggucccguggcaaaagaauugucagggcuaccaucuggaccuagcgcugguuccugccccccccccccaccuccuugcccuccacccccacccguuuccaccauaagcuguuccuaugaauccgcaucccguucaucccucuucgcccagauuaaucagggcgagagcauuacucacgcucugaagcacgugagcgaugacaugaagacccacaaaaacccugcacugaaggcucagucaggucccgucagaagugggccuaagccuuucucugcuccaaaaccucaaacaucacccucuccaaaacgggccacuaaaaaggagccggcagugcucgaacuggaagguaaaaaguggcgcguggaaaaucaggagaacguuuccaaccuggugauugaagauacggaacugaagcaagucgcguacauuuacaaaugugugaacacaaccuuacagauaaaaggcaaaaucaauucaaucacuguugauaauuguaaaaaacugggccucguuuucgaugauguggucgggauuguagaaauuauuaacuccaaagauguaaaaguacaagugauggggaaagugcccacgauuucuaucaacaagacugauggcugucacgccuaucuuucaaagaacucccuagauugugagaucgugagugccaagucuagcgaaaugaacguuuuaauccccacugaaggcggagacuuuaacgaguucccaguaccagagcaguucaaaacucuguggaauggccagaaacuggucacuaccgucacugaaauugcagguuag

SEQ ID NO: 12434 - RNA, 438 nt, Artificial Sequence
  Description of Artificial Sequence: Synthetic coding sequence
auggcagauaugcagaaccucguggaacgccuggagagagccgucggcagacuggaagccgugucccauacuucagauaugcaccgagguuacgcugacucccccucuaaggccggcgccgccccuuaugugcaagcuuauaucaaggaauuccauaccacaggccuggccuggagcaaaacuggcccuguggccaaagaacucagugggcuaccuagcgggccaagcgcaggaucaugcccaccaccuccucccccuugucccccacccccuccaguaucaacuauaucaugcuccuacgagagcgcuucccgcagcagcuuauucgcucagauuaaccaaggugaaagcaucacacaugccuugaaacauguauccgaugacaugaaaacacauaaaaauccagcacucaaagcacaaaguggacccguccgguag

SEQ ID NO: 12435 - RNA, 1428 nt, Artificial Sequence
  Description of Artificial Sequence: Synthetic coding sequence
auggcugauaugcagaaccuuguggagagguuagaacgugcuguugggcgccuagaagccgugucucauacaagcgacaugcauagaggauacgccgacagccccuccaaagcuggcgcagcaccuuacgugcaggcuuuugauagccugcucgcugggccuguggcagaguaucucaaaauauccaaagaaaucgggggggauguccaaaagcaugcggaaauggugcauaccggacuuaaacuugagagggcucuuuuggucacugcuagccaaugccagcagccugcugagaacaagcugucagaucugcuggcccccauuagcgagcagauuaaagaagugauuacauucagggaaaaaaauagaggcucaaaacuauuuaaccaccugucggcagucuccgagagcauccaggcgcugggguggguagcuauggcacccaaacccggaccauauguuaaggaaaugaacgacgcugccauguucuacaccaaccggguucuuaaagaguacaaggauguggacaagaagcacgucgacuggguaaaggcguacuuguccauuuggaccgaacugcaggcauauaucaaagaguuucauacaaccggucucgccugguccaagacugggccagucgcaaaggaacuuucuggacuucccucuggacccucagccgggucuuguccucccccgccaccacccugcccuccaccuccucccgugagcacaaucagcugcucuuacgaaucggccagccggagcucccuuuuugcgcaaauuaaucagggggaaagcauaacccaugcgcugaaacauguauccgacgacaugaaaacacacaagaacccugcccugaaggcccaauccgggcccgucagaagcggcccuaaaccuuuuuccgcucccaagccccagacuucaccaucgccuaagcgggcaacaaaaaaggaaccugcuguccuggaauuagagggaaaaaaauggagaguagagaaucaagaaaacguaucaaaucuugugauagaagauaccgaauuaaagcagguagcuuauauauacaagugugugaacacaacccugcagauuaaaggcaagauuaauuccauaaccguggacaauugcaaaaagcugggccugguguuugaugauguagugggaaucguagagauuauuaacagcaaggaugucaaagugcaaguuaugggaaaagugccuaccauuagcaucaauaaaacagacggcugccacgccuaucucagcaagaacucucucgauugcgagaucgugucagcgaaaaguagugagaugaacgugcuuauucccacugaagggggagacuucaaugaauuuccagugccugaacaguuuaaaacucuguggaauggacagaaauuggucacaaccgucaccgagauugcgggcuag

SEQ ID NO: 12436 - RNA, 1425 nt, Artificial Sequence
  Description of Artificial Sequence: Synthetic coding sequence
auggcggacaugcagaaccuggucgaacgccucgaaagagcagugggccggcucgaggccgugucacauaccagcgauaugcacaggggauaugccgauagcccuucgaagggagcagcaccuuacguucaggcuuuugacagucugcuggccgggccagucgcggaguaccuaaagaucucgaaagagauuggcggagacguccagaaacacgcugaaauggugcacacaggcuugaagcucgagagggcccuucucgugaccgccagucagugucagcagccggcagagaacaagcuaagugaucuccuugcccccauuucugagcagaucaaagaaguaauuacauucagggagaagaaccgaggaagcaaauuguucaaccaucuaagcgcagucuccgaaucaauccaggcccucggguggguugcaauggccccuaagcccggcccauaugucaaagagaugaacgaugcggccauguucuauaccaaucgagugcucaaggaauacaaggacguagacaagaagcacguggacuggguuaaggcuuaucugucuauuuggacugagcuccaagcuuauauuaaagaauuccacacuacgggacuggcuugguccaagacuggccccgucgcaaaagaacuuucugggcucccuagugguccaucagccggguccuguccacccccccccccaccaugcccccccccuccaccuguuagcacuauuagcugcaguuaugagucagccucgcgauccucauuauucgcgcaaaucaaucagggugaaucuaucacucacgcgcugaaacacgucagugacgacaugaaaacacauaagaauccagcacugaaggcucagucuggaccugugagaagcggcccaaagccuuuuucugcgccaaaaccucagacauccccuucgccaaagcgugcuaccaagaaagaaccggcaguccuagaguuagaggggaaaaaguggcgcguggagaaccaggagaaugugucuaaccucguuauugaggauaccgagcuuaaacaaguugcauauaucuauaagugcguuaacaccaccuugcaaaucaaggguaagauaaauagcauaacuguggauaauugcaagaagcucggucuggucuuugaugacgucguuggcaucguugagaucauaaauagcaaggaugugaaaguacaggucaugggcaaagucccuaccauuaguaucaacaaaaccgacggcugccacgcauaccugagcaaaaauucccucgauugcgagaucguuucagccaaguccagugaaaugaaugugcuuauuccuaccgaagguggcgacuuuaacgaauuccccgugccagaacaauuuaaaacucuauggaauggucagaaguuaguuaccacgguuacagagauagccggcuag

SEQ ID NO: 12437 - RNA, 1425 nt, Artificial Sequence
  Description of Artificial Sequence: Synthetic coding sequence
auggcugacaugcagaaccuuguggaaagauuagagcgcgccguugggcgucucgaggccgugucgcacacaagcgacaugcacagaggauacgccgacagucccuccaagggagcagcaccguaugugcaggcauucgacucccugcuugcuggcccuguggcggaguaucucaaaauuucaaaggaaaucggaggagacgugcagaaacacgcagaaaugguccauacggggcucaaacuggagagagcacugcuugucacugcaucccaaugccagcagccagccgagaacaaacuuucagaucugcucgcgccuauuucugaacagauuaaggaaguuaucacauuccgugaaaagaacagggguucaaaguuauucaaucaccuaagcgccgucagcgaaucaauccaggcccugggaugggucgccauggccccuaaacccggacccuaugugaaggaaaugaaugacgccgcuauguuuuauaccaauaggguucucaaggaauacaaggacgucgauaaaaagcacgucgauugggugaaagccuauuugaguauuuggaccgaguuacaagccuacauuaaggaguuucacacgacaggacuggcuuggagcaaaacuggucccguugcaaaggagcugagcggccugcccuccggcccaucagcuggcucaugcccacccccgccgcccccuugcccaccaccaccgccagugucaacuaucucuugcaguuacgagagugcaagccggaguuccuuguucgcacagauuaaucagggggaaagcaucacucaugcucuaaaacacguauccgacgacaugaagacucacaagaacccggcccuuaaggcucaaagcgggccugucagaucugguccuaagccuuuuuccgcaccuaaaccucagacuuccccuaguccgaagagggcuacuaagaaagaaccagcuguccuagaacuggaaggaaaaaaguggcgagucgaaaaccaagagaauguguccaaucucguuaucgaagacacagaacugaagcagguagcguacaucuacaagugcguuaacacuacccuccaaaucaaaggaaagauuaauuccaucacaguggauaacuguaaaaagcugggucucgucuuugacgauguggugggcauugucgagaucauuaacuccaaggaugucaaggugcaggucaugggcaaagucccaacuauuucaaucaauaaaacugauggcugucacgccuaucuaucuaagaauuccuuggacugcgagauuguaucugcgaagagcucugaaaugaauguauuaauucccacugaagguggcgacuucaacgaguucccaguccccgaacaguucaaaacgcuguggaauggacagaaguugguuacuacgguuacugagaucgcaggauag

SEQ ID NO: 12438 - RNA, 1428 nt, Artificial Sequence
  Description of Artificial Sequence: Synthetic coding sequence
auggcagacaugcagaaccuggucgaaaggcuugagagagcggugggaagauuggaggcuguuucccacaccucugacaugcaucgcggguaugccgauaguccuagcaaagcaggcgcugcuccauaugugcaggcauucgacaguuuacuagccggcccuguugcagaauaucucaaaauauccaaggaaaucggaggcgacguucagaagcacgcugagaugguucacacagggcucaaguuggagagagcucuuuugguaacugccagucaaugucaacaaccagcugagaauaagcugagcgaccucuuagccccuauuucugagcaaauuaaggaagucauuaccuuuagagaaaagaaccgcggcagcaaauuguuuaaucaucugagcgccguaagcgaaucuauccaggcuuuaggcuggguugcaauggcaccuaagccagggccauacgugaaggagaugaaugacgcugcuauguuuuacaccaaucgggugcuuaaagaguauaaagauguugauaagaaacauguugacugggugaaagcguaccugucuaucuggaccgaacuccaggcauauaucaaagaauuccacacaaccggccuagccuggucuaaaacggguccuguggcaaaagaacugucuggacugcccuccgggccauccgcuggaucgugccccccuccaccuccaccuugccccccgccaccucccgugaguaccauaaguugcucuuacgaguccgccagccguagcagccuguucgcccaaaucaaccaaggagagucuaucacgcacgcgcucaagcacguaagugacgacaugaagacccauaaaaauccagcccugaaagcccaguccggcccuguucgcagcggaccuaagccuuucucugcccccaaaccacagacuaguccaagcccgaaacgcgcuacaaaaaaggagccagcuguacuggaguuagagggaaaaaaguggagaguggaaaaccaggaaaacgucucuaaucucgugaucgaggauacagaacuaaaacaaguugccuauaucuacaaaugcgugaauacaacucugcagaucaagggcaaaaucaauucuauaacaguugacaacuguaagaaguuaggccugguauuugacgauguggucggcauuguggaaauuaucaacucgaaggaugucaaggugcagguuaugggaaaagugccuacgaucucuaucaacaagaccgauggaugccaugcauaccucucgaagaacagccuggacugcgaaauugugucugccaagaguucugagaugaaugucuugauccccacugagggcggcgacuuuaacgaguucccaguuccagaacaguuuaagacgcuguggaauggccagaagcuggucaccaccguuaccgaaaucgcugguuag

SEQ ID NO: 12439 - RNA, 1209 nt, Artificial Sequence
  Description of Artificial Sequence: Synthetic coding sequence
augaccgcacugccagguccccuuuggcugcugggccuugcccuuugugcccugggaggaggggggccuggacugagaccaccacccggauguccucagaggcgguuaggcgcgagagaacgacgagacgugcagcgggaaauuuuagcagucuugggccuuccaggucguccucgaccacgggccccacccgcagcuucccgacucccagcguccgcuccacuguuuaugcuagaucucuaucacgcgauggcuggcgacgacgaugaggacggcgccccugcugagagacgccucgggagagccgaucuagucaugucuuucgucaauauggucgaacgugaucgagcacuuggacaccaggaaccucacuggaaagaguuccgcuuugaccuuacacagauccccgccggcgaggcaguaaccgcagccgaguuccggaucuauaagguucccuccauccaucugcugaauaggacccugcacgugucaauguuucaaguuguacaggagcagagcaacagggagucugauuuguucuuccuggaucugcaaacucuucgcgcgggugacgaggguuggcucguucuggacgucacagccgccuccgauuguuggcucuuaaagagacacaaagaccucggcuuacgccuuuaugucgagaccgaggaugggcacucaguugauccggggcucgccggccugcucgggcagagggcaccccguucucagcagcccuuuguugugacauucuucagagcaucuccuagcccuauucgcacgccaagggccguccggccacugagacguaggcagcccaagaaaucaaacgaacuaccacaggccaaccgccucccuggcaucuuugacgauguccacgggucgcauggaagacaagugugccgaagacaugaacuuuacguuucauuccaagaccuggguuggcuggauugggucaucgcuccucagggcuacuccgcuuacuacugugaaggcgaauguuccuuuccgcuggacagcuguaugaaugccaccaaucacgccauucugcaaucucuggugcaccugaugaugccagacgccguacccaaggccugcugugcuccuaccaaauugucugccacuagcgugcuguauuaugauucaucuaauaacgucauccuucgcaagcauagaaauaugguuguaaaggcuuguggaugccacuag

SEQ ID NO: 12440 - RNA, 804 nt, Artificial Sequence
  Description of Artificial Sequence: Synthetic coding sequence
auggcugcgaucagaauggggaaacugacuacgaugcccgccggucugaucuaugcuucaguaaguguccacgcagcuaaacaggaggagucuaaaaagcagcucgugaagcccgaacagcugccuaucuacacggcgcccccuuugcaaucaaaguaugucgaggaacaacccggucacuuacaaaugggcuuugcuucaauuagaacugccacuggauguuacauaggauggugcaagggagucuauguauucgucaagaaugguauaauggacaccguccaguucgggaaagaugccuauguuuaccugaaaaacccuccgagagauuuccugccaaagaugggcgugauuacuguuaguggacuggccggccuuguguccgcccgcaaaggaucaaaguucaaaaaaauuacuuauccccugggacuggccacccuaggugccaccguauguuauccaguucagaguguuauaauugccaaggugacagccaagagauauaugcugcaggcuucuaaguuccuggaacaauuaaaccauuguggacagaaagcggccaaaaagucacacagccugaacuugaagaagaccaaauuggguaguuccuccgaaaucgagguuccggcaaaaacaacccauguucuuaaacauucgguaccucucccuacggaauugaguucagaagcaaagaccaaauccgaaucuaccagcggugcuacgcaguuuaugccugauccuaaacugauggaccaugggcaaagccacccugaggauaucgauauguacagcacccgcuccuag

SEQ ID NO: 12441 - RNA, 807 nt, Artificial Sequence
  Description of Artificial Sequence: Synthetic coding sequence
auggcugcuauuaggaugggcaagcugacaaccaugccagccggucugauuuaugcuucagucucaguucaugcagccaaacaggaagagucuaagaaacagcuggugaagcccgagcagcuacccauuuauacagcuccuccuuugcagaguaaauacguugaggaacagccuggccaccuccagaugggguucgcaaguaucaggacagcaacuggcuguuacaucgggugguguaaggguguuuaugucuuugugaagaauggcaucauggauaccgugcaguucggcaaagaugccuacguguauuugaagaauccuccacgagacuucuuacccaaaauggguguuaucacaguuuccgguuuggcgggccuggucucggcucggaaggguuccaaauuuaagaaaauuacguauccacucggucucgccacguuaggagcaaccguguguuacccaguccaaucugucauuaucgccaagguuaccgccaagaaaguguacgcuacaucucagcagaucuucggugcugugaagucacuguggacaaaaaguucuaaagaagagucucugccaaaacccaaagaaaaaacuaaacuugguuccuccuccgaaauugagguaccugccaaaacaacccacguacuaaagcacucagugccacuccccaccgagcuuuccucugaagcgaagaccaaauccgagucaaccucgggcgcuacucaauuuaugccggacccgaagcuaauggaucacggucaaucacacccugaggauauugacauguacagcacccgcucauag

SEQ ID NO: 12442 - RNA, 3672 nt, Artificial Sequence
  Description of Artificial Sequence: Synthetic coding sequence
auggcgccauugagagccuugcuauccuaccuuuugccucuucacugugcucugugugcugcugcaggcagcaggacuccugaacuacacuuguccggcaaguuauccgacuauggugugacuguaccaugcagcacagauuuccgaggaagauuccugagucaugucguguccggcccagccgcugccagugccgguuccauggucguugacaccccacccacccugccacgacauucuagucacuugcggguggcacggucaccccuacaucccggggggacucucuggcccggccgcgugggcagacauagccuguacuucaacgugacuguuuucggcaaggaauugcacuugcgacugcgaccaaauaggcggcuggugguccccggcagcucaguggaauggcaggaggacuucagagaauuauuccggcagccgcugaggcaggaaugcguguacacuggaggcguaaccggaaugccuggggcugcuguggccauuucuaauugcgacggguuagccggccucauucggacugauucaaccgauuucuucaucgaaccuuuggagagaggccagcaggaaaaggaggcuaguggacggacccauguagucuacaggcgagaggccguacagcaggagugggcugaacccgauggcgaccugcauaaugaggcuuuuggacugggcgaucuacccaaucuccucgggcuggugggggaucagcugggcgacaccgaaagaaagagacgccacgcuaagccaggaaguuauuccauagaggucuuguuggugguggacgauucuguuguucgguuucacggcaaagagcaugugcagaacuacguguuaacgcugaugaauauugucgaugaaaucuaucacgacgagucucuaggggugcacauuaacaucgccuuggugcgucucaucauggugggauaccggcagagccugagccucaucgagcgaggaaauccaagccggagucuggaacaggugugucgcugggcccacagucaacagagacaagauccuucucaugcagagcaucaugaccacgucgucuuucuuacacgccaagacuucgggccgagcgguuaugcccccgucaccggaaugugucacccucucagaucuugugcccugaaucaugaggauggauucuccagugccuuugugaucgcccacgaaacaggucacgugcuggguauggaacacgauggccaggggaauggcugugccgacgagacaagucucgggagugucauggcuccacugguacaggcugcauuccacagauuccauuggucuaggugcucaaaacuggaacugucucgcuacuugcccucuuaugauugcuuacucgacgaccccuucgaucccgcuuggccacagccucccgaacuuccuggaauuaauuauuccauggaugaacagugucgcuucgauuucggcuccggcuaccaaacaugucuggcauucagaaccuucgagcccugcaagcaguugugguguagccaccccgacaaccccuacuuuugcaaaacuaaaaaggguccuccacucgacggcaccgaaugcgcuccagggaaaugguguuucaaggggcacugcaucuggaaguccccugagcagacguacggccaggacggcggguggagcaguuggacaaaguuuggcuccuguucaagaagcugcggggggggagucaggagucggagccgcucaugcaacaacccaaguccggcuuacggaggccggcuaugccuuggcccuauguuugaauaccaagucuguaacucugaagagugcccaggcacuuacgaggauuuucgagcgcaacagugcgcaaaaagaaauucuuauuacguccaccagaacgccaaacauuccuggguuccuuacgagcccgaugacgaugcccagaaaugugagcugaucugucaaucugcggauacaggggacgucguuuuuaugaaucaggugguucacgauggcacccgguguuccuacagggacccuuauucagucugcgcacggggggaaugcgugccaguaggcugcgauaaagaggucgguucuaugaaagccgacgauaaaugcggcguuugcggcggcgacaauucucauugcagaaccgugaagggaacacugggaaaggccuccaagcaggccggggcacugaaacucguucaaauuccagcuggggcaagacacauccaaauagaagcucuugagaaguccccccauagaauaguggugaaaaaccaagugacagggagcuuuaucuuaaacccaaaaggcaaagaagcaacaucccgcacauuuaccgccaugggucuugagugggaggacgcagucgaagaugcuaaggagagucucaagacauccggcccuuugcccgaggcaaucgcuauacucgcacugcccccaacagaggggggaccccgaucuagucucgcuuauaaauauguaauccaugaggaucuauugccuuugaucgguagcaauaauguccuccuggaagagauggauaccuacgagugggcucucaaaagcugggcuccaugcuccaaagcauguggcggugguauccaguucacuaaguauggaugccguaggagaagggaucaucacaugguccagcgccaccugugugaccacaaaaagaggccuaaaccuaucaggagaagaugcaaucaacacccauguagccagcccguaugggugacagaagaauggggagcuuguucuagaaguugcggcaagcucgggguccagacuagagguauccagugccugcucccccucagcaacggaacucauaaaguaaugccugcuaaggcaugugcaggggacaggcccgaggcucguaggcccugucuucgagucccuugucccgcccaauggaggcugggcgcauggucucaaugcagcgcuacuugcggagaaggcauacaacagagacaggucgugugucggacuaaugcaaacucucuggggcacugcgaaggggacaggccagauacgguccaggucugcagccuaccagccugcggcggaaaccaccaaaauaguaccguccgagcugacgugugggaacucggcaccccagaggggcaaugggugccgcagucagagccacuucaucccauaaacaagaucuccuccaccgagccaugcacaggugaccgaaguguguuuugucaaauggagguccuggaccgguacuguuccaucccuggauaccauagacuaugcuguguuaguugcauaaagaaggcuagcggcccuaauccgggacccgacccugguccaaccucuuugcccccauuuucaacccccggcucaccccugccuggcccacaagauccugccgaugccgcagagccuccggggaagccaaccgggucagaagaccaccagcaugggagggccacucagcugccuggcgcacuggacacaagcaguccaggaacccagcacccuuucgcgcccgagacacccaucccgggcgccagcuggagcauaaguccaaccacaccggguggauugccaugggguuggacacagacucccacccccgugccugaggauaagggacagcccggagaagaucuuagacaccccggcacuagucugccggcagcaucgccuguuaccuag

SEQ ID NO: 12443 - RNA, 3681 nt, Artificial Sequence
  Description of Artificial Sequence: Synthetic coding sequence
auggcccccuugcgcgcucugcuguccuaucucuugccccuacacugugcucuaugcgcagccgccgguucccguaccccggaguugcaccuguccggcaaguugucagacuacggugucacaguuccaugcucuacagauuuuagagggcgguuucucagccacgucguuucagguccugcagcugccucggcuggaucaaugguuguugacaccccaccaacucugccucgucacucuucccaccugagaguggcgagaagcccacuucauccaggcggcacccuguggccaggucgggugggacgacauagccuguacuuuaacgugaccguguucggcaaagagcugcaccugcgccuacguccuaaucgucgacuagucgugcccggcaguuccgucgaguggcaagaggauuucagggagcuauuucgacagccuuuacgucaggaguguguauauacugggggggucaccggaaugccuggagcugccgucgccauauccaacugcgaugggcuggcaggccugauccgcaccgacucuaccgacuuuuucauugagccacucgagcgcggucaacaggaaaaagaagcuagcggucggacccaugugguguaucguagggaggcugugcagcaggaaugggcagaaccggauggagaucuccacaaugaggcauucggacuuggcgaucugcccaaccugcuuggucucgugggagaccaacuuggagacacggagcgaaaaagaaggcacgcaaagcccgguagcuauagcauugaaguccuguuaguaguggacgacagcguugugcgcuuccauggcaaagagcacguucaaaauuaugugcuuaccuugaugaauaucguugacgagaucuaucaugaugaaagccuaggcgugcauaucaauauagcgcucguuaggcugauaauggugggcuaucggcaaucuuugucauuaaucgaacgugguaaucccuccagaagcuuagaacagguguguaggugggcacauucucaacagagacaggacccuagccaugcagagcaccacgaccacgucguuuuuuuaacaaggcaggacuucggaccgagcggaaugcaggguuacgcuccggugacugggaugugccacccgcugcgcucuugugcuuugaaucaugaagaugguuuuaguucagccuucguuaucgcucaugagaccgggcacguccugggcauggagcacgauggacaggggaauggaugugccgacgagacgagccugggaaguguuauggccccacucgugcaagccgcguuccaucgguuccauuggucccggugcucgaagcuggagcugagcagguaccuuccuagcuacgauugcuuguuggacgauccuuucgaccccgccuggccucagccccccgaguuaccuggcaucaacuauaguauggacgaacagugucgguucgacuucggcucaggcuaccagacaugucucgcuuuuagaacuuuugaaccuugcaaacagcuuuggugcagucacccugauaaccccuauuucugcaaaaccaaaaaaggcccuccucuggaugggacagagugcgccccggguaaguggugcuucaagggacauugcauauggaaaagcccugaacagacuuacggccaggacggcggcuggaguagcuggacuaaauuuggcucuugcaguaggucuugcgggggcggaguaaggagcaggagcaggagcugcaacaaucccucccccgccuacggcggcagauugugccuuggcccuauguucgaguaccaagugugcaauagcgaagaaugcccagggacauacgaggacuuuagagcccagcaaugcgcaaagagaaauaguuacuacgugcaucagaacgcgaaacauucaugggucccauacgagccugacgaugaugcacaaaaaugugaguugaucugucaguccgccgauaccggcgaugucgucuuuaugaaccaggugguucacgacgguaccaggugcaguuaucgagaccccuacucuguuugcgcuagaggugagugugugcccgugggcugcgauaaagaagucgguucuaugaaggcggacgacaagugcggcguguguggcggcgacaauucacauugccgcaccguaaagggcacacuugguaaggcuagcaaacaggccggcgccuugaaauuagugcagauuccagccggcgcaagacauauccagaucgaggcacuugagaaaucuccucacagaaucgugguuaagaaucaggucaccggcuccuucauuuugaaucccaagggcaaggaagccacauccagaaccuucacggcgauggggcucgagugggaggaugccguggaggaugccaaagagucccuuaagacgucaggcccuuuacccgaagcuaucgcuauccuggcacuccccccaacagagggaggcccaagaagcagccuugcauauaaguacguuauccacgaagaucuuuugcccuugauaggcuccaauaacguacucuuggaggaaauggacacuuaugaaugggcucucaagaguugggcuccuugcucuaaggccuguggaggcggcauccaauucacgaaguaugguugucguagacggcgcgaucaccacauggugcagagacaucucugugaucacaagaagcguccuaaaccaaucagacgcagguguaaccagcacccuugcucacagcccguguggguaaccgaagaguggggcgcuuguucccggucaugcggaaaauugggcgugcagacucgggguauccagugucuccugccauuguccaacggaacccauaaggucaugccggccaaggccugcgcuggggauaggccggaagcucguagaccuugucucagggucccauguccugcccaauggaggcugggcgcuuggucucaauguucugccacauguggagaaggcauccagcaacgucagguuguguguaggaccaaugcuaauagccugggucacugcgaaggggaccggccagauacaguccaggucugcagcuuacccgccuguggcgggaaccaccagaauagcacugucagggccgauguuugggagcucgguacuccagagggacagugggugccucagucagagccucugcaccccauuaauaaaauaaguagcaccgaaccaugcaccggcgaucgcucaguuuuuugccagauggaagucuuagaucgauauuguuccauuccaggauaccacagacuguguugcgugucuuguaucaaaaaggcuucuggccccaauccaggucccgaccccggaccuacgucucuaccucccuucaguaccccaggcucacccuugccggguccacaggaucccgcugacgcagcugaaccccccgggaagcccaccggaagugaagaucaucagcacggcagagccacucaacucccaggagcacuggacacuuccagccccggcacccagcauccuuuugcucccgagacccccauccccggcgccaguugguccauuaguccaacaacccccgggggguuaccaugggguuggacucagacaccuaccccagugcccgaggacaaggggcaaccaggcgaggaucugagacaccccgggaccaguuuaccagcugcuucgcccgucaccuag

SEQ ID NO: 12444 - RNA, 762 nt, Artificial Sequence
  Description of Artificial Sequence: Synthetic coding sequence
auggcagccgcaacgagagguugucgcccauggggaagucuguugggcuugcucggccuugugagcgcugcugcagccgcuugggauuuggcaagucucaggugcacauugggcgcguucugugagugugacuucagacccgaccucccagggcuggaaugcgaucucgcccagcaccuugcuggacagcaucucgcuaaagcuuuggucgugaaggcucuaaaagcauuuguuagagacccagcuccuaccaagcccuuagugcuuagccuccauggguggacaggcaccggcaaaagcuacguaagcucucuguuggcucacuaccuuuuccaaggaggguugagaagcccacgcguccaucauuucucacccgucuuacacuucccccaucccucacacaucgaaagauacaaaaaagaucugaagaguuggguccaaggcaaccucacugccugugguagaucauuauuucuguucgaugaaauggacaagaugccaccugguuugauggaaguucugaggcccuuucucgguucgucauggguaguuuauggaacgaauuaccgcaaagcuauuuucaucuucauccgcuggggcccagcccugcagugggcacaguggggcggacauuuuuccgagguucagcuguacucacugagucuauguagccagcagaauccugugccccacggccuaaguugggccuucccagugcccagcgcuaccuuacgggacgauaucgugauucccccagguuag

SEQ ID NO: 12445 - RNA, 966 nt, Artificial Sequence
  Description of Artificial Sequence: Synthetic coding sequence
auggcugccgcuacacgcggaugucgaccgugggguucccucuugggucugcugggacuugugucagcugccgcugccgccugggaccuggcuucucuuagauguacccuuggggcuuuuugcgaaugcgauuuuagacccgaccugccuggguuagaaugcgaccuugcccaacaucuugccggucagcaccucgcuaaagcccucgucgucaaggcccucaaggcguuuguccgcgaccccgccccaaccaagccccuugugcugagccugcacggauggacgggaacagggaaaucauacguuucaagucuccuggcacacuaucuguuccagggggggcuucggucaccacgggugcaccacuucucuccgguacugcacuucccacaucccucccacauugaaagauauaagaaagaucucaagaguugggugcaggggaauuuaacagccuguggacgaagucuguuucuguuugaugagauggauaagaugccaccaggacuuauggaagugcugcggccguuccuaggcuccucuugggucguguacggaacgaacuauagaaaggcgaucuucauuuuuauuaguaauacuggugggaagcagauuaaccagguggcucuugaagccuggcguucaagaagggauagagaggagaucuugcuucaggagcuagaaccaguaauuucacgggcugugcucgacaacccacaccacggcuuuagcaauuccggcaucauggaagagcgccuccuggacgcuguggugccauuucucccgcuccagaggcaccauguccgucacugcguguugaaugaacuugcucagcugggacucgagccucgcgacgagguuguacaggcgguccucgauucaaccacauucuucccugaagaugaacagcuauucaguucuaauggauguaaaacaguggccucccgaaucgccuuuuuuuuguag

SEQ ID NO: 12446 - RNA, 576 nt, Artificial Sequence
  Description of Artificial Sequence: Synthetic coding sequence
augcaggucuggugugaccaacgacacgaucccgggggcuggacggucauucagcgucgcuuggacggcucuguaaauuuuuuccguaacugggaaacauacaaacagggguucggcaacaucgauggugaguacuggcugggcuuagaaaauaucuacuggcucacgaaccaagguaacuacaagcuucugguuacgauggaggauuggagcgguagaaagguguuugccgaguacgccuccuuccggcuggaacccgaguccgaauacuacaaguugcguuuagguagauaucacgggaaugcaggagauagcuucaccuggcauaaugggaaacaguuuacuacguuagauagagaccacgauguguacaccgggaauugcgcccauuaucagaaaggagguuggugguacaaugccugcgcccauucuaaucuuaacggaguaugguaucgcgggggucauuaccgcaguagauaccaagacggaguuuauugggccgaguuccguggggguagcuacucgcugaagaagguggugaugaugauccgucccaauccuaacacauuucauuag

SEQ ID NO: 12447 - RNA, 1482 nt, Artificial Sequence
  Description of Artificial Sequence: Synthetic coding sequence
augcggccacugugugucacguguugguggcuuggccuuuuggccgcuaugggugcuguugcagggcaagaagacggguucgaaggaacugaagagggaagcccaagagaauuuaucuaccuaaaccgcuacaaaagagcaggggaaucucaggauaagugcacuuauacuuucaucgucccgcagcagagggugaccggugccauuugugugaacucaaaagaaccagaggugcuacucgagaauaggguacauaagcaggagcuggaauugcugaauaacgagcugcucaaacaaaagaggcagaucgagacacuccagcaauugguugaaguggauggaggaauagucucagaaguuaagcuccucaggaaggaaucgcggaauaugaacucgagagugacacagcuguacaugcaauuacuccaugagauuauucgcaaacgggacaaugcuuuggagcuuucacaacuagaaaauaggauacuaaaucaaacagcagauaugcugcagcuugcuagcaaauacaaggacuuagagcacaaguaucagcacuuagccaccuuagcgcauaaccaaucugaaauaaucgcucagcucgaggagcacugucaacgcguacccucggccagacccgugccucagccuccaccugcugcgcccccacggguguaccaaccuccaaccuauaaccgcaucaucaaccagauuuccaccaacgaaauccaaagcgaucagaaccugaagguauugccaccaccccuuccaaccaugccuacccugacaagcuugcccucuucgacugacaagcccaguggcccguggagagacugccugcaggcucuggaggacggccaugauacauccaguauuuaucucguuaagcccgaaaacaccaaccgauugaugcagguguggugcgaucagagacacgauccuggcggguggacugugauccagcguaggcuagaugggucugucaacuuuuuuagaaauugggagacauauaagcaggguuucgggaacauugacggggaguauugguugggccuugaaaauauauacuggcucacuaaucagggaaacuauaaguugcucguuacuauggaggauugguccgggaggaaagucuucgcggaguaugcuucuuuucgguuagagcccgaguccgaguacuacaagcuuagacucggucguuaccauggcaacgcaggggauucuuucacuuggcauaauggcaaacaguucaccacucuggacagagaccaugacguguacaccgguaauugugcccacuaucagaagggaggcuggugguauaaugcuugugcccauuccaaucugaacggagugugguaucggggagggcauuaccggagccgcuaucaggauggaguguacugggccgaguuucggggcgggaguuauagccuuaaaaagguagugaugaugauuagaccuaaucccaacaccuuucauuag

SEQ ID NO: 12448 - RNA, 1959 nt, Artificial Sequence
  Description of Artificial Sequence: Synthetic coding sequence
auggcugcggcagcccugcccccgagaccucuucuuuugcugccccuuguucuucugcugagcgggaggccaacaagagcagacagcaaaguuuucggcgaucuugaccaaguuaggaugacgagugaggggucagacugccgaugcaaguguaucaugcgcccccugucaaaggacgccuguucgcgggugagaucaggaagagcuagaguggaagauuuuuacacugucgaaacagucucauccggaaccgacugucggugcagcuguacugcgccaccuuccucacugaaucccugugagaacgaauggaagauggagaaacugaagaaacaggcaccagaguuguugaagcugcagucaaugguugaucugcuugaagggacauuguauuccauggaccucaugaaaguccacgcauacgugcacaaagucgcgagucagaugaauacauuggaggaguccaucaaagcuaaccuuuccagagaaaaugagguggucaaggacuccgugcggcaucucucggagcagcucagacauuaugagaaucacuccgcaauuaugcucggaauuaagaaggagcuguccagacucggacugcagcugcugcagaaggaugccgccgcugcccccgcuacaccagcuacagggaccgguucuaaggcacaggacacggcuagaggaaaggguaaggauaucucuaaauauggauccguucaaaaaucauucgcggaucgaggauugcccaagcccccaaaagaaaaacuacuacagguggagaaguugagaaaagaguccgggaaaggcucuuuucuucagccuacugccaaaccacgggccuuagcucaacagcaggccguuauucgcggguucacguacuacaaagccggcaagcaagaagucacggaggccguagcugacaacaccuugcaaggaacaagcuggcucgaacaacuaccccccaaaguggagggcaggucuaacagcgccgagccuaauagugccgaacaggacgaagcggagccucgauccucagagagagucgaccuggccagcgguacgcccacuuccauucccgccacaacaaccaccgcuaccaccacuccaaccccgacuacgucccugcuuccaaccgaaccccccucuggaccugagguuagcucccagggaagagaggcaucgugcgagggaacacuccgcgcaguggaucccccugugcgacaucacagcuauggaaggcacgagggcgccuggaugaaggauccugcugcacgcgacgaccguaucuaugugacgaauuacuauuauggcaauucguugguugaguuucgcaacuuagagaacuucaagcagggccgcugguccaacauguacaaacugccuuauaacuggauugggacaggucacgucgucuaccagggugccuuuuacuauaaucgggcauucacaaaaaacauaauaaaguaugaccugcgccaaagauuuguggcuuccugggcccugcugccugauguuguuuaugaggacacgacucccuggaaauggcggggccacucagacauugauuuugccguggacgaauccggucuuuggguaauuuacccugcuguugacgauagagacgaggcccagccagaagugauagugcuauccagacuggauccuggcgaccuuuccguccacagggagacuacauggaaaacgcggcuacgccggaauagcuauggcaauugcuuucucguuugcggcauacucuaugcuguugacacguacaaucagcaggaaggccaggucgccuacgcuuuugacacacauaccggcacugaugcacgcccccagcuuccguucuuaaacgaacaugcauacacaacccaaaucgauuacaaccccaaggagagaguucucuaugcaugggauaauggccaccaguugacuuacacauugcacuuugugguguag

SEQ ID NO: 12449 - RNA, 1641 nt, Artificial Sequence
  Description of Artificial Sequence: Synthetic coding sequence
augaagaaccaggacaaaaaaaacggcgccgccaagcaguccaacccgaaaucauccccgggccagccugaggccggcccugaaggugcucaggagaggccaagccaagcagcacccgccguggaagccgaaggaccaggcagcucacaggcuccaagaaagcccgagggugcccaggcucggacggcucagagcggagcccugcgagaugugagcgaggaauuaagcaggcagcuggaagacauucuguccacauauugcgucgauaacaaccaaggcggacccggggaagacggggcccagggagagccggcugagccagaggacgcugagaaguccaggacauacguggcuaggaauggagaaccugaacccaccccagucgugaacggagaaaaagagccgaguaagggggauccgaauacagaagaaauccgacagagugacgaggugggcgaccgcgaucaucggagaccgcaagagaagaaaaaagccaagggacuuggaaaagaaaucacccuccugaugcaaacacuuaacacacuuuccacaccugaagagaaacuggccgcucugugcaagaaauacgcugagcugcucgaagagcaccgcaauucucagaagcagaugaaauuacuccagaagaagcaaucccagcuuguacaggaaaaggaucaccugcggggagaacauuccaaggcugugcuggccagaagcaagcucgagagccugugcagagaguugcagaggcauaaccggaguuugaaggaagagggcguccagagggcacgggaggaggaagaaaaacggaaggaggugaccagccauuuucagguaacucugaacgauauucaacugcagauggaacagcacaaugaacgcaauucaaagcugaggcaagagaacauggagcuagcugagcgccugaagaagcucaucgaacaauaugaacugcgggaggagcacaucgacaaaguauuuaaacacaaggaccuucagcagcagcuaguagacgccaaacuccagcaggcccaagagaugcugaaagaggccgaggaaagacaccagcgagagaaagacuuucugcugaaggaggcagucgagagccagcgcaugugcgaguugaugaagcagcaggagacucaccugaaacagcagcuggcccuauauaccgagaaguucgaggaauuccaaaauacccugucaaaaucaagcgaggucuucacuacguucaagcaggaaauggagaaaaugacuaagaagaucaaaaagcuggagaaagaaacaacgauguacaggagccgcugggagucauccaacaaagcucuacucgagauggccgaagaaaaaaccgugcgugauaaagaguuagagggacuccaagugaagauccaaaggcuggaaaagcugugccgggcgcuacagacagaacggaaugacuuaaacaagcgaguucaagaucucagcgcagggggccaggguagccucacagauagcggcccagaaaggagacccgaaggcccaggagcucaggcucccucaucaccccggguaacggaggcccccuguuauccaggagcgccuucaacagaggccagcggccagaccgggccacaggagcccacgucggcucgggccuag

SEQ ID NO: 12450 - RNA, 1641 nt, Artificial Sequence
  Description of Artificial Sequence: Synthetic coding sequence
augaaaaaccaggacaagaagaacggggccgcuaagcagagcaacccaaaguccucaccuggccagccagaggcggggcccgaaggcgcccaagagaggccgucccaagcagcuccagccguugaggcugaaggaccggggucgucgcaagcgccaaggaagccugaaggcgcccaggcuagaaccgcccagagcggugccuuacgagauguuagugaagaacuuucuaggcagcuugaggauauuuugucuacauacugugucgauaacaaucaaggaggcccuggggaagauggagcccagggugagcccgccgagcccgaggacgcugagaaguccaggacauacgucgcacgaaauggcgaacccgagccgacaccuguggucaacggcgaaaaggaaccaaguaagggugauccgaacacugaagagauuaggcaaucagaugaaguuggagacagagaccaucgcagaccacaggaaaagaagaaagcuaaaggucucggcaaagaaaucacgcuguuaaugcagacccucaauacgcuguccacgccggaagagaagcuggccgcucugugcaagaaguacgcugaacuucucgaagagcaccgaaauagccagaagcaaaugaaacuacugcaaaagaaacaaucgcaguugguccaggaaaaagaucacuuacgaggagaacauuccaaggcugugcuugcccgauccaaacucgaauccuuaugucgcgagcugcaacgccauaauagaagucuuaaagaggagggcguccaaagagcgcgugaggaggaagagaaaaggaaggaaguaacgucacauuuucagguuacucuuaacgacauccagcugcagauggagcaacacaaugaaaggaacagcaaacuaaggcaggagaauauggagcuggcugagagacugaagaaguuaauugagcaguacgagcugcgggaagagcacaucgauaaagucuucaagcauaaggaucugcagcagcaguugguggaugccaaacugcaacaggcacaagaaaugcucaaggaggcugaggagcgacaucaaagggagaaagauuuucuuuuaaaggaggcuguggagucgcagaggaugugcgaacuuaugaagcagcaggaaacucacuuaaagcaacagcucgcacuguauacagagaaguuugaggaguuccagaauacauugagcaagagcagcgaggucuuuaccaccuucaagcaggagauggagaagaugacaaaaaagauaaagaagcuugaaaaagaaaccaccauguacaggagcagaugggagaguucuaacaaggcacugcuggagauggcugaggagaagacggugcgggauaaggaguuggaagguuuacaggugaagauccagagacucgagaaacucugccgggcccuucagacugagaggaacgaccugaauaaaagagugcaagaucugucugcgggugggcaggggagccugaccgauuccgggccagaaaggcgucccgaaggcccaggcgcccaggccccaagcucaccuagaguaacagaagcccccugcuauccuggcgcaccaucaacagaagcuucaggacagacagguccgcaggagccuaccucugcaagagccuag

SEQ ID NO: 12451 - RNA, 1392 nt, Artificial Sequence
  Description of Artificial Sequence: Synthetic coding sequence
augcacggcucauguagcuucuuaaugcuccugcugccauugcugcuccugcugguagcuacuaccggcccugucggugccuuaaccgaugaggaaaagcgccucaugguagaacugcacaaucucuaucgagcacagguuucccccacagcaagcgauaugcuucacaugcgaugggaugaagagcuggccgcuuuugccaaggccuaugcccgucagugcguguggggucacaacaaggaacggggaaggaggggggaaaaucuguucgcuauuacugaugagggaauggacgugccauuggcuauggaggaauggcaccaugagcgugaacacuacaaucugucugccgcuaccugcagucccggacaaauguguggccauuacacacaagucgugugggcgaaaacggagcggaucggcugcgguagucauuucugcgaaaagcugcaggguguagaggaaacuaauaucgaacugcuaguaugcaacuacgagccuccaggcaacguuaagggcaagcgacccuaccaagaaggaacucccugcucccaaugcccuucuggguaccacugcaagaacucauuaugcgaacccauugggaguccagaggacgcccaggaccugcccuaccuugugacagaggccccgaguuuucgggcuacugaggccucugauucaagaaagauggguacaccuucaucuuuagccaccggcauuccagcauuccucgucacugaagucucugguucacuggccaccaaagcguugccagccgucgagacccaggcuccaacuucucuugcaacgaaggacccuccauccauggcuaccgaggccccacccugcgucaccaccgaggugccuucaauccuugcugcucacagucugcccagccuggacgaggagccagucacauuucccaagaguacacacgucccuauaccaaaaagcgccgacaaggucacagacaagacaaaaguaccuagccgcagucccgagaauucacuggauccuaaaaugagccugacaggggcacgggagcuucugccacaugcucaggaggaggcagaggccgaggccgaacuccccccuucuuccgaaguacuggccuccgucuuuccagcgcaggauaaaccuggcgaacuucaggccacacuagaucacacaggacauacuucaucuaaaagccucccgaauuuccccaauacuagugcaacugcgaacgcaacuggagguagggcucuggcccugcagaguaguuugcccggugcagaagggccugacaaaccaucuguggugagcggacugaacucaggacccggacacgugugggggccccuuuuaggacugcucuugcugcccccccucguccuggccgggauauuuuag

SEQ ID NO: 12452 - RNA, 459 nt, Artificial Sequence
  Description of Artificial Sequence: Synthetic coding sequence
augauguugccucaguggcugcuccuuuuguuccugcuguuuuuuuucuuauucuuguugacacgcgguagucugucgccuaccaaauauaacuuacucgagcucaaggaguccugcauuagaaaucaagacugugagaccggauguugucaacgcgccccugauaauugugagagucacugugcugaaaaaggaagugaaggcucacugugccagacccaagucuuuuuuggccaguaucgcgcauguccuuguuuacggaaucugacauguaucuauucuaaaaacgaaaaguggcugucuaucgcauacggccggugccaaaaaaucggaagacaaaaauuagcaaagaagauguuccugguacugccuccgaguugcugccuguuguugcuucaccuucuguccagccucccacgugcccucugcagccccugcucaccugagcccccccccuag

SEQ ID NO: 12453 - RNA, 366 nt, Artificial Sequence
  Description of Artificial Sequence: Synthetic coding sequence
augaugcugccucaguggcuacugcuguuauuucuuuuguuuuuuuuuuuauuccuguugacucguggaagucugucucccacaaaguauaaccugcuagaauugaaagagaguugcauacguaaccaagacugugaaaccggcuguugucaacgcgcacccgacaacugcgagagucacugcgcagaaaaaggaagugaagggucacucugccagacacagguuuucuucggccaguaucgugcgugcccuugucugagaaaccuuacaugcauuuauuccaaaaacgagaaguggcuuucuaucgccuacggaagaugucagaagauuggucgccagaaacuugccaaaaagauguuuuucuag

SEQ ID NO: 12454 - RNA, 1122 nt, Artificial Sequence
  Description of Artificial Sequence: Synthetic coding sequence
augaggcuucucgcguggcugauuuucuuggcaaauugggguggcgcuagagcugagccggguaaguuuuggcauauagccgauuugcauuuagaccccgacuauaaagucagcaaggauccguuccaggucugucccuccgccggaucccaaccuguaccugacgcagguccuuggggagauuaccucugugauucucccugggcacuuauuaacucuucaauuuacgcgaugaaggaaauugagccugagcccgacuucauucucuggaccggagaugacaccccgcaugucccggaugagaaacuaggugaggccgccguccucgagauaguugaacgcuugacaaagcuuauuagggaaguguuuccugacacuaagguguacgccgcauugggaaaccaugauuuucacccaaaaaaccaguucccagccgggaguaauaauaucuauaaccagauagcagaauuauggaagcccugguuauccaacgaguccauagcucuguucaagaagggggcauucuauugugagaaauuaccggggccaagcggcgcuggacguauuguugugcuaaacacuaaccuguauuacaccuccaaugccuugacagcagacauggcagauccaggucagcaauuccaguggcuugaggauguccuuacggaugccagcaaggcaggugacauggucuauauuguggggcacgucccaccuggcuuuuuugaaaagacgcagaacaaggccugguuucgugaaggauucaacgagaaguaccugaaaguuguacgcaaacaccauagggucauagccggucaguuuuucggacaucaccacaccgacuccuuuagaaugcuguaugacgacgcuggugugccaaucuccgcaauguucaucacccccggugugaccccuuggaaaacuacucugccugggguagugaauggcgccaauaauccggccauucggguuuucgaguaugaccgagcgacuuugucccugaagguacggagcccggcagaggccaggggaggaggcugggagggccucaaaugcauaacuacauucccacauucucaacugauacaucucccccugacgacagagccgcaggaaggcuag

SEQ ID NO: 12455 - RNA, 810 nt, Artificial Sequence
  Description of Artificial Sequence: Synthetic coding sequence
augcggcucuuggccuggcugaucuucuuggcaaacugggguggugcacgagcggaaccugaagaagcacagggcccuugcgcacaggagaaggguaagggaccuccaccaaccagcauccuggcauccuuagcaccaggacuggaagcuggcaaguuuuggcauauugcagauuugcauuuagaccccgacuacaagguauccaaggauccauuucaaguuugccccagugcagguucccagccaguucccgacgcuggucccuggggugacuaccugugugacucgcccugggcauuaaucaauaguuccaucuaugccaugaaagaaauugagccugaacccgauuuuauccuuuggacaggcgacgacaccccccacguccccgacgaaaaacugggagaggcugcgguacuggagauuguggagcgauuaaccaaacugauccgggaaguguuccccgacacaaagguguaugccgcccucggcaaccacgacuuccaccccaaaaaccaguucccugccggaucaaauaacauuuacaaucagaucgccgaacuguggaaaccuuggcuuuccaaugagaguaucgcccucuucaaaaagggcgcauucuacugugaaaagcugcccgggccaucaggagcaggaaggauuguggugcugaauaccaaucucuacuacacuagcaaugcacucacggcugauauggccgacccaggacagcaguuccaauggcuugaggauguauuaacagacgccaguaaagcuggagacaugguuuauauagugggacacgugcccccuuag

SEQ ID NO: 12456 - RNA, 1368 nt, Artificial Sequence
  Description of Artificial Sequence: Synthetic coding sequence
augagacugcuggccugguugaucuuuuuagccaacugggggggugcucgggcugagcccggcaaauucuggcauaucgcugacuuacauuuggacccagauuauaagguuucaaaagacccuuuccagguuugcccuucugcagguagccaaccugucccugaugccggcccuuggggugacuaucugugugauuccccuugggcccugauuaacaguucaaucuaugcuaugaaggagaucgaaccugaaccugauuuuauuuuauggaccggcgaugauaccccccauguuccugacgaaaagcugggcgaagccgcugugcuugaaauuguggagagacuaacaaagcuuaucagagagguguuuccggacacuaaaguguacgccgcacuggggaaucacgauuuucacccaaaaaaccaguuccccgccggauccaacaacauauauaaucagauugccgaguuguggaaaccauggcugucgaacgagucuauagcccucuucaaaaagggagcauucuauugugagaaacugccuggcccaucaggugcaggacggaucgucguauuaaacacaaaccuguauuacaccagcaacgcucugaccgcggacauggcugacccaggacagcaguuccaguggcuggaagacguccugacugaugcuucuaaggccggcgauaugguguacaucguugggcaugucccaccaggcuucuucgaaaagacccagaacaaggcaugguuuagagaagguuucaacgaaaaauaccugaaaguggugaggaagcaucaucgcgugauugcuggccaguucuucggacaucaucauaccgauucauuucgcauguuguaugaugacgcagguguccccauuuccgccauguuuauuaccccugguguuaccccauggaaaacgacucugcccggcguuguaaacggcgcuaacaauccugccauuagaguguuugaauacgaccgggccacccugagccugaaagacauggucacuuauuuuaugaaucugucucaggcaaacgcacagggaacaccccgcugggaacuagaauaucaguuaacugaagccuacggggugcccgacgccuccgcucacagcaugcauacugugcucgaccgcauugccggggaucagaguacccuucagagauauuacgucuauaacagcguuagcuauucugcuggagucugcgacgaggccugcucuaugcagcauguuugugcuaugcgacaagucgacauugaugcauacacuacaugccuguacgcaucaggcacuacaccaguuccccaguuaccccugcugcugauggcacuguugggacuaugcacacugguccuguag

SEQ ID NO: 12457 - RNA, 867 nt, Artificial Sequence
  Description of Artificial Sequence: Synthetic coding sequence
auggccuuagcaccuccgccuagaggccucuggcaggccaaagacauuucucccaucgugaaggccgcucgucgagauggagagcuuuugcugucugcccaacucgauuccgaagaaagggacccaggugucccaagaccuucccccuacgcacccuacauuuugguuuaugcaaacgaccuggccauuuccgaaccaaauagcguagcagugacauuacaaagguacgaccccuucccugcaggcgauccugaaccacgugcagcaccaaacaacuccgccgacccuaggguuagacgcgccgcacaggccacuggaccucugcaagacaacgagcugcccgggcucgacgaacguccaccucgugcccacgcucagcacuuccauaaacaccaacuguggccaucuccuuuccgggcucuuaaaccacgucccggccguaaggauaggcgcaagaagggacaggagguauucauggccgccucacagguccuugacuucgaugagaagacgaugcaaaaggcccgccgcaagcagugggacgagccccgcguguguagucgccgauaccucaaagucgacuuugccgauauuggcuggaacgaguggauaaucucacccaagucuuucgaugccuauuacugugcaggagccugugaauucccuaugcccaaaauuguacgaccuuccaaccaugcaacgauucaguccauugugcgggcgguggggauaaucccuggaauccccgaacccuguugugugcccgauaaaaugaacagccugggaguguuguuccuggacgagaaccgcaauguuguguugaagguguacccgaacaugucugucgacaccugcgcaugucgcuag

SEQ ID NO: 12458 - RNA, 1626 nt, Artificial Sequence
  Description of Artificial Sequence: Synthetic coding sequence
augccguuucggcugcugauuccucugggcuugcuaugcgcuuuauuaccucagcaccauggggcuccuggcccugacggcucugcgccugacccugcccacuauucuuuuucccugacccuuauugacgcccuugacacccugcugauacuuggaaaugugucugaauuccaacgcgugguagagguucuccaggauuccguagacuuugauaucgauguaaacgcuucagucuucgaaacuaauauucgggucgucgggggccugcuuagugcgcaccuccuguccaaaaaggccgggguagaaguggaggcagguuggcccuguucaggaccucugcuccgcauggccgaagaggcagcacgcaaauuacuaccagcauuccaaaccccaacaggcaugcccuacggaacugugaaucugcugcacggcgugaauccuggggagaccccagucacuuguacugccgguauaggcaccuucauuguggaguucgccacacuuagcagccugaccggggauccugucuucgaggacguagcaagaguggcccugaugagacuaugggaaucucggucagacauuggccugguugguaaccauaucgaugugcuuacaggcaaauggguagcucaggacgccggcaucggcgcgggcguggauagcuauuuugaguaccuugugaaaggagcaauucugcuacaggacaaaaaauuaauggcuauguuccuggaguacaacaaggccauccgaaacuacacaagauucgaugauugguaucuuuggguucagauguacaaaggaacggucagcaugccgguuuuucaaucccucgaggccuacuggccaggcuugcagagucuaauuggagauauugauaaugccaugagaacauuucuuaacuacuacaccguuuggaaacaguuuggggggcuuccagaguucuauaauauuccacaaggauacacagucgagaaacgggaagguuauccauuacgaccugaacugauugaguccgccauguacuuguaccgggcaacuggggaucccacccuguuagagcugggcagggacgcaguugagucuauugaaaagauuucuaaaguggaauguggcuuugcaacuaucaaggaccucagggaccacaagcucgacaacaggauggagagcuuuuuccuggcagagaccgugaaauaucuguaccugcuguucgauccuacuaauuuuauccacaauaauggaagcacuuucgaugccgugauaacaccuuacggcgaguguauccucggcgccggagguuacaucuucaacacugaagcccacccgauagacccugccgcgcugcacuguugccagcgucugaaggaggaacagugggaggucgaggaucuuaugcgggaauuuuacagccugaaaaggucacgaucaaaauuccagaaaaacacugucagcaguggacccugggaaccgccugcacggccugggaccuuguucaguccagaaaaccacgaccaggcuagggaacgaaaaccugccaaacaaaagguaccucuucugucuugcccuucacagccuuucacgucuaaacuggcacuauuggggcaggucuucuuggauucaaguuag

SEQ ID NO: 12459 - RNA, 1737 nt, Artificial Sequence
  Description of Artificial Sequence: Synthetic coding sequence
augcccuucaggcuccugaucccccuaggcuugcuuugcgcacuccucccucagcaucauggggcucccggcccagaugguuccgcccccgaccccgcucauuaccgggagcgaguuaaagcaauguuuuaucaugccuacgauucauaccucgaaaaugccuuccccuuugacgagcuucggccucuaaccugcgaugggcacgacacuuggggcagcuuuucacuuaccuugaucgaugcacucgauacccugcugauccuuggaaaugugucugaguuucagcgcgugguggaagugcugcaggacagcgucgauuucgauaucgaugugaacgcuucugucuucgagacaaauauucgaguggugggggggcugcugagcgcacauuugcugucuaaaaaagccggcgucgaaguggaggcugguuggcccugcuccggcccuuuacugagaauggccgaggaagccgcuagaaaacuccugccggccuuucaaaccccgaccggcaugcccuauggaacagucaaucuucugcauggcguuaauccaggagaaacccccgugaccugcacagccgggauugggaccuucaucguggaguucgcaacccucuccuccuugacaggcgaucccguuuucgaggacgucgccagagucgcgcugaugcgcuugugggagucuaggucagacaucgggcugguaggcaaccacauugaugugcuaaccgguaaguggguggcgcaggaugccggcauaggagcggguguugacucuuacuuugaguaucuggucaagggugcuauucugcugcaggauaaaaaauuaauggccauguuccuagaguacaacaaggccauuagaaacuauaccagguuugacgauugguaucuguggguucagauguauaaaggcacagugucuaugccaguauuucagucccucgaagcauauuggccgggccugcagucccucauuggugacaucgauaacgccaugcgcacauuccuaaauuauuacaccguauggaagcaguucggcgggcugcccgaguucuauaacauaccucaggguuacaccguggaaaagcgcgagggauacccuuugagaccugaacugauugaaagcgcaauguaucuguaucgggccacuggcgacccuacccuccucgaguuaggacgagaugcaguggagagcaucgagaaaaucucaaaaguggaaugcgguuucgcaacgauaaaggaccuccgggaucacaagcuggacaaucgcauggagucguucuuuuuagcugaaacagugaaguacuuauaucuacuuuucgauccgaccaacuuuauacauaauaacgguuccaccuucgaugccgugauuaccccuuauggugaguguauccugggcgccggcggguacaucuuuaacaccgaggcccacccaauagaucccgcugcccugcacugcugccagaggcugaaagaggaacagugggaggucgaggaccucaugcgcgaauucuacucuuugaagcgcagucgcucaaaauuucagaaaaauacugugucaucuggcccgugggagccgccagcaaggcccggcacccuguuuuccccagaaaaucacgaucaggcccgcgaaagaaaaccugccaaacagaaagucccuuuacugagcugcccaucacaacccuucacauccaagcuugcccuguugggccagguguuucucgauucuagcuag

SEQ ID NO: 12460 - RNA, 495 nt, Artificial Sequence
  Description of Artificial Sequence: Synthetic coding sequence
augcguuccuguuauguagcccaagccggcuugaaacugccugggaguagugaucccccagccagcgcuagccagucaacccgcauuacagcuaguggauacggcccuccaucguccagaccauccaguagaguggugaacggcgaagaugccgugccuuacucauggccauggcaaguaucacugcaauaugagaaaagcgggucuuucuaccacacguguggugguucccugauugcaccugauugggugguuacugcaggccacuguaucucgaguucaagaaccuaucagguuguuuuaggcgaguacgaucgcgcaguuaaagaaggcccggagcaagugaucccaauuaauucaggggaccucuuuguccacccccucuggaaccgcucauguguggcuugcggcaaugacaucgccuuaaucaagcucagccggucagcccagcuaggagacgccguccaauuggcuucccugccucccgcgggcuag

SEQ ID NO: 12461 - RNA, 3663 nt, Artificial Sequence
  Description of Artificial Sequence: Synthetic coding sequence
augccuggcuuauuaaauuggaucacaggagccgccuugccuuuaaccgcgucugaugugacaucuugugugagcggcuacgcccuuggccuuacugccucccuuacuuacggaaaucuggaggcucagccauuccagggacuuuuuguguaccccuuagacgagugcaccacagugaucggauuugaggccgugaucgcggaucgcguggugacugugcagauuaaagacaaggcaaaacuggaguccggacauuuugacgccucucauguuagaucuccgaccgugaccgguaacauucuucaggacggcguuucaauugcaccccauucaugcacucccggcaaggugacccuagaugaggaucuggagaggauucuauuuguagccaaccucggaaccaucgcucccauggagaacgugacuauuuuuaucucuacaucuucugaguugccuacccuaccauccggcgccgugcgcguccuucugccugccgugugcgcgccuaccguaccccaguuuugcaccaaaucgacaggcaccaguaaucagcaagcccaggggaaggacagacacugcuuuggcgccugggcaccuggaagcuggaacaagcuaugucuggccacacugcugaacacagagguuaguaaccccauggaauaugaguucaacuuccagcucgagauccguggacccugcuuacuggcaggggucgagucuccuacccacgagauccgcgcugaugccgccccaagugcgagaagugccaagucaaucauuaucaccuuggcuaacaagcacacuuuugacaggccuguggagauccucauccauccauccgagccucacaugccgcacguacuuaucgagaaaggcgauaugacccucggcgaauuugaccaacaccuuaagggaaggaccgauuucauuaaaggaaugaaaaaaaagucaagagcagaacgaaagacagaaauuaucagaaagagacugcauaaggacauuccucaucauagcgugauaauguugaacuucugcccugaccugcaaagcguacagccuugccuacgaaaggcucauggggaguuuaucuuucugauagauagguccucgucuaugagugggauaucuaugcaucgcgugaaagacgccaugcucguagcuuuaaagucguuaaugcccgccugucuuuucaacaucauuggguucgguucgacauucaagagucuuuuucccucaagccagacauacucagaggauucacuggcuauggcuugugacgacauucaacgcaugaaagccgauauggggggaacaaacaucuuaucuccccucaaaugggugauuagacagcccguccacagagggcauccacggcuacuguuuguaauuacugacggcgcagugaauaauacuggaaagguccuagaguuagucaggaaccacgcauucucaacuagguguuacagcuucggcauuggccccaauguaugccauagacuggugaaaggacucgcaaguguuagcgaggggucggcggaguuacugauggaaggugagcgccugcagccaaaaauggugaagagucugaagaaggcuauggcccccguccugucugauguuacgguggaauggaucuucccggaaaccaccgaaguguuaguguccccuguuagcgcuagcucgcuguucccgggagaacggcuaguuggauacggaauugucugcgacgccagccuacauaucagcaaucccaggagcgauaagcggcgacgauauucuaugcuccacucccaagagucugggaguuccguguucuaccauucgcaggacgauggacccggccuggagggcggcgacugcgcuaaaaauagcggagcgcccuucauccucggucaggccaagaaugcucgauuagcauccggcgacaguaccacuaagcacgaccugaaccugucacagcgacgacgggcuuauaguacaaaccagauuacgaaucacaagccccucccccgugccacaauggcaagugaucccaugccagcagcaaagagguauccccuccggaaggccaggcuacaggauuugaccaaccaaacuucccuugaugugcagagauggcagaucgaccugcagccccuucugaauuccggucaagaucucaaccagggacccaagcuccggggucccggugcacgccguccaucacugcucccacagggcugccagccguuccugccuuggggucaggaaacgcaggccuggaguccuguuagggaacggaccagugauagucgcagucccggcgaccucgagcccucccaccauccuagcgcguucgaaacugaaaccucuagcgacugggauccuccggccgagucacaggaacgagcaagcccgagccggccugcaacaccggccccaguccucgggaaagcacugguaaaagggcuccacgauagccaaaggcugcagugggagguauccuuugagcugggaacccccgggccagagcgcggcggugcacaagaugcugaccuguggucugaaacauuucaccaucuggccgcccgagcuauaauacgcgacuuugagcagcucgccgagcgggaaggcgaaauugagcagggauccaaucgccgguaccaggucagcgcuuuacauacauccaaagccuguaauauaaucucaaaauauaccgcuuuuguucccguugaugugagcaaaagcagauaccugccaacuguuguggaguauccaaacucagcggcguuacgaaugcucggaucgagggcuuuggcccaacaguggagaggaaccuccagcggcuucggccgaccacagacuaugcugggagaagacucggccccaggcaaugguaaauuccaggcuuugaacauggaggcguccccuaccgcacuuuuuucagaggcccgaagcccagguagagaaaaacacggcgcaucugaggggccccaaagaucacuggccacaaauacgcugaguuccaugaaggcauccgagaacuuguuugggagcuggcugaaucucaacaaaagcaggcuguuaacaagagcagcaaaaggcuuccugucuaagccacugauaaaggcugucgaaucuacgagcggcaaccagucauuugacuauauaccuuuggugucacuccagcuggcaagcggggcguuccuccugaacgaggccuuuugugaagcuacccauaucccaauggagaagcuaaaauggacuuccccuuucacaugccaccguguaucccuaaccacaagaccgucagaguccaaaaccccuucuccucagcuuugcaccuccucaccuccacgccacccaucuugcgacucauucucccuugagccucucgccaagggcaagcugggacuugaaccacgagcuguaguagagcacacuggaaaacugugggccaccguugugggccucgccugguuggagcacucaucagcuagcuacuuuacugagugggaacugguggccgcgaaggcuaauucaugguuggaacaacaggagguccccgaaggacgaacucagggcacacucaaggcagcggcaagacagcuguucguccugcuccggcauugggacgagaauuuagaguuuaacaugcuguguuauaauccuaauuauguguag

SEQ ID NO: 12462 - RNA, 3051 nt, Artificial Sequence
  Description of Artificial Sequence: Synthetic coding sequence
augcccgggcuccugaauuggauuacuggagcggcccugccacugacggcuuccgacguuaccagcugcguuucaggauacgcccucggucuaacugcuucacugacuuaugguaaucuggaggcccaaccauuccagggacuguuuguuuacccucucgacgagugcacaaccgucauuggauuugaggcagugauugcugaucgcguggucacuguucagauaaaggacaaggccaaacuggagucuggacacuuugaugccagccauguacgaucuccaaccgucacugguaacauucuacaggauggaguauccaucgcuccacauucaugcaccccaggcaaagugaccuuggacgaagaccucgagcgcauuuuguuuguagccaaucuggggacuaucgcaccuauggagaacguaacaaucuuuauuagcaccagcuccgaauugccuacucugccaucgggggccguccgcguccugcugcccgccgucugugcccccacugucccacaauucuguacaaaaagcaccgggaccuccaaucagcaggcucaagggaaagaucgucauuguuucggcgcgugggcccccggcucauggaauaagcugugcuuagcaacccuuuuaaacaccgaaguaaguaauccaauggaauaugaguuuaacuuucagcuugagauucggggaccuugucuccuggccggggucgaaagucccacccacgaaauccgggccgaugccgcaccuuccgccagaagugccaaguccaucauuauuacccucgcaaacaaacauacauuugaccgccccgucgaaauacuuauccaucccagugagccucauaugccucacguucuuaucgagaagggggacaugacucucggcgaguucgaccagcaccugaaaggcagaacggacuucaucaagggaaugaaaaagaaaaguagagccgagcgcaagacggagaucauacgaaagcgucuccauaaggacauaccacaucacagugucauuaugcuuaauuucugucccgaccuccaguccgugcaaccgugccuucggaaagcccacggcgaauucauuuuccugauagaucgcucuucuuccaugagcgguauuagcaugcaucgcguuaaagaugcaaugcugguagcccugaaaucacuuaugccagccuguuuauucaauaucauuggcuuugguaguaccuuuaaaucucuguuccccagcucccaaaccuacagcgaggacucucuugcaauggccugcgacgacauccagcguaugaaggcagacaugggcggcacaaacauccuaagcccucugaagugggugauuagacagccggugcaucggggucacccacggcuccuguuugucauaacugacggcgccgucaacaauacggggaaagugcuugagcugguacggaaucacgccuuuucuacgcggugcuauaguuuuggaaucgggccaaacguuugccacagauuggugaagggucucgccucuguaucugaagggagcgcagagcuuuugauggaaggagaaagacuucaaccuaagaugguuaaaaguuuaaagaaagccauggccccaguccucuccgaugugacgguagaguggaucuuccccgagaccacggagguccuggucaguccuguauccgccucuuccuuguuuccuggggaacgcuuaguagguuacggaaucgugugcgaugcaucccugcacaucucuaauccgagaagcgauaaaaggcgucgguacaguaugcugcauagccaagaaucugguagcucuguguuuuaccauagccaagacgauggaccugggcuggagggcggcgacugcgcgaagaauucaggggcgcccuucauucucggccaggcuaaaaaugcccgccuggccucaggcgauucuaccacaaagcaugaccugaaucuuucacagcgacggagggcguacagcacaaaccagaucaccaaccauaagccuuugccccgcgcaacaauggcauccgaccccaugcccgcugcaaaacguuaucccuugagaaaagcccgacugcaggaccuuacaaaccagacuucccuagauguccagcgauggcaaaucgacuuacagccacuccugaacuccggacaagaucugaaucaggguccgaaacuaagaggaccgggagcccggcgcccaucgcugcugccucagggcugucagcccuucuugccuuggggacaggaaacacaagccuggucaccaguucgggaaaggacuuccgauagccgcaguccgggcgaucuggagccuagccaccaucccucugccuuugaaacagaaacgucaagcgauugggauccuccugcagaaagucaagaacgcgcaagcccuagccgcccugcuacuccugcuccugugcucggcaaagcacucguaaagggacugcaugauagucagaggcuccagugggagguuucauuugaacucggcaccccaggaccagagcgggguggagcgcaagaugccgaucugugguccgaaaccuuccaccaccuggccgcgcgugcgaucauacgcgauuuugagcagcuugcagaacgagaaggggagaucgagcagggaaguaacagaagauaucaggugagcgcccugcacacauccaaggccugcaauaucauauccaaguacacagcuuuuguaccaguggacgucucaaagucucgguaucuccccacaguggucgaguauccgaauucugcugcauuaagaaugcuggguagccgggcacuggcccagcaguggagaggaacauccaguggguucgggcggccccagaccaugcugggcgaagauagcgccccaggaaacggcccuaggaaauguucgcagacccucaugggauuuaagacuaaaaccgaaaccgagcauucgguucguggauggaagcccagaggcgcauugcagaaccaaucugugcugucaaccaguuggagucauuggccccccaaaccucggaggacgagcucaacuccagagccuagcuag

SEQ ID NO: 12463 - RNA, 3663 nt, Artificial Sequence
  Description of Artificial Sequence: Synthetic coding sequence
augccaggucugcugaauuggauuacuggagccgcacuccccuugacugcauccgaugugaccucuugugugucugguuaugcccugggguuaaccgcaagccuuacauaugggaaucuugaggcacagccauuccagggccuguucgucuauccucuggaugaguguacuacagucauuggguucgaagcugugauugccgaccgcgugguuacgguccagaucaaagauaaagccaaacuugaaucaggccauuuugaugcgucgcacguaagguccccgacuguuacugggaacauucugcaggauggcgugagcauugcuccgcauucuuguacuccuggcaaagucacccuagacgaggaucuggagagaauccuuuuugucgccaaccuggggacgaucgcuccaauggaaaauguuacgauauuuaucucuaccagcuccgagcuuccaacacugccaagcggagcagucaggguacuucucccugcagugugcgccccuacagugccccaauucuguacuaagagcacgggcacauccaaucagcaggcgcagggaaaggaccgacauugcuucggcgcaugggcccccggcaguuggaacaagcucugucuggccacgcuccuuaacaccgaggugucuaauccuauggaauacgaguucaacuuccaacuugaaauucgcgggccgugccugcuagcuggcguugaaagucccacacaugagaucagggccgaugccgccccuuccgcgcgaucagcaaagagcauaaucaucacccuugcgaacaaacacacuuucgauaggccagucgagauccucauccaucccagcgagccccauaugccgcaugugcucauagagaagggagacaugacccugggggaguucgaccagcaccugaagggaagaaccgacuucauaaagggcaugaaaaagaagagcagggcagagaggaaaacagagauaauucguaaacgucugcauaaggacauuccgcaucacuccgugaucaugcuuaauuuuugcccagaccugcagagcgugcagcccugccugaggaaggcucacggggaauucauuuuucugaucgacagaaguucguccaugaguggaauuagcaugcaccgaguuaaggacgccauguugguggcacugaaaucucuuaugccagcuugucuuuuuaacaucauuggauucggguccacuuuuaagucccuguucccaagcucccaaacguacagcgaagauucacuggcuauggcaugugaugauauucagcgaaugaaagcugauauggguggcacaaacauacucaguccgcucaaaugggucaucagacagccaguccacagaggccauccaagacuucuuuuuguuaucaccgacggcgccgucaauaacacaggcaaagugcuggaacuggugcggaaucacgccuucagcacgaggugcuacucguuuggcaucggacccaaugugugucaccgccuggugaagggacucgccagugucuccgagggaagcgccgaguugcucauggagggugaacgccugcagccaaaaauggugaaaucucuaaaaaaagcuauggccccaguacugagcgacguaacaguggaguggaucuuuccagaaacaaccgaggugcuugugucccccguguccgccaguucccuuuuucccggcgagagguuggugggcuauggaauaguuugcgacgcgucacuacauaucaguaacccgcgcucugacaagaggagacguuauuccaugcugcacucccaggagaguggaaguagcguguuuuaucacucucaggacgauggccccggacucgagggcggagauugcgcaaaaaacaguggugcuccuuucauuuuagggcaagcaaaaaacgcgaggcuugccucaggugacucuacuaccaaacacgaucugaauuugucucagcguaggagggcauacucuaccaaucagaucacuaaucauaagccacugcccagagcuacuauggccagcgauccaaugccugcagccaagcguuauccccuuaggaaggcuagacuucaggaccugacuaaccagaccagccucgaugugcagagguggcagaucgaccugcaacccuugcugaauuccggccaggaccuuaaucaggguccaaaacucaggggcccaggcgcaagacggccuagcuuacucccccaagggugccagccauuccuacccuggggccaggagacucaagccuggucacccguccgagagaggacgagcgauaguagaagcccuggcgaccucgaaccuucccaucacccuucugcuuucgaaacagagacauccagcgauugggacccaccagccgaaucacaggaaagggcaagcccuucucgccccgcuacaccagccccugugcugggcaaggcccuugucaaaggcuuacacgacagccagaggcuucaaugggaggugaguuuugaguuaggaaccccaggccccgagcgagggggcgcccaagacgcagacuuguggagcgagaccuuucaucacuuggcagccagggccauuaucagggauuuugaacaacuugcggagagagaaggagagaucgagcagggaucuaacagaagauaccaagugagugcucuucauacauccaaagcaugcaauaucaucucaaaguacacagcuuucgucccgguggacguuuccaaaucacgauaccucccgacaguagucgaauacccuaauucugcagcuuugagaaugcuggggucccgagcacucgcucaacaguggagaggcacuuccagcgguuucgggaggccgcaaacuaugcugggagaggacucugcaccugguaacggaaaguuccaggcucuaaauauggaggccuccccgaccgcccucuucucagaggcgcgauccccaggcagagagaaacauggugcuucagaggggccacagcggagccuagcuacaaacacccuguccuccaugaaagccagcgaaaaucuguucgguaguugguugaaccucaauaagagucgcuuacugacccgggccgccaaaggcuuccuuucaaagccuuugauaaaggccgucgaauccaccucuggaaaccagaguuuugauuacaucccccuggugucguugcaguuagcuaguggcgcuuuccuacugaaugaggcauucugugaggcuacucauauccccauggagaagcugaaguggacaucuccauucaccugccacagagugucgcucacaacucgucccucugaaaguaagacgcccuccccccaacuuuguacaucgucaccccccaggcauccuucaugcgacucuuucagcuuggaaccccucgcuaaaggcaagcucgggcuggaaccccgcgcgguggucgagcauacaggcaaacuaugggccaccgucguaggccucgccuggcuggaacauucuuccgcuagcuacuucacagagugggaacucguggcggcaaaggcaaacucguggcucgagcagcaagaggugcccgaaggaagaacucagggcacccugaaagcagccgccaggcagcucuucguuuuacuccggcacugggaugagaaucuugaguuuaacauguuaugcuacaauccaaacuauguuuag

SEQ ID NO: 12464 - RNA, 5235 nt, Artificial Sequence
  Description of Artificial Sequence: Synthetic coding sequence
augcggcugcuguggggccugaucugggcuaguagcuucuuuacacugaguuugcagaaaccccgauuguugcuuuucucucccucuguagugcaucucggcgugccccucagcguaggagugcagcuacaggacgugccuagaggccagguugugaaggggagcguguucuuacgaaacccaucuaggaauaacgucccuugcucucccaagguugacuucacccucagcucagaacgagauuucgccuugcuuucccuacaggucccgcuuaaggaugcaaaaucuuguggcuugcaccaacugcuucgaggaccugaggugcagcuggucgcacacucaccguggcugaaagauucgcuaucccgcacaacgaacauucagggaauuaauuugcuuuucucaagccgucgcggccaccuguuucuacaaacggaccaaccaaucuacaauccagggcagagggugcgauauagagucuucgcccuggaucagaagaugcgcccgucgaccgauacaauuacgguuaugguggaaaacucgcacggauuaagggugcguaaaaaagaggucuacaugcccaguuccaucuuccaggaugacuucgucaucccagacaucucugagccuggaaccuggaaaauuuccgccagauucuccgauggacuugaaucuaauucaaguacacaguuugaagugaagaaauauguucucccuaacuucgagguaaaaaucaccccaggcaagccguauauccugacugugccaggucaccuggaugagaugcaacuugauauccaggcaagauacaucuacggcaagcccgugcagggggucgccuacgugcgauucgggcuccuggacgaggaugggaagaagacuuucuuucgagggcuagaaagccagacuaaguuagucaacggacagucacacauuagccuuucaaaggcagaguuucaggaugcgcuugagaaauugaauaugggcauaacagaccugcaagggcuucggcuauaugucgcugccgccaucauugaauacccuggaggggagauggaagaagcagagcucaccucaugguauuucgugucaucacccuuuagccucgauuugagcaagaccaaaagacaccuggugccaggugcccccuuccugcuucaagccuuagugcgcgaaaugucaggcaguccagccucggggauccccgucaaagucucugcuacuguguccucaccagguucuguuccagaggugcaggacauucagcagaacacugaugggagcggucagguguccaucccaauaauuaucccucagacaauauccgaacugcagcuuuccgucuccgcuggguccccacaccccgcaaucgcacguuuaacuguggcggcaccuccgagcggagggccgggauuucucucuaucgaacgcccugacagccgcccuccaagggugggcgauacacugaaccucaaucugcgggcuguuggaaguggcgcaacuuuuucacauuacuacuacaugauuuuaagcagggggcagaucguguucaugaauagagagccuaaaaggacacuuacaagcguuucuguguuuguggaccaccauuuagcaccuagcuucuauuucguggccuucuacuaccauggugaucaucccguggccaauaguuugcgcguggacgugcaagccggagcuugugaaggaaaguuagagcuguccguggacggggcuaaacaauaccguaauggggagagcgucaaauugcaccuggagacugacagccucgcccugguagcccucggugcccuugauaccgcccuguaugcugcagggucaaagagucacaaacccuugaauauggggaaggucuucgaggccaugaauuccuacgaccuaggcugcggucccgguggaggggauuccgcuuugcaggucuuucaggcagcugggcuugcuuuuagugacggcgaccaauggacguuaucuagaaagcgguuguccugucccaaagaaaagacaacaaggaagaagagaaaugugaacuuccagaaggcuauuaacgagaaacuggggcaguaugcuucuccaacagccaaacgauguugucaagacggaguuaccagguugccuaugaugagauccugcgagcagagagcagcaagagugcagcagcccgauugcagagagccuuuucuguccuguugccaguuugcugagagucuacguaagaaguccagagacaagggacaggcuggguuacaacgagcucucgagauuuugcaggaagaggaccucauugaugaggacgauauaccgguucgaucuuucuuuccugagaacuggcuguggcguguggaaacaguggauagauuucagauccugacacuguggcugcccgauagccugacuacuugggagauccacgggcugucccugagcaaaaccaaggggcucugcguagcgacgccugugcagcuuaggguguuucgagaauuccaccuccaucuccggcucccuauguccgucagaagguuugaacaacuggaacuaagaccagugcuguacaacuaucuagacaaaaaucugacuguuuccguccaugucagucccguggagggccugugccuagcaggaggcggggguuuggcccagcaggucuuggugccugccggcuccgcgcgcccgguggcuuucucugucguaccuacggcagccgcagcuguuucacuaaaagugguagcccggggcucauucgaguuucccgugggcgaugcuguaaguaaaguacuccagauugagaaggaaggcgcuauucacagggaggagcuuguauacgaauugaauccuuuagaccaccguggccgcacacucgagauucccgggaacagcgaccccaacaugauuccggacggagauuucaauagcuacgugcggguuacagccucugacccucuggacacauugggcuccgagggcgcccugagcccagggggagucgccagucuuuugcgucugcccagaggauguggugaacagaccaugauuuaccuggccccaacccuggccgcuucucgguaucucgacaagacugaacaguggucaacccuaccccccgagacaaaggaucacgccgucgacuuaauccagaagggguacaugcggauccagcaguuccgcaaagccgauggauccuacgcugccugguugucucgaggcagcucuacaugguugaccgcuuuuguucuuaaggucuugucccucgcacaggaacaagugggcgggagcccagaaaaguugcaagagaccucuaacugguugcugagccagcagcaggcugacggauccuuucaggaccugagucccgugauccaccgcagcaugcaggggggacugguggguaacgacgaaacuguggcauuaacagcauuugugaccauagcacugcaucauggccuggccguguuucaggaugaaggagcugagccuuugaagcaaagaguggaggcaucuaucucgaaagcguccuccuuuuugggugaaaaggcaagugccggcuuauugggugcgcaugccgccgcaauaacugcuuaugcauugacucuuacaaaggcuccugccgauuugaggggcgucgcucauaauaaucugauggcgauggcccaagagacaggcgauaaucuguauuggggaucagugacgggcucacagaguaaugccgucucccccacacccgcucccagaaaucccucagauccaaugccucaggcccccgcucucuggaucgagaccaccgcuuacgcccuccuacaucugcucuugcaugagggaaaagcggagauggcggaccaggccgccgccuggcucacucgucaaggaagcuuucagggcggcuuucggaguacacaagauaccgucauagcuuuagaugcccugucugccuauuggaucgcaucacacacaacugaagaacggggcuuaaauguaacccugucuagcacuggccgcaauggcuuuaaaucccacgcccugcaacugaacaacagacagauacggggccuagaagaggagcuacaauucagccucggcuccaaaaucaaugucaaagucggggggaacuccaaggggacucugaaaguacuacgaacuuacaacguacuugacaugaaaaacaccaccugccaggaucugcagaucgaaguuacagucaagggucacguggaauacacaauggaagcuaaugaggacuacgaagauuaugaauaugacgaacugccugcaaaagacgauccggacgccccucugcagccugugacaccccugcagcuguuugagggccggagaaaccgcaggcgccgggaggcaccgaaaguugucgaggaacaggagagcaggguccauuacacagucuguaucuggcgaaauggcaagguggggcuguccgggauggccauagccgaugugacacuccucucagguuuucacgcccuccgggcugacuuggaaaaguuaacuagucugagcgaucgcuacgucucccauuuugagacugagggcccccacguccugcucuauuucgauucugugcccaccucuagggaguguguggguuucgaggccgugcaagaagugcccguugggcuggugcagccagcuagcgccacccuuuacgacuacuauaaucccgaacgaaggugcagcguguucuacggggcuccuucuaaaagccgacucuuggcuacccugugcucagcugaaguuugccaaugugcagaaggaaagugcccacgccaacggcgagcccuugaaagaggauuacaggaugaggacgguuaccgaaugaaguucgccugcuacuacccucgagucgaguauggguuucaagugaagguuuuacgcgaggacucgcgcgcugcuuucagauuguuugagacuaagauuacccaaguucugcacuucaccaaggacgucaaggcggcugccaaccaaaugcguaacuuccucgugcgagccagcugccgccuccgccucgaacccgguaaggaauaucugaucaugggacuugacggcgcuaccuaugaucuggaaggccauccucaguaccuccuggauucuaauucuuggauugaagaaaugcccagcgaaagacuaugccgaucuacccgacaaagggccgcaugugcacaacucaaugauuuccugcaggaauacgguacacaggggugccagguguag

SEQ ID NO: 12465 - RNA, 1242 nt, Artificial Sequence
  Description of Artificial Sequence: Synthetic coding sequence
augaagggugcacuggguagcccaguugcggcggcaggggcagcgaugcaggagucuuucggaugugugguagcuaaucguuuccaccagcuacuggacgacgagagcgacccuuuugacauccuccgugaggcagaacgcagaaggcagcaacaacuucagagaaaacgacgggacgaagcagccgcugcugcaggagcaggucccagaggugggcgaagccccgccggagccucuggucaccgggcgggggcagggggcaggagagagagucagaaagaacguaagucgcuuccugcgccaguugcucaacggcccgacucucccgguggagggcuacaggcaccgggacagaagagaacuccccgcagaggagaacagcagggguggaaugacucacggggcccugaagggauguuggagagggccgaacgcagauccuauagagaauaccgccccuaugagacugaaaggcaggccgauuucacagcagaaaaauuccccgacgaaaaacccggagacagguuugaucgagacagaccacucagagggcgaggcgggccaagaggcgguaugagagggcggggccgagguggcccaggcaacagagucuuugacgcuuuugaccagcgggggaaaagagaauucgaaagguacggcgguaaugauaaaauagcggugcggacugaggauaauauggguggaugcggagugcggacuuggggcucggguaaggauaccucugauguggaaccaaccgcucccauggaggagccgacugugguggaggaaucacaagggacacccgaagaagagagccccgcgaaaguuccagaacucgaagucgaagaagaaacacaggugcaagagaugacucuggacgaguggaaaaaccuccaagaacagacuagaccgaaacccgaguuuaauaucaggaagccugagucuacaguaccaucuaaagccguugugauccauaaaucgaaauaucgcgacgacauggugaaggacgauuacgaggacgauucacauguauuucggaaaccugcuaaugauaucacuagccaauuggagaucaauuucgguaauuugcccaggccaggcaggggcgcaagagguggcaccagaggaggccggggaagaauacgucgagccgaaaauuauggaccuagagccgaagucgugaugcaggacguggcgccaaacccggacgacccagaagauuucccagcgcuguccuag

SEQ ID NO: 12466 - RNA, 927 nt, Artificial Sequence
  Description of Artificial Sequence: Synthetic coding sequence
augaaaggcgcucuuggcucucccguggcggccgcaggugccgcuaugcaagaaucauuuggaugugucguggcaaauagauuccaucaacuacuggacgaugaaagugauccuuuugauaucuugcgugaagccgagcgccgucgccagcagcaacuccaacgaaagaggcgcgaugaagccgcggcugcagccggcgcaggacccagagguggcaggucgccugccggagccucggggcaccgggcuggggcaggcggcagacgugagucucaaaaggaacgcaagucccugccggccccaguggcucaaagacccgacucuccuggaggaggccuucaagcgccaggccagaagagaacuccaaggagaggagaacagcaaggauggaaugacaguagaggacccgaaggaauguuagagcgagcggaacgcaggucauauagagaauacagaccuuaugaaaccgagagacaggcugauuucacugccgaaaaauucccagaugagaaaguuccggaauuggaaguugaggaggaaacacagguucaggagaugacuuuggacgaauggaaaaaucugcaggagcagacgcgcccaaaaccugaguuuaacauccgcaaaccagaaucaaccgugccuucuaaggccguggugauccauaaaucaaaguaucgggaugacauggugaaagaugauuacgaggaugacucccauguguucagaaaaccugcgaacgauauaacaucacagcuagaaaucaauuuugggaauuugccgaggccuggcagaggcgcucggggcggcacucgcggaggucgugggcgcauuaggagggcugaaaauuacggaccucgagcugaaguggugaugcaggacguagcccccaaucccgaugauccggaggacuuuccugcccuaagcuag

SEQ ID NO: 12467 - RNA, 1437 nt, Artificial Sequence
  Description of Artificial Sequence: Synthetic coding sequence
augccccgcaggggauauucuaagccagggagcugggguagcuuuugggccaugcugacccuuguggggcucgugacccacgcugcucaaagggccgaugugggaggcgaagccgcuggaacgagcauuaaccauagccaggccguacuacaacgccuacaggaacugcuacgccaaggaaacgcuucagauguuguucugagagugcaggcugccgggaccgacgaggucagagucuuucaugcccaccgcuuacuucugggucugcauagcgagcuauuucucgaacuccucucaaaccaguccgaagccgugcuccaggagccacaggacugcgcugcuguauuugauaaguuuauccguuaccuguacuguggggagcuuacggugcuucugacccaggccaucccacuucaccgacuagcuacuaaguacggaguguccucccuucagcgcggcguagccgauuauaugcgggcccaucuugcaggcggggccggaccugcuguggguugguaccauuaugcugugggcacuggagaugaagcccugagagagagcugccugcaguucuuagcguggaaccugagcgcuguggcagccucuaccgaauggggugccgucucccccgaacuucucuggcaacuucuucagaggucggaucucgugcugcaggaugagcucgaacuuuuucaugcacucgaagccuggcuuggucgagcaagaccaccacccgcuguugcagaacgggcgcugcgcgcaauacgauacccgaugaucccucccgcccagcucuuccaacuccaggcccgcagcgcugcccuggcccgccacgguccugccgucgccgaucugcugcugcaggccuaccaauuccaugccgcuucuccccuccauuaugccaaguucuucgauguuaauggcucagcuuucuuacccagaaacuauuuggcaccugccuggggggcuccaugggucaucaacaauccugcaagagaugacagaucuacaagcuuucagacacaacugggccccucaggccacgacgcggggcgccggguuacguggaauguccuguuuucuccccgcuggcugccaguaagucuccgaccuguauacgcugaugcugcagggacagcgcugccagcugcccggccugaagacgggagaccucggcucgucgucacccccgccuccaguggcggcgacgcugcuggaguuucuuuucagaaaaccgugcucgugggcgcacgucagcaaggucgacugcuugugcgccacgcuuacucguuccaccaaaguagcgaagaggcuggcgauuuuuuggcacacgcugaccuacagcgcagaaacucagaguacuuaguagagaacgcuuugcaccugcauuugauugugaagcccguauaccauacccucauucgaaccccaaaguag

SEQ ID NO: 12468 - RNA, 477 nt, Artificial Sequence
  Description of Artificial Sequence: Synthetic coding sequence
auguguugcccgggagggcauuacacacucauuuugcggagaggcaaucguuuucgacgagagaagcguccugcuaaagucaccggcgcacagaccgaaguacagcucgcgccccccuuaccacgcgguagggcucgcagaucgccauggucaguacccauuagucuuuccauugauaggcuggaguucgaucuguuauaccccgccaucaagggugacacaauccaacuuuacuugggcgccaaacugcuggacucgcagggcaaggucacuaaaugguucaauaacuccgcugcuucacuuacuaugccaacgcucgauaacauccccuucucauuaaucguaucucaggacguaguuaaagcagcagucgcagccguguuauccccagaagaguucauggugcuguuagauucugugcugccagagagcgcacaucgccugaagucuucuauaggucugauuaacgaaaaguag

SEQ ID NO: 12469 - RNA, 771 nt, Artificial Sequence
  Description of Artificial Sequence: Synthetic coding sequence
auguuucagacaggcggccuaauuguguucuauggccuguuggcccagacaauggcccaguucggagggcuuccuguaccccucgaccagacgcugccucuuaacguuaacccagcucucccccugucucccacugggcucgcggguuccuuaacaaaugccuuauccaacggucugcuaagcggcggcuuacugggaauccucgaaaaucugccucugcuggacauuuugaagcccggcggcggcacaagcgguggacuuuugggcggccucuugggaaagguaacaucagucauucccggcuugaacaacauuauugauaucaaggugacagacccccaguuguuggaacucgggcuggugcaaaguccugacgggcacaggcucuacgucacaaucccccuggguaucaagcugcaagucaauacuccgcuuguuggggcaucacuucuucgguuagccgugaaacuagauauuacagcagaaauccuugccguucgagauaaacaagaacgaauccaucugguuuugggagacuguacucacagcccgggcagccugcagauaucucuucuagauggacuugguccccugcccauucagggacugcuggauucccugaccgggaucuuaaacaaggugcugccagaacuuguccaggggaaugugugcccucucgucaacgagguauuacguggccuagauaucacccucgugcaugauauugugaacaugcucauccauggucuccaguuugugauuaaaguuuag

SEQ ID NO: 12470 - RNA, 771 nt, Artificial Sequence
  Description of Artificial Sequence: Synthetic coding sequence
auguuucaaacaggggguuugaucgucuuuuacggccuacuagcacagacuauggcucaguuuggugguuugcccguaccucuagaucagacucugcccuugaacguuaaccccgcccucccacugucacccacuggccuggccggcucccugacgaaugcccuuucaaacggacucuugucuggcggacuccuggggauccuggagaaccucccacugcucgacauacucaaaccagggggcgguacuucuggcggccuccuggggggguuauuaggaaagguaaccaguguaauccccggccucaacaacauaauagacauuaaggugaccgacccacagcuccuggaguuaggcuuggugcagagccccgauggccacagacuguauguuacaaucccccuugguauuaaacugcaggugaauaccccucuugugggggcuagucuucuccgacucgccgugaaguuggauaucaccgccgaaauucuugccguucgagauaaacaggaaaggauucauuugguacuuggugacuguacucauagcccagggagcuugcaaauuagccuuuuagacgggcugggaccacugccaauccagggcuuacuugacucucugacagguauucucaauaaagugcugccagaacugguacagggcaacguuuguccuuuaguuaaugagguauugcgcggccucgauauuacacugguacacgauaucgucaauauguuaauccacggccugcaauuuguaaucaaggucuag

SEQ ID NO: 12471 - RNA, 657 nt, Artificial Sequence
  Description of Artificial Sequence: Synthetic coding sequence
augaugugcccuuuguggagacuccugaucuuucugggacugcuggcccuuccauuggccccucacaaacaaccguggccaggacuugcucaggcacaucgcgauaacaagucuacgcuggcccguauuaucgcccaaggcuuaauuaaacauaaugcugaauccaggauccagaauauacacuucggcgacaggcucaacgccagcgcacagguggcuccaggucugguaggguggcuaauaaguggucgaaagcaccaacagcagcaagagucacgguccuucgacaacaauauugucaaaaugugcgcccacauguccaucguuguggaauucuggcuggaaaaagaugaguucggacgucgcgaccuggugauugguaagugugaugccgaacccucaagugugcauguggcuaucuuaaccgaggcaauuccgcccaaaaugaaccaguuucuguauaacuuaaaagagaaucuucaaaaagugcugccgcauauggucgagagucagguuuguccgcugauuggagaaauucugggccaacucgacgugaagcuguugaagucuuuaaucgaacaagaggccgcccaugagcccacacaccacgaaaccucccaacccagugccugucaagcgggcgaaucaccaagcuag

SEQ ID NO: 12472 - RNA, 765 nt, Artificial Sequence
  Description of Artificial Sequence: Synthetic coding sequence
augaugugucccuuauggagacuguuaauauuucucgggcuucucgcccucccacucgccccacacaagcagccauggccaggcuuagcacaggcccaccgggacaacaagagcacacuugcccguaucauugcccagggucugauaaagcauaaugcggagagcaggauccaaaauauucacuuuggcgauagacugaaugcuuccgcucaggucgcuccggguuugguaggguggcucaucaguggccggaaacaccagcagcagcaggagucaucuaucaauauaacgaauauccagcuugauuguggcggcauucaaauauccuuccacaaagagugguuuagcgccaauaucaguuuagaauuugaccuugaacuucgaccaagcuuugauaacaauauaguuaaaaugugugcucacaugucaauuguuguggaauucuggcuagagaaagacgaguuugggcgccgagacuuggugauaggcaaaugcgacgcugaacccaguucugugcaugucgcuauccugacagaagcaaucccccccaagaugaaucaguuccuguauaaccugaaggagaaccugcaaaaaguacugccacacaugguagaaucccaggucugcccccuaauuggugagauccuaggccaguuggacgugaagcuucuuaaaucucugauugaacaggaggccgcacacgagccuacgcaucacgaaaccucucagcccuccgccugucaggcuggcgagucacccaguuag

SEQ ID NO: 12473 - RNA, 1635 nt, Artificial Sequence
  Description of Artificial Sequence: Synthetic coding sequence
augaaaauuucaaugaucaauuacaagucucuccuggcuuugcuuuucauuuuggcuucguggauaauauucaccguauuccaaaacucgaccaaaguauggagcgcacuaaaccugaguauuucccuccacuacuggaacaauucaaccaagucucuuuuccccaaaaccccccugaucaguuugaaaccccucaccgagacggaacugaggauuaaagaaauaaucgagaaauuagaucagcagauaccaccaagacccuucacucaugugaauaccacaacaagcgcuacccacucuacugcuacuauuuugaacccuagagacaccuacugcaggggagaucagcuacauaucuuguuggagguucgugaucaccugggucguaggaaacaguaugggggcgacuuccuccgcgcccgcauguccagcccugcccuuauggcaggggcaagcgguaaagucacggacuuuaacaaugggacuuacuugguuagcuuuacccuuuucugggaggggcaagucagccucucucuacugcucauacaucccucugagggugugucggcccuguggagcgcacgcaaucaagguuacgaccgugucaucuucacuggucaauuugucaacggcacaagucagguucauucggaaugcggacucauuuuaaacacuaacgcugaauugugucaguaccucgacaacagagaucaagaggguuucuauugcgugagaccucaacacaugccuugcgccgcacugacucacauguauagcaagaauaagaaggugucuuauuuaagcaagcaagagaaaucauuguucgaacggucaaacgugggcguggaaauaauggaaaaguuuaauacaauuagugugagcaagugcaauaaggaaaccgucgcuaugaaggaaaaauguaaguucggcaugacaagcacaauuccaucgggacacgucuggaggaauaccuggaaccccgugagcuguagcuuggcaacagugaaaaugaaggagugccugcguggcaaguugauauaucucaugggugacucaacaauuagacaguggauggaguacuucaaggcuaguauaaauacccucaaauccguagacuugcaugagagcggcaaacuucagcaucaauuggcagucgaccuggaccguaacaucaacauucaguggcagaaguauugcuaccccuuaaucggguccaugacauacucagugaaagagauggaauaccuuaccagagcaauugacagaaccggaggcgaaaagaauaccguuauagugaucagccucgggcaacauuuccguccguuuccgauugaugucuucaucagacgagcgcuuaauguccacaaggcaauucagcaccugcucuuaagaucuccagauacaauggucauaaucaaaacugaaaacauaagagaaauguacaaugaugcugaacgguucagcgacuuucauggauacauacaguaccugauuauaaaagacauuuuucaggauuuaucuguuucuauaauagaugcgugggauaucacuaucgcguacggaacaaauaacguucacccuccccagcauguggugggaaaccaaauaaacauucuguugaauuacaucuguuag

SEQ ID NO: 12474 - RNA, 1845 nt, Artificial Sequence
  Description of Artificial Sequence: Synthetic coding sequence
auguggauggcauggugugucgcagcucucucuguuguggccgugugcgggacaagccaugaaaccaacacugugcuucgagucaccaaggacguguugucaaaugcgaucuccgggaugcuucagcagagcgacgcucuccauucggcacuccgcgaagucccccugggaguuggcgacauccccuauaaugacuuucaugugcggggcccccccccgguguauacaaauggaaagaaacuggacgggauauaccaguauggccacauugagacgaacgacaacaccgcccagcucggggguaaguacagauauggagaaauccuggaguccgagggcuccauucgugauuugcgaaacagcggguaccgguccgcagaaaaugcuuacggaggccacagagguuuaggaagauaccgcgcagcuccuguuggacgccuccacaggagagaguugcagccuggcgagauaccccccggcguggcaacgggagccguugggcccggcgggcuuuugggcacuggggggaugcuugcagccgauggcauucucgcaggucagggagggcugcucggcggcggaggucuucugggagacggcggacuucuaggggguggcggcguguugggcguguugggcgaaggggggauccucaguacuguccagggaauuacaggccugcguaucguggaacugacacugccaagaguuucggugcgccugcugcccggcguaggaguuuaccucagucuguacacaaggguggcaaucaacggcaaaagucuuauuggguuucuugacauugccgucgaagugaauauuacugcuaagguucgccugacuauggaucggacgggcuacccuaggcuagugaucgagcgaugcgauacucugcuuggugguaucaaggugaagcuucugaggggccuacugccuaacuugguagacaaucucguuaaccgcguuuuagcugauguucugccagauuuacuuuguccaauuguagacgucgugcugggccuugucaacgaccagcugggauuaguugacucucugauuccccuagggauccugggcucuguacaguacacauucagcucccugccucuggugacuggagaguuccuggagcuggaccugaauacacucguuggcgaagccggcgggggacugaucgacuaucccuugggcuggccagccguguccccaaagccgaugccggaguuacccccuaugggagauaauaccaagagccagcuggcuaugucagcgaauuuucuuggcucuguucuaaccuuacuucaaaaacagcaugcauuggaccucgauaucacgaacggaauguucgaagaacuucccccgcugacaaccgcaaccuugggcgcccucauccccaagguguuucaacaguaccccgagucuugcccucugauuauccggauccagguguuaaaccccccaucugucaugcuccagaaggacaaggcccucgucaaagugcuggcuacagcggagguuaugguaagccaaccaaaggaccuggaaacaaccauaugucucauagauguggacaccgaguucuuagcuagcuucaguaccgaaggagauaaacugaugauugaugcaaagcuggaaaaaacaucuuugaaucugagaacuagcaacgucgggaauuuugacaucgggcucauggagguucucguggaaaagaucuuugaucuggcguuuaugcccgcaaugaacgcaguuuugggaagugggguaccuuuaccaaaaauauugaauaucgacuucagcaacgccgacauugacguucuggaggaucuguuagucuugagcgccuag

SEQ ID NO: 12475 - RNA, 1431 nt, Artificial Sequence
  Description of Artificial Sequence: Synthetic coding sequence
augcaaccugucaugcuagcccucuggagccuuuugcugcuguggggccuagcgacccccugucaggagcugcuggaaacggugggaacccuggcuaggaucgauaaggacgagcugggaaaggccauccagaauucuuuaguuggagagcccauuuugcagaacgugcucggaucugucacggccgucaaucgcgguuuguuagggaguggaggucugcuagguggcggcggucugcuuggccacggcggcguauucggcguaguugaagaacugucgggucugaaaauugaagaacugacucugccaaaagugcuguugaagcuacucccaggcuucggcguucaacugaguuugcacacgaaggucggcaugcacugcucaggcccuuugggcggccuccugcagcuggccgcugagguaaacgugacaucacgcguggcuuuagcugucucaucgcgaggcaccccaauccugauccuuaagagaugcaguaccuuguugggccacaucagccuauucuccggacugcuuccaacuccucucuucggugugguagagcaaaugcuguucaaagugcucccaggcuugcugugcccuguugucgacucagugcuuggagucgucaaugaacugcucggugcugugcugggguuagucucccucggggcccugggcaguguggaguucucccuagccacauuaccacugauuucuaaccaguauauugagcucgauauuaacccgauugugaagagcgucgccggcgauauaaucgacuuucccaaguccagagcaccugcgaaaguaccucccaaaaaggaucauacaagccaaguuauggucccccuuuaucuguuuaacacaaccuucggauugcuccagaccaacggagcccuggauauggauauaacucccgagcugguccccuccgacgugccgcugacuaccacggaccucgcugcccuccucccugaagcccuugguaaguuaccuuuacaucagcaguuguugcuuuuccuuagaguaagagaagcgccuacagucacccuccacaauaaaaaagcacuugugucccucccagcuaacauucauguccuauuuuacgugccgaagggaacaccugagagcuuguucgaacucaacagcgucaugacgguucgggcgcaacuggcaccaagugcaacgaaacugcacauaagcuuguccuuggaacgccuguccgucaagguggcuucaagcuuuacacacgccuucgauggcagucgccuagaagaauggcucagccaugucgucggggcgguguaugcuccaaagcucaacguggcccuggacgugggaauuccccugccaaaagugcuuaacaucaauuucaguaauuccgugcuggaaaucguugagaaugccgugguucucacaguggccaguuag

SEQ ID NO: 12476 - RNA, 585 nt, Artificial Sequence
  Description of Artificial Sequence: Synthetic coding sequence
augcaggaugccccccuaaguuguuuauccccaacuaagugguccucuguaucaucagccgauucgaccgagaagucagccuccggggcaggcacaaggaaccugccuuuucaguuuugccucagacaagccuugagaaugaaagccgcuggcauucucacacucaucggcugucugguuacuggagccgaaagcaagauuuauaccagaugcaaacuggcuaaaaucuucucacgugcuggacuugacaauuacuggggauucucauugggcaauuggaucuguauggcuuacuaugagucaggcuacaacacgacggcgcagacuguacucgacgauggaucuauagacuacggcauauuucaaauuaacuccuucgcuuggugucgcagaggcaaacugaaggagaauaaucauugccacgucgcuugcuccgcucugauuacugacgaucuaacugaugcaauuauaugugcaagaaagauugugaaagagacgcaggggaugaacuauuggcagggguggaaaaagcauugcgaagggcgcgaucuuucagaguggaaaaaaggcugugaaguuuccuag

SEQ ID NO: 12477 - RNA, 1266 nt, Artificial Sequence
  Description of Artificial Sequence: Synthetic coding sequence
auggguuuuuugagcccaaucuacguaauauucuuuuucuuugggguaaaggugcacugccaguacgaaacauaccagugggaugaggauuaugaccaggagcccgacgacgacuaucagacggguuuccccuuucggcaaaacguagacuauggggugccuuuucaccaguacacuuugggcugcgucucugagugcuuuugccccacaaauuuccccucuagcauguacugugacaaucgaaaacugaagacgauacccaacauccccaugcacauccaacagcuuuaccugcaguuuaaugaaauagaggcuguuaccgccaacucauuuauaaaugcaacccaccugaaagagaucaaucucagccacaacaaaauuaagucccaaaaaauagauuacggcguuuuugcaaagcucccuaacuugcuccagcuccaccuugagcacaacaacuuggaagaauuuccguucccgcucccaaagucucuagaaagacucuugcuaggguauaaugaaaucucuaagcugcagacuaacgcuauggacggcuuggugaaucuuacaaugcuugaccuguguuauaacuaccuccacgacucccuccuaaaggacaaaaucuucgccaagauggaaaaacugaugcaacuaaauuuaugcagcaauaggcuggaaucgaugccacccggacugccuuccucccucauguaucucucacuugaaaacaacucuaucucaucuauaccagaaaaauauuucgauaagcugccaaaacugcacacauugagaaugagccacaauaagcugcaagauaucccguauaacauauuuaaccucccaaacaucgucgaguugaguguuggccauaauaagcugaagcaagccuucuauauuccuagaaaucuggaacaucuuuaccuucagaacaacgagaucgaaaagaugaaucuuacuguuaugugcccgucaaucgaucccuugcacuaccaucaccuaacauacauucggguugaucagaacaaacuuaaggaaccuauuucuucauacaucuuuuucugcuuuccucacauccauacgaucuacuacggggaacagcgcucgacaaacggccaaacuauucaacucaagacacagguauuuaggcguuuuccagacgaugacgaugagucugaagaccaugacgacccugacaaugcucacgagagucccgagcaagaaggggcugaggggcacuucgaccugcacuauuaugagaaccaagaguag

SEQ ID NO: 12478 - RNA, 252 nt, Artificial Sequence
  Description of Artificial Sequence: Synthetic coding sequence
augcuauguuguuguccccucgcugaugcucuucuuauuuuccucgaaaccggaucuuguuuccagcccggucaacaauccgagacgcuuagccaaaaacagaauaaaacaaacaacaaaaagugggcuggcggagccggauguagacccuucagacucugguggguaggaaggucccgcggcgccgggguucagcuguauucaacuaagaaaggguggauacugagagggaagggcgguacagaggccuag

SEQ ID NO: 12479 - RNA, 2559 nt, Artificial Sequence
  Description of Artificial Sequence: Synthetic coding sequence
augcugccuacugagguaccacaaagucacccagggccaagcgcccuucuuuugcugcaacuucugcucccuccgacaagcgcguucuucccuaacaucuggagccuccuggccgccccuggaucgauuacacaccaagaucucacagaggaagccgcacugaauguaacgcuucagcuguuccuggagcagccaccaccaggcagaccacccuugcgcuuagaagacuucuuagggcgcacacugcuggcagacgaccucuuugcggccuacuuugggccuggcagcagcagaagauucagagcugcuuuaggugagguaucccgcgccaaugccgcacaggauuuucucccaacaagccguaacgacccagaucugcauuuugacgccgagagauuggggcaaggcagagcuaggcuagugggagcuuuaagagagacugucgucgcggcccgcgcccuugaccacacccuggcuagacaaagacuuggagcugcauugcaugcuuugcaggauuuuuauucucauaguaacuggguggagcugggagaacagcagccacauccccaucuccuuuggccaaggcaggagcugcaaaaucuggcccaaguagcagacccaacuuguagcgacugcgaggaauuaaguugucccagaaacuggcugggcuuuacucugcugaccucuggguacuucggcacucauccuccaaaaccccccggaaaguguucccacggaggccacuucgacagaagcucuucacagcccccucgcggcgggaucaauaaagauagcaccagccccggauucuccccucaccacaugcugcaccugcaggcagcgaaacuagcucuucuugccaguauacaagccuucucuuuacuccggucaaggcugggcgaccgggacuuuucgagauugcuggauaucacccccgcuucaagccuaagcuucguucuugauacaaccgggucaaugggagaagagauuaaugcugccaagauccaggcgcgucaccugguggagcaacgccgcgggaguccuauggaaccagugcacuacguccucgugccauuucacgaccccggguuuggccccguuuuuacaaccucugauccggauucguuuuggcagcaacucaacgagauccacgcacuuggaggaggggacgagccagagaugugucugucugccuuacagcuagccuugcuucauaccccaccacugucagauaucuucgucuucacugaugcgagccccaaggaugccuuccuuacuaaccagguagaaucgcugacgcaggagcggagaugucgcguuacauuuuugguuacggaggacaccucacgcgugcaaggucgggcuaggcgggagauccucagcccucuacgguuugaacccuacaaggcuguggcuuuagcuuccggaggcgaggugaucuuuaccaaagaccagcauauuagggauguggcugcaauugucggugagucuauggcggcuuuaguaacccuuccgcucgacccacccguugugguaccuggacagccccuugucuucaguguugauggcuugcuccagaaaauaacugucagaauccauggggauaucucuucguuuuggaucaagaauccagcuggcgugucccaaggccaggaagagggcggcggacccuuggggcacacccgucgcuuugggcaauuuuggauggugacuauggaugauccuccccaaacagggaccugggagauccaggugacugcugaggacacaccggggguccguguccaggcacagaccucucucgauuuccuauuccauuucggcauacccauggaggacgguccccacccagggcuuuacccucugacccaaccuguggccggccuccagacccagcuucuaguggaaguuacuggccugggcucccgcgccaacccaggggacccucagccacauuucucucaugugaucuugagaggagugcccgaaggcgccgagcugggacagguuccacucgaacccguggggccuccugaacgagggcugcuggcugcaucucugagccccacuuuacuguccaccccuagacccuucucacucgagcucaucgggcaagaugcugccggccggaggcuucacagagccgccccacagccuaguaccguggugcccguccugcuggagcugucugggcccucaggauuucuggcuccuggcucuaaggugccccucagccuacggauugcuucuuucucugggccucaggaucuugaucugagaacauucguaaauccaucauucaguuuaacuuccaaucuaucccgagcucacuuggagcugaacgagucggcauggggccggcuuuggcucgagguacccgauucagcggcacccgauagcgucgucaugguuacugucacagcagggggacgggaagcaaaucccguccccccgacccacgcauuccugcgccuccuggugucggccccggcaccacaggucagaaaccacuauuuuccaucccagggacccgcccaucacccauaccgguugaucuag

SEQ ID NO: 12480 - RNA, 2676 nt, Artificial Sequence
  Description of Artificial Sequence: Synthetic coding sequence
auguuaccuacagaaguuccacagucccaccccgggccuucagcacuuuugcuccugcagcuacugcucccacccacaucggcauucuuuccaaacauauggaguuuauuagccgcgccaggguccaucacccaucaggaucuuaccgaagaggccgcuuuaaauguaacacuccaguuauuuuuagaacagccgccuccuggacggccgccccuuagauuggaggauuuccucggacgcacacugcuugcugaugauuuguuugccgcguacuuuggaccugguucuagcaggcgguuccgcgcugcccugggggaggugucccgugcaaaugcugcccaagauuuucugcccaccagucgcaaugaucccgaccuacauuuugaugcagaaaggcucggacaaggccgcgcaagacucguuggggcauuacgagaaacagucguggcagcucgggcucuggaucacacccuggcaaggcagcgucugggugcggcucuucacgcacuacaagauuucuauucacacuccaauuggguugaacucggggaacagcagccacacccccaucugcuguggccccgacaagagcugcagaauuuggcucagguggccgacccaacaugcuccgauugcgaagaacuguccugcccucgcaacuggcugggguucacuuugcucacuagcggguauuucgggacucauccccccaaaccccccgggaaaugcucacauggggggcacuucgacagguccucaucccagccuccacgcggagggaucaauaaagacagcacuaguccaggcuuuucaccacaccauaugcuucauuugcaagcugcgaaauuagcccuccuggcguccauacaggcauucucacuccuccgcuccagacuuggcgaccgggacuuuaguagacugcucgauauuaccccugcaucaucacugaguuuugugcucgauacaaccggcucuaugggggaggaaaucaacgcggccaagauccaggccaggcaccuuguagagcaacgccgcggaagcccaauggaaccugugcacuaugugcuugugccauuccacgaucccggcuucggaccagucuuuacaaccucugaccccgacucauuuuggcaacagcuuaacgagauccacgcucucggcgguggugacgagcccgagaugugcuuaucugcguugcagcuugcacuguugcauaccccaccccugagcgacaucuuuguguucaccgaugccucuccaaaggacgccuuuuuaaccaaucaggucgagagccuuacacaggagaggcguugcagagugacuuuucuuguuaccgaagauacaagccgagugcagggccgggcccggcgcgagauucugaguccucugcgcuuugaaccuuacaaggccgucgcgcuggccucuggaggcgaggugaucuuuacaaaggaccaacacauuagggauguugccgcgaucguuggcgagagcauggcugcacucgugaccuuaccucucgacccacccgugguggucccaggacaaccuuugguguucucaguugacggauuauuacagaaaauuacgguucggauucauggcgacauuucuagcuuuuggauuaagaauccugccggcgucagucagggccaagaggagggcggggggccccuuggucacacccggagauucggccaauuuuggauggugacaauggaugauccuccucaaaccggcacgugggagauucaggugacggcagaggacacuccaggugugcgugugcaagcacagaccagcuuagacuuccuguuucauuucggaauuccuauggaggacggaccucaccccggucuguacccucugacacagccaguggcaggauuacagacucagcuccugguugaaguuacggggcuagggagccgagcuaauccaggcgacccccagccucauuuuucacauguuauccugcgcggagugccugaaggcgcugaguuaggacaagugccccucgagcccguggggccccccgagcgcggucugcuggcugccucauugaguccaacccugcuuucuacaccacgcccuuucucccuggaguuaaucggccaggaugccgccggcaggaggcugcacagggcugccccucagccuagcacugugguacccguacuccucgagcugucagggccaucaggauuccucgcuccuggcucaaaaguuccucugucccucagaauugccucauuuuccggcccucaggacuuggaccuacgcaccuucgucaauccaucauuuuccuugacuaguaaucuguccagggcccacuuggagcugaaugaguccgcgugggggcggcuuuggcuggaggucccugauucagccgcuccugacucuguggucaugguaacuguuacagcaggggggcgugaagcaaauccugucccgcccacucaugcuuuccuuaggcugcuggucucugcuccagccccacaggaccggcacacaacccccaccggaagcucugacccaauccugaccacagcaacuccugccuucucccccuucacccucgugacucagggaagggccggagccggacuugcugcuggaagcccauggugggguaccgugggcggggugcucuuacugcugggccuugcaaguugguag

SEQ ID NO: 12481 - RNA, 552 nt, Artificial Sequence
  Description of Artificial Sequence: Synthetic coding sequence
augguccgaaucuggacuacaauaaugauuguuuuaauucuccuacugcgaauuggaccaaacaagcccagucugucaggucgccaggcuccagcucaggcucaaacaucagaucucgugccuucccuguuuccuuuagggcugugggcccccggguuuugcaccuggagcucaccugaugaagacaaacguccacgaaaaccuguuccuggcacaggcaaucgggacuccgggacacguagaagacuucaggaugcuaccgaacaagacccucgaccugggaaugacguugccucagcugaaacggccgggccuccaucccccuccggcauuagagcccaggaccgggccccuagacaucgccgugccccucccgccaggaugccaguggcgcccgcaccaagcgcugacggcgagccuuuacaagagcagggagggggacuguuucaucgaacaagaagcguuuacaauggccuugaguugaauaccuggaugaagguagaaaggcucuuuguggagaaguuucaccaaucuuucucuuuggacaacuag

SEQ ID NO: 12482 - RNA, 444 nt, Artificial Sequence
  Description of Artificial Sequence: Synthetic coding sequence
auggcaggccccgccggcagccaaucucugggcccauuaugcuuucacagcuccccgcaagcccuauacacaguucuccugauugugcuggugaugaugagcuugguguuuggaaaauucgucccugugaacugggaacccccccagccccugcccuuuccuaaauacuugagaugcuacagaugccuacucgaaacaaaagagcucggcuguuuacuaggcucugacauaugucugacacccgccgguuccucuugcaucacacuacacaagaagaauucauccgggucugaugugauggugucagauugucgcaguaaggagcagaugucugacugcaguaacacacgaacaucccccgucagcggauucuggauauuuagccaguauuguuuucuggacuucuguaaugacccacagaacagaggucuguauacuccuuag

SEQ ID NO: 12483 - RNA, 447 nt, Artificial Sequence
  Description of Artificial Sequence: Synthetic coding sequence
augcaaacuuuccccgucgcuggggccuuagacccagcuauucuugacacuucuagcccccaagcucuguacacggugcuguuaauaguccuuguuaugaugucccuuguguuugguaaguucgugccuguaaacugggagcccccacaaccucugcccuuuccuaaguaucuccgcuguuaccggugccugcuugagaccaaagaguuaggaugucuguuaggcagcgacauuugccucacuccagccgggucaagcuguaucaccuuacacaagaagaauagcucugggucagacguaaugguuucugacugcagaaguaaggaacagaugagcgacugcucaaacacccgcacaucaccgguuucagguuuuuggaucuucucucaguacuguuuucucgauuucuguaacgacccacagaaccgagggcuguauaccccauag

SEQ ID NO: 12484 - RNA, 606 nt, Artificial Sequence
  Description of Artificial Sequence: Synthetic coding sequence
augaagguccacauguuagugggaguacuggugauggucggauucaccgucgggaaggugccagucccugauauucgcacaugccacuucuguuuagucgaggacccaagcgucggaugcauuuccggaucagaaaaaugcaccaucuccagcuccucucuguguaugguaaucaccauuuauuaugacguaaaagugcgguucaucgugcgagguugugggcaguacauuucuuacagaugccaggagaagagaaauaccuauuuugcugaguauugguaccaggcucaauguugucaguacgacuauuguaauucauggucaucaccccaguugcagucuagucugcccgagccucaugaucguccacuugcccugccucugucugacucucagauccaaugguucuaccaggcacuuaaucucucguuaccucuaccaaauuuucaugccgggaccgaaccagacggccucgacccuaugguaacccuuucccucaaucucgggcuguccuucgcugaguuacguagaauguaccuuuuccugaauaguucuggacugcuggugcugccucaggccgggcuguugacuccgcacccgucuuag

SEQ ID NO: 12485 - RNA, 345 nt, Artificial Sequence
  Description of Artificial Sequence: Synthetic coding sequence
augcucggaggggaggaagcaaggccaaacagcuggccauggcaggugaguuuacaguacagcagcaaugggcagugguaccauacaugcggagggucacuaauugcuaauaguuggguauuaacggcagcucauuguaucagacagauuauuaaggcacacaaggucuugcagaggugcuccuugauucuuuuuuuugugagggaucuuuguucuucucaacuggaacugacuggggugucugcugggagcagcggcauuuaucgagugaugcuugggcagcauaaccuguacgucgccgaaucggguagucuugccgugucagugaguaagaucgucguauag

SEQ ID NO: 12486 - RNA, 810 nt, Artificial Sequence
  Description of Artificial Sequence: Synthetic coding sequence
augauccguaccuugcuuuugaguacauuaguggccggugcguuguccuguggggugucaacauaugcgccugauaugucaaggaugcugggaggggaggaggcucgacccaauucauggccuuggcaaguaucucugcaauacucuucaaaugggcagugguaucauacuugcggcgguuccuugaucgcgaacucauggguccuuaccgcugcucacugcaucuccucgagcggcaucuaccgggugaugcugggucaacacaaucucuauguugcagagagcgggagcuuggcaguaaguguguccaagauuguuguccacaaagauuggaauucugaucagguuucaaagggaaacgacauugcccuacucaaacuggcaaaucccgucucucucaccgauaaaauccaacuugccugccugccucccgccggcacuaucuuacccaacaacuacccauguuauguaacgggcuggggacgacugcagacaaacggcgcccugccagacgacuuaaaacagggccagcuacugguaguggacuacgccacaugcuccagcaguggcugguggggaagcaccguuaagacaaauaugauuugcgccgguggugaugggguuauuuguacuuguaauggagauuccggcggcccccugaauugccaggcgagcgacggccguugggaggugcauggcauuggaucucugaccaguguccugggguguaauuacuacuauaaaccuucgauuuucacccgcgucucuaacuacaaugauuggauuaacucggugauugcuaauaacuag

SEQ ID NO: 12487 - RNA, 567 nt, Artificial Sequence
  Description of Artificial Sequence: Synthetic coding sequence
auguuccaccaaaucugggccgcauuacuuuauuucuauggcaucauccucaauuccauauaccagugucccgagcauucacagcugacuacccuaggaguggacgguaaggaguuucccgaaguucaucuaggacagugguacuuuaucgcuggcgcagcuccaaccaaagaggaauuggcaacuuuugacccuguggauaacauuguauuuaauauggcagccgggagcgcacccaugcaguuacauuuaagggcuacgauccggaugaaggacggcuuaugcguccccagaaaguggaucuaucaccuuacugagggcaguaccgaccuccgaacugagggaagaccugacaugaaaacugagcucuucagcucgagcugcccuggcggaauuaugcuuaacgaaacaggccagggauaucagcgcuuccugcuguacaauagguccccccaccccccugagaagugcguagaggaauuuaaaagcuugacuucaugccucgacucuaaagcauuccugcuaacccccagaaaccaggaagccugugagcuuagcaacaacuag

SEQ ID NO: 12488 - RNA, 390 nt, Artificial Sequence
  Description of Artificial Sequence: Synthetic coding sequence
auggcagcugggucugccccuaugcagcuccaucugcgcgccacuaucaggaugaaggacggacugugugugccaagaaaauggauauaccaucucacagaaggcucaacggaucuacgcaccgaaggacguccagacaugaaaaccgaacuuuuuagcaguagcugcccuggagggauuaugcucaaugagacaggccagggguaucagcgauucuuauuauacaacagaucaccccauccaccugaaaagugcgucgaagaauucaaaagccugacuucuugucuugauucuaaggcuuuucucuuaacuccaagaaaccaggggaaaggacuuaaaucucauaagaccggucugggguugacaaagucgagcggcgugaccggcuag

SEQ ID NO: 12489 - RNA, 351 nt, Artificial Sequence
  Description of Artificial Sequence: Synthetic coding sequence
auggcugccggauccgcaccaaugcaacuacacuugcgcgcuacaauucggaugaaagacggucuuugcgugccuagaaaauggaucuaccaucucacagagggaaguaccgauuuacgaacagaaggccgaccugacaugaagaccgaacuauuuuccucaucaugccccggagggauuaugcuaaaugagaccggucagggcuaccagcgcuuccuccuguauaaccgcucuccucacccuccugaaaagugcguagaggaauuuaagucccucacaucuugccucgauagcaaggcuuuucuucugacaccucgaaaccaagaagcaugugagcuguccaauaauuag

SEQ ID NO: 12490 - RNA, 435 nt, Artificial Sequence
  Description of Artificial Sequence: Synthetic coding sequence
augauuagaacgcuucugcucaguacucucguggcuggcgcuuugagcugcggcgacccaacauacccuccauaugugacccgggugguaggcggugaggaagcuagacccaauucuuggccauggcaagugucccuccaguacucuucuaacggcaaaugguaucauaccugcggaggcagcuuaaucgcaaacucgugggucuugaccgcggcacacugcauaucacagagcaugguccagugugcucacaaggugcuucaaagauguagccuaauccuguuuuuuguaagggaccuguguuccucacagcuggaacugacaggggugucagccggcucaagccggacauaccgugugggucuuggacgccacaauuuguacgucgcagaaucagguucccuggcggucucagugaguaagaucgugguauag

SEQ ID NO: 12491 - RNA, 204 nt, Artificial Sequence
  Description of Artificial Sequence: Synthetic coding sequence
augaaacuucuguugcugacuuugacagucuuacuccuucuaucccagcugacgccagguggaacucagagaugcuggaaucuuuacgggaaguguagauaucguuguucaaaaaaggagagaguguacguguauugcauuaauaauaaaauguguugugucaagccaaaauaucagccuaaggagagaugguggcccuuuuag

SEQ ID NO: 12492 - RNA, 231 nt, Artificial Sequence
  Description of Artificial Sequence: Synthetic coding sequence
augaagcuccuauuauugcuauuaacggucacccugcuuuuggcucaggugacaccagucaugaaauguugggggaaguccggaagaugcagaaccacuuguaaagaauccgagguguacuauauccuguguaagacagaggcgaaguguugugucgaucccaaguaugugcccguaaaacccaaauuaacugauaccaacaccucauuggaaagcacuucugccguuuag

SEQ ID NO: 12493 - RNA, 267 nt, Artificial Sequence
  Description of Artificial Sequence: Synthetic coding sequence
augaaguuacucuaccuguuccuggccauacugcuggcuaucgaggagccagugaucuccguagaauguuggauggauggccacugccgacuucugugcaaagauggugaagacucuauuauccguugcagaaauagaaagcgauguugcgugcccucucgauaccugaccauccagcccgucaccauucaugguauucucggcuggaccaccccacaaauguccaccaccgcgccaaaaaugaagacuaacauuaccaauagauag

SEQ ID NO: 12494 - RNA, 255 nt, Artificial Sequence
  Description of Artificial Sequence: Synthetic coding sequence
augaagcuucuuuaucuguuuuuggccauacuccuagccauagaggaaccagugaucucgggaaaaaggcacauucuacgcuguaugggaaacucaggcauuugccgagccucuugcaaaaaaaacgaacagccauaccucuauuguagaaauugccaauccuguugucugcaaucauacaugcgaauaucaauuucggguaaagaggagaacacugacugguccuacgagaaacaauggcccaggcuccccuag

SEQ ID NO: 12495 - RNA, 2631 nt, Artificial Sequence
  Description of Artificial Sequence: Synthetic coding sequence
augggccccgaagcgcuauccagucugcuucuucuucugcuuguagccuccggggaugccgauaugaagggccacuuugacccggcgaagugucgguacgccuugggcaugcaagaccgcacaaucccagacucagacauuagugccagcucaaguugguccgauagcacugccgcaaggcacaguagacuugaaaguuccgacggcgauggcgcauggugccccgcuggaaguguguucccuaaggaagaggaauauuuacaagucgacuugcaaagauuacauuuagucgcauuggugggcacccaggguagacacgcuggcggccucggcaaggaauucucaagguccuaccggcuccgguauucuagggacgguagacguuggauggguuggaaagacagguggggacaggaggugauuagcggaaacgaagacccagagggugugguacugaaagaucucgguccaccuaugguggcacgacugguucguuucuauccuagggcugauagggugauguccguuugucugcgcgucgaacuguacgguugucuguggcgagauggucuccugucauauacggcgccagucgggcaaacaauguauuuauccgaagcaguguaucugaacgauucuaccuacgauggccacacgguaggaggccugcaguacggagggcugggacaguuggccgacgguguggugggccuggacgacuuccgcaagucacaagaacugagaguguggcccggauacgauuacgucgggugguccaaucacaguuuuucuuccggauauguagagauggaauucgaauuugaccgauugcgggcuuuccaggcgaugcaggugcauuguaauaacaugcacacacugggagcuaggcucccggggggaguggaauguagauuccgucgggggccugcaauggcuugggaaggagagcccaugagacacaaucuggguggaaaccugggggacccuagggcccgagcugucucaguccccuuggguggaagggucgccagauuccuccagugcagauucuuauucgccggcccguggcugcuguucucagagauaaguuuuauuucugauguggucaacaacucuucucccgccuuggggggcacauucccucccgcaccaugguggcccccaggaccaccuccgacaaauuucucuaguuuggagcuggagccgaggggucagcagccaguugcaaaagccgaggguuccccgacagcuaucuuaauuggcugccugguugcgaucauccugcuucugcugcugauuauagcccugaugcucuggcggcuccacuggaggagacugcugagcaaagcggagcggcgcguccucgaggaggaacugaccgugcaucuguccgugcccggagauaccauccucauuaacaauagaccuggaccaagagagccaccaccuuaucaggaaccucgaccgcgggguaaccccccacauuccgcuccuuguguuccuaacggcucugcauauuccggagacuauauggaacccgaaaagccuggcgccccccugcuuccaccucccccucagaacuccgugccacauuacgccgaggcugacauugucacacuccagggcgugacuggagguaacacuuacgccguuccagcucugccaccuggugccguuggagacgggccgccgcgcguggauuucccccguucuaggcugcgauucaaggaaaaacugggagagggccaauucggagaggugcaucugugugagguagauucuccccaggaccugguuucacuugauuuuccccuuaauguuagaaaaggccauccacuguuagucgcagugaagauucugcggccagacgcaacaaaaaacgcacggaacgauuuccugaaagaagucaaaauuaugucccggcugaaagauccgaauaucauaagacuccuugggguaugcguucaggacgacccacucuguaugaucaccgacuacauggagaacggagaccugaaucaauuuuuauccgcccaucaguuggaggacaaggccgccgaaggagcuccgggcgauggccaggccgcgcaggggccaaccaucucuuauccaauguuguugcacguugccgcucagaucgccucagggaugcgguaccuagcuacgcuaaauuucgugcaccgcgacuuagcaacuagaaauugcuuaguaggggaaaauuucacgauuaagauugcugauuuugggaugagccgcaauuuauacgccggagauuauuauagagugcagggacgcgcggugcuuccuauacguuggauggcuugggaaugcauccugauggguaaauuuacaacugcuagugacgugugggcguucggcgucaccuuaugggagguguuaauguugugccgggcucagccauuuggacaacuuacugacgaacaggucaucgaaaaugcuggugaguucuuccgagaccaaggaagacagguuuauuugaguagaccuccagcaugcccacagggacuguacgaguugaugcuuagaugcuggucacgugagagugagcagcgccccccuuuuagccaauugcaucgcuuucuagccgaggacgcccuuaauacggucuag

SEQ ID NO: 12496 - RNA, 2742 nt, Artificial Sequence
  Description of Artificial Sequence: Synthetic coding sequence
augggacccgaggcuuugucguccuuacuuuuacucuugcuuguagcuagcggugaugcagauaugaaaggccauuucgaccccgccaaaugcagauaugcgcuugggaugcaagaucggacuauuccugauucugacauaucagcuuccuccucuugguccgacuccacugcagcaaggcauucucgccucgaaaguucagauggcgacggcgcuuggugcccagccggcagcgucuucccgaaagaagaggaauaucugcaaguggaccugcagagacugcaccugguagcacuggugggaacacaggggcgccaugccggcggucuggguaaagaauucucaaggagcuaccggcuacgcuauaguagggauggaaggcgcuggaugggguggaaagaccgcuggggucaggaagugaucucugggaaugaggaccccgaaggggucgucuugaaggaucugggcccacccaugguggcacggcuggugcgauucuauccucgugcugaucgcguuauguccguuugccuacgcgucgaacuguauggaugccuauggcgggauggauugcucagcuacacugccccaguagggcaaaccauguaucuuuccgaagcaguguaucugaaugauaguacauaugacggucacaccgucgggggucugcaauaugggggacuuggacaguuggcagacggugucguggggcuggacgauuucagaaaaagucaagaacugcgcguauggccuggcuacgauuacguuggcuggagcaaccacuccuucucuucgggcuaugucgaaauggaguuugaguuugaccgacuccgugccuuucaagccaugcagguucacuguaacaacaugcauacccugggggcucgccuuccaggcgggguggaaugcagguucaggcgcggcccugcgauggccugggaaggugaacccaugagacauaacuugggcgggaacuugggugauccccgggcgcgagccgugucagucccgcuuggagggcgaguggcccguuuucuccagugucgcuuccuguucgcgggacccuggcugcuuuucuccgaaauuucuuucaucucugacguggucaauaacuccucuccugcucuaggcgggacuuuuccaccugcuccuugguggccacccgggccccccccgaccaacuucagcucucuggaacucgagccaagagggcaacagcccgucgcgaaagcugagggguccccuacugcaauuuuaauuggaugucuuguugccauuauacuguuguuacugcuaaucauugcucuaaugcuguggcgccugcauuggcggcgccuccucucuaaggcagagaggcgugugcucgaagaggagcugacaguacaucuauccgucccaggagacacaauacuuauaaauaaucgaccaggcccacgugagcccccuccuuaccaggaaccaagaccaagagggaauccaccccauuccgccccuugcgugccuaacggaucugcucuguuguuaagcaauccagcauauaggcugcucuuggcuacuuaugccagaccgcccaggggacccggccccccuacccccgcaugggcgaagccgaccaauacucaggcauacucaggagacuacauggaaccugaaaaacccggggcuccacugcugcccccucccccacagaacuccgucccucacuacgccgaagccgauaucgucacuuugcaaggcguaacuggcgguaacacguacgccgugccagcgcugccuccgggcgccgugggcgauggacccccuagaguggauuucccccgguccagacugcgguucaaagaaaaacugggagaagggcaauuuggagaaguccaccugugcgagguagacucaccacaggaucuugucagcuuggauuucccacugaacgucaggaagggccauccucugcucguggcagucaaaaucuuacgccccgacgcgaccaaaaacgcacgaaacgacuuccuuaaggaggucaagaucaugagccggcucaaggauccaaauauuauuaggcuguugggugugugugugcaggacgauccccugugcaugauuacagacuacauggaaaacggcgauuuaaaucaguuccuuucagcccaccagcuggaagacaaagcggcggaaggagcacccggcgacggacaggccgcccagggccccacaaucagcuacccuaugcugcuucaugucgcugcacagauagcauccggaaugcgauaucucgcgacccucaacuucguccauagggaccuugccacccgaaauugcuuagucggggagaauuucacuauuaaaauugcugacuucggaaugucaagaaaccucuacgcaggcgacuauuauagagugcagggacgggccguacugccaauacguuggauggccugggagugcauccucauggguaaguuuaccacggcuucagaugugugggcuuuugggguaacacucugggaagucuuaaugcuguguagagcucagccuuuugggcagcugaccgacgaacaggugauugagaaugcuggcgaguucuuccgggaccaggggcggcagguguauuuaagccgaccucccgcaugcccgcaaggccuuuacgagcuuauguugagaugcuggagucgggaaucagaacagcgaccacccuucucacagcuucaucgguuucucgcugaggaugcccuuaauacuguguag

SEQ ID NO: 12497 - RNA, 2631 nt, Artificial Sequence
  Description of Artificial Sequence: Synthetic coding sequence
augggucccgaggcacuguccucacugcucuuacuuuugcuuguggcaucaggggacgcugauaugaaggggcauuucgacccugccaagugcagguaugcguuggggaugcaagaccguaccauacccgacucugacaucucggcuagcuccaguuggagugacucaaccgcagcccgacacucacgacuggagaguuccgauggcgauggcgcauggugccccgccgggucagucuuccccaaggaggaagaauaccugcaaguugaccugcagcgguuacauuugguagcacuagugggcacucagggccggcacgcuggcggacucggcaaagaauucucucgauccuaccgucugcgguacucucgcgacgggcguagauggaugggcuggaaggaccgguggggacaagaggugauuaguggcaacgaggauccagaaggcguuguccugaaagaucucggcccuccaaugguggcacgcuugguucgguucuauccacgcgccgauagggugaugaguguaugccugcgagucgaguuauacggaugccuguggagggauggccuucucagcuacacagcaccuguugggcagacaauguaccuguccgaggcgguuuaccugaacgauucuaccuaugauggacauacggugggaggccuucaauacggaggacucggacagcuggcugaugguguggucggccuggaugauuuccggaagucccaggaacuucgaguguggccagguuacgacuauguggguuggucuaaccacucuuuuagcucgggcuacgucgaaauggaguucgaguucgaucggcucagagccuuccaggcaaugcaggugcacugcaacaauaugcacacccuaggggcuagacuuccaggcggcgucgagugcagauuucgccgcgggccugccauggcaugggagggugagcccaugcggcacaaucuggguggcaaccuuggagauccacgagcucgggccguguccgugccccucggcggacgaguggcgcgguuccuccagugcagguucuuguuugcaggccccuggcugcuguucuccgagauuuccuuuaucuccgacguugugaacaauucaaguccugcuuugggagggaccuucccccccgcaccaugguggccgccaggaccccccccgacaaauuuuaguucauuggaacuggaaccucgcgggcagcagccaguggcaaaggccgaaggcagccccacagcgauucuaaucggaugucuggucgcaaucauccuccugcuucuccuuaucauugcccucauguuauggagacuccacuggcgaaggcuacuguccaaggcagagcgaagaguccuugaagaagaacuaacaguacaccugagcgugcccggugauacuauacucauaaacaaccgcccuggcccccgggaaccccccccuuaccaagaaccgcgcccucggggaaauccuccacacagcgcuccgugcgugccgaacggaagcgcuuacagcggcgacuacauggaaccagagaagccaggcgccccucugcugcccccccccccacagaacagcguuccgcacuacgccgaggccgacaucgucacccuccaaggggucaccggagguaacaccuacgcagucccagcacuacccccuggcgcagugggagauggaccuccacgagucgacuucccuagaucuagacugcgguucaaagaaaaacuuggcgaaggucaguuuggagaagugcaucuaugugaggucgacuccccccaggacuugguaucucucgacuucccccucaacguucggaaaggccacccccugcugguggcugucaagauccuacgucccgaugcaacuaagaacgcaagaaaugacuucuugaaggaaguaaagauaaugucccgacugaaggauccuaauaucaucaggcucuuaggcgucugcgugcaggacgacccacuguguaugauuaccgacuauauggaaaacggcgaccuuaaucaguuucugucagcccaccagcuugaggacaaagcggcugagggagcucccggagacggacaggcugcccaaggcccuacaaucuccuaccccaugcuacugcacguggccgcacagauugcgagcggaaugcguuaucuugcaacacuaaacuuuguucauagagaccuggcuacucggaacugccucguaggggaaaacuucacgauuaaaaucgccgauuuuggcaugucaagaaaccucuacgccggcgauuauuaccggguccaaggcagggcgguucuacccaucagauggauggcgugggaauguauucugaugggaaaguucaccacggccucagauguaugggccuuuggcgugacauuaugggagguguugaugcuuugccgggcucagccauuuggucaauugacugaugaacaggugauugaaaacgcuggggaguucuuccgagaccaaggaagacaaguguaucuaagcagaccuccugcaugcccgcagggccucuaugaacugauguuacgauguuggagcagagaguccgagcagcggccgccguuuagccagcuucaccgguuccuugcagaagacgcacugaauacugucuag

SEQ ID NO: 12498 - RNA, 2631 nt, Artificial Sequence
  Description of Artificial Sequence: Synthetic coding sequence
augggccccgaggcgcugucuucucugcuauuguugcugcuggucgcaucuggagacgcagacaugaaaggacauuucgauccugcuaagugccgguaugcccucggaaugcaggaucgcacuauaccggacucagacauuucugcaucauccaguuggucagauuccaccgcugcucgacauagcagacuggagagcagugauggagacggcgcuugguguccagcaggcucuguguucccuaaggaggaggaauacuuacaggucgaucuacaacgcuuacaccugguggcacuggucggaacacaaggacgacacgccggggggcucggcaaggaauucucccggucuuaucgccugcgguacucgcgugaugguagaagguggaugggcuggaaggauagguggggccaagaagugauaucuggcaacgaagauccagaaggcgugguacugaaagauuugggaccgccgaugguagcucgacuggugagauucuacccaagagccgaccguguuaugucaguuugccuccggguggagcuauacgggugccuguggagggacggucuauugagcuacaccgcucccguuggccagaccauguaccuuucagaggcagucuaucucaacgauuccaccuacgacggacacaccgucgguggccuccaguacggcggauugggacagcucgcggacggcguaguaggccuggacgacuuucggaaaucacaagagcuuagaguuuggcccggcuacgacuacgugggauggucaaaucauuccuucucaagcggcuacguggaaauggaguucgaguucgaccggcuacgagccuuccaggccaugcagguucacugcaacaacaugcacacacugggggcucguuuaccuggagguguugagugucgauucaggcguggucccgccauggcuugggagggagagcccaugagacacaaccuuggcgggaaccucggagauccccgugcccgggcagugagcgugccccugggcggacgcguggcucguuuccuucaauguagguuccuauucgccggaccguggcuguuauuuucagagaucucuuucauuucggauguggugaauaauuccagcccagcccuuggcgggacuuuucccccugccccuugguggccucccggccccccgccuaccaauuucucaucucuggaacuggagcccagaggacaacagcccguagcuaaagccgagggaagcccuaccgcaauacuuaucggcugccucguugcaaucauucucuugcuccugcugauuaucgcucuuaugcucuggagacugcacuggaggcgauugcugagcaaggcagagcggcgcguccuggaagaggaacuuacuguucaccuaagugucccuggcgauacaauccugauaaacaaccggccaggcccuagggagccuccaccuuaucaggaacccagaccacguggcaaucccccacauucugccccaugcguaccaaaugggucugccuauuccggcgacuauauggaaccagagaagccuggugcaccccugcugccuccgcccccacagaacagugugccccauuacgcugaagccgacaucgugacauugcagggggugacaggcggcaauaccuacgcuguuccugcacuuccucccggagccgugggagaugguccacccagagucgauuuuccucggucacgccugcgauucaaagagaagcuuggcgaaggacaguuuggagaagugcaccugugcgagguggacucaccccaagacuuagugucccuggauuuuccgcuuaaugugcgcaaagggcacccccugcucguggccgugaaaaucuugcggcccgaugccacuaagaaugcuagaaacgacuuccugaaggaaguuaagaucaugagucgacugaaggaccccaacauaaucaggcucuugggaguuugcgugcaagacgauccauuaugcaugaucacugauuauauggaaaauggcgaccugaaccaauuucugucugcccaccaacucgaagacaaagcagccgagggcgcucccggcgacggucaagccgcucagggaccaaccauuagcuacccuaugcuccuccacguggcagcgcagauugccagcggaaugcguuaccucgcaacccugaauuuuguucacagagaccucgcaacuagaaacugccuugugggagagaauuucaccauuaagauugcugauuucggaaugagccgcaacuuauaugcuggagauuacuaucgcguccaggggcgagccguauugcccaucagguggauggcaugggagugcaucuuaaugggcaaguucacuaccgccagcgaugugugggcuuucggagugacccuaugggaaguucuaauguugugucgagcacagccauuugggcaacugaccgacgagcaagugauugagaaugccggcgaguucuuccgagaccaggggcgccagguguaucuuagccgcccaccugccuguccccaggguuuauacgagcuaaugcucaggugcugguccagagagucagagcagcgcccucccuuuagucagcugcaucgguuucucgcugaggacgcacugaacacaguguag

SEQ ID NO: 12499 - RNA, 2760 nt, Artificial Sequence
  Description of Artificial Sequence: Synthetic coding sequence
auggguccggaagcucugucgucccuccuccuucuacuguuaguggcuucuggagaugccgauaugaaaggccauuucgaucccgcaaaauguagguacgcgcucggcaugcaggaucggacaaucccugacagugauaucagugccaguucaucauggagcgauaguacagcagcaaggcacucccggcuagagucaucagauggcgauggcgccuggugcccugcugggucgguguucccgaaggaagaagaauaccuacagguggauuugcagagacuucaccuugucgcuuuggucggaacacagggucggcacgccggaggacuuggcaaggaauuuucccgguccuaucggcuacgcuauucccgggauggccggagguggaugggauggaaagaucgguggggacaggaagugaucucuggcaaugaagauccugagggagugguccuaaaagaccugggaccaccaaugguggcucggcucguuagguuuuauccccgcgcagaccggguaaugucugucugccugcgaguggagcuuuacggcugccucuggcgcgauggccugcugagcuacacagccccugucgggcaaacgauguaccugagcgaagccguuuaccugaaugacucuaccuacgacggccacacaguggggggccugcaguauggcgggcugggccaacucgcagaugggguggucgggcucgaugauuuccguaagagucaggaguugcgcguuuggccugguuacgacuauguggggugguccaaucacucuuuuucuucuggguauguggaaauggaguuugaguuugauagacugcgggccuuccaggccaugcagguacauugcaauaauaugcacacccucggugcccgacuuccagggggaguggagugcagguuuagacguggcccugcuauggcaugggagggcgaacccaugcgacauaauuuggggggaaaccugggagauccaagagcucgcgcagugucggugccccuggggggccggguggccagguuuuugcagugucgguuccucuucgcugggccgugguugcucuuuuccgaaaucagcuucaucuccgauguugugaauaauucgagccccgcacucggaggcacguucccuccugccccuugguggccaccaggaccuccaccgacaaauuucucuagucucgaguuggaaccucgcggccagcaaccugucgcuaaggccgaaggcagcccgaccgccauccuuaucgguugucuuguagccaucauucugcugcuccugcugaucaucgcucuuaugcucuggagacugcacuggcgcagauugcuauccaaggcugaacggagaguuuuagaggaggaauugacaguccauuuauccgugccuggugauaccauucugaucaauaaccggccagguccgcgggaaccccccccguaccaggagccccgaccaaggggcaauccuccccacagugccccgugcguacccaauggguccgcauugcugcucucaaaucccgccuaucgauugcuucucgcuacuuaugcaaggcccccucgggguccaggcccaccuacucccgccugggccaagcccacgaauacacaagcuuacaguggcgacuauauggagccggagaagccaggcgcgccucuccugccucccccuccacagaauuccgucccucauuacgccgaggcagacaucgucacacugcagggagugaccggcggcaauaccuaugcaguacccgcgcugccuccuggagccgugggcgauggaccuccccgaguugauuuucccaggaguaggcugagguuuaaagagaagcugggcgaaggacaauucggggaagugcaucugugcgaagucgacagcccacaagaucuugucagccuugacuuuccucucaauguacguaaaggucauccccuucucguugcagugaaaauccuuaggccagaugcaacgaagaaugccaguuucucacuguuuucccgaaacgacuuucugaaagagguuaaaauuaugucuagguugaaggaccccaauauuaucagauuauugggagucugugugcaggaugauccccuuugcaugauaacagauuacauggaaaacggagaccuaaaccaguuucugagcgcgcaccagcuggaggauaaagccgcugagggagccccgggagauggccaggccgcucaaggccccacaaucuccuacccuauguugcugcauguggcugcucagaucgccagugggaugagguaccuagcgacacucaauuucguacaccgggaccucgcuacgaggaacugucucguaggcgagaauuucacaaucaaaaucgcagacuucggcaugaguaggaaucuguacgccggggacuauuauaggguccaggggcgggcaguccuuccaaucagauggauggccugggaguguauuuuaaugggcaaguuuacuacagccucagacgucugggcauucggcguuacccuaugggaaguacucaugcugugcagggcacagccauuuggccagcugaccgaugaacaggugaucgagaacgccggagaauuuuuccgagaucagggccggcagguguaucucaguaggcccccggcuugcccacagggcuuguaugagcuaauguuacgcugcuggagcagagaaucagagcagcgcccucccuucagccaacugcaccgguuucuggcggaagaugcucucaacacuguuuag

SEQ ID NO: 12500 - RNA, 1041 nt, Artificial Sequence
  Description of Artificial Sequence: Synthetic coding sequence
augcugaaaaagccacuuucugcgguaaccugguuauguauuuucaucguugcguucguuucccacccugcauggcuccagaaacugaguaagcacaagacccccgcgcagccgcaacugaaggccgcuaauuguugugaggagguaaaggagcucaaagcccagguggccaacuuauccucccuucucagcgaacucaauaagaagcaagaacgugauuggguuucagucgugaugcaaguuauggaacuggagucaaacaguaagcgaauggaaucccgucugacugaugcagaguccaaguauucugagaugaacaaccaaauugacaucaugcaguugcaagcggcucagaccgugacucagacaagugcagaugccauuuaugacugcaguucccucuaucagaaaaauuaccggaucagcggaguguauaaguuaccuccagaugauuuuuuaggguccccugaacuugaaguauucugugacauggagaccucagggggcggcuggaccaucauucaacgcaggaaauccggacucgucucuuuuuaccgcgauuggaagcaguacaaacagggcuuuggcuccauccggggggauuucuggcucgguaacgaacauauucacaggcugucucggcagccaacacgacuacggguggagauggaagacugggaaggcaaccuacguuacgccgaauacucacauuuuguccuggguaacgagcugaacuccuaccgacuuuuuuuagggaauuacacgggcaaugucggcaaugacgcuuugcaauaccacaauaauacagcguuuuccacuaaagauaaggacaacgacaacugcuuggauaaaugugcccagcuuaggaagggaggguacugguauaauuguuguacugauagcaaucugaacgggguguacuaucgacugggcgagcacaauaaacaccuggauggaauuacgugguaugguuggcacggaaguaccuacagucugaaaaggguggagaugaagauaaggcccgaagacuuuaaacccuag

SEQ ID NO: 12501 - RNA, 1056 nt, Artificial Sequence
  Description of Artificial Sequence: Synthetic coding sequence
augaagggaagagcaguuucuuuugauccacuugccugucagggacucaacgcauccccgggaagccucacaagcccauugcgcagaauucggucccugacuggccgcgaagugcugacaccuuucccaggacucggcacugcugccgcacccgcccagggaggagcacauuugaagccucacagccucguuuugccgaucacagcccugccaccucccccacucgccuuacgagggcgucaagcgaccaguaaacuuccaccuuuucugagcaguccguuccccccuucuuugugucccugggugccagaccccggauucaaagagacugcuuuccuuuacgccgugagcucggcggcacuuacucacacucuggcccgcgcgugcagugccggcagaauggaacgcuguacaugugaugacucccccgggcuugaguccaggcaggcauggcaauggggaguguguggcgacaaccugaaguauuccaccaaauucuugucuaauuuccuggggagcaagcgagggaauaaggaccugagagcccgagccgacgcacacaacacccacgucgggauuaaggcagugaaaucugggcuacgcacaaccugcaagugccacggcguaagugggaguugugcuguuagaacuuguuggaaacaguugucuccguuucgcgagaccggccagguacucaagcuacgguacgacagugccguuaagguuucauccgccacuaaugaggcucugggacggcucgaacugugggcacccgcuagacaaggaagcuugacaaagggccuugccccacgcagcggggaccugguguacauggaagacucaccguccuucugcaggccuuccaaauacucacccggcaccgcuggcagaguauguuccagggaagccucaugcaguucacuguguugugggcggggauaugauacccaaucuagacuaguugcauuuuccugccacugccagguucagugguguugcuacguugagugccagcaaugcguccaggaagaguuggucuacacuuguaaacacuag

SEQ ID NO: 12502 - RNA, 462 nt, Artificial Sequence
  Description of Artificial Sequence: Synthetic coding sequence
augaaacaucuuaggccccaguucccccuuauuuuggcuaucuauugcuuuugcaugcuccagauccccucuuccggcuucccccagccccucgcagacccuuccgauggacucgauaucguccaguuggaacagcuagcauacugccugagucaaugggccccucugagcagacagcccaaagacaaucaagauauauacaaacgauuccuauuccacuauagccguacucaggaggcuacacacccaguuaagacaggcuuuccuccuguacacccucugaugcacuuggcggcuaaacuggccaaccgacggaugaaaaggauccugcagcgugguuccggcaccgcagcugucgacuuuacaaaaaaggaccauacagcaacaugggggcgacccuucuuucucuuuagaccucguaacggucggaacauugaagaugaggcccaaauucaaugguag

SEQ ID NO: 12503 - RNA, 765 nt, Artificial Sequence
  Description of Artificial Sequence: Synthetic coding sequence
auggccgcugcaagugcaggcgccacccggcugcuucuccugcugcugauggcaguggcggccccaagcagggcgagggggucagggugucgcgcagggacgggcgcucguggggcgggugccgaggggcgcgagggugaggccugcggcacuguggggcuacugcucgagcauucuuucgagauugacgauucugcgaacuuccgaaaaagaggaagucuguuguggaaccaacaagaugguacacucaguuuaucucagcggcagcuauccgaggaagagcgagggcgauugcgggacguggcagcacugaacggccuuuaccgcgugcggauaccuagacggccaggggcgcucgacggccucgaagccggcggcuacgugucaaguuuugugccugcuugcagucucguggaaagucaucuuagugaucagcugacucugcacguugauguggccggcaacguggucggugugucagugguuacucauccuggcgguugccggggccacgaggucgaggacguggaccuagaauuauucaacacuuccguucaguuacaacccccuacgaccgccccaggacccgaaacagcugccuuuauagaacggcuugaaauggaacaagcacagaaagcaaaaaacccacaggaacagaaaucauuuuuugcgaaauacuggcauauuauuuuaggcggcgcagucuugcucacagcucucaggcccgcagcccccgggccagcuccaccaccacaagaggcguag

SEQ ID NO: 12504 - RNA, 810 nt, Artificial Sequence
  Description of Artificial Sequence: Synthetic coding sequence
auggcagccgcuagcgcaggugcuacccggcuguuacugcugcuccugauggcgguugcugcgccuagucgcgccaggggcagcggcugccgugcugggacaggggcccguggcgcuggagccgaaggaagagagggagaggcauguggcacuguuggccuguuauuggaacauaguuuugagauagacgauagcgccaauuuccggaagcgcggcuccuuauuauggaaccaacaggacgggacauugagccugucacaacgucaauugucugaggaggagagagggaggcuuagagacguggcugcauugaacgggcuguacagggugcggauaccuaggcgcccaggggcguuggacggauuggaggccgggggauauguguccagcuucguacccgccugcucacuggucgaaucccacuugucugaucagcucacccugcauguagauguggccggaaaugucgucggaguuucggucgucacucaucccgggggcugccggggccaugagguugaagacgucgacuuggagcucuuuaacacuagcgugcagcugcaaccgcccacgaccgcgccaggccccgaaaccgcagcauucauugaacgucuugagauggagcaagcucagaaggcaaagaacccccaagagcagaagucauuuuuugccaaauacuggauguacaucaucccugugguucucuuuuuaaugauguccggggcccccgauacaggaggccagggagguggcgguggaggagguggugggggaggauccgggcggugcugcguucccccuagucuguag

SEQ ID NO: 12505 - RNA, 480 nt, Artificial Sequence
  Description of Artificial Sequence: Synthetic coding sequence
augucuuccccacagcgccgaaaagcuaugccaugggcccuuucccucuugcuuaugggauuucaacuucuugucaccuaugcgugguguucugaggaagaaauggggggcaacaauaagauaguccaggaucccauguuccuggccaccguggaguucgcccugaauaccuuuaaugugcaaucaaaagaagagcacgcuuaucgacuccuucgaguucugucaucauggagagaggauucaauggaucgcaaauggcggggaaagaugguauucucuaugaaccugcagcuacggcagacgguguguagaaaauuugaggaugauaucgacaauugcccuuuccaagagagccucgaacuuaauaaugugcggcaaggaauaagcuucccucaggugcacaguugcggaugcugcaugggcugcggcgucgggacaggugcggcggauaaggcaauaccucgagacaaaggaaaauag

SEQ ID NO: 12506 - RNA, 1737 nt, Artificial Sequence
  Description of Artificial Sequence: Synthetic coding sequence
auguuacuucuccuccugcuggccccccuguuccuucgcccacccggcgccggcggggcacagacacccaacgccacgucugaagggugucagaucauccacccuccaugggaaggugggauccgauaucgcggccuuacgagagaccaggugaaagcuaucaauuuucuccccguugauuacgaaauugaguauguauguagaggcgagagagaaguugucggcccgaaggugcgcaagugccuagcaaaugggucuuggaccgacauggacacaccaucucgaugugugcgcauauguuccaagaguuaucuuacucuggagaauggcaaaguguuccuaacaggcggagaucuccccgcucucgauggagccagaguggacuuuagaugugacccggacuuucaucucguuggcucuuccagaucaaucugcucucaagggcaguggucgacgcccaagccccacugucagguuaacaggaccccucacagugagagacgggcuguguauaucggcgcccuguucccgauguccggcggcuggccaggaggacaggcgugucagccagcgguugaaauggcacucgaagacguaaauagccgccgcgacaucuuacccgauuacgaacugaaauugauccaucaugauuccaaaugugacccgggccaggcuacaaaguaccuguacgaacuccucuauaacgaucccaucaagauaauccugaugccagggugcagcaguguaucuacucuuguggcagaagccgcacggauguggaaccuuaucgugcugucguauggcucuuccucccccgcucucucuaacaggcagagguucccaacuuucuucaggacucacccauccgccacccugcauaaucccaccagagugaaacuauuugagaaguggggcuggaaaaagaucgcuaccauccaacagacgacagagguauucaccucaacccuugacgacuuagaagagcgggugaaggaggcugggauagagauuacauuccggcaguccuuuuuuagugacccagccgucccaguaaaaaaucugaagaggcaagaugcuaggauuauagucggguuguucuacgagacugaagcuagaaaaguauuuugugaagucuauaaggagcgacuguuugguaagaaauauguuugguuucugauuggaugguacgcugauaacugguucaaaaucuacgacccaagcauaaacuguaccgucgaugaaaugacagaggccgucgagggacauauuacuaccgaaauuguaaugcuaaauccagcgaacacccgcagcauuuccaacaugacgagccaagaguuuguagagaaacugacuaagaggcuuaaaaggcacccugaggaaacgggcggcuuccaggaagcuccacuugccuacgacgcuauuugggcgcucgcccuggcucugaauaaaacauccggagggggcgguagaagcggggugaggcuggaggauuuuaauuacaacaaccagacuaucacggaccaaauuuaccgugccaugaacagcuccucauuugagggcgugagcggucacgugguuuuugaugcuagcggcagccgaauggcauggacccucauugaacaguugcagggaggcagcuauaaaaaaaucggcuacuaugacaguacgaaagacgaucuuuccuggaguaaaacggacaaauggauagugauaagcagaacacauuccccaaccuag

SEQ ID NO: 12507 - RNA, 444 nt, Artificial Sequence
  Description of Artificial Sequence: Synthetic coding sequence
augcuaggccucccuuggaaaggagguuuaucuugggcacuuuuacugcuucuccuggguucccagauauuacuuaucuacgcauggcauuuucacgaacagagagacugugaugagcacaacguaauggcccgcuaucucccagccacuguggaauuugccguccacacauuuaaucagcagaguaaggacuacuaugcauaucgccucggacacauucugaauagcuggaaagagcaaguagagucgaagacuguguucaguauggagcugcugcucggaagaacuagaugcggcaaauuugaagaugauaucgacaauugucacuuccaggagagcaccgagcucaauaauaccuuuaccugcuucuucacaaucucaacgcggccauggaugacccaguuuuccuuacucaacaaaacaugccuggaaggauuccauuag

SEQ ID NO: 12508 - RNA, 444 nt, Artificial Sequence
  Description of Artificial Sequence: Synthetic coding sequence
augugguccuuacccccaucccgagcucugagcugugccccgcuccugcuacucuuuagcuuucaguuucugguaaccuacgccuggcgguuucaagaagaagaagaauggaaugaucagaaacagauugccguguaucugccaccuacgcucgaauucgccguguacaccuuuaacaagcaaucaaaggacugguaugcauacaaauuaguccccgucuuagcguccuggaaggaacagggguacgauaaaaugacauucucuaugaaccuacaacugggaagaaccauguguggcaaguucgaggacgauauugacaauuguccauuucaagagucaccagaacugaauaacaccugcacuugcuuuuucacaauuggcauugaaccuuggcggacccgguuugaccuguggaauaaaaccuguuccggcggacacucuuag

SEQ ID NO: 12509 - RNA, 2535 nt, Artificial Sequence
  Description of Artificial Sequence: Synthetic coding sequence
augggcccgggagccccuuuugcucgcgucgguuggccacugccauuacugguggugauggcagcaggaguagcgccagucugggccucucacucaccacaccuaccgagaccucacucaagagugcccccucacccgucuuccgagaggagggccgucuauaucggcgcccuauucccuaugagcgggggguggccugguggucaggccugccagccggcgguagagauggcccucgaagauguuaauucacgacgugauauccuucccgauuacgagcuuaaguuaauacaccacgauaguaaaugcgaucccggccaagcaacuaaguaucuguaugagcuguuauacaaugaccccauuaagaucauucugaugcccgggugcagcuccguguccacgcuuguggccgaagccgcuagaauguggaaccucaucguucugagcuacgguagcagcucccccgcccugucuaacaggcagagauuuccgaccuucuucagaacccacccuucugcuacguugcacaauccuaccagagucaaacuguucgagaaguggggguggaagaaaauugcuacuauccaacagacgaccgaaguguuuacuaguacacucgacgaccuggaggaacgcguuaaggaagccggaauugagauaacuuucagacagucuuucuuuagcgacccugccgugcccgucaagaaucuuaaaagacaggaugcucguauuaucgugggccuguuuuacgagacggaggcacgcaaagucuuuugugaaguguauaaggagaggcucuuuggcaaaaaauaugucugguuucuuauuggcugguaugcugauaauugguuuaaaauuuacgaccccucaauuaacugcaccguagaugaaaugacugaagcaguggaagggcacauaaccaccgagaucgugaugcugaaucccgcaaacacacggucgauuagcaauaugacuagccaggaauucguggaaaagcugaccaagcgcuugaagcgucacccugaagaaacaggcggguuccaagaggcccccuuagcauacgacgccaucugggcccuggcccuggcucuuaacaagaccuccggaggagggggacgcucaggggugcgguuagaggacuuuaacuauaacaaucagacaauaaccgaucaaaucuaucgagcaaugaacuccucuuccuucgagggagucuccggccaugucguguuugaugccaguggaucgcgcauggcauggacuuuaauagagcagcuacagggcggaaguuauaagaaaaucggcuauuacgauucaaccaaggacgaccuuagcuggucuaaaacagauaaauggaucggcggcagcccaccagcggaccagacucuuguaauaaagacuuuucgguucuuaagucagaagcuuuuuauuucugugucagugcugagcucucucggaaucguucucgcuguugucugccuuucauucaauauuuacaacucacacguccgguacauucagaacucucagccuaaucuuaacaacuugacagcagugggaugcucccuggccuuggccgcuguguuuccucuggggcuugacggauaucacaucggcagaaaucaguuuccuuuugugugccaagccagacucuggcuccucggacuuggguuuucccugggauauggaucuauguuuacaaagauuugguggguucauacaguguucacaaagaaggaggaaaagaaggaauggcgaaaaacccuagaaccauggaaguuauaugccaccgugggacugcuagugggcauggacgugcucacacuggcgauuuggcaaauuguggacccauuacacagaacuauugagacauucgcaaaggaagagcccaaggaggauauugacgugaguauccuuccccagcuugagcauuguagcagcagaaagaugaacacuugguugggcaucuucuacggguacaaaggacugcugcuccugcuuggcaucuuccuggcuuaugaaacuaaaucaguuagcaccgagaagaucaaugaucauagagcagugggcauggccauuuauaacgucgccguucuuugucugauaacggcaccugugaccaugauauuaagcagccaacaagacgccgccuucgcuuucgcaucauuagccauagucuucaguucuuauaucacauugguggugcucuuugugccuaaaaugagacggcuuaucacaaggggcgaguggcaguccgaggcgcaggauacaaugaagacuggcucuucgacuaauaacaacgaggaagagaagucccggcugcuugagaaagaaaacagagaacuggagaaaauuauugcagaaaaggaggaaagagugagcgaauuacggcaucaguuacaaucucggcagcagcuucgcagucgcaggcacccuccuaccccuccugagccuuccggcggacugccgcgcgguccuccugagccuccagaccguuuaaguugugacgggucacgcguacaccuguuguauaaauag

SEQ ID NO: 12510 - RNA, 2700 nt, Artificial Sequence
  Description of Artificial Sequence: Synthetic coding sequence
augcuccuccuguugcuccuggcaccacuguuccugcguccccccggcgcagggggagcucaaacgcccaacgcaacuucggaggggugccaaauaauccauccgccuugggagggcggaauuagauaccggggcuugacccgcgaucagguaaaagccauuaacuuccugcccguggacuaugagauugaguauguuugucguggggaacgugaggucgugggucccaaagucagaaagugucuggcuaauggcucuuggaccgacauggacacaccaucuagaugcgucaaccguaccccacauucugagcgaagggcagucuauaucggcgcccuguuuccaaugucaggaggauggccaggggggcaggcuugccagccugcuguugagauggcucucgaggaugucaacuccagacgagauauccugccggauuacgagcugaaacugauccaucacgauucuaagugcgaccccggucaggcuacuaaauaucuguaugaacuguuguacaacgaccccauaaaaauaauccucaugccagguuguucaucugugucaacgcucgucgcggaggccgccaggauguggaaccucauagugcuauccuauggcucaagcuccccggcuuuaagcaaucgacagagguucccaacauuuuucagaacacaccccucggcgacccugcacaacccuacccgcgugaaacuguuugagaaaugggguuggaaaaaaauugcaaccauccagcaaaccaccgagguguuuacaucaacacucgaugaucucgaagaacgagugaaggaggcuggcauugagaucacauucaggcaaaguuuuuuuucagacccggcggugcccgugaagaaccugaagcggcaggacgcaagaauuauugugggacucuucuacgagaccgaggcuagaaaaguguuuugugaaguguacaaggagcgcuuguuuggaaagaaguacgugugguuuuugaucgggugguaugcugacaauugguuuaagaucuaugauccaucaauuaauuguacuguggaugagaugacagaagcgguggagggucauauuacaacugaaauuguuaugcucaaccccgccaacaccaggagcaucucaaacaugaccucucaggaauuuguagagaaacucacuaagcgacugaaacgccauccagaagaaaccggaggcuuccaggaggccccacucgccuacgaugcgauaugggcacuugcucuggccuuaaauaagacaagugguggcggcggcagaagcgguguccgguuagaggauuucaauuacaauaaucaaaccaucacugaccagaucuacagagcgaugaauucgucuucguucgaaggagugagcggacaugucgucuuugaugccucuggcuccagaauggcauggacuuugauagagcaguugcaaggcggguccuacaaaaagauugguuacuacgauagcaccaaagacgaucuauccugguccaaaacagauaaauggaucggaggaagucccccugcugaccaaacauuagugauuaagacauuccgguuucuuucccagaaacucuucauuucggugucaguucugucuucucucgguauuguguuggccgugguaugcuuauccuuuaacaucuacaauagucacguucgguauauacaaaauucucagccaaaucugaacaaucugaccgccgucggcugcucacucgcccuggccgccgucuuccccuuggggcucgauggcuaucacaucggcagaaaccaauucccuuucgugugucaagcuagauuguggcuguugggacugggguuuuccuugggguacggcuccauguucacaaaaaucugguggguccauaccguguucacgaaaaaggaggagaagaaggaauggagaaagacacucgaaccuuggaagcuguacgcaaccguuggucugcugguaggaauggacguguugacccuggccauuuggcagaucguggauccgcuacauagaaccaucgagaccuucgccaaagaagaaccaaaggaggauauugauguuucaauucugccgcaguuggaacacuguagcucccguaaaaugaacacguggcucggaauuuuuuacggcuacaaagggcuguuguuacugcuggguaucuuucuggcuuaugagaccaaaagcgugaguacggagaagauaaacgaccaccgagccgucggaauggccauuuauaauguagcugugcuuugccuaaucaccgcucccguaaccaugauucuguccucucagcaagaugcagccuucgcuuucgccucacuggcuauagucuuuaguucauacauuacacuaguagugcuguucgugcccaaaaugagaagacuuauaacacggggcgaauggcagucugaagcccaggauaccaugaagacuggaucuagcaccaacaacaaugaggaggagaaauccagauugcuugaaaaggaaaauagggagcuggagaaaauaauugcugagaaggaagagcggguuagcgaguuacgccaccagcugcagaguaggcagcagcuacgguccaggaggcacccccccaccccuccggaacccuccggcggauugccacgcggccccccagagccccccgauagacugucaugcgacggaucuagagugcaucuccuguacaaguag

SEQ ID NO: 12511 - RNA, 2886 nt, Artificial Sequence
  Description of Artificial Sequence: Synthetic coding sequence
augcugcuccugcuccuacuagcaccacucuuucugcguccuccaggagccggaggcgcacagacaccuaacgccacauccgaagguugccaaaucauccacccaccgugggaggggggaauucgcuacaggggacugacccgggaucaagugaaggcaaucaacuuucugcccguugacuaugagaucgaauaugucugucggggcgagcgcgaagugguuggaccaaagguuaggaagugccuugcuaacgguuccuggacggauauggacacuccaucacgcugugugcggaucugcucuaagaguuauuugacacucgagaaugguaaaguuuucuuaacggggggcgaccucccggccuuagauggcgcgcggguggacuuccgaugugacccugauuuucaccugguuggaagcagccgcaguauauguagccagggacaguggagcacccccaaaccacacugccaggugaaccgcaccccucacagcgagaggagggcgguguauauuggagcccuuuucccuaugucaggcggauggcccgggggacaagccugccagccugcuguggagauggcuuuagaggacgugaacucccgaagagacauccugccugauuacgagcuuaaauuaauccaccacgauagcaaaugcgauccuggccaggccaccaaguaucuauaugagcugcuguauaaugaucccauaaaaaucauacucaugccaggcuguucuucaguuucaacacugguugcugaagcagcuagaauguggaaucugauagugcuuagcuauggaagcucuagucccgcucuaaguaaucgccagagguuccccacuuucuuccgcacucacccaagcgcaacccuccauaacccaacccgcgucaagcucuucgaaaaauggggauggaaaaaaaucgcgacaauucagcagacuacugagguuuucaccucaacacuugaugaucuggaggagcgagucaaagaagccgguaucgagauaaccuuucgucagaguuucuuuagcgacccugcaguuccugucaaaaacuugaaacgucaggacgcgcgcauuaucgugggcuuauuuuaugagaccgaagcaagaaagguguucugcgagguguacaaagaacgacuguuugguaagaaguaugugugguuccugauaggaugguaugcugacaacugguuuaaaauuuacgauccuucuaucaacuguacagucgaugaaaugacagaagccguggaagggcauaucacaacagaaaucgugaugcuaaauccagcuaacacuaggagcaucaguaacaugacuagucaagaguucguggagaaacucacaaagcgauugaaacggcaccccgaggagacaggaggauuccaggaggccccuuuagcauaugacgcuauuugggcccuggccuuggcuuugaacaaaaccagcggcgggggcgggcgguccggagugagguuggaagauuucaauuauaacaaccagacuaucaccgaucagauauaucgggcuaugaacaguagcaguuuugaaggugucagcggccacgucguguuugaugcaucuggaucccgcauggccuggacuuugauugaacaacuccaggggggcucuuacaaaaagaucggcuacuaugauuccacuaaggacgaucugucauggucuaagaccgacaaguggaucggggguucucccccugcggaucaaacuuuagucaucaagaccuuuagauuccucucacagaaacuuuucauuucaguauccgugcuaucgagccuugggauaguucuggccguggugugccugaguuucaacaucuacaacucccacguccgguacauccaaaauagucagccgaaccugaauaauuuaaccgccgucgguuguucacuggcucuggcugcgguuuucccacugggucuggacggcuaccacaucggaagaaaucaguuuccuuucgugugccaggcccgucuuuggcuccuaggccugggauuuuccuuaggguacggcucuauguucaccaaaaucuggugggugcauaccguguuuacaaaaaaagaggaaaaaaaagaguggagaaaaacacuugaaccuuggaagcuguacgccacuguugggcugcuagugggaauggacgugcugacacuggccauuuggcagauuguggauccacugcaccgcacaaucgagacuuuugccaaggaagaaccuaaggaggacauugacguguccauccucccgcagcucgaacacuguagcagcaggaagaugaacacuuggcugggcaucuuuuauggguacaaagggcugcugcugcuucugggcaucuuccuugccuacgaaaccaaaagcgucagcacggaaaagaucaaugaccacagggccguuggcauggcuaucuacaacgucgccguuuugugccugaucaccgcccccgucacaaugauccuuucaucgcagcaagacgccgcguucgcauucgcaucacucgccaucguguucaguucauacauaacacuggugguucucuucgucccuaagaugcggagguugauuacgagaggggaauggcaguccgaagcacaggacacgaugaaaacuggcaguaguaccaauaauaaugaagaagaaaaaagccgccugcuagagaaagaaaauagagagcucgagaagaucaucgcagaaaaagaggagcgcguuagugaguugcgacaccagcuccagucccggcaacaauuacgcagcagacgccacccuccaaccccuccggaaccuuccgguggcuuaccucggggaccaccagaaccuccugauagacuaucuugcgauggaucuaggguccacuuacucuauaaauag

SEQ ID NO: 12512 - RNA, 882 nt, Artificial Sequence
  Description of Artificial Sequence: Synthetic coding sequence
augaacaauuuguccuuuucugaacucugcugucuguuuugcugcccuccaugucccgguaaaauagcaaguaaacuagcuuuccuccccccggauccaacuuacacccuuaugugcgacgaauccgguucgcgguggacccuccaccuuagcgaacgagcagauuggcaguacuccucaagggaaaaggacgcuauugaaugcuuuaugacuaggacuaguaagggaaaccguauugccugcauguucguuaggugcagcccuaacgcaaaauacacucugcuguucucucacgggaaugcggucgacuugggacaaaugaguaguuucuauauuggucugggcucuagaauaaacugcaacauuuuuaguuaugacuacagcggcuauggcgccuccagcgggaagccaacggaaaaaaaucuuuacgcagauauugaagcggcuuggcuggcccugcgcacacgauaugguauuaggccagaaaacgucaucaucuauggacagagcaucggaacuguucccuccgucgaccuugcugcaagauacgaauccgcggccgugauccuccauagucccuuaacauccggcaugcgcguugccuucccggacacaaaaaagacuuacugcuuugaugcauuuccgaauaucgauaaaaucucaaagaucacuucccccgugcuaaucauccacgguacagaggacgaagucauagacuuuucacacggauuagcccucuuugaacggugucaaaggcccguggagccuuuguggguagagggagcaggacacaaugacguggaacuguauggccaguaucuggaacggcucaaacaguucguaucccaggaguugguucaaaagcauaaagagggaaaguag

SEQ ID NO: 12513 - RNA, 1155 nt, Artificial Sequence
  Description of Artificial Sequence: Synthetic coding sequence
augugguaugucagcacucgcggaguugcccccagagugaacuuugaaggugcucuuuuuucuggcuaugccccugacgguggccuguucaugcccgaagaacucccccaacucgaccgcggcacauuaugucaguggucaacucuaucguacccuggucucgucaaggagcugugcgcacuguuuauuggcuccgaacuucucccuaaagacgagcugaacgacuugauugaucgcgcuuucucccgauuuagacaucgcgaaguaguacaccugagccggcuuaggaacggccuaaacguucuggagcuuuggcauggcgugacuuaugcauucaaggaccuuagucucucaugcacaacgcaauuccugcaguacuuccucgagaaaagagagaagcacguuaccgucgucgugggcacaucuggagauacggggagcgcggcuauugaguccguccagggugccaaaaacauggacauuaucguucugcugccaaaaggacacugcacuaaaauucaggaacuucaaaugacuaccgugcugaaacaaaacguucaugucuucggcgucgaaggcaauucugaugaacucgaugaaccgauaaaaaccgucuucgccgaugucgccuucguaaagaaacacaacuuaaugagucuuaacucuaucaacuggaguagaguucucguccaaauggcucaccauuucuuugccuauuuucaauguacccccucucuggacacacacccacuaccgcugguggagguagugguacccaccggugcugcaggaaaccuggcugcuggcuacauugcccagaaaauuggucugccaauuagacucguuguggcagugaaucgcaaugacauuauacaucgcacggugcaacagggcgauuucucucucucugaggcggucaaauccaccuuggccuccgcuauggacauccaaguaccuuacaauauggaaaggguguuuugguuacucagcgguuccgacucccagguaaccagggcccucauggagcaauuugaacgaacccaauccgugaauuugccuaaggaguugcacucaaaacacagcccugugcucccucgucccugucugugcucccaggugccuggcagcuguccgggaugcuggcccgaccccuag

SEQ ID NO: 12514 - RNA, 2889 nt, Artificial Sequence
  Description of Artificial Sequence: Synthetic coding sequence
auguugcgucgaccagcuccggcucucgccccugccgccagacugcuguuagcaggccugcucugcggagggggugucugggcugcccgcgugaauaagcauaagccuuggcucgaaccaacguaucacggcauugucacagagaaugauaauaccguccuccuugacccuccacuuaucgcacuagacaaagacgcgccacuuagguuugcagaguccuuugaagucaccguuacgaaagagggggagauauguggauucaagauccacggccagaacguuccauucgaugcuguggucguggacaagaguaccggagaaggugugauuagaucuaaagaaaaguuagauugugagcuccagaaagacuacagcuucaccauccaagcguaugacuguggcaagggcccagaugguacuaaugugaagaagucccacaaggcaacugugcauauccagguuaacgaugugaacgaauacgccccaguuuuuaaggaaaagucuuauaaagcaacugucauagaggggaagcaguaugacucuauccuccgaguggaagccguggaugcugacugcuccccgcaguucagccagauaugcaguuaugaaaucaucaccccagaugucccuuucacuguugauaaagaugguuacauuaagaauacagagaaguugaacuaugguaaagaacaccaauauaaacucacugucacagccuaugauugcgggaagaagcgggcuacugaggaugugcuugugaagaucaguauuaagccuacguguacaccaggguggcagggcuggaauaaccgcauugaguaugaacccggcacaggagcacuggcgguuuuuccuaauauccaccuugaaacaugcgacgagccuguggccucaguucaggcaacuguggaguuagagacuucccacauugggaagggaugcgaucgugauacuuacagugaaaagucucugcauagauuauguggggcugcugcaggcaccgcagaacuccugcccagcccaucaggaucucuaaacuggaccaugggcuuaccuaccgauaauggccacgacuccgaccaggucuuugaauucaacggcacccaggccgucaggaucccggacggcguggucagugugagcccaaaggaacccuuuaccauuucugucuggaugagacaugggccauucggacguaaaaaagagaccaucuuauguucuuccgauaagacugauaugaaccgucaccauuauagucuuuacguccaugguugccggcugauauuccuuuuuagacaggacccuagcgaagaaaaaaaguacagaccggcugaauuccacuggaagcucaaucaggugugcgaugaagaguggcaucacuacgugcucaacgucgaauuccccuccgucacauuauauguugauggaacaagccacgaaccuuucuccgugacugaggauuauccccuucacccaucaaaaauugagacgcagcucgucguaggagcuuguuggcaagggggcgaucuucauaugacacaguucuucagggguaaucuggcagggcuaacccucagaagcggcaaguuggcugauaaaaaggugaucgauugccuguauacaugcaaagagggccuugaccugcaagugcucgaagacucuggccgcggaguacagauucaggcucacccaagucagcuggugcuaacccuggaaggagaagaucugggugaacuggacaaggccaugcagcacauuucuuaccucaauucacgccaguuucccacaccugguauaagacggcugaagaucaccucaacaauaaaaugcuucaaugaagccacuugcauuucugugccacccguugacggguauguuauggugcuccagccggaggaaccaaaaauuuccuugagcgggguccaucacuucgcuagggcagcgagcgaguucgaguccagcgaaggcguguucuuauuuccagaacugcgcauaaucucaacaaucacucgcgaagucgaaccagaaggggauggagccgaagaccccacuguacaggagucccucguuuccgaagagauuguucacgacuuagauaccugcgaaguaacggucgagggcgaagagcugaaccacgagcaggagucccuggagguugauauggcacgcuuacagcagaagggcauugaagucagcagcagcgaacuuggcaugaccuuuacagggguagacaccauggcuaguuacgaggagguacuccaucuucuuagguaucgcaacuggcaugcccgcagccuucuugaucguaaauuuaaacuaaucuguagugaacuuaacggccgguauaucagcaacgaauuuaaaguggaggugaacgugauacacacugccaaccccauggagcaugcaaaccacauggcagcccagccacaguuuguacaccccgaacacaggucguucguagaucucagcggacauaaucuugccaacccucauccauuugcuguggugccaucaacagccacgguugugaucgugguuugcgucuccuuucuggucuucaugauuauccugggggucuucaggauccgagccgcccaccgccggacuaugcgagaucaagacaccgguaaggaaaacgagauggacugggacgacucagcauugacuaucaccgugaaucccauggaaacauaugaagaucagcauucaucagaagaagaggaggaggaggaagaggaggaggaguccgaggacggggaagaggaagaugacauuacauccgccgagucugaaagcuccgaggaagaagagggggagcagggagacccccagaacgcgacacgccaacaacaguuagaaugggaugacucuacuuuaaguuauuag

SEQ ID NO: 12515 - RNA, 2946 nt, Artificial Sequence
  Description of Artificial Sequence: Synthetic coding sequence
augcucaggagaccugcacccgcacuggcccccgcggcacgacuucuguuagcaggucuguuaugcggaggaggaguuugggccgcgaggguuaacaagcauaaaccauggcuagagccgaccuaccacggaaucgucacagaaaacgauaauacagugcugcuggaccccccacugauugcccuugacaaggaugcaccucugagguuugcugagagcuucgaggugacugugaccaaagagggagagauauguggauuuaaaauacacggacagaacgucccuuucgaugcagucguggucgauaagucaaccggcgagggggugauccggagcaaagagaagcuggauugugaguugcagaaggauuauuccuucacaauacaggcuuacgacugcgggaaggggcccgacgguaccaauguuaagaagucucacaaagcaacaguccacauccaagugaacgacguuaaugaguaugccccgguguuuaaggaaaaaucauauaaagcuaccgugaucgagggaaagcaguacgacagcauuuugcgaguagaagccgucgacgcugauugcuccccgcaguucucucagauuuguaguuaugaaaucauuacgccugaugugccuuucacgguggacaaggacggauacauuaagaauaccgagaagcugaacuacgggaaagaacaccaauacaaauugacggugacugcguaugacugcggcaagaagcgggccacagaggaugugcuggucaaaauuucuaucaagccaaccuguaccccuggguggcagggguggaacaaccguaucgaauaugagccugguaccggagcacucgccguguuuccgaacauucaucuugagaccugugaugagccuguugcuuccgugcaggccaccgucgaacucgagacaucgcacauuggaaaagguugugacagagacacauacucagagaaaucauuacacagacuuuguggcgccgcggcaggcaccgccgagcugcuaccaucaccuucgggcagccuuaauuggacaauggggcugccuacagacaacggacacgacagcgaucagguguuugaguuuaaugggacacaggcagugagaauacccgacggggugguuuccguuuccccuaaagagcccuuuaccauuucugucuggaugagacacggcccauucggaaggaagaaggagaccauucuguguagcagugacaaaacagacaugaaucgacaccacuauucguuauaugugcaugguugccgacuuauauuucuguucaggcaggaucccagcgaggagaagaaguacagaccagcggaauuucacuggaagcucaaccaaguaugcgacgaggaguggcaccauuauguccucaauguugaguuuccaagcguuacccuguacguugauggcacuucucaugagccguuuuccgucaccgaggacuacccacuucacccauccaagaucgaaacucaacuggucgucggagcguguuggcaggaauuuucuggcgucgaaaaugauaacgagaccgaaccagucacaguugccagugcagggggagaccugcacaugacucaguucuuucgggggaaucucgccggacugacccuacgaagcggcaaacucgccgacaagaaagugauugacugucuguacaccugcaaagaaggccuggauuuacagguccuugaagauuccggcaggggagugcagauucaggcccauccuucccagcucgugcugacccuggaaggcgaggaucuuggggagcuugacaaggccaugcagcacaucuccuaucucaacucacgccaguuuccuacacccggaauucgucggcuuaagauaacuucaacaaucaaauguuucaacgaggcuacaugcaucucggucccacccguggauggcuaugugaugguucugcagccugaagagccuaaaaucucgcucuccggcgugcaucacuucgcaagagcggcaucagaguuugaguccagcgagggaguuuuccucuuuccugaacugagaauaaucagcacuaucacucgugagguggagcccgagggcgauggcgccgaggaccccacuguccaagaguccuugguguccgaagagauaguccacgauuuagacaccugugaggucacuguggaaggagaggaauuaaaucaugagcaggaaucucuugagguggacauggcuagacugcagcagaaaggaauugaggugucgagcuccgaguuggguaugaccuucacagggguugauaccauggcaagcuaugaagaaguuuuacaucuauugagguaucggaauuggcacgcacgcucucuucuggaccgaaaauuuaagcugaucuguuccgaacuuaacggacgcuauaucucuaacgaguucaagguggagguaaacgugauccacaccgcuaacccuauggagcaugccaaccacauggccgcacaaccccaauucguacaccccgagcaucgguccuucguggaucuuucggggcauaaucucgcaaacccucaucccuucgcuguaguaccaaguaccgcuaccgucguuaucguugucugcguuucguuucugguguucaugauuauucucggcguauuccggauuagagcugcccaccgcaggacaaugcgcgaucaagauaccggaaaggaaaacgagauggauugggacgacuccgcacugacgauuacugugaacccuauggaaacuuacgaagaucaacauaguagcgaagaggaggaggaggaggaggaggaggaagaguccgaagacggggaggaggaagaugacauuacauccgcagagagugagucaagcgaagaagaggaaggcgagcagggggacccucagaaugcaacgagacagcaacagcuugaaugggacgacuccacucuguccuacuag

SEQ ID NO: 12516 - RNA, 678 nt, Artificial Sequence
  Description of Artificial Sequence: Synthetic coding sequence
augagcgggugcucaaaaaggugcaagcucggcuucguuaaauucgcccagacuauuuuuaaacugauuaccggcacacuaucaaaagacaagauugaagacgaacucgaaaugacuauggugugccauagacccgaagggcuggagcagcuggaggcccaaacaaacuuuaccaaaagggaacuucagguguuguauagaggauucaaaaacgaaugcccaucugggguggucaacgaggacaccuucaaacaaaucuaugcccaguuuuucccacauggcgaugcgucaaccuacgcucacuaucuauuuaacgcguuugacacaacucagaccggaagugucaaauucgaggauuuuguaacugcacuaaguauuuugcugcgggggacaguacaugagaagcuccguuggacuuucaaucuguacgauaucaacaaagauggguauauuaacaaggaagagaugauggacauugucaaagcaaucuaugauaugauggggaaauauacauauccaguccugaaagaagauacuccuagacagcacguugacguguuuuuucaaaaaauggauaagaacaaggacggaaucgugacucucgacgaguuccuugagagcugccaggaagaugacaauaucaugcgaucacugcaacuauuccagaauguuauguag

SEQ ID NO: 12517 - RNA, 420 nt, Artificial Sequence
  Description of Artificial Sequence: Synthetic coding sequence
auguauaaguuggccucauguugccuguuguucauaggcuuucugaacccuuuacugucucugccucucuuggauaguagagaaaucucuuuccagcuguccgccccccacgaagaugcucgccucaccccugaagagcucgaacgcgcaucccuccugcagauuuuacccgagaugcuuggugcagagcgaggggauauucuccggaaagccgauucuucaacaaacauuuucaauccucgcggcaaccugcggaaauuccaggauuucucaggacaggacccuaauauacugcuaagccacuuacuugccagaauauggaaacccuauaagaaacaacgccgaaaacuaagacaggaccuacggcucuggaagaaggagccaggacuccgcaucuuuaaaaauuacguuuggguguag

SEQ ID NO: 12518 - RNA, 879 nt, Artificial Sequence
  Description of Artificial Sequence: Synthetic coding sequence
auggaggugacggccguggcgacucagggcgguuauggcucgucagacugggugaccucauaucuguuaauguuuucugauggaggucggaacuggaaacaguauagaagagaggagucaaucuggggguucccggggaauacgaaugccgauucagucguacacuaccgccugcagccaccuuucgaagcuagguuucuccgguuccucccacuggcauggaacccucgaggacgaaucgggaugaggauagaaguguacggaugcgcuuauaaaucagaaguggucuauuuugacgggcagagcgccuuacuguauagacuggauaagaagccccucaaacccaucagagacgucaucucucucaaguuuaaggcuaugcagucuaauggaauacugcugcauagggaaggccaacauggcaaccauauuacacuggaacucauuaaaggaaagcuagucuucuuccugaauucuggaaacgcuaaacugccuucaaccauagccccugugacuuuaacccuagggucucuucuugacgaucagcacuggcauuccguucugaucgaauugcuugacacccagguaaauuuuacuguggauaagcauacccaccauuuccaagcaaaaggcgacucguccuaucuggacuugaacuuugaaauuagcuuuggcggcauuccgacaccuggccgcucacgcgcauuccgcaggaagucuuuccaugguugcuuagagaaccucuauuauaacggcgucgacgugaccgaacuugcaaaaaaacacaagccccagauucucaugauggaacuugcccacgggcuucaggaucagaacuuaaagaucucacugacagugugucaccagacaacucaguag

SEQ ID NO: 12519 - RNA, 783 nt, Artificial Sequence
  Description of Artificial Sequence: Synthetic coding sequence
augaagacaagugauggguucacacuaaacgccgaaucuuaugucuccuucaccaccaagcuggauauacccacugccgcaaaguacgaauauggugugccccugcaaacaagcgacuccuuccugcgguucccuaguucccucacaagcagucugugcacugacaacaacccggcugccuuccuugugaaccaggcugugaagugcacucgaaaaauaaaccuggagcagugcgaagagaucgaggcccucuccauggccuuuuacucaucgccugagauacugagagugccugauucaagaaagaaaguaccuauaaccguccagucuaucgucauccaaucuuugaacaagacucuuacacgacgcgaggacacagacguacuccagccgacuuuagucaaugccgggcacuucucccuaugcguaaaugucguccuggaggucaaguacuccuugacauauacugacgccggcgaagucaccaaagccgaccuguccuucguucuugggacaguuucguccgugguugugccgcugcaacagaaauuugagauccauuuucuccagacagacuggucauccccuguuucagcucgcuccacugaaggagaggagccagccgugggaccuggccucccccguuuacgcggaccuuuuuggaaguuuccuggaccuggucacgcuggccugggugcccacccauugcaucauccagucauccagcaggagggcuucuugcccgccccucgcgguuucggauauagaagugaaguugauuag

SEQ ID NO: 12520 - RNA, 3624 nt, Artificial Sequence
  Description of Artificial Sequence: Synthetic coding sequence
auggcuagcguagcgugggcuguguuaaaggugcugcugcugcugccaacacagaccuggucuccuguuggggcaggaaacccucccgacugcgacgccccucuggcauccgcccugccucggucuucuuuuucauccucaucugagcuuuccucaucucauggccccggguucucccgucuuaaccgccgagacggugcugggggcuggacaccucuggucagcaacaaguaucaguggcugcagauugaucugggcgagagaauggaagugaccgcaguagcaacacagggcggcuacgggucauccgacuggguuacuaguuaccuguugauguuuucagacggcgggcgaaauuggaagcaauacaggcgggaggaaagcaucugggguuucccagggaauacaaacgccgacagcguaguacauuacagauuacagccaccuuucgaagcgcgauuuuuaagauucuugccccuggcauggaauccaagaggucgcaucgggaugaggaucgagguuuaugggugcgcguauaagucugagguagucuacuucgacgggcaguccgccuugcuguacagacucgauaagaagccccugaagcccauaagagaugugauaagccugaaauuuaaagccaugcagucaaauggcauucugcuccauagagagggucaacacgguaaucacauaacacuggaacugauaaaaggaaaguugguguucuuccucaauucagggaacgcaaagcuuccguccacaauugcuccuguaacacucacacugggcuccuuacucgacgaucaacauuggcauucuguucugauagaguuacuugacacccaggugaacuuuacugucgacaagcacacucaucacuuucaggcuaaaggcgauucuaguuacuuggaccuaaacuuugagauuagcuucggcggaauccccacacccgggaggaguagagcauuccggcgcaaaagcuuccacggaugucuugagaaccuuuauuauaaugguguagaugugacugaauuagcaaaaaaacacaaaccacagauucuuaugauggggaaugugucauucagcuguccucaaccucaaacggugcccgucacguuucuguccucucgcagcuaccuggcccugccuggcaacagcggugaggauaaggucucagucacauuucaguuucgcacuuggaaucgggcagggcauuugcuguucggggagcuccgccgggguagcggguccuucguucuuuuccucaaagacggaaagcuuaaauuguccuuauuccaaccugggcaaucaccccgaaaugucacggcuggugcugguuugaacgacgggcaguggcacuccguaagcuuuucugccaaguggucccacaugaaugugguaguggaugacgacacggccgugcagccguuaguggccgugcugaucgacucuggagacacauauuacuucgggggcugucucgauaauagcaguggaucuggaugcaaaaguccccucgguggauuccaggggugcuugaggcugauaacaauaggggacaaagcugucgaucccauucucguacagcaaggggcacugggguccuuucgggaccugcaaaucgacagcugugguaucacggacaggugcuugcccuccuacugugaacaugggggagaaugcagccagagcugggacaccuuuucaugugauugucuggggacaggcuauacaggagaaacaugccacucgucucuguacgagcaaagcugcgaggcgcauaagcacaggggcaacccuucaggguuguacuauauagacgccgaugggucagggccauuaggcccuuuucugguguacugcaacaugacggacgcugccuggacaguggugcagcacggcggucccgaugcuguaacacugagaggcgcccccagcggacauccuaggagcgcagucuccuuugccuacgcagcaggugccggccaguuacgaucagccguuaaucuggcugaacggugcgagcagaggcuggcguuaagaugcgguacagcgagacggccggauucacgcgacgggaccccauugagcuggugggucggaagaaccaacgagacgcacacgucuuggggcggcucuuuaccugaugcucagaaguguacaugcggacuggaagguaauugcaucgacucgcaauacuauugcaacugcgacgcagguagaaaugaguggacuucagacacaaucgugcugagucagaaggaacaccugccugucacccaaaucgucaugacugacgcuggaagaccgcauuccgaagccgcuuacacucuuggacccuugcuaugcaggggcgaucagaguuuuuggaauucagccuccuuuaauacagagacgucuuaccugcauuucccggccuuccacggcgaacuuacggcugacgucugcuucuuuuuuaaaacgacuguuucaagcggcguauuuauggagaaucuggggaucacugauuuuauuagaaucgaacuccgcgcaccaaccgaaguaacauuuuccuuugaugucgguaauggcccaugcgaggugacggugcaauccccaacaccuuuuaacgacaaucaguggcaucauguccgggcggaacgcaauguuaaaggagcaagccuucagguugaccagcucccgcagaaaaugcagcccgccccggccgaugggcacguaagacuccaacugaauagccagcucuucaucgagaucagcgccuauuucgcuacaggcucauccaugacauaccauuuccaggagcacuacacgcuuagcgagaauuccucaagccucgucagcucacuccaucgugaugugacucuuacuagagaaaugauuacauugagcuucaggaccacccgaacccccucacuguugcuuuacgugucgagcuuuuacgaagaauauuuauccgucauauuggcaaauaacggaagccuccagauccgauacaaacuggaccgucaccagaauccugacgccuuuaccuucgauuucaaaaauauggccgacgggcagcuccaccaggugaagauaaaucgagaagaggccgucgucaugguggaagugaaccagaguaccaaaaaacaagugauccuguccagcggaacugaguuuaacgccgucaaaagccugauacugggaaagguccuggaggccgccggagcagaucccgauacacggcgggccgcuaccucagguuuuacagguugccuauccgcaguccgauucgggcgugccgcaccucuuaaggccgcccuacgaccaagcgguccgagcagaguuacugugagggggcauguagcaccuauggcucguugcgccgcaggugcugcuucaggauccccggcucgcgagcuggcuccaaggcuugccgguggagcgggacgcagugggccugccgacgaaggcgaaccacuugugaaugcugaucggcgcgacagugccgugauugggggagugaucgcuguuguaaucuucauuuuguuguguaucacagcuaucgcgaucagaauuuaccagcagaggaagcugcggaaggaaaacgaauccaaggugagcaaaaaagaggagugcuag

SEQ ID NO: 12521 - RNA, 2238 nt, Artificial Sequence
  Description of Artificial Sequence: Synthetic coding sequence
auggccuccguagccugggcuguauuaaaagugcucuugcuucuaccuacucagaccuggucaccuguaggcgcuggaaacccucccgacugcgaugccccgcucgcgucagcacugccgcggucaagcuuuagcuccagcucugaacucuccuccucccacggacccggauucucucgccugaaucgacgcgauggagcggguggcuggacuccccucguaucaaauaaauaccaaugguuacagaucgaccuaggagaaaggauggaggugacugcaguagcgacgcaggggggcuacggaaguagugauugggugaccagcuauuuacuuauguucagcgauggagggagaaauuggaagcaauaccgccgagaggaguccaucugggguuucccugggaacacaaacgccgacagcguggugcacuacagacugcaaccgcccuuugaggcuagauuccugagauuccugccuuuggcauggaaccccagaggucgaauugggaugcgaauugagguguauggaugugcauauaaaagcgagguugucuauuucgacggacaguccgcccuguuguauagacuugauaaaaagccccuuaagccgauccgggacgugaucucccugaaguucaaggcgaugcagucaaauggcauucuucugcauagggaagggcagcacgggaaucacaucacccucgaguugaucaaaggaaagcuuguauuuuuucugaauucugggaaugcuaaacuccccuccaccaucgccccagucacacuuacacuggguagucuucuggacgaccagcauuggcacuccguccugauugagcugcuggauacccaagucaauuuuaccguugacaaacacacccaucauuuucaggcaaagggagacucauccuaccuggaucugaauuuugagaucucuuuuggaggaauuccaacccccggacggagucgcgcuuuccgacgaaaauccuuucauggcugccuugagaaccuguauuacaacggagucgacgugacugagcuugcuaagaaacacaaaccucagauacugaugaugggcaauguuagcuucuccuguccacagccucagacagugccgguuaccuuucugucuucucguucuuaucucgcccuaccugggaauucaggugaggauaaaguuuccguuacguuucaguucagaacuuggaacagggcgggacaccuccucuucggugaauugagacggggcuccggguccuuugugcuuuuucucaaggacgggaaacuuaagcucucucuguuccaacccgggcaaagucccagaaacguaacagcuggcgccgggcugaaugauggucaguggcacuccguaagcuuuuccgccaaguggagccauaugaacgugguuguugacgacgauaccgcuguucagccacugguggcaguccugaucgacagcggggacacguacuacuuuggcggaugucuggacaacaguucuggcagcggguguaagagcccucucggcggguuccaggggugccuucgauugauuaccauaggcgacaaagccguugacccuauucuggugcagcaaggagcacuggguagcuuuagggaccuacagaucgauucaugcgggauuaccgaccgcugucucccuagcuacugugaacacggcggagaaugcucccaguccugggacacguucuccugugacugucugggcacaggcuauacuggggagacgugccauucuucacuguacgagcaaucuugcgaagcacauaagcaccgcgggaacccguccgggcuuuauuauaucgacgcggauggcucuggcccccugggcccuuuccuuguguacugcaauaugacugaugccgcauggacaguggugcaacacggcggucccgacgccguaacgcuccgaggagcacccuccggacacccgagauccgccguaucuuuugcuuacgcggccggggcugggcaacucagaucagccguuaaucucgccgaaagaugcgaacagagacuugcacuccguugcggcacagcgagacgucccgauuccagagacgguacuccacuuucaugguggguggggagaaccaacgagacucauaccagcuggggcgggucccuaccagaugcgcaaaagugcacauguggccuagagggcaauuguauugauagccaauacuacugcaauugugacgccgggcggaacgagugguag

SEQ ID NO: 12522 - RNA, 549 nt, Artificial Sequence
  Description of Artificial Sequence: Synthetic coding sequence
auggagccgcaacugggaccugaagcugcugcacuucgacccggcugguuagcccuucuccucugggugucagcccugucaugcucuuucucacugcccgcgagcaguuuaaguucucuuguaccucaagugcgcacauccuacaacuuuggcaggaccuuccucggacuggauaaauguaaugcuugcauuggcaccucaaucuguaaaaaauucuuuaaggaggaaauacgauccgacaacuggcuggccucccaucuaggccucccucccgacucccuucucucauaccccgccaauuauucugacgauuccaaaauuuggcguccuguggaaaucuucagacuugugagcaaguaccaaaaugaaauaagcgaucguagaauuugugccuccgcuuccgcacccaagaccugcuccauugaaaggguguugaggaaaaccgagcgauuucagaaauggcuccaggccaaaagacugacgccagauuuaguucaagacugucaccagggacaaagggaacucaaauuccugugcaugcucagguag

SEQ ID NO: 12523 - RNA, 282 nt, Artificial Sequence
  Description of Artificial Sequence: Synthetic coding sequence
auggauucauuacgcaaaaugcucauuagcguugccaugcugggcgcaggcgccggagucggcuacgcacuucuagugauugugacuccaggagaaaggaggaaacaggaaaugcuuaaggagaugccauugcaggacccaagaucuagagaggaggcagcucggacccagcagcuauuacuagcaacucuccaagaggccgccaccacacaagagaacguggccuggcgaaaaaauuggauggugggcggugagggaggcgcugguggucgaucgcccuag

SEQ ID NO: 12524 - RNA, 387 nt, Artificial Sequence
  Description of Artificial Sequence: Synthetic coding sequence
augggaaaaucugcuuccaaacaguuucacaacgaaguauuaaaagcacauaaugaauacagacagaaacacggugugccaccucuuaagcucugcaaaaaucuaaaucgcgaggcgcaacaauauagcgaagcacuggcguccacccgaauucucaaacacucccccgagagcagcaggggacagugcggagagaaucucgccugggcgucauacgaccaaacgggacauuucacugcuaugguguggaaaaauacgaagaaaauggggguuggcaaagcauccgccucugacggcagcuccuucguuguugcaagauauuuuccugccgguaacguggugaaugagggauuuuucgaggagaaugugcucccuccaaaaaaauag

SEQ ID NO: 12525 - RNA, 465 nt, Artificial Sequence
  Description of Artificial Sequence: Synthetic coding sequence
augggaaaaucagcaaguaagcaguuccacaaugaggugcugaaagcccacaaugaauaccgccaaaaacacggugucccuccccuaaagcuuuguaagaaccucaaucgcgaggcucagcaauacuccgaagcacucgcuucuacaaggauccuaaaacauucccccgaaucuucgcgcggacaguguggcgaaaaucuugcuugggccuccuaugaccaaacuggaaaggagguggcugauagaugguauuccgagaucaaaaauuauaacuuccaacagccaggguucaccuccggaacuggucacuucaccgccaugguuuggaagaauacaaaaaagauggguguuggcaaggcgucagccuccgauggcaguuccuuuguaguugccagguacuuuccugcugggaaugucguuaacgagggcuuuuuugaggagaacguccugcccccgaaaaaauag

SEQ ID NO: 12526 - RNA, 831 nt, Artificial Sequence
  Description of Artificial Sequence: Synthetic coding sequence
auggacagcucucgugagccaacacuuggacgacuugaugcagcaggcuucuggcaaguguggcagcgcuucgacgccgaugagaagggcuauaucgaagagaaagaacuggaugccuucuuucuccauaugcuuaugaaacucggcacugaugauaccguaaugaaggcaaaccugcacaaagugaagcaacaguucaugaccacccaggacgcuuccaaggacggacgaauaaggaugaaggagcuggcuggcauguuuuugagcgaagacgagaauuuucugcuucuuuuccgccgggaaaauccucuagauuccucuguagaguuuaugcagauuuggcgcaaauaugaugcugacagcucaggguucauauccgcugcagagcugcgcaacuuucuaagggaccuuuuucuucaucauaaaaaggcgauuucugaggcuaaauuagaggaauauacagggacgaugaugaagauuuuugaccggaacaaagacgguaggcucgaucugaaugauuuagcucggauucuggcuuuacaggagaacuuucugcugcaguucaaaauggacgcuugcuccacugaggagaggaaacgagauuuugagaagauuuuugcauauuacgacguuucaaaaacaggcgcucuugaagguccagagguggacggcuuugugaaagacaugauggagcucguucagccaucuauuuccggcgucgaucucgacaaguucagagagauauuacugcgccauugugaugucaacaaagaugguaagauucagaaguccgagcuugcacugugccucggccugaaaaucaaucccuag

SEQ ID NO: 12527 - RNA, 216 nt, Artificial Sequence
  Description of Artificial Sequence: Synthetic coding sequence
augcccgccggugugccaaugagcacauauuugaaaauguucgccgccagccuuuuagcaaugugcgcgggcgcagaagugguccacagauacuaccgcccagauuugaccauuccagaaauuccuccuaaacggggcgaacugaagacagagcugcugggccuaaaagaaagaaaacauaagccucaaguuucucagcaggaagaacugaaauag

SEQ ID NO: 12528 - RNA, 1287 nt, Artificial Sequence
  Description of Artificial Sequence: Synthetic coding sequence
augaagccgaugcucaaggauuucuccaaccuccugcugguagucuugugcgauuacguccugggagaagcggaauauuuauuguugagagaaccaggacaugucgcacucucgaaugauacagucuauguagauuuucaauacuuugauggcgcuaauggcacacugagaaaugucuccguguuacuuuuggaggcuaauacaaaccaaacugugaccacaaaauaucugcugacgaaccaaucucagggcacucugaaauucgaauguuuuuacuucaaggaagccggugacuacugguucacuaugacacccgaagccacagacaauagcaccccuuuccccuggugggagaaaucugcguuuuugaagguugaguggccagucuuucauguugaccugaauagaagugcaaaggcagccgagggaacguuucaagugggccuguucacuagccagccucuuugcccguuucccguggauaagccuaauauugugguggaugucaucuuuacgaauuccuuacccgaggcccgcagaaauucucgacaaccgcuggagauacguacaagcaaacgcaccgagcucgcacaggggcaguggguggaauucggcugcgccccacugggaccggaagcuuaugugacaguggugcugaagcugcugggucgcgacucugugauaacuucaaccggcccgaucgaucucgcucagaaguuugguuauaaacuuguuauggucccagaacuuacaugcgaaucagggguggaagucaccguccuccccccgcccuguaccuuuguccagggcguugugaccguuuuuaaagaagcaccgagauaccccggaaaaagaaccauccaccuggcagaaaacagccuacccuugggagagagacgaaccauuuuuaauuguacucuguuugauauggggaaaaauaaauacuguuuugacuucggcaucagcagccguagucacuuuagugccaaagaagaauguauguugauacagagaaauacagagacauggggcuuauggcagccuuggucucagugcagcgccacguguggcgauggugugcgagagcgaagacgggucugucuuacuucuuuccccucuagucccguguguccaggaaugagucuagaggccaguuugugcucucuugaggagugugcuggcagauucagaucgugcuguccuggauggucagcuauggugcgcagucgacucacgaacuccgccuccagggugcaagcuauucuucugccucagccucuggcuuag

SEQ ID NO: 12529 - RNA, 312 nt, Artificial Sequence
  Description of Artificial Sequence: Synthetic coding sequence
augaagcucuguguuacuguguugucguuacucgugcugguugcugccuuuuguucacuggcacucucugcgcccaugggcucugaccccccaaccgcgugcuguuucucuuauacugcucgcaaacucccccgaaauuucguuguggauuauuaugagaccucaucccuguguucgcagcccgccgugguguaccgagaauccgccucuuccgcugcccccgguagaauucccuccaccagggcggcuccccacggaccuuggucgggccgugggaggugucucccccaagcucgagauaaagcuagauag

SEQ ID NO: 12530 - RNA, 279 nt, Artificial Sequence
  Description of Artificial Sequence: Synthetic coding sequence
augaaacugugugucacuguucugucucugcugguucucguagcugcauuuuguucucuggcacugucagccccaauggggucagauccuccuacggcuugcugcuucuccuacacugcacgcaaacucccacgaaauuucgucguugauuauuaugaaaccucaagccucuguucacagccugccguccccugggauaguaaccuugguaagcaggucugcgcagauccuucugaaucauggguccaggaauauguguaugaucuugaacugaauuag

SEQ ID NO: 12531 - RNA, 282 nt, Artificial Sequence
  Description of Artificial Sequence: Synthetic coding sequence
augcaaguguccacagccgcucucgcaguucuucugugcacuauggcacuauguaaucagguccugucugcaccccuggcagccgacacuccuacagcaugcugcuuuuccuacacuucaaggcagauuccucagaacuuuaucgccgauuacuucgagacuucuucacaguguucaaaacccagugucauuuuucucaccaagagagggcgacagguuugugccgauccuucagaagaaugggugcagaaauacgugucagaucuggaacucagcgcauag

SEQ ID NO: 12532 - RNA, 1869 nt, Artificial Sequence
  Description of Artificial Sequence: Synthetic coding sequence
auggggaaaagcgaaggccccguagguaugguagaauccgccgggagagcaggccagaagaggcccggauuuuuagaggguggcuugcuucugcugcuucugcuggugaccgccgcucuugucgcccuggggguccucuacgcagaucgccggggaaagcagcugccgcggcucgcaucccgacuaugcuuucugcaggaggaacgaacauucgugaaacgcaaaccuagaggcauuccagaagcacaggaaguaucagagguguguacaacuccugggugcgucaucgcugcagcccggauccugcagaacauggacccaacaacugagcccugcgacgauuucuaccaguucgcgugugggggcuggcugcgccggcauguuaucccggaaacaaauagccgcuacagcauuuuugauguuuuaagagaugaacuggaggucauucucaagguugagcucgaaacacagcuugccaaagcaacaguaccucaagaggagagacaugaugucauugcacuuuaucacagaaugggcuuggaggaacugcagucccaguuuggacucaagggauuuaauuggacacuguucauucagacugugcugaguucuguuaaaauuaagcugcugcccgacgaagaagugguuguauacggaauuccauaccugcaaaaccuagagaauaucaucgacacuuauucugccagaacaauccaaaacuaucuuguguggaggcugguguuggauagaauuggcucccugucccagcgauucaaggauaccagagugaauuacaggaaagcccucuucggcacgaugguggaggagguuagauggcgggagugcgugggcuacgucaauuccaauauggaaaaugcugugggcucccuuuacguuagggaagccuuccccggagauaguaaauccaugguucgggagcucaucgacaaggugcgcacuguauucguugagacguuggaugagcucggauggauggacgaagaaucuaagaagaaggcacaggagaaggcaauguccauuagagagcagaucggacauccagauuauauuuuagaggagaugaaccgacgccuggacgaagaguacaguaauuugaacuuuucugaagauuuauacuuugagaauagucugcagaaccugaaagucggugcucagaggucgcugaggaagcugcgcgagaaaguugauccaaaucuguggauaaucggugcagcugucgucaacgcuuuuuacucacccaacaggaaucagauuguguucccugcaggaauacuccaaccgccauucuuuucuaaggagcagccccaagcccucaacuucggcgggauugguauggucauuggccaugagauuacgcacgguuucgacgacaacgggaggaauuucgacaaaaaugguaauaugauggacugguggucuaauuucucgacucagcauuucagggagcaguccgagugcaugaucuaucaauauggcaacuauucaugggaucuggcagaugagcagaacgucaacgguuuuaacacgcucggcgaaaacaucgcugauaacgggggcguccggcaggccuacaaagccuaucuaaaguggauggccgagggugggaaagaccaacaguuaccaggacuggaucugacccaugaacaacucuuuuucauuaacuacgcccaggucuggugcggcagcuaucgacccgaguuugcuauacaguccauuaagacugauguccacucuccccugaaguaccgcguucuggggucccuucagaaccuugcagccuuugcugacacuuuccacugugcgagaggcaccccgaugcauccuaaagaaagaugucggguuugguag

SEQ ID NO: 12533 - RNA, 2340 nt, Artificial Sequence
  Description of Artificial Sequence: Synthetic coding sequence
augggaaaguccgaaggacccguggguauggucgagagcgcaggacgcgcuggacagaaaagaccuggauucuuggagggaggucugcuccucuugcuccuacuggugacagccgcccuuguggcccucggaguguuauacgccgacaggcgggguaaacaacucccaagacuugcuagccgucuuugcuuccuccaggaagagaggacuuucguuaaacgcaagccgaggggcauuccagaggcccaagaaguaucggaagugugcaccacucccgggugugugaucgccgcagcacguauacuucagaacauggaccccacaacagagcccugugacgauuuuuaccaguuugccuguggaggauggcugcggcgccacgugauuccugagacaaauagccgcuacucaaucuuugacgugcugcgggacgagcucgaggugauucugaaagcaguacuggaaaacucuaccgcaaaagaucgccccgccguggaaaaggcgcguacucuguauaggaguuguaugaaccagagcgucauugagaaacgcggaagccagcccuuacuagauauucuggaagugguuggaggauggcccguggccauggacagauggaacgaaaccguggggcuggagugggaacuggaaaggcagcuagcgcucaugaauucacaauucaaccgccgagugcucaucgaccuguucauuuggaaugacgaucaaaacagcucacggcacaucauuuacaucgaucagccgacgcugggcaugccaucucgugaauauuacuuuaauggcggaucaaaucgaaaagugagggaggcauaccuccaguucauggugaguguugccacacuucucagagaggaugccaacuuacccagagacagcugccugguccaagaggacaugguacaaguccuggagcucgagacacagcucgcuaaggccaccgucccucaggaagaacggcacgacgucauugcucucuaucaccgcauggggcuugaagaacugcagucccaauuuggacucaaggguuucaacuggacacuguuuauccagaccguccucuccuccguuaagauaaaguuguugccggacgaagaaguggugguuuacgggauaccguauuuacagaaucuggaaaauauaaucgauaccuauucagcuagaaccauccaaaauuauuugguuuggaggcuagugcucgauagaaucgggucgcuuucacagagauucaaggacacacgggugaacuaccgcaaagcccuguuugguacaaugguggaagagguucgcuggcgagaaugcguuggauaugugaacucaaauauggagaaugcagucggcucccuuuacguccgcgaagcauucccuggugacaguaagagcaugguacgagagcuaauagacaaggugcggacgguauucguggagacacuggaugaauugggcuggauggacgaggagucuaagaaaaaggcacaggagaaggcaaugagcauccgggaacagaucggccaccccgauuacauccuggaggaaaugaaccguaggcuggacgaggaguauucuaaucugaauuuuagcgaggaucuguacuuugagaauagccugcagaaucucaaggugggggcacaacgcagcuugagaaaauuaagggaaaaagucgacccgaauuuauggauuaucggagcugcugucgugaacgccuuuuauuccccaaaucgcaaccagauugucuuucccgcggguauuuugcaacccccuuuuuuuucuaaagagcagccucaggcacugaauuuuggaggcaucgguauggucauuggacacgagaucacccacgguuuugacgacaacggcagaaacuucgauaaaaacggaaacaugauggacugguggucuaauuuuucuacccagcacuuccgugagcaaagcgagugcaugauuuaucaguacgguaacuacucuugggaucuggccgacgagcagaacgugaacggauuuaauacacugggagaaaacaucgccgacaacggcgggguucgacaagcguauaaggcuuauuugaaguggauggcagagggaggaaaagaucagcaguuacccggccuggaccuaacccaugaacagcuauuuuuuauuaauuaugcucaaguguggugcggcuccuaucguccagaauuugccauucagagcauaaagacagacgugcacucuccacuuaaguauagaguacuugguucccuucagaaccucgcugcauuugcugauacauuucauugugcccgggggacuccaaugcacccaaaggagcgaugcagggugugguag

SEQ ID NO: 12534 - RNA, 258 nt, Artificial Sequence
  Description of Artificial Sequence: Synthetic coding sequence
augucuguucacaugcccgccaugaagaucugcgagaaacugaaaaaacuggauagccaaaucugcgagcugaaguaugagaagacacuggaccuggcguccgucgaccugaggaagaugcgugucgcagaauuaaaacaaauucuucacucuuggggagaggagugcagagccugugcagaaaaaaccgacuauguaaaccucauacaagagcuagcucccaaguacgccgccacacauccuaagaccgaguuauag

SEQ ID NO: 12535 - RNA, 657 nt, Artificial Sequence
  Description of Artificial Sequence: Synthetic coding sequence
augggaagaguguuucugaccggcgagaaagccaauaguauccugaagagguacccaagagccaacggguuuuuugaagaaauucgacagggcaauaucgaacgggaauguaaagaggaguucugcacuuucgaggaagcaagggaggcauucgagaauaaugagaagacgaaagaauucuggucaacauacaccaaagcccaacagggcgaaucaaauagaggaagcgacugguuucaguucuaucucacuuucccgcuuauuuucggccuauuuaucauccuucuugugaucuuucuaaucuggcgaugcuuccuccgaaacaaaacuaggagacagaccgugacagaaggacauauccccuucccgcagcaccugaacauuauaacuccuccacccccaccugacgaaguauucgacaguucaggccugagcccuggcuucuuaggcuaugucguaggccgguccgauuccguaaguacccggcugaguaacugcgacccacccccaaccuaugaggaggcuacuggacagguaaaccuccagaggagugagacggagccacacuuagaccccccuccugaauaugaagacauaguuaacuccaauuccgccucagcaauuccuauggucccaguugugacaacaaucaaauag

SEQ ID NO: 12536 - RNA, 1365 nt, Artificial Sequence
  Description of Artificial Sequence: Synthetic coding sequence
auggccagaccaaauaaauuccuccuuugguucuguugcuucgcauggcucuguuuccccaucuccuuaggcucccaggcaucagggggugaggcacaaauugcugcaagugcagagcuggaaaguggcgccaugccauggucucugcugcaacacaucgaugagagggaccgcgccggucuccuccccgcuuuguucaaagugcugucagugggcaggggcggcucucccaggcugcagcccgauucccgggcucugcacuauaugaaaaagcuauacaaaacauacgccaccaaagaagguauaccuaagucaaauaggucucacuuguacaacacggugcgucuguucaccccuugcacgcggcauaaacaggccccaggggaucaggugaccggaauauuaccuuccguggaacuucuuuucaaccuggauaggaucacaaccgucgagcaccuccucaaaucuguguuauuguauaacaucaauaauuccguguccuucagcuccgcggucaagugcguguguaaccugaugauuaaagagccuaagucuuccucucgcacucugggacgugcccccuauaguuuuacuuuuaacagucaauuugaguucgguaaaaagcacaaguggauucaaaucgacguuacuagucuacuucaaccccucgucgcgucuaauaagaggucaauccacauguccauaaauuucacuugcaugaaagaccaauuggaacauccuuccgcacaaaacggccuguucaacaugacucucguaagccccucauugauacucuacuugaaugacaccucagcccaagcauaucauaguugguacucucuccacuacaagcggagaccuagccaaggcccagaccaagaaaggagcuugucggcauacccuguuggugaagaggcagccgaagacgguagaaguucucaucacaggcacaggcgaggccaggaaacaguguccagcgagcugaaaaagccacugggucccgcgaguuuuaaccucagugaguacuuccgucaguuccuccuuccccagaacgagugugaacuccacgacuuccgucucuccuucagucagcucaagugggacaauuggauuguggcaccacauagguauaaucccagauacugcaagggcgacuguccucgcgcagugggacaccgguacggcaguccugugcacaccauggugcaaaauauuaucuacgaaaagcuggacucgagugugccucgcccaagcuguguaccugccaaguacucuccauuaucuguucuuacgauagaaccagauggcucuauugcuuauaaagaauaugaggauaugauugcaaccaaaugcaccugcagguag

SEQ ID NO: 12537 - RNA, 417 nt, Artificial Sequence
  Description of Artificial Sequence: Synthetic coding sequence
augacuuggcgccaagccguucugcugucgugcuucuccgcagucguauuacugucaauguugagggaagguacuuccguguccgugggaaccaugcagauggcaggcgaggaggccuccgaggacgccaaacagaagauuuucaugcaggaaucagacgccagcaauuuccucaaaagaagagguaaacgguccccaaagucaagagaugaagugaacguggaaaaucgacaaaaacugcgaguggacgagcuacgaagagaauauuacgaggagcagcggaacgaguucgaaaauuucgucgaggaacagaacgaugagcaggaggagagaucacgugaggcagucgagcaguggagacaguggcauuaugauggguugcacccaagcuacuuauauaacagacaucauacguag

SEQ ID NO: 12538 - RNA, 729 nt, Artificial Sequence
  Description of Artificial Sequence: Synthetic coding sequence
auggcuuuaaagaacaaguucucaugcuuguggauccugggguugugucuggucgcuaccacuucauccaagaucccuucaaucacggacccucauuucaucgacaauuguauagaggcucacaacgaauggaggggaaaggucaauccacccgccgccgacaugaaguauaugauuugggauaagggacuggcgaagauggcaaaagcaugggccaaccaguguaaguuugagcauaaugacugccucgacaaaaguuacaaaugcuacgcugcauucgaauaugugggcgagaauauuugguugggagguaucaaauccuucacgccacgccacgcaaucacagcuugguauaaugagacccaguuuuaugacuuugacucacucuccugcucaagaguauguggacacuauacgcagcuggucugggcuaauuccuucuacgugggaugcgcaguggccaugugcccaaaccuuggcggagccucaacugcuauuuucgucuguaauuauggaccagccgguaauuucgcaaacaugccuccuuaugugagaggagagucuuguucacucuguuccaaggaagaaaagugcgucaaaaauuuguguaggacuccccagcugauuauuccaaaccaaaaccccuuuuuaaagccuacuggucgcgccccgcaacaaaccgccuuuaacccauuuagccuaggcuuuuuacugcugaggauuuuuuag

SEQ ID NO: 12539 - RNA, 813 nt, Artificial Sequence
  Description of Artificial Sequence: Synthetic coding sequence
auguuaaggcagcuccucuuagccgcucucugucucgccgggccuccugcuccugcucgagcuugucaacugcccucagaguggcgcccccugagcgagggaugccgcgcugagcuugccgaaaccauuguguacgcacguguucucgcgcugcaccccgaggcucccggccuguacaaccacuuacccuggcaguaccaugccggucaaggcggauuguuuuacucugccgaagucgaaaugcuaugugaucaggcuugggguucaaugcucgaaguuccugcuggguccagacugaaucuuacgggucugggguauuucucaugccauucccauacaguggugcaggauuauaguuacuuuuuuuuccucagaauggacgaaaauuacaaccuccucccucauggcgucaauuuccaagacgcgaucuuuccagacacccaggaaaaccggcguauguucagcucucuguuccaguucuccaauuguucgcaaggucaacaacucgccacauucucuucugacugggagauucaggaagauucuaggcuuauguguucaucuguccaaaaggcccucuucgaggaggaggaucacguuaagaagcuccagcaaaaaguggccacacuggaaaagcgcaaccggcagcugcgagaaagggugaagaaagucaaacgcagccugaggcaggcaagaaagaagggcaggcaucuagaacuugccaaucagaagcugucugagaaacucgccgcgggagcccugccccauauuaacgcccgggggccagugagaccaccauaccuccgaggguag

SEQ ID NO: 12540 - RNA, 438 nt, Artificial Sequence
  Description of Artificial Sequence: Synthetic coding sequence
auggaugaaaacuacaaccugcucccacacggcgugaauuuccaggacgcaauuuuucccgauacucaggaaaacaggagaauguuuuccuccuuguuccaguucucaaacuguucccaaggacagcaguuagccacguucucaucggacugggagauacaggaagauucacgccugauguguucauccguccagaaggcauuguuugaagaggaggaucaugugaagaaauuacaacagaaggucgccacacuugagaaacggaaucgccaguuaagagaaagagucaaaaaaguuaaaagaucacugcgucaggcccgaaagaaaggucgacaccucgagcuugcgaaccaaaaguuguccgaaaaacuggcggcuggugcauugccucacaucaaugcgaggggccccguuagacccccauauuuaagaggguag

SEQ ID NO: 12541 - RNA, 1830 nt, Artificial Sequence
  Description of Artificial Sequence: Synthetic coding sequence
auggaacuggguugcuggacccagcugggccugaccuuucuccagcuguuauugauuucuagcuugccacgcgaguauacuguuauaaaugaggcaugccccggugccgaauggaacauuauguguagagaauguugugaguaugaucagauugagugcguguguccugggaaacgcgaaguagugggauauacaauuccuugcugucgaaacgaagaaaaugagugcgacagcugccuaauccacccaggcuguacuauuuuugaaaacugcaaaucuugucggaauggguccuggggaggaacccuggaugacuuuuacgugaagggauucuauugcgcggagugccgagccggcugguacggaggcgacugcaugccaugcaguucuucaccguguuuccacgacggcacauguguucuggauaaagcaggaucuuacaagugcgcuugucucgccgguuauaccggucaaagaugcgagaaccuccucgaggagaggaacuguuccgauccugggggccccgucaacgguuaccagaaaaucaccggcggacccgggcugauaaauggccgccaugcuaagauagggaccguugugucguucuuuugcaacaauucuuacgucuuauccgggaaugagaaacgcacuugccaacagaacggugaguggucagguaagcagccaaucugcaucaaggcaugccgcgagcccaagaucagugaucuggugcgccgaaggguccucccuaugcaggugcagucaagggagacacccuugcaucaacuguacagugcugcauuuagcaagcagaagcugcaguccgcaccaacuaagaaaccagcacugcccuuuggagauuuacccaugggguaccagcaccugcacacucaacuacaauacgaauguaucagccccuucuacagacgacuaggcagcagccggcgcacaugccugaggaccggcaaguggagcggucgagcccccagcuguaucccaauauguggcaaaauagaaaacaucacagccccuaaaacacaaggccuuagguggccauggcaggcggccaucuaccgacgcaccucgggagugcaugaugggucacugcauaagggugcgugguuucuuguuuguuccggugcauuggucaacgaacgcacagucguggucgcagcucacugcgugacagauuuaggcaaggucacuaugauuaagaccgccgaucuuaaaguuguacucgggaaguucuaucgcgaugaugaucgagaugaaaagacaauacaaucccuccaaaucagcgccaucaucuuacacccuaauuacgaucccauccugcuugaugccgacauugcuauccugaaacugcuggauaaggcaagaaucucaacucgcguucagcccauuugccuggccgccucuagagaccucucgacaucuuuucaagagagccacaucaccgucgcaggguggaacgugcuggcugacguacggaguccaggauuuaaaaacgauacacugcgcucugguguugucucugugguugacagccuccugugcgaggaacagcacgaggaucaugguauacccgugagugugacugacaacauguuuugcgccucaugggagccaaccgccccgagcgauauuuguacugccgagacagggggcaucgcugccguaaguuuucccggucgggccucucccgagccaagguggcacuugauggggcuaguuucauggaguuaugauaaaaccuguucccauaggcugagcacugcuuuuaccaaaguacugcccuuuaaagauuggaucgagaggaacaugaaguag

SEQ ID NO: 12542 - RNA, 2163 nt, Artificial Sequence
  Description of Artificial Sequence: Synthetic coding sequence
auggagcugggaugcuggacucagcuuggucugaccuuccugcagcuccugcugaucucaucccugccccgugaauacaccgugauuaacgaggcgugcccuggggcggaauggaauauuaugugccgugaguguugcgaguacgaccaaauugaguguguauguccaggaaagcgugaaguggugggauauaccauuccuugcugccguaacgaagagaacgagugcgauagcugccuaauccaucccggguguaccauauucgagaacuguaaaucuugccgaaauggauccuggggcggaacucuagacgacuuuuaugugaaaggauucuacugcgccgagugucgugcgggcugguaugggggcgacuguaugcgaugcggccaaguguugagagcaccuaagggucagauacuacuggagagcuauccgcuuaaugcacauugugaguggacuauccaugcaaaaccaggauuugugauucagcuccgcuucguaaugcugucauuggaguuugauuauaugugucaguaugacuauguugaaguaagggauggggauaaucgggacggucagaucauuaagaggguaugugguaaugagcgcccagcaccuauccaaagcauuggaucuucucuccacgugcuguuucacagugauggcagcaaaaacuuugauggguuucacgcuauauaugaggaaauuacagcuugcaguuccuccccguguuuccacgauggcacaugugugcuggauaaagccgggagcuacaaaugcgcaugucuagccggcuacacaggccagcggugcgaaaacuuauuggaggaacgcaauuguuccgacccgggaggcccagugaauggcuaucagaagauuacaggaggcccaggacuaauuaacggaagacacgcuaaaaucgggaccgugguaagcuuuuucugcaacaauaguuacguucugucaggaaacgagaagcgaaccugccaacagaacggggaguggucuggaaagcagccuauuuguaucaaggcuugcagagaacccaagaucuccgaucuggugcgaagacgggugcugccuaugcagguccagucaagagagaccccgcugcaccagcuguauucagccgcauuuuccaaacagaagcuccagucugcaccuacuaaaaaaccagcccuuccauuuggcgacuugccuaugggauaucagcaucugcacacacagcuacaguaugaauguaucucaccuuucuaucgaaggcugggaaguagucgaagaacaugucugcgcacugguaaguggaguggucgggcgccgucaugcauuccuaucuguggaaagauugaaaacaucaccgcacccaagacacagggucuuagguggccauggcaggccgcaauuuacagaaggacaaguggcguacaugaugggagucugcacaaaggcgcuugguucuuggugugcucgggcgcucugguuaaugaaaggaccgugguggucgccgcgcauugcgugacugaccucggcaaggugacuaugauuaaaaccgcugaucugaaaguaguuuuggguaaguuuuacagggacgacgaucgugacgagaaaacuauucagucuuugcagauuucugccauuauauugcacccaaauuacgacccuauccuccuugacgcagauaucgcaauucugaagcuauuggacaaggcaagaauaagcacccgugugcagcccaucugcuuggcagcuagucgggaccugaguaccuccuuccaggaaucucacauuaccguggccggcuggaaugugcuagccgacgugaggagcccagguuuuaagaaugacacacuaaggucaggcguuguguccgucguggacucccuccugugcgaggaacagcacgaagaucacggcauaccugucagcguaacagauaacauguucugcgcuucuugggagccuaccgccccaucagacauauguacagccgagacaggugggauugcugccguaucauuccccggacgagcaucaccggaacccagauggcaucugauggguuugguaucuuggagcuacgacaaaaccuguagccaccgacucuccacagcauuuacgaaagugcuucccuucaaggacuggaucgagagaaacaugaaauag

SEQ ID NO: 12543 - RNA, 1134 nt, Artificial Sequence
  Description of Artificial Sequence: Synthetic coding sequence
auggaggccuuacugcugggcgcuggcuugcuccugggugcuuacgugcucgucuacuacaaucuuguuaaagcgccaccuugcgggggaauggggaaucuaaggggucgaacggccguggugacaggugccaauucugggaucgguaaaaugaccgcccuugagcuugcccgcagaggagcuaggguaguccuugccugucggucacaagagcguggagaagccgcggcuuucgacuugcggcaagagagcgggaauaaugaggugaucuuuauggcccucgaccucgccucacucgccucggugagagccuucgcuacugccuuccugagcuccgagccgcgucucgauauauugauccauaacgccggcauuuccuccugcggucggacaagagaggccuucaaucuacuacugagaguaaaucacauagggccuuuucuucuaacucaccugcuucuuccuugccugaaggcaugugccccaucccgggugguugucguggccagugcagcccacuguagagggcgccuggacuuuaagagacucgacaggccuguagugggauggcgacaggaacuccgcgcauacgccgauaccaagcuugccaacguacuauuugcuagagagcuugccaaccaacuugaggcuacgggcgucaccugcuaugccgcacacccaggccccguuaauucagaacuguucuugcgacauguuccaggguggcuuagaccccuucugcggccuuuagccuggcucgugcuucgggcaccucgggguggugcucagacgccauuauacugugcuuugcaggagggaaucgaaccacuuucaggucgcuacuuugccaauugucacguggaggaagugcccccggcagcccgggaugauagggccgcucaccgccucugggaggccagcaagcggcuggccggacucggucccggcgaagacgccgagccggacgaagauccacagucugaagacagcgaggcacccagcucccuguccacgccccaucccgaggaacccacugugagucagccauacccaagcccacagaguuccccugaucuuaguaagaugacccaccgcauccaagccaagguugaacccgagauucaacugucuuag

SEQ ID NO: 12544 - RNA, 381 nt, Artificial Sequence
  Description of Artificial Sequence: Synthetic coding sequence
augauuucauuucacgucauuuuucugucccuggggcguggaaagcucuuccucccaguaaacuuuuguuuucucaagcugaaaaacucucaaguccgaauuccaaaggacuuuacaugcaaucugcacgugcucuuccggacgguccaaggugaggaucggaauaccauguucagaggccacuggucuaucuacagucgaaauuucccccucgcagucguaccugcuuaugucacagaagacggaaagaacaccucgcauagagccuccggccaguuuugcaacgcacugucucagggcgaaauuccaaguuccuuacagcugguaaauaguuacgcuuuggagcccaggaccgauaugccauguaauuuccucacauag

SEQ ID NO: 12545 - RNA, 876 nt, Artificial Sequence
  Description of Artificial Sequence: Synthetic coding sequence
auggcaguuacacugagccugcugcucggggggcgugucugcgccgcagugacuaggugcggguucgccacgaggggcguagccggcccuggccccaucggccgagaaccugaccccgauucugauugggagccagaggagcgcgaauugcaagagguggaaucuacccugaaacgccagaaacaggccauuagauuucagaaaauacgcagacagauggaggcaccgggugccccaccccggacccucaccugggaggcuauggaacagauccgcuaucugcacgaggaguucccagagucuuggucugugccgaggcuggcugaaggcuuugacgugagcaccgacgugauucgccgcgugcuaaaaagcaaauuucuuccgacacuugaacagaaguugaaacaagaucagaaggugcugaagaaggcugggcuggcacauucacuccaacaccuucggggaagcggaaacacuagcaagcugcucccagcaggacauuccguuucaggcucccuccucaugcccggacacgaagcaucauccaaagauccuaaccacucuacagcccugaaggucaucgaauccgacacacaccguaccaauacgccuagaaggagaaaaggucgaaacaaagagauccaggaucuggaagaaaguuuuguuccaguugccgcgccucuagggcauccaagagaguuacaaaaguacagcucugauagugagucaccccgagggaccggaucuggagcccuaccaucagggcaaaaacuagaggaacugaaggcagaagagccagauaauuucagcaguaagguggugcaacgugggagagaauucuucgauuccaauggcaauuuucuguaccgaaucuag

SEQ ID NO: 12546 - RNA, 2541 nt, Artificial Sequence
  Description of Artificial Sequence: Synthetic coding sequence
auguucaagugcugguccgugguccuggugcuuggauucauuuuuuuggaauccgaagggagacccacgaaggagggcggauacggacugaaauccuaucagccacuuaugcgccuacggcacaaggagaaaaaccaggagucaucacgcgugaaaggguucaugauccaggaugggccuuuugggucaugugagaacaaguauugcggucugggaagacauugcgugaccuccagagaaaccggccaggcagaaugugcauguauggacuuauguaagcggcacuauaaaccaguuuguggaucagauggcgaguucuacgagaaccacugcgagguucaucgugccgcgugccuuaaaaagcaaaaaaucaccaucgugcacaacgaggacuguuucuucaagggcgacaaguguaagacaacagaauauaguaagaugaagaauauguuguuagaccuucaaaaccaaaaguauauuaugcaagaaaacgaaaaucccaacggcgacgauauuaguaggaagaagcuuuuggucgaucagauguuuaaguacuuugacgcagacaguaauggguugguggacaucaaugagcugacacaggugaucaagcaggaggagcuggguaaagaccuuuuugauugcacucuguaugugcuccuuaaauaugaugauuuuaaugccgacaagcaucuagcucucgaggaauuuuaccgggcuuuucagguuauacagcuuucucugccagaagaucagaaacugucaauuacugcagcuacugucggacagagcgcuguucugucuugcgcuauacaaggaacucuaagaccuccuaucaucuggaaacguaauaauauaauuuugaauaaucucgaccuugaagauauuaacgacuuuggagacgauggcagucucuacauuaccaaagugaccacgacacacguugguaacuauacuugcuaugcugacggcuaugagcagguauaucagacucacauuuuccaggugaacguaccucccgugauccgcgucuacccagaaagucaggcccgcgagccgggugucacagccagcuuacgcugccaugcugagggaauuccaaaaccacagcugggcugguugaagaauggcaucgacaucacaccuaagcucagcaaacagcucacuuugcaagccaacgggagcgaggugcauaucucuaaugucagauaugaggauaccggagccuacaccugcaucgcuaaaaaugaagcuggcguugacgaggacaucucuucauuauucgucgaggauuccgcgagaaagacacuggcgaacauucuuuggcgcgaggagggccucggcaucggaaauauguuuuaugucuuuuaugaggauggcaucaaagugauucagccuauugagugcgaguuucagagacauauuaaaccuucugaaaaacugcuugguuuucaggacgaagucugcccuaaagcggagggcgacgaggugcagagaugcgugugggccucugccgucaacguuaaagauaaguucauuuacguggcccagccaacacuggaccgugugcugaucguggacgugcagagccagaaggucgugcaggccgugagcaccgacccgguccccgugaagcuucauuacgauaaaucacacgaccaagucuggguucugucuugggggacauuagagaaaacuucacccacccuccaggucaucacccuggccucugggaacgugccacaccauacgauucauacacagccuguggggaagcaguuugaucggguggacgauuucuuuauaccaaccacuacccucauuauuacucacaugagauuuggguucauacugcauaaggaugaggccgcucugcagaagaucgaucuggaaaccaugucauacauuaagaccauuaaccuuaaagauuacaagugcguuccccagucacuggcguauacucaucuaggggguuacuauuucaucgguugcaagccagacucaacaggggcaguaucaccucaaguaauggucgaugggguuacagauucagugauugguuuuaauagcgacgugaccgggacgccauauguaucuccugacggacacuaccugguaagcaucaaugaugucaaagggcuugucagagugcaauauauuacuauaagaggcgagauacaggaagcauucgauauuuacacgaacuuacacauuucggaccucgcauuucagccaaguuucacugaagcucaccaauauaauaucuaugggucaagcaguacacagacagauguguuauucgucgagcucuccucuggcaaggugaaaaugaucaagucccugaaggagccucucaaagcugaggaauggccauggaacagaaagaaccgucaaauccaggauucaggcuuauucgggcaguacuugaugacaccuucaaaggacucucucuucauuuuggacgggcggcugaacaaacugaacugugagauaacagaaguggagaaaggaaauacgguaaucuggguuggagaugcauag

SEQ ID NO: 12547 - RNA, 291 nt, Artificial Sequence
  Description of Artificial Sequence: Synthetic coding sequence
augagagucacuucugccaccugcgccuuacugcuggccuugaucuguucugugcaauuaggcgaugcaugucucgauaucgauaagcuccuggcuaaugugguauuugacgugucucaggaucugcugaaagaggaauuagcccgcuauaaccccaguccucucacagaagaguccuuucugaauguucaacaaugcuuugcuaacgugucugugaccgagagauucgcacauuccguggugaucaaaaagauccuucagucgaaugacuguauugaggcugccuucuag

SEQ ID NO: 12548 - RNA, 1971 nt, Artificial Sequence
  Description of Artificial Sequence: Synthetic coding sequence
augagaacugucgugcugacuaugaaagccucugugauugaaauguuccucgugcuccuuguaaccggaguacacuccaacaaagaaacugccaagaaaauaaagcgaccuaaauuuacagugccacagaucaauugcgauguaaaagccggcaagaucauugaucccgaguuuauugugaaaugucccgcagguugccaggacccaaaauaccacguguauggcacggacguguacgcaucuuauagcucgguguguggagcagcaguccauuccggugugcuggacaauucuggggggaagaucuuaguccggaaagucgccggccagucuggcuauaaggguucauauucaaauggaguccagagucugucacucccgcgcuggagggagagcuuuauuguucuugaguccaaacccaaaaagggcguaacuuauccaucugcccucacguauuccucgaguaaguccccugcagcccaagcuggugaaaccacaaaggccuaccaaagaccuccaauucccggaacaaccgcucaacccguuacacugaugcagcuccuugccgucaccguugccguggcaacuccuacuacucuccccagaccaucuccuucggccgcgagcacuacuucgaucccccgcccucaaucggucggccaccggucccaagagauggaucuguggucuacugccacuuauacuaguucccagaaccgcccacgagcggaccccggacucgugcccaaggaggaacuuuccacccaaagucuggagccagugagccugggagaccccaauugcaagauugacuugucguuucucauugauggauccacuucgaucgguaaacggagauuccgaauccagaagcaacugcuggcagauguggcccaagcgcucgauaucgguccagccggcccccuaaugggcgugguucaguauggcgacaacccagccacccacuuuaaccugaaaacccauacuaauucacgugauuugaaaacagcuaucgaaaagauaacccagcgggggggccugagcaacguggggcgcgcaauuuccuuuguuacuaagaacuucuuuucaaaagccaacggcaaucgcuccggagcaccgaaugugguuguuguuaugguugauggauggccaaccgacaaaguggaggaggccagcaggcuugcuagagaaucaggaauaaauauuuuuuuuaucacgauagagggagcggcggagaaugaaaagcaauacgucguggaaccgaacuucgcuaauaaagcugucuguagaacaaauggguuuuacucccugcacguucagucaugguucggauuacacaaaacucugcaacccuuggucaaaagaguuugcgacacagaucggcucgcuuguucaaaaacaugccuuaacucagccgacaucggcuuugucaucgaugggucaucaucagucggcacggguaacuuccguaccguccuucaguucgugaccaacuugaccaaagaguuugaaaucucggauacggauacccgaaucggggcugugcaauacaccuacgaacaaagauuggaguuugguuucgacaaauauucgucuaagccagauaucuuaaacgccaucaagagagugggauacuggagcggcggaacaucaacuggggccgcaauaaacuuugcccuugagcagcucuuuaagaaaucgaagccuaacaagagaaaguugaugauucugauaacagacgggcguucuuacgacgaugugaggauucccgccauggccgcacaucucaagggcgugauuaccuacgccaucggaguugcgugggccgcucaggaagagcuugaagucauagcuacacacccggcucgugaccauagcuuuuucguugacgaguuugauaaccugcaccaguacgugccaagaaucauccagaacaucuguaccgaauuuaacucacagccacguaauuag

SEQ ID NO: 12549 - RNA, 2082 nt, Artificial Sequence
  Description of Artificial Sequence: Synthetic coding sequence
augaggaccgucguccugacuaugaaagcaagcgugauagaaauguuucugguccuccuugugacuggagugcauagcaauaaagaaacagcaaaaaagauuaagcgaccaaaguuuaccgugccucagaucaacugcgacguuaaagcaggcaagaucauugacccagaauucauuguuaagugucccgcgggcugucaggacccuaaauaucaugucuacgggacagacguguacgcuagcuauucaucugugugcggugcugcagugcacaguggaguucuggauaacucaggagguaagauccuggugcggaaggucgcaggacaguccggauacaaagguaguuacaguaacggagugcagaguuugucacucccgagguggagagaaaguuucaucgugcucgaauccaagcccaaaaagggugugacauacccuucugcccugaccuauagcagcuccaagucaccagccgcacaagcuggggagacuacuaaagcuuaccaaaggccacccauuccaggcacaacugcucagcccguaacucugaugcagcugcuagcagugacagucgcuguggcuacuccaacaacucucccgcgacccucuccuagcgccgcuucaaccacgucaauaccucgaccgcagucagugggucacagaucccaggaaauggaccuuuggagcacugcaaccuauacuucaagccagaaucggccucgggccgauccagguauacagaggcaggauccuagcggugccgccuuucagaaaccuguuggugccgaugugaguuugggggagauggauagcuggaagccuggcagcgucuuacuggaugaggggcuugugccuaaagaggaacucucuacccaaagccuugagcccgugucacucggugauccuaauuguaaaaucgaucuaaguuuccugaucgacgguaguacuagcauugguaaaagacgguucagaauccagaaacaacugcucgcagacguggcccaggcucuagacauuggcccagcuggaccauugaugggggucguccaauacggcgacaauccugcaacucacuuuaaucucaaaacgcauacaaacucacgagacuugaagacagccauugagaagaucacacaacgcggcggacuguccaaugucggucgggccaucuccuucguaacaaaaaacuuuuuuucuaaagccaauggaaaccgaaguggugcaccuaaugucgucguugucauggucgauggcuggcccaccgauaagguagaggaggcuucacgcuuggcucgggaauccgggaucaauaucuucuucauaacuaucgaaggagccgccgaaaacgaaaagcaguaugugguggaacccaacuuugcuaacaaagccgugugccgcacuaacggguucuacucacuccacgugcagagcugguucgggcuccauaagacacugcaaccucuggugaagagggugugcgacacagaucgguuggcuuguucaaagacgugucugaacucugcggacauuggauuugugaucgacggcucaucaagcgugggcaccggcaacuuucgcaccguccuacaauuugucaccaaucugaccaaagaguucgagaucagcgacacagacacgagaauaggggccgugcaguacaccuaugagcaaagacuagaauucggguucgacaaguacucuuccaagccugacauucucaaugcuauuaagagagucggcuacuggagugggggcaccucaaccggugcagccauuaacuucgcgcuggagcaguuguucaagaaaagcaaacccaauaaaaggaagcucaugauccuuaucacagauggcagaucuuaugacgauguccggauaccugcaauggcagcccaccuuaaaggcguuauuacuuacgcuaucggaguggcuugggcagcccaggaagagcucgaggugauugcuacucauccagcuagagaucacucauucuucgucgacgaguucgacaaccuacaccaguacguucccagaaucauucaaaacauuuguacagaguucaacagccagccaagaaauuag

SEQ ID NO: 12550 - RNA, 555 nt, Artificial Sequence
  Description of Artificial Sequence: Synthetic coding sequence
auguucugucugcugcaccuuugcuuuuaccucgcuaacuucgcuagcagcaucaaacggacgcaugcugugaauggcuguuguggacuacaaaugaucgcccucugggcacaaagcucugguaacgccgaugcgcgaguugaagagauccucgcgggcgaggaacggagacuggccgcgcuuuuagggucacagggaaugcgcuucugggugugccuugccgccugucgcgcgauguggggacuagcugcuaggaggggacgagccgaagacucuaguagcucaccaguggacgcgagcaaguuucccuggcgugggggucagcauagaacaacgaugaugccguguuugcuccgcguaggaguguuucgacccugucaugugagaccuacuggggacccauccugcgauguacagccaccgagauugggguucaguagagugcccgauacccaaguggccuucuacggcagcggccacugggacccuaccccauuuagugugcauuccuguuuuuuuaauuuccaaguucgcaaaauuaucuuccuuuuauag

SEQ ID NO: 12551 - RNA, 864 nt, Artificial Sequence
  Description of Artificial Sequence: Synthetic coding sequence
augacuagugcugcccauuacuaccccaaacugaugagcaucaugggcaacguucugcgcuuucuuccagcguuuguuaggaugaaacagcuaauugaagaagguuacgucggugaaccguuggugugugaagugcaaguacacggcgggagccugcuagggaagaaguacaacuggagcugcgacgacuuaauggggggcgguggauugcauagcguugguaccuacauuauugaucugcuuacauuccugaccggccaaaaagccgucaaggugcaugggcuucugaagacguucgucaagcagacagaucacauuaagggcauacgacagauuaccucugaugauuucuguacauuucagaugguucuggagggggggguaugcugcaccgugacccugaauuuuaacgugccaggagaauucaaacaggacguuaccgugguaggaucugccggaagauuguuagccgugggaaccgaccuuuauggacagcgcaacucagccccugaacaggaacuccuggugcaggaugccaccccugucagcaauagccuucuacccgagaaggcauucagcgauaucccuuccccuuaucugcgaggaaccauaaaaaugaugcaagcagucagacaagcauuccaggaccaggaugaccgcagaacgugggauggaaggccuuugacaauggccgcaacauuugaugauugucuauacgcuuuauguguaguggacacgaucaaacguagcucccagacgggagaguggcagaacauugcuauaaugaccgaagaacccgaacucucaccagcauaucuuaucucugaggcuaugagaaggagccggaugucacuuuauuguuag

SEQ ID NO: 12552 - RNA, 1173 nt, Artificial Sequence
  Description of Artificial Sequence: Synthetic coding sequence
augcugccaggugucggcguguucgguaccucucugaccgccagggucauaauuccucugcugaaggacgaggguuuugcgguuaaggcccuguggggucgcacacaggaagaggccgaagaacuggcaaaggaaaugucggucccguucuacacuucaaggaucgaugagguucugcuucaccaagacguggacuuaguaugcauuaacuugccuccaccacugacacgacagauugccgugaaaacucuuggaauugggaagaacgugaucugugauagaacugcaacuccucuggacgcauuuagaaugacauccgcugcgcacuacuaccccaaacugauguccauuaugggaaauguccuucgguuccugccugccuucguacggaugaagcagcucauugaagagggguacgugggagaaccgcuggugugcgagguacaaguccauggcgggucccugcugggcaagaaauauaauuggucaugcgaugacuugaugggcggcggaggccuccauucugugggaaccuauaucauugaucugcuuacguuucugacuggccagaaggcugucaaggugcacggacugcugaagaccuuugucaagcaaacugaccacaucaagggcauccgacagauuacauccgacgauuuuugcaccuuucagaugguccucgagggaggaguguguugcaccgucacacugaauuucaacgugcccggagaguuuaagcaagaugugaccguggugggcucggcuggacgacuacuugcugugggcaccgaucuguauggucagagaaacuccgcccccgaacaagagcuguugguacaagacgcaacccccgucuccaauucucugcugccagaaaaagcguuuagcgacauccccuccccuuaccugagaggaacuauuaagaugaugcaagcgguccgccaggccuuccaggaucaagacgacagaaggacuugggacggcagaccacugacaauggccgcuacauucgacgacugccuguacgcccugugugugguugacacaaucaaacgcucaucacagacaggugaguggcaaaauauugcaauaaugacugaagagcccgagcugucucccgcuuauuuaauuagugaggcuaugcggaggagucgcaugagccucuacugcuag

SEQ ID NO: 12553 - RNA, 5718 nt, Artificial Sequence
  Description of Artificial Sequence: Synthetic coding sequence
augcagucucggcuccugcuucuuggggcucccggggggcacggcggccccgcuucacgcaggaugcgccuccuucugcgccaggugguccagcgucgaccaggcggcgauaggcagaggccagaggugagauuacugcacgcaggcagcggcgcagauacuggggacacggucaauaucggggacguaucuuauaagcuaaaaauccccaagaacccugagcucgugccccagaauuauauaagcgacucacuggcacagagcguagugcaacaucugagguggauuaugcagaaggaccuacuggggcaggacguguuccugaucgguccuccagggccacuaaggagguccauugcaaugcaguaccuugaguugacgaagcgcgaaguggaauacaucgcccuaagucgcgauaccaccgaaacagacuugaagcaacgccgagaaauccgcgcuggcacagcauucuacauagaucagugugccgugcgggcugcaaccgagggaaggacccugauacucgaagggcuugaaaaagcugaacgaaacgugcugccaguccucaauaaucucuuggaaaaucgagaaaugcagcuugaggacggccgauuuuuaaugucugccgaacgauacgacaaacuauuacgcgaccacacaaaaaaggaacucgacagcuggaaaauaguccgagugagugaaaacuucagagucaucgcgcucggccuacccguaccgcgguacaguggaaacccucuggacccuccccuucguucuagguuccaagcccgggauaucuauuaccugccauucaaagaccagcugaaacugcuguacaguauaggugcuaacgugucugcagaaaaaguuagccaacugcugucauucgccaccaccuugugcagucaggaaagcagcacccugggauuaccugauuuuccacuggacagucuagcugccgcaguucaaauccucgacucguuuccuaugaugccuaucaaacaugcaauacaaugguuguaccccuauucgauccuucuaggacacgagggcaagauggccguggaggguguucugaaacgcuucgaguugcaggacuccggauccuccuuguuaccuaaagagauugucaagguugaaaagaugauggagaaccauguaucacaggccagugugacuauccgcauagcagacaaagagguuacgaucaagguaccagccgguacaagacugcuuagccagccuugcgcuagugaucguuuuauacagacgcugagucauaaacaguugcaggccgagaugaugcaaagccacaugguuaaagacauaugucucauaggcgguaaggguuguggcaaaacggugaucgcaaagaacuuugcugauacacuggguuacaauaucgagccuauuaugcuauaucaggauaugacugcucgcgaccuguugcaacaacgguauacacugccuaacggcgacacagcguggcggaguucuccccuugugaaugcugccuuggaggggaagcucguguugcuggauggcauccaccgugucaaugcgggaacgcucgccgugcugcagagacuuauccacgaucgggagcucucccuuuacgauggaagucgccuguuaagagaagaccgguacaugcgccuaaaagaagaauuacaguugucugaugaacagcuucaaaagcgaaguauauuuccuauccacccuucuuuuaggauuauugcucuugcugaacccccagugaucgggucgacggcucaccaguggcugggacccgaauuucucacuauguucuucuuucauuacaugaaaccccugguuaaaagugaggaaauucaggugaucaaggagaagguccccaacguaccucaggaagcuuuggauaagcuguugucuuuuacacacaagcuucgcgaaacccaggacccuacagcccagagccuggccgcuagccugagcacccgucagcugcugaggaucagcagaaggcugucucaguacccuaaugaaaaccugcacuccgcuguaaccaaggcuugccugagccgcuuucuucccucucuagcaaggagcgcauuagaaaagaaccuugccgaugcuacaauugaaauuaacaccgaugacaaucuggaacccgagcucaaggauuacaagugugagguaacgagcgggacacugcgaauuggcgcggugagugcgccaauauauaaugcccacgagaaaaugaaagugccggauguguuauuuuacgacaauauucaacauguaaucgucauggaggacaugcucaaagacuuucuccucggcgagcauuuguuauuagucggaaaucaagguguuggcaaaaauaagauugucgaccgguuccuccaccugcugaacaggccaagagaauauauccaauuacaccgcgacacaacuguacagacacugacauugcaaccaagugugaaggauggguugauuguauaugaggauuccccucucguuaaagcaguuaaacugggacacauccuggugguggaugaggcagauaaggcccccaccaacgugacaugcauccucaagacccucguggaaaauggagagaugauccuggccgauggccggaggaucgucgcuaacagcgccaacgucaacggccgcgaaaacguaguggucauccacccugacuuucggaugaucguucuggccaauaggccuggcuucccuuuucuugguaacgacuuuuucggcacccuaggugauauauuuuccugccacgccguggauaacccaaagccgcacucugaacuggagaugcugagacaguauggaccaaacguuccagaacccaucuuacagaaacugguagccgccuucggagagcuacgcucauuggcugaucagggcauaaucaauuacccuuauucaaccagggagguuguaaauauaguaaagcaccuccagaaauuuccgacagagggccuaucuuccgucgugaggaauguuuucgacuucgacagcuacaauaacgauaugcgagagauucugaucaauacacugcacaaauauggaauccccaucggggcuaaacccacuucugugcagcuggcaaaggagcuuacccugccagaacaaacuuucaugggcuacuggacaaucggucaagcaagaagcgguaugcaaaaacuucucuguccggucgagacccaccauaucgacaucaaagggcccgcacuuauuaauauccaagaguacccgaucgagcggcacgaagagagaucacuuaacuucaccgaggaaugcgcuucauggaggaucccgcucgacgaaauaaacaucauuugugacaucgccacaucacacgagaacgaacaaaauacauuauaugucgucaccugcaauccugccucccuguauuucaugaauaugacuggcaagucaggauuuuucguggacuucuuugacauuuucccccggaccgcuaaugggguuuggcauccauuugugacaguggccccacucgggagcccccugaaggggcaggucguccuccacgagcagcaaucaaacgucauccuauuacuggauacaacgggcagagccuugcaccgauugauccugcccucagagaaauuuacaagcaagaagcccuuuugguggaacaaagaggaggcagagacauauaaaaugugcaaggaauuuagucauaagaacugguugguguuuuauaaagaaaaggguaauucccucaccguccucgaugugcuggaaggucgcacccacaccaucagucugccaaucaauuuaaaaacuguguuccugguggcagaggacaaaugguuacucguugagaguaagacuaaccagaaguauuuguuaacuaagcccgcgcacauugaauccgagggaucuggagugugucagcuguacguucugaaagaggaaccaccaucaacaggcuucgguguaacucaggaaaccgaguucucaauaccucauaaaaucucuucagaccaacugucaagugagcaccucuccucagccguugaacagaagauugcuagccccaauagaauacucucugaugagaagaacuacgccaccaucguuguagguuucccugaucuuaugagcccaagcgaggucuacuccuggaagcggccaucuucucuucacaagcgcagcgggacugacaccagcuucuaccgcggcaagaagaagcgggggacgccgaagcagagcaauugcgucacucuguuagauacaaaucaggucgugcggaucuuaccaccaggcgaggugccacugaaggauaucuauccaaaagacguaacaccaccacagacaaguggcuauauugaagugacugaccugcaaucgaaaaaacuuagauacauuccgauuccgcgguccgaaucccugagcccguacaccaccuggcucucaaccauuagcgacaccgaugcucuguuggcggaaugggauaagucaggaguggucacaguagauaugggggggcacauuagauuaugggaaacagggcucgagcgacugcagcguagccuuauggaauggagaaacaugaucggccaggacgacaggaacaugcaaauuacuauuaaccgcgauucuggcgaggaugugagcucucccaagcacggcaaggaagacccugacaacaugccccaugugggagguaacacaugggcuggcggcacagggggccgggauaccgcagggcuuggaggcaaagggggcccauauaggcuggaugccggucacaccguguaccaagucucacaagccgaaaaggaugcuguccccgaggaggugaaacgagcugcccgagaaaugggacagcgagccuuucagcagaggcucaaggaaauacagaugucugaguacgaugcugcaaccuaugagagguuuuccggcgccgucaggaggcagguacauucuuugcgcaucauucucgacaaccuccaggcuaagggcaaggaaaggcaaugguuacgucaccaggccacaggagagcuggacgacgccaaaaucauugacgggcuuacuggcgagaaagccauuuacaaacggaggggggagcuggaaccccagcucggcucgccacaacagaaaccaaaaagauugagacuggugguggacgucagcgguagcauguaccgcuuuaaccgcauggacggucgccuggaacguacuauggaagccgugugcauggucauggaggccuuugaaaauuaugaagaaaaguuccaauacgacauugucggacacuccggagauggguauaacauaggccucgugcccaugaacaagauucccaaagacaacaagcagcgccuggaaauucugaagacaaugcaugcgcauucgcaauuuuguaugagcggagaccauacgcuagagggcacugaacacgcuauuaaagaaaucguuaaggaggaggccgacgaauacuucgugaucguacucucagacgccaacuuaagccgguacggcauccauccagcaaaguuugcccaaaucuuaacaagagauccucaggugaacgcuuuugccauuuucauugggagccugggcgaucaggcaacacgauugcagcggacacugccagcgggccgauccuuugucgcuauggacacuaaggacaucccgcaaauccuacagcagaucuucacgagcacuaugcugaguagcgucuag

SEQ ID NO: 12554 - RNA, 561 nt, Artificial Sequence
  Description of Artificial Sequence: Synthetic coding sequence
auggaagccuuaccccuuuuagccgccacaaccccagaucauggccgccacaggagacugcuacugcucccacugcuacuauuucucuugcccgccggcgccgugcaaggaugggagacagaggagcgcccucgcacgcgcgaggaagagugucacuuuuacgcagguggccagguauacccuggcgaagccagcaggguaagcgucgcugaucacucccuucaccugagcaaagccaaaaucuccaaaccugccccuuacugggagggcacagcagugauugacggcgaauucaaggagcugaaacugaccgauuacagaggaaaauaccugguguucuuuuucuauccccuggauuucacuuucgugugucccacagaaauuaucgcauucggggaucgccuugaagaauucaggagcauaaacacagaagucguagcauguuccguugacagucaauuuacgcaccucgccuggucuguauccuacacauauauucggcgcaagaagcgaauggacuugcuccucaagcaugggcaaauaacucuggauaugauuuag

SEQ ID NO: 12555 - RNA, 816 nt, Artificial Sequence
  Description of Artificial Sequence: Synthetic coding sequence
auggaagcuuugcccuugcuugccgccacuacuccagaucacggccggcaccgucgacuauugcuuuugccucuccuucucuuucuacugccagccggugccgugcagggaugggaaacggaagagcgucccaggacucgugaggaagaaugccacuucuaugccgguggucaagucuacccaggggaagccucacgggugucuguagccgaucacucucugcaccuaucaaaagccaagaucucaaagcccgcccccuauugggaggggacggcagugauugacggagaguuuaaagaacugaagcuuacagacuaucgagggaaguacuugguuuuuuucuucuaccccuuagauuuuacauuugugugcccaaccgaaaucauugcuuuuggcgaucgauuggaggaguuccguagcauuaauaccgagguaguugcauguaguguggauucccaguucacucaccuagccuggaucaauacaccucguagacaggggggccucggacccauaagaauuccccuccucagcgaccuaacccaucagauuagcaaggacuacggaguauacuuagaggacucaggccacacacuacgcggccuauucaucauugaugauaaggggauccugagacaaauaacacuuaacgaucugccagucggaagguccguugaugagacacuccgauuggugcaagcuuuucaauauaccgauaagcauggagaggugugcccagccggguggaagccagggucugaaacgauaauuccagauccagccggcaaacuaaaauacuuugacaaauugaacuag

SEQ ID NO: 12556 - RNA, 558 nt, Artificial Sequence
  Description of Artificial Sequence: Synthetic coding sequence
auggaccaccgcaguagacugaggggcacaggccugaaccguaucccaggaacacagagcagggccccaagggugccucucccauuucacguccagcaggaagcuagagagggugaggacugggaaagggagccuccuagacagagaccaccuaucuacgagccacccgaaucugaggaacugccagauaacgugaugguaucgaaacccgcgccuuacugggaagguacagccgucauugacggugaauuuaaggaauugaagcucacagacuaccgggggaaguaucucguauuuuuuuucuacccucuagacuuuacauuugugugccccacugaaaucauagcuuuuggggauaggcuggaagaauuccgcucaauuaauaccgaggugguggcuugcaguguugauagccaauuuacccaccucgcuuggauuaacacaccucgccgacaaggaggacuggggccuauccguauuccccuacuaagugaucugacccaccagaucagcaaagauuacggcguguauuuggaggauaguggacacacuuuguag

SEQ ID NO: 12557 - RNA, 843 nt, Artificial Sequence
  Description of Artificial Sequence: Synthetic coding sequence
auggcacgcuuuuggguuuguguggccggugccggauuuuuccucgcguuccucgugcugcacuccagguuuugcggaucuccugugcugcgaaacuuuacuuucgcugugucuuggcggacggaaaaaauccuguauaggcuggacguuggauggccuaagcauccagaauacuucacaggcacaacauuuugcguggcuguagacucccuaaauggacucgucuacauuggacagcgcggcgauaacaucccaaagauccuugucuuuaccgaagacggguauuuucugagggcuuggaauuauacaguugacacgccccacggcauuuucgccgccuccacauuguacgaacaaucugucuggauuacggaugugggaucugacuuuaugauuuuguggcuucacggggagaaugggacuggaccugcuaaauucaacaucccucacucaguaacccucgacucugcuggacgcguuuggguugcggaucggggaaacaagagaauacaaguuuuugacaaggacacuggugaguggcucggcgcguggaacaauuguuuuacagaagagggcccaaguucgguccgcuucacgcccgaugguaaguaucuaaucguagcgcagcugaaccugagccggcugucugucgucgcggccccuccagucgguagcauuggcgagugcuccgugaucaguaccauucaguuggcagaccaggugcuuccucaucuccucgagguggauagaaaaaccggagcgguauacguggccgagaucggagccaagcaggugcaaaaguauguuccccugaauaguuauguucccuccuuuggaucuuag

SEQ ID NO: 12558 - RNA, 1044 nt, Artificial Sequence
  Description of Artificial Sequence: Synthetic coding sequence
auggcccguuuuuggguuugugucgcuggugcugguuuuuuucucgccuuucugguuuugcauagcagauucugugguucuccugucuugcgcaauuuuaccuucgccguguccuggcgcacugagaaaauucucuacaggcuagacgucggauggccuaagcaccccgaauacuuuaccggaaccacuuucugcguugcuguggacucacucaacggucugguguauauaggucaacgcggggauaacauuccuaaaauucugguguuuaccgaggacggauacuuccuaagagcuuggaacuacacaguugacacaccgcacggcauuuucgcggcuuccacuuuguaugaacaguccgucuggauuaccgacguggguagcggcuuuuucggacacacgguuaaaaaguauagcuccuucggggaucugguccaggugcuggggacaccagggaaaaaaggaaccagucugaauccuuuacaguucgacaauccugccgaacuguauguggaggacacaggggauauauacauaguggacggugaugggggccugaauaauaggcuaauuaaauugucucaagauuucaugauucuuugguugcauggcgaaaacgggacgggaccagccaaguuuaacauaccucacagugugacacuugauuccgccggccguguaugggucgcugaccgggguaauaagaggauccagguguuugauaaagauacaggagaguggcucggugcuuggaacaacuguuucacagaagaaggacccucuagcgugcgguucacaccagacggaaaauauuuaaucguugcgcagcuuaaucucuccagacuuagcgugguggcagcaccuccugucgguagcauuggcgagugcucagugauuaguaccauacaguuagcagaccaggugcucccacaucugcucgaagucgaucgcaagaccggcgccguuuacguugccgagaucggcgccaaacaggugcaaaaauaugugccacugaacucauaugugccaagcuuugguagcuag

SEQ ID NO: 12559 - RNA, 1707 nt, Artificial Sequence
  Description of Artificial Sequence: Synthetic coding sequence
augguccugcugcauuggugucucuuguggcugcuguuuccccucucuucccggacacagaaacuuccuacuagggacgaagaguuguuucagaugcagauuagagacaaggcauuuuuccacgauucuagcgugauucccgauggggccgaaaucucaaguuaccuguuuagggacaccccgaagagguauuucuucguggucgaggaggacaacacuccccuaucuguaacugugacucccugugacgccccacuugaauggaaacuaucacuccaagagcugccugaagauagauccggugagggcaguggcgaucuggaaccccuugaacagcagaagcagcagauuauuaaugaggaggguacagaacuauuuaguuacaagggcaaugacguggaauacuucaucuccuccucaucccccagugggcucuaccagcuggacuuacugucuaccgaaaaagauacgcacuucaagguguacgccaccaccacaccagagagcgaccaaccauacccagaacugccauacgauccaagaguagacguuacuagucugggaagaacaacgguuacacucgccuggaaaccuucacccaccgccucucugcugaaacagccaauccaguauugcguugucaucaauaaggagcauaauuuuaaaagcuugugcgcaguugaagccaaguugagugccgaugaugcuuucaugauggcuccaaagcccggacuggauuuuucccccuucgacuucgcccacuucggcuuccccucugauaauucugguaaagagcguucguuccaagcaaagccaagccccaagcuagguagacacguguauucaaggccaaaaguggauauccagaagaucugcauaggcaacaagaauauuuucaccguaucugaucuuaagcccgauacucaauauuacuucgacgucuucguugugaauaucaacucuaacaugucgacagcuuaugugggaacuuucgcccgaacuaaagaggaggccaaacagaagacagucgagcugaaggauggaaaaauaacggauguauuuguuaagcgcaagggugcuaaauuccugcgguucgcaccugucuccucacaccagaaggucaccuuuuuuauucauucuuguuuggaugcagugcaaauccaggugaggagggauggcaagcuguuacucagccagaacguggaaggcauacagcaauuccaacugagaggcaaacccaaggccaaauacuuagugagacuaaaggggaauaagaagggcgccucaaugcuuaagauucuggcuaccaccaggccuacaaaacaaaguuucccuucacugcccgaggauaccagaaucaaagcauucgacaagcuccgcacuugcaguucagccacgguugcauggcuuggcacucaggaaagaaacaaguucugcaucuacaaaaaagagguggacgacaauuacaacgaggaucagaaaaagagagaacagaaucagugccucggccccgacauccgcaaaaaaagcgaaaagguguuaugcaaguacuuccauagccagaaccugcaaaaggcggucacuaccgaaacuauaaaaggccuacagccaggcaaaaguuaccugcuggauguguacgucauuggccacgggggacauuccgugaaguaccagaguaaggugguaaagaccagaaaguuuuguuag

SEQ ID NO: 12560 - RNA, 489 nt, Artificial Sequence
  Description of Artificial Sequence: Synthetic coding sequence
augaaagguuuuacugccacgcuuuuucuauggacacuaaucuuuccuucuugcagcggaggaggcggcggaaaggccuggcccacccacgucguauguuccgacagcggucuggaaguccuuuaccaauccugugauccgcuccaggauuuuggcuuuagcgucgagaaguguagcaagcagcuuaaguccaacaucaauaucagauuuggcauaauccugagagaggacauuaaggaacuguuccuggaucuagcccucaugucccagggaagcaguguccuuaauuuuagcuacccaaucugugaagcagcucuacccaaauucuccuuuugugggagacgaaaaggugaacaaauuuacuacgcaggacccgucaauaacccagaguucacaaucccccagggagaguaccaagugcuccuugagcucuauacugaaaagaggucaacaguggccugcgcaaacgcaacuauuaugugcucauag

SEQ ID NO: 12561 - RNA, 1698 nt, Artificial Sequence
  Description of Artificial Sequence: Synthetic coding sequence
auggauuuccuacuggcuuuagugcucguauccagccuuuauuugcaggcggcagcggaguucgacggcagguggcccagacagaucgugucgaguaucggacucugccgcuacggaggccggauugauuguuguuggggcugggcucgucagucuuggggccagugccagcccgucugucagccgagaugcaaacauggagaauguauuggucccaacaaauguaaaugucaccccggauacgcuggaaaaaccugcaaccaggaucugaacgagugcggauugaaaccaagacccuguaaacacagauguaugaacaccuauggaaguuauaaaugcuauugccucaacgguuacaugcucaugccugacgggucuuguagcucugcucugacaugcaguauggcuaacugucaguacggaugcgauguggucaaaggacagauuagaugucaauguccgagccccggccugcagcuagcuccugauggaagaaccugcgucgauguagacgaaugugcaacaggaagggcguccuguccccgcuuucgccagugcgucaacaccuuuggaucguauaucugcaagugccauaaaggcuuugaccuuauguacaucggggggaaauaucagugucacgauaucgacgaguguucucugggccaguaccagugcaguucuuucgcccggugcuacaacauccggggaucuuacaaguguaaaugcaaagagggauaccagggggauggguugacuugcguauauauucccaaggugaugaucgagccuaguggccccauccaugucccaaaggguaacgguacuauucugaaaggcgauacugggaacaacaauuggauuccugacgugggcucuacgugguggccucccaaaacaccauacauuccuccuaucauaacgaaccgucccacaucuaaacccacgacaaggcccaccccuaaaccaacacccauccccacacccccucccccaccacccuuacccacggaacugcguacgccucuuccuccaacuacucccgaacgcccaacuacugggcugacgaccauugcuccugcugcgagcacuccgccgggcgguauuacgguugacaacagaguucaaacagacccacagaaaccuagaggugacguguucauuccgcggcagcccucuaaugaccuuuucgaaaucuuugagaucgaaagaggcgugucugcugaugacgaggccaaggacgauccaggugugcucguacauucauguaacuucgaccacggccuguguggcuggauuagggagaaggauaacgaccuucauugggaacccauccgugacccugcuggcgggcaguaucugacgguaagugccgccaaggccccagguggaaaagccgcacgucucgugcugccacucgggcgauugaugcacaguggggaccucugcuuaaguuuucgacacaaggugacuggcuugcacaguggaacacugcagguguuuguuagaaagcacggugcucauggagcagcuuuguggggacggaacgguggacacggguggcggcaaacccaaaucacacugaggggagcugacauaaagagcgucgucuucaaaggcgagaagcggcgggggcacaccggggaaaucggccuugacgacguaagucugaaaaaggggcacugcucagaagagagguag

SEQ ID NO: 12562 - RNA, 1413 nt, Artificial Sequence
  Description of Artificial Sequence: Synthetic coding sequence
augaagagaucggucgcagucuggcugcuggugggccugagucugggugugccucaguuugguaagggagacauaugcgacccaaauccuugcgagaauggcggcauauguuugccgggucuugccgauggauccuuuucuugcgaaugcccagaugguuuuacugauccaaacuguagcuccguugucgaagugggccccugcacucccaacccuugucauaauggaggcacaugcgaaauuagcgaagcuuacagaggggacacauuuauuggcuacgucugcaaguguccccgagguuucaauggaauccauugucagcacaauaucaacgaaugcgaagucgaacccuguaaaaaugguggcauauguacggaucuaguagcuaauuauucgugugagugcccuggagaauuuaugggccgaaauugccaauacaaauguaguggcccucugggcauagagggcgguauuauaagcaaccaacaaauuacagcuucgagcacacacagggcacuguucgguuugcagaagugguaucccuacuacgcaagacucaacaaaaaaggccugauaaaugcuuggacagccgccgagaaugacagguggccuuggauacaaauaaaucugcagaggaaaaugaggguaacuggagucauuacccagggagcuaagcgcauaggaagccccgaauacaucaaaucuuauaagauagccuacagcaacgaugggaaaacuugggcuauguacaaagugaagggcacaaaugaggauauggucuuucgagggaauaucgauaauaacacuccauaugccaauagcuuuacccccccuauuaaggcccaguaugugcgguuguauccucagguuuguagacggcauuguacucugcguauggagcuguuggggugugaguuauccggcuguagcgagccucuuggcaugaaaucuggucacauccaagauuaccaaauuaccgcaucuuccauauuccggacccugaacauggauauguuuaccugggagccccguaaggcaagacucgacaaacaagggaaaguaaaugcauggaccagugggcacaaugaccaaucucaauggcuacagguugaucuauugguccccaccaagguuacggggauuauuacacagggggcaaaagacuuugggcacgugcaguuuguggguagcuauaagcuggcauacucaaaugacggcgaacauuggacugucuaccaagaugaaaagcagcgcaaggauaaaguguuccaagggaauuuugauaaugauacacacagaaagaauguuaucgauccaccaauuuaugcccgacauauuagaauucugccuuggagcugguaugggagaauuacgcuacgcuccgaacugcuggguugcaccgaggaggaauag

SEQ ID NO: 12563 - RNA, 1254 nt, Artificial Sequence
  Description of Artificial Sequence: Synthetic coding sequence
auggccagcuaccuuuaugggguuuuguucgcugugggacugugcgccccgaucuauugugugucccccgcaaacgcuccaucugcuuauccucguccaucuucgaccaaauccacaccggcuagccaggucuacucgcugaacacugacuucgcauuucgccuauaucggcgccucguguuagagacuccuucucaaaacauuuucuucucucccgugagcguuucaaccucucuggcaaugcuguccuuaggcgcccauucagugaccaagacccagauccuccaggggcucggguuuaaucugacccauaccccagaaucagccauccaucagggauuucagcaccugguucacagccugacugugccuucuaaggaccugacgcuuaaaaugggcagcgcccuuuuugugaagaaggaacuacaacugcaggccaauuuccugggaaacguuaagcgccuguacgaggcggaaguguucucuacugauuuuucuaaccccucaaucgcucaagcucguaucaauagccacgugaaaaagaagacacaggguaaggucgucgauaucauacagggcuuggaucugcuuacugcaauggugcucgugaaucauaucuucuucaaggcaaaaugggagaaaccuuuccauccagaauauacaaggaagaacuuuccuuuucugguuggcgaacaggucacagugcacgugccgaugaugcaccagaaagagcaguucgcuuuugggguggauacagaguuaaauugcuuuguucugcaaauggauuauaaaggggacgccgucgccuucuuugugcugccguccaaaggcaaaaugcgccaacucgaacaggcccugagcgcacgcacgcuccguaaguggagccauucccugcaaaagagauggaucgaaguuuucauuccaagauucucuaucucagcuucguauaaucuagaaaccauccugccuaaaaugggaauccagaacguguuugauaaaaacgcagauuuuuccggaauagcaaagcgggauucacugcagguuucaaaagcaacacauaaggcagugcuugacgugucggaggagggaacagaagcaacugcugcuaccacaacaaaauuuauaguccguagcaaggaugggcccagcuacuuuacagugucauuuaauagaacauuucuaaugaugauuacuaauaaggcgacugaugggauacuguuccucggaaaggucgagaacccaacuaaaaguuag

SEQ ID NO: 12564 - RNA, 486 nt, Artificial Sequence
  Description of Artificial Sequence: Synthetic coding sequence
augcuuaugcccgugcacuuccuacucuugcuucuccuacuccuuggaggaccucguacaggcuuaccucacaaauuuuauaaagccaaacccauuuuuaguugccugaacacugccuugucagaggcugagaagggccaaugggaagacgcuagcuugcugagcaaaagaagcuuccauuaccugagaagccgagaugccagcaguggcgaggaggaagaagggaaagagaaaaagacuuuccccauaaguggcgcucggggaggagcacgcggaacccgguaccgauauguaucucaagcgcaaccuagagggaaacccagacaagauacugcuaagucuccucaccggaccaaguuuacccuaucccuugauguccccaccaauaucaugaaccuccuuuucaauaucgcuaaggcaaagaaccugagggcccaggccgcagccaacgcacacuugauggcacaaaucgguagaaagaaguag

SEQ ID NO: 12565 - RNA, 2091 nt, Artificial Sequence
  Description of Artificial Sequence: Synthetic coding sequence
auggcgauggcccgacugggaaguuggcugggugaggcacaguggcuggcgcuggugagccuguucguggccgcacuggcuacgguugggcuguaccuggcccaaugggcauuggcucgcgcucgcccucaaccacagcggagggcuguggaaccaggggaggggccacggcccggcucagacgccuugcugaguuggauucucacgcuugguuccuggcgcucucaguggcaggcagcuugggucaccgcuuugaaugaagaggcugagcgcaaagguggaccuccuuucuugagcuucgaagaagaccccaggcagcaggcccuggagcucguggugcaggaagugucaucugugcucagauccgccgaagaaaagguggugguuugucacguugucggccaggccauucaauuccucguuagcgagacacccgcccuaggagcuggcuguagauuguacgacaugcggcucucaccauuucaccugcagcucgaguuccacaugaaagagaaaagggaagaucugcagaucuccuggaguuuuauuagcgugccugaaauggcagugaacauacagccaaaggcccuaggcgaggaucagguggccgagaccucagccauguccgauguccucaaagacauccugaagcacuuggcgggcuccgccucaccuucagugguccucaucaccaaacccacaacagugaaggaagcccagaacuugcagugcgcugccucuacggcccaggaguccugucccccuaaaccuccaagagcgcacgaacugaaacugcuaguccgcaauauccauguccuccuccuaagcgagcccggagccaguggccauauuaacgcuguguguguggugcaacucaacgauccuguucagagguuuucgucaacccugacaaagaauaccccggaucugaugugggaggaggaguuuacauuugaacucaacgccaagaguaaagagcuucaccuccaaaucucagaagccggacgcuccucugaaggccuacuggcaaccgcgacagugccucuugauuuguuuaagaagcagcccagcggcccacagucauucacccuuacaagugguucagcuugcgguuccucugugcucggcagugugacagcggaguucucguauauggagcccggagaacuaaagucauggccaaucccgccgccugugcccgccgccaagauugaaaaagaucgcacggugaugccaugcgguacuguuguaacaacuguuaccgccguaaaaaccaagcccagagucgacguaggacgggccuccccgcugaguuccgacagucccguuaagaccccuaucaaagugaaggugauagagaaggacaucuccguacaggcaaucgcuuguaggagugccccagugucaaaaacucuguccagcucugauacagaacugcuggugcucaauggcucagacccgguugcugaaguugcaauacgccagcuuuccgagaguucuaaacuuaaacucaagagcccacgcaaaaagucuacaauuauaauaucugguauuuccaagaccucacugucacaggaucacgaugcagcacugaugcaaggauacacagccaguguggauaguacccaccaggaagaugcaccaucccauccagagcgcgcagcugcaagcgccccacccgaggaagcagagagcgcccaggcgucacuggccccuaaaccucaggaagaugaacuggauucuugggauuuagagaaggaaccccaagcugcagccuggagcagccaaguccuucuggaucccgacggagaugaguuaagcgagucauccaugagcgugcucgagcccgguaccgcaaaaaagcacaaagggggaauucugcgaaagggggcaaaacucuuuuuccgccggcgccaucaacaaaaagacccgggaaugucccagucucacaacgauuugguguuccucgaacagccugaaggaucgcgacguaagggcaucacauugaccagaauccuuaacaagaaacuuuuaagcagacauagaaauaaaaauacaaugaacggcgcccccguagaaccaugcaccuag

SEQ ID NO: 12566 - RNA, 669 nt, Artificial Sequence
  Description of Artificial Sequence: Synthetic coding sequence
augccggcaucuucccccuuccuccucgcaccgaaagguccaccuggaaauauggggggacccgugcgugagccugcgcucagugucgcccuguggcuuaguuggggcgccgcucugggggcaguugccugugcaauggccuuacugacccagcagacugaguugcagagccugaggagagaaguuagucgacuucagggaaccggcggcccuagccagaacggcgaagguuaucccuggcagucccugcccgagcagcacuccguacugcacuuggugcccaucaacgccaccuccaaggacgacucagacguaacagaggugauguggcagcccgccuuacggagaggacgggguuugcaggcgcagggcuacgguguaagaauacaggacgcaggcgucuaucuguuguacagucaaguccucuuccaggaugucacguuuaccaugggucagguagucucuagggagggccagggcagacaagaaacccucuuucgcugcauucgcucgaugccuagccacccugacagagcguauaacuccugcuacucagcuggcguguuccaccugcaucaaggggauauucugucuguuaucaucccacgcgcccgggcgaaacucaaccucagcccucaugguacuuuuuuaggguuugugaaacuuuag

SEQ ID NO: 12567 - RNA, 2205 nt, Artificial Sequence
  Description of Artificial Sequence: Synthetic coding sequence
auguggggccuguuacuggcauuagcggcguucgccccagccgucggacccgcccucggagccccuagaaauagcguuuugggcuuagcucagcccggcacaacgaaggugccagggagcaccccugcacugcauaguucuccugcacaaccaccagccgagaccgcaaaugggaccuccgagcagcaugugagaaucaggguuaucaagaaaaagaaagucaucaugaaaaaaagaaaaaaacugacauugaccagacccaccccucuggucacagcuggaccccucguuaccccgacacccgcgggaacccuagauccugcugaaaagcaggaaacugguuguccuccucucggucuggagucucugaggguguccgacagcagacuggaagccagcagcagucagagcuucggccucggaccccacagggggcggcugaacauucagagcggccucgaagacggcgaccuguaugacggagcauggugugccgaagagcaggaugccgacccuugguuccagguggaugccggucauccgacacgcuucucagggguuauuacacagggucgcaauuccguguggagauacgacugggugacauccuacaaggugcaguuuagcaacgauagucguacauggugggggucucggaaucauucaucaggcauggaugccguguuccccgcuaacuccgaccccgagacaccuguguuaaaucuguugccagagccacagguggcgcgcuuuauacgacuccugccacaaacauggcugcagggaggagcaccauguuugcgggccgaaauccucgccugucccguauccgauccaaaugaucuguuucucgaagcgccugccagcggaucuagugacccccucgacuuucaacaucauaacuauaaagcuaugagaaaauugaugaaacaaguccaggagcaguguccuaauaucacgcgcaucuacagcaucgguaagucauaccagggucugaagcuuuacgucauggagaugucagacaaaccgggggagcaugagcugggagaaccugaagucagauacguggccgggaugcacgguaacgaagccuugggcagagaacugcuccuccugcuuaugcaguuucuuugccacgaauuucuccgaggaaacccucgggugacucgccucuugagcgagaugcggauccaucugcucccuuccaugaaucccgauggauaugagauugcguaucaccgggguagcgagcucguagggugggccgaagggcgguggaacaaccaaucaaucgacuugaaccacaauuucgccgaucugaacacgccucugugggaagcucaggacgauggaaaagucccccauauuguucccaaucaccauuugccccuaccaacauacuacacacuuccuaacgcaacagucgcgccagagacacgcgccgucaucaaguggaugaagaggauuccauucgucuuaucugcaaaccuacaugguggagagcucguugucagcuacccauucgauaugacccggacaccuugggccgcuagagagcucacaccgacucccgacgaugcaguguuccgaugguuaucuaccguguaugcaggauccaaccucgcaaugcaagauacaagccgccggccgugccacucucaagacuucuccguucacgggaacauuauuaacggcgccgacuggcacacugugcccggcuccaugaacgacuuuuccuaccuacacaccaacugcuucgaagugacaguugaguuaagcugugauaaguucccccacgaaaaugaacugccucaggaaugggaaaauaacaaagaugcacuccugaccuaccucgaacaggugcgcaugggaauagcagguguggucagggauaaagauacggagcugggaaucgccgaugcuguuauugcagucgacggcaucaaccaugaugugacaaccgcauggggcggagauuacuggagacugcucacaccuggugauuauauggugacugcaucagcggaaggcuaccauagcguuacccgaaauugucgugugacguuugaagaaggcccauuuccuugcaacuucguguuaacaaaaacgcccaagcagcgccucagggaguuacucgcugccggagcaaagguuccgccggaccuaaggagacgguuggaacgauuaaggggacaaaaggauuag

SEQ ID NO: 12568 - RNA, 759 nt, Artificial Sequence
  Description of Artificial Sequence: Synthetic coding sequence
augcgggccccgcucuuaccucccgccccggucguccugagccuacugauccuggguuccggucacuacgccgccggccuugaucuuaaugacaccuacagcggaaagcgggagcccuuuagcggcgaccacuccgccgauggcuucgaagucacaucaagauccgaaaugaguuccggaucugaaaucucccccgugagugagaugcccucuuccagugaaccaucgagcggggcggauuacgacuauagcgaagaauacgauaaugaaccgcagaucccuggguacauaguagacgacucagugcguguugaacagguaguaaagccaccccagaacaaaacugaauccgagaacacaucagauaaacccaagcggaaaaaaaagggcggaaagaacggcaaaaauaggaggaaucggaaaaagaaaaaccccugcaacgccgaguuucagaacuucuguauccauggagaaugcaaguauauugaacaucuugaagcagugaccuguaaaugccagcaagaguauuuuggggagcgcuguggagaaaaaucaaugaaaacucacagcaugaucgacagcagucucucaaagaucgcucuagccgcgauugcagcuuuuaugucugcuguaaucuuaacugccgucgccguaauuacaguccagcuacggaggcaguauguccguaaauacgaaggggaagcugaggaaagaaagaagcugagacaagagaauggaaauguucacgcaaucgccuag

SEQ ID NO: 12569 - RNA, 8487 nt, Artificial Sequence
  Description of Artificial Sequence: Synthetic coding sequence
augccaaagagggcucacuggggagcgcugagcguuguacuuauccuacuguggggucacccucguguugcucuggcauguccccauccgugugcuugcuacguuccuagcgaagugcacuguacuuuccgaucgcucgcuucagucccugccggaauagcuaagcacgucgaacggauuaaccugggcuucaacuccauacaagcucuguccgaaacaucguucgcugggcucacaaagcuggagcuacuuaugauucacggaaaugagauccccucgaucccugacggcgcccugcgcgaccugucgagucuucaaguuuucaaauucuccuauaacaaacugagggucauuacgggucaaacacuucaggggcucucuaacuuaaugcgguugcacaucgaccacaacaagaucgaauucauucauccccaagcguucaacggucuuaccagucucagacuucuccaccuagaagggaauuugcugcaccaguugcauccguccacuuuuucuacauucaccuuuuuggacuauuuuaggcuauccacaauccgccaucuguaccuggcagagaauaugguuagaacacucccggcaucuaugcugcguaacaugccacuucuggaaaaucucuacuugcaggguaacccauggaccugcgacugugaaaugaggugguuccuugagugggaugcaaagucuagggggauucuaaaguguaagaaagacaaagcguaugagggaggccagcugugcgcaaugugcuucucuccaaagaaacuguauaagcacgagauacauaagcucaaggauaugaccugccucaaacccaguaucgaaucuccgcugcgacagaaucggucaaggaguaucgaggaagaacaggaacaggaggaggacggcggaucccaguuaauccuugaaaaguuccaacucccgcaguggagcauuagccucaauaugaccgaugaacacggcaacauggugaauuuagucugcgacaucaagaagccuauggacguuuacaagauccaccucaaucagaccgacccacccgauaucgacauuaacgccacuguggcccuagacuucgaguguccaaugacccgagaaaacuacgagaagcuuuggaaauugaucgccuacuacuccgaggugccugucaagcugcaccgcgaacugauguugucaaaagauccacgggugucauaucaguaucgacaggacgcugaugaagaggcccuguacuauacaggcgucagggcgcagauccuggccgaacccgaaugggugaugcagcccaguaucgacauccagcucaaucgucggcagagcaccgccaaaaaaguucuccugagcuacuauacccaauauucacagacuauaucaacuaaggacacacgccaggccaggggucgaucuugggugaugaucgaaccuucuggcgcgguccagagggaucagacugugcucgaggggggaccuugccaacucagcuguaacguuaaggccucagaauccccaaguauuuucuggguucugccugacggcuccauccuuaaggccccuauggaugacccagauucuaaauucucaauucuuuccucaggguggcugcggaucaaguccauggagccuuccgacaguggauuauaucaguguaucgcccagguacgcgaugaaauggaccgaaugguguaccggguacuggugcaaucacccucaacgcaaccagccgaaaaggacacagucacuauaggaaagaauccaggcgaaagcgucacucugccaugcaacgcacuggcgaucccagaagcccaccucaguuggauccuacccaaccgaagaauuauuaaugauuuggcuaacacgucucacguguacaugcuaccgaaugguacucugagcauccccaaggugcaggucagcgacucagguuauuacaggugugucgccgucaaucaacagggugccgaccauuuuacuguggguaucaccguaaccaagaaaggaucuggccuaccuagcaaaaggggcaggaggccaggugcaaaggcauugagccgagugcgggaggacaucguggaggaugagggcggaagcggaaugggugaugaagaaaauacaucacgcaggcucuugcacccuaaagaccaggaggucuuccugaagacaaaggacgacgccaucaauggcgauaagaaggcgaagaagggaaggagaaaacugaagcucuggaagcacucugaaaaagagcccgagacgaaugucgcagaagguaggcgcguguuugagucucggcgcaggaucaauauggcuaauaagcagaucaauccagaacguugggccgauauccucgccaaggucagggggaagaaccugccuaaggggaccgaaguuccaccccuuaucaagaccacuucgccgccaucacuuucucucgaagucaccccuccuuuuccagcgauuucuccgccauccgccucccccgugcagacagugaccagugccgaggagucaucggcagaugugccccugcugggugaggaggaacacguucuggggacgaucaguucagcuagcaugggccuagaacacaaccauaauggugugauucucguggagcccgaagucacuagcaccccacuugaggaaguuguagacgaccucagugagaaaacagaggagauaacaucgacagagggggaccugaagggaaccgccgcaccgacccucaucagugaacccuacgaaccaagccccaccuugcacacacuggauacugucuacgaaaagccuacgcaugaggaaaccgccacagaggguuggagcgccgccgaugucgggucuagcccugagccuacaucaucugaguaugagccgccccucgaugcagugucuuuagcugagucugagccuaugcaauauuuugacccggauuuagagacuaaaucccagcccgacgaggauaagaugaaagaagauaccuucgcacaucugacuccgaccccaaccauaugggugaacgacucuagcaccucucagcuguucgaggacuccacuaucggagagccuggcgugccuggucaaucacaccuccagggucuuaccgacaacauccacuuggucaaaucaucacugucaacacaggacacacuuuugauuaaaaaagguaugaaagaaaugagucagacguugcaggggggaaacaugcuggaaggcgaccccacucauucucgcagcucugagucggaaggucaggaguccaagucgauuacucuuccugacagcacacuggguaucaugaguucuaugagcccugugaagaagccagccgagacaacaguugguaccuuauuggauaaggauaccacuaccgccacaacaacaccucgccagaagguggccccaucaagcaccaugucuacacauccuucuaggaggagaccuaacggucggaggcggcugcgcccgaacaaauuuaggcaccggcacaagcaaacaccaccaaccacuuuugcuccgucugagacauuuaguacgcagcccacucaagcuccugacaucaagaucuccucgcagguggaaagcucccuaguuccaacagccuggguggacaauacaguaaacacgcccaagcagcuggagauggagaaaaaugcggagccuacgucuaagggcaccccaaggcgaaaacaugguaagcgccccaacaagcauagguacaccccuucaacagugucgagccgcgcauccgguuccaaaccgucaccgagcccagaaaacaagcauagaaauauugucacaccaucaagcgagaccauccugcugccacgaacugugagccucaagaccgaaggaccuuaugauucuuuagacuauaugacuacaacucggaagaucuacaguuccuauccuaagguccaggaaacacuuccugugaccuacaagccuaccucugaugguaaagaaauuaaagaugauguagcuaccaacgucgauaaacacaagucagauauccuggugacuggcgaauccauaacaaaugccaucccuaccucacgcaguuugguuucgacaaugggcgaguuuaaagaggaguccucaccagugggguucccaggcacccccacauggaacccuucacgaaccgcucagccuggucgccuccagacaggcaucccagugacuaccucgggggagaaccucacugacccuccccuacugaaggagcuggaggauguugacuuuacuucugaauuucuuucuagccugacaguuucuacaccguuccaccaggaggaagcuggcucaucaaccacacuuaguucaaucaaggucgaggucgcuucaucacaggccgagacaacgacccuggaucaggaucaccuggaaacaaccguugccauucugcuuuccgagacacguccacagaaccacacuccuaccgcugcucgcaugaaggaaccggccagcaguuccccuucaaccauacugaugagccugggucagaccaccaccacuaaacccgcacuccccagcccuagaaucucacaggcaagucgcgacucuaaagaaaauguuuuccucaacuaugugggaaauccagaaacggaggcaacacccgugaacaaugaaggaacgcagcauaugucgggacccaaugagcucucaacaccuucaucagaccaggacgcauucaacuuaucuacuaaguuagaacuggagaaacagguguuugggucaagaagcuugccuagagguccugacucucaacgacaagacggacgggugcaugcuagccaccagcugacacgcguuccagcuaaaccaauccuuccuacagcuaccguucgguugccugaaauguccacccagucggccagucgguauuucguaaccucacagagccccaggcacuggaccaacaagccugaaaucacuaccuaucccagcggcgcucugcccgaaaacaaacaguuuacuacgccccgccugaguaguaccacaauuccacuuccccugcacaugaguaaaccauccaucccgaguaaauucaccgaccggcggaccgaucaauuuaacggcuacucgaaaguuuucgguaauaacaacaucccagaggcacggaauccaguuggcaagccgccaucuccucgaaucccacacuauucaaaugguagacuucccuuuuucacuaacaagacccucaguuucccacaacuggguguaacgcggaggccucagauaccuacuaguccugcgccuguuaugagagagagaaaaguaauuccaggcagcuacaaucguauucacagucacuccaccuuucacuuagacuucggacccccggccccuccucugcuucauacaccucaaacaacaggguccccauccacuaaucuucagaacauuccgauggugaguuccacccaaucuucuauauccuucaucacuaguuccguccagagcagcggcucuuuccaccaaagcucuaguaaauuuuuugcugguggaccgccagcuaguaaauuuuggucccuuggagaaaaaccacagauccuuacaaagucuccacagacuguguccguaacugccgaaaccgacaccguguuccccugugaagcuaccgggaaacccaaaccauucguaaccuggacaaaggucagcacuggcgcacugaugacacccaauacgagaauacaacgcuuugagguucugaagaaugguacacuagugauuaggaaaguacaaguccaagauaggggccaguauaugugcacugcguccaaucugcacggccuggauaggaugguggugcuacucagcgugacuguucagcagccccaaauacuggcaucccauuaccaggaugucaccguguaucugggcgauaccauagccauggagugccuggcaaaaggcacccccgcgccucaaaucagcuggaucuuuccagaccggcggguguggcaaacuguguccccuguagagggucguauuacuuugcaugagaaccgcacacucucuaucaaagaggcaucguucagcgaucggggcguguacaaaugcguugcuuccaacgccgcuggagccgauucacuggcaaucagacugcauguggccgcccugccaccugucauucaccaggaaaagcuggagaacaucucauuaccaccuggccugagcauacacauacacugcacagcaaaggcugcgccgcugccuagcguucgauggguauugggcgaugggacacagauacggccaucucaguuccugcacggcaaucuguuugucuuuccuaacgggacccuguacauucgcaaucucgcuccuaaagacucuggacgcuaugaauguguggcggcuaaucuggucggcuccgcccggaggaccguacaauugaauguucagagagccgcugccaacgcgcgcaucacaggcaccagcccacgcaggacagaugugagguauggagguacccuuaaacuugauugcucagccuccggggauccuuggccucgaauucucuggcgcuugccaaguaagcgcaugauagaugcccuguuuuccuucgacucgcggaucaaaguguuugccaauggaacucuggucgucaagucaguaacagauaaagacgccggggauuaccucugcguggcccgaaacaagguuggggacgauuacgucgugcugaagguggaugucgugaugaaaccugcgaaaaucgagcacaaagaggagaacgaucauaaaguguuuuauggaggugaucucaaaguugauugugucgcuaccggucuaccaaacccggaaauaagcuggucacugccggacggaucccucgucaacagcuucaugcagagugacgacucaggagguagaaccaagcguuacgucguuuuuaacaaugguacccuauacuuuaacgagguggguaugagggaggagggcgauuacacaugcuucgccgagaaucaggucggaaaggacgaaaugcgagucagagugaaaguggugacugcuccagcaacuauucgaaauaagacauaucucgcuguucaggugccuuauggugauguggugacuguggccugcgaggcuaagggagaacccaugccaaaagugacuuggcugucaccaacaaacaaaguuauuccuacaaguagugaaaaguaccagauuuaccaggauggaacgcuccugauccagaaagcccagcggagcgacucagguaauuauacaugccuggugaggaauucugcuggggaggauagaaagacggucuggauacacgugaaugugcagccaccuaaaauaaacggcaaccccaacccuaucacuaccguucgcgagauugccgccggcgggucacgcaagcucauugacuguaaggcggagggcaucccaacaccccgcguacugugggcauucccagagggcgucguacucccugccccauacuaugggaauagaaucacuguucacggcaauggaagccuggauauucgcagccuaagaaagagcgacucuguucaguuggugugcauggcaaggaaugagggcggugaggcgaggcugauccuucaguugaccgugcucgagccgauggaaaaaccaaucuuccacgauccuaucuccgaaaagaucacagcuauggccggacauacuauuuccuugaacuguagcgccgccgguacaccgacaccuucccuugucuggguccuaccuaauggaaccgaucuccagucagggcaacaguugcagagguucuaucauaaagcagacgguaugcuccacaucaguggacugagcucuguggacgcuggggccuacagauguguugcccgcaacgcagccggccauacggagagauugguaaguuuaaaggugggacugaagccugaagcaaauaagcaauaccauaauuuggucucgauuauuaauggcgaaacuuugaagcugcccuguacuccccccggagcagggcaggggcgcuuuucguggacucuucccaacgguaugcacuuagaggguccacagacuuuagggcgugugucgcugcuggauaacggcacacugacagucagagaagcaucaguguucgaccgggguacuuacgucugcagaauggaaacggaguacggacccucuguuacuagcauuccagugaucguaaucgcuuacccuccacguaucacuucugagcccacucccguuauauacacuaggcccggaaacaccguuaagcuuaauugcauggccauggggaucccgaaggccgauauuacaugggaguuaccagauaaaucucaucuuaaagcuggcguacaggcucgacuuuacgggaaucgguuuuugcacccucagggcagccuaacaauccagcacgccacacagagagacgcaggguucuauaaaugcauggcaaagaacauuuuaggguccgacagcaaaaccacuuacauccacguauucuag

SEQ ID NO: 12570 - RNA, 3330 nt, Artificial Sequence
  Description of Artificial Sequence: Synthetic coding sequence
augaggcugcuguuguugguaccacugcugcuugcccccgccccgggaagcagcgcuccuaaggucagaagacaaucugauaccuggggacccuggucccagugguccccuuguucgagaaccuguggcgguggugugucguuuagagaacgcccuugcuauucacagcgacgcgacgggggaucuucguguguuggacccgcccgcucgcaccgcuccugcaggacagagaguugcccagauggagcgcgagacuuccgggccgagcagugugccgaauuugacggcgcagaauuccagggaaggcgguaucgguggcucccuuacuacucagcacccaauaaaugugaguuaaauugcaucccuaaaggcgaaaauuucuacuacaagcacagagaagccguuguggauggcacuccaugugaaccugggaaaagagaugugugugucgacggcucaugccgcguugucggcugugaucacgagcucgauuccucuaaacaggaagacaaaugccuucgauguggcggcgacgguaccacauguuacccugucgcuggaacauucgacgcuaaugaucugaguagaggguacaaccagauacuuauuguaccuaugggugcuacuuccauucugauugacgaagcagcugcaucccggaauuuccuggcagugaaaaacgucagaggcgaauacuauuugaauggacacuggacgaucgaggccgcacgggcccucccugcagccucaacuauccuccacuacgagcgcggcgcagaaggagaucucgcccccgaacggcugcacgcccggggccccacuucggagccucuggugauagaacugauaagccaagagccaaacccugggguucacuaugaauaucaccuaccuuugagacggccuucucccgguuuuuccuggucucacgguuccuggagcgauugcagugcugagugcggcgggggacaucaguccaggcucguguuuugcacaaucgaccacgaagccuauccugaccauaugugccagagacagcccagacccgcagaccgacguucauguaaucugcauccuuguccagaaacaaagcgcuggaaagccggaccaugggccccgugcuccgccagcuguggaggaggaagucaaucacgcagcguuuacugcauuuccuccgauggggcaggcauucaggaggccguagaagaggcugagugugcuggcuugcccgggaagccuccagcuauucaggcuugcaaccugcagcggugugcugccuggucucccgaaccuuggggggaaugcucuguuuccugcggaguggguguacgaaagcguagcguuacauguaggggagagcgcgguucucuacuucauacagcugccuguagucuugaagacaggccuccauuaaccgaaccuugugugcacgaagauugcccccugcugagcgaccaggccuggcaugugggaacauggggacucuguucgaaaucaugcucaaguggaacaagaagaagacaggugauaugcgccauugguccccccucacacuguggcucacugcagcauuccaagccaguugauguggaaccauguaacacucaaccaugccacuuaccccaggagguucccagcaugcaagauguccacaccccagccucaaaccccuggaugccacugggaccccaggagucucccgcuagcgacucuagaggucaguggugggcggcucaggagcauccaagcgccaggggcgaucauagaggcgagcggggcgauccaagaggugaucaggggacgcaccuguccgcacuugguccugcucccucucugcagcagccaccauaccaacagccgcugcgguccggcucugguccucacgauugcaggcauaguccucaugguugcugcccugacgggcauaccgccucccucgguccccaguggcagggcuguccaggcgcgccuugccagcagucgagguacggcuguugcccagaccgugugaguguugcugaaggcccacaccacgcuggauguacaaaaucauacggaggggauucgaccggcggcaugccucgcagccgggcuguggcuucuacaguccauaacacccaccagccucaggcccaacagaaugagccuuccgagugucgaggcucccaauucgguugcuguuaugacaacguggcuaccgcagcuggucccuugggugaagggugugucggacaaccuagucacgcauaucccgugagaugucuguugcccucugcccacggcagcugugcggauugggcugcucgcugguauuuugucgccaguguaggacaauguaaccgcuucugguacggagguugucacgggaacgcgaacaauuucgccucugaacaggagugcaugagcaguugccagggaucccuccauggaccccgcaggccccagcccggugcuaguggcaggagcacccacacugaugggggcggcaguaguccagccggugagcaagaaccaucccagcauagaacuggugcugcugugcagcgaaaaccauggccuaguggaggucucuggagacaggaucagcagccagggccaggcgaggcaccccauacucaggcauucggcgaauggccuuggggccaggagcucggcuccagggcgccaggccugggaggggacgcgggcaguccggcuccacccuuccacucaucaucauaucgcauuucacuggccggugucgaacccucccuggugcaagcagcccuuggucagcuggugcgacuguccugcucugaugacaccgccccagagagucaggcugccuggcaaaaggaugggcaaccaauuaguagugaucgacaucgccugcaauucgauggcucccugauaauccacccucuucaggcggaggaugccggcacuuacaguugcgguaguacuagaccagggagagauucccagaagauucagcugcguaucauuggcggagacauggccguccuuucugaagcagaguuaaguagauucccacagccucgugacccugcacaggacuuuggacaagccggagccgcagggccccugggggccaucccuuccagucauccccaacccgcuaacaggcuccggcuggaucagaaccagccaaggguaguugaugcuagcccagggcagcgcauccggaugaccugucgcgcugagggguuucccccuccugcaauugaguggcagagggaugggcagcccgucaguaguccuuccacucacaggccugcucagggacccuggcaggggcugcgacguccugcuagagcuggucagcuguag

SEQ ID NO: 12571 - RNA, 405 nt, Artificial Sequence
  Description of Artificial Sequence: Synthetic coding sequence
augaaaaguguacuccugcuuaccacacuacugguaccggcucauuugguugcagccuggaguaacaauuacgccguagauugcccucagcauugcgauuccagugaguguaaaagcuccccaagaugcaaacgcaccguguuggaugacugcgguuguugucguguuugcgccgccggacgcggggagaccuguuauagaacggucagcgguauggauggaaugaaaugcggccccggacugagaugccagccuucaaauggcgaagaccccuucggcgaagaauuuggcauuugcaaagaacaugauauggccucuggugacggcaauaucgugagagaagaggugguuaaagaaaaugcggccgggagucccguuaugcgaaaauggcuuaauccccgauag

SEQ ID NO: 12572 - RNA, 555 nt, Artificial Sequence
  Description of Artificial Sequence: Synthetic coding sequence
augaaaucagugcugcugcuaaccacacugcuggugccagcacacuuaguagccgccuggagcaauaauuaugcugucgauugcccccaacacugugacagcagugagugcaaauccagcccccgguguaaacggacuguauuggacgauuguggauguuguaggguuugcgcugccggccgcggagagacauguuaccggacaguaagcggaauggaugggaugaaaugugggccuggauuacggugucagcccucuaacggcgaagaucccuucggggaggaauucggcaucugcaaagauugcccuuauggaaccuuuggcauggacugucgggaaacauguaacugccagucuggaauuugugacagaggcacugguaaaugcuugaaauuucccuuuuuccaguauucugugacuaaaucaucaaauagguuuguuucauuaacagaacaugauauggcaucuggugacgguaacauugugagagaggagguuguuaaagagaaugcugcuggcucacccgucaugcggaaauggcugaauccccguuag

SEQ ID NO: 12573 - RNA, 597 nt, Artificial Sequence
  Description of Artificial Sequence: Synthetic coding sequence
augccaauucccgccucgccucugcauccaccacuaccgucacugcucuuguaccuauugcuugaguuggccggggucacacauguuuuucacguucagcaaacagaaaugagucaaacugucagcacaggggaguccauuauucuuaguugcagcguccccaauacacugccuaacggccccguucugugguucaaagggaccggccccaaucgcaagcucauauacaacuuuaaacaaggcaauuucccuagggugaaagagauuggcgauaccacaaagcccgguaacacugacuucuccacuaggaucagggaaaucucacuggcugacgccggaaccuauuacugugugaaauucauuaaggggcgcgccauuaaggaguaccagucugggagaggaacccaggucuuuguaaccgccgaacagaacccccggccccccaagaaccgccccgccgggagagccggcucuagagcucaccacgacgcacauaccugucugagcgcucugcccgagcgaaacuccacaaacuacuuuguucagcccuguuguugucugcgucuucugggcuuaacaggcuugcucaguaaguag

SEQ ID NO: 12574 - RNA, 594 nt, Artificial Sequence
  Description of Artificial Sequence: Synthetic coding sequence
augcccauaccugccuccccacuccaucccccucuuccgucguuauuacucuaucuguuacuugaguuagcuggggugacacacgucuuucacguucagcagacagagaugucccagaccgugucuacuggcgagagcauaauccuuucaugcucaguacccaacacucucccaaauggacccgugcugugguuuaaaggaaccggccccaauagaaaacugaucuacaauuucaaacaaggaaauuucccuagggugaaggagauaggagauaccacuaaacccgggaauacagauuucagcacacgcaucagggagaucagccuggcugacgcuggcacuuacuacugcgucaaauuuauuaaaggacgagccauuaaggaauaucagagcggucgcggaacccagguguuugugacagagcagaacccccggcccccuaaaaacaggccugcuggcagagcaggauccagggcacaucaugacgcucauacuugccuaagcgcucuuccagaaagaaacaguacuaacuauuucguccagccuuguugcugucuccgccuucuggggcugacuggccuguuaagcaaauag

SEQ ID NO: 12575 - RNA, 1563 nt, Artificial Sequence
  Description of Artificial Sequence: Synthetic coding sequence
augacuacggaugauacagagguacccgcuaugacacucgccccaggucaugcagcacucgaaacacaaacacucagugcugaaacaucuagucgugcaaguacccccgccgggcccauaccagaggcugagaccagaggggccaagcguaucucuccagcccgcgagacccgcucuuuuaccaagacuagcccuaauuucaugguccugaucgcuaccagcgucgagacauccgccgccucagggaguccugagggugcaggcaugacuacaguccagacuaucacaggaagcgauccaagagaagcgaucuucgacacccucugcacugaugacaucagcgaggaggcaaaaacucugacaauggacauccugacgcucgcgcacaccaguacugaggcuaaagggcuaucaucagagucuucagcuucaucagacggcccccacccuguuaucacuccuagccgggccuccgaauccagcgccaguuccgauggaccacacccagucaucacucccucucgcgcgucagaaaguagcgcuuccuccgacggcccccauccagucauuacccccuccagagccagcgagagcucggcuagcucagacgggccacacccuguaaucacuccaaguuggagcccugguuccgaugucacacugcucgcugaagcacucgucacggugaccaacauugaggugaucaacuguagcauuaccgagauagaaaccacuacuucuucaauacccggcgcuagcgacaccgacuugaucccuacagaggggguuaaagccucuagcacaucagacccccccgcccucccagacucaaccaauacuaagccccacaucaccgaggugacugcaucugccgagacucucagcacugccgggacuacugaaucugccgcacccgacgcuacaaucggaacacccuugcccacuaacuccacuaucgagagggaggugaccgcuccuggggcuaccacacugaguggggccuuagccacaggaaauccuuuagaggaaacaagugcacuuucuguugagacuccaagcuacgucaaagucucuggugcagcuccaguguccauugaagcaggcuccgcagucggaaagaccaccuccuucgcaggcagcagugccagcagcuacucaccucuugaggcggcccugaaaaacuuuacaccaagcgagacacucaccaccgacauugccaccaaggguccuuucccaacuuccagagacccccuuccuagcgugccucccacuacuaccaacuccucucggggaacuaacuccacacuggcaaaaaucaccacaagugcgaaaaccaccaugaagccaccaacugccacccccaccacugcucggacucggcccacuacagacguguccgccggcgagaacggcgguuuccuucuacugcggcuguccgucgccuccccugaagaccugaccgacccgaggguugccgaaaggcugaugcagcagcugcaucgugagcuucacgcccaugccccccauuuccagguuucgcugcugagggugagaagaggauag

SEQ ID NO: 12576 - RNA, 600 nt, Artificial Sequence
  Description of Artificial Sequence: Synthetic coding sequence
augcucuggaggcaacucauauauuggcagcuccuugcgcuuuucuuuuuaccuuuuugucucugucaggaugaguauauggaguccccacagacaggcggccuucccccggacuguaguaaguguugccaccacgggaauaacggaaauaacggcgccacuggucacaagggagaaaaggguuaucccgguaucccaccugagcuucaaauugcuuuuauggcuagccucgcgacgcacuucaguaaccagaacagugggaucauuuuuucaucggucgaaacaaauauuggaaauuucuuugacguuaugacuggacgcuucggcgcacccgucuccggaguguauuuuuuuacuuucuccaugaugaaacacgaagacguagaagagguguauguauaucuuaugcacaauggaaauacuguguuuucaauguacuccuaugagaugaaggggaagucugacacaucaagcaaccacgccguacucaagcuggcaaaaggagacgagguguggcugcguaugggaaauggggcccuccacggugaccaucagagguuuaguacuuucgccggauuccugcuguucgaaacuaaguag

SEQ ID NO: 12577 - RNA, 960 nt, Artificial Sequence
  Description of Artificial Sequence: Synthetic coding sequence
augcucuggcgccaacucaucuauuggcagcuacuggcccuuuucuuucugccauucugccugugucaggacgaauacauggaagugucaggaagaacuaacaaagucguggccaggaucguucagagccaccagcagacggguaggucugguucuaggagagagaaggugcgggaacggucccacccgaagaccggcacagucgauaacaacaccucuacugaucuuaaaucccucaggccugaugagcugccccaccccgaggucgaugaucucgcacaaaucaccacauuuuggggacagagcccccagacagggggauugccuccggacuguucuaagugcugucauggggauuauucguuuaggggcuaucagggcccaccuggaccgccuggaccaccugggaucccugggaaucauggcaacaacgguaauaauggagccacgggacaugaaggugcaaagggagaaaagggggauaaaggggacuugggacccagaggagagagaggacaacauggcccaaaaggcgagaaaggguaccccgggauccccccagaacugcaaauugccuuuauggcuagccuggcuacacauuuuuccaaucagaacuccgggauuauauuuucuuccguagaaaccaacauuggcaacuuuuucgaugugaugacgggcagauucggcgccccugugucuggcguguauuuuuucaccuuuuccaugaugaagcacgaggacguugaggaagucuacguguaucugaugcauaacggcaacacagucuuuagcauguauucauacgagaugaaaggcaaguccgauacaucaucaaaucaugcuguccugaaacuggccaagggugaugagguuuggcugagaaugggcaacggggcucuucacggggaucaccaaagguucucuacauuugcagguuuuuuacuguucgagacaaaguag

SEQ ID NO: 12578 - RNA, 855 nt, Artificial Sequence
  Description of Artificial Sequence: Synthetic coding sequence
augacuaagucaucucuccggccacugcagaaacaaagcccccagacgggaggacugccaccugauugcuccaaaugcugucacggcgauuacucauuuaggggguaucaaggcccuccagguccgccuggaccgccagggaucccaggaaaucacggaaauaacgggaauaacggggccacuggacaugagggcgcuaagggcgaaaagggugauaagggagaucuuggaccucgcggggaacgaggccaacacggaccuaagggcgagaaaggauauccaggcaucccucccgaacugcagaucgcauucauggccagucucgccacacacuucucaaaucagaacucagguaucauuuucuccuccguggaaacgaacaucggcaauuucuuugacguuaugacaggacgguucggcgcccccgucucuggcguguauuuuuucaccuucucgaugaugaagcaugaggacguggaggaggucuauguguaucuaaugcauaacgguaauaccguguucaguauguauuccuacgaaaugaaggguaaaucugacacaucaucaaaucacgcagugcuaaagcuggcgaaaggcgacgaaguguggcuacgaauggggaacggagcucugcacggcgaccaucaacgauucucgaccuucgcuggauuucuguuauuugagacuaaaugccacggagagaccccugccggaccuagggacagugccgcgggaaaaaguaaggcauaccugugucaggcagaauggaucuggcccguccggaaacuucugccagucucauggccacguuaucaauuguuuggcuucgugagguggaaagaacaacacaucuag

SEQ ID NO: 12579 - RNA, 234 nt, Artificial Sequence
  Description of Artificial Sequence: Synthetic coding sequence
auggcuacaagauccgugcuccucgcuuuaguuguucuuaaccugcuguucuacgugcccccagggcgauccggaccaaacguuuacauucagaaaaucuuugccucaugcuggaggcugcagggcacaugucgaccuaagugccugaaaaaugaacaguauaggauucucugcgacaccauucaucugugcugugucaacccaaaguaccugccuauuuugacugggaaauag

SEQ ID NO: 12580 - RNA, 237 nt, Artificial Sequence
  Description of Artificial Sequence: Synthetic coding sequence
augaaccucugcuuaucugcucuucuguuuuuucucgucauucuuuugccguccggaaagggcauguucgguaacgauggugugaagguccgcacuuguacuucucagaaagccguguguuuuuucggaugcccucccggguaucgguggauagcauuuugccauaacauccugucuuguuguaaaaacaugacccgguuccagccaccucaagccaaagaccccugggugcauuag

SEQ ID NO: 12581 - RNA, 627 nt, Artificial Sequence
  Description of Artificial Sequence: Synthetic coding sequence
augggggcacagggggcccaagaaucuauuaaagcuauguggagggucccaggaacuacgagaaggcccgucaccggggaauccccggguaugcacagaccagaggcaauguuacuacuacuuacacuagccuuauugggaggccccaccugggcugguaaaauguacggcccuggaggcggcaaauauuuuuccacuacugaagauuacgaccaugagauuaccgggcuccgugucuccgugggucugcuguuggugaaaagcguucaagugaaacugggugauaguugggacguuaagcuuggagcacucgggggaaauacucaagaagucacucugcaacccggcgaauacauaaccaagguguucguugcuuuucaggccuuucucaggggcauggugauguacaccuccaaggacagauauuucuacuucggcaagcuggacggacagauaucuucugccuacccaucacaggagggccaagugcuugugggaauuuauggacaguaccagcugcuuggcauuaaauccaucggauuugaguggaauuaccccuuagaagaacccacuaccgaaccuccagugaaccuuaccuacagcgcuaacuccccugucggccguuag

SEQ ID NO: 12582 - RNA, 288 nt, Artificial Sequence
  Description of Artificial Sequence: Synthetic coding sequence
augaaauuccuccuccucguguuggcagcguuaggcuuccucacucagguuaucccagcuagugccgguggcucaaaaugcguguccaauacucccggcuacugucggaccuguugccauuggggggaaacugcccuguucaugugcaacgccagucguaaaugcugcauuucuuacucauuucugccuaagccagaccugccacaguugaucgggaaccacuggcagagccggcggagaaacacacagagaaaagacaagaaacaacaaacaaccguuacgagcuag

SEQ ID NO: 12583 - RNA, 339 nt, Artificial Sequence
  Description of Artificial Sequence: Synthetic coding sequence
auguuugugcucuuauacguuaccucuuucgccaucugugcaucaggucaacccagaggcaaccaacucaagggagaaaauuacucuccuagguacaucuguucgauuccuggauuacccggccccccagguccacccggagcgaauggauccccaggaccacauggucgaauuggccuacccggucgagaugguagagacggccgcaaaggggagaaaggggaaaaaggcacagcaggguuacgaggaaaaacaggcccacucggacuggcaggcgaaaagggggaccagggagagacuggcaaaaaaggaccuauagggccggaaggggagaaguag

SEQ ID NO: 12584 - RNA, 300 nt, Artificial Sequence
  Description of Artificial Sequence: Synthetic coding sequence
augggccuuuuuaugauuauugccauccuuuuguuccaaaagcccacagucacugaacaacucaaaaaaugcuggaacaauuacgugcaaggacauugucguaaaaucugucgugugaacgaagugccugaagcacuuugcgaaaaugggcgauacuguugucugaauaucaaagaguuggaagcuugcaaaaagauaacaaagccccccagaccuaagcccgcuacucucgcgcucacccuccaagacuacguuaccauuauugaaaacuuuccgagccuuaaaacccaauccacauag

SEQ ID NO: 12585 - RNA, 336 nt, Artificial Sequence
  Description of Artificial Sequence: Synthetic coding sequence
augaagucucuguuauuuacccucgcgguguucaugcuccuggcucagcuagucuccggcaacugguacguaaaaaagugucugaaugacguugguauauguaaaaagaaauguaagccagaggaaaugcaugucaaaaacggcugggcuaugugcgguaaacagagagauugcugcgugccggccgaccgacgugccaauuaucccguauucuguguccagaccaagaccacccgaaucucaaccguaaccgcuaccaccgcuaccacuacccugaugaugacuacagcuaguaugucuuccauggccccaacuccaguaucaccaacuggauag

SEQ ID NO: 12586 - RNA, 1698 nt, Artificial Sequence
  Description of Artificial Sequence: Synthetic coding sequence
auggaagacagcgauagcgcagccaaacagcugggccuggccgaagcagcugcuguggcagcugccgcagccguggccgcggccgcugcagcugccgccgguggcgaagccgaggaaccagugcuguccagggacgaggacagcgaggaagaugcagauucugaagcugagcgagagaccccacggguuacagccguggccguaauggccgccgaaccaggccacauggauaugggcgcggaggcucugccuggaccugacgaagccgcugccgccgccgcuuuugcugaagugacgaccgucacagucgccaacguaggagcugcagcugacaacguauuuacaaccucaguggccaaugcugcaagcaucaguggacacguucuuucuggcaggaccgcccuacagauuggcgauucccuuaacacugaaaaggccacccuuaucgugguccauacggaugguaguauuguagaaacaaccggccuaaagggaccagccgccccucucacccccgguccucagucuccacccacaccccuugccccuggucaggaaaaaggcgggaccaaguauaacugggaucccuccguauaugauagcgaacuaccaguccgaugcagaaauaucuccggaacacuguacaaaaauagacucgggucagggggacgcggccgauguauaaagcagggcgaaaauugguauaguccaaccgaguucgaagcaauggcaggcagggcuagcucaaaggacuggaagcgcagcauuagguacgcaggcagaccucugcagugcuugauccaggacgguauccugaauccccacgccgccucaugcaccugcgccgcauguugcgacgacaugaccuuguccggaccagucagguuguucgugccauacaaaaggcgaaagaaagaaaacgagcugcccacuaccccugugaaaaaagauagucccaaaaacauuacucugcuaccugcuacggcagcaacaacauuuacugugacaccauccgggcagauuaccaccuccggcgcucucaccuucgaccgcgcuuccaccguggaggcuacagcagugauuuccgaaagcccugcgcaaggcgauguguuugccggagccaccgugcaagaggcaagcgugcaacccccuuguagagccagccacccugaaccucauuacccuggguaucaggacucaugucagauugccccuuucccagaagccgcacugcccaccagucaccccaaaauuguguugaccucucugccagcgcuugcugucccaccaccaacacccacaaaggcagcccccccagcccuagucaacggucucgaacuaucggaaccccgaucuuggcucuaucuggaggaaauggugaauucccuuuuaaauaccgcgcagcagcugaagacgcucuuugaacaggccaagcaugccagcacauacagagaggcggccacgaaucaggcuaaaauucaugcugaugcagaacgaaaagaacaaagcugugugaauuguggacgggaggcuaugagcgagugcacagguugucauaaaguuaauuacuguagcaccuuuugucaaaggaaagacuggaaggaccaucagcacauuugcggccagagcgcagcagugacagugcaggccgacgaaguccacgucgcagaguccguuauggaaaagguaacuguguag

SEQ ID NO: 12587 - RNA, 471 nt, Artificial Sequence
  Description of Artificial Sequence: Synthetic coding sequence
augaacauucuuaugcugaccuuuaucaucuguggccuccuaacccgcguuacaaaagggagcuucgagccucagaaauguuggaagaauaaugucggacauugccgaagaagaugccuggacaccgagcgcuauauccugcuguguagaaacaaacugaguugcuguauuucuaucaucucucacgaguacacaagacgaccggccuuuccggugauucaucuggaggacaucacccucgacuauagugacguugauucuuuuaccgguagccccguuuccaugcugaacgaccucauuacauucgauacgaccaaguuuggcgagaccaugacaccagagacuaacaccccugaaacaacaaugccaccuucugaggcaacuacccccgagacgaccaugccaccauccgagacugcuaccucagagacaaugcccccccccagucagacggcccugacacacaacuag

SEQ ID NO: 12588 - RNA, 837 nt, Artificial Sequence
  Description of Artificial Sequence: Synthetic coding sequence
auggguggaccaagggcguugcucgcugcccuuugggcuuuagaggccgcugggaccgcugcccugcggaucggagcuuuuaacauccaguccuuuggcgauucaaaagucuccgaucccgccugcggcuccaucaucgcgaaaauuuuagcuggauacgacuuagcccuggugcaggaaguacgugaccccgaccugagugccgugagcgcccugauggagcagauuaacucuguuuccgagcaugaauauagcuucgucaguucccaaccucugggacgggaucaauauaaggaaauguauuuguuuguguacagaaaagacgccguuagcgugguugauacguaucuguauccugaccccgaggauguguuuuccagggaaccuuucgucguuaaauuuucugccccaggcacugcacagaaccuggugcugauuccccuccaugccgcaccccaucaggccguugccgaaauugaugcacuguaugacguauaucucgacgugaucgacaaauggggcaccgaugacaugcuguuccuuggcgacuuuaacgccgacuguuccuauguaagagcccaggauugggcggcuauuaggcugaggaguagugaggucuucaaaugguugaucccagauucagcagauacaacagucggcaauagcgacugugccuaugacaggauaguggcaugcggagcucgacuccgccgcucccucaagccucaaucagcaacaguucacgauuuccaggaggaauuuggucuggaucaaacucaagcacucgcaaucucugaccacuuucccguagagguaaccuuaaaguuccaccgcuag

SEQ ID NO: 12589 - RNA, 3039 nt, Artificial Sequence
  Description of Artificial Sequence: Synthetic coding sequence
auggcagaggcugcacuugaggcuguuaggagcgaacucagggaauuuccugcggccgcgagagagcuguguguuccacuggcggugcccuacuuagacaagccacccacgccucuccacuuuuacagggacuggguguguccuaacagaccaugcaucauucgaaacgcuuugcagcacuggccggcacuucagaaauggucucucccuuauuuccgcgcuaccguggggaguacugaagugucuguggcagucacacccgacggcuacgccgacgccguuagaggcgauagauucaugaugccagccgaacgacgccugccccucaguuuugugcuggauguguuagaggggcgugcacagcacccgggggugcuguaugugcagaaacagugcagcaaccucccaucugagcuuccgcaacugcuccccgaucucgaaagccacgugccaugggcuuccgaagcucugggcaagaugcccgaugccgucaauuucuggcuuggcgaggccgccgccguaaccucucuccacaaggaucauuaugaaaaucuguacugcguggucuccggugagaaacacuuucucuuccaccccccaucugauaggcccuuuauaccuuaugaacuuuacacaccugccacuuaccaguugacugaggagggcacauucaagguaguggacgaagaggcuauggaaaaagcagaagugucuagaacuuguuugcugacgguucgcgugcuccaggcucacaggcuuccgagcaaagaucuggugacccccagcgacugcuaugugacucuuugguugcccacagccuguucccacaggcuccaaacuaggacuguuaagaauaguucuuccccaguguggaaucagaguuuccacuuuagaauacaucgucagcugaaaaaugugauggagcucaaaguguucgaucaggaccugguuacaggcgacgauccaguucuaagcgugcuguuugaugcaggaacauugcgcgccggcgaguuuagaagagagucauuuucacuaucuccucagggcgagggucgguuagagguggaauuccgacugcagucccuggccgacaggggcgaauggcuggugucaaacggggugcuggucgcacgggaacucucuugccuacacguccagcuggaggaaacuggcgaccagaaaucuagugagcauaggguacagcuugucgucccagguucuugugaaggaccgcaagaggccagcgucggcacugggacauuucgguuucacuguccagcauguugggagcaagaacuuuccauucgacuccaggacgccccugaggagcagcugaaagcaccacugucggcucugccaucuggccaaguggugagauugguguuucccaccucgcaggagcccuuaaugagaguugaacuuaagaaagaggccggacuuagggaacuggccguacgacuggguuucggcccuugugcggaggaacaggccuuucugucccgaaggaagcaagugguagcggcggcccugaggcaagcccuucaacuugacggcgacuugcaggaggacgagauuccugucguggccaucauggcgacagggggcggaaucagagcuaugacuucauuguacggacagcucgccgggcugaaggagcugggguugcuggacugcgucaguuacauuacuggugcuuccgguagcacaugggcacucgcaaacuuguacgaggacccggaauggucucagaaggaccuggcaggccccacugagcuacugaaaacgcaggugacgaaaaacaaacuaggcguacuggccccuucacagcuucaaagauaccgacaagaacucgccgaacgcgccaggcucgguuauccgucuugcuuuaccaaccucugggcacugaucaacgaagccuuacugcacgacgaaccgcacgaccacaaguuauccgaccaaagggaggcacuaucacauggccaaaacccccugccaaucuacugugccuuaaacacgaaaggccaaagcuuaacaacguuugaguucggugaguggugcgaauucucgccuuaugaaguugguuucccuaaguacggugcuuuuauccccucggagcuguucggcuccgaguuuuucauggggcagcuuaugaagcgguugccugaaucccgcaucugcuuccuggaaggaauauggucaaaccuguacgccgcgaaucugcaggacucacucuauugggcuagcgagccgucacaguucugggauagaugggugaggaaucaagccaaucuggauaaagagcaggugccucuauuaaagaucgaagaaccccccuccacggcuggcagaauagcugaauuuuuuacugauuuacucacuuggcguccuuuggcccaggccacacacaacuuccuacggggguugcauuuucacaaagacuauuuucaacauccucacuucucaacauggaaggcaaccacacuugacgggcugcccaaccagcugacccccucagagccccacuuaugucuguuagacgugggcuaucuuaucaacacaucuugccuuccucugcugcagccaacgcgcgacguagacuugauuuugucacuggauuauaacuugcauggcgcauuucagcagcugcaguuacucggaagguucugccaagaacagggcauuccuuuuccccccaucagcccuagcccagaggaacaguuacagccaagggaaugucacacuuuuagcgauccaaccugucccggagccccugcaguuuuacauuucccccuuguuagugacucuuucagggaauauuccgcgcccgguguaaggcgaacacccgaagaggccgcagccggugaggugaaucugagcucuuccgauagccccuaccacuauaccaaggucaccuacagccaggaagauguggacaaacuucugcaccugacucauuauaacgugugcaauaaccaggaacaacugcuagaggcucugagacaggcagugcagcggcggagacaaagaaggccccacuag

SEQ ID NO: 12590 - RNA, 1548 nt, Artificial Sequence
  Description of Artificial Sequence: Synthetic coding sequence
auggcuuggccguacuuucuugauugucaccgauacuucacacgggaggacgaaggaugcuacgauccacuggaaaaacugcgaggcggucuggaagcugacgaggcucuuccuagcggccugccaccaaccuuuauccgcuucucucaccauucauacgcucagauggugcgaguacugagacgcacagccucaagaugugcgcauguggcacgcacauacagcauugguagaagcuuugacggcagggaauuauuaguuauugaguucagcucucguccuggccagcacgaacugauggaaccugaggucaaacugauuggcaacauccaugggaacgaaguugccggccgggagauguugaucuaucuggcccaauaucuuugcuccgaguaccugcugggaaacccgcggauccagcguuuguugaacaccaccaggauucacuuacuaccuucuaugaaccccgauggauaugaagucgccgccgcggagggggcgggguauaauggguggacgaguggccgccagaaugcccagaacuuggaucucaaccgcaauuuuccugaucuaaccagcgaauacuaccgccuagccgaaacucgaggagcacggucugaucacaucccgauuccacagcacuacugguggggaaagguugcccccgaaaccaaggccauaaugaaauggaugcaaaccauuccuuucgugcuuucagcuagccugcaugggggggaccuaguuguauccuaccccuucgauuucuccaaacacccccaggaagaaaagauguuuucacccacucccgacgagaagauguuuaagcugcugagccgggcguaugcggaugugcauccaaugaugauggauagaagcgaaaaucggugcggcggaaacuucuugaagagaggaucuauaaucaauggcgccgacugguacucuuucaccggaggcauguccgauuuuaacuaucuccauaccaacuguuuugagaucacuguagagcugggaugcguaaaauucccuccagaagaggcucucuacauccuguggcagcauaauaaagagucccuguuaaauuuugucgagaccgugcaucgaggcauaaaggguguggucaccgauaaguucggaaagccugugaagaacgcucgcauaaguguuaaggguaucagacaugacauaacuacugcuccugauggggacuacuggcggcuguugccucccgggauccacaucgugauagcacaggcccccgguuaugccaagguuaucaaaaaggugauaauuccugcccguaugaagcgagcaggcaggguggacuuuauacugcagccguuagguauggggccaaagaauuuuauucauggccugcgucgcacaggcccacaugacccguugggcggggccagcucccugggugaagcuacagagcccgacccucuucgcgccagacgccaaccguccgccgaugguuccaagccauggugguggagcuacuuuacaucccuuagcacucaucgaccacgcuggcugcucaaguacuag

SEQ ID NO: 12591 - RNA, 285 nt, Artificial Sequence
  Description of Artificial Sequence: Synthetic coding sequence
augcgcacccucgccauccucgccgccauucuccucguggccuuacaggcccaagcggagcccuuacaggcacgugcagaugaaguggccgcagcuccugaacagaucgccgcagacauucccgaggucguggucucacuggcaugggaugaaagucuugcaccaaaacacccgggcucuagaaaaaacauggcgugcuacugcagaauuccugccuguauugccggcgaacgacgguacgggacguguauauaccaaggcaggcugugggcguucuguuguuag

SEQ ID NO: 12592 - RNA, 420 nt, Artificial Sequence
  Description of Artificial Sequence: Synthetic coding sequence
augggaaacccagguggcgucggcuccgaacguaugagaguggcccgaaggacgagaaacgucugucguugccccagagccgcgggcccuggcgucccugaacccagagcugccccgcucccccuucucgcuauggcucccccccccgccuguagaucuccgaugucaccacccccuccaccucuguugcugcuacuccucagcuuggcuuuacugggcgcccgcgccagagccgaacccgccggauccgccguacccgcccagucccgccccuguguagacugccaugcauuugaguucaugcagcgagcacuccaggaccucagaaaaacagccugcagucucgacgcccgcacagagaccuuauugcugcaagccgaacgucgggcgcuaugugcgugcuggccugcaggccacuag

SEQ ID NO: 12593 - RNA, 471 nt, Artificial Sequence
  Description of Artificial Sequence: Synthetic coding sequence
auggcccccgccgugacuagacuucuguucuuacagcucgugcugggaccaacccuuguaauggacauaaagaugcagaucgguucuaggaauuucuacacccugaguaucgauuauccccgcguaaacuauccaaagggguuccgcgguuauuguaaugggcucauguccuauaugcgcggaaaaaugcaaaacagcgacugcccgaaaauccauuaugugauacaugcuccuuggaaagcgauccagaaguuuuguaaauacuccgacuccuuuugugaaaacuauaacgaguauuguacacugacacaagauucucugcccaucaccgucugcucccuuucacaucagcagccaccuaccucuugcuacuauaacucaacauuaaccaaccagaaacuauauuuacuaugcucaagaaaguaugaagcagauccgaucgguaucgccggccuguauagcgggaucuag

SEQ ID NO: 12594 - RNA, 444 nt, Artificial Sequence
  Description of Artificial Sequence: Synthetic coding sequence
augaucauuaugguaauuaucuuucucguguuacuuuuuugggaaaacgaagugaacgaugaagccgugaugagcacauuggaacauuugcacguggauuacccgcaaaacgaugugccaguccccgcuagauacugcaaccacaugauaauucaacgcgugauucgagagcccgaccauaccugcaagaaagaacacgucuuuauccaugagcguccaaggaaaaucaauggcauuuguaucucaccgaagaaaguagcaugccagaaccugucugcaauuuuuuguuuccagagcgagacuaaauuuaagaugacagugugucagcugauagaaggcacaagguauccugccugucgcuaucacuacaguccuacggagggcuuuguccuggucaccugugacgaccugcggccggacucauuccugggcuacguuaaauag

SEQ ID NO: 12595 - RNA, 453 nt, Artificial Sequence
  Description of Artificial Sequence: Synthetic coding sequence
augagauucauggccggccccgccggaucccaaucucucggaccucuuugcuuccauucuucaccccaagcccuguacacggugcugcuuauagugcuugucaugaugucuuuaguauuugggaaguuuguucccguuaacugggaaccaccucaaccacucccuuucccuaaauaucugcgaugcuacagaugccugcucgagaccaaagaacuuggaugccugcuggguuccgacaucugccucacacccgcgggcagcucaugcauuacuuugcacaaaaagaacuccucagguucagacgugauggucuccgacuguaggagcaaggagcaaaugucugacuguuccaauaccaggacaagcccugucucuggauucuggauuuucucccaauacuguuuuuuagacuuuuguaaugauccucagaauagaggacuguacacuccauag

SEQ ID NO: 12596 - RNA, 2742 nt, Artificial Sequence
  Description of Artificial Sequence: Synthetic coding sequence
augggacccgaagcccuaucuagucugcuacuucuccuccucguggcaaguggggaugcagauaugaagggccauuucgauccagcuaaguguagauaugcacugggcaugcaggauaggacaauccccgauucugacauaucugccucauccagcuggucugacagcaccgcugcuagacauucuagauuggaguccucagauggagauggcgccuggugcccagcagguuccgucuuuccuaaagaggaagaguaucugcaaguggaucuccagagguuacaucugguugcccuggucggcacccaggguaggcacgccggcgggcuagggaaggaguucucaagaaguuauagacugagauauucacgggacggcaggcgauggaugggcuggaaggauagauggggacaggagguaauuucaggcaacgaggaccccgaaggcgugguacucaaggacuuagggccacccaugguggcucggcuggugagauucuacccucgggccgaccgcguaaugagcgucugucuaagaguggaauuguacggaugucuguggagggacggacugcuuucauauaccgccccugugggacagaccauguaucucagcgaggccguguauuuaaacgauagcacguaugauggacauacugugggaggacuucaguacgguggucugggucaacuggccgacggugugguuggccucgacgacuuuagaaaaucccaagagcugagaguguggccuggguacgauuauguggguuggaguaaccauucuuuuucaagcggcuacguggagauggaguucgaauucgauagacugcgggcuuuucaggccaugcagguucacugcaauaauaugcauacccugggcgcccgucuuccaggagguguggaauguagauuccggcgcggcccagcgauggccugggagggggagccuaugcgccauaaucuggguggcaaucugggcgacccgcgcgcucgcgccgugagugugccucucggcggacguguggcccgguuccugcaaugucgcuuucuguuugcugggcccuggcuccuguuuagcgagaucucauucaucagcgacgugguaaacaauucauccccggcauuaggcggaacauuuccuccugccccuugguggccaccaggcccaccaccuacaaauuucaguucacuggagcucgaaccaagggggcaacagccaguugccaaagcagaaggcagccccacagcaaucuugaucgggugucugguggccaucauucuucuccugcuucugaucaucgcacucauguuauggcgcuugcauuggaggcgucugcugucgaaggcugaaagaagaguuuuggaggaggaguugacugugcaccucuccguaccuggcgauaccauacucauuaauaaccgcccagggccuagagagcccccucccuaccaggagccucggccacgggggaaccccccucauucugcacccuguguuccaaacggaagcgcccuccuguuaucaaauccggccuaccggcuacuauuagccaccuaugcaagaccacccaggggaccaggucccccuacgccagcaugggcuaagcccacgaacacucaagcauauucuggcgacuauauggagccugagaagccaggcgcaccccugcugccucccccaccucagaacuccgugccccauuaugccgaagccgauaucgugacccugcaaggagucaccggggguaauaccuaugcugugcccgcucucccuccuggagcugucggagauggaccaccccggguggacuuuccacggucccggcuuagguucaaagaaaaauuaggcgaagggcaguuuggcgaaguucauuuaugugaaguugacucuccucaagaucuugucucucuggauuucccacuaaacgugcgaaaaggacacccccuacucguagcuguuaagauccugaggccugacgcuaccaagaacgcccgcaacgacuuucucaaagagguuaaaaucauguccaggcugaaggaucccaauauuauacggcuucucgggguuugcgugcaggacgauccucuguguaugaucaccgacuacauggaaaacggggaucuuaaccaguuccucagcgcucaccagcuggaagacaaggcugcugagggagccccuggggacggacaagccgcucaggguccgaccaucucguaccccaugcuacuacacguggcagcacagaucgcaucagguaugcguuaccuggcuacccucaacuucguucaccgcgaccucgcuacacgcaauugccuugucggagagaauuuuacaauuaagaucgccgauuucggcaugucuagaaauuuguaugccggagacuauuacagagugcaggguagagcaguccugccgauccgguggauggcuugggaaugcauccucaugggcaaauucacuacggccuccgacgugugggccuuuggugugacauugugggagguccuuaugcucugucgcgcacagcccuuuggucagcugacugacgaacagguaauugaaaaugccggagaguuuuuuagagaccagggccgccaaguguaccuuagccggccuccagcgugcccgcagggacuguaugagcuuaugcugcgguguuggaguagggaaagugaacagagaccaccauucagccaguuacaucguuucuuggccgaggacgcauugaacacaguauag

SEQ ID NO: 12597 - RNA, 453 nt, Artificial Sequence
  Description of Artificial Sequence: Synthetic coding sequence
augcgguuuauggcgggcccagccggcucccaguccuuagggccccugugcuuucauagcucuccccaggcccuguacacagugcugcugaucguguuaguuaugaugucuuuaguguucgguaaauuuguaccagucaacugggaaccaccucagccgcucccuuuucccaaguaucugcggugcuacagaugucuguuagagacaaaggaacuggguugccuccucggcuccgauaucugucugacuccugcuggcaguuccuguaucacucugcacaagaaaaacaguuccggcucugacguuaugguguccgauugcagaucaaaagaacaaauguccgauugcucuaacacacgcaccucaccagugucaggauuuuggaucuuuucucaguauugcuucuuagacuuuuguaacgauccacaaaauaggggcuuguacacuccguag

SEQ ID NO: 12598 - RNA, 567 nt, Artificial Sequence
  Description of Artificial Sequence: Synthetic coding sequence
auguuucaccaaauaugggccgcucugcuuuauuuuuacgggaucauacugaauuccauuuaucaguguccugagcacucacagcugaccacucugggagucgaugguaaagaguucccagaagugcaucucggccagugguacuuuaucgcuggugcugcuccaacuaaagaagagcuggccaccuucgacccaguggacaauaucgucuuuaacauggccgcaggcagcgcaccaaugcaacuccacuugagagcuacaauucggaugaaagauggauuaugcgugccccggaaauggauuuaccaccugaccgagggcucuaccgaucugagaaccgagggcagaccagauaugaaaacagaauuguucucauccagcuguccgggcgggaucauguugaacgaaaccggccagggcuaccaacgcuuucuacuuuacaaccgauccccccacccucccgagaagugcguggaagaguucaaaucccugacgaguugccuugauagcaaagcuuuucuguugacaccucgcaaccaagaggccugcgaacuuuccaauaauuag

SEQ ID NO: 12599 - RNA, 2535 nt, Artificial Sequence
  Description of Artificial Sequence: Synthetic coding sequence
auggguccaggcgcaccuuuugcaagagugggauggccacugccacuccucguugucauggcagcuggcguugcacccguaugggcuucacauucuccucaccugccuaggccacauagucgaguuccuccccacccuucuucagagcgaagagcuguuuauaucggugcacucuuuccgaugaguggcggcuggccuggggggcaggccugccagcccgccgucgagauggcuuuagaggacguuaauucaagaagagauauucugcccgacuacgagcugaaacuuauccaucacgauaguaagugcgauccgggccaggcgacaaaguaccucuaugaacugcucuacaaugacccuauuaagauuauucugaugccugggugcaguagugugucuacucugguggcugaggcagcacgcauguggaaccuuauaguucucagcuauggaaguuccucccccgcccucagcaaucggcagagauuucccacauucuuuaggacacaccccagcgcuacacuccauaauccuacacggguuaagcuauuugaaaaguggggcuggaaaaaaauagcgacaauccaacagaccacugagguauucacauccacucuagaugaccuugaagagcgaguaaaagaggccggcauugaaauuacguuuaggcagucuuuuuuuucugaucccgcggugccggugaaaaaccugaaaaggcaggaugcccgaauuaucgugggacucuuuuaugaaaccgaagcccggaaaguguucugcgagguuuacaaggagagacuguucggaaaaaaauacguaugguuccuuaucggaugguaugccgacaauugguuuaagauauacgacccgucgaucaauugcacuguggacgagaugacugaagcaguggagggccacauuaccacggagaucguuaugcucaauccugcgaacacgcgaucaaucucaaacaugacaucccaagaauucguggaaaaguugaccaagagacuuaagcgccaucccgaggagaccggugguuuccaagaagcaccucuggccuaugacgcuaucugggcucucgcccuggcucucaacaagacgucugggggaggaggucgcaguggcgugcgccucgaagauuuuaauuauaacaaccagacaauuacagaccagaucuaccgagcuaugaauuccucuuccuucgaaggcgugaguggccacgugguguuugaugcgucaggaagucguauggcauggacccugaucgaacagcuccagggggggagcuacaagaagaucggauacuaugacucaacuaaggacgaccugagcuggucaaagacagauaaguggauuggagggagcccaccugccgaccagacucugguuaucaagacauuuagguuucucagccagaaacucuucaucuccgucucagugcuuucuucucuuggcaucgugcucgccguggugugccucuccuucaauauuuacaacucccauguucgauacauucaaaacagccagccaaaucugaauaaccuuaccgcggugggguguucucuggccuuagccgccguguuuccacugggccuugacggauaccauauuggcagaaaccaguuucccuuuguuugccaggcucgucuauggcuacugggucucggcuucucccuggguuauggcucaauguuuaccaaaauuugguggguacauacaguuuuuacaaaaaaggaagaaaagaaggaguggagaaaaacacuggagccuuggaaacuguacgccacagugggccuguuggugggcauggacgugcucacucucgccaucuggcaaauuguggauccucuucauaggacaauagaaaccuucgcgaaggaggagcccaaggaggacaucgauguaagcauucucccacagcuggagcauuguucaagucgcaaaaugaauacguggcuggggauauucuacggcuacaagggccuguuauugcuccuggguauuuuccucgcauacgaaacaaaguccguauccaccgaaaaaaucaaugaucaucgagcgguggguauggcuauuuacaacguggcuguucucugucugaucacagcuccugucaccaugauccugagcucccagcaggaugccgcguuugccuucgcuaguuuggcaauagucuucucaucauauauuacccugguagugcuguucgugccuaaaaugcgccggcugaucacgcgcggugaauggcagagcgaagcacaagacacuaugaagacagguucuuccacaaacaacaaugaggaggaaaaaagcaggcuguuagagaaagagaacagagaguuggagaaaauuaucgcagagaaagaagaaagaguaagcgaguugagacaccagcuccaaucuaggcagcaguugcggucccggaggcauccgccaacacccccugagccuagugguggucucccccgugggccaccugagcccccagacagacucagcugcgacggaaguagaguccauuugcuguauaaauag

SEQ ID NO: 12600 - RNA, 237 nt, Artificial Sequence
  Description of Artificial Sequence: Synthetic coding sequence
augggcagcggacugccccucguccuccuguugacccugcuugggagcucucacggcacaggucccgguaugacacugcaacuuaagcugaaggaguccuuuuuaaccaauaguucuuacgaaagcagcuuucucgagcuacuugaaaaacugugucuguuguuacaucuacccucaggaacauccguaacucuccaccacgccagaagccaacaccacguggucugcaauacauag

SEQ ID NO: 12601 - RNA, 2700 nt, Artificial Sequence
  Description of Artificial Sequence: Synthetic coding sequence
augcuauuacuccuccuucucgcucccuuauuuuugaggccacccggugccggcggagcccagacaccgaacgccacuuccgagggaugucagaucauucacccccccugggaagggggaauccguuauaggggccucacucgagaccagguuaaagcgauuaauuuucugccuguggacuaugaaaucgaguaugucuguagaggggaacgcgagguggugggcccuaaaguacggaagugccuugcaaacggcagcuggacagauauggauaccccuagccgaugcgugaauagaacgccacacagugaacggcgggccguauacaucggugcuuuguucccgauguccggcgguuggccaggaggccaagccugucagccggccguggaaauggccuuggaggaugucaauagucggcgcgauauucucccagacuacgaauuaaaacugauccaucacgauagcaaaugcgaucccggccaggccacaaaauaccuguaugaacuccuguacaacgacccaauaaaaauaauucucaugccaggaugcuccuccgucucaacgcucguggcggaggcagcacggauguggaaucugauuguccucagcuacggcuccuccuccccugccuuaaguaaccgccagcgguucccuaccuuuuucaggacucacccuagugcuacacugcauaauccaacuagagucaaguuguuugagaaguggggauggaagaagauagcuacgauucaacagacgacagaaguguuuacuagcacucuugacgaucuggaggagcgagugaaagaagcugggaucgagaucacauuucgccagucuuucuucagcgauccugccgugccugugaagaaucucaaacgccaggacgcccgcauuaucguggggcuguuuuacgagaccgaagcuagaaagguauuuugcgaagucuacaaagagcggcucuuuggaaagaaauaugugugguuucugaucggcugguacgccgacaacugguucaaaauuuacgacccaucaauuaacuguacuguugacgaaaugacugaggcagucgaagggcauauuacaaccgagauugugaugcugaaucccgcuaauacucguagcauuucaaauaugaccagucaagaauuuguagagaaguuaacgaagcgacuuaagcggcacccagaagaaacggguggcuuccaggaggcaccucuugcuuaugaugccauaugggcacucgcacucgcuuuaaacaagaccuccggaggaggcggcagauccggcgugaggcucgaagauuucaauuauaacaaccaaaccaucacagaccagaucuauagagccaugaauucaagcuccuucgaaggcgucucuggacacgucguguuugacgccucggggucacggauggccuggacacugauagagcaguuacaggggggcucuuacaagaaaauuggauacuacgacucuaccaaggacgaucucaguuggaguaaaaccgauaaguggauaggggggagcccuccggcggaccagacucuugugaucaaaaccuuuagauuucugagccagaaacuguucaucucagugucagugcuaagcagcuugggcauagugcucgcaguggugugccucucuuuuaauaucuauaauucucacgucagauauauccagaacagccagccaaaucugaacaaccuuacugccguaggcuguagucuggcccuugccgccguguuuccacuuggacuggaugguuaccacauuggaaggaaucaguuuccauuuguaugccaagcgaggcugugguugcucggacuggguuucucccugggguacggauccauguucaccaaaaucugguggguccauaccguguucacuaaaaaggaggaaaaaaaggaauggcgaaagacccucgaaccauggaaacuguacgcaacagugggacuuuuagugggcauggacguuuugacuuuggcuaucuggcaaauuguugacccccuucaccgaacgauugaaaccuuugccaaagaggagcccaaagaggauauugaugugagcaucuuaccccaacuggaacacugcaguucacggaaaaugaacacuuggcugggaaucuuuuacgguuauaaagggcugcuccuuuuauuaggcaucuuuuuagcuuacgagaccaaaucuguuucaacggagaagaucaacgaccaccgggcagugggcauggcuauuuacaaugucgccguauugugccuuaucacugcacccgucacuaugauuuugucuagccagcaagaugcugccuucgccuuugcauccuuagcgauaguguuuucauccuauaucacccuugugguccucuuugugcccaaaaugagaagguuaaucacucgcggggaguggcaaucagaggcgcaggacacuaugaagaccggcucaagcacuaacaauaaugaagaagaaaaaucucgacugcuggaaaaggaaaaucgcgagcuugagaaaauuauugcugaaaaagaggagcgagucagugaguuacgccaccagcuccaguccagacaacaacugcgaucucggagacacccucccaccccaccugagcccagcggcggccugccaagggguccaccggagccucccgauaggcuuaguugcgacggauccaggguucaucugcuguacaaauag

SEQ ID NO: 12602 - RNA, 2886 nt, Artificial Sequence
  Description of Artificial Sequence: Synthetic coding sequence
augcuacuuuuacuccuacuggcucccuuauuccugcgcccgcccggggccggaggugcccagacgcccaacgccacuucugaggguugucagauaauacauccgccaugggaaggaggcauucgguacaggggucugacacgcgaucagguuaaagccaucaauuuucuccccguagauuaugaaauugaguaugugugccgcggcgaaagagaggucguugguccuaaaguucggaaaugucuggcgaauggcucuuggacugacauggauacuccgagcagaugcguucggaucuguaguaagagcuaccucacccuggagaacggaaaaguuuuccugacugggggugaccuuccugcacuggauggcgcacgggucgacuucaggugugauccugauuuucaccuggucggcaguuccagguccauuuguucucaaggccaguggucuaccccgaaaccccauugucagguuaaccggacgccucacagcgaaagaagggcuguguacauuggcgcccuguucccuaugaguggcggcuggccgggagggcaggcaugccagccugccguggaaauggcccuggaagacguaaacagccgacgggauauacuccccgauuaugaauugaaacugauccaucaugacuccaaaugcgaucccggccaggcaaccaaauacuuauaugaguugcucuauaacgauccuauuaaaaucauccuuaugcccggauguucaucuguguccacccuugucgccgaagcagcacggauguggaaccucauaguucucagcuauggaucuagcaguccugcacuuagcaauagacagcgguuucccacauucuuccgcacucacccuagcgccacgcuccacaacccaacuagggucaaacuguucgagaagugggguuggaagaagaucgcaacuauccaacagacaacugagguguucaccucuacauuagacgaucuggaagagcgcgugaaagaagcugggauagagauuaccuuucgccagagcuucuucagcgacccagccguccccgugaaaaaucugaaacgacaggaugcucggaucauugugggucuguucuaugaaacugaggcucggaaaguuuuuugcgaaguguacaaggagagacuauuugggaagaaguaugucugguucuuaaucggcugguaugcagauaacugguuuaagauuuacgaccccagcauuaauugcacugucgaugagaugaccgaggccguggagggucauaucacuacggagaucgucaugcugaacccagccaauacaaggaguauuagcaauaugaccagccaggaguuuguugagaagcuuacgaagagauuaaaacggcaccccgaggagacggggggguuccaggaagcgccuuuggcauaugaugcuaucugggcauuagccuuagcacugaacaaaaccuccgggggagguggcagguccggaguucgccuugaggacuucaacuacaacaaccagaccaucacagaccagauuuaucgcgcuaugaacucuuccaguuucgaaggcgugucaggacaugucguguucgaugcuucggggagcaggauggccuggacucuaauugagcaacugcagggaggcuccuacaagaagauuggguacuacgauucuaccaaggacgauuugucauggucgaagacugauaaauggaucggaggaucuccuccugcggaucagacccuggucaucaaaaccuuucgcuuucucucccagaaacuguuuaucuccgucucagugcugagcucuuuaggaauuguucucgcuguugugugccugucauucaacauuuacaauucucauguaagguacauucaaaauucccagcccaacuugaacaaccuuacggccguggguuguucgcucgcccucgccgcaguguucccacugggacucgauggguaccauaucggcagaaaccaguuuccuuuugucugccaggccaggcuuugguugcuaggccugggauucucccucggguaugggucaauguucaccaagaucuggugggugcauacaguguuuacaaagaaggaggagaagaaagaguggcgaaaaacccuugaaccauggaaacucuacgccaccguaggccuccuaguggggauggacgugcugaccuuggcuaucuggcaaaucguggauccacuucacagaacgaucgagacguucgcuaaggaagagccgaaagaagacaucgauguuuccauacuaccacaacuugagcacuguuccagccggaaaaugaacacauggcuugguauauucuacggguauaaagggcuacuguugcuccuuggaaucuuucuugcauacgaaacaaaguccguuuccaccgaaaagauuaacgaucaucgagccguuggcauggccauauacaacguugcugugcucugccugauuaccgcccccgugacuaugaucuugucaucccagcaggacgcagcauuugcguucgcaucccucgcuauugucuucucaucauauauaacuuuagugguguuauuugugccuaaaaugcgaagacuuaucacucguggagaauggcagucugaagcccaagauacuaugaagaccggaaguucgacaaauaacaaugaggaagaaaagagccggcuucuugaaaaagaaaauagagaguuagagaaaaucauugcugagaaagaggaacgcguaucagagcugagacaccaauugcagucuaggcagcaacuccgcaguagaagacauccuccaacaccgcccgagccauccggcggucugccucgagggccucccgaaccacccgacaggcugagcugcgacggguccaggguccaucuucucuauaaauag

SEQ ID NO: 12603 - RNA, 2535 nt, Artificial Sequence
  Description of Artificial Sequence: Synthetic coding sequence
augggaccaggggccccauucgcccgcguggguuggccccucccccuacucgucgucauggcggcuggaguggcuccaguaugggccagccacaguccccaccucccaaggccucauaguagaguacccccccacccauccuccgaacgccgggccgucuacaucggcgcucuguucccuaugucgggaggauggccagggggacaagcgugucaacccgccguagagauggcccucgaggaugucaauucuaggagagauauucuaccugacuaugaacucaaacugauccaucacgacagcaaaugugauccgggacaggcuacuaaauaucucuaugagcuccuuuauaaugacccgaucaaaauuauucugaugccuggaugcuccuccguguccacgcuuguagcagaagccgcuagaauguggaaccucauagugcucagcuauggcucaaguagccccgcacugagcaaucgacaaagguuccccaccuucuucagaacucauccaucagcaacacugcauaaccccaccagggugaaacuuuucgagaaguggggcuggaaaaaaauugcgaccauccagcagacuaccgagguuuuuacgucgacucuugaugaccuggaagagagggucaaagaagcggguauugaaaucaccuuuagacaaucuuucuuuagugaccccgccguuccggucaagaaccucaagcgacaggaugcccgaauaauuguaggccuguucuacgagacagaggcaaggaagguuuuuugcgaaguuuauaaagaaagacuguuuggaaaaaaguacguaugguucuugauuggaugguacgcagauaauugguucaaaaucuaugaccccuccaucaauugcaccguugacgaaaugacugaggccguugagggacacaucacaacagagaucguuaugcuaaacccugcuaacacucgcagcauuucaaauaugaccucccaagaauucguggagaaacugacaaaaagacucaagcgucauccugaagaaacagggggguuccaggaagcaccacuggccuacgaugccaucugggcucucgcacuggcacuuaauaaaaccucaggcgggggaggaaggucuggcguacgccuggaagauuuuaacuacaauaaucaaacgauuacagaccaaauuuaucgcgcaaugaauagcuccaguuucgagggcgugucaggccacguuguauucgaugcuucuggcagcaggauggcauggacacugaucgaacagcuucaggguggaucuuauaaaaagaucggauauuacgacaguaccaaggacgaccuguccuggagcaaaacagacaaauggaucggcggauccccgccugcagaucaaacccuugucaucaagacauuuagguuucuaucacaaaagcuguucaucuccgugucugucuugucgagccugggaauaguacuagcaguaguuugucugucuuuuaauaucuauaacucucaugugcguuauauccaaaacucacaaccuaaccugaacaacuuaaccgcggucgggugcucuuuggcucuugcugcaguguucccccucgggcuggacgguuaucauaucgggagaaaucaguucccuuuugugugccaagcccguuuaugguuguuaggcuugggcuucucucuagguuauggaucaauguuuaccaagaucuggugggugcacacuguguuuacaaaaaaggaggagaaaaaggaguggagaaaaaccuuggagccauggaagcuuuacgccaccguggguuugcucguuggaauggauguguugaccuuggccaucuggcagaucgucgacccccugcacagaaccauugaaacguucgcuaaagaggagccgaaggaggauauugacgugagcauacugccacagcuugaacauugcagcuccagaaagaugaacacauggcucggcaucuucuacggauauaaaggucuccugcuccuacugggcauauuucuggcuuaugaaaccaaaucuguauccacagagaagauaaaugaccauagggccgugggcauggcuauuuauaacguggcggugcugugccuuaucaccgcccccguuaccaugauccugagcucccagcaggacgccgcguucgccuucgccucacucgccauugucuucuccuccuauaucacccucgugguccuguucguccccaagaugaggagacuaauuaccagaggagaguggcagagcgaagcccaagauaccaugaaaacuggcaguucuaccaacaacaaugaagaagaaaaauccaggcuacuggagaaggaaaauagggaacuggaaaagauaaucgcggagaaagaagagcggguuagugagcugcgucaucagcugcaaagucggcagcaguuaaggucacggcgacauccgccuaccccaccugaaccuucugggggucugccaagaggcccacccgaaccaccagauagacuuuccugcgauggauccagagugcaccuacuuuauaaguag

SEQ ID NO: 12604 - RNA, 2535 nt, Artificial Sequence
  Description of Artificial Sequence: Synthetic coding sequence
auggggccuggugcccccuuugcccgcgugggcuggccacuuccccugcuugucguaauggccgccggcguagcucccgucugggccagucacucuccucaccugcccaggccgcacagucguguuccaccccaucccuccagugaacgucgcgcaguauacauaggagcuuuauuuccgaugagcggcggguggcccggaggacaggcaugucagccagcuguugaaauggcacuugaggacgucaauagcagaagagauauccuacccgacuacgagcugaaacugauccaccaugacaguaagugugaucccgggcaggcaacgaaguaucuguaugagcuuuuguauaacgaccccauaaaaauaauacucaugccgggcuguuccuccguaagcacacuaguggcggaggcagcuaggauguggaaucuuaucguccugaguuaugguucuucuagcccugcgcucucaaaccgccagagauuuccuacauuuuuucggacucacccaagcgcuacauugcacaauccuacgcguguuaaacucuuugagaaauggggcuggaaaaagaucgcaacgauccagcagaccaccgagguguuuaccucaacgcuggacgaccuggaggagcgugucaaggaagcaggcaucgagauuaccuuucgccagagcuuuuucagcgauccagcaguuccggugaaaaaccugaagcggcaggaugcccgaauuauagugggacucuuuuacgagacugaggcgcggaagguauuuugcgagguuuauaaggagcgucuguucggaaagaaguaugugugguuccugaucgguugguaugcugauaacugguuuaagauauaugaccccaguaucaacuguacgguggaugaaaugaccgaagcggucgaagggcauauaaccacugagauugucaugcucaacccugcaaacacucgcaguauuaguaauaugaccagccaggaauucguggagaaacugacuaaaagacugaaaagacacccagaagagacuggcggcuuucaagaagcaccccuggcuuacgacgccaucugggcccuggcccuggcacugaacaaaacaagcggcggaggcgguaggagcggggucagacuggaggauuucaacuauaauaaucaaacaaucaccgaucaaaucuaucgggcuaugaauaguaguucuuucgagggcguuagcgggcacgucguauuugacgcuagugggucuagaauggcauggacacuuaucgagcaguuacaggggggauccuauaagaaaaucggauacuaugauagcacaaaggaugacuuguccuggucaaagaccgacaaguggaucggcggcucacccccugcugaucagacccuggucaucaaaacuuucagguuuuugagucaaaaacucuuuaucuccguuagugugcuaucgagccugggcaucguacuggcagucgucugccugaguuuuaacaucuacaauucacaugugagauacauccaaaacucgcagccgaaucugaacaaccucacagcugucggcuguucucuugccuuggccgcuguauuuccucuggguuuggauggcuaccacaucggacgcaaccaguuuccauuugucugccaggcccguuuguggcugcuggggcugggcuucucauuagguuacggaucuauguuuacaaaaauuugguggguucauacuguguucacaaagaaggaggagaagaaagaguggagaaaaacacuggaacccuggaaguuauaugcgaccgugggauuacugguagggauggacgugcugacacuggcuauuuggcaaauuguugacccacugcauagaacaaucgagacauucgcaaaagaggagcccaaagaagauauagacgucagcauacuuccacagcuggagcacugcaguucucgcaagaugaauacauggcugggcaucuucuacgguuacaaaggccuucuguugcugcucgguauuuuccuggcguaugaaaccaaauccguuucuacagaaaagaucaaugaucauagggccgugggcauggcgaucuauaauguggcuguguugugucugauuacugcgcccgucaccaugaucuugucgagucaacaggaugccgccuuugcuuuugcgucucuugcaauuguguuuucuaguuauaucacuuuagucgugcuguucgugcccaaaaugcgccggcuaauaacccggggugaauggcagagcgaagcccaggacacuaugaaaacaggcucuaguacaaacaacaaugaggaggagaaaagcagacugcucgaaaaggaaaaccgcgaacuggagaaaauuaucgccgagaaggaggaaaggguuucggagcuccggcaucaguugcagagccggcagcaguugagaagccggcgccaucccccaacuccacccgagccgagcggaggacugccccgcgggccaccggagccaccugaucgccugucaugugacggaagccgcguccaccuccuguacaaguag

SEQ ID NO: 12605 - RNA, 2700 nt, Artificial Sequence
  Description of Artificial Sequence: Synthetic coding sequence
augcuuuugcuccuucuucucgcuccacuauuucucaggccgcccggagcaggaggugcgcagacacccaacgccacuuccgaagggugccagauuauccauccaccgugggaaggaggaauacgcuauagaggccugaccagagaccaggugaaagccauaaauuuccucccaguagauuaugaaauagaguaugucugccgcggugaacgugaggucgugggaccaaagguccgcaagugucucgcuaauggauccuggacggacauggauacaccaucuagaugcgugaacagaaccccccauagcgaacgcagagcaguuuauauuggcgcgcuuuuccccaugucgggcggguggccugggggccaggccugucaaccugccguggagauggcuuuggaggacgucaacagccgcagagauauccuaccagacuaugaacuuaagcucauccaccacgacagcaagugcgauccaggacaagcaacaaaguauuuauaugagcucuuguacaaugauccgauuaaaauuauacuuaugcccgguugcagcagcgucagcacccuuguugcagaggccgcccggauguggaacuugauaguucugucuuaugggucaagcucucccgcauuaagcaaccgccagcgauuccccacuuuuuuucgcacucauccaagugccacauugcauaaccccacccgcguuaaauuguuugaaaaguggggcuggaagaagauugccacgauccagcagacuacagaaguguucacaagcacacuggacgacuuggaagagcgaguuaaagaggccggcaucgagauuacauuuagacaaucguucuucuccgacccagccgucccugugaagaaucugaaacgucaagacgcucggauuauugucggccuguucuacgaaacugaggcacgaaagguguuuugcgagguuuacaaggagagauuauucgguaagaaguaugugugguuccuuauugggugguacgccgauaacugguucaaaauuuacgauccaagcauuaauuguacaguggacgagaugacagaggcuguggagggccacauuacuacggagauugugaugcugaacccugccaacacccgcagcaucuccaauaugacuagucaggaguucgucgagaagcugacgaagagacugaaaaggcauccugaggagaccgggggauuucaggaagcgccccucgcauacgacgcuaucugggcccuugcccucgcccugaauaaaacuagcggggggggcggucgcucuggcguccgcuuagaagacuucaacuacaacaaucaaacuauuaccgaccagauuuaucgagccaugaacuccaguaguuuugagggcguuaguggccacguugucuuugaugcauccggaucacgcauggcuuggacucugaucgaacaguuacagggggguucauauaagaaaaucggguauuaugacuccaccaaagacgaccugucauggucaaagacagacaaguggauagggggcucuccccccgcagaccaaacacuggucaucaaaaccuuucgauuucucagccaaaagcuguuuauuucggucuccgugcugucuucgcucggcaucgugcucgcagucguaugccuuucguucaacauauauaauucccacgugcgguacauucaaaauagucagccuaauuugaauaauuugacugccgucggauguucucuggcguuagccgccguguucccccuggggcucgacggcuaucacauugggagaaaccaauucccauucgugugucaggcacggcuguggcuacucggccuuggauucagccucggcuaugguagcauguucacgaaaauauggugggugcauacaguuuucacaaagaaagaggaaaagaaagaguggagaaagacgcuugaacccuggaagcuguacgcuaccguggggcugcuuguugggauggacgugcugacccuugccaucuggcagaucguggacccccuucacagaacuaucgaaaccuucgccaaggaggagccaaaagaagauauagaugucucuauucugccccagcuugagcacuguaguagcaggaaaaugaacacuuggcuagggaucuuuuauggcuacaaaggacugcuuuugcugcucggaaucuuucuggcauacgagaccaaguccguaucaacagaaaagaucaaugaccauagggccguaggaauggccauuuacaacgucgccguucugugccuuauaacagcccccgugacuaugauucugucaucucagcaggacgcagcuuuugccuuugccucacuugcuauaguuuuuuccagcuauauuacccuugugguccuguucguuccgaagaugcggcgucuaauuacucgcggugaguggcagucagaggcccaggauaccaugaaaacaggcucguccacuaauaauaacgaagaggagaagucgcggcuccucgagaaagagaaucgggagcuggaaaaaaucaucgcugagaaggaggaacggguuucugaacugcgccaccaguugcaaucaagacaacaauuacguucaaggagacauccucccacacccccugaacccucagguggacucccacggggcccuccugaaccaccagauaggcugaguugugauggcaguaggguucaucugcucuauaaauag

SEQ ID NO: 12606 - RNA, 2886 nt, Artificial Sequence
  Description of Artificial Sequence: Synthetic coding sequence
auguugcucuuacugcuucuggccccccuguuucugcgcccccccggagccggcggagcucaaacucccaacgcuacgagcgaaggcugucaaaucauccacccccccugggaaggcgguauucgguaucgaggcuuaacgagggaucaagugaaggccaucaacuuucugccaguggauuacgagaucgaauaugugugucggggcgaacgagaggucguugguccgaagguucgaaagugucuugcaaauggcaguuggacagauauggauacacccagcaggugugugaggaucuguucaaaaagcuaccucacacuugagaauggcaagguguuccugacagggggugaccuuccugcucuggacggagcuaggguagauuuucggugcgacccagauuuccaccuggugggguccuccaggucuaucugcagccaaggacaguggucuacgccuaaaccccacugucaagugaacagaacaccacauuccgagcgacgggccguguacaucggagcuuuauuuccaaugagcggaggauggcccggcgggcaagcaugucaacccgcugucgagauggcucuugaagauguuaauucaagacgcgacaucuugccugauuacgagcuaaaguugauacaucacgauucaaaaugugauccuggccaagccaccaaguaccuguacgaauuacuuuauaacgauccuauuaagauaauccugaugccaggguguagcucagugagcacacugguugccgaggcggcucgaauguggaaccugaucguuuuaucuuaugguagcucaagcccugcccucagcaaucgacagcgguuuccuacuuuuuucaggacccauccaucggcuacacuucauaauccuacaagaguuaaacuguuugagaaguggggcuggaaaaagaucgcuaccauccagcagacuaccgaagucuucacuagcacccuggacgaccuggaggagcgcgugaaagaggccgguaucgagaucacuuuccgacagagcuuuuucucagaccccgcagugcccgugaagaaucugaaaaggcaggacgcucgaauaauagugggccuguuuuacgaaacagaggcgaggaagguguucugcgaaguguacaaggagcgccuguuuggcaagaaauauguuugguuccuuaucgggugguaugcagauaauugguuuaagauauaugaccccagcaucaacuguacuguagacgaaaugacugaagcaguggagggacacaucacaaccgagauugugaugcuuaaucccgcgaauacuagaaguaucucaaauaugaccucccaggaguucguggagaaacugacuaaacguuuaaaacgccauccagaggagacgggcggcuuucaggaagcuccauuagccuaugacgccauuugggcucucgcgcuugcccuaaacaagacuucuggcggcggggggagguccggaguaagguuggaagauuucaauuauaacaaucagacuaucaccgaucagaucuaccgcgccaugaauagcucuaguuucgagggcguguccggccauguagucuucgaugcaucaggaucccggauggcauggacucugauugagcaacuucagggcgguucauacaaaaaaauuggcuacuacgauucuacuaaggaugacuuaaguuggucaaaaacugacaaguggaucggcggcaguccuccagccgaccagacucugguuauuaagaccuuucgguuccugucacagaaguuguucaucuccguuuccgugcuguccucucucggcaucguccuggccgucgugugccucagcuuuaauaucuauaauucccacgucagauauauccagaacucgcaaccuaaucucaauaaccugaccgcagugggaugcagucuggcacuugcagccguguuucccuuaggacuugauggauaccacaucggcagaaaccaguuuccauucgugugucaggcuagguugugguuauugggacucggcuucucccugggauauggcucaauguuuacuaaaauuugguggguccacacuguuuuuacuaagaaagaagagaagaaggaauggaggaagacgcuggaacccuggaagcuguaugccacugugggauuauugguggguauggauguccucacucuggccauuuggcagauagucgauccuuuacaccggacgauugagaccuuugccaaagaggaaccuaaggaagauauugaugugagcauccugccccagcuggaacauugcuccagcaggaagaugaauacaugguuagguaucuucuaugguuauaaaggguugcuguugcugcucggaauuuuucuggccuaugaaacaaagagugucaguacugagaaaauuaaugaccacagagccgugggcauggccaucuauaacgucgcgguccuaugccuaaucaccgccccaguuacuaugauccucagcagucagcaagaugccgccuuugcauucgcaagucuggcaauaguguucucuucauauaucacacugguuguuuuauuugugcccaaaaugaggaggcugauuacccgcggugaauggcaaagugaagcacaggacaccaugaaaaccggcagcucuacuaacaauaacgaagaagagaaaucccggcuauuagagaaagagaauagagaguuagagaagaucaucgcggagaaggaagaacgggugagcgagcugcgccaucagcugcagucuagacagcaguuacgcucuagacgccauccccccacaccaccugagccaagcggcggccucccuagaggaccgccugaaccccccgaucgucuaaguugugauggaagucggguacaccuacuuuauaaauag

SEQ ID NO: 12607 - RNA, 2535 nt, Artificial Sequence
  Description of Artificial Sequence: Synthetic coding sequence
auggggccuggggcaccuuucgcacguguggguuggccauugccacugcucguggucauggccgcaggagucgccccaguuugggcaucccauuccccucaccuuccccgcccacauucucgcguccccccacacccauccagugagcgccgcgccgucuacauuggcgccuuguuccccaugagcggcggcuggccuggcggccaggcgugccagccagcaguugagauggcuuuggaagacgugaauagccggagagacauucugccugauuaugaacucaagcuaauccaucacgacaguaagugugacccugggcaggcaaccaaauaccuuuacgaauuguuauauaaugauccaauuaagauuauccugaugccaggaugcagcucugucaguacguuaguagcugaagccgccagaauguggaaucugauaguacuuucauacggaucaagcagucccgcacugucaaacaggcagcgguucccuacauucuuuagaacucaccccucugcuacccuccacaacccuacucgugugaaacuauucgagaaguggggauggaagaaaauugcuacaauacagcagaccacagaggucuuuaccagcacccucgacgaccuggaagagcguguuaaggaggccggaaucgagauaacuuuccgccaguccuuuuuuagcgaucccgcgguaccuguuaagaaucucaagcgccaggacgcgaggaucauugucggccucuuuuacgaaacugaagcccgcaaagucuuuugugagguuuacaaggaaagacuguucggaaagaaguacguuugguuuuuaauuggcugguaugcagauaauugguucaagauuuaugacccaagcauaaauugcacgguggacgaaaugacagaagccguggaaggccauaucacuacagagaucguuaugcugaauccugccaacacucggagcauaaguaacaugacaucacaagaguucguggagaagcuuacaaagagacugaaacgccacccugaagaaaccggcggcuuucaagaggcuccccucgcuuaugaugcaauuugggcacucgcgcuugcacuuaacaaaacauccggugggggcgguagaaguggggugaggcuggaagacuucaacuacaacaaucagacuaucaccgaccagaucuaucgggccaugaacagcucgucauucgaggggguuucaggccacgucgucuucgacgccuccgggucccggauggccuggacacucauugagcaacugcagggagguagcuacaagaaaauuggauacuacgauuccacuaaggaugauuuguccuggucgaaaacggacaaguggauuggcggcagcccgcccgcggaccaaacacuggucauuaagacuuuucgauuccucucacagaaacuguucaucucuguguccguucuguccucucucggcaucgugcuggcaguggucugucuaucauucaauauuuacaacucccauguccgcuacauacagaacucccagccuaacuuaaauaacuugacugccgugggguguucgcuagcccucgcagccguuuucccccugggauuggauggauaccauauuggaagaaaucaauuccccuuuguuugccaggcccgguuaugguuguugggccugggguuuucacugggcuauggguccauguucaccaagauauggugggugcauacuguguucaccaagaaagaagaaaagaaagaauggcgcaaaacacucgagccauggaagcuuuaugccacugucggccugcuggugggaauggauguguuaacucuggcaauuuggcagaucguggacccucugcaccggacuauugaaaccuuugccaaagaggagccgaaggaagacaucgacgucucaauacucccccaguuggaacauugcuccagcaggaaaaugaauaccuggcuaggaauuuuuuauggguauaaagguuuacugcuguugcugggaauuuuccuggcauacgagaccaaguccgucucaacugagaaaaucaacgaucauagagccguggggauggccauauauaacguagcggugcugugucucauaaccgcuccugugacuaugauacugucgucccaacaggaugcugccuuugcguucgcaagccuagcaauuguuuucaguucuuacaucacacucguuguccuguucgugcccaagaugcggcgacuuauuacccguggggaguggcaguccgaagcucaagacacgaugaagaccggcucuagcaccaauaacaaugaagaggaaaagagucggcugcuugaaaaggaaaaccgggaauuggagaagaucaucgccgagaaggaagaacggguuuccgagcuccggcaccaguugcaaucacgucaacagcuucgcucuagacggcacccaccaacuccacccgaacccuccggggggcucccuagagggcccccugaaccucccgaucggcuaucaugugauggaucucggguccaucuacuguacaaauag

SEQ ID NO: 12608 - RNA, 3090 nt, Artificial Sequence
  Description of Artificial Sequence: Synthetic coding sequence
augcccccgacaaagagugugucugagccugucccuuuugaaacagaagcaccauccaugacaauaguucccacuacagacauugaacccgugacuguuagaacagaggccacagugacuacacuggcuccaaagaccagccagcgcaccaggacuagacguccuaggccaaaacauaaaacaacuccaagaccugaaacacugcaaacuaaacuggauuucgggcccaucacucccgggacuaguagcgcucccacgacaaccacuaagcggacucggcgcccccacccuaaacccaaaacuacaccccauccugaaguaccgcagaccaagcucgucccugccacgauccuggagcccgugcuucgcaccgaagcuuccgggacuacugccgugccugcuacuaucuucgagcccguaaguccuauuaaggaagccccugggacuacguuuguuccaguaacagaccucgaaccuguaacguuuagaacugaaauucccgccacaacacuugcaacuaagacauccaaaaggacaagaccuccccggccuaggccaaaaacaacgcccucuccucaagcuccugagaccaagcccguuccugcuacaguccuugagcccgucacucuucggcccgaggcgaguacaacacuggcaucaaaaacaagucagcgcacacgacgaccgcgacuuaggacgaaaacuacaccgcgcccagaggcuccugagagcaaaccaguuccuacagcugaacucaagccagugacucuucggacugagacaugggugaccacacaggccccuaagacuucacagagaacaaggcggccccguccgaagacaaaaacuaccccuucuccagaggugccucaaacaaagcuuguuccaagcaccgauuuagaacccggaacccuucggacagaagcgccaaaaacuaugguugugacuaccguguuagaaccagauacauuccgcaccaaguuccccgaaaccacccucgccccaaagacucagcgaaccagaagaccaagaccaaggccuaaaaccacuuccuccccagagguuccucaaaauaaaucugugagugugacgggauuugagcccguuguucauagcacagacgcacccgggaccaccuuugcuuuaacagaauugcagacucuuauucucaagcccgugacaagucccagccucgaaaugacugagagccagccgguuagcgauguauuggaaaguguaacacucucuaccgagagcccuaaggagaccaucgccccugccaaaacggauuauguuuacccuaccgccaaggcucccuuguggccggaggagccuaaaaccgaaguuguggaaucaaucacguacgugucagaaccucccgagacuacacucgagacaaguccgcucccgagccagucuaucacucugcccuccccugaugagccacagaccgagcccgccccaaaacagacgccaagggcuccgccaaagcccaaaacaagucccagaccacggauuccccaaacacagcccguuccaaaggucccacagcgagugaccgccaaacccaagaccucccccucucccgaagugucuuacacaacaccagcuccgaaagacguacuccugccgcauaagccauauccagaggucucgcaguccgagcccgcuccacuggaaacuagagggauuccuuuuaucccuaugauuucacccagccccagccaggaggaacuacagaccacucucgaggaaaccgaucagucuacacaggaacccuucacaacuaagauuccacgcacaaccgagcuggcuaagaccacccaagccccucacagguucuauacuaccgucagaccaagaacuucugauaaaccacacauuagaccuggagugaaacaggccccacgucccucaggagcagacagaaauguguccguugauagcacgcauccaacuaagaaacccggcacaaggagacccccacuaccuccucgccccacacauccccggcgcaagccucugcccccuaacaacguuacagguaagcccggcagcgcaggcaucauaagcagcggccccauaacgaccccaccucugagauccacuccucgccccacuggaacgccucucgagcggauugaaaccgacauaaaacagccuacagugcccgcuucaggcgaagaacuagagaauauuaccgacuuuuccucaagcccuaccagagagacagacccacuaggaaaaccacgcuuuaaaggcccgcauguucgcuauauucagaaaccggauaauuccccauguagcauuacugauagcguuaaacgauucccuaaggaggaggcaacugaaggaaacgccaccucccccccccagaaccccccaacuaaucuuacagucguaacaguggaaggaugucccuccuucgugauccuggauugggagaagccucugaaugauacggugacagaauacgaggugauaucucgggagaauggcucauuuucaggcaagaauaagagcauccagaugacgaaccaaacguucagcacgguggaaaaucuaaagccuaacacaucauacgaguuccaagucaaaccaaagaacccauugggcgagggaccugugaguaacacuguggccuucuccacugaauccgcugauccuagagugagcgagccaguuagcgcagggcgcgacgccaucuggacugagcguccuuucaacagugacaguuacagcgagugcaaaggaaagcaguacgugaaaagaacuugguacaagaaauucgucgggguucagcuguguaacucccucagauacaagauuuauuugagcgauucauugacggggaaguuuuauaacauuggagaucagcggggccacggcgaagaucauugccaguucguggacucguuccuugacggcagaacugggcaacagcuaacaagcgaccagcugccuauuaaagaggguuauuuccgcgccgugaggcaggagcccgugcaguuuggcgagauuggcggacauacucagaucaacuacguacaaugguaugagugcggcacgacaauuccaggaaagugguag

SEQ ID NO: 12609 - RNA, 2355 nt, Artificial Sequence
  Description of Artificial Sequence: Synthetic coding sequence
augaccauuguaccgacaacagauaucgagcccgugacaguacgcacggaagcuacaguaacuacccucgccccgaaaacgagccaacguacccggacccgccguccucggcccaaacacaagacaacucccagaccugagacacuccaaacuaaacuggacuucggaccaauuaccccaggcacaaguucugcgccuacaacuacaacaaaacggacacgaaggccucaucccaaacccaagaccaccccucaccccgaaguuccgcagaccaaguuagcgccgaaggugccucaaagaacccaucgaccgcacccgaagccaaagacuacuuugucucccgaggaacugcagacagaacugguuccaguuaccgaucucgagccugucaccuuccgcaccgagauccccgcgacaacacuggcgacuaagacuaguaagcguacgcggccucccagaccccgcccaaaaaccacgcccucaccccaggccccugaaaccaaaccugugcccgcaaccguacuugaaccagucacucuccgucccgaggcuucuaccacccucgccucuaagaccucacagagaacacgccgcccccggcugagaacaaaaacuacgccgagaccagaagcucccgagagcaagccagcuccaaaacagaccccaagggccccgccaaagccuaagaccuccccuaggccgcgcauuccccaaacucagcccgucccuaagguaccccagagagucacagcuaagccuaagacaucuccgucgccugaggucucguauacuacacccgcccccaaggauguguuacugccacacaagcccuauccugaggucucccagagcgaacccgcuccguuggagacgagaggcauccccuucauuccaaugauuagcccgucgcccucucaggaagagcuccagacuacccuggaggaaacagaucagagcacucaggagccuuuuacuacgaagauccccagaaccacugaauuggccaagacuacccaggccccucaucgauucuauacuacaguaagaccucgcaccucagauaaaccgcacaucaggcccguguuaaauagaaccacaacucgaccaacuaggcccaagcccagcggaaugccaucaggcaacggcgucgggacaggcgugaagcaggcuccaaggccuuccggggcagaccggaacguuuccguggauucaacccauccuacaaaaaaacccgggaccagaagaccaccacugccaccuagaccuacucauccacggagaaagcccuuaccaccuaauaacgugaccggaaagccaggauccgcgggcauuaucucaucaggaccuaucacuacuccuccuuugcgauccacaccgcgccccaccgggaccccauuggaaaggaucgagaccgacaucaaacaaccaacagugcccgcuagcggcgaagagcucgaaaacauaacagauuuuucuagcagucccaccagagagaccgauccccuagguaaaccuagguuuaaggggccacaugugagguauauucaaaagccagauaauuccccaugcucuauuaccgauucuguuaagcgguuucccaaagaggaggcuacugagggaaaugccacuuccccuccccagaaucccccaaccaaccugaccguggugaccguggaaggauguccgucauuuguuauacuagacugggaaaagccuuugaacgacaccgugacugaauaugagguaauaagucgggagaaugggaguuucucagguaaaaacaagagcauccaaaugaccaaucagacauuuucgaccguugaaaaccucaagccuaauacauccuacgaguuucaagucaagcccaagaacccccucggcgaaggacccgugaguaacacgguggcauucaguacagaaucagcagauccccgggugucugaaccugugagcgcagggcgggaugccaucuggaccgaaagaccauucaacucagauucuuauuccgaaugcaaagggaaacaauacgugaagcgcaccugguauaaaaaauuuguaggcguucaauugugcaacucuuuaagauauaaaaucuauuuauccgacucgcugaccggaaaguuuuacaauaucggagaccagagagggcauggagaagaucacugucaguuuguggacuccuuccuugauggucgaacagggcagcaacugacaucagaucagcuuccuaucaaagagggguacuucagggcuguacgucaggagcccgugcaguuuggcgagaucggaggucacacucagaucaauuacguucagugguaugaaugcggaacaacaaucccugggaagugguag

SEQ ID NO: 12610 - RNA, 1584 nt, Artificial Sequence
  Description of Artificial Sequence: Synthetic coding sequence
augcuaaugcucuucgucuuuggugugcugcugcacgaagugagccucucuggccagaacgaggccccacccaacacccauagcauccccggcgagcccuuguacaauuaugccucaauucgucucccugaagagcacauccccuuuuuucuccacaauaaucgccacauugccacagucugucggaaagauucacuguguccauacaagaaacacuuggagaagcugaaguacuguuggggauacgaaaaaaguugcaagcccgaguuucgguucggcuauccgguuugcagcuauguggacaugggcuggacugacacacuggaauccgcggaggauaucuuuuggaagcaagcugacuucggguacgcuagagagcgccuagaagagaugcacguucucugccaacccaaagaaacuuccgacagcucucuggugugcucccgauaccugcaguauugcagggcuaccaaccuguaucuggaccuucggaacaucaaaaggaaccacgacagauucaaggaagacuuuuuccagaguggagagaucggaggccacugcaaacuugacauuaggacucuuaccucagagggacaacgaaaauccccucuacagucaugguucgcugagcuccaaucauauacacaacugaacuuccgcccaauugaagaugcuaaaugugacauagugaucgagaaacccacuuacuuuaugaaauuagacgccggggugaauauguaccaucauuucugugacuucauaaaucuguacauaacgcagcacgucaauaacagcuucagcaccgacguguacauagugaugugggauacaagcaguuacggcuauggcgaucuguucagugacaccuggaaugcauuuaccgauuaugaugucauucaccugaaaacguacgauucuaaacgaguuuguuucaaagaggcuguguucagucuccucccuagaaugcgcuauggacucuucuacaacaccccucucauaucugggugccagaauacaggacuguuucgagcauuugcacagcauguguugcaccguuuaaacaucacacaggaagggcccaaggauggaaaaauuagaguuacaauucucgcuaggucuaccgaauaucggaaaauauugaaucagaaugaacuggucaaugcucuaaagacaguuuccacuuuugaggugcaaaucguugacuauaaguaccgagaacugggcuuucuagaccagcuuaggauuacacacaacacggacauuuucaucggcaugcacggggccggccuuacccaucuucuguuuuuaccugauugggcugcugucuuugagcuguauaauugcgaagacgagcgauguuaccuggaccucgcaagacugaggggcguacacuacaucacuuggcggcgucagaauaaagucuuuccacaggauaaaggucaccauccaacgcucggggagcauccuaaguuuacuaacuacucguuugacguagaggaguuuauguaccuuguauuacaggcagcugaucaugugcuccaacaccccaaguggccauuuaaaaagaaacacgacgaauuguag

SEQ ID NO: 12611 - RNA, 2004 nt, Artificial Sequence
  Description of Artificial Sequence: Synthetic coding sequence
augggaucuucccgccucgccgccuuguuacuccccuugcuccugaucguaauagaccugagcgacucagcagggauuggguucaggcaccugccccauuggaauacuagaugcccgcucgcuagccacacugacgacagcuucacuggcucauccgcguacaucccuuguagaacguggugggccuuguucucaacgaagcccugguguguucggguguggcacugcagccguugccuuugucagcaucuccuuagcggcgguuccgggcuacagcgcggacuguuccauuuguuaguucagaaguccaaaaaaucgaguacauucaaauucuacagacgccauaaaaugcccgcucccgcacagagaaagcucuuaccgcgccgucaucucucugagaaaucucaccacauuaguauuccgagcccagacauaucucauaagggacugagaucuaagcgaacacaaccaagcgauccagagacaugggagagccucccaaggcuugauucucagcgccacggcgggccggaguucaguuucgaucucuuaccugaagcaagggcuauccgggugacaaucaguucaggccccgaggucuccgucagacucugucaccagugggcacucgaaugcgaagaauuaagcuccccauacgacguccagaagauuguaucugggggacacacaguugaacucccauaugaauuucuccugccuugucugugcauugaggccucauaucugcaggaagacacggugcgucgcaaaaaaugccccuuucaguccuggccagaggcuuacggaagcgacuucuggaaaucugugcauuucaccgauuauagccagcacacucagauggugauggcgcugacccuacgcugcccacugaaacucgaagcugcauugugccaacgccacgacuggcauacacuuuguaaagacuuaccuaacgccaccgcccgggaaagcgauggcugguauguacucgaaaaaguggaucuccacccccagcucuguuucaaguucagcuucggcaacucaucgcacguggaauguccacaucagaccgggucacuuacauccuggaacguauccauggacacucaagcccagcaacucauccugcacuuuaguagcagaaugcaugcaacuuucagugcugcuuggucgcuuccaggccugggucaagacacucucgucccaccaguuuacaccgucagccaggcucggggcucuuccccggugucacuggaucucauuauaccuuuucugaggccagguuguugcguucuuguguggcggagcgacguucaguucgccuggaagcaucuccuaugccccgaugugucuuauagacauuuaggacuacucauccucgcccugcucgcucuguugacucugcugggcgucguccuugcccucaccugucggagaccacaaucugggcccggcccagcgaggcccguuuugcugcuccacgccgcagacagugaggcucagagaagacucgucggugcucuugccgaacuccuccgcgcagcacuagguggcgggcgggauguuauuguggaccugugggaaggucgacauguggcuagggucggcccccuuccuuggcuuugggccgcucgcacaagaguagcacgagagcagggaacagucuugcuccuuugguccggcgcugaucugaggccugugagcggaccugauccccgggccgcaccucugcuagcauugcugcacgcggcuccacggccgcuuuuauuacuggcauauuuuucacggcucugugccaaaggcgacauucccccuccacugcgugccuugccucgguaucgacuucuuagagaccugccccguuuacuccgcgcccuagaugcucgcccuuucgccgaggcuacuucaugggguaggcugggcgcccggcaacgccggcagagccggcuugagcuuuguagccggcuggaaagggaagcugcccgacucgccgaucugggcuag

SEQ ID NO: 12612 - RNA, 1101 nt, Artificial Sequence
  Description of Artificial Sequence: Synthetic coding sequence
augccaaugaucuccguccuugggaaaauguuuuuguggcagcgagaaggcccagggggacgguggacaugucaaacuagccgccgcguuaguuccgauccggcaugggccgucgaguggauugaacugcccaggggacuuagcuuaagcagucuggggucugcgaggacuuugcgaggcuggagucgcucuucccgccccagcagcgucgacucacaggacuugccggaggugaauguuggcgacaccguggccaugcuaccaaaaucaaggagagcucugacaauccaggagauagccgcacuggcgcguucaucccugcaugguaucucccaaguagucaaagaucacgucacuaaacccacugccauggcccaaggacgaguggcgcaccucauugaguggaaaggguggaguaagccuuccgauaguccagccgcccuggagagcgcuuucucuuccuacagcgaccugagugaaggugagcaggaagcaagauuugcagccggcguggccgagcaguucgccauugcugaggcaaaguugcgagcuugguccaguguggacggagaagacucaacagacgauagcuacgaugaagauuucgcaggcggaauggauacagacauggccggacaguugccacucggcccccaccugcaggaucuguuuaccggacaccgauuuuccaggcccgugcgucaagguuccguagaaccugaaagugacugcagccagaccgugucuccagauacacucuguucuucccucuguagccuggaagacggccucuuaggaagccccgcuagacuggccagucagcuacugggcgacgaauuacugcuggccaaacuuccaccgagcagagaauccgcuuuccgcucacucggucccuuagaggcacaagacagccucuauaacucccccuuaaccgaguccugcuuaagcccggcagaggaagagccagcuccauguaaagauugucagccuuuaugcccuccauugaccgggaguugggagcgucagcgucaggcguccgauuuggcaucaagugggguaguuagucuggaugaggacgaggccgaaccagaagagcaguag

SEQ ID NO: 12613 - RNA, 5172 nt, Artificial Sequence
  Description of Artificial Sequence: Synthetic coding sequence
augcaguuucagcuuacucuguuucugcaccuuggcuggcugaguuauagcaaagcccaagacgauugcaaucggggugcgugccauccaacuacaggagauuuacuugucggucguaacacucagcuuauggcaucgucaacuuguggucuuucaagagcucagaaauauuguauccugucuuaccuggagggggaacaaaaguguuucauuugcgacucccgcuuuccauaugauccguacgaccaaccgaacagucacaccauugaaaaugucaucguuagcuucgagccugauagagaaaaaaagugguggcagucagagaacggucuggaccaugugaguaucagacucgaucucgaggcccuguuccgcuuuucccaccuaauacucaccuucaaaacauuucggccggcugcuaugcuuguggaacggagcacagauuauggccacaacuggaagguuuucaaguauuuugccaaagacugcgcuacaucuuucccuaacaucacaagcggacaggcucaagguguaggagauaucguuugcgacucuaaguauucagauaucgagccuagcaccgggggagaggugguucugaagguccuggaucccagcuuugagaucgaaaacccuuauagccccuauauccaagaccuggugaccuugacaaaccuacgcauaaacuuuaccaaacuucacacucucggggaugcacuuuuggguagaaggcagaaugacagucuggauaaguauuacuaugcuuuauaugaaaugaucgugcgggggucuuguuuuugcaacggccacgcuucugagugcaggccaaugcaaaaaaugaggggcgauguguucucucccccagguauggugcacggucaguguguuugucaacauaauaccgacggaccuaauugugagagguguaaagacuucuuucaggaugccccauggaggccagcugcugaccuccaggauaacgcgugccgcuccuguuccuguaauucacauagcucccgcugccacuucgacaugaccacuuaccuggccagcggagguuuaucuggcggcgucugugaagauugccagcauaacacagaaggucagcacugcgacagaugccggccucuuuucuaccgcgacccauugaaaacaaucucagacccguacgcgugcauucccugcgagugugacccagauggcacuauuuccggggggaucugcgugucccacuccgacccagcacuuggcuccgucgccggucagugucugugcaaggagaacgucgaaggggcaaagugcgaucagugcaaaccuaaccacuacgggcugucugcuaccgauccauugggaugccagccuugcgacugcaacccucugggcucacuccccuuucucacuugugauguggauaccgggcaguguuugugucugucuuaugucacaggcgcgcacugcgaagagugcaccguuggguauugggggcuuggcaaucaccuucacggauguucuccaugcgauugcgauauugggggcgcguacucuaacgucuguaguccaaagaacggacagugugaaugccguccacaugugacuggaagauccugcagcgagccagccccuggguauuucuucgcaccacucaacuuuuaucuauacgaagcagaggaggcaacuacucugcagggguuggcaccgcuggggagugagacauucggccaguccccugcuguucacgugguccugggugagccugugccugggaacccugucacauggacaggaccuggauuugcuagagugcuuccaggagcuggccugcgcuuugccguuaauaauauaccuuuuccaguggacuuuaccaucgcaauccauuaugagacccagagcgccgccgacuggaccgugcaaaucguugugaacccacccggaggaagugagcacugcauaccaaaaacucuucaguccaaaccccagagcuucgcucugcccgcugccaccagaaucaugcucuuaccaacaccgauuugccuggagccugauguccaguauucaaucgacgucuacuuuucucaaccacugcagggagaaagucaugcucauagccacgugcuugucgauucacuaggacuuauuccccagauuaacuccuuggagaauuuuugcucaaagcaggaucuugaugaauaccagcugcacaauugcguggagaucgcuuccgccaugggcccgcaggugcucccuggugcaugugagcguuuaauuaucuccaugucugcuaagcuucacgauggggcaguggcuugcaagugucacccgcagggcucaguggggucauccugcuccaggcucgggggucagugucagugcaaaccgcuggugguggggcgguguugugaccggugcaguaccggcaguuacgaucuaggccaucacgguugccacccuugucacugucauccacaagggagcaaggacacagugugcgaucaagucaccggucaaugucccugccacggcgaagugucaggaagacgcugugacagaugccucgcagguuacuucggauuucccucaugccaccccugccccuguaaucgguucgccgaacuaugugaucccgaaacaggcucauguuucaacuguggaggguucaccaccggacggaauugugagagaugcaucgacggcuacuacgggaaucccuccagcgggcagccuugccggccuugucuguguccugacgacccaucuagcaaucaauacuuugcccacaguuguuaccagaaccuguggagcuccgaugucauuugcaacugucuucaggguuacaccggcacacaauguggugagugcuccacugguuuuuauggaaacccccgaaucucuggcgccccuugccagccuugcgcuuguaauaauaauauugacgucacugacccagaaucuugcuccagaguuacuggcgagugucugaggugccuacacaacacccagggagcaaauugccagcuguguaagccgggucacuacgguagcgcucugaaucagacuuguagacgauguucgugucaugccucuggcguguccccuauggaauguccaccuggcggcggugcuugccugugugauccaguuacuggagcuugcccuugccuuccaaacguaacagggcuggcgugugaccgcugugcagauggguacuggaauuuaguaccagggaggggaugucaaagcugugacugcgaccccagaacuagccagagcagccacugugaucaacuaaccggccagugcccuugcaagcugggguacgggggcaagcggugcagcgaaugccaagaaaacuacuauggagacccucccgggcgguguauuccgugcgacuguaaucgcgcagguacucagaagcccauuugcgacccugacacaggcaugugccgaugucgcgaagguguuaguggucaacgcugcgauagaugcgcccgugggcauucgcaggaauucccuaccugccuccaaugucaccuguguuuugaccagugggaucauacaauaucuagucugucuaaggcaguccaggggcugaugagacucgcggcgaauauggaggauaaaagagaaacccugccagugugugaggcagauuucaaggaucugagaggcaaugugucugaaauugaacgcauccucaagcacccagucuuucccaguggaaaauuuuuaaaaguuaaggauuaccacgauagcgugcgccgucagauaaugcaguugaaugagcagcuaaaggccgucuaugaauuucaagaucucaaggacaccaucgaaagagccaaaaacgaggccgaucugcugcuugaagaucuccaggaagaaauagaccugcagucauccguucuuaaugcauccauugcugacagcucggaaaacauuaagaaguacuaccauauaucuaguucugccgagaaaaagauuaaugagacgaguagcaccauuaacaccagcgcuaauacaagaaacgauuuguugacuaucuuggauacccucacgucaaagggaaaucucucccucgagagauugaaacagaucaagauaccugacauccagauccucaacgagaaaguguguggagaccccggaaaugugcccugugucccacuacccugcggaggcgcccuguguaccggucgcaaggggcaccgaaagugccgugggcccggaugccaugguagccuuacacugagcacaaacgcccuccagaaggcccaggaggcaaaguccauuauccguaaccucgacaagcagguuagagggcucaagaaccagauagagucuaucagcgagcaggcggaaguuaguaagaacaacgcgcuccaacugagagagaaacugggaaacauaagaaaccaaucugauagcgaggaagagaauaucaaccuguuuaucaaaaaggugaagaauuuucuccuagaggagaacgucccgccagaggauauugagaaggucgccaauggggugcucgacauccaucugccaauacccucccagaauuugacagacgaguuagugaagauccagaaacacaugcagcugugcgaggacuauagaacagaugagaacaggcugaacgaggaggccgauggagcucagaagcuccucgugaaggccaaggcugcggagaaggcugcuaauauccuucugaaccuugauaagacgcugaaccagcuccaacaggcccaaauuacucagggcagagcaaauucaacaaucacccagcucaccgccaauauuaccaagauaaaaaaaaacguguuacaggccgagaaccagacucgcgaaaugaaaagcgaauuggagcucgccaagcaacgcucuggccucgaggauggccucucccugcuccagacaaaguuacagcggcaucaagaccaugccguuaaugcuaaggugcaggcagaaucugcucaacaccaagccggcaguuuagagaaggaguucgucgagcugaaaaagcaguacgcgauucugcagagaaaaacaaguacaaccggacugacuaaggagacacucggaaagguuaagcaauugaaggacgcugcugaaaagcuggccggcgacacugaagcuaaaaucaggaggauuacaggcuguuuccaaaauagcgcuagguag

SEQ ID NO: 12614 - RNA, 5286 nt, Artificial Sequence
  Description of Artificial Sequence: Synthetic coding sequence
augcaguuccaacuuacguuguuucuucacuuggguuggcugagcuacagcaaagcucaggaugauugcaauagaggcgcgugccacccuacgaccggggaccuguuagugggccggaacacgcagcugauggcuuccucaacauguggacucagcagggcucagaaauacugcauacucucauacuuagaaggugaacagaagugcuucauuugcgauagcagauuuccauaugacccauacgaucaaccaaacucucauacuaucgagaauguaauuguguccuuugagcccgacagggaaaagaagugguggcagucggagaacggucuggaucacguuucuauuaggcuggaccucgaagcacuguuccgcuuuucucaccugauccugacuuucaagaccuuuaggccugcagcuaugcucguggagaggucuacugacuacggacacaacuggaagguuuuuaaauauuucgcuaaggacugcgccacaucguucccaaacauuacuuccgggcaggcccagggcgugggugauaucgucugcgauucaaaguauuccgacaucgagcccucuaccggaggugaagucgugcuuaaaguucuagaucccucuuuugagaucgagaacccauauaguccguacauccaagacuuagugacuuugacaaaucucagaaucaacuucacaaaacuucacacucucggggacgcucuacuugggcgcaggcagaacgacucccuagacaaguacuauuacgcucuguacgaaaugaucguccgcgguucgugcuucuguaacggccaugccucagaaugccgaccaaugcaaaaaaugaggggcgauguguuuagcccucccgggaugguacacggccagugugugugccagcacaauaccgaugguccaaacugcgagcgguguaaagauuucuuccaggacgcgccauggcggccugccgccgacuugcaggacaacgccugucgauccuguuccuguaauucccauucauccagaugucauuucgauaugaccacuuaccuggcuucaggcggacuuuccggaggcgugugcgaagauugucagcacaacacagaaggccagcacugugaccgcugccggccucucuucuaccgggacccuuugaagaccaucagcgacccuuaugccuguauuccaugcgagugcgacccggaugguacuauuucaggugggauuuguguuucucauagcgacccugcauuaggaucuguggcaggccagugucuguguaaggaaaauguugaaggggcaaagugcgaucaguguaagcccaaccacuacggccugagcgcaaccgacccccugggcugccagccuugugacuguaacccccugggaucucugccuuuccugaccugcgaugucgacacaggacaaugccuauguuuaucauacguuacaggugcucacugugaagaauguaccgucggcuacuggggacugggcaaccaccuucaugguuguucgcccugcgacugugacauaggcggcgcguacaguaaugugugcucucccaaaaacgggcagugcgaguguaggccacacgucacaggaaggaguugcuccgaacccgccccagguuauuucuucgcaccacucaacuuuuaucucuacgaggcagaggaggccacuacucuucaaggacuggcacccuuagggagcgaaacauucggccagucucccgcuguacauguugucuugggggaacccguaccugggaacccagugacauggacuggccccgguuuugccaggguguugccuggcgcuggacugcgguucgccgugaacaacaucccuuucccuguagauuuuaccauagcuauucacuacgagacacagucugcggcugacuggacuguccagaucguugugaauccaccaggaggcuccgagcacugcauaccaaaaacccuccagucaaaaccccaaucauucgcauugcccgcugccaccagaauaaugcuacuucccacacccauuugucuggaaccagauguacaguacucuauagacguuuacuuuucccagccucuacaaggugagagccacgcucauucccacgugcuuguggacucucuaggacucauuccacagauuaacagucucgaaaacuucugcucaaagcaagaccuggacgaauaucagcugcacaauugcguggagaucgcauccgcgaugggcccucaggugcuacccggggcuugugaaaggcuuaucaucaguaugucugcgaaacugcacgauggggccguggccuguaaaugccauccccaaggcucaguggggaguagcuguagcagacuggguggccagugccagugcaagccucugguugucggacgguguugcgaccgcugcucaaccggaagcuaugaucuaggccaucacggcugucacccuugucacugccacccccaggguuccaaggauacggucugugaucagguuacugggcaguguccuugucacggcgaagugucuggacggagaugugacagaugccuggcgggauacuuuggcuuuccuucaugccacccaugccccuguaaucgguucgcagagcugugcgaucccgagacagguucaugcuuuaauuguggaggguuuacaacaggccgcaauugcgagcgcugcauugacggauacuauggcaauccuuccucuggucaacccugucgacccugccugugcccagaugaccccucguccaaccaguauuuugcucacaguuguuaccagaaucugugguccagugauguuauuugcaauugccugcagggcuacacuggaacucaguguggcgaaugcucaaccggguuuuauggcaaccccagaaucucaggcgccccaugccaacccugcgccugcaacaacaacaucgauguuacagacccugagucuuguaguagggugacaggugaaugucucaggugucugcacaacacucagggggccaauugccaacuguguaaaccgggacacuauggguccgcucugaaccagacuugccggagaugcucuugccacgcaucuggagucagcccgauggagugcccuccuggcggaggagcuugucuaugugauccugugacuggggcgugccccugucucccuaacgugaccggguuagccugcgaucggugcgccgacggauacuggaaccuaguuccgggccggggaugccaaucgugugauugcgaccccagaacaagccaaucaucccauugcgaucaguuaacaggucaaugcccauguaagcugggauauggcggcaaaaggugcucggagugccaggaaaauuacuacggcgacccucccggccggugcauucccugcgauugcaacagggccgggacccaaaaacccauuugcgaccccgauaccggcaugugucgguguagagaggguguuuccggccagagaugugaucguugcgcccguggccauucccaggaguucccuacuugcuugcagugccacuuaugcuuugaccagugggaucacaccauuucgagccucuccaaggcgguucaagggcugaugcggcuggcugccaauauggaggacaagagggaaacacugccagugugugaagcagacuucaaggaccuacgggguaacguguccgagaucgaacgaauccugaagcacccaguguuccccuccggcaaauucuugaagguaaaggacuaucacgauucgguucgccgccagaucaugcagcugaacgagcagcuuaaggccgucuacgaauuccaagaccugaaagauaccaucgagagggccaagaaugaggcagaccuguuacuagaagaucugcaggaagagaucgacuugcaguccucgguucuuaacgccucuaucgcugacagcucugaaaauaucaaaaaauacuaccauauuuccucuucagccgagaagaaaauuaacgagacuuccaguaccauuaacacuucagccaacacacggaacgaccuccuaacuauccucgacacccugacuaguaaaggcaaucuaagcuuggagcgguugaaacagaucaaaauaccugacauucagauccucaacgaaaaagucuguggggaucccgguaacgugccgugcgugccucugccgugcgggggggcgcucuguacggggcgcaaagggcacaggaaaugcaggggacccgggugccacggcaguuugacgcugucuacgaaugcccugcagaaagcccaggaggcaaaaaguauuauccguaaucuggacaagcagguacggggacucaaaaaccaaaucgaaagcauuucggagcaggcugaggugucuaaaaauaacgcccuccaauugcgagagaaacucgggaacauaagaaaccaaucagacucagaagaagaaaacauuaaccuguucauuaagaaagucaaaaauuuccugcuggaggaaaaugucccaccagaagauauugagaaaguggcgaacggcgugcucgacauucaccugccgaucccaagucaaaaccugacagacgagcuggugaaaauucagaagcauaugcagcucugugaggacuaccggacagacgagaaccgcuugaaugaggaagccgauggggcucagaagcugcuggucaaggcuaaggcugccgagaaagcugccaacauuuuacucaaucuagauaagacucucaaccaguugcaacaagcucagauuacacagggucgggccaauucuaccaucacacagcugaccgcaaacaucacaaaaaucaagaagaauguuuugcaggcugagaaucagacacgcgagaugaagagugagcuggaacucgcaaaacagcguucaggccucgaagacggccuuagcuuguugcagacaaaacuccagcggcaucaggaccacgccgucaacgcuaaagugcaggccgaauccgcucagcaucaggcggguucucucgaaaaagaauucgucgaacugaaaaagcaguacgcuauccuccaacgcaaaacaucaacuaccggacucaccaaggagacauuaggaaagguuaaacagcugaaggacgcagcugaaaagcuugcuggcgacaccgaggcgaagaucagaaggaucacugaucuggagcgcaagauccaagaccuuaaccugucacgacaggcaaaggcugaccagcugcggauauuagaggaucagguugucgcuauuaaaaaugaaauuguggaacaggagaagaaguaugcccgcugcuacucuuag

SEQ ID NO: 12615 - RNA, 1455 nt, Artificial Sequence
  Description of Artificial Sequence: Synthetic coding sequence
augggcgccgaggcccugcccgguccugacgaggcugcugccgccgccgcguuugccgagguuacaaccgucaccgucgcgaacgucggugccgccgcggauaacguguuuacgaccucgguggccaaugccgcauccauuaguggacauguguugagugggaggaccgcccugcaaauaggugauagccuuaacacugaaaaagccacucuuaucguagugcacacugacggaaguauuguggaaaccacuggcuuaaaggggccagcugccccucugacucccggcccccaauccccuccuacaccccuggcaccuggacaggaaaaaggcgguacaaaguacaacugggaccccuccguguacgauucagaauugccaguccggugucguaacauuucagggacauuauacaaaaauaggcucggauccggaggacggggucgaugcauuaagcagggagaaaacugguacuccccaaccgaauuugaagccauggccggccgcgccucaucuaaagacuggaagcgaaguauuagguaugcugggaggccacugcaaugucucauucaggauggcauccuaaauccacaugcugcuagcugcacuugcgccgcuuguugcgaugauaugacccuaagugguccuguccgacuguuugugccuuacaagagacggaagaaggagaacgagcuuccuaccacgcccguaaagaaagauucgcccaaaaacauaacguuacugccugccacugccgccacuacuuuuacuguuaccccaucgggacaaauaacuacuaguggcgccuugaccuuugacagggcuagcaccguggaggccaccgccgugauuagcgagucccccgcucagggagauguuuucgcuggagcuacuguccaagaagccucggugcagccuccgugucgggcaagccaucccgagccucacuaccccggauaucaggacagcugccagaucgccccuuuuccugaagccgcucugccgaccagucauccuaagaucgucuugacaagccucccugccuuggccguaccccccccuacgccaacaaaagccgcuccacccgcacugguaaauggacuagaguugagcgaaccucgguccuggcucuaccuggaggagauggugaauucacugcuuaauacugcccagcagcugaaaacccuguuugagcaggccaagcacgccuccacuuaccgcgaggccgcuacaaaccaggcaaaaauccaugcugaugccgagagaaaggagcagaguugcgugaauugcggccgcgaagccauguccgaaugcaccggaugccauaagguaaacuacugcagcaccuucugccagaggaagcgguggucccugacgaugcugacgagucuggucucuauuucuuggcugcgcgcuauccugccuugccagccccccaaaguucuuggucuguag

SEQ ID NO: 12616 - RNA, 1512 nt, Artificial Sequence
  Description of Artificial Sequence: Synthetic coding sequence
augagcggggcacuccuuuggccuuugcugccacugcuauuguuacuucugagugcaagggacgggguuagggcagcacagccccaggccccgggauaccuuaucgcagcacccucugucuuccgagccgguguagaggaagugaucucggugacuauauuuaauaguccacgugaggugaccguacaagcacaacugguggcacagggggaacccgucgugcagagccaaggugccauucuagacaaaggaacuaucaaacucaaggugccaacaggacuccgcggacaagcacugcugaaaguauggggaaggggguggcaggcagaagaagguccccuguuccauaaccagacgucagugacagucgacggaagaggcgccagcguuuuuauccagacagauaagccgguauacagaccccagcaucgagugcucaucucuaucuucaccgugucccccaaccuccggccugucaacgaaaaacuggaagcauacaucuuggacccaagagggagcagaaugaucgaguggaggcacuugaagcccuucugcugcggcaucacaaauaugaguuuuccacugucagaccaaccaguucugggcgaaugguucauuuuuguggagaugcaaggucacgccuacaacaaauccuucgaagugcaaaaauacgugcugccaaaguucgaauugcugauagacccaccucgcuacauucaggaccuggaugcaugcgaaacuggcacaguacgcgccagguacacguucggcaaaccuguggcuggcgcucuaaugaucaacaugaccgucaauggugugggauauuacucacacgagguaggcaggccggugcugaggacuacuaaaauucuuggaagucgugauuucgacaucugcgugagggacaugaucccggccgacguucccgagcauuuuagaggaagagugagcaucugggccauggugacaucaguggacggaagccagcaggucgcuuucgacgacucuacuccgguucaaaggcagcucguggacauucguuacucuaaggauacaaggaaacaguuuaagcccggccuggcuuauguggguaaagucgaauugucguaccccgauggauccccagcugaaggcgucacgguccagauuaaggcugaauugacucccaaggauaacauuuacacuucagaaguggugagccagcgcgguuuagugggcuuugagaucccaagcauccccacuuccgcucagcacguuuggcucgagguuuuccaagagcucgaggauuaugacgugucggacucuuucgggguuagucgggaagacggaccuuuuuggugggcugguuuaacagcccagcggcggagacgaucaaguguauucccuuggccgugggguaucacuaaggauucaggguuugcuuucacugugcgcagaggcaaugggaccgguggugaugauagaccaagugaaccugaacccccugcuggccgauggccccugcaccgauag

SEQ ID NO: 12617 - RNA, 144 nt, Artificial Sequence
  Description of Artificial Sequence: Synthetic coding sequence
augaaguugugugugaccguucugucuuugcucguccucguggcagccuucuguagucuggcgcuaucagccccaaaagcuucaaaauccgcucucacaccugucucaccagggucacguuccacuuguaugacuuggaacuag

SEQ ID NO: 12618 - RNA, 861 nt, Artificial Sequence
  Description of Artificial Sequence: Synthetic coding sequence
auggaaguguacaucaggcauuuagaaaagguguugcggcgguaugugcagcgacugcaguggcuccuguccgggccaguacuaugcucucgcaccugguacagacagagcauggacaggggggugaugaugaccgcggcgagcggaagucgacgauuguucggaaccguguuagagucuaaagucuguauccugcuugauacaagcggcucuaugggcccauaucugcagcagguaaaaacugaacucguuuuguugauuugggaacaacugcgcaaaugcugcgauuccuucaauuugcugagcuucgccgaauccuuucaaucguggcaggauacacuggucgaaacaacugaugcagcaugucaugaggccaugcagugggugacacauuugcaggcucagggaaguaccagcauuuugcaggcucugcugaaagccuucaguuuccacgaccucgagggacuguaccuacugacagacggcaaacccgauacuuccugcucucucgugcugaaugagguucaaaaacugcgcgaaaaacgugauguaaaaguccacacgaucuccuuaaauugcuccgaccgcgcggcuguggaguuucugcgcaagcuggcaaguuucacugggggccgcuaucacugcccagugggggaggacacauugaguaagauccauagccuucugaccaaaggcuuuaucaacgagaaagacccaacgcuucccccuuuugagggugaugaccuccgcauauuggcucaggaaauuacaaaggcccggucauuucuuuggcaggcccaaucguuucgcucacagcuccagaaaaagaaugacgcugaacccaagguuacccuguccuag

SEQ ID NO: 12619 - RNA, 3555 nt, Artificial Sequence
  Description of Artificial Sequence: Synthetic coding sequence
augaaaaaguaucggaaaauaucuauugggugcuucgcuauggcuacccagaccucccauguguuccaugggcaggaaaauauguuccuggagaaucacuguauacgcagaaacaccgggagggacagcaaaaagccccucaagcagaaaaauaugaacggucugggacaaaauagugauaacggccuccuggugacgcacgugaaucagacacaggacuugcuuagguugcaagguagugaaacccagagcucggacugggaagacagugaggacuggcucucagcucacucccugaagugucaaaagcugacucuggcagaucucaucucccaagggaccgagguucucgaggagggcacuaacgugguccagaaaauuugcuuuuccacacagaucaucagacacuuugaaaguaagcuuagcgauaccauagagguguaccaggagcgcauacaguggcugaccgaaaacucuaaaaaagcauucggccuuaucaaaggagcccgggugucuauucugaucgaugucuccgcaauaucuagcggcccucaaaaagaagaauuucagaaagaccuuaugaguuuaaucgaugagcagcucagucacaaggaaaaacuguucgugcuguccuuugguacuaaugccggcagccucuggcccgaccccauggaggugucugcaucuacacuacaggaguugaaauugugggugaaaacauuacagccagaugggggaucaaaucugcugcaggcucucaaaaaaaucuucacucucaagggccucgauagccuaguggcaauaaugcguaguugcccagaucagccaagcgagauucugucagauuauauccaacaauccaccaugggccgagaucuuaucauucauuucaucacauaucgcugugaugaucaaaugccgccagccguucuuaaaaaccuggccgaagccgugcgaggauauuaucacugcuacucuccaaaaauggaacauuacacaucgcgggacauggaugaguuacucgcggagauccagaaggcccaaucccugcuuucgcacguccaagcacuucagcauucuagucccugcgaggcccuaacauguacgauggaggaaaucucaacagaaaucacuaaugggccacugaucucacucuugccgaaaccuccuaagcaugacgccccccuuacuauugaguuccccaaucuugauaagacgagugccgaguggcuuaagguaaacgggcugaaggcuaaaaaacugucgcuguaucaggugcuggcacccaaugccuucuccccaguugaggaguuuguaccuauucuccaaaaaacagugucuucuaccauucacgagaaggcgaugauccaguucgaguggcaugauggaacagucaaaaauauucacguggacccuccuuuucuguauaaguaucagcagcaguugucacgagcuaugaggauguacgaaagacggaucgaguggcugagccucgccagucgccgaauuuggggaacagucugugaaaagcgagugguugugcuucuugacauuucggccacuaauaguauguauaucauacacauacagcauucccucagacugcuauuggaggaacaacucucaaauaaggacuguuuuaaccucauugcuuucggaucgaccaucgagucuuggagaccagaaauggucccgguuagccacaauaaucuacagucggcauggcggugggcucucaauuuaaggugucgaggcaguaggaaugucuuaagugcacugcgcaaagcaguagaagucgauuuuaaggacaaggauaagcaucaaagccaaggcauuuauuuauucaccggaggaauuccugaccaggauaugcccacccugagcgcauauauggcugaggcuuguggaggaugcgaucuucaguugaaugugugccuguucuacgugggggaaccgaagauggauaccaccccccccgcuagguaugcaucccacaccgauaccgccgcagcguacaaagaaguuacaagggccgcggguggaagguuccacugguucggcgacaccggcauuuacgagucggaugacaucaauuccauuauguccgagauggagaaagcccuuaacuauucccagaaaugcgcauuucugauggcuagucucaagaaucacuccggaaagguguugggcagcuccgcacuaccuaaagagaagcccaaaacucuccaguugcguucucagccuaagaagcucuguccucccagacccacugugccccugggcgcccggaugucuauaaaagacgauccagauagagaaaaaagcccaccacugaagagccucaaauggagaccucuguccagcaggguaggcaucucgccagcugccgcucagccgaccaaagagggcaugauggaguuacgccggaagacuaaaucucgagaggccgaaaccucucuuuuacuauucuauacagagaaggguaaugauguagggagcguguacaagaaguacccccaagggagaggccugcguagaacgucaaguagcauugaucugccccggaaggacacaguaugcucaagccaggagugggucgccaaguacggacucaagaaacuuaaguuggaaauuagccgauguaugggcccuaacugcacccaccagaaaucggggcaaagaucagccucugcgaagcauuguagcaucuucccuucagucgagauccacggagucgugcggcacauccaguggacaccucgugagauggaaguguacauuagacacuuggaaaaagugcugagacgauauguccagcggcugcaguggcuccucuccggcagccggaggcuguuuggcaccguccuggagaguaaagucugcaucuuguuagauaccagcgguuccaugggaccauaucugcaacaggugaagacagagcucgucuuauugaucugggagcagcugcgaaaaugcugugacucauucaaucugcucucuuuugccgaaucguuucaguccuggcaggacacgcucguagagaccaccgaugcugcuugucacgaggccaugcaguggguaacccaccuccaggcucagggaucuaccuccauauugcaggcacugcugaaggccuuuucuuuucaugaccuagaaggacucuaccuacugaccgacggcaaaccagacaccagcuguuccuuaguccugaacgaaguccagaaauugcgcgagaaacgggaugugaaaguacacacaaucucucucaauugcagugaccgcgccgcggucgaguuuuugcgcaagcuggcaucuuucaccggagggcgguaccacugcccagugggcgaggauacacuuucaaaaauccauucccuacugaccaagggguucaucaacgagaaagauccaacgcugccuccguuugaaggcgacgaccuuaggauccuugcacaggagaucaccaaagcacgcucuuuccucuggcaggcacagaguuuccgaucccagcuacagaagaaaaaugaugccgagccuaaggucacucugaguuag

SEQ ID NO: 12620 - RNA, 906 nt, Artificial Sequence
  Description of Artificial Sequence: Synthetic coding sequence
auguuaccccuaacaaugacgguccucaucuugcuacugcugccaacuggacaggcugcccccaaagauggugugacccgcccagauuccgaggugcagcaccaauuguugccuaacccguuucaaccugggcaagaacaauugggccucuugcagaguuaucugaaaggacugggacgaacagaagugcaguuggagcaccucagccgggagcaggugcugcucuauuuauucgcucugcacgacuacgaucagucuggccagcuugacggccuggaacuucugucuaugcuaacugcugcccuagcaccuggcgccgcaaauucccccacaacuaacccggugauauuaaucguggacaagguucuagaaacgcaagaccugaacggggacggucuaaugacaccagcugaacuuaucaacuucccuggaguggcacugagacacguggaaccaggcgagccccuugcuccuucaccucaagaaccucaagccguuggucgccagucacugcuggcuaagucaccccugagacaggagacacaggaagcuccaggccccagggaagaggccaaaggccagguugaagcccgucgggaaagccuggaccccguccaggaacccggaggccaagcugaggcugacggagaugugcccggccccaggggagaagcggagggccaggcagaggcaaaaggugaugccccuggaccacggggggaagccggcggucaggccgaggccgagggggaugcaccaggcccacggggcgaggcuggcgggcaagcugaagcacgggaaaacggggaggaggcaaaagaacugccaggugaaacccuagagagcaaaaacacccagaacgauuuugaggugcacauaguucaggucgaaaaugaugagauauag

SEQ ID NO: 12621 - RNA, 4722 nt, Artificial Sequence
  Description of Artificial Sequence: Synthetic coding sequence
augcgcgugcucgcuugccucuuagccgcccuggucggcauccaagccguugaaaggcugagacucgccgauggcccucaugguugugcaggacgacuggagguuuggcaugggggacgcugggguaccgugugcgacgacggcugggauuugagagacgccgcuguagccugcagacagcugggaugcggcggggcucuggccgcucccggcggugcuuucuucggcgaaggagcagggccggucuggcucagugaauuggcuugucggggcaacgagggccagcucggccugugccaucaccguggguggaaagcucacauuugcucucacgaggaagaugcuggcguuguuugcgccgggcaaaggguagccaauagucgcgaugacucaaccuccccucuugauggcgcuccuuggccuggacugcugcuagaguugucucccagcacagaagagcccuuaguuacccaugcaccacggccugcuggaaacccccagaacgccucccggaaaaaaucaccuaggcccaaacaggccaagaguacacgugccccacugcuuacaaccggagcuccacggcaagaaagacuuagacuggugucaggcccccaccggugcgcugggcggcuugaaguauggcacgggggacgcuggggcaccgucugcgacgacgggugggaccucagagaugccgcgguagccugccgagaacuggggugcgguggagcccuugccgcccccggcggcgcuagauuugguccaggagcagggcccgucuggauggaugacguugggugcggcggaggagaacaggcccuacgggauuguccuagaagcccuuggggucguuccaauugcgaucacagcgaagaugccgguuuagucugcacggggccagcuccaagacugagguuggccgaugguccucauggaugcgccggacgacuggagguguggcacggggggcgauggggguccgucugcgacgacgcaugggaccugagggaugccgccguagcuugucgagagcuggguuguggaggggcccuugccgcaccagguggcgcauucuuuggagaaggauccgggcccaucauacuggacgauuugcggugcagggguaacgaaaccgcacugcgguuuugccccgccaggccguggggccagcacgacugucaucacagagaggaugcaggcgcugucugcgacgggaugccucuuggguacguacccccaacugcaccuacugauagcaauaauagcacuccacgggaagccgccucuaggccccccagcacuaugacuagccaggcuccaggcacggcuggcguaaguccuccuccagccuccccuaccgugcucugggaaccagggcccgaagcuggauccccccaacugcgucugguggcuggcccauccaagugcaguggaagacuugaaguguggcaugaccaaagguggggaaccgugugugacgacuccugggacaugcgggacucugcagucgucugccgugaacugggaugcggcgguccccaacagcccgaccccgcugccggaagguucggcuggggcgcugguccaaucuggcuugaugauguugggugugucggcaccgaggcuagccuuuccgauuguccagccgcaccaugggggaagcacaauugugcucauaacgaggauguuggcgucacuugcaccggcccaccgggccuggacuccauuucugauccuuucuccugguccuggaucccuggcuugggccgggacagagaugccuggcuccccggagaguuagcgacgaagcccucugcuucagugaccgcuucugugcuggaaaaaacaaccacuaaggcuccaggaaagaugcccaaaaguaccaagaagugggugacuaagaaugcuaaacggcccacuacacagccacccgugaugccaaccaccaaacacuccagggcccaaagcccaccagaucugaccucgcagacgacugcugcgcugacaaccgaagccucccggcgucccacgagcgaauucacucgacgcccaaccacagaagcuccccagagauggacaagucauaccaccgcuacauugacaccacaggccccuagagagcggaccacaaaaacgauggccaugcuuacaacacaggggccucaggagaugacgucggagagcacgauuaaauccaucccacaggccucucuggagcccucugcggaaaucccugagggaagccccgaauccccuaaggaccccgcuccaagccccuccgugaguacaacaggggaaaguggcuuauucagagucaggcuugcugaugggcccaacagaugcgccgggcggcuggaggucuggcaugccgggagauggggaacugucugcgaugauaauugggaccuucgggacgccaccguagcuuguugggagcucggguguggcaaagugagaccccggguaggcaagacgcauuauggccccggaacggguccuauauggcuagacgacaugggaugcaagggcuccgaggccucucucucugacugcccaaguggagcaugggguaagcauaauugugaucacgaggaggacguuggacugaccugcacgggauacacugauuacgacgauuauccuccauggacgugggauccgacaagccgcgaggaccuugcuaagggcacaaccacggccgggguacccggccauacgcugccauggagaaccacccggcgcccaggaucuagcucacccgcaauucgacgguuaccagauacuggauccaaggaugguuacaaacuucccuggacaugggauacuccaagugggcgcggacucgccgaaggcacccccaccgccgguaagcuaggccccacccucggcgccggcacgacccgcuccccggguucaccaccuacacuccgagugcauggugauaccggcucccccagaaagcccuggcccgaaaggcgcccgccccgcccagccgcgacgaggacagcacccccuacuccuagcccagggccaucugcuaguccugggccuccaggcccagcucucacaucggauuccucucgcgagcugacgccucacuccgccuuaacuagcgaggcuacaucagacgcacccgacacaucgcccccaacaccagacccagcuagccggaccaauccugauuugauucucacaagcccugauuuugcucuaaguacccccgacucuucaguggugcccgcccucacuccugaacccucuccaacgccccuccccacacuacccaaagagcugaccucugauccuucaaccccuagcgaagugacguccuuaucaccaacauccgaacaggugccagaaucugacacaaccccugaucucgauacaaccccuuacagcuccacugucuccgaauacucucgauccccggauccuuccccuagcccucaucccacgacaaccccggaucccaccauggccccagauccgauaacaacgcugaaccccaccgugaccccucauuuuccuacaaccccucaccccacuaccaccccgcaccccaccacuauuacacacuccacuaugauccccgacccaacaaccacuccccagccguucacaacaauaacucacagcacgaugauucccgaccccacaacgacuccucaacccuucaccacgaugcagccaacaacaacuccucacucgaccacaccgcacccaacaacuaccccccauccaacuacaauaacgcauaguaccaugauucccgaccccaccacaacaccucagcccuucaccacgaugcaaccuaccacgaugccccaucccacaaccaccccucacccaacuacaacuccacauccuaccacuacaccacacccaaccaccacuccccauccaacaaugacucccgauccaaccaccacgcccuacccaacuaccacuccagacccuacaaccacgccucaucccacaaccccggaucccucuuccacaccaguaaucaccacaguuagucucccuacuucauugggcacagaacucaguucucccacacuugcgccaaccgugaaaccaucucugcacccacagcucacuuucacagcaccugccccucauaccucaacuucccagauucccacgcucgagcccuccccggcacuggagagcagucccucgcgcagcaguaccgcgaccucgauggacccccugaguacagaagacuuuaagccgccucggucgcagaguccaaaccugacucccccaccgacucacacuccucacucagcuucggaccucaccgucagccccgacccccuccucaguccaaccgcccacccccucgaucacccgccccuugauccucuuacuuuggguccuacucccggacagucuccugguccacacggcccaugcguugcgccuacccccccaguaagggucauggccugcgaacccccugcacugguugagcugguagccgccguacgggauguaggaggucaacugcaaagauugacacagguaguggaacaagagcggcaggagaggcaggcguuacugcugggccugacccaacuaguugaggcugccaggggucucgggcaacuaggggaggccguuaaacgcuuggccgagauggccuggaccaccuccaugcccgccccuaccacuaccacuccagaggaagaagagaggccacugagaggagacguguag

SEQ ID NO: 12622 - RNA, 1911 nt, Artificial Sequence
  Description of Artificial Sequence: Synthetic coding sequence
augaccacguggucccugaggagaaggccugcccgcacgcuugguuuacuguuacugguaguccucgguuuucugguacugcggcgcuuagauuggucuacacucgugccccugagguuacgucaucgccaguugggucuccaagcuaagggguggaauuuuaugcucgaagauagcacauuuuggauuuucggcgggucuauacauuacuuccgggugccccgugaguacuggagagacagauuacucaaaaugaaggcuugcgggcugaacacccugaccaccuacgugccauggaaucugcaugagcccgagagagggaaguucgacuucucggggaaucuugaccuugaagcguuuguccucauggcugcugaaaucggguugugggugauccuucguccagggccuuauauuuguagcgagauggaucucggcggcuugcccagcugguuacugcaggacccugggaugcgccuccgcacaacuuauaagggcuuuacagaagcagucgaccuguauuucgaucaucuaaugucucgcgugguuccucuccaguauaagcggggggggccuaucaucgcugugcagguggaaaacgaguauggcucauacaauaaagaccccgccuacaugcccuaugugaaaaaagcacucgaggacagggggaucguagaguugcuacugaccagcgauaauaaagacggguuaucuaaagggauuguucagggaguccuggccacaauuaaucuucagucgacgcacgaguugcagcuguuaaccaccuuucuauuuaacgugcaggggacucaacccaaaaugguuauggaauauuggacuggcugguuugacucaugggggggcccacacaacauccuugauagcucagaagugcuuaagacugucagugcgauuguggaugcugggaguuccaucaacuuguauauguuccauggaggcaccaauuucggauuuaugaauggcgcaaugcacuuccacgauuacaaaagugauguuacaucuuaugauuaugacgcaguccuaacugaagcuggugauuauacugcuaaauauaugaagcuccgcgauuuuuucggcucgauuucggggaucccuuugccaccuccccccgaccugcuacccaaaaugccuuaugagcccuuaaccccuguccuauaucucagccugugggaugcucucaaguacuuaggggaaccuaucaagucagaaaaacccaucaauauggagaauuugccuguuaauggggguaauggacagucauuuggguacauauuguaugagacaucuaucacuucaucugggauccugucuggacacgugcaugaccggggccaagucuuugugaauaccguuuccaucggguuccuugauuauaagacaacaaagauugcagucccacugauccaaggcuauaccguccugagaauccuggucgagaacaggggucgggucaacuauggagaaaacauugacgaccagagaaaggggcugauugggaaccuuuaccuuaaugauagcccucuaaagaacuucaggauuuauucucuggauaugaagaaguccuuuuuccagagguuuggucuggacaaauggaguucucugccugagacacccacgcugcccgcauucuuucuggggucccugucaaucucuagcaccccgugcgauacauuccuuaaauuagaggguugggagaaaggcguaguuuucauaaacggacagaaucuggggcgguacuggaauauaggcccacagaaaacgcuauacuugccagguccguggcugucgagcgguauaaaccaggucaucguauucgaggaaaccauggcuggaccggcuuugcaguucaccgagacuccacaucuaggaagaaaccaguauauuaaguag

SEQ ID NO: 12623 - RNA, 2037 nt, Artificial Sequence
  Description of Artificial Sequence: Synthetic coding sequence
augcguacugucgugcuuacuaugaaggcuagugucauugaaauguuucugguacugcuugugacaggaguccacuccaacaaagagacugcuaaaaagauuaagcgcccuaaauuuacggugccccagaucaacugugaugugaaagcaggaaagaucauagaccccgaauucauugugaagugccccgccggaugccaggauccaaaauaucacgucuaugguaccgacguuuacgccucguacaguucagucuguggggccgcuguccacagcgggguacuggauaauagugguggcaagauccuagugaggaaaguagcuggccagucagguuauaaaggauccuacucgaacggcgugcagucacucagccucccgcgcuggagagagucuuucaucguauuagaaucaaaaccaaaaaagggcgucaccuacccaagugcccugaccuauucuucgagcaagaguccugccgcccaggcuggggagacuacuaaagccuaccagcgaccaccaauaccuggaaccacagcccagccggugacuuuaaugcagcugcuggcugucaccguugcugucgcaaccccaacuacccugccucgcccgucuccaucugcugcaucuacaaccucaauccccaggccucagagcguuggccacaggucccaagagauggaucucuggucuacugcuacauauacgaguucacagaaucgaccccgggccgacccaggcauccagaggcaagacccuuccggagcggcauuccagaagccaguuggugccgauguuucucuuggacuggugccaaaggaagaacugagcacccagagccuggagccugucuccuugggagacccuaacuguaagauugaccuuaguuuucucaucgacggauccaccucgauuggcaagcgacguuuccggauccaaaagcagcugcucgccgaugucgcacaggccuuagacaucggacccgcaggcccccugaugggaguugugcaauacggugauaacccugccacucauuucaacuuaaaaacccacacuaauagccgugaucugaaaacagccaucgagaagaucacucagaggggcggccuuagcaacgugggaagggccaucuccuucguuacaaagaacuuuuuuuccaaagccaacggcaacaggucuggagcaccaaacguggucgucgucaugguagauggauggccuaccgauaaaguagaggaagcuagucgauuggcacgcgaguccggaaucaauaucuucuuuauaaccaucgaaggcgcggcagaaaaugaaaagcaauacguugucgaaccaaacuucgcuaacaaagccgucugcagaacuaauggcuucuauucguuacacguucaguccugguucggccuacacaagacgcugcagccguuggugaaacgcgugugugacacugacagacucgcuuguagcaaaacgugccuuaauagcgcagacauuggcuucguaauugauggcaguagcagcguagggaccgggaauuucagaacuguccuacaguuugugacuaaucugacaaaggaauuugaaauuucggauaccgauacccggauuggcgcugugcaguacacuuacgagcaaaggcuugaauuuggcuucgauaaguacuccagcaagccggacauucugaacgcuauuaaacgcgucggauacuggucaggggggaccuccacuggcgcugcaaucaacuuugcacuggaacaacuauucaagaaaucaaaaccuaacaagcggaaacuaaugauucugauuaccgacggccgaucauacgacgauguuagaauuccggcuauggccgcacacuuaaagggggugaucacuuaugccauaggcguggcuugggccgcccaagaagagcuugaagugaucgcaacucauccugcccgcgaucacagcuuuuucguagacgaguucgacaaccugcaccaguacguccccaggaucauucagaacaucugcacugaauucaauagccaacccagaaacuag

SEQ ID NO: 12624 - RNA, 324 nt, Artificial Sequence
  Description of Artificial Sequence: Synthetic coding sequence
ugaaccguagcugccccaucaguuuuuauuuucccaccuagcgacgaacaguuaaaaagcggcaccgcauccgucguuugccugcuuaauaauuucuacccucgcgaagcuaaaguucaguggaagguagacaaugcgcuucaguccggcaacagccaggaauccguuaccgaacaggacucaaaagauuccaccuauuccuuaucaucgacccucacccucagcaaggccgauuacgaaaagcacaaaguuuacgccugcgaggugacucaccagggccugucuucgccugugaccaaaaguuucaauaggggugagugcuag

SEQ ID NO: 12625 - RNA, 366 nt, Artificial Sequence
  Description of Artificial Sequence: Synthetic coding sequence
auggugcuccagacccagguguuuauuagccuucuguuguggauuucaggggccuacggcgauaucgugaugacccaaucccccgacucucuugcggucucacuaggcgagcgcgcaaccauuaauugcaagaguucacaguccguuuuguacaguucuaauaauaaaaacuaccuugcuugguaucagcagaagccaggacaaccaccaaaauugcucauuuauugggcuagcaccagagagagcggcgugccagaccgguucaguggcagugguuccggaaccgauuucacucucacaauuaguucacuccaggcagaagauguggccgucuacuauugucagcaguauuacucuaccccuuag

SEQ ID NO: 12626 - RNA, 984 nt, Artificial Sequence
  Description of Artificial Sequence: Synthetic coding sequence
gcauccacaaagggcccuucuguauuuccacuggcaccaugcaguagguccacaagcgaauccaccgccgccuugggaugccuggucaaggauuauuuucccgaacccguuacaguuuccuggaacucuggggcccugacaucaggcgugcacacguucccugccguguuacaaucgucuggccuguacucuuugucuagcguggucaccgucccgucuaguagucugggcacgaagaccuacaccugcaauguggaccacaaaccauccaacacuaagguagauaagcgcgucgaaucuaaguacggaccuccaugucccucuugcccagcaccggaguuucuugggggaccuuccguguucuuguucccacccaagcccaaggacacccugaugauuucaagaacacccgagguuacuugcgucgucgucgacguaagucaggaagaucccgaagugcaguuuaacugguauguggacggagucgaaguacacaacgccaagacaaaacccagggaagaacaguucaacuccacuuauagagucgucucuguuuugacugugcugcaccaagacugguugaaugggaaagaauacaagugcaagguaagcaauaaaggacugccuuccucuauugaaaagacgauuucaaaagccaaaggccagccgcgcgaaccacagguguauacccuucccccaucccaggaagagaugacuaagaaucaaguaucccugaccugcuuggugaaaggcuuuuaucccagcgauauagcuguugaaugggaaucuaauggacagccugaaaauaacuacaaaacaaccccccccguucuagauucagacggcucauucuuucucuacaguaggcuaacagucgauaaaaguagguggcaggagggaaacguguuuaguugcucugugaugcaugaggcccugcacaaucauuacacacaaaagucauuaucacuuucacuggguaaauag

SEQ ID NO: 12627 - RNA, 981 nt, Artificial Sequence
  Description of Artificial Sequence: Synthetic coding sequence
gcuucaacgaagggcccgagcgucuucccccuggccccgugcucuagaagcacaucugaaucaaccgcagcccucgggugccuuguaaaggacuauuuccccgaacccgugaccgucucuuggaauuccggagcgcugaccagcggcguucacacuuucccagcuguccugcagucuuccggauuauacucccugaguuccguugugacaguacccucaucaaacuucgggacucagaccuauacguguaauguagaccacaaaccauccaauaccaagguagauaagaccguugagcguaaauguugcguugagugcccgccauguccggccccccccguggcaggacccaguguguucuuauucccaccaaagccgaaagacacccuuaugauuucucgcaccccagaaguaacaugcgucguaguggaugugucacacgaagauccugaaguccaguucaacugguaugucgacggaguugaggugcauaaugcuaagaccaaaccccgggaagaacaguuuaauuccacguuucgcguugugucugugcuuacaguuguucaccaggauuggcugaauggaaaagaauacaaguguaaggucuccaacaaaggccucccagcuccuauugaaaagaccauaucuaaaaccaaaggccagccccgcgaaccucagguuuauacucuucccccaagccgugaagaaaugacaaagaaucagguuucgcugacaugccuggugaaggguuuuuauccuucugauaucagcgucgaaugggaaagcaacggacagccugaaaacaacuauaaaaccaccccgccaaugcuagauucugaugggucauuuuuucuuuacagcaaguugaccguagacaagagcagauggcagcaagggaacguuuuuucaugcagcgugaugcaugaggcccuccacaaucauuacacucagaagagccuuucacugucuccuggcaaauag

SEQ ID NO: 12628 - RNA, 993 nt, Artificial Sequence
  Description of Artificial Sequence: Synthetic coding sequence
gccaguaccaagggaccgaguguguucccacuggcccccuccagcaaauccacuagcggcgggacagccgcacugggaugucuggugaaggacuauuuucccgagccugugaccgugagcuggaacucuggcgcucugaccagcggcguccacacguuuccugcaguacuccaaagcagcggccuguacucacuuuccucuguaguaacaguuccuagcaguagucuggggacucaaacuuacaucuguaacguuaaccacaagccaucaaauaccaaaguggauaaaaaaguugagccaaaaucuugcgauaagacgcacacgugcccccccugcccagccccugagcuucuuggaggacccucuguuuuccucuucccacccaagccgaaggauacacugaugauuagcaggacucccgaggugacuuguguggugguggacguuagccacgaagaucccgaagugaaguucaacugguacguggacggcgucgagguccauaaugcgaagaccaagcccagggaagagcaauacaauagcacguacagagugguaagcguucugacuguacuccaucaggauugguugaauggaaaagaauacaagugcaaggucuccaauaaggcccuucccgccccuauugagaagacaauuagcaaggcuaaaggccagccucgcgagccccaaguguacacguuacccccaucuagagaugagcucacaaagaaucagguaagucugacgugccuggugaagggcuuuuaccccucugacaucgcaguugagugggagucuaacggacagcccgaaaauaacuacaaaacaacuccacccguguuggacagcgacggauccuucuuccuauacagcaaacuuacuguggacaaguccagguggcagcagggcaacgucuuuucuuguucugugaugcacgaggcauugcauaaccauuauacacaaaaguccuuauccuugucuccaggaaaguag

SEQ ID NO: 12629 - RNA, 651 nt, Artificial Sequence
  Description of Artificial Sequence: Synthetic coding sequence
augggugcagucaugggcacauucucuuccuugcagacaaagcaacguagacccagcaaagacaagauugaggaugagcuugagaugacaauggucugucacaggccugagggacuagagcaacuggaggcccagaccaacuuuaccaagagggagcugcagguuuuguauaggggguucaaaaacgagugcccuaguggagucguuaaugaggauacguuuaaacaaaucuacgcccaguucuuuccacacggagaugcaagcaccuacgcccauuaucuuuuuaaugcuuucgacacuacacagacaggaucaguuaaauucgaggauuucguuacagcccugaguauacuuuuacgagggacuguucacgagaagcugagauggacuuuuaaucuuuacgacauaaacaaagauggcuauaucaauaaggaagaaaugauggacauagugaaggcgaucuaugauaugauggguaaguacaccuauccagucuugaaagaagacacucccagacaacacgucgauguauucuuccagaagauggacaagaacaaagauggaaucgugacucucgaugaauuucuggaguccugccaggaagaugauaacauuaugcggucucugcaacuguuucagaaugugauguag

SEQ ID NO: 12630 - RNA, 762 nt, Artificial Sequence
  Description of Artificial Sequence: Synthetic coding sequence
auggcucgcucauuauugcugccgcugcaaauccuacuucuauccuuagccuuagaaacagcuggugaggaggcucagggggauaagauuaucgacggugcccccugcgccaggggaagucauccauggcaagucgcgcuguuaucaggcaaucaacuacacuguggcggcguuuugguaaacgaaagauggguacuuacagccgcccacuguaaaaugaaugaguacacaguccaccucggaagugacaccuuaggagacagacgggcccaacgcauuaaggcaucgaagucauuucggcacccgggguacaguacccagacucacgucaacgaucugaugcucgucaagcugaauagucaggcuaggcuguccuccaugguuaaaaaaguccggcugccuucuaggugugagccucccgguacuacgugcaccgugagcgguuggggcaccacaaccaguccagacguaaccuuccccuccgaccucauguguguggaugucaagcuaauuucuccucaggauuguacaaagguauauaaagacuugcucgaaaacuccaugcugugcgcaggcauaccagacagcaagaaaaaugcauguaauggagauuccgguggaccacucguguguagaggcacccuucagggacuggucaguuggggaacguucccgugcggacagccgaaugacccuggugucuacacccaagucuguaaauucaccaaguggauuaaugacacaaugaagaaacaucgauag

SEQ ID NO: 12631 - RNA, 468 nt, Artificial Sequence
  Description of Artificial Sequence: Synthetic coding sequence
auguuucagagauugcuccuccugcuccuacuguccaugggcggaaccugggccuccaaagagccacuuagaccucgcugucgaccaaucaaugcuacauuggcagucgagaaggaagguugucccguguguauuaccguuaacacgaccauuugcgcaggguacugcccaacuaugacucggguccuucagggcguccugcccgcccucccacagguggugugcaacuaccgagacguacgauuugagagcauacgcuugccgggcugcccccgcggaguuaauccaguuguuucauaugcugucgcccuuuccugccagugcgcgcugugccggaggucuacaaccgacuguggcggacccaaggaccacccacucaccugugacgaccccagauuucaagauuccucuucuucuaaagcaccuccucccuccuugccuagcccgagcaggcuaccagggccuuag

SEQ ID NO: 12632 - RNA, 1554 nt, Artificial Sequence
  Description of Artificial Sequence: Synthetic coding sequence
auggccgugagcagaaaggauuggagcgcauugagcuccuuggcucggcagagaacacuagaagacgaagaggaacaggagagagagcguaggcggcgccaccgaaacuuguccagcaccacugaugaugaagccccuagauugucucaaaauggggaucgccaagcuagugcaagugaaagacuuccuuccgucgaagaagcugaggugccuaagccucucccaccagccagcaaagacgaagaugaagauauacagagcauacuaagaacacgccaagagaggcgacaacgacggcagguaguugaggcugcacaggcuccaauucaggagagacuggaagcggaggagggacgaaacagucugucuccaguucaggcaacacagaaaccuuugguuaguaaaaaggaauuagagauuccaccgagaagacgucugagccgugagcagaggggccccugggcacuggaggaagaaucccuuguaggacgcgagccagaagaacgaaagaagggcgugccagagaagagccccguuuuggaaaaguccucgaugcccaagaaaaccgcucccgagaagagccuggugagcgacaaaacaucaaucucugagaaggugcuggcaagcgagaagaccucacuuucagaaaaaaucgccgucuccgaaaaacguaauucuucggagaaaaagaguguguuggaaaagacaaguguuuccgaaaaaagccuugcgccuggaauggcccugggcucuggacgaaggcucgugagcgagaaggccucaauuuuugagaaagcccuggcuucugagaaaagccccacagccgaugcaaagccagcaccuaaacgggccacggccucggagcagccacucgcccaagaaccaccugccucaggagggucaccagcgacgaccaaggaacagcgcgggagagcacugcccggaaagaaucucccuucgcucgcuaaacagggggccuccgacccaccuacuguagcaucucgccucccacccgugacucuucaggugaaaaucccuucuaaagaagaggaggcagacaugucuucccccacucagagaacauacaguagcucuuugaagaggucaagccccagaacgauauccuuccguaugaaaccaaaaaaagagaauuccgaaaccacccugacacggagcgcaucuaugaagcugcccgauaauacugucaaauuaggagagaagcuagaaagauaucauacagcaauucggcggucagaaaguguuaagagcagggguuugccuugcacagagcuguucguggcgccggugggaguugcuucuaagcgccaccuguucgagaaggaacuugcugggcagucucgcgccgagcccgccucaucgagaaaagagaaccuccggcugagcgguguggugaccucuagacucaaccuguggauuuccagaacacaagagucuggugaccaggacccacaggaggcccagaaggcaagcuccgccacugagagaacacaauggggccagaaaucugacucaagucuugaugccgagguguag

SEQ ID NO: 12633 - RNA, 270 nt, Artificial Sequence
  Description of Artificial Sequence: Synthetic coding sequence
augcaggcauguauggugcccggucucgcgcucugccuacucuugggccccuuggcaggagcuaagcccguucaggaagaaggugacccguacgcugaguugccugcuaugccuuauuggcccuuuuccaccagugacuuuuggaacuacgugcagcacuuccaggcuuuaggcgccuauccacagauugaagauauggcccguacauuuuucgcacacuucccuuuaggauccacacugggauuucacgugccguaccaagaagauuag

SEQ ID NO: 12634 - RNA, 1302 nt, Artificial Sequence
  Description of Artificial Sequence: Synthetic coding sequence
augggaaacgcuuguugggagcuguacugccuggaacacggcauccagccagauggucagaugcccucugauaagaccaucgguggcggagacgauagcuucacaaccuuuuuuugcgaaacuggggcugguaagcauguaccucgcgccguguucguggacuuggagccaaccgugauugaugaaauaagaaacgggccauaccgucagcucuuccauccugaacagcuaaucacgggaaaagaggaugccgcuaauaauuaugcacgugggcauuacacaaucgggaaagagauuaucgacccggucuuggauagaauaaggaagcugagcgaccagugcacaggccugcaggguuuucuuguauuucauucauucggcggggguacaggaucuggguuuacgucucugcuaauggagcgacugucgguagacuacgggaaaaaaagcaagcucgaauucucaauauacccagccccucagguaagcacagccguaguggaacccuacaauucgauccucacgacucacacaacuuuagagcacucugauugugccuuuaugguugauaaugaggccauuuaugauaucugucgcaggaaccuagauauugaacggccaaccuacacuaaucugaaucggcugaucagccagaucgugaguaguaucacagcuagccugagauuugacggugcacugaauguggaucuuaccgaauuccaaacuaaucuggugccuuacccccggauacacuucccccuagccaccuaugcucccguaaucuccgccgaaaaggcuuaccacgaacaacucagcgucgccgaaaucacuaaugcaugcuucgagccggcaaaccagaugguuaagugcgacccacggcacgggaaauacauggcgugcugcuugcuguauaggggggacguuguuccaaaagaugugaaugcugcaauugcugcgauaaagaccaagagaucuauucaauucguugacuggugccccacaggauucaaaguuggcaucaauuaucagccucccacagucgucccgggcggcgacuuagcaaaaguacagagggcuguauguaugcucagcaacacaaccgccauugcugaggcaugggcccgccucgaucacaaauuugaccuuauguacgcuaaacgagccuucguccauugguacgucggagaagggauggaagaaggagaauuuucugaggcuagagaggauauggcggcucuagagaaggauuaugaagaaguugggauagauagcuaugaggacgaggacgagggagaagaguag

SEQ ID NO: 12635 - RNA, 1965 nt, Artificial Sequence
  Description of Artificial Sequence: Synthetic coding sequence
auggccccaaagaaauugucuugucuccgcagcuuguuacugccacugucccugacccuuuugcuaccccaagcugacaccagaagcuucgucguggauagagggcaugaucgguuucucuuggauggagccccguuccgcuacguaagcggcucucugcauuacuucaggguucccagagugcugugggcugaucggcuucugaagaugagguggaguggccugaacgcuauacaauucuauguccccuggaacuaucaugaaccucagcccgggguguauaacuuuaacggcucaagggaccucauugccuuucugaaugaagcugcgcuugcuaaccugcuugugauccuccgaccggguccauacaucugcgcugagugggaaauggguggguugccaucuuggcugcuucgaaaaccugagauucaucugcggaccucugacccugacuuccucgccgcgguagacucaugguuuaagguuuugcugccaaagauuuacccuuggcuauaccacaacggugguaacaucaucuccauucagguggagaacgaauaugggagcuaccgcgcaugugacuucagcuauaugaggcaccuggccggccuguucagagcucucuugggggagaagauccugcuguucaccacggauggccccgagggccugaagugcggcucucucagaggacuuuacacuacaguugacuuugguccagcagauaauaugacuaaaaucuuuaccuugcugcggaaauacgagccucaugguccccucgugaacucggaauacuacacagguuggcucgauuauugggggcaaaaucacucaacccggucagugucugcuguaacuaaaggacucgagaacauguugaaacugggagcgagugugaacauguacauguuucacggagggacuaacuuugguuauuggaauggugcugacaagaagggccgguuucuccccauuacaaccagcuacgacuacgacgcccccauuucagaggcuggggacccgacucccaagcuguuugcguuacgcgacgucaucaguaaguuccaggaagucccgcucggaccccugcccccccccagcccgaagaugaugcuagggccugugacucugcaucucguuggccaccugcuugccuuucuggaucuucuuugcccccgggguccuauucauucaauucuucccaugaccuucgaagcuguaaaacaggaccauggguucaugcuguauagaaccuauaugacacauaccaucuucgagccuacaccuuuuuggguaccgaacaacgguguccaugaccgggccuacguuaugguugauggcgucuuccaagguguaguggagagaaacaugcgggacaaacucuuccuuacuggaaaacuuggcuccaaauuggauauucuuguggaaaacaugggaaggcuuucauucggcucaaacaguagugauuucaagggucuccuuaagcccccaauccugggccagacaauccuuacacaguggaugauguucccucugaaaaucgacaaccucgucaaguggugguuuccacuccagcugcccaaauggccauacccacaagcuccaagcggaccgacuuucuacuccaaaacuuucccuauacugggcuccguuggagacaccuuucucuacuugccaggcuggacuaaaggucagguauggauaaacggauuuaaucuaggucgcuauuggacgaagcagggcccccaacaaaccuuauaugucccucgguucuuguuguuucccagaggcgcucugaacaagauuacuuugcuggaauuagaggacgugccacugcagccucagguucaguuucuggacaagccaauuuuaaacucaacuagcacgcuccaccguacacacaucaacucccuguccgcugauaccuuauccgcuucagagccaauggaguugucugggcauuag

SEQ ID NO: 12636 - RNA, 1173 nt, Artificial Sequence
  Description of Artificial Sequence: Synthetic coding sequence
augaaguuccagggaccucucgccugucugcugcucgcucuaugccugggaagcggggaggcaggaccgcuacagucuggggaggaaucuacggggacuaacauuggcgaggcccugggccacggacugggagacgcgcuuuccgagggaguuggcaaagcuauagggaaggaggcaggcggcgccgcuggcagcaagguuucagaagcucugggccaggggacucgggaggccgugggcacuggcguccggcaagugccaggguuuggcguagcagaugcacucgguaauagggugggggaagccgcccaugcccugggcaauacaggccaugaaaucgguaggcaggcugaggacgugauuaggcacggugcugacgccgucaggggaucguggcagggcguccccggccauaauggagcaugggaaacuagcggcggacacggaauuuuuggcagccagggcggcuugggaggccagggacaggggaaccccggaggucuggguaccccauggguacaugguuaccccggcaacucagccgguucauuuggaaugaauccucagggugcaccgugggggcagggugggaaugguggaccaccaaauuucggcacuaacacucaaggcgcuguugcucagcccggcuacggaagcgugagagcaucgaaucagaacgaagggugcacaaaucccccuccaaguggcuccggagggggcagcucgaauagcgggggcggauccgggucucagaguggguccuccgguucuggguccaauggcgauaacaauaacggcaguucaucugggggaagcuccagcgggaguucaucuggggggucuucgggggggagcucaggcgguucgucuggcaacagcggaggcucgcggggagauucuggcucugaaucaucuuggggaaguucaacagguucaucuagcggcaaucaugguggcagcgggggcgguaacggccacaaaccugggugcgaaaagccaggcaaugaggcuaggggcuccggggaaagcggaauucaaggauuucgcggacagggcgugagcaguaauaugaggaacagcgagaccucuccaggcauguucaacuucgauaccuuuuggaaaaacuuuaagucaaaacugggcuuuaucaauugggacgccauuaacaaauag

SEQ ID NO: 12637 - RNA, 846 nt, Artificial Sequence
  Description of Artificial Sequence: Synthetic coding sequence
auggguaguagaggccaaggucuguugcuggcuuacugccuccuacucgcauuugccucugguuugguuuuaagucgcgucccacacgugcagggcgagcaacaagagugggagggcacagaggaauugccuucaccccccgaccacgcugagagggcugaagagcaacaugaaaaauaccgcccaagccaagaucagggacuacccgcuucgagaugccugcgcuguugcgaccccggcaccaguauguauccagcaacagccgucccacaaauuaacaucacuauacuuaagggcgaaaaaggggaccgaggcgaccggggccugcaaggcaaguacggaaaaacuggcucagcaggcgcaaggggacacacagggccaaaggggcaaaaaggcagcaugggcgcccccggagagaggugcaagagccacuacgcugcauucagcguugggcgcaaaaagccaaugcacagcaaccacuauuaucagacugugaucuucgacacagaguucgugaaccuauaugaccauuucaauauguucaccggaaaauuuuacugcuacgugcccggccuuuacuucuucucccuaaacgugcacaccuggaaccagaaggaaacauaccuucacaucaugaagaacgaagaagagguugugauuuuauuugcccaagugggcgauagaaguauuaugcagucgcagucacugaugcuggagcugagggaacaagaucaggucugggugaggcuauacaagggugaaagggaaaacgccauuuucucugaggaacuugacacguauaucacuuuuucagguuauuuggucaaacaugccaccgagccauag

SEQ ID NO: 12638 - RNA, 876 nt, Artificial Sequence
  Description of Artificial Sequence: Synthetic coding sequence
guucucagcgccucaggaccuggaagaaaaaugggaagccgaggucaggggcucuugcuggcauauugucugcuccuugccuucgcuucaggccugguacucagcagagugccacacguccagggugagcaacaggaaugggaaggaaccgaggagcuaccaucuccaccagaccacgcugagagagcagaagagcagcacgagaaguaucgaccaucccaggaccaagguuugccagccucuagaugccugcggugcugcgaucccggaaccucgauguauccagcuacggccguaccccagaucaacauuacuauucuaaagggagaaaagggggauaggggcgaucgaggguuacaagguaaguaugggaaaacuggcagugccggagccagaggccauacgggcccaaagggacaaaaagguucaaugggggcgccuggcgaacgaugcaagagucacuaugcagccuuuagcgugggacgcaaaaagccuaugcauucuaaucacuacuaucagaccgucaucuucgauacugaguuugucaaucuguaugaucacuucaauauguucaccgggaaauucuacugcuaugugcccggccuguacuuuuuuucccugaauguacacacauggaaucagaaagagacuuaucuacauauuaugaaaaaugaggaagaagucguuauacuuuuugcccaggugggggaccgcucaauaaugcagagccaaucauugauguuagaguuaagagagcaagaccagguuugggugaggcucuacaaaggcgaaagggaaaacgcaaucuuuucugaagaacucgacacuuauaucacauuuuccggcuaccuggugaaacaugccacggagccauag

SEQ ID NO: 12639 - RNA, 1002 nt, Artificial Sequence
  Description of Artificial Sequence: Synthetic coding sequence
augguuuccaagagccgguggaaguuacuugcgaugcucgcacucguccugguggucauggugugguacucuauuagucgggaagaucgauauaucgaacucuucuauuucccaauuccagaaaaaaaggaaccgugccugcagggugaagccgaaucuaaggccaguaagcucuuugggaacuacucccgggaccaacccauuuuccugagacucgaagauuauuuuuggguaaagacaccgagcgccuaugaacuccccuaugggacuaagggaagugaggaucugcugcugcgaguucuugcaaucacuagcaguucuauuccuaaaaacauucagucacuccgaugucgacgcugugugguuguaggaaauggacaccgccugcgaaacagcucauuaggcgacgcuaucaauaaguaugauguggucauuaggcuaaauaacgcacccguggcuggguacgagggagacguaggcuccaagaccacaaugaggcuguuuuaucccgagagcgcccauuuugaucccaagguggaaaauaaucccgauacccuccugguguugguggcuuucaaagcgauggauuuucacuggauugagaccauccuuucagauaagaaaagagugaggaaaggcuucuggaagcagccaccccugauaugggacgugaaccccaagcaaauccggauccugaaucccuuuuuuauggagauugccgcugacaagcuccucucccugccaaugcagcagccgagaaaaauaaagcagaagccaacaacugggcuccuugcuauuacacuugcuuuacauuuaugcgaccugguucauaucgcggguuuugguuacccagacgcuuacaauaaaaagcaaacuauacacuacuacgaacagaucacacuaaagucuauggcaggcucuggucauaacgugucacaagaggcucuggccaucaaaagaaugcuugagaugggcgccaucaagaaccugacaucauuuuag

SEQ ID NO: 12640 - RNA, 312 nt, Artificial Sequence
  Description of Artificial Sequence: Synthetic coding sequence
augaguggccgggggaaagggggcaaagggcuggguaaggggggagccaaacggcaucgaaaaguguuaagagacaacauucaggggauuacuaagccggcuaucaggcgucuugcgaggaggggggggguuaagagaaucucuggacugauuuaugaggagacaaggggcguguugaagguguuccuggaaaacgugauaagggaugccguaacuuauacagaacaugcuaaaaggaagaccgugacugcaauggacgugguuuaugccuuaaagcgacaaggacgcacacuuuaugguuuugggggcuag

SEQ ID NO: 12641 - RNA, 312 nt, Artificial Sequence
  Description of Artificial Sequence: Synthetic coding sequence
augucgggcagaggcaaaggcgguaaagggcucgggaaaggaggagcgaaaagacacaggaagguccuacgagacaauauccaaggcauuacuaagcccgcuauccgacguuuagcucggcgaggcggcgugaagaggauuucggggcucauuuaugaggagacgcggggugucuuaaaaguguuucuagagaacgugauuagggaugcugugaccuacacagaacaugccaaacgaaagacagugacggccauggacguuguauaugcauuaaaacggcaagggcgcacucucuaugguuuugggggguag

SEQ ID NO: 12642 - RNA, 312 nt, Artificial Sequence
  Description of Artificial Sequence: Synthetic coding sequence
auguccgggagaggaaaaggcgggaagggacugggcaaaggcggggcgaagagacaccggaaagugcuucgggauaauauccaaggaauuacaaaacccgccauucggcggcuggccagacgaggcggaguuaagaggauaucaggucugaucuacgaggaaaccagggggguguuaaaagucuuccuggaaaaugucauccgagacgcgguaaccuauaccgagcaugcuaagcgaaaaacugugacggccauggauguuguguacgcacuuaaaaggcaggguagaacucuguacggcuuuggaggcuag

SEQ ID NO: 12643 - RNA, 312 nt, Artificial Sequence
  Description of Artificial Sequence: Synthetic coding sequence
augagcggaagggguaagggcgguaaaggccuaggaaaaggaggugcaaagcggcaccgcaaaguacugagagacaacauccaggggauuacuaagccagccauccgaagacuugcacggcgcggcggggugaagcgcauuuccggccuaaucuacgaagagacgcgcggaguccugaagguuuucuuagagaaugucauuagagaugccgugacuuacacugaacacgccaagagaaaaacagugacagcaauggaugugguauaugcacugaaaagacaagggcggacauuauauggauuuggggguuag

SEQ ID NO: 12644 - RNA, 2268 nt, Artificial Sequence
  Description of Artificial Sequence: Synthetic coding sequence
augcccccauuucucuugcuggaggcuguaugcguuuuccuguuuuccagggucccccccucucucccccugcaggagguucacguauccaaggagaccauuggaaagaucagcgcugcuucaaaaaugauguggugcagcgccgcaguugauauuauguuccuguuggacggcaguaacucugugggaaaaggcucauuugaacgcagcaaacacuuugccauuacuguuugcgacggccuggauaucucucccgagagagugagggugggcgccuuccaauucagcaguaccccccaccuagaauuuccccucgauucauuuagcacacagcaggaaguuaaagccaggauuaagaggaugguuuucaaaggcggacggacagaaaccgaacuagcucugaaguaucugcugcacagaggcuugccgggcggaagaaacgccucagucccacagauccugauaauagugaccgauggaaaaucucagggcgauguagcacugccuuccaagcaacuuaaggagcgaggggugacagucuuugcgguaggaguccgguucccccggugggaggagcugcaugcacucgcuuccgagccaagggggcagcacguucugcuggccgagcagguggaggaugcuacaaacggacucuucuccacacuaagcucauccgccaucuguucaagcgcaacaccugacugcaggguggaagcucauccaugcgaacaccgcacccucgagaugguuagggaguucgcuggcaacgcacccuguuggcgcgggucucggaggacacucgccguucuagccgcccauuguccguuuuauuccuggaaaaggguguuccugacccauccagcgaccugcuaccggacuaccugcccaggcccaugcgacagccaaccgugccagaauggaggcacauguguuccagaaggucuugacgguuaccagugucuuugcccucuggcuuuuggaggugaagccaauugcgcccucaagcugucucuggagugcaggguggaccuccuguuucuacuggacaguucggcagggaccacuuuagacggcuuccugcgugcuaaagucuucgugaagagguucgugagagcagugcuuuccgaggacucucgcgcacgagucggggucgcgacguauucucgggaacucuugguggcggugccugugggagaguaccaggacgugccugaccucguguggucacucgauggcauaccguuucgcggcgggccaacccuuaccggcucagcuuuacgucaggcugcugaacgcggauuugguagugcuacaagaacuggccaggaccggccuaggcgcgugguggucuuguuaacagagucucacuccgaggacgagguggccgggccugcgcggcacgccagggcucgcgagcuucuguuauuagggguggguuccgaggcgguacgagcggagcucgaggagaucacugggucaccuaagcaugugaugguguacucugauccccaggaucuguuuaaucagauaccagaacugcaaggaaaguuguguagccggcagcggccuggcugucgaacccaggcucuugaucugguuuuuaugcucgacaccucggcaucagugggaccagagaacuucgcacagaugcaguccuuugugaggucaugugcccuacaguuugaagugaacccagaugucacccaagucggacuggucgucuacgggucacaggugcagacugccuucggcuuggauacaaaacccacuagggccgcuauguugcgggccaucagccaggcucccuaccucggaggcguugguagcgccggaacugcccugcugcacauauaugauaaggugaugaccguacagaggggcgccagaccuggagugccuaaggccgucguaguccucaccggcggacggggcgccgaggacgcagccgucccagcacagaaguuaagaaacaacggaauaucgguucuggucgugggcguagggcccgugcucuccgaggguuuacguaggcucgcaggcccccgggacucacugauucacgucgcugcuuacgccgauuugagauaucaucaggauguucucaucgaauggcucugcggcgaagcaaagcagcccgucaaccuguguaaacccagcccaugcaugaaugaaggcaguuguguucugcagaauggcucauauagaugcaagugucgcgacgguugggaagggccccacugugaaaacagauuccugcgccggccuuag

SEQ ID NO: 12645 - RNA, 816 nt, Artificial Sequence
  Description of Artificial Sequence: Synthetic coding sequence
augauuaccggcguuuucaguaugcgacucuggacccccgucgggguacugaccaguuuggccuacuguuuacaucagcgaagaguugcacuugcugaacugcaggaagccgacggacaaugcccaguggacagaagccugcugaaacugaaaaugguacaggucguguuuagacacggugcgaggucaccacucaagccucugccccuugaagaacagguggaguggaauccgcagcuacucgaagugccaccucagacccaguucgauuacacagugaccaaucucgcaggcggcccuaaaccuuacucgccuuacgacagccaauaucaugagacuacacugaaaggagguauguuugcuggacaacugaccaaagugggaaugcagcagauguuugcguugggcgaacgucugagaaaaaacuauguggaagauaucccauuucuguccccaacguucaacccccaggaagucuuuaucagaucaaccaacauauuuaggaaccuggaaucuacgaggugccuacucgcgggccucuuccagugucaaaaagaaggaccuauuaucauucacacugaugaagcugacagugaaguguuauaccccaauuaccaauccugcuggucacuuaggcagagaacuagaggcaggcgccagaccgccucacuacaaccaggaauuucagaggacuuaaagaaggugaaggacagaaugggcaucgacucgagcgauaagguagauuuuuuuauucuguuggacaacguggcugccgaacaggaaaaaauggggagcugucgcuuccacggcucauag

SEQ ID NO: 12646 - RNA, 1395 nt, Artificial Sequence
  Description of Artificial Sequence: Synthetic coding sequence
auggaacacaguguuugucccuccuccgccguucaccugaucccuguaucaacccccaagaauggcaugagcagcaaaucccggaaacguauuaugcccgacccugucacugagccaccaguaacagacccuguguacgaagccuuacucuacugcaauauaccaaguguggcugaacggagcauggaggggcacgccccgcaccauuuuaaguuagucagugugcacguauuuauucgacauggggaucgauauccucucuacgugauaccgaaaacaaagcgaccagagauugauuguacacuuguagcaaacaggaaaccuuaccaucccaagcuugaggccuucauuucccauaugaguaaaggauccggcgccucuuucgaaaguccauugaauagucucccccuguauccuaaccauccccugugugagaugggugagcugacccagacgggagucguucagcauuugcagaauggacaacuacugagggauaucuacuugaagaagcauaagcuacuaccaaacgacugguccgcugaccaguuauaucuagagacgaccggcaaaucacgaacauuacagucaggucuggcccuguuguauggauuucugcccgacuucgauuggaagaagauuuauuuccggcaccaacccagugcucuguucuguagcgggucaugcuauuguccagugagaaaucaauacuuggagaaggaacagagacggcaguaucuccugagacuuaagaacagucaauuggagaaaaccuacggagagauggcgaagaucguggacguuccuaccaaacagcugagggcagccaaccccaucgauagcaugcucugucacuuuugucacaacguuuccuuuccaugcacacgaaaugguuguguggauauggagcauuucaaggucaucaaaacucaccaaaucgaggacgaaagagaacggcgggaaaagaaguuguauuucggguauucccugcucggcgcccaucccaucuugaaucagacaaucggcagaaugcaacgggccacggaaggaaggaaagaggaacuguuugccuuguacagcgcucacgaugucacccuuucgcccguccuuuccgcccugggucugagcgaggcuagauuuccccgcuucgccgcacggcucauuuucgagcuguggcaggaccgagagaaaccauccgagcauuccgugcggauucuauauaauggcguggacguaacuuuccacacgucuuucugucaagaccaccauaaaaggagcccuaagccaaugugcccacucgaaaaucucgugcgguucguaaaaagggacauguucguagcacugggaggcuccggcaccaacuacuacgacgccugccacagagagggcuuuuag

SEQ ID NO: 12647 - RNA, 1443 nt, Artificial Sequence
  Description of Artificial Sequence: Synthetic coding sequence
augcuguucaggaauagguuccuccugcugcucgcccuagcugcccuacuggccuucgugucuuugucguugcaguucuuucaucuuauuccaguuucuacaccaaaaaaugggaugucuuccaaaucacgcaaacgcauuaugcccgaccccguaacagaaccgcccgugacugaccccgucuaugaagcccugcuguauuguaauauucccuccgucgcagaacgaaguauggaaggacacgccccucaccauuucaaacuuguaagcgugcaugucuucaucaggcauggcgauagauauccucucuaugucaucccaaaaacaaaacgcccugagaucgauuguacccugguagcaaaucgcaagcccuaccaccccaaguuggaggcauuuaucucccauauguccaaagguagcggggcaucuuuugaaucaccacucaacagccugcccuuguauccuaaccauccucugugugaaaugggugaauuaacgcagacgggcgucgugcagcaccugcagaacgggcagcugcuuagagauaucuaucugaaaaaacacaagcugcuccccaaugacuggagcgccgaucagcucuaccuggagaccacaggcaagucccgaacccugcaauccggucuggcauuguuguacggcuuccuaccagacuuugacuggaagaagauuuacuuuagacaucagcccagcgcucuuuucuguagugggucuuguuauuguccugugaggaaccaguaccuugaaaaagaacagcgucgacaguacuuacugcgccugaaaaacucacagcuggagaagaccuauggugaaauggcuaaaauugucgauguuccaacuaagcagcugagggccgcuaacccuauugacucuaugcuuugccacuuuugucacaaugucucuuuucccuguacaagaaacggauguguggauauggagcacuuuaaggucauuaagacacaccaaauagaagaugaaagggaacgacgagagaagaagcuuuauuuuggcuauucgcugcugggagcccauccuauccuaaaucaaacaauagguagaaugcagagagcaacagagggucggaaagaagagcuguucgcacucuacucagcucacgacgugacccucagucccgugcuguccgcccucggccuaagcgaggcucguuuuccaagauucgcggcuaggcugauuuucgaacuguggcaggaccgagagaagccuucugagcauucaguccggauucuauacaauggcguugacgugacuuuccacacgagcuucugucaagaccaucauaagaggagccccaaaccuauguguccccuggaaaaucuaguccgcuucguuaaaagagauauguucguagcacugggcgguuccgggaccaauuacuaugacgcuugucauagggagggcuuuuag

SEQ ID NO: 12648 - RNA, 1311 nt, Artificial Sequence
  Description of Artificial Sequence: Synthetic coding sequence
augcagggcaccccuggcgguggaacacggcccggcccuagcccagucgauaggcggacacuccucgucuucucauucauccucgcugccgcccuuggccagaugaacuuuacaggugaucaggucuuaagagucuuggcaaaggacgagaaacagcucucucugcugggugaucuggagggguugaaaccacagaaaguugacuuuuggagaggcccagcuaggcccucucuccccguugauaugagggucccguucucagagcuuaaggacaucaaggccuaucuggagagccauggauuagcuuacuccauuaugauuaaggacauccaggucuuguuagacgaagaaagacaggcaauggccaaaucaagacgacuggaacgaucuacaaauuccuucucguauaguucauaccacaccuuagaagagauuuauaguuggauugacaauuucguaauggaacacuccgauaucgugucgaaaauccaaaucggaaacuccuucgagaaucaaucuauccuuguucucaaguuuucaacuggcggguccaggcaucccgcuauuuggauagauacagguauccacucccgcgaguggaucacacaugcuaccgguaucuggacagccaauaaaaucguaucugacuacgggaaagauaggguacucacagacauacuaaaugccauggauaucuucauugagcuugugaccaaucccgacgguuucgcauuuacgcacucuaugaauaggcucuggcggaaaaauaaauccaucagaccugguaucuucugcaucggcgucgaccuaaaccgcaacuggaagucaggauucggaggaaacggguccaauaguaauccuuguagugagacuuaucauggccccucuccucagagugaacccgaaguagcugccauagugaauuucaucacugcgcaugggaacuucaaagcccucauuaguauucauucauacagucaaauguugauguacccauacggccgccugcuagaaccgguuucaaaucaaagagagcuguaugaucuugcaaaagacgccgucgaggcccuguacaagguacacggcaucgaauacaucuucgggaguauaucuacuacucuuuacgucgcuucuggaaucaccguggauugggcauacgauucaggcaucaaguacgccuuuuccuuugagcuucgagauacaggucaauacggauuucuuuugccagccacacaaauuaucccuacagcucaagagaccuggauggccuugcggaccauaauggaacacacucugaaccauccuuauuag

SEQ ID NO: 12649 - RNA, 1161 nt, Artificial Sequence
  Description of Artificial Sequence: Synthetic coding sequence
auggcucaguggcauuguucacagcggacccaggcagguggccauggggucggggaaaggcuugcucagugccaggaccagaguucccgacacgcugccgagcucagagacuucaagaauaagaugcuuccucuacucgaggucgcagaaaaagaaagggaggcacugcgcacggaagccgauacuauuagcgggagagucgauaggcuggagcgggagguugauuaccuggaaacgcaaaacccugcacucccgugcgucgaguuugaugagaaagugacaggcggcccgggcacaaaagggaagggccgccggaaugagaaauaugacauggugacggauuguggcuauaccaucucacaagugagguccaugaagaucuugaaacgcuucggaggcccagccggacucuggaccaaagauccuuuggggcagacagaaaagauauauguucucgacggcacucagaaugacacugcguucguguucccacgacuuagagauuuuacccuggcaauggccgcucgcaaggcuagcagagugcgagugcccuuuccuuggguugggacgggucagcugguguacgggggcuuuuuguacuucgccaggagaccuccaggacgaccaggagggggaggugagauggagaauaccuuacaguuaauuaaguuucacuuggccaauaggacaguugucgacuccagcguguuucccgcagaggguuugauuccuccguauggguuaaccgccgacacuuauauugaucucgcugcugacgaagaaggacugugggccguguacgcuacucgggaggacgaucggcaccuguguuuagcaaaacucgauccacagacuuuggacacugagcaacaaugggacacacccugcccacgcgagaaugcggaagcagccuuugugaucugcggcaccuuguacguuguguacaacacacgccccgcuagccgggcccgcauucagugcucauucgaugccucagggacacuaacacccgaacgcgcagcccuuccuuacuuuccgaggagauauggagcacacgcgucacugcgauauaacccaagagaaagacaacuuuaugccugggacgacggcuaccagauaguguacaaguuggagaugaggaagaaggaagaggagguguag

SEQ ID NO: 12650 - RNA, 990 nt, Artificial Sequence
  Description of Artificial Sequence: Synthetic coding sequence
augcgcccgccaccagcccuggcccucgccggucugugccugcuggcucugcccgccgccgccgcuuccuauuucggauugacggggcgggaaguccugacuccguucccaggccucggcacggcugccgccccugcccagggaggagcgcauuuaaagcagugugacuuguugaaacugucacggcgacagaagcagcuuugccgccgcgagccaggucuggccgagacccugagagaugccgcacaucucggauuacuggagugccaauuccaguucagacaugaacgauggaacugcucgcucgagggucggaugggucuucugaagaggggguucaaggagaccgcuuuccuuuaugccguauccagugcugcacuuacgcauacccuggcacgcgccuguagcgccggucgaauggagcgaugcaccugcgaugauagccccggacucgaauccaggcaggcauggcaguggggugugugcggcgacaaccuuaaguauucgacuaaauuucugagcaauuuccuggggaguaagagagggaauaaggaccuaagagcgcgggccgaugcacauaauacccaugucgguaucaaagccgugaagucgggccuuaggaccacaugcaagugucacggcgugucuggauccugcgccgugagaaccugcuggaagcagcucagcccguucagagagacaggacagguacugaaguuacgcuaugauucugccgugaaagugucgagugccacaaaugaggccuuggggcgucuggaacugugggcaccggccagacaggggaguuuaaccaaaggacuugcgccccgcagcggugaucuuguuuacauggaggauuccccgucuuucuguaggcccucaaaauauucucccgggacagcuggauggagcgcugucgcaaggucccaauuaauaacaacgucuacuucccggauccaagcaauacuuccuucgcagcugccugaguag

SEQ ID NO: 12651 - RNA, 579 nt, Artificial Sequence
  Description of Artificial Sequence: Synthetic coding sequence
augcgguuagcagggcccgagagcagugugacggccgccccucgagcaaggaaauacaaaugcggacucccucaaccauguccagaagaacaucuugccuuucggguggugucuggggccgcuaauguuaucggaccaaagaucugcuuggaggacaagaugcucaugucuagugugaaggauaauguaggucgcggauugaacauugcacucgugaauggcgucuccggggagcucaucgaggcccgggcguuugauaugugggcaggagaugucaacgaucuacuuaaauucauccgcccacugcaugaaggcacucugguauuuguagcgucguacgaugacccagcuacgaaaaugaacgaggagaccagaaaauuguucagcgagcuuggcagccgcaacgcaaaggaacucgccuuucgcgacuccuggguguuugucggagcaaagggcguccagaacaaaucaccguucgagcagcacguaaagaauaguaagcauaguaauaaguacgaaggcuggcccgaggcacuugagauggaagggugcauaccucguaggagcacggcuaguuag

SEQ ID NO: 12652 - RNA, 1053 nt, Artificial Sequence
  Description of Artificial Sequence: Synthetic coding sequence
augaagugcagucugcgcguuugguuuuuaagcguggcauuccuacugguguuuauaaugagccuccucuucaccuacucccaucauucaauggccacccugccuuauuuagacagcggggcgcuggacggcacacacagaguuaagcuggugccuggcuacgcuggacugcagcgacugucuaaagaacggcugagugguaagucaugugcaugucgacgguguaugggcgaugcuggcgcaucagauugguucgacucacauuucgacggaaauauaagccccguguggaccagagaaaacauggaucuuccuccagauguucagcggugguggaugaugcugcaaccccaguuuaaaucucauaauacuaacgaggucuuagaaaaacuguuucaaaucgugcccggagagaaucccuauagguuucgagacccccaccaauguaggaggugcgcugugguuggaaauagcgggaacuugcgaggaagcggauacggccaagacguagacggacacaauuucaucaugcggaugaaucaggcgcccacagucggauucgaacaggacgucggcucaagaacuacgcaccauuuuauguacccggaguccgccaaaaauuugccugccaacgugucauucguucuggugccguuuaagguccuagaccugcuuuggaucgcuagugcccuuaguacgggacagaucagguuuaccuaugccccuguuaaaucuuucuuaaggguggacaaagagaaagugcagauuuauaaccccgcauucuuuaaauacauccacgauagauggacggagcaccacgggagguauccaucuacaggcauguugguucuuuuuuucgcucugcaugucugcgacgagguaaauguguacggguucggcgcagacagccgaggcaauuggcaccacuacugggagaacaauagguacgccggcgaauuccguaagaccggggugcaugaugccgauuuugaagcacacaucauugauaugcuggcaaaggcuucaaagauugagguguaccggggcaacuag

SEQ ID NO: 12653 - RNA, 189 nt, Artificial Sequence
  Description of Artificial Sequence: Synthetic coding sequence
augaagauccagcuauuuuuuuuuauucuucauuucugggucacaauucucccugcacggucaaacuucgagccuaaauaccgcuucgagagaugugaaaaagugagagguauuugcaaaacguucugugaugaugucgaauaugacuauggauauugcauuaaguggagaucccaaugcugcguuuag

SEQ ID NO: 12654 - RNA, 738 nt, Artificial Sequence
  Description of Artificial Sequence: Synthetic coding sequence
augacgcuguucccaguccugcuauuccugguggcuggacuucucccuagcuuucccgccaacgaagacaaagauccagcuuuuaccgcacuccugacgacccagacccagguccagagggaaauagucaauaagcacaacgagcuccgccgcgcuguuucuccucccgcucggaacauguugaaaauggaguggaacaaagaggcagccgccaacgcacagaagugggcaaaucaguguaacuauagacacucgaacccuaaggaccggaugaccucucugaaaugcggcgagaaccuguauaugagcagcgccagcucaagcuggucucaggccauucagucuugguuugacgaguacaaugauuucgacuucggaguuggcccaaaaacgccgaaugcggucguuggucauuacacacaaguuguuugguacuccagcuaccuuguagguuguggcaaugccuauuguccuaaccaaaaagugcuaaaauacuacuaugucugucaauauugcccugcggguaacugggccaacagauuguacguuccuuaugaacagggcgccccaugugcguccugcccugacaacugcgacgacgggcugugcaccaacggcuguaaguacgaggaccuuuauuccaacuguaaaucgcugaagcugacucucacauguaaacaccaacugguaagagauuccuguaaagcauccugcaauugcucuaauucuaucuauuag

SEQ ID NO: 12655 - RNA, 1341 nt, Artificial Sequence
  Description of Artificial Sequence: Synthetic coding sequence
augcuacauccggagacuaguccugggagaggccaccuccucgcuguguuacuggcacuacugggaacugcuugggcugagguguggcccccucagcuucaagaacaggcccccauggcaggggcauuaaaucggaaagagucauuccugcuucuuagccuccacaauaggcuacgauccuggguccagccaccugccgccgauaugcggagacuggacugguccgauucucuugcccaacuggcccaggcgcgcgcugcuuugugcgguacgccaacccccucucuugccuccggguuguggcgcacgcuccagguuggauggaauaugcaguugcucccugccggacucgucucuuuuguagaagugguaucccucugguucgcugaaggccagcgguacucacacgccgccggggagugcgccagaaaugcuacuugcacucauuauacacagcuuguuugggccacauccucacaacugggcuguggacgucaccuaugcucagcuggccaagcggcuauagaagccuuugucugugccuauagcccucgaggaaacugggaaguaaacgggaagacuaucgugccuuauaagaaaggagcuuggugcucacuaugcacagccucggugucagguugcuucaaggcaugggaucaugcuggcggcuugugugagguuccgcgaaacccgugcaggauguccugucaaaaccauggacgucucaauauuaguacaugccacugccacugccccccaggcuauacaggcagguauugucagguccggugcucacuucagugcgugcauggacgcuuucgagaggaagagugcucuuguguuugugacauagguuauggcggagcucagugcgcaacuaaggugcauuuucccuuucauacgugcgaccugcgaaucgauggggauugcuuuauggugucaagugaagcagacaccuacuacagagccagaaugaagugccagagaaagggaggcguuuuagcgcagaucaaaucccaaaaaguccaggacauucucgcuuucuacuuggggcgguuagagacaaccaaugaggugauugauuccgacuuugaaacuaggaacuucuggauuggauugaccuacaagacugcuaaggauuccuuucgcugggccacaggggaacaccaggcauuuacaucguuugcauuuggccaaccagacaaccauggguucgguaacuguguggagcugcaggcuuccgcugcuuuuaauuggaaugaccagagauguaaaacccgcaaucgauauauaugccaauuugcacaagaacauauuagccguuggggaccagguuccuag

SEQ ID NO: 12656 - RNA, 585 nt, Artificial Sequence
  Description of Artificial Sequence: Synthetic coding sequence
augaccaugcgccauaacuggacucccgaucugagcccgcuuugggugcuccuacuaugcgcccacguuguaacacuucuggugagggccacuccggugucacaaacuacuacugccgccaccgccagcgugaggucuacgaaagauccauguccuucacaacccccuguguucccugccgccaagcagugcccagcccuagaagucacauggcccgagguggaggucccccugaacgggacgcuuucucucagcugcgucgcuuguagccgauuccccaauuuuucuauccuauacugguuaggaaaugguuccuucauugagcauuugcccggaagauugugggaaggcucuacuagucgugaacguggcucuaccgguacacaacugugcaaagcacucguacucgaacagcucacccccgcauuacauucaacuaacuucagcugugugcuuguugaccccgaacaaguuguucagaggcacgucguuuuggcccagcuaugggcuggcuuaagggcaacacugcccccaacacaggaagcacugcccucaucucacuccucaccgcagcaacaaggauag

SEQ ID NO: 12657 - RNA, 585 nt, Artificial Sequence
  Description of Artificial Sequence: Synthetic coding sequence
augacaaugcgccacaauuggacaccagaccuuagcccucuaugggugcugcuccucugcgcucauguugugacacugcucguacgggcgacuccuguaucccagacaacaaccgccgcuaccgccagcguaagaucuacaaaagacccuuguccuucacagccgccuguguuccccgccgccaaacagugcccagcacuagagguaacauggcccgagguggaggugccacuuaacggcacacugagucuaucuugcguggcaugcagccgcuucccuaacuucagcauccuuuacuggcugggcaauggcagcuuuaucgagcaucuacccgggagauugugggaaggguccacuucaagggaacgaggcucuaccgggacccaauugugcaaggcacucguacuugagcagcugacgccagcgcugcauucaacuaacuuuaguuguguauugguugacccggaacaggucgugcagagacacgucguccuggcucagcugugggcgggacugcgggcuacauuacccccaacucaggaagccuugccuagcucacauucuucuccccagcaacaaggauag

SEQ ID NO: 12658 - RNA, 348 nt, Artificial Sequence
  Description of Artificial Sequence: Synthetic coding sequence
augacuaugcgacacaauuggacuccugaccucucaccauugugggugcucuuacugugcgcucaugugguuacccuuuuaguccgagcaacuccugugagccagacgacaaccgcagcuaccgcaagcguacgaaguacaaaagauccaugccccagccagccaccuguguuuccagcggccaaacaauguccggcucuugagguuacguggcccgagguggaggugccucugagcugggcggaaggaaaccuagcaccacacccucgcucuccagcuuuacagccccagcagucaaccgccgccggccugagacucaguaccggucccgcagcugcucagccauag

SEQ ID NO: 12659 - RNA, 528 nt, Artificial Sequence
  Description of Artificial Sequence: Synthetic coding sequence
augcucccucccauggcacuccccuccguuaguuggaugcugcugucaugccucaugcugcucagccaaguacagggggaagaaccacagcgcgaauugccaucagccagaauucgcugucccaagggaagcaaagcuuacgggagccacugcuaugcucuauuccucagcccuaagagcuggaccgacgcagacuuagcaugucaaaaacgacccagcgggaaccugguuaguguguugucaggcgccgaagguucuuuuguuucaaguuuagucaaauccauugggaauagcuacaguuacguguggauaggccuucacgaccccacccagggaaccgagccuaauggcgagggcugggaguggagcagcagcgaugugaugaauuauuucgcaugggaaagaaauccaagcaccaucucgucucccggucacugcgcaucacuuucccgauccaccgcauuccuuagauggaaggacuacaauugcaacguaagacugcccuacguuuguaaauuuacugauuag

SEQ ID NO: 12660 - RNA, 993 nt, Artificial Sequence
  Description of Artificial Sequence: Synthetic coding sequence
auggguaagcugugucuaggcccaacucuguguccugcugcagcugccgaggaaagcagggaugcugagccccgccgugaacuccucuguucuggacgucccuggaccuggagagccgcugcccgagugacgaccaugauucccugggugcuucuggcaugugcucuuccuugcgccgccgauccucugcugggagcguucgcacgaagagauuuccgcaaaggcucuccccaacuuguaugcucucugccuggaccacagggaccucccggaccucccggggcccccggacccagcggcaugauggggcguaugggguuucccggcaaggaugggcaagauggacacgacggugauaggggagauagcggagaggaggggcccccuggccgcacugguaaccgggguaagccgggacccaagggaaaagcuggcgccauaggacgagcuggcccaagagguccaaaagggguuaacgggacaccagggaagcacggcacaccuggcaaaaaggggccuaaggggaagaagggugagccuggccucccagggccuuguagcuguggauccggucacacaaagucugcauucucuguggccguaacuaaaaguuauccaagagaaagguuaccaauuaaauuugacaaaauucucaugaacgaagguggccacuauaaugccaguuccgggaaauuugucuguggcgucccaggcaucuacuauuucacuuaugacaucacccucgcaaauaagcaucucgcaauuggccucguucauaacggucaguaucgaauaaggacauucgacgccaauacaggcaaccaugaugucgccucagggaguaccauacuagcccugaagcagggcgaugaaguguggcuacaaaucuucuacagugaacagaauggacuguucuacgauccuuacuggacugacucucuuuuuacuggcuuccuuauuuaugcagaucaggacgauccgaaugaaguguag

SEQ ID NO: 12661 - RNA, 390 nt, Artificial Sequence
  Description of Artificial Sequence: Synthetic coding sequence
augagacugcuccuccuggugccacugcugcuagcacccgccccagggagcuccgccccuaaggugcgccggcaaagcgacacuuggggcccauggucacaguggucucccuguaguagaacaugcggaggagggguuagcuuuagagagcggccaugcuacucccagcgaagggacggaggauccaguuguguggguccagccagaagccacagaucaugccgcacagagucuugccccgauggggccagagauuuccgagcagaacagugcgcagaauucgacggagcugaguuucaagggaggagauaccgcuggcugccauacuauagcgcacccaauaagugugaauugaauuguauaccuaagggacucggguugcagggcuag

SEQ ID NO: 12662 - RNA, 1227 nt, Artificial Sequence
  Description of Artificial Sequence: Synthetic coding sequence
auguucucaaaugcaaacucuagaucaaagauguggcuacuacugacaauggcaucccuuauuucgguguuggggacgacucacgggcuuuuuggaaagcugcacccagguucaccagaggugacgaugaacaucagccagaugaucaccuacuggggauauccuaacgaagaauacgaagucgucaccgaggacggauauauuuuggaaguuaacagaauuccguauggcaagaaaaacagcgguaacacagggcagagaccugugguguuccuucagcacgggcuucuagcgucggcaacaaauuggauaagcaacuugccuaacaauucuuuggcauucauucuggcggaugcuggauacgacguguggcugggcaacuccagaggcaacaccugggccaggcggaaccuguauuacuccccugauucgguagaguucugggcauucaguuucgacgagauggccaaauacgaucugcccgcaaccauagauuuuaucgugaaaaaaacaggccaaaagcaguuacauuacgugggucauagucaggguacaacuaucggauuuaucgcauuuagcaccaauccuagccuugcuaaaagaauuaaaacuuucuaugcgcuggccccugucgcaacuguuaaguauaccaagucccugaucaacaagcuaagguucguuccgcaaucucucuucaaauuuauuuucggagacaaaaucuucuacccucauaacuuuuuugaccaauuccuggcaacugagguguguagccgcgagaugcuaaaccuucucuguucuaaugccuuauucauaauaugcgguuuugauagcaagaacuuuaacaccaguagacuagauguguaucugucucauaacccugccgggacuagcgugcaaaauauguuccauuggacacaggcaguuaaaucaggaaaauuucaggcauaugacugggguuccccagugcagaaccgaaugcauuacgaucaaucacagccacccuacuauaaugucacagcgaugaacgucccuaucgcuguguggaacggcggaaaggaucuguuggcugacccgcaagaugugggccuucuccugcccaaacuuccuaauuuaauuuaccauaaagaaauuccuuucuacaaucaucuugacuuuaucugggcuauggacgcuccacaagaaguguauaaugacauuguuagcaugauuagcgaggacaagaaauag

SEQ ID NO: 12663 - RNA, 393 nt, Artificial Sequence
  Description of Artificial Sequence: Synthetic coding sequence
auggcauccgauuugauucggaccaucuuagccguggcuuugaucuccaagcuaggcacagccguagacgccgaauuaaugccaucaggggccauacuacaaaacaagcgcgagaaccucccccgcgugugucaugcgcucgcauuucucggcauggcuagaugucaggaucucuuucucguccgucuacagggguggaaguugggcacgagauuccaggacggcccuagaucuacgccacaggaagaaggcgggaguccacaacgaaaacggggcaugccagugcaaauucacuuccugcucaaaucauucuuauccuccccuaucaccuuugccuuuaucucguuagcgcguacugugucucucgccacagcuauaugcaagaucguguag

SEQ ID NO: 12664 - RNA, 393 nt, Artificial Sequence
  Description of Artificial Sequence: Synthetic coding sequence
auggcauccgacuuaauuaggacaauucuugccgucgcccugaucagcaagcuugggacagccguugaugccgaguuaaugccuagcggagcaauccugcaaaacaagcgagagaaccucccccgugucugucaugccuuagccuuucugggaauggcucguugucaggauuuauuucucgugcgcuuacaagguuggaaauuagguacccgcuuucaggacgguccaaggagcaccccacaggaggaagguggaagcccgcagcgaaaaagagggaugcccgugcagauucacuuccucuuaaaaucuuuucucuccucuccuauaaccuucgcuuuuaucucguuagccaggacugucagccuggccaccgcuauuugcaagauuguauag

SEQ ID NO: 12665 - RNA, 1731 nt, Artificial Sequence
  Description of Artificial Sequence: Synthetic coding sequence
augauaguguuuggcugggcuguguuucuugcuagucgcagccugggucaggggcuccugcuuacucuggaggagcacauugcacauuucuuggguacgggcggcgccgcgacuacuauggggaacuccuguaucugcagggaugacucuggaacagacgacagcguugacacacagcagcagcaagcagaaaauucugcagucccuaccgccgauacccggucacagccaagagaccccguccgaccucccagacggggacggggcccacacgaaccaaggagaaaaaagcagaaugucgauggucuggugcuggacacucucgcuguaauccgcaccuugguggacaaugaccaggagccccccuauagcaugaucacacugcacgaaauggcugaaacugacgaaggguggcuugauguugugcagucacugauucguguaauaccacuagaggauccacuuggcccggccgugaucacacuccuacuugacgaaugcccccugccaacuaaagacgcccugcaaaagcucacugaaauccucaaucucaauggugagguggccugccaggauuccucccacccugccaaacacagaaauacuuccgcugugcuugggugccucgcggagaaauuagcagggccagcaagcaucggacugcuaucgccugggauucuggaauaucugcugcagugccugaaacuucaaucacauccuacagugaugcuguuugcuuugauugccuuagaaaaauuugcccagaccuccgagaacaaacugacuauaucugaaaguucuaucuccgauagacuggugacccuggaguccugggccaaugauccagacuaucuuaagagacagguggguuuuugcgcucaguggucccuggacaaucuauuucugaaggaaggccggcaacugacguaugaaaaggugaauuugagcucuauucgcgcgaugcugaauuccaacgacgucucugaguaccugaagaucucaccacacggacuugaggcgagaugcgacgcuuccagcuucgagucagugcgcugcacguuuugcguggacgccggagugugguacuacgaagugacgguggugaccuccggaguuaugcaaauugguugggccacgagggacaguaaguuccugaaccacgagggauacgggaucggcgaugaugaguacagcugcgcguacgacggaugccgccaacugauuugguauaaugcaagaagcaaaccccauauacauccaugcuggaaggagggcgacacgguaggauucuuacuugaccugaacgaaaaacagaugaucuuuuuccucaauggcaaccagcuaccaccagagaaacaaguguuuagcagcacaguauccgguuucuuugcggccgccagcuuuaugucuuaccaacaaugugaauucaauuuuggagcgaaaccuuucaaguacccccccagcaugaaauuuagcacuuuuaacgacuaugccuuccuuaccgcagaggagaaaaucauccugccacgccaccggagacuagcccugcuuaaacaggucaguauucgcgagaauugcugcucacuguguugugacgagguggcugauacccaacugaaaccauguggacacucggacuuguguauggauugcgcgcuucaacuugaaacaugcccucuuugcaggaaggaaaucgugucuaggauacggcagaucagucacauuucguag

SEQ ID NO: 12666 - RNA, 360 nt, Artificial Sequence
  Description of Artificial Sequence: Synthetic coding sequence
auggcaaggccuggaauggaaagauggagggauagacuggcacuugucacaggggcuagugggggcauuggggccgccguggccagggcgcuggugcaacagggccuuaaaguugucggaugugcccggacaguggguaauaucgaagaacuggcagcugaaugcaaaucugcaggguacccaggcacuuugauaccuuaucggugugacuuaucaaacgaggaggacauucuauccauguucagugcaauucgcucccagcacagcgguguggacauaugcaucaacaacgccggguuagcuagaccagacacucuacuuagcggcuccacuucuggauggaaagacauguucaacuag

SEQ ID NO: 12667 - RNA, 144 nt, Artificial Sequence
  Description of Artificial Sequence: Synthetic coding sequence
augcagguuucuacagcagcccuggcgguacugcuuugcacgauggcauuauguaaccagguccugagcgcuccucaagccggccguuccguucuaaccccugugcgcuccgggucucguaauacaucugugacaugguccuag

SEQ ID NO: 12668 - RNA, 159 nt, Artificial Sequence
  Description of Artificial Sequence: Synthetic coding sequence
augcaagugucaacagccgcucuugccguccuacucuguacuauggcgcucugcaaccagguacugucugcuccuuuaucuaggccucgugaagccggacgcagcguucucacuccaguucgaagcggcagcaggaauacuagcgugaccuggucguag

SEQ ID NO: 12669 - RNA, 1272 nt, Artificial Sequence
  Description of Artificial Sequence: Synthetic coding sequence
auggagcuggaacucaugcccuuuaacgugcugcucaggacuacccuugaccuccugcaggaaaaagauccagcccauaucuuugccgaacccgugaaucuuagcgaagugccagacuaucuggaguuuauaucaaagccaauggacuuuaguacgaugagacguaagcuggagucccaucucuauagaacuuuggaagaguucgaagaggauuuuaaucugauugugacuaacugcaugaaauacaaugccaaagacacaauauuucauagagcagcagugcgucuucgcgaucuaggcggagccauucugcgccacgcccgccgccaggcggaaaacaucggcuaugacccugagcggggaacucaccuaccagagucaccuaagcuugaagauuucuaucgcuucagcugggaggacguugauaauauuuugaucccagagaauagggcacaucuuagccccgaagugcagcucaaggagcuacucgaaaaacuagaccucguaagcgccaugcgaucgagcggagcacgcacccgacgaguccgacuccugcggagagaaauuaaugcccuucgacagaagcuugcacagcccccuccuccacagccacccucauuaaacaagacugucagcaacggugagcuccccgcagggccgcaaggagaugccgcugugcuggagcaagcccugcaagaggagccugaggacgacggcgauagagaugauagcaaauugccaccacccccuacccuugagccuaccggucccgcaccgucucugagugagcaggaaucaccacccgaaccaccuacccugaaacccauuaacgauucuaaaccucccucucgcuuccugaaaccacggaaagucgaggaagacgaacugcuagaaaagagcccccuucagcuaggcaacgaaccacugcaacgucuccugagcgauaacgggauaaauaggcugagucucauggcucccgauaccccggcugggacuccacuuaguggagucggaagacguaccagcgugcuguuuaagaaggcgaaaaacggagugaaacugcaacgcucgccggaucgcgugcucgagaauggcgaagaccacggcgucgcaggcucacccgcuagcccugccagcauugaggaagaaagacacucucgcaagagacccagaucacgcagcuguucagagucagaaggcgagcggaguccccagcaggaagaggaaacaggaaugacgaauggcuuuggcaagcacagaaagcgcguguag

SEQ ID NO: 12670 - RNA, 3030 nt, Artificial Sequence
  Description of Artificial Sequence: Synthetic coding sequence
auggggucagggcgcgugcccggccuuugccuuuuggugcuucucgugcaugcacgugcagcgcaguacuccaaagccgcccaggaugucgaugaguguguugaagggacagauaacugccacauugacgccaucugccagaauacgccacgcuccuauaaaugcauuugcaaguccgguuacacuggggacggaaaacacugcaaggacguggaugagugugaaagggaggacaaugccggcuguguccaugacugcgucaauauccccgguaacuacagauguacuugcuaugacggcuuucauuuagcacaugauggccacaacugucuugauguggaugaaugugccgagggcaauggcggcugccaacaaucaugcgugaacaugaugggcaguuaugaaugucacugccgggaaggcuucuucuugucagauaaccagcauaccuguauccagcguccugaggagggcaugaacuguaugaauaaaaaccauggcugugcacauaucugcagagagacuccaaaggguggaaucgcuugcgagugccgccccggcuuugaacugaccaagaaccagcgagauuguaagcugaccuguaauuaugguaacgggggcugccagcacacaugcgacgacacagagcaggggccuaggugcgguugccauauuaaguucgugcuacacacugacggcaaaacaugcaucggggagaggcgccuggagcagcauauuccgacucaggcaguaagcaacgagacgugcgcagucaacaauggugggugugauaguaagugucaugaugcagcaaccggugugcacugcacguguccagugggguucaugcuacagccagaccguaaaaccuguaaggacaucgaugagugccgucugaacaacggggggugcgaucauauuuguaggaauaccgugggaagcuuugagugcagcuguaaaaagggauacaagcuucuaauuaaugagaggaauugccaggauauugaugaguguaguuucgaccgcacaugugaucacaucugcguuaacacccccggcaguuuccagugucuuugccaccguggguaccuuuuauacggaauuacacacugcggcgaugucgacgaauguaguauuaauagaggaggaugccgguucggauguaucaacacaccaggauccuaucaauguacaugcccugccggccagggacgucugcacuggaacggcaaggauugcacagagccacucaagugccaagggucccccggcgcuagcaaagcaaugcuguccugcaauagaucuggcaagaaagacaccugcgcuuugacuugucccucaagggcaagauuucuucccgagucagaaaacggauuuacagucucuugugggacacccucaccacgggccgcaccagcacgugcggggcauaauggcaacagcacaaauucuaaccacugccacgaagccgcaguucugucuauuaagcagcgagccuccuucaaaaucaaggacgccaaaugucggcuucaucugagaaacaaggggaaaacugaggaggcggggcgaauuacugggccuggaggcgcacccugcucugagugccaggucaccuucauucaccucaaaugcgauagcaguagaaaagggaaagggcggagggcccggaccccccccggaaaagaagugacucgacugacccuggaacuggaggccgaaguacgcgcugaggaaaccacagccuccuguggucuccccugucuccggcagcggauggaacggagacuuaaaggcucccugaaaaugcugagaaaaaguaucaaccaggauagauuccugcugcgccucgcuggacuggacuacgaacuggcucacaagccaggccuaguggcuggugaacgggcugagccgauggaaagcugccgccccggucagcaccgagcagguacgaaaugcguauccugcccacagggaacauauuaucauggacaaaccgaacagugcguuccaugccccgcuggcaccuuucaggaacgcgagggccagcuuuccugugaccugugccccggauccgacgcacacggcccucuuggagcuaccaacgucacuaccugugccggucagugccccccaggccaacauucuguggacggauuuaaaccaugucaacccugcccgagaggcacuuaccagccggaagccggacggacacucuguuucccuugcggggggggguugacuacaaagcaugagggcgcaaucucauuccaagacugcgacacaaagguucaauguucccccggucauuacuacaauaccagcauucaccgaugcaucagaugugcgauggggucauaccagcccgauuuuagacaaaacuuuuguucuagaugcccagggaacaccaguacugauuucgacggauccacuucuguugcccaguguaagaaucggcaaugcggcggcgagcugggcgaauuuaccgguuacauugaaucccccaacuauccugguaauuaucccgccggcguggagugcauauggaacauuaacccaccaccaaaaagaaaaauccuuauugucguuccugaaauauuccugccaucagaggacgagugcggcgaugugcuggugaugaggaagaauucuagcccaaguuccaucacgaccuaugagacuugucagacauacgagagacccaucgcguuuacugcaagaagcaggaagcuguggaucaauuuuaagacuucugaggccaauucagcacggggcuuccagauucccuauguuaccuaugacgaagacuaugagcagcugguggaagacaucgugcgagaugggcggcuguaugccucugaaaaucaucaagaaauucugaaggacaagaaacugauuaaagccuucuuugaaguguuagcgcauccucagaauuacuucaaguacaccgaaaagcauaaggaaaugcugccaaaaaguuucauuaagcugcugagaagcaagguauccucuuuucugcggccuuauaaauag

SEQ ID NO: 12671 - RNA, 984 nt, Artificial Sequence
  Description of Artificial Sequence: Synthetic coding sequence
augacugccuuggaacuggccagacgcggggcaagaguuguccuggccugccggagccaagagcgcggugaggcagccgccuuugaucugcgccaagagagcggaaauaaugaggucauuuucauggcucucgaucuugcuucacucgcaagcgucagggcuuucgcuaccgccuuucucucauccgagccuagacuggacaucuuaauacacaacgccgggauuaguucuugcggccggacccgugaagccuuuaaccuacuguuacguguaaaccauauaggccccuucuuauugacacaccuccuucucccuuguuugaaagcaugcgcaccaucucgggucguagugguagccagcgcugcccauugucgcgguaggcuggacuucaagagacuugaucguccuguugugggcuggagacaagagcugcgggcauaugccgacacaaaguuagccaacguccuuuuugcaagagagcuggcuaaccaacuggaagccacaggggucaccugcuacgccgcccacccaggcccaguuaacagcgaauuguuucugcgccaugugcccgguuggcuuaggccccucuuaagaccacucgccugguuggugcuccgcgccccccguggcggcgcacaaaccccauuguacugugcccuccaggaagggaucgaaccucuuucaggccgauauuucgcuaauugccauguagaagaagugccccccgccgcgagggacgaucgggcggcucauagguuaugggaagcuuccaagcggcucgccggucucgguccuggcgaagaugcugagccugaugaagauccccagucagaagauuccgaggcucccuccagcuugagcaccccacauccugaggagccuaccguuagucaacccuacccuagcccccagagcagccccgauuuaucgaagaugacucaucggauucaagcgaagguugagccggagauccagcucucuuag

SEQ ID NO: 12672 - RNA, 1320 nt, Artificial Sequence
  Description of Artificial Sequence: Synthetic coding sequence
augccagccaucgccguucuugccgcugcggcagcugcaugguguuuccugcaaguggagucuaggcaccuggaugcucuagcagguggcgccgggcccaaccauggcaauuuucuggauaacgaucaguggcuaagcacggucucucaguaugauagggacaaguacuggaaucgcuuccgcgaugaugacuacuuuagaaauuggaacccaaacaagcccuuugaucaagcccucgaccccucgaaggauccauguuuaaaaguaaaguguuccccacauaaaguaugugucacacaggauuaccagaccgcccugugcgucagccggaaacaucuccugccuagacaaaagaaaggcaacguggcccagaagcauugggugggcccauccaauuuagugaagugcaagccaugcccuguggcucagucagcaaugguaugugggucagacggccacagcuacacauccaaaugcaaacuagaauuccaugcuuguucgaccgguaaaucucuggcaacacucugcgacggcccuuguccuugcuugcccgagccagaaccgccgaaacacaaggccgagcgaucugcauguaccgacaaagagcuacggaaccuggccucuagguugaaggauugguuuggcgcacugcacgaggacgcuaacagggugaucaaaccgaccucuuccaacacugcacagggccguuucgacacaagcauucuuccaauauguaaagauagcuugggcuggauguucaauaagcuggacaugaacuacgaucuccuguuagaucccucagagaucaaugcuaucuaucuagauaaauacgaaccuuguaucaaaccguuguucaauucgugugauucuuuuaaggacgguaaacuuucuaauaacgaauggugcuacuguuuucagaaacccggcgggcuuccaugucaaaacgagaugaauaggauacaaaagcugucaaagggcaagucccuucugggcgccuucaucccgaggugcaacgaggagggcuauuacaaggccacucagugucacggcucgaccggucagugcuggugcguggacaaguauggcaaugaguuagccggaaguagaaaacagggggccguuagcugcgaggaggaacaagagacuuccggggauuuugguucaggggguucggugguacugcuagaugacuuggaguaugagagagagcugggacccaaagauaaagaagggaaacuuagagugcauacacgcgcuguuacugaggacgacgaggaugaagaugaugacaaggaagaugaggugggcuacaucugguag

SEQ ID NO: 12673 - RNA, 3687 nt, Artificial Sequence
  Description of Artificial Sequence: Synthetic coding sequence
augaagggcgccagacucuuuguccuuuuauccucacucuggaguggcgggauaggccugaauaacucuaaacacagcuggaccauccccgaagacggcaauagccagaagaccaugccaucugccaguguaccaccuaauaagauacagucucugcagauccuucccacaacccgcguuaugagcgccgagaucgcuacaacuccugaggcucggacgagugaggauagcuugcugaagucuacccugcccccaucagagacaucugcuccugcagaaggcguuaggaaccagacgcucaccagcacagaaaaggcugagggcguggugaaacugcagaauuugacacuccccacgaaugcaucuauuaaguucaauccaggugcugaguccgugguccugaguaauucuacacugaaauucuuacaaucuuucgccaggaaaaguaacgagcaggcaacgucccugaacaccgugggcgggacaggagggaucggaggggugggcgguacaggcggggugggcaacagggcacccagggaaacauaucucucccggggcgauagcucuuccucucagcguaccgacuaccagaagagcaacuuugagaccacccgcgguaagaauuggugugcuuaugugcacacucgacugucacccacagucauucuggauaaucaagugaccuacgucccuggaggaaaagggccuuguggcuggaccggcgggagcugcccacagcgcagucagaaaauauccaaucccguuuacaggaugcagcacaaaaucgugacuucucuggacuggcgguguugccccggauacucaggcccuaaaugucagcuucgggcccaggaacagcagucacuuauccacacuaaccaagcagaaagucacaccgccguuggccguggcguagccgaacagcagcagcagcaaggcuguggggaccccgaaguuaugcagaagaugacggaucaagugaauuaccaagcuaugaagcugacccugcugcagaagaagaucgacaauaucagucucacagugaacgauguccgaaacaccuauagcucccuggagggcaagguuuccgaggacaagagucgggaauuccagagcuugcugaaaggacugaagaguaaguccaucaacguccugauaagagacaucgugcgcgagcaguucaaaauuuuccaaaaugauaugcaggagacuguggcccagcucuuuaaaacugugaguagccuaucugaagaccuugagucgacccgccaaaucauccaaaagguuaacgagucaguugugagcauugcagcccagcaaaaauucgugcugguacaggaaaaccgcccuacucucacagacauuguggagcuucguaaccacauugugaacgugcgccaggaaaugacccuuacaugcgaaaaaccuauuaaagaacucgaggucaagcaaacccaucuggaaggagcccuugagcaggaacacagccggucaauacuguauuaugaauccuugaauaagacccuuaguaaacuuaaagaagugcacgagcaguugcugagcacggaacaagucagcgaccaaaagaaugccccugcagcagagucggucucuaacaacguuaccgaguauaugucuacuuuacaugagaacauuaaaaagcaaagcuugaugauguugcaaauguuugaagaccugcauauccaagagucuaagauaaauaaucucacaguuucacuugagauggagaaagagucucuucgcggcgaaugugaagacauguugaguaagugucgaaacgauuuuaaauuucagcucaaagacacagaagaaaauuugcacguccuuaaucagacgcuggccgagguuuuauucccaauggacaacaaaauggauaagaugucggaacaauuaaaugaucugacauaugacauggaaauucugcagccacuguuggagcagggcgcuuccuugcggcaaacaaugacuuacgaacagccaaaagaggccaucguuauccggaagaagauugaaaaucuuacaucugcugugaauuccuugaacuuuaucauuaaagagcugaccaaacggcacaauuuguugaggaacgagguccaggggcgcgacgacgccuuggagagacgcauuaaugaauacgcccuugaaauggaagacggccugaauaagaccaugacaauuaucaacaaugcuauugauuucauucaagacaacuacgcacucaaagagacccuguccacgauuaaagauaauuccgaaauucaucauaaauguacuuccgacauggagacuaucuuaacauucaucccucaguuucaucgguugaacgacucgauacaaacccuggugaacgauaaucagagauauaauuuugucuuacaagucgcaaaaacacuugccggcaucccacgcgacgaaaaacuaaaccagucaaauuuccagaaaauguaucagauguucaaugagacuaccagccaggugcgcaaauaccaacagaacaugagucaccuggaggagaaauugcugcugacuacuaaaaucuccaaaaauuuugaaacuagacuucaggacauugagucuaagguuacucaaacccucaucccauauuauaucuccgucaagaagggcucaguggugacuaaugaaagagaucaggcauugcaacugcaagugcuuaacucuagauuuaaggcucuugaggccaagaguauacaccuaaguauuaacuuuuucuccuugaauaagacccugcacgagguccuuacuaugugccauaacgcaaguaccuccgucuccgaacugaacgcaacgauaccuaaauggaucaagcacucccugcccgauauucaguugcugcagaagggacugaccgaguuuguugaaccuaucauccagauaaagacucaggcagcucuuuccaaucuuacauguuguauugacaggaguuuacccgguucgcuagcaaacguggugaagagccagaagcaagucaaauccuugccaaaaaagaucaacgcccugaaaaaaccaacuguaaaccugacuacuguccugauuggacgcacccaacggaacacagauaacauuaucuauccugaggaauacagcagcugcagccggcauccgugccagaacggcgggacuugcaucaaugggcggaccucuuucacgugugcuugucggcacccuuucaccggcgacaauuguacuaucaaacugguggaagagaaugcgcuagcucccgauuuuucuaaaggaucauauagguaugcaccaauggucgcuuucuucgcaagccacacuuacggcaugaccaucccaggcccaauacuguuuaauaaccucgaugucaauuacggagcaucuuauacucccagaacagggaaguuccgcauaccauaucugggugucuauguuuuuaaguacaccaucgaguccuuuagugcacacauauccggauuucuuguuguggacggaaucgauaaacuggccuucgagucagaaaauauuaauuccgagauccauugugauagaguucuaaccggggacgcacugcuggaguuaaacuaugggcaagaaguguggcugagauuggcgaaggguacaauaccugcgaaguucccaccaguaacaacauucucugguuaccuucuguaccggacauag

SEQ ID NO: 12674 - RNA, 1596 nt, Artificial Sequence
  Description of Artificial Sequence: Synthetic coding sequence
augaaaggggcccggcuguuugugcugcucucuagccuguggagcggggguaucggucugaauaauagcaagcacucuuggaccauaccggaagacgguaacagccagaagaccaugcccucugcaucagugccccccaacaaaauccagucccuucagauucucccaaccacaagggugaugagugccgaaaucgcaacaacaccagaaaaggcggagggggucgugaaguugcagaaccugacucucccuacuaaugcuucuaucaaguucaauccuggcgccgagagcguuguucuuaguaacucuacacugaaguuucugcaauccuucgcuagaaagaguaacgagcaggcgacuucccugaacaccgugggcggcacaggggguaucgggggggugggaggaacagguggcguugggaacagagcaccacgcgagacauaccugucaaggggagacuccuccuccucacagcgaaccgacuaccagaaaaguaauuucgagaccacucggggaaaaaauuggugcgcuuacgugcauaccagacugucacccaccgugauacuggacaaucaaguaacauauguaccaggugggaaggggccuugcgguuggacuggggggaguugcccucaacgaucccaaaagauuaguaaucccgucuacagaaugcaacacaaaauugucaccagccuugacuggcgaugcugccccggauauagcggcccuaagugucaguugagggcacaggaacagcaaaguuuaauccacacaaaucaggcugaaucucacacagcagugggcagaggaguggcagagcagcagcagcagcaaggauguggcgaccccgaggugaugcagaagaugacugaccaagugaauuaucaggccaugaaacuaacacuucugcagaagaagaucgacaacauuucuuuaaccguaaacgacguacggaauacauacagcucccucgagggcaagguaagcgaggacaagucaagggaguuucagagucuccuaaaggaagaguacucuagcuguucccggcauccaugccagaauggcggaaccugcaucaauggccguacauccuuuaccugcgccuguaggcaccccuuuacuggcgauaauugcaccauuaagcuggucgaagaaaaugcccuugccccggacuucaguaaaggaucuuaccgcuacgcaccuaugguagccuuuuuugcuucccacacuuacggcaugacaauaccagggccuauccuguucaacaaucuggacgugaacuacggagcuucauacaccccucggacaggcaaauuccgcauucccuaucuggguguuuacguguuuaaguauaccauugaaagcuuuucugcgcauaucuccggguucuuggugguagaugggauugacaaacucgcauuugaaagcgaaaacauuaacagcgaaauccacugcgauagggugcuuaccggcgaugcauuguuagaauugaauuauggucaggaagucuggcuccgccuugcuaaagggaccauacccgccaaguuuccuccuguaacuaccuucagcggauaccugcuuuaccggaccuag

SEQ ID NO: 12675 - RNA, 942 nt, Artificial Sequence
  Description of Artificial Sequence: Synthetic coding sequence
augagugaccuguugcugcucgggcugauagggggucucacccuauugcugcuccugacccuucucgcuuuugcaggcuacucuggacuccuggccgguguugaagugucugccggcagcccccccauccgcaauguuaccguggcuuauaaguuccacaugggccuuuauggcgagaccgggcgguuguucacugaaucaugcagcauuucacccaagcuccguucuaucgccguguacuacgacaauccucacauggugccuccugacaaaugcaggugugcagugggcuccauccugucagagggagaggagagucccucuccugaguuaaucgaccuguaucaaaaguucgguuuuaaaguguuuucguucccggcccccucucacgucgugaccgccaccuuuccauacacaacuauccuguccaucugguuagcaacgaggagaguucaccccgcucuagauacuuauauuaaagaaagaaagcuuugcgccuauccgcgccuagagaucuaucaggaagaccagauucacuucauguguccucuagcuagacaaggagacuuuuacguccccgagaugaaagagacugaauggaaguggagagggcugguugaggcaauagauacccagguagaugggaccggggcagacaccaugucagauacaaguagcgugagucuugaggugagcccaggaucucgcgagaccuccgccgccacucucucaccaggagcuucgucuagaggcugggaugacggcgacacccgaagugagcacagcuauagcgaauccggagcuagugguucuagcuuugaggagcuugaucuugaaggagaagggccccuuggcgaaucaagauuagauccaggcacggaaccacugggcacaacuaaguggcuaugggaacccacugcuccugagaaaggaaaagaguag

SEQ ID NO: 12676 - RNA, 834 nt, Artificial Sequence
  Description of Artificial Sequence: Synthetic coding sequence
auguguacggugguugauccucgaauuguucgucgauaccuccugaggagacagcugggccagggggcauauggcauugucuggaaagcaguggaucggcgcacuggagaaguggucgccauuaagaaaauauucgaugcuuuucgcgauaagaccgacgcccaaagaaccuuucgcgagaucacucugcuccaagaauuuggcgaccauccaaauauuaucucauuguuggacguuauuagagcagagaaugaccgcgacaucuaucucguguuugaauuuaugggauguccccccucaccucccccucccacugccguccggacucugucugcagauaccgauuugaaugccguuauuaggaaagggggacugcuucaagauguucacgugagaaguauuuucuaccagcuauuaagagccacaagauuuuuacauuccggacauguggugcaccgggaucagaaaccgaguaauguacuccuggacgcuaauugcacugucaaacucugugauuuuggccuugccagaucuuuaggcgaccuuccagaaggcccugaagaccaggccgugaccgaguauguggccacgagaugguaccgggcccccgaaguccugcugagcagccacagauacacgcugggaguggauauguggucccugggauguauacucggagagaugcuccguggaagaccccuguuuccugggaccucuaccuuacaucagcuagagcuaauucuagaaacuaucccaccacccucugaagaagauuugcuugcccuugguagcggcugccgagccucggugcuccaccaacugggcucucgauag

SEQ ID NO: 12677 - RNA, 765 nt, Artificial Sequence
  Description of Artificial Sequence: Synthetic coding sequence
augugcacggucguggacccgcggauuguacgccgauacuugcugagacgccagcucggccaaggcgcuuacggaaucguuuggaaagcgguugauagaaggacaggagagguuguggccauuaagaagauuuucgacgcguuuagagauaagacagaugcucagcgaacauuuagagagaucacauugcuccaggaguucggcgaucaccccaacaucaucagcuuacuagacgucauuagggcagaaaaugaucgggauauuuauuuaguauuugaguuuauggacacugaccuuaacgccgucauccggaaaggugggcuucuccaggauguacaugugagguccauuuucuaucaguuacuuagagcaacacgcuuucugcacucugggcaugugguacacagggaccagaaacccucgaacguccugcuugaugcuaauugcacagucaaacucugcgauuuuggacucgccagaucucuuggggaucuccccgaaggacccgaagaucaggccguuaccgaguacguggcaacacggugguaucgagcaccagagguauuauuauccagccacagguacacgcuuggcguugauauguggagucugggguguauacuuggcgaaaugcuucgugguaggccacucuuuccugguacauccacucugcaucagcuggagcuuauucuggagacuauuccccccccuagcgaggagggggcucagaccgcuugcagaagcggaacaggagcaucaacauag

SEQ ID NO: 12678 - RNA, 474 nt, Artificial Sequence
  Description of Artificial Sequence: Synthetic coding sequence
auggcucuccugcugugccucguaugccucacagcagcacuugcccaugggugucuacacugucauaguaacuuuucaaaaaaguucaguuucuauaggcaccaugugaauuucaaguccugguggguaggcgacauccccgugucuggcgcccugcugacagauuggagcgacgacacuaugaaggaacugcacuuagcuauucccgcaaagauuacacgagaaaaguuggaccagguugccacagcaguauaucaaaugauggaucaacuauaccaagggaagauguacuuucccggcuacuucccaaacgagcuaagaaacauauucagagagcaaguccaucugauucagaacgcaauaaucgagagacaucuugcuccgggcuccugggggggcggucagcucagcagagagggacccagccuggcccccgaaggauccaugccaaguccccgaggagaccugcccuag

SEQ ID NO: 12679 - RNA, 699 nt, Artificial Sequence
  Description of Artificial Sequence: Synthetic coding sequence
auggcucugcugcugugucucgugugucuuacugcagcucuagcccaugguugcuuacauugucacaguaacuuuucuaaaaaauuuagcuuuuacagacaucauguuaacuucaaaucgugguggguuggcgacaucccagucuccggggcccuguuaaccgauuggucagacgacacuaugaaggaacugcaccuagccaucccagcgaagauaacucgggagaagcuugaccagguggcaacagcaguuuaucagaugauggaucagcuguaccagggcaaaauguauuuuccggguuauuuccccaaugagcugagaaauauuuuucgcgagcaaguccaucuaauucagaaugccaucaucgagucucggaucgauugucagcaccgcuguggcauuuuucaguacgaaacaaucucuugcaauaacugcaccgauucccacguagccugcuucgguuauaauugcgagucuagugcucaguggaagagcgccgugcaggggcuucugaacuacaucaauaacuggcacaagcaggacacauccaugagacccagguccuccgcauuuuccuggcccggcacucaucgggcuaccccagcauuccugguaucgccagcgcucagaugucuagaaccuccacaccuggcaaaccuaacccuugaagacgcugccgagugccucaaacagcacuag

SEQ ID NO: 12680 - RNA, 396 nt, Artificial Sequence
  Description of Artificial Sequence: Synthetic coding sequence
augggaggugauggccgauacguuuugaacggacacugggucguuuccccaccuggaacuuacgaagcugccggcacccacguggucuacacuagggacacgggcccccaggagacgcugcaggcugcugguccuaccucacaugauuuacuccuucagguccugcuucaggaaccgaaucccggaaucgaauuugaauuuugguugccacgagagagauauagcccauuccaagcccgggugcaggcucugggauggccccugcgacaaccucagccacgcggaguagaaccccagcccccugcagcuccugcgguuacccccgcacagacccccacgcucgcuccagggcccucagccggaccaccaccaccugguccaggagauccccuguag

SEQ ID NO: 12681 - RNA, 447 nt, Artificial Sequence
  Description of Artificial Sequence: Synthetic coding sequence
auggccaggaucccaacugccgcccuagguuguauaucacuccucugccugcagcugccugggucucugucucgcucucucggcggcgacccccguccgguaaagccacgcgaaccuccagccagguccccuucuucaucucuccagccccgacaucccgcaccccgacccgugguguggaaauugcacagagcccuccaagcucagcgaggagccggccuugccccuguuaugggccagccacuccgcgauggcggacgacaacacucagggccccguagacauucuggaccgcgacgaacccaagcucagcugcuaagaguugggugugugcucgggaccugccaaguccagaaucuaagccaucgguuguggcaguuaauggggcccgcuggcaggcaagacagcgcucccgucgacccauccagcccacacuccuacgguuag

SEQ ID NO: 12682 - RNA, 447 nt, Artificial Sequence
  Description of Artificial Sequence: Synthetic coding sequence
auggcgcggaucccaacugccgcacugggguguauuucccuccucugccuccaacuccccgguucucuuuccagaaguuuagggggggacccccgaccagugaagccucgcgagccuccggcacgcucacccuccucaucgcuucagccuagacaucccgcccccagacccguugucuggaaacuccacagagcccugcaggcccagcgaggcgccggacucgcacccgucaugggucagccuuuacgagacggugguaggcagcauuccgggccccgacgacauaguggcccccgcagaacacaggcccaacucuugcgcgugggcugcguguuagguaccugccagguccaaaaccucucacaucggcuguggcagcugaugggaccagcggggagacaagacuccgcucccguagacccaucuagcccucacucauacggauag

SEQ ID NO: 12683 - RNA, 537 nt, Artificial Sequence
  Description of Artificial Sequence: Synthetic coding sequence
auggaucgggccgccaggugcaguggcgcgucuucucugcccuuacuccuugcucucgcauugggacuggugauucuccauugugucgucgcagacggaaauaguacccguucuccagagacaaacggacucuuauguggugacccugaagaaaacugugccgccacaacuacacagucuaaaaggaagggccauuuuagucgcugucccaaacaguauaagcacuauugcauaaaaggccguugcagauuuguaguggcagaacagacgccuucuugcgugugcgaugagggguacauuggagccaggugugaacgcguugauuuauuuuaccuucggggagaccggggacaaauucuggucaucugucugaucgcagucaugguggucuuuauaauucuuguuauuggcgugugcacaugcugccacccccuucguaagagacggaagagaaaaaagaaagaagaagagauggagaccuuagggaaggacaucacaccuaucaacgaagacauugaagagaccaacauugccuag

SEQ ID NO: 12684 - RNA, 1251 nt, Artificial Sequence
  Description of Artificial Sequence: Synthetic coding sequence
augaguaucucucugucuagccuuauccuucugccgauuuggaucaauauggcccagauucagcaaggcgguccagaugagaaagaaaagacgaccgcacugaaagaucugcugucucgaaucgaccuggacgagcugaugaaaaaagacgagccgccccuugacuuuccugacacucuagaaggauuugaguacgccuucaaugaaaagggacagcuccggcacaucaaaaccggggagcccuuuguguuuaacuaucgcgaagaccugcacagauggaaccagaaacguuaugaagcacugggggagauuaucacaaaauacgucuaugaacugcuagaaaaggacuguaaucuuaagaagguaaguauuccaguggaugcuaccgaaagcgaaccuaaaaguuucaucuucaugucugaggacgcucugaccaauccccaaaaguugaugguucugauccacggauccggaguggugagagcaggacagugggcgcggaggcugaucauuaacgaggaccuggauucuggcacacaaauccccuuuauuaaacgggccguugccgaaggguacggugucauugugcucaaccccaaugagaacuacaucgaaguggagaagcccaaaauccacguucaguccagcagcgauuccucagaugagccugcggagaaacgggaaagaaaagacaagguuagcaaagaaaccaaaaaaaggagggauuuuuaugaaaaauaucgcaauccacagcgggaaaaggaaaugaugcaacuguauauccgcgagaacgggucccccgaagaacacgccauauaugucugggaccacuucauugcacaggcugcugcagagaauguauucuucgucgcucacagcuaugguggucuggcuuuuguggagcucaugauccagcgggaagcugacgucaaaaacaaagucacagcuguagcucuaacagacuccgugcauaauguguggcaucaagaagccgggaaaacgauccgagaauggaugagggaaaacugcugcaacugggugaguuccagugagccgcuagauacauccgucgaauccaugcugccagacuguccacggguguccgccgggacagaucgccacgagcugacaagcuggaaauccuuuccuagcaucuucaaauucuucaccgaggcauccgaggcaaaaacaaguucacuuaaaccagccgugacuagaagaagccauagaaucaaacacgaagaacucuag

SEQ ID NO: 12685 - RNA, 840 nt, Artificial Sequence
  Description of Artificial Sequence: Synthetic coding sequence
augaagauuaucauccuguugggauuucuaggagcaacccucuccgcgccccugauuccucagagauugaugagugcgagcaauagcaaugagcuccugcuuaaucugaacaacggccaacuucucccauugcagcuccagggaccacuuaauagcuggaucccccccuuuucugggauuuugcagcagcagcaacaagcacaaauccccgggcuuagccaguuuagucucucggcccuggaccaguucgcagggcuccuccccaaccagaucccucugacuggugaagcuucauucgcccagggagcucaggcuggccagguggauccacugcaacugcaaacccccccucagacccagcccgguccuucccaugucaugcccuacgucuucucauucaaaaugccgcaagaacagggacagauguuccaguacuaccccgucuacaugguccucccaugggaacagccccagcagaccgucccccguuccccccagcagaccagacagcaacaauaugaggaacaaauccccuucuacgcccaguucgguuacauaccucaacuugcggaaccagcaauaagugguggacagcagcaacuugcauucgacccacaguugggcacugccccugagaucgccguaaugagcaccggagaagaaaucccauacuuacagaaagaagcuauuaacuuucggcaugacucagccggaguguuuaugccaagcacuucaccaaagccaucaaccacaaauguguuuaccuccgcuguugaccagaccauaacacccgaguugccagaagaaaaggauaagacagauaguuugagagaaccauag

SEQ ID NO: 12686 - RNA, 444 nt, Artificial Sequence
  Description of Artificial Sequence: Synthetic coding sequence
augggcccugaagcacucucgucucugcucuuauuauuacugguggcuucuggcgaugcugauaugaagggccacuucgaucccgccaaauguagguaugcacugggaaugcaggaccguaccaucccagacuccgauauuucggccucuaguaguuggucagauucgacugccgcuagacauucuaggcuagagucuucagauggggacggggcauggugucccgccggcaguguguuucccaaggaagaagaguauuuacagguggauuuacagagacugcacuuaguagcauuggucgguacacagggaaggcaugcaggugggcuaggcaaggaauuuagucgcucauaccgccuacgguacagccgagacggccgcagauggaugggguggaaagaccgguggggccaggagguuaucuccgggaacgaggaccccuag

SEQ ID NO: 12687 - RNA, 618 nt, Artificial Sequence
  Description of Artificial Sequence: Synthetic coding sequence
auggggggcccagugagagagcccgcccugagcgucgcucucugguuaucuuggggggcugcacugggagcuguggcaugugcuauggcucuguugacccagcagacggaauugcagagucuaaggcgggaggugagucgacuccagggcaccggcgggccaagucagaacggagagggauacccauggcagucacuccccgagcagcacucaguccuucacuugguucccauaaaugcaacaagcaaggaugauucugacgucacagaagucauguggcagcccgcacuccgacgagggcgaggucuucaagcccagggcuacggaguccgaauccaggacgcggggguuuaucugcucuauucucaaguguuauuccaggacgugaccuuuacaaugggacaggucguaucucgggaaggccagggaagacaggagaccuuauuccgauguauuagaagcaugcccucccacccugaucgggccuauaacagcugcuauucagcugguguuuuccaucugcaucaaggcgacauccuguccguaauaauaccuagagcccgcgcaaagcucaaucuguccccgcacggcacuuuuuugggauucgugaaacuuuag

SEQ ID NO: 12688 - RNA, 744 nt, Artificial Sequence
  Description of Artificial Sequence: Synthetic coding sequence
augccugccucuagcccauuccuacuugcuccaaaaggaccucccgggaacaugggugggccagugcgcgaaccugcauugaguguagcgcuuuggcuuuccuggggagccgccuugggggccguggcaugcgcaauggccuuacuaacucaacaaacagagcuccagagucugcgaagagaggugagucggcuacagggaacuggcgggcccucacagaacggagagggcuaucccuggcaauccuuacccgagcagagcagcgacgcucucgaagccugggagaacggugaaagaucucgcaaacgucgugcuguccugacccaaaagcagaagaaacaacacuccguccuucaccuugugcccaucaaugcgaccuccaaagacgauagcgacgucaccgaagugauguggcagcccgcacuccgacgcgguagggggcugcaggcccaggguuauggaguucggauccaggaugcuggaguuuaucuguuauauucacagguguuguuucaagacgugacuuucacgaugggacaaguuguuuccagagaaggccaaggacggcaggaaacgcuguuccgcuguauucgaagcaugccaucacaucccgaucgcgccuauaacuccuguuacucagcaggaguguuucauuuacaccaaggagacauucuaucagugauuaucccgcgggccagagcaaaguuaaaucugucuccacacgggacuuuccugggccuguag

SEQ ID NO: 12689 - RNA, 39 nt, Artificial Sequence
  Description of Artificial Sequence: Synthetic coding sequence
augggcaaaagugaaagucuccaauccuuacagcgguag

SEQ ID NO: 12690 - RNA, 4266 nt, Artificial Sequence
  Description of Artificial Sequence: Synthetic coding sequence
augaugcucccucagaauucuuggcacauugauuucggccgcuguuguugccaucagaaccuguucagugcuguugucacuugcauccuacucuugaauagcugcuuccuuaucagcucuuuuaacggaacagaccuggaacugagacucguuaauggcgaugggccauguucgggaacaguggaagugaaauuucaagggcaguggggcacaguuugcgaugacggauggaacaccacugcuaguacugugguuuguaagcaauugggguguccauuuucuuuugcgauguucagguuuggacaggcagucacaagacacgggaaaaucuggcuugaugaugucucaugcuauggcaaugagucagcccugugggagugccagcaccgggaguggggaagccacaauuguuaucauggcgaggaugugggagugaacugcuauggcgaagcaaaccugggacugaggcuuguggacgguaacaacucuuguucaggaagaguugaagugaaauuucaagaaagguggggcaccauuugcgaugaugguuggaaucugaacacugcugccguuguuugccgccagcugggcugcccuaguuccuuuaucagcagcggaguagugaauaguccggccguacuucgccccauuugguuggacgacaucuugugccaggggaaugaguuggcuuuguggaauuguaggcaccgcggcuggggcaaccacgacuguagccauaaugaagacgugacccucacaugcuaugauagcuccgaccucgaacuaaggcuugucggcggcacgaauaggugcaugggaagaguggaacucaagauacagggacgaugggguaccgucugucaccauaaauggaacaacgccgcugccgaugucguuugcaaacagcuggguugcggcaccgcgcugcacuucgccggacucccacaccuccagaguggcuccgaugucguguggcuugauggagugucuugcucggguaaugaaaguuuucugugggacugucgccauucugggacagugaauuuugauugucuccaucaaaacgaugugagcgucaucugcagcgacggggcagaccuugagcugaggcuugcugauggcuccaauaacuguaguggaagaguggagguucggauucacgaacagugguggacuauaugcgaccaaaauuggaagaacgagcaggcgcuggugguaugcaaacaacugggguguccauucagcguguuugggucucgaagggcuaaaccaagcaaugaggcccgcgacaucuggauuaauagcauauccugcaccgguaaugagucugcucuaugggacuguacguaugauggcaaagcaaagagaacgugcuuucgcagaagugaugccggaguaauauguuccgacaaagcggacuuggacuugcgguuagucggcgcacacucuccaugcuauggaagacuggaaguaaaauaucagggugaaugggguacaguuugccacgaccgguggucaacacgcaaugcugccguaguguguaagcaguuaggaugcggcaagccacuucacguguuugggaugaccuacuuuaaggaggcauccgggccuaucuggcuggaugacgucagcuguaucgggaacgaguccaauauuugggacugcgagcacucaggguggggcaagcauaacuguguccaucgcgaggacgugauaguuacuuguaguggcgacgcuacguggggccuccgccucgucgguggcagcaaucgguguuccggacgccuggagguguacuuucagggacgauggggaacuguaugugaugacggguggaacaguaaggccgccgcagucgucugcagucagcuggacugucccagcucuauuaucggcauggguuugggaaaugccucuacuggguacgggaaaauuugguuggaugacgucagcugcgauggugacgagagugaccucuggucgugcagaaacuccgguugggggaacaaugacuguagccacuccgaggaugugggugugauuuguucggacgccucggauauggaauugcgacuugugggugguucaagcagaugcgccgggaaaguugaggucaacguacagggggcugucggcauccucugugcuaacgguuggggcaugaauaucgcugaggucguuuguagacagcuggaaugcggaagugcaaucagagugucuagggagccccauuucacagagaggacgcugcacauauugaugucuaauucuggcuguaccggaggcgaagcaucccugugggacugcaucagaugggaauggaaacagacugccugccaccugaauauggaggcuagccugaucuguucagcccaucgucaaccgcgacucgugggagccgauaugcccuguuccggacgcgucgaaguaaaacacgcggauacauggcggucggugugugauucugacuucucccugcaugccgcaaaugugcuuugccgcgagcuaaacuguggcgacgcuauuagcuuaagcgugggcgaucacuucggcaagggaaacggcuuaaccugggccgagaaauuccagugcgaaggcagcgaaacccaccuagcccugugcccuauugugcagcaccccgaggacacaugcauucauuccagggaggugggcguuguaugcagccgcuacacggaugugcgauuaguuaacgguaagucucaaugcgacggacagguugagaucaauguucugggacauuggggcagccuaugugauacucacugggacccugaggacgcuagggugcucugcagacaacuuucaugugggaccgccuuaucuacaacuggagggaaauacaucggcgaaagguccguacgcguuuggggucaccgguuucacugucugggaaacgagaguuugcuggacaauugucaaaugaccguccugggagcaccucccugcauccauggcaacacaguuagugugauaugcacuggcucccuuacccagccccuguuuccgugcuuggcaaauguuagugauccauauuuauccgcugugccagagggcuccgcucugauuugucuggaggacaaacgcuugcgccucguugacggggacagucgaugcgcagguagggucgaaauuuaccacgauggguucuggggaaccaucugcgaugacggaugggaucucagcgaugcccacgucgugugucaaaaauugggaugcgggguggccuuuaacgcaacaguuucugcacacuucggcgagggaagugggccaauuuggcuugacgaucuaaacuguacugggauggaaagccaccuguggcaguguccgucuagagguugggggcaacaugacugcaggcauaaagaggaugccggggugaucuguucugaguucaccgcccugcggcuauauagcgagacagagacagaaagcugugccggccggcuagagguuuuuuacaaugggacauggggcucugugggcagaaggaauaucaccacagccauugcugggauuguuugccgacagcugggcuguggagaaaacggggucgucagccuagccccccucuccaaaaccggauccggcuucauguggguugaugauauccaaugcccaaagacucauauuucgaucuggcagugcuugagcgcuccuugggagcguaggaucucgucuccugcagaagagacguggauuaccugcgaagaccgcauacgaguacgcgggggagacaccgaguguagcggaagggucgagaucuggcacgccgguucaugggguaccgucugugacgauagcugggaccucgccgaggcugaagucguaugccaacagcugggcuguggcagugcccucgcggcauugcgagaugccucuuucggacagggaacagggacaaucugguuagacgacaugagguguaagggcaaugaaucguuccugugggauugucaugcgaaaccuuggggccagagcgacugcggacacaaggaggacgcuggcgugagguguucuggccaguccuugaagucacuuaaugccagcucaggucaucucgcuuugauacucagcuccauuuuuggguuacugcucuuggugcuguuuauccuguuccucaccuggugccgcgugcaaaagcagaaacaccugccacugcgggaugacacuccuaaccacgggugugaggaugccagcgauacgucucugcucggcgugcugccagccagugaggcaacuaaauag

SEQ ID NO: 12691 - RNA, 1410 nt, Artificial Sequence
  Description of Artificial Sequence: Synthetic coding sequence
augaucaccgaaggagcacaagcaccuagacugcugcuuccaccgcugcuucuccuacuuacccuuccggcuacaggcucagaccccguacuguguuuuacccaguaugaagagagcagugggaaauguaaagggcuauuaggagggggagugaguguugaagacuguugccugaacaccgccuuugccuaccagaagagaucaggaggacuaugccagccaugcagaaguccgcguuggucguuauggagcaccugggcucccugcagugucacuuguuccgaggguucccaguugcguuaccggaggugugucggauggaauggccaguguaguggaaagguagccccugggacucuugaguggcagcuucaggcuugugaagaucagcaguguuguccagaaaugggagggugguccggcuggggacccugggaaccuugcagcguaacauguagcaaagguacucggacgcgaagacgggcaugcaaccaucccgcccccaaaugcggcggacauugcccgggucaggcccaggaguccgaagcaugugacacgcagcaaguguguccaacccacggagccugggccacauggggcccauggacucccugcagugccucaugccauggcgguccacacgagccuaaggaaacgcggagucggaagugcagugcaccggagccuucccagaagccgcccggaaagcccugcccugguuuggcuuaugagcagcgacgguguacugggcuccccccaugcccaguugccgggggauggggacccugggggcccguuuccccguguccaguuaccuguggucucggucagaccauggagcagcguacuuguaaucaucccguaccccagcacgguggucccuucugugccggcgaugcgacccgcacccacaucugcaacaccgccgugccgugcccaguugacggagagugggauaguuggggagaguggucccccugcauccgccguaacaugaagucgauuaguugccaggagauacccggacagcaaagcaggggccggacaugcagaggacguaaauucgacggccacagaugcgcuggccaacagcaggauauuagacauuguuauagcauccagcauuguccccugaaaggcucuugguccgaaugguccacuuggggucuuuguaugccaccaugcggcccgaaccccaccagagcacgucagcgacuuugcaccccccugcuuccuaaauaucccccuacaguauccaugguagagggucaaggagagaagaaugugacauucuggggccgcccucuacccaggugcgaggaauuacagggccaaaaacugguuguagaagagaaacgacccugucuccacgucccggccuguaaggauccagaagaggaggagcucuag

SEQ ID NO: 12692 - RNA, 837 nt, Artificial Sequence
  Description of Artificial Sequence: Synthetic coding sequence
augcaguggcucagggugcgagagagcccaggugaagccacagggcaucgcguuacaaugggcaccgcagcucucggaccaguaugggcggcucuccugcucuuucuucuuaugugcgagaucccuaugguagaacuuacauucgaucgggcuguggccagugggugccagcgaugcugcgacagcgaggacccccuggacccggcgcacgugaguucagccucguccagcggccgaccccacgcucuucccgaaauacguccuuacaucaacaucacuauucugaaaggugauaaaggugaccccggacccaugggacucccagguuauaugggacgggaaggcccccagggagagccuggaccucaggguaguaagggggacaagggugagaugggauccccuggagcaccuugccagaaacgcuucuucgccuuuuccguuggaaggaaaacagcccuucauucaggcgaagacuuucagacccugcuauucgagcgaguauucguaaauuuggauggcuguuucgacauggcuacaggccaguucgcagcaccuuuaagaggaaucuacuuuuucucucuaaauguccacuccuggaauuacaaggaaacauacguccauauaaugcacaaucagaaagaggcugucauccuguaugcccagccaagcgaacggucgaucaugcagucccaguccgucauguuggacuuagccuacggugaucgagucuggguccgccuauuuaagcggcagagggaaaacgcuaucuauaguaacgacuuugauacauauauaaccuucagcggacaccugaucaaagccgaggacgacuag

SEQ ID NO: 12693 - RNA, 1128 nt, Artificial Sequence
  Description of Artificial Sequence: Synthetic coding sequence
auggaauucgaaauuacauuucgccccgacucaggagacggaguuuugcuuuauucauaugauaccggcucaaaggauuuucucagcaucaacuuggccgggggccauguagaauuuagauucgauugcggaagcggcaccggaguucucagaagcgaagacccucugacucuuggaaacuggcaugaacuucgggugucccggaccgcaaaaaacggcauccuccagguggacaagcagaaaauuguagagggaauggcugagggaggcuuuacccaaauuaagugcaauaccgacauuuucauaggcgggguucccaauuacgaugacgugaaaaagaacuccggcgugcucaaaccauuuucaggaucuauucagaaaauaauucucaacgauagaacuauucacgugaagcaugacuucacaucgggaguuaauguugagaacgcagcacauccuugugugcgagcgcccugugcccauggaggaaguugucggccacgaaaggaaggauaugacugcgacuguccgcucggguuugaaggacugcacugucagaaagcuauaaucgaggccauugagaucccacaguucauuggaagauccuaucugaccuacgacaaccccgacauacuaaaacgggucuccggcagccgaucuaaugucuuuaugcgauucaagacuacggcaaaggauggucuucuccuguggaggggagauucucccaugaggccgaacagcgauuuuaucucacuugggcucagagauggcgcccugguguucuccuauaauuugggaucaggcguugcgagcauaauggugaacggguccuucaacgauggccgcuggcauagggugaaggcugugcgcgaugggcagucuggcaagauuacaguggaugauuauggcgccaggacuggcaagucucccggcaugaugcgacagcucaacaucaauggugccuuguacguggguggcaugaaggagauugcccugcacaccaauaggcaauacaugagaggacuaguagggugcauuucccacuucacucugucaaccgauuaucauaucucccuugucgaagaugcuguggacgguaagaacauuaacacguguggagcgaaguag

SEQ ID NO: 12694 - RNA, 459 nt, Artificial Sequence
  Description of Artificial Sequence: Synthetic coding sequence
augagguuuaagacgacugccaaagauggccuguuacucuggcggggugacucaccuaugaggcccaacuccgauuuuaucucucugggacugagggacggcgcacuagucuucucauauaaucuggguagcggaguggcaucaauuauggucaauggguccuucaaugacggacgcuggcaucgaguuaaggcaguucgagaugggcagucugguaaaauaaccgucgaugacuauggagcuagaaccgguaaauccccagggaugaugagacagcugaacaucaacggcgcacucuacguaggagggaugaaagagauagcacugcacacuaauaggcaauacaugcguggacucguugguugcaucagucacuuuacacuuuccacagauuaucauauuagccucguugaagaugcaguggacggcaagaauauuaacaccugcggagcgaaguag

SEQ ID NO: 12695 - RNA, 1050 nt, Artificial Sequence
  Description of Artificial Sequence: Synthetic coding sequence
augacggccuuacccggcccccuguggcuacuuggccuugcucugugugcuuuggguggcgguggaccgggccuccgccccccaccagggugcccacaaaggcgacugggcgccagagaacgacgagauguacaacgcgaaauccuggccguguuaggucuaccugguagaccccgcccuagagcgccaccagcugcuagcaggcugccggccuccgccccuuuauuuaugcucgacuuguaucacgcaauggcaggugacgacgacgaggauggcgcaccagcugagaggcgccuuggucgggcagaccucguaaugaguuucguaaauaugguggagcgcgauagagcccuuggacaucaggagccccauuggaaggaguuccgcuuugaccucacccagauccccgcuggagaagccgugaccgcugcugaguucagaaucuacaaagucccaucaauacaccuccuaaacaggacucugcacgugagcauguuccaaguggugcaagaacaaucuaaucgggagucugaccuguuuuuccuugaccugcagacccugcgggccggcgaugagggguggcuggucuuagauguaaccgcagccagcgacuguuggcuacugaagagacauaaggaccugggccuaagacuguacguagagacggaggacggagaaacauggacuggguggggguggacaaaagauucccgacugcagauguggaaguugaggcucagcaggacucccugggugcucucucuccacgcgccuggcccugcccaagcccccgccgagcggccuuuguugugccuguugcaaggucauuguccugcaucuccuagcccuaucaggacuccucgggccguacggccauuaagaaggcgacagccgaaaaaguccaaugaacugccucaagcuaaccgacugccaggcauuuuugacgacgugcaugguucccaugggaggcagguuugcaggagacacgagcuguauguguccuuucaggaucuggggugguugguuauagccgacucuagcuguuucuag

SEQ ID NO: 12696 - RNA, 1617 nt, Artificial Sequence
  Description of Artificial Sequence: Synthetic coding sequence
augucauuuagugcgaccauccuauuuucucccccaagcggaagcgaggcuagaugcuguugcugcgcauguaagagcgagacaaauggagggaauacuggcagucagggcggcaauccuccacccagcaccccaauuacagugacgggacacggguuagcgguccagucuucugagcaacugcugcaugugaucuaucaaaggguagauaaggcaguagggcuggcugaagccgcauugggucuugcucgggccaauaacgagcuucucaaacggcuccaggaagagguuggcgaucugcgccagggaaaggugucaauuccagaugaagauggagaaucuagggcccauuccagcccgccagaggaaccaggaccccugaaagagucaccaggcgaggccuucaaagcccuuucagccguggaggaagagugcgauuccgugggcaguggaguucagguggugauugaggaauugcggcaacugggcgcugccagcguuggaccuggcccccugggcuuccccgcuacgcaacgcgauaugcgacucccaggcuguaccuuggcugccuccgaagcugcuccccuccugaacccauugguggacgacuacgucgcaucagagggcgccguacagaggguucuagugcccgcguacgcuaaacagcugucccccgccacacagcuggccauccagcgagccacuccugagacgggccccgagaacgguacuaagcuuccacccccucgaccugaggacaugcucaacgcugcagcagcccuggacuccgcucuugaggagagcggcccaggaagcacaggggaacugcgacacagccuggggcuuacagugucuccaugucgcacucgcggaucuggacagaagaauucaagaagaaagagggaccuuguucugucuaaguuagugcauaauguccauaaucacauaacgaacgauaaacgcuucaacggcucugaaagcauaaaaucuaguuggaauaucucaguuguaaaguuucuacucgaaaaguuaaagcaggagcuggugacguccccccacaacuacacggacaaagagcugaaaggcgcuugugucgccuacuuccugacuaagcgccgcgaauauaggaauagucugaauccguuuaagggacugaaggagaaggaggagaagaaacugcggucccgaagguaucgucuuuucgcgaaucgcucuagcauuaugagacacuucggcccggaggaucaacgacuuuggaaugacgucacugaagaauuaaugucagacgaggaagauucuuugaacgaacccggugucuggguugcucggccaccccgguuucgugcacaaagacugaccgaacuuuguuaucaccuugaugccaauagcaaacacggcacaaaagcuaauaggguuuaugggccuccgucagaccgauugccauccgccgaagcucagcuccuccccccggagcuguauaacccaaacuuccaagaagaagaagaugagggcggggacgagaaugccccagggucccccucauuugaccagccucacaagacuugcuguccagaccugaacaguuucauagaaaucaaaguagaaaaagaugaguag

SEQ ID NO: 12697 - RNA, 630 nt, Artificial Sequence
  Description of Artificial Sequence: Synthetic coding sequence
augaguuuuagugccaccauucuguuuuccccgccauccggaucggaggcucgcuguuguuguugugccuguaaaagcgaaacaaaugggggaaauacaggcucucagggcggcaacccccccccgagcacuccuaucacugucacuggucauggcuuggccguccaaucuucagagcaacuacuccaugucauuuaccagcgaguggauaaagcagugggucuagcagaggcugccuugggucuagccagagccaacaacgaacuguugaagagguugcaagaggaggugggggaucucaggcaggguaaagucucuauuccagacgaggacggggaaaguagagcccauaguucgcccccagaggaacccggcccguuaaaagaaaguccuggcgaggcauucaaagcacucucagccguugaggaggaaugugacuccgugggguccgguguccagguggucaucgaggagcucagacagcuaggagccgcuaguguugggccgggccccuugggcuucccugccacccagcgagauaugagacuccccggauguacuuuagccgccucagaagccgcaccauuguugaauccgcuaguggacgacuacguagccagcgaaggcuag

SEQ ID NO: 12698 - RNA, 1617 nt, Artificial Sequence
  Description of Artificial Sequence: Synthetic coding sequence
augagcuuuucagcgaccauuuuauucucccccccuuccggaucagaggcccgauguuguugcugugcgugcaagagcgaaaccaacggcggaaauacugggucucagggcgguaaucccccccccucgacaccuaucacagugacuggacacgguuuggccgugcagucaagcgagcagcugcugcaugucauauaccagcgcguggauaaagcaguuggccuggccgaagcggcucugggguuggcccgcgccaauaacgaacuguugaagcggcugcaggaagaagugggcgaucucagacaggggaaagugucuauuccggaugaagacggcgaaagcagggcccacagcucuccucccgaggagcccggaccccugaaggaaucaccaggcgaagcguucaaggcccugucagccguggaagaggaaugcgacucggucggaucaggcgugcagguggugauugaggaacuacggcaauuaggagccgcuucugugggccccggcccgcucggcuucccugccacacagcgcgacaugagacugcccggcugcacccuggccgcgagugaggccgccccacugcucaauccucucguggacgauuacgucgcauccgagggugccgugcaaagggugcuggucccagcuuacgcaaagcagcugagcccugccacccagcuagcuauccaaagagcuaccccugagacuggucccgaaaaugggaccaagcucccaccuccacgucccgaggacaugcuuaaugccgcugcugcccuggauuccgccuuggaagaguccggcccaggcucaaccggggagcucagacauucacugggccuaacuguaucuccgugccggaccaggggaucaggucagaaaaacaguagacguaagagggacuuaguccuauccaagcugguucauaaugugcauaaccauauuaccaacgacaaacgcuucaacggauccgagucaauuaaaucgucuuggaauaucuccgucgugaaauuccuucucgaaaaacuaaagcaggaauuaguaaccuccccucauaacuauaccgacaaagagcuaaagggcgcuugcguggccuacuuucucacaaagcguagggaguaccggaacucauugaacccauucaaagggcuaaaagagaaggaggagaaaaaacugagaucucgcagauaccgguuguucgccaaccguucauccauuaugaggcacuucgggcccgaggaucaaagacuauggaaugacguaaccgaggagcugauguccgacgaggaggauucacugaaugagcccgguguguggguugcccguccuccacgauucagggcccaaaggcucaccgaacuuugcuaccaucuggacgccaauuccaaacaugggaccaaggcuaacagaguuuauggccccccaucagacagacuccccagcgcugaggcccaguuguugccccccgaguuauacaacccaaacuuccaagaagaagaagacgaaggcggcgacgaaaaugcccccgguucccccucuuuugaucaaccccauaagaccuguugcccagaccucaauuccuucaucgagaucaagguugaaaaagacgaauag

SEQ ID NO: 12699 - RNA, 1524 nt, Artificial Sequence
  Description of Artificial Sequence: Synthetic coding sequence
auguguaccaaaaccauacccguccuguggggguguuuucuuuuauggaauuuauaugugucuuccagucaaaccauuuaccccggaaucaaggccagaauuacacagagagccuuagacuacggcgugcaggcagggaugaagaugauugaacaaaugcuuaaagagaagaaguuaccugaccuuucuggauccgaaagccuagaguucuugaagguugauuacgugaauuauaauuucuccaauauuaagauuucugcauuuucuuucccuaauacaucacuggccuucgugccaggcguugggauaaaggcacugacaaaccacgggaccgccaacaucaguaccgacugggguuuugagucaccgcucuuucaggauaccgguggagcagaccuguuucuauccggcguuuacuuuacaggcauuaucauuuuaacucgaaacgacuucgggcauccaacccucaaauugcaggacugcuaugcgcagcucucgcacgcccacguauccuuuucuggcgaacucagcgugcuguacaauagcuucgccgagcccauggaaaagcccauacucaaaaaccugaacgaaaugcugugccccauaaucgcuuccgaggucaaggcccucaacgccaaccucaguacgcuugaaguucugaccaaaaucgauaauuauacucuccuggauuauucuuugaucuccagcccggaaaucacagagaacuaucuugaccugaaucugaaggguguguuuuacccacucgaaaaucucacagacccuccauucucgcccguuccuuucgugcugcccgagagaucaaacuccaugcuguacaucggaaucgccgaguauuuuuuuaagucugcgagcuucgcucauuuuaccgcuggcguuuuuaaugugacacuaucuacagaggagauuaguaaucauuuugugcaaaacucacagggccuggguaacguucugucuagaauugccgagauuuauauccugucucagccuuucauggugcgcaucauggccaccgaaccccccauuauaaaccugcagccugguaauuucacucuugacauuccagccucaaucaugaugcuuacacagccuaaaaauaguacaguugaaaccauuguuucuauggacuuuguagccagcacgucagugggacugguuauccugggucagcggcugguguguucucuuucuuugaaucguuuucgccuggcgcuaccugagucgaauagaucuaacauugaggugcugcgauucgaaaacauacuguccaguauacugcauuuuggaguguugccucucgcgaaugccaaguugcagcaaggcuucccccuuuccaauccucauaaauuucuguucgugaauucugacauugaaguccucgagggauuucugcugaucucgaccgaucucaaguacgagacuucaucgaaacaacagccaagcuuucacgugugggagggucugaacuuaauuagcagacaguggagaggcaaauccgcaccauag

SEQ ID NO: 12700 - RNA, 753 nt, Artificial Sequence
  Description of Artificial Sequence: Synthetic coding sequence
auggcauccgagcggcucccuaaccggcccgcgugucuucucguagcgucuggcgcagcagaaggaguuuccgcucaguccuuccuccacuguuuuacaauggcuaguacagcauucaaccuucagguagcaacccccgggggaaaggcuauggaguuuguugacguuacugagucuaaugcaaggugggugcaagauuuuaggcuaaaggcauacgcgucacccgccaagcuggaauccaucgacggggccagguaccaugcgcuccugauuccuuccugcccuggagcccucacugauuuagccucaucgggcucucucgcuaggauccuccaacauuuucacucugaaagcaaaccuaucugcgcugucggccacggcgucgccgcauugugcugcgccaccaacgaggauagaucuuggguuuuugacucuuauucucuuacuggcccuaguguuugugaacuagugcgggccccaggguucgcucgccucccacuggucgucgaggauuucguuaaggauucuggcgcauguuuuucaggcgcagcggccagcugucccaaagcagaucgccacuggcaacauuuuccugucgaggaaauauuucuugcuugcggcuuuaagguagcaggucugggcgcagccccuggcugggggcgugggggaaaacaagaggauaggccucccgaggaacagagaagagcaggagaggauuuucccauuuaucaguguguguucaucuacccauag

SEQ ID NO: 12701 - RNA, 1386 nt, Artificial Sequence
  Description of Artificial Sequence: Synthetic coding sequence
augucccucgauauucaaagcuuagauauccaaugugaggaguuauccgaugcuagaugggccgagcuccugccccuucuucagcagugccagguggugagacucgacgauugcggguugacagaagcuagaugcaaagauauuuccuccgcccugcgugugaauccagcgcuggcagaacuaaaucugcggagcaaugagcuuggugaugugggcgugcacugcguccuccaggguuugcagacacccucuugcaagauucagaagcugagccuacagaauugcugccugaccggugcugggugcggugugcucucaaguacucucagaacacugccaacucugcaggagcugcacuugucagauaaccugcugggagaugcuggucugcaacuguugugugagggauugcucgacccccagugccgccuggaaaaacugcagcuggaguauuguucacugucugccgccuccugcgaacccuuggcuuccguacuccgugcuaaacccgauuuuaaggaacucacugugucgaauaacgauaucaacgaggccggcgugagaguguugugccagggacugaaagacucccccugccaguuggaggcucugaaauuggagucaugcggggugacauccgacaacugccgggaccugugcggcauuguggccagcaaggcuucccuccgagaacuagcacucgguucgaacaaacucggugauguggggauggccgagcugugccccggauuguugcauccuucaucucggcugcguacccuguggauaugggaauguggaaucaccgcuaagggaugcggggauuuaugucgcgugcuacgggcaaaggaaagcuugaaggagcugucccuggcugguaaugagcugggcgaugagggagcuaggcucuugugcgaaacccuucuggagccaggaugucagcuggaaucccuguggguaaaguccugcuccuucaccgcugccugcugcucacacuucucuucaguauuggcacagaacagguucuuacuggagcuccaaaucagcaauaacagacuugaagaugcuggugugcgugaauuaugccaagggcuggggcagccuggcuccgugcugcggguguuguggcuugcagacugugaugucagcgacagcuccuguuccagccuggcugccacucuucuggcuaaucacucucuccgcgaauuagaucuuuccaauaacugccugggagaugcggguauccugcaacuaguggaauccgugcgccagccugguugccugcucgaacaacuuguguuauacgacaucuauuggucggaagaaauggaggaucgguuacaggccuuagaaaaagacaaaccgagucugagagugauuucuuag

SEQ ID NO: 12702 - RNA, 1386 nt, Artificial Sequence
  Description of Artificial Sequence: Synthetic coding sequence
augucucuugauauucaaagucucgacauucagugcgaggaguuaucugaugcccggugggcugaacugcuaccgcugcugcagcagugucagguggugagauuagacgauuguggguugaccgaggcacguugcaaggacaucucauccgcauuacgugugaaccccgcccucgccgaacugaaucugcguuccaacgagcugggugacgugggagugcacugugugcuccagggacugcagacucccucauguaaaauacaaaaauugagccuccagaauuguugucuuacaggcgccggaugugggguucugagcuccaccuuaagaacacuccccacgcuacaggagcugcaccucuccgauaaccuccucggcgacgcugggcugcaacuacugugugaggggcugcuugauccucagugccggcuagagaaauugcagcuggaguauuguucccuguccgcugcuuccugcgaaccccuugccaguguguugagagcgaagccggacuuuaaggagcugacugucuccaacaacgauaucaaugaagccgguguucggguacucugucaagggcugaaggacagcccaugccaacuggaggccuugaaacucgaguccuguggagugacaagugauaacuguagagacuuauguggaauaguugcuagcaaggcuagucuccgagaguuagcgcucggcagcaacaaacuaggggaugugggcauggccgaacucugccccgggcuuuugcaucccucgagcagauugcgcacacuguggauuugggaaugcggcauuaccgcgaaaggguguggagaccucugucgcgugcugcgggccaaagaaagccucaaggagcucucgcucgcuggcaaugagcucggcgacgagggagcaagacuccucugcgaaacccuccuggagccaggaugccagcucgagucccucugggugaaaaguugcuccuuuacggcugccugcugcucgcacuucucuucaguacucgcacaaaaucgcuuucuucuugaguuacaaauuucgaacaaucgucuggaagacgcaggcguccgagaauuaugccaaggccuuggccagcccgggaguguguuacggguucugugguuggcagacugcgacguuucagacucuucuuguucuagccucgccgccacccuccuggcgaaucauucccuucgagaguuggaucugaguaauaauugucugggcgacgccgggauccugcagcucguggagaguguuaggcagccagggugccugcuagagcagcugguucucuaugacaucuauuggucagaagaaauggaagaccgccuccaggcucuggagaaggacaaaccaaguuuaaggguuaucuccuag

SEQ ID NO: 12703 - RNA, 1386 nt, Artificial Sequence
  Description of Artificial Sequence: Synthetic coding sequence
augucucucgacauucagucccuggauauacagugugaagaguuguccgacgcgaggugggcggaguugcuacccuugcugcaacaaugucaaguggugcgguuggacgacugcggccugacugaagcucgguguaaggacaucagcuccgcgcugagagugaaccccgcccuggccgaauugaacuugcguagcaacgaguugggugauguuggaguucacugcguacuucagggccuucagaccccaucuuguaaaauccagaaacucucucuccaaaauuguugucuuacuggagccggaugcggugucuuguccucuacccuucgcacguugcccacacugcaggagcuccauuugucagacaaccucuuaggcgaugcagggcuccaacuacugugcgagggacuucuggauccccaguguagacucgagaaauuacagcuugaauacuguucucuuagugcugcaucaugugaaccacuggcuagcguuuuacgagccaaacccgacuuuaaagaacugaccguaucaaauaaugauaucaacgaagcaggcgugaggguacugugucagggccugaaggauuccccgugccaacuugaggcucugaagcuugaaucuugugguguaacuagugacaauuguagggaccugugcggaauagucgccuccaaggcaucuuuacgagagcuggcauuggggaguaacaaacuuggcgauguggguauggccgagcucugucccgggcuacuccaccccucuucacgucuucggacccuguggaucugggagugcggaauuaccgcaaaagguugcggcgaccugugccgggugcuaagagcuaaagagucacuaaaggagcugagccuugccggaaacgaauugggcgaugagggugccagacugcuuugugagacccuuuuggaaccggggugccaguuggagaguuuaugggugaaaucguguuccuuuacggcggcgugcugcucacauuucaguaguguucuugcccagaauagguuucuucuugagcuucaaaucucaaacaauaggcucgaagaugcaggggugcgcgaguugugccaaggacugggacagccugggagcguacucagagugcucuggcuugcagauugcgacgugagcgauucaucaugcuccucccucgccgccacucuccuggcaaaccacagccugcgggagcuggaucuuuccaauaacugccugggcgaugcuggcauccuucaacugguagaaucaguucgccagccagggugccuccuggaacagcuuguucucuacgacauuuacuggucagaggagauggaggacagacugcaagcccucgagaaagacaaacccagccuccgugucauuagcuag

SEQ ID NO: 12704 - RNA, 1452 nt, Artificial Sequence
  Description of Artificial Sequence: Synthetic coding sequence
augaucaccgcccauugcucauuggaucugcugggaucuguagcuguucuaugcguuugcgacuuauccccggcccagugcgauauuaauugcugcugcgauccagacuguucuagcgucgacuuuucaguauuuuccgccugcucugugccaguggugacaggggacucucaguucugcagccagaaagcuguaauuuacucuuugaacuuuacagcaaaucccccccagcgcguguucgaauuaguggaccagauuaauccuucaauuuuuugcauucacauuaccaauuacaagccagcucucucguucauuaaccccgagguccccgaugaaaacaauuucgacacucucaugaagaccucagacggcuuuaccuugaacgcagaaaguuacguuucuuuuacuaccaaacucgauauaccaacagccgcuaaguacgaguauggagugccucuucaaaccuccgauucauuucuucgauucccgucaagucuuaccuccagucuguguaccgacaauaaucccgccgcauuccuggugaaucaggccguaaagugcacccgcaagaucaaccuggagcaaugugaagaaauugaagcccugucaauggcuuucuauucauccccggaaauccucaggguacccgacucccgcaaaaagguuccgauaaccguucaaucgaucgugauccagagucuuaauaagacccuaacccggagagaagauacagauguccugcagccuacacuaguuaacgcaggucacuucucucuaugugucaacgucgugcuggaggucaaauauucucuuacauauacagacgcuggggaaguuacuaaggcagaccugagcuuugugcuaggaacaguuuccucaguggucguuccauuacagcagaaguuugagauccacuuucugcaagagaacacccaacccguuccuuugagcggaaacccaggauaugucguaggauugccuuuagccgccggcuuucaaccccauaaaacgggagcauugcccugccaauugguagcacagaagguaaaaagccugcucuggggacagggcuucccugauuauguugcccccuucggcaacagccaggcccaagacaugcucgauuggguaccgauccauuucauaacccagagcuuuaaccggaaacacuuugucuugcaggauucaugccaacugccgggggccuuaguaauugagguuaaguggacuaaguaugggucuuugcucaacccccaggcaaagauugugaaugugacugcuaaucucaucucuuccucauuuccagaggcaaacagcggcaacgagcggacgauccuaaucaguaccgcugucacuuuuguggacgucagugcuccagccgaagccgguuuccgcgcaccaccugcuaucaacgcccggcuccccuucaacuucuucuuucccuucguguag

SEQ ID NO: 12705 - RNA, 1596 nt, Artificial Sequence
  Description of Artificial Sequence: Synthetic coding sequence
augugucagcugcuggagagcaccgugauccagccacagggugauucccccgucgcaguucuaugcgucugcgacuugagccccgcacagugugauauaaauugcuguugcgacccugacuguagcucaguggauuucucaguuuucuccgcuuguucuguccccguagucacaggugacucacaguucuguucucagaaggccguuaucuacucccucaacuucacugcaaaucccccccagcggguauucgaauugguggaccagaucaacccuucaauuuuuugcauacauauaaccaacuauaagccugcccugaguuuuauuaaccccgaggucccugacgaaaauaacuuugacacacugaugaagacuuccgauggcuuuacacucaacgcagaaaguuacguguccuuuacgaccaagcuggauaucccaacugcugccaaguaugaauauggcgucccauuacaaacgucugacagcuuccugagauucccguccucucugacuaguucgcugugcacagacaacaaucccgccgcuuuucuggugaaccaagcugucaaguguacccgaaaaauuaaccucgaacagugcgaagagaucgaggcacuaucuauggcuuuuuauaguaguccagagauacugcgggugccugacagucgcaaaaaaguacccauuacuguccagucaaucgucauucaauccuugaacaagacccucacaagaagggaagauacggauguccuccagccaacccuggugaaugcugggcacuucagccuuugugucaaugucgugcuggaggugaaauacucccuuaccuauacagacgcuggggaaguuacuaaggccgaccuuaguuuuguguuagggaccgugaguucuguaguugugccacuucagcaaaaauuugaaauucauuuucugcaggagaauacacagccaguaccucuuagcgggaaccccggauacguggucggacucccacucgcugcuggguuccaaccccauaagaugagcgggaucauacagaccaccaaccguuacggacagcugacaauccuucacuccaccacagaacaggacugccuugcccuggagggagugcgaacgccaguccuguuuggcuacacuaugcaguccgguugcaaacugaggcuuaccggugcauugcccugucaguugguggcccaaaaagucaagucccugcuuuggggccaaggcuuccccgauuacguggcaccuuuuggcaacucccaagcacaggacaugcuggacugggugcccauccauuuuaucacccaaaguuuuaaccgcaaggacucuugucagcuuccaggcgcccuaguuauugaagugaaguggaccaaauacgggagccugcuuaacccacaagccaaaaucguuaacgugaccgcaaaucuaaucuccuccucuuuuccugaagcaaacuccggaaaugaacgaaccauucugauaucaacugccgugacauucgucgacgucagugccccugccgaagccggauuccgggcuccccccgcuaucaacgccagacuuccuuucaacuucuuuuucccuuuuguguag

SEQ ID NO: 12706 - RNA, 1722 nt, Artificial Sequence
  Description of Artificial Sequence: Synthetic coding sequence
augcggccucgcggguugcccccucucuugguaguucugcuaggcugcugggccuccguuagcgcacagaccgaugcgacucccgccgugaccacagaaggucucaacuccacagaagcggcccuagccacauuugggacuuuccccucaacccgucccccaggaaccccacgggcccccgguccgucuaguggcccacggccaacucccgugaccgauguugccguacuguguguuugcgauuugucaccugcccagugugauaucaauuguuguugcgaccccgauuguucuaguguagacuuuagcgucuucagcgccuguagcguuccagucgugacaggcgauucacaguuuugcucacaaaaagccgucauuuacagucugaauuucacugccaaucccccacagaggguauuugaacugguggaccagaucaacccauccaucuuuuguauucacauuacaaacuauaagcccgcccuuuccuuuauaaacccagaaguaccagacgaaaauaacuucgauacauuaaugaagacaucagauggguuuacacugaacgcugaguccuacguaaguuucaccacuaaauuagauauucccacugcugcaaaauaugaguacgggguccccuugcagacaagcgauuccuuccucagauuucccuccagucugaccucuuccuuaugcaccgacaauaaucccgcgggacaggcauacugguuuaccccggugauccccgcacugugggaagccgaagcaagagguucucuggagguaccagauucgcguaaaaaagucccaauuaccgugcagucaaucgucauccagagucugaauaagacuuuaacgagacgugaagauaccgaugugcuucagcccacacuggugaacgccggccauuucucccuguguguuaaugugguucucgaggugaaauacucgcuuacauacaccgacgcuggugagguuacuaaagcggaccugaguuuuguacugggcacugugaguaguguaguaguaccucugcagcaaaaauucgaaauccauuuuuugcaggagaacacacagccaguuccucuuucaggcaauccagguuacgucguaggccucccgcucgcggccggcuuucagccacacaaaggcagcggaauuauccaaacuaccaaucgauacggccagcugacgauucuccauucgacuaccgaacaggacugucuugcccuugagggugugcguacgccuguucuauucggauauaccaugcagaguggcuguaagcugcgacugaccggcgcucuuccuugucaacucgucgcucagaagguuaagucgcugcuguggggccagggguucccugauuauguugcucccuuugguaacagccaggcacaggauaugcuggacugggugccgauccauuucaucacacagucuuuuaauaggaaggacucaugccagcuccccggcgcccucgugauagaaguuaaguggacaaaauauggcucacuucucaauccccaagcuaagaucgugaacguaacagccaacuuaaucucuucuucauucccggaagcuaacucaggcaacgaaaggaccauuuugaucagcacugcagugacguucguugauguguccgcgcccgcugaggcuggcuucagggcuccuccagcuaucaaugccagacucccauuuaauuuuuuuuucccauucguauag

SEQ ID NO: 12707 - RNA, 1230 nt, Artificial Sequence
  Description of Artificial Sequence: Synthetic coding sequence
augaaaacaucagacgguuucaccuuaaacgccgagagcuacguaucuuuuaccaccaaacuggauaucccgacagccgcgaaguaugaauauggagucccacuccagacuagcgacagcuuccuuagguucccuuccucauugacaucaagccucuguaccgauaacaauccagcggcuuuucuagugaaccaggcuguuaaaugcacucgcaagauuaaucuagaacaaugugaggagauugaggcccucuccauggcuuucuacuccuccccugaaauuuugcgggugccugauagccgcaagaaagugccuauuaccgugcagucaauugugauacagucucuuaauaaaaccuugacccgccgcgaggauacagacgugcugcagccaacacuuguuaacgcaggccacuuuucccugugcgugaacgugguacuugaagucaaauauucauuaacuuauaccgaugcuggcgaaguaaccaaagccgaucugaguuuuguccucggaacaguauccagcguagucgugccuuugcagcagaaauucgaaauacauuuccuucaagagaacacccaacccguuccccugagugggaauccgggguacguggugggacuuccauuagccgccgguuuccagccucacaagggauccggcauaauccagacuacaaacagauacgggcaguugaccauccuucauucgaccaccgaacaggacugucucgcucuugagggcguccgaaccccgguucuauucggguacacaaugcagagcggguguaaauuacggcuuacuggggcacuccccugucaacugguggcccagaaggucaaaucguuguuguggggccagggguucccagauuaugucgcuccguuuggcaauucucaggcucaagacaugcuagauuggguuccuauccacuuuauuacacagucauuuaaucgcaaagauuccugccagcuccccggcgcacuggucaucgaagugaaauggaccaaguaugggucacuccucaauccccaggcuaagauagugaacguaacggcuaaucuuauuaguucuuccuuuccugaagcaaauucugggaacgagcguacuauucucaucucgacugccgucaccuucguggaugucagcgcacccgccgaagccggauuucgagcuccucccgcuauaaaugcgaggcuuccauuuaacuucuuuuucccauuuguauag

SEQ ID NO: 12708 - RNA, 1779 nt, Artificial Sequence
  Description of Artificial Sequence: Synthetic coding sequence
augaggcccagagggcugccgccgcuccugguuguauuauugggcugcugggcaagcguuucugcccaaacagaugcaacuccugccgugacaacugagggccugaacuccacagaggcugcacucgcaacauuuggaacauucccaagcacccggccccccggaacgccccgugccccuggcccaucaucuggacccaggcccacuccagucacagauguggccguauuauguguuugugacuugagcccagcccaaugcgauauaaacugcuguugugaucccgacugcuccuccguggauuuuuccguguucucggccugcagcgugcccgucgucaccggcgauucacaguuuuguagucagaaggcgguuauuuacagucuuaacuuuaccgcaaacccaccacagcguguguuugaguuaguagaccagaucaacccgucaaucuuuuguauucacauuaccaacuacaagccugccuugaguuuuaucaacccagagguacccgacgaaaauaauuucgacacccugaugaaaacguccgacggcuucacucugaacgccgaguccuaugugagcuucacuacaaagcucgauauacccaccgcagcuaaauaugaguauggagugccgcuccaaacuuccgacuccuuucugagguuucccucuucucuuaccaguagucuguguacagacaauaaccccgccgccuuucuaguuaaccaggcggugaaguguacccgcaagauaaaccucgagcagugugaagaaaucgaggcucugucaauggccuucuacucaaguccugaaauacuccgagugccagacucacguaaaaaaguucccaucacagugcaauccauuguaauacagucacuuaacaaaacucugaccaggagggaagacaccgaugugcuucagccuacccuuguuaaugccggccauuucucccugugugugaacgucguauuggaagugaaauauucccugacuuacaccgacgccggagaaguuacuaaagccgaucugagcuucgugcugggaaccgugucuaguguagucgugccacugcagcaaaaauuugagauacacuuucugcaggagaauacccaaccggucccucuguccggaaauccagguuacgucgucggacugccccuggcugccggcuuccaaccccacaaagguagcgguaucauccagacuacaaaucgguauggacagcuaacaauccuccacucaacaacugaacaagacugccuugcuuuggaaggagugcgaaccccuguacuguucggcuauacaaugcagucuggcugcaagcugcgauuaacaggggcacugccuugucagcucgucgcgcagaaggugaaaucacuucuguggggacagggcuuucccgauuauguagccccuuucgggaacucacaggcccaggauaugcuagauuggguaccaauucauuuuaucacucaguccuuuaaccgaaagcacuucguguugcaagacucaugccagcugcccggggcccuggucaucgagguuaaguggaccaaguacgggagccuucuuaauccgcaggcuaaaauugugaacgugaccgcuaauuugaucucaaguaguuucccagaggcaaacagcggcaacgagcgcacaaucuugaucaguaccgccguaacauuugucgaugugucagcccccgcggaggccggauuccgggccccacccgccaucaacgcucggcugcccuucaacuuuuucuuuccauuuguguag

SEQ ID NO: 12709 - RNA, 552 nt, Artificial Sequence
  Description of Artificial Sequence: Synthetic coding sequence
augauauuuuuacuucucaugcugucucuagaguugcagcuucaccagaucgcagcccuauucacagugacagugccuaaggagcuauacauuauugaacauggauccaacguaacccuggagugcaacuuugacaccgguucacacgugaacuugggcgccauuacagcgagccuacagaaaguagaaaacgacacaaguccacaccgggagcgcgcuacucuucuggaggaacagcuuccauugggaaaggcuuccuuccacauuccccaaguccaagucagggacgagggccaguaucagugcauuaucauuuauggcguagcaugggacuauaaauaucugacacugaaaguuaagggccagauggaaccccggacccacccuaccuggcugcuccacauauucaucccauuuugcauaauagcuuuuauuuucauagcgaccguaaucgcgcugcgaaaacagcuuugucagaaacuguacuccucuaaagauaccaccaagcgcccgguaaccacgacaaaaagagaaguuaacagcgcaaucuag

SEQ ID NO: 12710 - RNA, 822 nt, Artificial Sequence
  Description of Artificial Sequence: Synthetic coding sequence
augaucuuuuuacugcugaugcuuucucuugaacugcaguugcaccagauugccgcccuguuuacuguuaccgucccgaaggaauuauauaucauugaacacggauccaacgugacacucgagugcaacuucgacaccggcagucacgugaaucucggagccauuacagccagucuccagaaaguggaaaaugauaccuccccacacagagaaagggcaacgcuguuggaagaacaguuaccacugggcaaggcuuccuuccacaucccacagguacaaguccgggacgagggacaguaucaaugcaucaucaucuacggaguugcaugggauuacaaauaucucacccuuaaaguaaaagccaguuaccgcaagauuaauacacacauuuugaaagugccagaaaccgaugaggucgaguuaacgugccaggccacaggcuacccgcuggcugaaguuuccuggcccaauguguccgugccagcaaauaccucucacagccgaacuccggaaggccucuaccaggucacauccgugcugcguuugaagccgccacccggucgcaacuucaguugcgucuucuggaauacccauguccgagagcugacacuugcgucuaucgaccuccagucgcagauggagccaagaacucacccgaccuggcuauugcacauuuucauuccuuucugcauuauugcuuuuauuuucaucgccaccgugauagcacuuagaaaacagcuuugccagaagcucuacucauccaaggacaccaccaagcggccugugacuacaacuaaacgcgaagugaacucagcaaucuag

SEQ ID NO: 12711 - RNA, 372 nt, Artificial Sequence
  Description of Artificial Sequence: Synthetic coding sequence
cugggcgauaggagaggucguaguucaggagcaagagcagccgcugugggcucaacaggcgagagauuggagauggaggaagauauacugcagcuccaagccgaggcaaccgcugaaguguugggggaggucgcucaagcacagaaaguucugagagauucggugcaacggcuagaaguucaguugcguagcgcuuggcucgguccagcauaucgggaauucgagguccuuaaggcacaugcugacaaacagucacacauccugugggcucuuacgggucauguccagcggcaaaggagagaaaugguggcucagcagcauagguugagacagauccaggagcggcugcauacagccgcguuaccugcauag

SEQ ID NO: 12712 - RNA, 345 nt, Artificial Sequence
  Description of Artificial Sequence: Synthetic coding sequence
auggccuccuucaagcuagcagauagugugugggaagacagucuuucaaaacgccaaaggaaucagggccgcaugaaaacuuugccugugcugguccucucacugacacuccugacuguauucagcgaaacuucuccuauacucacagagaagcaagccaagcagcuccugaggucucguagacaagauaggccauccaaaccaggcuuuccagacgaaccuaugagagaguauaugcaucaccuucuggcucuggagcaccgggccgaagagcaauucuuagaacauuggcucaauccccauugcaagccucauugugaccguaaucgaauucaucccguguag

SEQ ID NO: 12713 - RNA, 345 nt, Artificial Sequence
  Description of Artificial Sequence: Synthetic coding sequence
auggcauccuucaagcuggcugauagugucugggaggauucucuuucaaaaaggcagcggaaucaaggcagaaugaagacuuuaccggugcugguucuaucccugacucugcugaccguguucuccgaaaccagcccgauuuugacagaaaaacaagccaaacagcuccugcgaagcagaaggcaagaccgaccuuccaaacccgguuuuccagacgaaccaaugagagaauacaugcaucaccuccucgcucuugagcaccgagcagaggaacaguuucucgagcauuggcuuaauccacauugcaaaccacacugcgaccgaaauaggauccauccugucuag

SEQ ID NO: 12714 - RNA, 444 nt, Artificial Sequence
  Description of Artificial Sequence: Synthetic coding sequence
auggcccuacagagaacucauagccuacugcuucucuugcuucucacucuccuuggauugggguuaguucaaccuucauauggccaagauggaauguaccaacgcuuucuuagacagcacguccauccugaagagacuggugggagcgauagguauugcaauuuaaugaugcagcgcaggaagaugacucuauaccacugcaagagauucaacaccuucauucaugaggauaucuggaauauccgcuccauuugcucuacuaccaauauccaguguaagaacggaaaaaugaauugccacgagggcguggugaaaguaacagacugcagagauacaggcaguucucgggccccuaauugccgcuaucgagcuauugcaucaaccagaaggguugucaucgccugcgagggaaauccucaagugccaguucacuuugaugguuag

SEQ ID NO: 12715 - RNA, 1302 nt, Artificial Sequence
  Description of Artificial Sequence: Synthetic coding sequence
auggagccccagcuggggccugaggcugcugcuuugagaccagguuggcuugcgcuucugcucuggguuagcgcuuugucaugcucauucucccucccggcuuccucauuaaguucacuuguuccucaaguacggaccuccuacaacuuugggcgaacauuccugggccuggauaagugcaaugccugcaucggcacguccaucugcaaaaaguuuuucaaggaagaaauucgcagcgacaauuggcuagccucccaucuugguuugccaccugauucccuucuguccuaucccgccaauuauagugaugacagcaaaauuuggcggccagucgaaauauuccgccuuguaucuaaauaucaaaacgaaaucuccgaccgacgaauaugugcaucugcuucagccccuaagaccugcuccauugaacggguccugcggaagaccgagcgauuucagaaguggcugcaagccaaaagacugacccccgauuuagugcaggguuuggcuucaccacugcuucgcugucccucucagaggcugcucgaucgcguagugcggcgguacgcugaggucgcugacgccgggucaaucuuuauggaucacuuuacugauagggauaaacugagacuucuguauacucuggccguuaacagccaucccauccuucugcaaauuuucccuggcgcagagggguggccucugcccaaauaccuggguucuuguggacgguuccucgucuccacaagcacccgaccacuccaagaauucuaugacgcgccucccgaccaagcggccgacuuggcuuaccagcuucugggugugcucgaaucccugaggucaaacgauuugaacuacuucuucuacuucacgcacauugaugcagguauguuuggcguuuuuaauaacggacaucuuuucauucgcgaugcauccgccguaggcgugaucgacaaacaggaggguucucaggaagcgaaucgcgccggagagaacaaagauauuuucuccugucucguuagcggcugucaggcucaacugccaaguugugagucaaucuccgagaaacagagccuggugcucgugugucaaaagcuccuuccacgacuucuccagggacgcuuuccuaguccagugcaggacgacaucgauucuauucuggugcaauguggagauucuauacggcccgauccugaagugcuuggcgccgcuucucaacucaaggacauccuccggccucuucguaccugugacucgcgauuugccuaucgguauccugacuguaaauacaaugacaaauucuag

SEQ ID NO: 12716 - RNA, 600 nt, Artificial Sequence
  Description of Artificial Sequence: Synthetic coding sequence
auggagaccuuuccacuccuguugcugucacuggggcugguguuggccgaggccucagaaaguacaaugaagauaauuaaggaagaauuuacugaugaagagaugcaauaugauauggcaaaaucuggccaagagaagcaaaccaucgagaucuuaaugaaucccauauugcuggugaaaaauacaucccuguccauguccaaagaugacaugucaagcacacuguuaacauucaggaguuuacacuacaaugacccaaaaggaaauagcagcgggaaugauaaggaaugcugcaacgauaugacaguguggagaaaagucucugaggccaacggcagcugcaaauggucaaauaauuuuauucguagcucuaccgaggugaugcgccgagugcaccgcgccccgucuuguaaauuuguucaaaauccuggcauuucuugcugcgagucauuggaguuggagaauacugucugccaguuuaccaccgguaaacaguucccccggugucaauaucacucagucaccucucuggagaagauccucacgguacugacgggucacagucugaugagcuggcucguguguggaucaaaauuguag

SEQ ID NO: 12717 - RNA, 600 nt, Artificial Sequence
  Description of Artificial Sequence: Synthetic coding sequence
auggagacguucccguugcugcuguugucacugggcuuggugcuggcggaagcgucugaauccacuaugaagaucaucaaagaagaguucaccgaugaggagaugcaauaugacauggccaaauccgggcaagagaaacagacuauugaaauccuaaugaacccuauucuacucgucaagaauacaucgcuaucaaugucuaaagaugacauguccuccacccugcuuaccuuccggucgcugcacuauaaugacccaaaagggaauagcuccgggaaugacaaggaguguugcaaugauaugaccgucuggcguaagguaucugaggcgaaugguucauguaaguggaguaauaacuuuauacgaucuaguacugaagugaugaggaggguacaccgugcaccuaguugcaaguuugugcagaaucccgggauuagcuguugugagucucuggaacuugaaaauacagugugucaauuuacuacggggaagcaguuuccucgcugucaguaucacuccguuacaagcuuggagaaaauucucaccguauuaacaggucacucgcugauguccuggcugguuugugguucuaaacuguag

SEQ ID NO: 12718 - RNA, 291 nt, Artificial Sequence
  Description of Artificial Sequence: Synthetic coding sequence
augcucccaugucuggcgcuccuccuuuuaauggaacuuucaguuuguaccguggcaggagaugguggugaggaacagacacuaagcaccgaagccgaaacuugggaaggcgcuggcccuucuauucagcuccaacugcaggaggucaaaaccgguaaggcuagccaguuuuucggccugaugggaaaacgcgugggcgccuaucagcucgagcacacuuuccagggccugcugggaaagcgaucgcuguuuacagaaggacgcgaagaugaggcucagggguccgaauag

SEQ ID NO: 12719 - RNA, 981 nt, Artificial Sequence
  Description of Artificial Sequence: Synthetic coding sequence
augaccggauuguguggguacucagcaccggauaugcggggcuugaggcugaucaugauccccguugaacugcugcugugcuaccuucucuuacacccuguggacgcaacaagcuauggcaaacagaccaauguauugaugcacuucccucuuagccuggagagucagacacccucauccgauccacuuaguugucaguuuuuacaucccaagucucucccuggauuuucgcauauggccccuuugccuaaguuucugguuucucuugcccuccgaaacgcacuugaagaggccggcugucaggcagauguuugggcucuccaacuucagcucuaucgccaggggggaguuaacgccacucagguacuuauccaacaucugcgcggacuacagaaagguaggucaaccgaacgcaacguuucuguggaggcccucgcuucggcccugcagcuccuggcucgcgagcagcagucuacgggaagggugggcagaucacuaccaacagaggauugugaaaaugaaaaagaacaagcaguucauaaugucguucagcuucucccaggggucggcacauucuacaaccucgggaccgcuuuguacuacgcuacacaaaauugccuggggaaggcucgggaacggggcagggauggcgcaaucgaccuuggcuaugaccugcugaugaccauggcugguaugagcgggggcccuaugggacucgcgauuagugcagcuuuaaagccggcucuacguagcgggguccagcaguuaauccaauacuaccaggaucagaaggacgccaauauuucccaaccggaaacuaccaaagaggggcuacgagcuaucagcgauguuagugaucucgaggagaccacaacccuggcauccuuuaucuccgaagucgucucaagugcacccuacuggggcugggcaaucauuaagaguuacgauuuagaucccggcgcagggucacucgagaucuag

SEQ ID NO: 12720 - RNA, 1476 nt, Artificial Sequence
  Description of Artificial Sequence: Synthetic coding sequence
augcgguggauacucugcuggagccuuacccugugcuugauggcucagacagcacugggcgcacuacauacaaagagaccccagguggugacuaaguacggcacgcuccaggguaaacagaugcacgucggcaagacaccaauacagguuuuucucggugucccuuucucuagaccuccccugggcauucuucguuucgccccgcccgaaccaccagaaccuuggaaaggaauuagagacgccacuacauaccccccgggcugcuuacaagaguccuggggacaacucgccucuauguaugucagcacacgcgaacgcuacaaauggcuucguuuuucagaagacugucuguaucucaaugucuaugcucccgccagagcacccggugacccucagcucccagugaugguuugguuccccggcggcgcguuuaucgucggugccgcuuccucuuacgaggguagcgaucucgcggcacgggaaaaagugguccucguauuccuccagcaccgucuggggaucuucgguuuccuuuccacagacgauucucaugcccgcgguaauuggggguugcuagaucagauggcugcccugagguggguucaagaaaacauugccgcauuugggggugaucccgggaaugugacgcuauucggacaguccgcaggcgcgaugucuauuaguggcuugaugaugucuccauuggcaagcggccuguuucaccgugcuauuucacaguccggcacagcgcuguuucgucuguucaucacgagcaacccccugaagguggcgaagaagguugcccaucucgcugguuguaaccacaacaguacgcagauccucgugaauugucuucgugcccuguccgggacaaaggugaugagaguuucuaauaagaugagauuccuucagcugaauuuucagcgugauccagaggaaaucauuuggaguaugagucccgucguggaugggguggugauuccagaugacccucuugugcuucugacucagggaaaaguuagcucuguaccauaucuucugggggugaauaaccucgaguuuaauuggcuucucccuuacaacaucacgaaggaacaggugccacuugugguggaggaauaucuggauaauguaaaugagcacgacuggaaaaugcugagaaaccgcaugauggacauaguccaggaugcaacuuucguguacgcuacccugcagaccgcacacuaucauagaggccugucaaugggaaaggaaaaagccuugucucugcagaugaugaaauacugggcuaauuuugccagaacagggaacccaaacgacggcaaccugccuugcuggcccagauacaauaaagacgaaaaauaccuccagcuugacuuuacuaccagagucggaaugaaacuuaaggaaaagaagauggccuucuggaugucucuguaccagucgcagcgaccugagaagcagcggcaguucuag

SEQ ID NO: 12721 - RNA, 285 nt, Artificial Sequence
  Description of Artificial Sequence: Synthetic coding sequence
auggcugcauucccucauaaaaucaucuucuucuugguuugcagcaccuuaacccauguggcuuuuagugguauuuuuaauaagcgcgacuuuacccguuggccuaagcccagauguaagauguauauucccuuagauccagacuacaacgcugacuguccuaacgugacugcaccgguaugugcaagcaauggucauacuuuccagaacgagugcuucuucugcgucgaacaaagagaguuccacuacagaauuaaguuugaaaaauauggcaaaugcgacuag

SEQ ID NO: 12722 - RNA, 402 nt, Artificial Sequence
  Description of Artificial Sequence: Synthetic coding sequence
augaggcagcgguuacuacccucuguuacaucgcugcuguuaguggcucuucuguuccccgggucuucccaggcacggcacgugaaccacucagccacggaggccuuaggcgagcuccgagagcgggcccccggccaaggcacaaacggauuccaacuacucagacaugcuguaaaacgcgacuuacucccuccucgcacaccuccauaccagggugauguuccuccagggauucgcaacacuauaugccauaugcaacagggaauuuguaggcuguuuuucugucacucaggcgagaaaaagagggacauauguucagaucccuggaacagaugcuguguuuccaauacagacgaagaaggcaaagagaaacccgaaauggaugguagaucugggauauag

SEQ ID NO: 12723 - RNA, 564 nt, Artificial Sequence
  Description of Artificial Sequence: Synthetic coding sequence
augggaugcugcgguuguaguggcggaugcggauccggaugugguggauguggcagcggcugcggagggugugguagcuccuguugcguuccaaucugcugcugcaagccuguuuguuguuguguuccugcauguucauguagcucuugugggucuugcggaggcuccaaaggaggacgcggaucaugcggugguucgaaaggcgacuguggauccuguggcggaucuaaagggggcuguggaucguguggauguucccaauguucguguuauaaaccauguuguuguuccuccggaugcggaucuaguuguugccaaucuagcugcugcaagcccugcugcagucaguccucuuguuguaagccauguaguugcucuucuggauguggcucaaguuguugucaaaguuccugcuguaagccauguuguucucaguccucuugcugcaaacccuguuguugcuccucuggcuguggaucgucuugcugucagucaaguugcuguaagcccugcuguucccagucuucuugcugcguccccaucugcugucagugcaagauuuag

SEQ ID NO: 12724 - RNA, 564 nt, Artificial Sequence
  Description of Artificial Sequence: Synthetic coding sequence
augagaccgcucgcgggugcuccagucccaaagcgccagaagugcgaccacuggacacccugucccucagacaccuacgcuuaucgccuucuuucaggugggggucggucaaaauaugccaagauuuguuucgaagauaaucugcuaaugggcgagcaguugggaaacguggcacgggguauuaauaucgccauagugaauuaugugacgggcaacguuacugcuacaagauguuucgacauguacgagggcgacaacucaggcccuaugacaaaguuuauacagucagcugcgccaaaaagccugcuguuuauggucaccuacgacgaugguagcacgcgccugaacaaugacgcaaaaaacgcaauugaagcacuugggagcaaagagauucgaaauaugaaauuucggucuuccuggguuuuuauugcugcaaaaggccuagaguuaccuucugagauccagcgagagaaaauaaaucauagcgacgcuaagaauaaccgcuacuccggauggccugcagagauccagauugaggguuguauuccaaaagagagaucguag

SEQ ID NO: 12725 - RNA, 249 nt, Artificial Sequence
  Description of Artificial Sequence: Synthetic coding sequence
augaaaauacugugcauauuucucacauucguuuucacaguuucaugcgguccaagcguaccccagaagaaaacucgcgaaguggcugagagaaagcgugaaugccaacucgugcgcggagcuuguaaacccgaaugcaauucaugggaguauguguacuacuacugcaauguaaauccgugcugcgccgugugggaguaucagaaaccuaucaucaacaaaauuacaucuaagcuccaucagaaauag

SEQ ID NO: 12726 - RNA, 186 nt, Artificial Sequence
  Description of Artificial Sequence: Synthetic coding sequence
augaagauucauguuuucuuauucguccuguucuucuuuuugguacccauugcuacucggguuaagugugcagucaaagauaccuacuccugcuucaucaugcgaggcaaaugccgucacgaaugccaugauuucgaaaaacccaucggauucugcacuaaacugaacgcuaauuguuacauguag

SEQ ID NO: 12727 - RNA, 1056 nt, Artificial Sequence
  Description of Artificial Sequence: Synthetic coding sequence
augggaaaucuguuuaugcuuugggcagcacucgguaucugcugcgcugcuuuuucugcauccgcauggagugugaacaacuuccucauuacugguccuaaagcuuaucucacauacaccacuaguguggcccugggagcccaaucaggaaucgaggaguguaaauuccaguuugccugggagcgcuggaacugucccgaaaacgcccugcagcugaguacacauaauagguuaagguccgcaaccagagagacaagcuuuauucacgcaauaucuucugccggcgugauguacaucaucacuaagaauugcuccaugggcgacuucgagaauugcggcugcgauggcucuaacaacggcaagacgggaggccacggcuggauuugggggggcuguucugacaacguugaguucggggagcgcauuucaaaacuguucgucgauagcuuagagaaggguaaggacgcacgcgcucugaugaaccuccauaacaauagagccggcagacuggccgugagggccacuaugaaaagaacaugcaaaugccauggaauaagugggucauguucuauucagacuuguuggcuccaguuggcagaguuccgcgaaaugggagacuaucugaaggccaaauacgaucaagcucugaagauugagauggacaaacgucagcugagagcuggaaauucugccgaaggucacuggguucccgcugaggcuuuucucccgucggcagaagcagagcugaucuucuuggaagaauccccugacuacugcacaugcaacucaucgcucggcaucuacgggacugaaggucgggagugcuugcagaacagccauaauaccucaagaugggagcggagaaguugcggacgcuuguguacggaauguggacugcaaguggaggaacgaaaaacugaaguuauaucguccuguaauugcaaauuucaaugguguugcaccgugaaaugugaucaaugucgccacgucgugucaaaauacuacugugcucguucacccgggucagcucagucucucggaaaggguagugccuag

SEQ ID NO: 12728 - RNA, 1446 nt, Artificial Sequence
  Description of Artificial Sequence: Synthetic coding sequence
augcaguccaggcuccugcugcugggggcuccagguggccacggugggccagccucuagaaggaugagacuacuacugagacagguaguucagcgccggccuggcggcgacaggcagcgucccgaagugagacuacugcacgccggcuccggcgccgauacuggagauaccguaaacaucggagauguuaguuacaaacugaagauuccuaaaaauccugaacuugucccucagaauuauauuuccgacucucuggcccaaucaguugugcagcacuugagguggaucaugcaaaaagacuuauuaggccaggauguguuccugauuggcccccccgguccucuucguaggucgaucgcaaugcaauacuuagaacugacaaaacgggaaguggaguacauugcccuguccagagacaccaccgaaaccgaucugaagcagagaagagagaucagggcugggacggcguucuauauagaccagugcgcuguuagggcugcuacagagggcaggacccugaucuuggagggcuuggagaaggccgaacgcaacgugcugccaguacucaacaaccuccuggagaaccgugagaugcaacuagaagauggcagauuucuuaugagcgccgaaagauaugacaagcuguuaagggaucauaccaagaaggagcucgauaguuggaagauugugaggguauccgagaacuuucgcguuauugcguuaggccugccggugccccguuacucggggaauccccuggaccccccucuucggucgagguuucaggcucgggacauauacuaucuucccuucaaagaccaguugaaacugcuguacuccauuggagccaacguaagugccgaaaaagugucacaacuguugucauucgcaaccaccuuguguagucaggaaagcaguacauugggucucccagauuucccccuggacaguuuagcagccgcuguccagauuuuggauucuuuccccaugaugccaauaaaacacgcuauccagugguuguaucccuacuccauucuguuaggacacgaagggaaaauggccgucgaaggagucuugaaaagauucgaacugcaggacucugggucuucucuccuuccaaaggagauuguuaagguggaaaaaaugauggagaaccacgugucacaggccuccgugaccaucaggaucgccgacaaagagguaacaauaaagguaccagcaggaacucgccuuuuaucucagcccugugcguccgacagguucauacagacuuugagucacaaacagcuucaagcggagaugaugcagagccacauggugaaggauaucugucugauuggcggaaagggcugugggaagacaguuaucgcuaagaauuuugcagauacccugggcuacaacauagaaccaaucaugcuguaucaacacaaggugccccauaucuag

SEQ ID NO: 12729 - RNA, 786 nt, Artificial Sequence
  Description of Artificial Sequence: Synthetic coding sequence
auggcuagucuggccguuucuaacuggccuaagccaaugccacucauaccuugucucuccuggagcacggccucaggaguauuuaccacaggugugcuuucuaaguccaucaacuggcgcgaacuggaaaagcaguacuacacacagaccgucuacgaggaagagaucauccauaugcuggaauacugugggacugacaguuucaaaaugggccaggaguucguaaagcacuuuacgucaagcgccgacaaacugacaaaucucaaccuugucucucgcacgcugaaucucgacauaaguaaucaaguggucagccagaagcccgcagacugucacaauaguuccaagacuucuguauccgccacuucggaaggccuucuccugcaagauacguccaagaugaaaagguucaaucagacgcugucuacaaacaagagcggguauaccucuagaaacccacaguccuaccaccuucuauccaaagaacagucaagaaauagucugaggaaagagucacugauuuuuaugaaaggggugauggacgaauguacacacguagcgaacuucucgguucccguagaccccucguuaaucauaguggugcaggcaaaagaggaugcauauaucccaagaaccggaguaagaagccugcaggaaaucuggcccgggugcgagauucgcuaucuggagggcgggcauaucagcgccuaccucuuuaaacaggggcuguucagacaagcgaucuacgacgccuucgaucgauuccuucauaaauaugcaaauuag

SEQ ID NO: 12730 - RNA, 1245 nt, Artificial Sequence
  Description of Artificial Sequence: Synthetic coding sequence
augggagucucaaaacuggacauacuguaccgccguuuacugcuaacuaaacuguucauccggggaugggggcggccagaagaccuuaaaagacuguucgaauucagaaaaaugauugguaaccgggagcggugccagaaccucgugagcuccgauuauccgguacacauugauaaaauagaagagcagagcgacuguaaaauacuggacgggcauuucgucagucccauggcacacuauguucccgacaucaugccaaucgagagugugaucgcaagauuucaguuuauugucccuaaagaguggaauuccaaguacaggcccguaugcauccaucuggccggaacaggugaccaccauuacuggagacggaggacacuuauggcaaggccaaugauuaaggaggcgaggauggcuucucugcuguuagaaaaccccuauuacggcugcagaaaaccuaaggaucagguuagauccucucugaagaacguuagcgaucuguucguaauggguggagcauugguccucgagagcgcggcccuacugcauuggcuagagagagagggguaugggccucuggggaugaccggaauuucaaugggagggcacauggcgucucuugcaguauccaacuggcccaagccaaugccccugauccccugucucucuuggaguacagcauccggcguuuucacuaccacagacucauucaaaauggggcaagaguuuguuaagcacuucacuuccagcgccgacaaacucaccaauuugaaucuugucucccgcaccuugaaccuagacaucuccaaucaaguggugucccagaagccugccgauugccacaauuccucuaagacauccgugucugccacaucagaaggacucuuguugcaggacacuuccaaaaugaaacguuucaaccaaacccugaguaccaauaaaaguggcuauacgucacggaacccacaaucauaucaccuucugucuaaggaacagagcagaaauuccuugagaaaagagagucugauauuuaugaagggggugauggaugaaugcacacauguggcaaauuuuagcgucccaguugaucccucucuuauaaucgucguucaggccaaagaagacgccuauauuccuagaacaggcguaagaucauugcaagagaucuggccagggugugaaauccgauaccuugagggcgggcacauuagcgcauaccuguuuaagcagggacuguuuagauag

SEQ ID NO: 12731 - RNA, 747 nt, Artificial Sequence
  Description of Artificial Sequence: Synthetic coding sequence
augaaacugaccuucuuccuggggcugcucgcccugaucucguguuucacacccagcgagagucagcgcuuuucucguagaccuuaccugccuggccaauuaccaccuccaccccuguaccgccccagauggguaccuccuucccccccuccaccuuaugacaguagacugaacucaccacucucccuaccuuucgugccaggacgcgucccgccuuccagcuuuagcagauucucgcaagcagucauucucucacaacuguucccccucgaauccaucagacaaccuagguuguucccaggcuacccaaacuugcauuucccacuaagaccuuacuacgucgggcccauccggauccugaaaccuccuuuuccccccaucccguucuuccuugccaucuaucugccaauuucaaaccccgagccccagaucaauauaacgacagccgacaccacuaucaccacaaacccuccaacaacggcuacugcaacuacauccaccucaacuaagcccacaaugacaauaagcagcuccaccgucccuaucagcaguaccccugagccugcuacauccaucagugccgccacacccgcagcuucaacagagaauacgacucagauacuggccaacaggccccacacaguacugcucaacgcgacaguucaaguaacgaccucaaaucaaacgauccucucaaguccugcauuuaaaaguuuuuggcagaaauuauuugcgaucuucggauag

SEQ ID NO: 12732 - RNA, 231 nt, Artificial Sequence
  Description of Artificial Sequence: Synthetic coding sequence
augggcgcagcuaucucccagggcgcucuuaucgcgaucgugugcaacggguuaguaggguuucuucuucuccuguugugggugauccugugcugggccugucauaguagauccgcugacgucgauagucuuucugaaucuucccccaauagcucacccggucccugcccugaaaaagccccuccaccccaaaaaccaagucacgagggaucuuaucugcuccaaccuuag

SEQ ID NO: 12733 - RNA, 1536 nt, Artificial Sequence
  Description of Artificial Sequence: Synthetic coding sequence
augcuaguggacgguccuucugaacggcccgcccuuugcuuccuucugcuggcuguugcuaugucuuuuuucgggagcgccuugucuaucgacgaaacccgugcccaccugcuccugaaagaaaaaaugaugcgcuuaggcggcagacuggugcugaacacuaaagaggagcuagcuaaugaacggcugaugacccucaagaucgcagaaaugaaagaggcgaugcggacacuuauauucccccccucaaugcauuucuuucaggccaaacaucugaucgaacgaucucaaguauuuaacauccugcggaugaugccaaagggagcagcucugcaccugcacgacauagggaucguaacaauggacugguuaguccggaaugugaccuaccgcccucauugccauaucugcuucacaccccggggaauuaugcaauuuagauucgcccaucccacuccccgaccaagugagaaauguagcaaauggauccugcucgaggauuaucggaagcgcguacagaauguaacagaguuugacgauagccuacugagaaauuucacauuggucacccagcaucccgaaguuaucuauacuaaucagaauguuguguggagcaaauuugaaacaaucuucuucaccauuucaggucuaauucauuaugcuccaguguuucgagacuacguguucagguccaugcaggaguuuuaugaagauaacgugcucuacauggaaaucagggcuagauuacucccaguuuaugagcucucaggcgagcaccacgaugaggaauggucagugaagacguaucaagaggucgcacagaaguucgucgaaacccaccccgaauucauaggcaucaaaauaaucuacagcgaccaucggagcaaagacguugccgugaucgcugaguccauaagaauggcgaugggccugcgaaucaaguuuccgacagugguugcuggauucgaucuggugggccacgaagacacuggccacucccugcacgacuacaaagaggccuuaaugaucccagccaaagauggcguaaagcuuccauacuuuuuccacgccggcgagaccgauuggcaaggaaccaguauugacaggaauauccucgacgcguuaaugcugaauacuacgcgcauaggccacggcuuugccuugucuaaacauccagcaguaaggaccuacagcuggaaaaaagauauaccuaucgaagugugucccauaucuaaucagguacugaaacucguauccgauuuacgcaaccacccuguagccacacuuauggccacuggccacccaauggugaucucaagcgaugacccugccauguucggcgcaaaaggcuugagcuacgauuuuuaugaggucuucaugggcauuggugggaugaaagccgaccugaggacucugaagcagcucgccaugaacucgauuaaauauucaacgcuacucgaguccgagaaaaacaccuuuauggagauauggaagaaacggugggacaaauuuaucgcagacgucgcgacgaaguag

SEQ ID NO: 12734 - RNA, 1536 nt, Artificial Sequence
  Description of Artificial Sequence: Synthetic coding sequence
augcuaguagaugggccuagcgagcgaccagcucugugcuuucugcuucuggcaguggccaugaguuucuucggcucagcucucagcaucgaugaaaccagagcacaccuccuccucaaagagaagaugaugaggcugggaggucgucuaguguuaaacacuaaagaagagcuugcuaacgagcgucucaugacucugaagauugcagaaaugaaggaagcuaugcgcacgcugauuuuuccgccaagcaugcacuuuuuccaggcgaaacaucugaucgaaagaagucaagucuucaacauccuucgaaugaugccgaaaggagccgccuuacaccugcaugauaucggcaucguuaccauggacugguuggugcggaaugugacguacagaccgcacugccauauuugcuucacuccaaggggcauuaugcaguuuagguuugcccacccaacuccccggccguccgaaaaguguaguaaguggauccuucuugaagacuaccgaaaaagaguucaaaacgugacagaauuugacgauucucuacugcgaaauuuuacuuugguaacccagcaccccgaggugaucuacaccaaccagaacguggucuggucuaaauuugagacaaucuucuucaccauuucuggacuuauccacuacgcccccguguuucgagacuauguguuuaggucuaugcaggaguucuacgaagacaauguccucuauauggagauucgcgccaggcuuuuacccguauacgaacuuuccggagagcaucacgaugaggaguggaguguuaaaaccuaucaggaggucgcccagaaauucguagaaacccacccagaguuuauagguaucaaaaucaucuacucugaccaccgguccaaggauguggcagugauagcagagucuaucaggauggcaaugggacuuaggaucaaguuccccaccgugguugccggcuucgaccucgucggacaugaggauacaggccacaguuugcaugacuacaaagaggcccugaugauuccugccaaagacggagucaaguuacccuacuuuuuucacgcaggggagaccgacuggcaaggcacuucuauagaccggaacauucuugaugcacuuaugcuuaauacuaccagaaucgggcacggguuugccuuaucuaaacacccugccguccggaccuacucguggaagaaagacaucccuauugaaguuugccccaucagcaaccagguauuaaaacuaguguccgaucuuaggaaccauccagucgcuacuuuaauggccacagggcaccccauggugauauccucagaugacccugccauguuuggagccaagggacuaucuuacgauuucuacgagguauucauggggauuggagguaugaaggccgacuugagaaccuuaaagcagcuggccaugaacucaauuaaauauagcaccuuguuggaauccgaaaagaacacuuucauggagauuuggaagaaacgaugggacaaauucauugccgacguagccacaaaguag

SEQ ID NO: 12735 - RNA, 240 nt, Artificial Sequence
  Description of Artificial Sequence: Synthetic coding sequence
augaaacuccauagccugauuucuguccugcugcuguucgugacacugauucccaaaggcaaaaccggcgugaucccuggccagaagcagugcaucgcccuuaaggguguuugucgcgauaaacuguguucaacccuggacgacacuauagguauuuguaacgagggcaagaaaugcugcagaaggugguggauccuggaacccuacccaacaccuguuccaaaggggaaaaguccguag

SEQ ID NO: 12736 - RNA, 351 nt, Artificial Sequence
  Description of Artificial Sequence: Synthetic coding sequence
auggcugcuggaagugccccaaugcaacuacaucugagagcgacgauccgaaugaaagacggccucuguguuccacgcaaauggauuuaccaccugacugaagggaguaccgacuugcgaaccgaggggagaccugauaugaagacggaauuauuuuccagcucaugccccggagggauaauguugaaugagaccggacagggguaucagagauuuuuguuauauaaucggaguccucaccccccagagaagugcguggaggaguucaagagccuuacuucuugccuggacucaaaagccuuccuucucacaccuagaaaccaagaagcgugugaacucucuaauaacuag

SEQ ID NO: 12737 - RNA, 543 nt, Artificial Sequence
  Description of Artificial Sequence: Synthetic coding sequence
caggugaucccaauaaacucaggugaucuuuucguacauccguuguggaaccgguccuguguagcuugcggaaacgacauagcccugaucaagcucucccggagugcacaguuaggugacgcuguccagcuggcauccuuaccacccgcaggggacauauugccaaaugaaacaccuuguuauaucacuggcugggguagacuuuauacgaauggcccucucccagauaagcuccaggaagcccuucuacccgugguggacuaugagcacuguagucguuggaacugguggggaucuuccguuaagaaaacgauggugugcgccgguggugauauucggucuggcugcaacggggauuccggagggccucucaacugccccacggaggacggaggcuggcaagugcacggagugacaucuuucguguccgcauuuggcugcaauacccggcgcaagcccacugucuucacccgcguuagugcauucaucgacuggauugaagagaaacuccaggguaauaaagcucccgagaguaggacguag

SEQ ID NO: 12738 - RNA, 1215 nt, Artificial Sequence
  Description of Artificial Sequence: Synthetic coding sequence
augccuccauuccugauaacauuauuccuguuucacuccugcugucugcgcgccaauggacacuugagagaaggcaugacguugcucaagaccgaguucgcauuacaucuuuaucagagcguggccgcauguagaaacgagaccaauuucgugaucagucccgccggaguaucccuuccacucgagauacuucaguuuggagcagaggggagcaccggccagcagcucgcggaugcucugggauacacgguucacgacaaacgcgucaaggauuuccugcacgccguuuaugcuacccugccgaccucuucgcaggggaccgagauggaguuggccugcagccuguuugugcaagucgggacaccauuguccccuugcuucguugaacacguguccuggugggcgaacuccucucucgaacccgcggaucuaucugaaccuaauuccacagccauucagacuagcgaaggugcaucucgggaaacagccggaggaggaccaucugagggaccgggcggcuggccaugggagcagguauccgcugcguucgcccagcugguuuuaguguccacaaugaguuuccaaggaaccuggcgcaagagauucuccagcacugauacacaaaucuugccauuuaccugcgcauacggccugguucuccaggucccgaugaugcaucagacaacagaggugaacuacggccaauuccaagacacagccgggcaccagguuggcgugcuugaacucccuuaccugggaagcgcggugagccuuuuucucguguugccgcgcgauaaagauacuccacucagucauaucgagccucaucugacugcuagcaccauccaccucuggaccacaagucuccgaagagcgcgaauggaugucuuccugccccgcuuccguauucagaaccaguuuaauuugaaaagcauucuuaauuccuggggggugaccgauuuauuugacccucugaaagcaaacuugaagggaauaagcggccaagacggauuuuacguaucagaggcuauucacaaggcgaagauagaaguccuugaggaagggaccaaagcaagcggcgccacagcuuuacuucugcucaagagaucucgaauucccaucuuuaaggccgaucgccccuuuaucuacuucuugcgcgaaccuaauacgggauuuguuuucagcauugguagagucuccaauccacucgacuag

SEQ ID NO: 12739 - RNA, 444 nt, Artificial Sequence
  Description of Artificial Sequence: Synthetic coding sequence
augggcccugaggcucuuagcucacuucugcugcugcuccugguggcaaguggagacgcggacaugaagggacacuuugauccagcgaagugccguuacgcgcuagguaugcaagaccguaccauuccugauuccgauauauccgcuuccagcagcugguccgauuccaccgccgcacgacacucuagguuggagagcucugacggggacggagccugguguccagcaggauccguuuuucccaaggaggaggaauacuuacagguugaccugcagagauugcacuugguggcacucgucggcacacagggaagacacgccgguggucugggcaaggaauuuucacgaaguuaucgccuuagguauucuagagacggacgaagauggaugggcuggaaggaucgguggggacaagagguuauaucaggcaacgaagaccccuag

SEQ ID NO: 12740 - RNA, 2631 nt, Artificial Sequence
  Description of Artificial Sequence: Synthetic coding sequence
augggcccggaggcccugucgagcuuauugcuucuccuguuaguggcgucuggugaugccgacaugaaaggucacuuugaucccgccaaaugccgguacgcucuggggaugcaggacagaaccaucccagauagcgauaucucagcuaguucgucuugguccgauucuacagcagcaagacauucccguuuggagucuagugacggggacggggccuggugcccagccggcagcguguucccgaaagaggaggaguaucuucaggucgaccuucagaggcugcaccugguugcucuggucggcacgcagggcaggcaugccggcggccuggggaaggaguucucccguucguaccgcuuaagauacagccgggaugggcguagguggaugggauggaaggaucgguggggucaggaggucaucucuggcaacgaagauccugagggaguuguccugaaggaucucggaccaccgauggucgcuagacucguucgcuuuuauccgagagcagacagagucauguccgugugucugagagucgaauuauacggaugcuuguggcgcgacggccuuuuaagcuauacagcuccggucggacagaccauguaccucagugaggcaguuuaccugaacgacagcacauaugacgggcauaccguagguggacuacaauaugggggguuaggacagcuggcagacggcguuguggggcucgaugauuucagaaagucccaggaguugcgcgucuggcccggauacgacuacgugggguggagcaaucacagcuuuagcagcggauacguagagauggaguuugaauuugaucgcuugagagcauuccaggcaaugcaggugcacuguaacaauaugcacacucugggagcccgccuaccgggugggguugaaugucguuuccgcaggggaccugcaauggcaugggagggugagcccaugcgucacaaccucggcgggaaccuuggagauccucgcgcccgcgccguuucaguuccacucggaggccguguugcucgauuucugcagugucgguuucucuucgccgggccuuggcugcuguucuccgagauauccuucauuucagauguggucaacaacucuucucccgcacucggaggcacauuccccccggccccaugguggccaccaggaccuccgcccacuaauuucucuucucuugagcuggagccaaggggccaacagcccguugcuaaagcagaggguagcccaacugccauacucauuggcuguuugguggccauuauccuguugcuccuucugauuauugcgcucaugcuguggcgacugcacuggcggaggcuucuuucaaaggcggaaaggcgcgugcuugaggaagaauuaacugugcaucucucgguccccggcgauacuauccugauuaauaaccgcccagguccacgggagccaccucccuaucaggaaccccgcccccggggcaaucccccacauuccgcccccugcgugcccaauggcucugcguacucuggagacuacauggagccagagaagccuggagccccgcucuugccccccccaccacagaauuccgugccacacuacgcagaagccgauaucgucacucuucagggcgugacuggagggaauacuuacgcuguuccggccuugccaccaggugccgucggagacggccccccuagaguagauuucccgagaucaagacugagauuuaaggaaaagcugggggagggacaguucggcgagguacaccugugugaaguggacucaccccaggaccuagucagccucgacuuuccacugaacguccgcaagggucaccccuuacucguggccgugaaaaucuugagacccgaugcuacaaagaacgccaggaacgauuuccucaaagagguuaagauuaugagccgacugaaagacccuaacauuauacgcuugcugggcguaugcgugcaagacgacccuuuguguaugauuacggauuauauggagaacggcgaucucaaccaguucuuguccgcgcaucagcuugaagacaaggccgcagaaggcgccccuggggauggucaggcagcccaggguccgacuaucuccuaucccaugcugcuacauguggccgcgcaaauagcuuccgggaugagauaucuggcaacccucaacuuugugcaucgugacuuggccacacggaauugccucgugggcgaaaauuuuaccauaaaaauugcagauuucggaauguccaggaaucuguacgcaggcgauuauuacaggguucaaggcagagcaguguuaccuauaagauggauggccugggaaugcauucucauggguaaguuuaccaccgcaagcgacguaugggcauucggcgugacacuuugggaggugcuaaugcuuugucgggcucagccguuuggacagcugaccgaugagcaagugauugagaacgccggcgaguucuuuagggaucaaggcaggcaaguguauuuaucuagaccaccugcuuguccucagggcuuguacgaguugaugcugagguguuggucccgggaguccgaacagaggcccccauuuucgcagcugcacagguuucuagccgaggaugccuugaauacuguuuag

SEQ ID NO: 12741 - RNA, 2631 nt, Artificial Sequence
  Description of Artificial Sequence: Synthetic coding sequence
augggccccgaagcacuaucaagccuuuuguugcuguugcugguggccuccggcgaugccgauaugaaagggcacuucgauccugccaaaugucgauacgcucuggggaugcaggaucgcaccauuccagacucagauaucagcgcaucaaguucuuggagugacucuacagcugcgcggcacaguagguuagaaagcagcgacggcgauggcgccugguguccagccggcagcguguuuccaaaggaggaggaguaccugcaagucgauuugcagcgacuccaucuaguugcacugguuggcacucagggaagacaugcgggcggauuagggaaggaguucuccagaucauacaggcuccgguauucucgugacggcagacgcuggaugggcuggaaggaucgcugggggcaggaagucauuaguggcaacgaagaccccgagggggugguguugaaagaccucggucccccaauggucgcuagacuuguacgguuuuacccacgagccgacaggguuaugagcgugugccuacgaguugagcucuaugggugucucuggcgggacggccuacugagcuauacugcuccgguagggcagaccauguaucuguccgaagcuguguauuuaaaugacuccacuuacgaugggcacaccgugggcggacugcaguacgguggccucggccagcuugcugacggcgugguggggcucgaugacuuccggaagucccaagagcuucgcguauggccuggcuaugauuacguggguuggagcaaccacuccuuuaguucuggcuaugucgagauggaguuugaauuugacaggcugcgugcauuccaagcuaugcaaguccauuguaacaauaugcacacgcucggggccagacugcccggaggaguggagugcagauucagacggggucccgccauggcgugggaaggugaaccaaugcgacacaaccugggcggcaaucugggcgauccacgcgcucgggccguauccguuccauugggugggagagucgcccgcuuucuucagugucgauuccuguucgcaggucccuggcuccuguuuagcgagauauccuuuaucuccgacgucguaaauaacuccagcccugcccucgggggaaccuucccucccgccccuugguggccaccgggcccucccccuacuaauuucucaagccucgaacuugaaccgcgaggccagcagccaguagcuaaggccgaaggcucgcccacagcuauucugaucgguugccugguggcuaucauucugcuucucuugcucaucauugcacucaugcuguggagacugcacuggcggagauugcuguccaaggcggaaagaagagugcuggaggaggaacuuacuguacaccuuagugugcccggagauacgauccuuaucaacaacagacccgggccuagggaaccccccccauaucaagagccacgcccucgcggcaauccuccccauucggccccuugcgugcccaacggcucggcuuauagcggcgacuauauggagcccgagaaaccgggagcuccuuuacuuccuccuccuccucagaacucaguuccccauuacgccgaagccgauaucgugacucugcaaggagucacuggaggcaauacguaugcugucccggcucugccaccaggugccguuggcgaugggccgccaaggguggauuucccccggagccgacucagauucaaggaaaaacugggggaaggacaguucggagagguccaccugugugagguagauucaccccaagaucuaguaucucuugacuuuccucucaacguucgcaaggggcacccacugcuuguugcugucaaaauuuugagaccugacgccaccaagaaugccagaaacgauuuccuaaaagaggucaaaaucaugucccgacuuaaggaucccaacaucaucagguugcugggagugugugugcaggacgacccgcuuuguaugaucacagacuacauggaaaauggggaccugaaucaguuucucuccgcacaccagcuggaggauaaggcugcagagggggccccgggugacgggcaagcugcucagggcccaacaauuagcuaccccaugcuguugcacguggccgcacagauugccagugguaugcgguaccuggcaacccuaaauuuuguacacagggaucucgcgacacguaacugccuggugggggagaauuuuaccaucaaaauugcggacuucggcaugucucgcaaucucuaugcaggugauuacuauagagugcaaggccgggccgugcucccaauucguuggauggcgugggaguguauucucaugggaaaauuuacaaccgcuagcgacgucugggcuuucggcgugacacuuugggaggugcugauguugugucgggcacaacccuucggccagcuaacagaugaacagguaauugagaacgccggugaguuuuuuagggaucaaggccggcagguguaccugucccgaccuccagcuuguccucagggccuuuacgaguuaaugcucaggugcuggucaagggaaucagagcagcgcccccccuuuucacaauugcacagauuucucgccgaggaugcacugaacacuguuuag

SEQ ID NO: 12742 - RNA, 2742 nt, Artificial Sequence
  Description of Artificial Sequence: Synthetic coding sequence
augggcccagaagcacugucaucccugcuucuuuugcuccucguggcuagcggugaugcagacaugaaggggcacuucgacccugcuaagugucgguaugcuuuaggcaugcaagaccgaacaauucccgauucagauauuucugcuucaagcagcuggagcgacagcacagcagccagacauucucgucuugaauccagcgacggugauggcgcauggugcccagcgggaucaguguuuccuaaggaagaagaguaucuccaggucgaccuacaacgucuucaccugguugcccuuguggguacccaggguagacacgcaggaggcuugggcaaggaauuuucacggagcuaucgccugcguuacagccgggaugggcgacguuggaugggcuggaaggaucgcugggggcaagaggugauuagcggcaaugaggaccccgaagggguaguacucaaagaucugggcccgccaaugguugcaaggcucguccgauuuuauccccgagccgacagagugaugucaguuugucugcggguugagcuguauggcugucuguggcgagauggacuguugagcuauacagcuccagugggccaaacaauguacuuaucugaggccguguaccugaaugauagcaccuaugacgggcacacggugggcgggcugcaauacggaggccuaggacagcuugcugauggagucguggggcuggaugacuucagaaagucacaggaacuucggguguggccgggauaugacuacguuggcuggaguaaucauuccuuuagcagcgguuacguggaaauggaauuugaauucgauagacucagggccuuucaggcaaugcaaguacauuguaauaacaugcauacucugggugccagacuacccgggggagucgaaugucgcuucaggagagggcccgccauggccugggagggugagccuaugagacauaaccugggaggcaaucucggugauccccgagcccgcgcagugucaguuccccuuggcggacggguagcacgguuccuccagugucgcuuccuuuuugccggccccuggcugcuauucucagaaauuucguucauauccgacgucguuaacaauaguucuccugcauugggggguacauucccaccagcuccaugguggccaccugguccaccaccgaccaauuuuucuagucuggagcucgagccgagaggccaacagccaguggccaaagcagagggcucuccgaccgccaucuuaaucgggugccucgucgcaauuauucugcuucugcuucucaucaucgcgcugaugcuguggcgacuucauuggagaaggcuauuaaguaaggccgagcgccgggugcuggaagaggagcugacaguccaucugagcguacccggcgacaccauccuuaucaacaacagacccggaccccgcgagccuccaccauaccaggaacccagaccucgcggcaauccaccccacucggcacccugcgucccaaacggaucggcucugcugcugaguaaccccgccuaccggcugcugcuggccaccuaugcacgcccgcccagaggccccgguccaccuacaccagccugggcuaagccuacuaacacucaagccuacaguggugacuacauggagcccgagaagccuggcgccccccuacucccuccuccgccccagaacucuguaccacacuacgcagaggccgauaucguaacacugcagggcgugacgggaggcaauacauacgccguuccagcucucccuccaggagcuguuggugauggcccacccagaguagacuuccccagaucaaggcugagguuuaaagagaaacuuggcgaggggcaguuuggugagguucaucuuugugagguagacucaccccaggacuugguaucucuggauuuuccgcucaacgucagaaaagggcauccacuacuggucgccgugaaaaucuuaagaccugaugcuaccaaaaacgcucgaaacgacuuucugaaagaagugaagaucaugucacggcuaaaagacccaaacauaauccgccuguuaggugucuguguacaggaugauccacugugcaugauuacagauuauauggagaauggagaccugaaccaguucuugucugcccaucagcuggaagacaaggccgccgagggcgccccuggcgacgggcaagcugcgcaaggaccaacgauuagcuacccuaugcugcuacacguggccgcucagauagcaucuggaaugagguaucuagcaacacugaacuuugugcaccgcgaucuggcuacuagaaacugucugguaggggaaaacuucaccauuaaaauugccgauuuuggaaugucaagaaauuuguacgccggcgauuauuaucgaguacaagggcgagccgugcugccaauuagauggauggccugggaauguauccugaugggcaaguucaccacugcaagcgacgucugggccuucggagugacucuuugggaagugcugaugcugugucgcgcccagcccuucggccagcucacggaugagcaggucauugagaaugcgggagaauuuuuccgcgaccaggguaggcagguguacuuaucacgcccgccugcgugcccccaggggcuguacgagcugaugcugcgguguuggaguagggaguccgaacagagaccacccuucucucaacuccaucgcuuucucgcugaagaugcuuugaauacuguuuag

SEQ ID NO: 12743 - RNA, 444 nt, Artificial Sequence
  Description of Artificial Sequence: Synthetic coding sequence
augggcccugaagcacugaguucgcugcuucuacuccuacuugucgcuucuggagacgcggauaugaagggccacuuugauccagccaaaugucguuacgcucuaggcaugcaagauagaaccauuccugacucagacauuuccgccuccucgucuuggucugauuccacggcagcucggcacucccgcuuagaguccagcgauggggauggagcuugguguccggccggcucuguguucccuaaagaagaagaguacuugcaaguggaccuacagcggcuucaccugguggcacucguugguacgcaagggcgccacgcaggagguuuggggaaggaguuuucucgaagcuaucgacuucgauauagucgugauggucggcgauggauggguuggaaagaccgauggggacaggaggugauuaguggaaacgaagacccguag

SEQ ID NO: 12744 - RNA, 2631 nt, Artificial Sequence
  Description of Artificial Sequence: Synthetic coding sequence
augggucccgaggccuugagcucccugcuccuacuguuguugguugcuaguggagacgccgauaugaaaggacacuuugaucccgcgaagugccgcuaugcucugggaaugcaggauaggacaauuccggacagugauauuagcgccucauccagcuggucagacaguaccgccgcccggcauuccagacuugaaagcuccgauggagacggugccuggugucccgccggaucuguuuuccccaaggaggaggaauaccuccagguggaccugcagcgacuucaccucguggcccugguaggcacacaggguaggcacgcagggggguuagggaaagaauuuuccagauccuauaggcuccgcuauucaagggauggacggcguuggaugggguggaaagaucgcuggggccaggaaguaauaagugguaacgaagacccggaaggcguuguccugaaagaccugggcccccccauggucgcgcgccuggugcgcuucuauccacgcgccgauagggugaugagcguuugccucagaguagagcuguacggcugccucuggcgcgauggacugcuguccuauaccgcacccgugggccagacuauguacuuguccgaggcaguguaucucaacgauaguacuuacgacggucacacgguaggaggucugcaguacggaggauugggacaguuggccgauggcguggugggucuggaugauuuuagaaaaucucaagaacugcggguuuggccuggguacgauuaugugggcugguccaaccauagcuucucuaguggguacguggaaauggaguuugaguuugacagacucagagcauuucaggcuaugcagguacauuguaauaauaugcauacacuaggggcccgguuaccuggaggcguagagugcagguuuagaagaggaccagcuauggccugggaaggcgaaccaaugaggcauaaucuggggggaaaccuuggugacccacgggcaagagcugucagugugccacuaggcggacgcguggcaagauucuuacaguguagguuucucuucgccggaccauggcuucuauucucggagaucagcuucauaucugaugugguuaacaauucuagcccggcccuagguggcaccuucccaccggcccccugguggccccccggaccaccucccaccaacuucagcucucuggaacuagaaccccguggccagcagccuguggcaaaagccgagggcagcccaaccgccauccugaucggaugccugguggcaauuauccuucuacuccucuuaaucaucgcacuuaugcucuggcgucugcacuggcggcgccugcugagcaaggcugaacgucgaguacucgaggaggagcugaccguccauuugucugugccuggagauacgauacucauuaauaauagacccggcccucgugagccacccccuuaucaggagccaaggccucgagggaauccaccccauuccgccccuuguguccccaauggcucugccuauucuggagauuauauggagccggagaagccgggagcaccacuguugccgccacccccucaaaauucugugccccacuacgcagaggcagauaucgucacucuucaaggagugacaggaggcaacacauaugcagucccagcucuuccccccggagcagugggagauggcccuccuaggguagauuuuccgcgaucccggcuaagguucaaagagaaguugggugagggacaguuuggugaaguacaucuaugcgagguggauucuccucaggauuuagugucccuggauuuuccucugaauguuaggaagggccacccgcugcucgucgcggucaagauucuacgcccggacgccacgaagaacgccaggaacgacuuccucaaagaagugaagaucaugucucgauugaaggacccaaauaucauccggcuccugggggugugcguucaggacgacccguuaugcaugauaaccgacuacauggaaaacggcgauuuaaaucaauuucugucagcccaccagcuggaggacaaggcagcagaaggcgcuccaggggauggucaggcagcccagggucccacuauuaguuacccaauguugcugcauguggcugcacagauugccagcgguaugagauaucuugcaacucuuaauuuugugcaccgggauuuagccacacgcaacugccuuguuggagagaauuucacaaucaaaauugccgauuuuggcaugucgcggaaucuguaugcgggugacuauuaucgcguacaagguagggcuguucucccgaucagguggauggcuugggagugcauuuuaauggguaaguucacgacagcuagcgaugugugggcauuuggggucacucucugggaagugcuuaugcugugucgcgcccagcccuucggccagcugacugaugaacagguuaucgaaaacgccggggaauucuuucgugaucagggaagacaggucuaccucucccggccgccugccuguccccagggccucuaugaguugaugcugcgcuguuggagucgugaaagcgagcagcguccucccuuuucccagcuacaccguuuucucgcugaagacgcucuuaacaccguguag

SEQ ID NO: 12745 - RNA, 2631 nt, Artificial Sequence
  Description of Artificial Sequence: Synthetic coding sequence
augggaccugaagcccucucaagucugcugcucuugcugcucguggcuuccggcgacgcagacaugaaaggccauuuugauccagcuaaguguagguaugcgcuuggcaugcaggaucgcacaaucccagauucagacaucucugcuagcuccagcuggucugacagcacugcugcgcggcacucuaggcuggaaucuucugauggcgacggcgccuggugcccugccggaagcgucuuuccuaaggaagaagaguaucuucaggucgaccuucagagacuucaccuuguggcccucguggguacucaagggcggcaugcggggggacuagggaaagaauuuucacgcuccuaucgacugcgcuacagcagagacggcagaagguggaugggcuggaaggauagaugggggcaagaagugaucucgggcaacgaagaucccgagggugugguucugaaagaccugggcccaccaaugguggcccggcucgugagauuuuacccuagagccgaucguguaaugucuguaugccuuaggguggagcucuacggaugucuauggcgggauggccugcucagcuauacugcccccgugggucagacgauguaccugucagaggccguguacuugaaugacagcacguacgauggacacaccgugggggggcuucaauauggaggucugggucaguuagcugauggugugguggggcucgaugauuuuaggaaaucucaagaacugcgaguauggccgggcuacgacuacgucggguggucuaaucacucuuucaguucuggcuacguggaaauggaguuugaauuugauaggcuccgugcuuuucaggccaugcaggugcacuguaauaacaugcacacacucggagcacgccugcccgggggcguggaguguagguuucgccgagguccggcaauggccugggagggggaacccaugcgccauaaccucggcggaaaucuuggcgaccccagagcacgcgccguuagugugccucucggcgguagggucgcacgguuccuacagugcagauuucuauucgcaggucccugguugcucuucucagaaaucucuuucauuucugacguggugaacaauucaucacccgcauuaggggggaccuucccaccugcacccugguggccccccggaccccccccuaccaauuucucgucccuagagcucgagccaagaggacagcaacccgucgccaaagccgaaggcagccccacagcaauccucauuggauguuuaguagcuaucauuuuacuccuccuguugaucauagcccuuaugcuuuggagauuacacuggcgccgcuuacuuagcaaggcggaacggcgcgugcucgaggaagaacucacugugcaucugagcgugccaggcgacacgauuuugauuaauaaucggccaggccccagggagcccccuccguaccaggagccccguccaagggggaaccccccccauucugcccccuguguuccuaaugguagcgccuacuccggugacuauauggaacccgagaagccaggggccccgcuccucccccccccaccacaaaacucaguuccacauuacgcagaagccgacauugucacccuacagggcgugacuggggggaauaccuacgcaguacccgcuuugccucccggggcggugggggauggaccaccgagagucgacuuuccccggagccgcuugcgcuucaaagaaaaauugggggaggggcaguucggcgaagugcaccugugcgaagucgauaguccccaggaccuagucucacuggacuuccccuugaacguacguaaagggcacccccuacuuguagcugucaaaaucuugcgaccagacgcgacuaagaaugccaggaacgacuuccuuaaggaggugaaaauaaugagccgauugaaagacccgaacauuauccggcugcuaggcguuuguguccaggaugacccguugugcaugauuacugacuauauggaaaacggagacuuaaaucaguuccugagugcgcaucaauuagaggacaaggcagccgagggagcaccaggcgacggacaagccgcucagggaccuaccaucaguuacccuaugcuguuacacguggccgcucagauugccagcgguaugcgcuaucuggccacuuuaaacuucgugcacagagacuuggcaacaaggaauugucuugucggcgagaauuucaccaucaagaucgccgauuuuggcaugagucgcaaccuauacgcaggcgacuauuauagaguacagggccgugccguauuaccuauccgcuggauggcuugggaaugcauucuaaugggaaaauucacgaccgcuagcgaugugugggcauucgggguuacguugugggagguguuaaugcuuugccgagcacagccguuuggccaguuaaccgacgagcaaguaauagagaacgcuggggaguucuuccgcgaucagggccgccaagucuaccucaguaggccaccagcaugcccucaggggcuguacgaguugaugcugagauguuggaguagagaaucggaacagcguccuccauuuagucaguuacaucgauuucuggcagaagacgcacucaacaccguguag

SEQ ID NO: 12746 - RNA, 2631 nt, Artificial Sequence
  Description of Artificial Sequence: Synthetic coding sequence
augggaccagaggcgcugucaagucugcuccuccuccuacuuguugccucuggugacgccgauaugaagggccacuucgauccugcaaagugccguuaugcgcucggaaugcaggauaggacuauuccagauuccgauauuucugcauccuccucguggucagauagcacagcagcccgucacucucgacuggagucuagcgauggcgacggugccugguguccggcugguaguguguuccccaaggaggaggaauauuuacagguggaccuucaaagacugcaccugguggcucucguaggcacccaggggcggcaugcagguggccugggcaaggaguuuucuagguccuauagacuuagguauucccgggauggaaggagauggauggguuggaaggauagauggggccaggagguuauuucugguaacgaagauccggagggggugguccucaaagaccucggaccaccuaugguggcgagguugguacgauucuaccccagagcagacagggugaugagugucugucugcggguugaacuauauggcugucuguggagagacggauugcucaguuauacagcuccugucggccagacaauguaucugucugaagcagucuaccugaacgauucaaccuacgauggccacaccguggguggucuccaauauggcggacugggacaacucgcugauggugugguuggguuggaugacuuuaggaagucccaggagcuccgcguguggcccggcuacgacuaugucggaugguccaaccauucuuuuagcuccggguacguugagauggaauucgaauuugaucgguuacgagccuuucaggcuaugcaaguccacuguaacaacaugcacacccucggagcaaggcugccuggaggagucgaaugccgauuuagacgcgggccagcuauggcuugggagggcgagccaaugcgccauaaccugggaggcaaucugggcgacccgagggcccgugcugugucuguuccucucgggggcaggguggcuagguuccugcagugucgauuucuguucgccggcccuuggcuguuguuuucugagauuucauucauuuccgacguggucaacaacagcagucccgcuuuaggcggcacuuucccuccagcaccaugguggcccccuggcccuccgccuacaaacuucagcagucucgaacuugaaccacguggacaacagcccguugcgaaagcagagggcagccccaccgcaaucuuaauaggcugccuggucgccaucauucugcuucucuugcucauuauugcccugaugcucuggaggcugcacuggcgccgccugcucuccaaggccgagagacgggugcucgaagaagaauuaacuguacacuuaucaguccccggcgauacaauccucauuaauaaucguccagguccucgcgaacccccccccuaucaggaaccuagaccccgugggaacccuccccacucugcccccuguguucccaacgguagugccuacucuggggauuacauggaaccugagaagccaggagccccccuucucccgcccccuccucagaacaguguaccacauuacgcagaggcugauaucgucacccugcagggagugaccggagggaauaccuaugcugugccugcacuccccccaggggcugugggcgacggcccaccuagaguggacuucccucgaucacguuuacgguucaaggaaaaacugggcgagggucaguucggcgagguccacuugugcgaagucgauagcccccaggaucuggugucucucgacuuuccucucaacguucggaagggacauccacucuuaguggcagugaagauuuugcgccccgacgccacaaaaaaugccaggaacgauuuccucaaagaagugaaaauaauguccaggcuaaaagacccuaauauuauccgccuacucggcguguguguccaggaugauccacuuuguaugauuaccgauuacauggagaacggggacuugaaccaguuucucucugcccaucagcuggaggacaaggcugccgagggagcucccggugacggccaagccgcgcaggggccuacaauaaguuacccuaugcuguugcacguagccgcccagauugcgagcgggaugagauaucuagcuacuuugaauuucgugcaccgagaucucgcuacacgaaauugccuggugggagaaaacuucacuauaaaaauugccgacuuuggcaugaguagaaaccuguaugcaggagacuacuacagggugcagggaagggccguccugccuaucagauggauggcaugggaauguauccuuauggguaaguucacgaccgcauccgauguuugggccuucggcgucacacugugggaagugcuuaugcugugcagggcccaaccauuuggccaacucacagacgaacaggugauugagaacgcuggggaguucuuuagagaucaaggacgccaaguguaucuguccagaccccccgcuuguccccaagggcuguacgaacuaauguugagguguugguccagggaaagcgagcaacgucccccauucucccagcugcauagguuucuagcagaggacgcccuuaauacaguauag

SEQ ID NO: 12747 - RNA, 2742 nt, Artificial Sequence
  Description of Artificial Sequence: Synthetic coding sequence
auggggccagaagcccuguccucucugcuguuacuguugcugguugcuagcggugaugccgauaugaaagggcacuucgauccggcaaaaugucgguaugcccuuggcaugcaagaucggacaaucccugauucagacauuucugcuagcucuucuugguccgauucuacggcagccaggcauagucguuuggagucgucugauggcgacggugcuuggugucccgcugguucuguguucccuaaggaagaagaguaccuacaagucgaucuccagcgccuccaccugguggcccugguugguacgcagggucggcaugcgggaggccucggcaaggaguucaguaggagcuacaggcugcgguauagucgagauggacgccgguggaugggcuggaaggacagauggggccaggaaguuaucucaggcaaugaggaucccgaggguguagugcuuaaggaccuggggccuccaauggucgccagacucgugcgcuuuuauccaagagcagaucguguuaugucugugugccuaagggucgagcuauacggaugccuguggcgggacggccuguugaguuacacugcgccugugggacagacuauguaccugucugaggcuguguauuugaaugauagcaccuacgacggucauacuguugggggacuccaguaugggggccuagggcagcuggcggacggugucgucggguuagaugacuuucguaagucucaagaauuaagggucuggccuggcuacgauuacgugggguggagcaaccauucuuucagcuccggcuaugucgagauggaguuugaguucgaccggcuuagagccuuccaggccaugcagguucacugcaauaauaugcauacucucggcgcaagacuccccggaggggucgagugccgguuucgcaggggccccgccauggcaugggaaggcgaaccgaugagacacaaccugggcggcaaccugggugacccgagagcuagggcugugucugucccacucggcggccggguugcucgguuccuucagugccgauuucuguuugcaggcccauggcugcucuucucugagauuucauuuauauccgaugucgugaauaauucuuccccugcucucgguggaacauucccccccgcuccaugguggccaccaggcccuccuccuaccaauuucagcaguuuagaacuagaaccaaggggccagcagcccguggcaaaagccgagggaucccccacagcuauacucauuggaugucugguggcuauuauccugcuucuacuccugauuauagcucucaugcucuggcgacuccacuggagaagauuacugucgaaggccgagaggagaguacuggaggaagagcucacagugcaccugaguguucccggagacaccauucugaucaauaauagaccaggcccaagggaacccccccccuaccaagagcccagaccuagagggaauccaccccauucugcaccuugcgucccaaacggcucagcucuccugcugucaaaccccgccuacagacugcuccuggcuacguaugcgagacccccaaggggaccagguccccccacacccgcuugggcuaaaccaaccaacacacaggccuacaguggugacuacauggaacccgaaaaaccuggcgcuccccucuuaccaccuccaccucagaacucaguuccccacuacgcagaggcagauauugucaccuuacagggagucacugggggaaacaccuaugcugugccagcccucccuccaggugccguaggcgaugggccuccaagagucgauuucccgagaucuagacugcgauucaaggagaaacuuggggagggccaguucggggaaguccaucugugcgaagucgacuccccucaggaccuggugucccuggacuuuccacugaauguccgaaagggccacccccucuuaguagccgugaagauccuuagaccagaugccacuaaaaacgcacggaaugacuuucugaaggaagucaaaauuaugucccgguuaaaagaccccaacauuauccggcuucuuggaguauguguucaggaugauccccuuuguaugaucaccgacuauauggaaaacggggacuuaaaucaguuccugucagcacaucaacucgaagacaaggccgcugagggugcaccuggagacggccaggcagcccaggggccuacuauuagcuacccuaugcucuuacacgucgcagcccagaucgcaucugggaugagguaccucgcuacccugaauuucguucaucgcgaccuugccacucgcaauugucucgucggugaaaauuuuacaauuaagaucgccgacuuuggcaugucccgaaaucuguacgcaggagacuacuauagagugcaggguagagcuguucugcccauccgguggauggcuugggaguguauacucaugggaaaauuuacuacugcuagcgacgugugggccuucggugucacccugugggagguccugaugcuaugccgugcacagccauucggacaacucacugaugagcagguuauugaaaaugccggugaguuuuuucgcgaucaggggcgucagguuuaccucucccgcccuccagccuguccccaaggacuguacgaauugaugcugcgcugcuggucacgcgagagcgaacagagaccacccuuuucacaguugcaucgcuuccuggcugaggacgcccugaacacaguguag

SEQ ID NO: 12748 - RNA, 2742 nt, Artificial Sequence
  Description of Artificial Sequence: Synthetic coding sequence
augggacccgaggcccucucuucacuucugcuucugcugcuaguggccucgggagaugccgacaugaaagggcacuuugacccugcaaagugcagguacgcacuuggaaugcaggaucggacaauccccgacagugauaucucugccuccucaucuuggucugauagcacugccgcccgccacucacggcuagaaagcucagacggagacggggcuuggugcccggcaggaaguguguuuccuaaggaggaagaguaucuccagguggaccuucaacgcuuacaccucguggcccugguggggacccaaggaagacaugccggcggccuggggaaggaguucucuagauccuauaggcugagguacaguagagacggacguagauggaugggguggaaggacagguggggucaggaggugauauccgguaacgaagacccagaaggugugguccugaaagauuuaggcccaccuaugguggcaaggcuggucagauuuuauccgcgggccgaucgaguaaugucuguguguuugagagucgaguuguacgggugucuauggcgggauggacuuuuaucguauacggcgccggugggucagacuauguacuuguccgaagccguguauuugaacgacuccaccuacgacgggcauaccguagggggcuuacaguacgguggacugggacaacuggccgauggagucguaggccuagaugauuuucgcaaaucacaagaauuaaggguguggccaggcuacgauuacgugggguggucuaaucacucuuuuuccucuggguauguggagauggaguucgaguucgaucggcugcgggccuuccaggcuaugcagguucacugcaauaacaugcacacccucggugcaagacugcccggcggcgucgagugucguuucagaagagggccugcuauggcuugggagggugaaccuaugcgccauaaucuuggaggcaaccucggggauccccgcgcccgagcuguuucagugccccuggguggucggguugcuagauuccuacagugucgguuucucuuugccgggccguggcugcuuuuuucagagauuaguuuuauaucggacguggugaacaauucaucaccugcacucgggggcaccuucccuccugccccgugguggcccccgggacccccucccaccaauuuuagcaguuuggagcuggagccaagggggcagcaaccgguggcuaaagcugagggcucucccacggccaucuuaauuggcuguuuaguggccauaauccuucuucucuuauugaucauugcccugaugcuguggcgacugcacuggcggcgacugcucucuaaagcagaacguagaguuuuagaagaagagcucacugugcaccucucagucccgggagauaccauacucauaaauaauagaccugguccucgcgaaccgccuccuuaccaggagccaagaccgcgagggaacccaccacauagugccccuugcgugccuaacggcagugcucuccugcuguccaaccccgcguacagacugcuccucgcaacauaugccagaccaccacgggggcccggcccgccaacuccagcaugggccaagcccacaaacacgcaggcuuacucuggagauuauauggagccagagaagccaggagcaccacuacucccgcccccuccccaaaauucugucccgcacuaugcagaggccgacaucguuacccuccaaggugugacugguggaaauaccuaugccguacccgccuuaccucccggugccguaggugaugggcccccaagagucgauuucccgcggucaaggcugagauucaaggagaaacugggagagggucaguucggggagguucaccugugcgagguggacaguccucaggaccuugugucucuggacuucccucucaacguaagaaaaggucacccccucuuaguggccgugaagauucugagaccggacgcgacuaagaacgccagaaacgauuuucucaaagagguuaagaucaugucccgacugaaagauccaaacaucauacgccugcuuggagugugcgugcaagacgauccacuguguaugauuacagacuauauggaaaauggcgaccuaaaccaguuucuuuccgcccaucaguuagaggacaaagcagccgaaggugcaccaggcgauggccaggcagcccaggggccuacaauuucuuacccaauguugcuccacguugccgcacagauugcuaguggaaugcgguaccuugccacacuuaacuucguccaccgggaccuggcaacgaggaacugucuggugggagagaacuuuacaauaaagauagccgauuucggaauguccaggaaccucuacgcaggugacuacuacaggguccagggcagggcagugcuuccaauccguuggauggcaugggaguguauauugauggggaaauucaccacugcaagcgaugucugggcuuuuggagucacacucugggaaguucugaugcuuugucgugcgcaaccauuuggccagcugacagacgaacagguaauugagaaugcuggggaguuuuuuagagaccaagggcgucaggucuaccucucucguccuccagccuguccucaggguuuguaugagcugaugcugagaugcuggucacgggagagugagcagaggccuccuuuuucacagcugcacagguuccuagccgaggaugcacuuaauacuguuuag

SEQ ID NO: 12749 - RNA, 309 nt, Artificial Sequence
  Description of Artificial Sequence: Synthetic coding sequence
augucgguaaugaaaccgugucucaugaccauagcaauucuuaugauccuagcacagaagaccccgggcggccuuuuuagaagucauaacgggaaaucuagagaaccguggaacccuugugaacuguaccaggggaugugucgcaaugcaugccgcgaguaugagauucaguacuugaccuguccuaaugaucagaaguguugucuaaaacuuagcgucaaaaucacauccaguaagaaugucaaagaagacuaugacucaaauaguaaccuuagcgugaccaacuccucuaguuacagccauaucuag

SEQ ID NO: 12750 - RNA, 267 nt, Artificial Sequence
  Description of Artificial Sequence: Synthetic coding sequence
augcucccugaccauuuuagcccucuuagcggggauauuaaacuguccguuuuagccuuagugguauuggugguacuugcucagacugcgccagacggguggauaagacggugcuacuauggaaccgguagaugcagaaagucaugcaaggaaauagaacgaaaaaaagagaaaugcggcgaaaagcauauauguugcgugcccaaggagaaggauaagcucucacacauccacgaucaaaaagaaaccuccgagcuguacauauag

SEQ ID NO: 12751 - RNA, 1401 nt, Artificial Sequence
  Description of Artificial Sequence: Synthetic coding sequence
augaagcccccacugcucgucuucaucgugugccugcucugguuaaaggacucucauugcgcacccacauggaaagacaagacagcgauuucagagaaccuuaaaucuuucucagagguaggagagauagacgccgaugaggagguaaagaaggccuuaaccgggaucaagcagaugaaaauuaugauggagaggaaagaaaaagaacacacuaaccuaaugucaacacuuaagaagugucgcgaggagaagcaggaagcccuaaaguuguugaaugaagugcaggagcaccuugaggaagaggaaagacugugccgagaaagccuggccgauaguuggggcgagugucgcucaugccucgaaaacaauugcaugcgcauuuacaccacgugucagccaagcuggucuagcgugaagaauaaaaucgagagguucuuucggaaaauuuaccaauuucuguucccuuuccacgaagacaacgagaaggaccugccuauuucggaaaagcucaucgaagaggaugcucaacuuacucaaauggaagauguuuuuucccaguugacaguggacgugaacagccuuuuuaacagaucguuuaacguuuuuagacaaaugcagcaggaguucgaucagaccuuccagucccacuuuaucucagacacggaucucacagaaccauacuucuucccagcuuucuccaaagagccaaugaccaaggccgaccuggagcaguguugggauauccccaauuucuuucagcucuucugcaauuucuccgugaguauauaugaguccguguccgaaacaaucaccaaaauguugaaggcuaucgaggauuuacccaaacaagauaaggccccugaucauggggggcugauuucgaagaugcuuccuggccaggacaggggucugugcggcgaacuggaccaaaacuugagccgguguuucaaauuccaugaaaagugucaaaagugccaggcccaccuaucggaggauugcccagacgugccugcucugcauacggaacuggaugaagcuauuagacuugugaacgucagcaaccaacaauacggacagauacugcagaugaccagaaagcauuuagaggacaccgccuaccucguugaaaagaugcguggccaguucgguuggguaagugaacucgccaaccaggcacccgagacugagaucauuuucaacucuauucagguggucccgagaauccaugaagggaauauuucuaaacaagacgagacaaugaugaccgaccugucuauuuugccgucgucuaauuucacccucaaaauucccuuagaggagagugccgagagcuccaacuucauuggcuauguugucgcaaaggcguugcagcacuucaaggagcauuuuaaaacaugguag

SEQ ID NO: 12752 - RNA, 207 nt, Artificial Sequence
  Description of Artificial Sequence: Synthetic coding sequence
augaaacugugugugacuguuuugucccugcuaguacuuguggcugccuuuuguucacuugcccugucugcacccaccaaauccagcgaguggaaauugcaagguguguguuuccaguguugcagugggaaggauccuauccaucaaagcuguccgaccuggacaaugguucgccagagaaagaugcccaccaccggaaaggguuag

SEQ ID NO: 12753 - RNA, 420 nt, Artificial Sequence
  Description of Artificial Sequence: Synthetic coding sequence
auguacaaacuggcaucauguuguuuguuguuuauuggguuucucaacccccuccugucccugccccugcuggauagucgcgaaaucucuuuucaauuaucugccccacacgaggaugcccgccuuaccccugaggaauuagagagggccucacuguugcaaauucugccggaaaugcugggggccgagcggggagauauccuucggaaggccgauucaucaacuaacauauucaaucccagagguaacuugcguaaguuccaggacuucuccggacaggaccccaacauuuuguuaucucaccugcuggcuagaauuuggaaacccuacaaaaagcagcggcguaaacuucggcaagaccuuagauuauggaaaaaggagcccggccuuagaaucuucaagaacuauguauauaucuag

SEQ ID NO: 12754 - RNA, 1974 nt, Artificial Sequence
  Description of Artificial Sequence: Synthetic coding sequence
augaggacagucguucucacuaugaaagcgucugugauagagauguuccugguacuuuuagucaccggaguucauucgaauaaggagacagcuaaaaaaaucaaacgaccuaaguucaccgugccacaaaucaacugcgacgucaaggccggaaagauuauagaucccgaauucaucguuaaauguccagcagggugucaggauccaaaguaccauguguauggaacugauguuuacgcauccuacuccucugucuguggugccgccguucacuccggcgugcucgauaauaguggggguaagauauuagucagaaagguggcaggucagucaggcuacaaagggucuuauaguaacggcgugcagucucuaagcuuaccacgguggagggagucuuucaucguccuggaaagcaaacccaaaaaaggggugaccuacccuagugcgcuuacguacucuagcaguaaaagccccgcagcccaggcgggcgagacaacaaaagccuaccaaagacccccaauuccagguaccacugcucagccagucacacuaaugcaacuacuugcggugaccgucgcagucgcuacgccaacgacccuuccccgcccuagcccauccgcugcuucgacgaccucuaucccuagaccucaauccguggggcaccggucucaggaaauggaccuguggagcacugcaaccuauacguccucgcagaaucgcccacgagcagauccaggaauucagcgacaggauccgucaggagccgcuuuccagaaaccagugggcgcugacguguccuuggacuguaaaauugacuuaucauucuugaucgacggcucaacuaguauagggaagcggcgguuucgaauccagaagcagcugcucgcagacguagcacaggcccuggacauuggcccggccgguccucuuaugggcguuguacaguacggagacaauccagccacacacuuuaaucuuaagacgcacacaaauucucgugaucuuaagaccgccauagagaaaauaacucaaagagguggccucagcaacguuggaagggccauaagcuuugucacuaagaauuuuuuuucgaaagcgaauggaaaccguuccggagccccgaauguaguuguagugaugguugacggauggcccacagacaaaguugaagaagcuagccggcuggcaagagaguccgguauuaacaucuuuuuuauuaccauagaaggggcagccgaaaaugagaagcaguaugugguggagcccaacuuugcaaacaaggcagucugccgaacaaacggguuuuacucuuuacauguccaaucaugguuuggccuccacaaaacauuacagccccuggugaaacgggugugugacacggacaggcuggccuguaguaagacaugcuuaaauucugcagacauuggcuuuguuaucgacggcucaucaucagugggaaccggaaauuuccgcaccguccugcaguuugugacaaaucuaaccaaagaguuugagauuucugauaccgauacacgcauuggugccguacaauacacauaugaacaacgucucgaauuugguuuugacaaguacucuucgaaaccugauauacucaaugcaaucaagagagugggcuacuggaguggcgggacuucaacgggagccgcuaucaauuuugcacuugagcagcuguuuaaaaaaucaaagccaaauaaacgcaaacucaugauauugaucaccgacggccgcagcuacgacgaugugaggauucccgcaauggcugcgcauuuaaagggcgucaucacuuacgcuauugggguggccugggcugcgcaagaggagcuugaggugaucgcuacccacccagcccgggaucauagcuucuucguugaugaguucgacaaccuccaccaguacgucccacguauuauccagaauaucuguacagaguucaacagucagcccaggaauuag

SEQ ID NO: 12755 - RNA, 3975 nt, Artificial Sequence
  Description of Artificial Sequence: Synthetic coding sequence
augagacauggcguggccugggccuugcugguggccgccgcucuggggcugggcgccagaggagugcgcggggccguggcacuagcggacuucuauccuuuuggugcugaaagaggcgaugccguuacacccaagcaggaugauggugggucggggcuucgcccccugagugugcccuucccuuucuucggcgccgagcacuccggucuguauguaaacaacaacggcaucaucucauuccucaaggaagugagccaauucacccccguggccuuuccaaucgccaaagaccgcugugugguugcagcuuucugggccgacgucgauaacagaagggcaggcgacguguauuaccgcgaggcaacagauccugcaaugcuucgcagagccaccgaggacgugcgccacuauuuucccgagcugcuggacuuuaacgccacaugggucuucguagcuacaugguaccgcgugacuuucuuuggcggcagcuccagcaguccuguuaauacguuccagaccgugcuuauuacugacgguaagcugucuuucacgauauucaauuacgagucgauuguguggacuaccggaacacacgcuucaaguggaggaaaugcaaccggccuuggcgggauagcggcccaagccggguuuaacgcuggagauggacaacgauacuucagcauuccuggcucaagaacagccgacauggcagaaguggagacaacuaccaacguuggggugccuggacggugggcguuuagaauugaugaugcacaggugcgggucggaggcugcggccacacuaccuccgugugccuggccuugagacccugucuuaacggugggaagugcauugaugauugcgugaccggaaauccaaguuauacuugcuccugcuugagcggcuucaccggacggcgcugccaccucgacguaaaugagugugcaagucagccaugucagaacggaggcaccugcacacaugguaucaauaguuuccgaugucaaugccccgcaggcuucggcggacccacuugugaaacagcacagagcccaugcgauacuaaggaaugccagcacggaggacagugccagguggagaauggcagcgccgugugcgugugccaagcaggcuacaccggggcugcuugugagauggauguugacgauuguuccccugacccuugucuaaauggcgggucaugcguggaccucguuggcaauuauaccugucuuugcgccgagccauucaaaggccuucgcugugaaaccggagaccaccccgugccagacgccugccucucagcucccugccauaacggaggaaccugcguugaugcagaucaggguuauguuugcgagugccccgaggguuuuaugggucuggauugucgggagagagugcccgaugacugugagugcagaaauggggggcgcugccugggggcaaacacuacauugugucaguguccccuggguuucuuuggccuacucugugaauuugaaauaacggcaaugccuuguaacaugaauacccaguguccagacggcggcuauuguauggaacaugguggaaguuaccuguguguuugucacaccgaucacaacgcaucacauagccugccuaguccuugugauucugauccauguuucaaugggggaucuugugaugcucaugaugauaguuauaccugugagugcccuagaggguuccacgggaagcauugugagaaggcacgcccacauuuauguucaucugggcccugccgcaacggggguaccugcaaggaggcuggcggcgaauaucacugcagcugucccuacagguuuacagggcgccauugugaaaucggcaagccugauucaugcgcuagcggaccuugccauaacgggggcacuugcuuucacuacaucgggaaguacaagugcgacugcccgcccggcuuuagcggcaggcacugugagaucgcuccaaguccaugcuuucgcagcccaugugugaauggaggcaccugcgaagacagggauaccgauuuuuuuugccacugccaagcaggauacaugggucgacggugccaggcagagguggacugcggaccuccugaagaagucaaacaugcaacacugcguuucaacgggacccgacugggagcaguugcccuguacgcuugcgaccguggguacagccuaucggcuccaucuagaauuagggucugucagccccaugguguuuggagcgaaccaccucagugucucgaaaucgacgagugccgcucacagccuugccugcauggcggguccugccaggaccgcgucgcuggauaucugugccuguguuccacuggguacgagggagcccacugugaacuagaacgugaugaaugcagagcccacccuuguagaaacggcgguucuugccggaaccucccuggggcauacgucuguagaugccccgccggguucguuggugugcacugcgaaaccgagguggacgcuugcgacagcuccccuugucagcacggaggucggugugagaguggagguggggcauauuugugcgugugucccgagaguuuuuuuggguaccacugcgagaccguuucugauccuugcuucaguucccccugcggaggaagaggauauugccuugccagcaauggcucucacaguugcacgugcaaaguugguuacacuggugaagacugugcgaaggagcuuuucccaccgacagccuuaaaaauggagaggguggaagagaguggugucagcaucuccuggaauccccccaacggcccugccgccagacagauguuagacgguuacgccgugaccuacgugagcagugacgguagcuacaggcggacggauuuuguagaccggacucguucuucucaucagcugcaggcccucgccgccggucgagcuuauaauaucagugucuuuagcgucaagagaaacucaaacaacaagaaugacauaucccggccagcugugcugcucgccagaacccgaccuagacccguagaaggcuucgaagugaccaaugucaccgcgucaaccauaucaguccaaugggcacuucauaggaucagacacgcaacgguuucagguguuagaguaaguauccggcaucccgaggcccugcgggaccaagccaccgauguggaccgcucggucgaucgguuuacauucagggcgcuucugcccgguaagagguacacaauucagcugacgacucucucaggccugcguggugaggaacacccaacugagagccuggcuaccgcuccuacacacguguggacccgaccauuacccccugccaaucugacugccgcccgagugacagcuacaagcgcccauguagugugggacgcaccaacaccuggaagccugcucgaggcuuacgugaucaaugugaccacaucccaguccaccaagucgcgguaugugccaaaugggaaacuggccucguacacuguccgcgaucuacucccgggccgaagguaccaguuaagcgugaucgcaguucaaagcaccgaauuaggcccucaacacucagagcccgcgcauuuauauauuaucaccucuccaagagauggugcggaccggcgcuggcaccaaggaggacaucaccccagaguccugaaaaaccgcccuccccccgccaggcucccagaacugagacuucuuaaugaucauuccgccccugagacccccacccagcccccacgcuucagcgagcuggucgacggucgcgggcgagucagugcucgcuuuggaggaucuccuagcaaggcugcuaccgugcgcucccagcccacagcuucggcccaauuggagaacauggaggaggccccuaagcgcguaucucuggccuugcagcuuccugaacaugguagcaaggacaucgguucugaauccgcagcccugguaggcacccugggguugaccgacugcucacagggccccuag

SEQ ID NO: 12756 - RNA, 732 nt, Artificial Sequence
  Description of Artificial Sequence: Synthetic coding sequence
augggcaucuuccugguuuacguaggcuuuguguucuucucagugcuguacguacaacagggacuuaguagucaagcuaaauuuacagaguucccccgaaauguaaccgccaccgaaggccagaauguugaaaugucgugugcguuucagagcgggucugccagcguauaucuugagauccaauggugguuuuugagaggcccagaagacuuggauccaggcgcagaaggagcuggcgcacagguggagcugcugccagaccgggacccagauagugacgguacaaagauuucuacagucaaggugcagggaaaugacaucagucauaaauuacaaaucuccaagguuagaaaaaaggaugagggacucuacgagugccgcgugacagaugccaacuauggcgaacugcaggagcauaaggcccaggcuuaccucaaaguuaacgccaacucucacgcgcgaagaaugcaagcuuuugaagccagcccaauguggcugcaagacaugaagccaagaaagaacgucuccgccgccauaccaucuaguauucacgggucugccaaucaacguacacacucaacuaguagcccucaggucgucgccaaaaucccuaagcagucuccccagucuggcauggagacccacuucgaaccuuuuauuuuaccucugaccaaugcuccacagaaaggccaaucuuaucgggucgaucguuuuaugaacggggacuuuuag

SEQ ID NO: 12757 - RNA, 1218 nt, Artificial Sequence
  Description of Artificial Sequence: Synthetic coding sequence
augugguauguuucaacacgaggaguugcaccucgggugaauuuugagggggcuuuauuuagcggcuacgcacccgacggcggccuguucaugccugaagaacuuccacagcuagaucgaggcacacugugccaguggucuacccuuuccuaucccgggcuggugaaagagcucugcgcccucuuuauuggcucugaguugcugccgaaggaugaacucaacgaucugauugaucgggcauucagcagauuucggcacagggaggugguacacuuaucuaggcucagaaauggucugaacguucucgaguuauggcauggugugaccuacgcauuuaaagacuugagccugagcuguacaacacaguuccugcaguacuuuuuagagaagcgcgagaaacaugucacugucguaguagggacaagcggcgacacuggcucagcagcuaucgaguccgugcagggagcgaaaaauauggauaucaucguucugcugccuaaggggcacuguaccaaaauucaggagcugcagaugacaacaguguuaaaacagaauguccacguguuugggguggaggguaacagcgaugaacuggaugagccuaucaagacaguguucgcagacgucgccuuugucaaaaaacacaaccuuaugucccugaacucaauuaauuggucccggguccucgugcagauggcgcaucacuuuuucgcguacuuccaguguacacccucucuggacacucauccacugccgcuagucgagguaguagugccuacaggagccgccggcaaccuggccgccgguuauauagcucaaaaaauaggucucccaauccgacucgugguggcugugaaccguaaugacauuauccauagaaccguucagcaaggggacuucagcuuguccgaagcugugaagagcacccuggcuucugcuauggacauccaggugcccuauaauauggaacgaguguuuuggcucuugagcgguuccgacucucaggugacacgugcuuugauggagcaguuugaaagaacacagucugugaaccucccuaaagaacuccacucuaaaugggaaaggcaagauuaugagaagauggccgugauggagugcgaugguuguugcguggagcuguguuugggcaauuguggcccacggagaggcagcgugacagauauacccgguaccgcaaugguuaggggggggggauag

SEQ ID NO: 12758 - RNA, 573 nt, Artificial Sequence
  Description of Artificial Sequence: Synthetic coding sequence
augcgcacaguuguuuugacaaugaaagcuagcgucaucgagauguuccuggugcuccucguuacaggcgugcacuccaacaaagaaaccgccaagaagauuaaaagaccaaaguucaccguuccucaaaucaacugugauguuaaagccgggaaaauuaucgacccagaguuuaucgugaaaugcccugcgggaugccaggacccaaaguaccacgucuacggcacugauguguaugccucuuauucauccgucugcggcgcugcuguucauucugguguguuagacaauuccggcggaaaaaucuuagugaggaaaguggccggucagucuggguacaaaggcuccuacaguaacggaguccagucucugagucucccacgcuggagagagucuuuuaucguguuggaaaguaagcccaaaaaaggggugaccuaccccucagcccugacuuacucuaguaguaaaagcccugccgcgcaggccgauuuauggagcacagcaaccuacacuaguucccaaaaccgcccuagggcagacccuguccagcgccagccauguuacucucucuag

SEQ ID NO: 12759 - RNA, 399 nt, Artificial Sequence
  Description of Artificial Sequence: Synthetic coding sequence
auggcccccaguccaagaacggguucgcgacaggaugccaccgcauugccuaguaugucauccaccuucugggccuucaugauccucgccuccuuacucauagcauauuguucacaauuagcugccggcaccugcgaaauugugacguuagaccgugauagcucccagccccgcaggacaaucgcacgccagacggccaggugcgccuguaggaagggccagauugcugguacgacccgcgcccgccccgccugcguugaugcucgcaucaucaagacuaaacaguggugcgacaugcugccaugucuagaaggagaaggaugugaucugcuuaucaauagaucagguuggacauguacccagcccggaggaagaaucaaaacaacaaccgugucuuag

SEQ ID NO: 12760 - RNA, 957 nt, Artificial Sequence
  Description of Artificial Sequence: Synthetic coding sequence
auguuaccacugacuaugacgguccugauccugcuguuacugccuacggggcaggccgcccccaaggacggcguaaccagaccggacagcgaaguucagcaucagcuucugccuaacccuuuccagcccggacaggaacagcugggucugcuucagaguuaucucaagggucuuggccggacugagguacaguuggagcaucugagucgggagcagguccuccucuaucuguuugcacugcacgauuacgaucagagcggccagcuggacggccuggaacuauuauccaugcucaccgccgcccucgcacccggugcagccaauuccccaacaacaaaccccguuauauuaauuguggacaaagucuuagaaacucaggauuugaacggagauggucugaugacaccagccgaacugauaaacuuucccgguguagcauugaggcacguugagccgggggagccucuggcccccagcccucaagagccacaagcuguuggccgccagucacugcuggcuaagagcccacuuaggcaggaaacccaggaggcacccggaccacgggaggaagcuaagggacaagucgaagcgagacgggaaagucuugacccugugcaggagcccgguggacaagccgaagcugauggagaugugccgggaccacguggcgaggccgaaggucaggccgaagcuaagggagacgcaccuggcccgagaggggaagcaggugggcaggccgaggccgagggcgaugcucccgggccccggggugaggccggcggccaggccgaagcagagggagacgcaccaggcccccgaggagaagcaggcggacaggccgaggcuagggagaauggagaggaggcuaaggaacugccuggggagacacuggagucaaaaaacacccagaacgacuuugaaguucacaucguucagguggaaaacgacgaaauuuag

SEQ ID NO: 12761 - RNA, 399 nt, Artificial Sequence
  Description of Artificial Sequence: Synthetic coding sequence
augcugccucucaccaugacagugcugauucuccuccuccuccccacgggucaggcagcaccuaaggauggcgucaccaggccagacucugaaguucaacaccaguuauugcccaauccuuuucagccaggacaagaacagcugggacuuuugcaaucuuacuugaaggggcucggccgaacugaaguccaacuagagcaccuuagcagagagcagguucuguuauauuuauuugcccugcacgacuaugaccagagcggucagcuggauggcuuagagcugcuuagcauguugaccgcagcccuugcccccggcgcagccaacagccccacgaccaacccuggaaaucuggaugcacggcucgacggaggcgaaaaagcaaugcagccccagugguag

SEQ ID NO: 12762 - RNA, 732 nt, Artificial Sequence
  Description of Artificial Sequence: Synthetic coding sequence
augcugcucucuuuacugggcgcuugcgcuguagugggccccuuccauggcccagagugggagcccgugcaaggacugcucucccaaaaucacaguugcagggauccucaguguugugggaaccucuuagugcugugccucuuccugguuuggcaagugcggcauuguuggcaucaggucacaagaaccagauucaguacacggaaugucauuaaggugccgcugcaaaagagagccgugccauccaugcgcugcgagacaguguucaagcugaccccagaguucuucucuccagguaagagccgaggccuugacucccaacagugcgcucagaggcagcggugggguuauagacggagccugcaagaaagcugggcccagaaccugcugucuccucaacacccuugcccgggaccuccuuccggaguccacacccauuccgaaccaaucuuuugcaccaccucaauuagcaacacuugucugcuuccucaaaauucuuccuggaaagccuggcaagugccguggugucuccacgauggccagaccagaccagccuuggauaugugccaggaaauggaacaacuccuccuccacucucaggagcgccucguaucguuagaacccgucauuagcguccgcagucgcccuacaucgaugacccugacaacuucccugccaaaucugcugucugcagaaagauuacaauucuguccgcagcgugcacccgcuuag

SEQ ID NO: 12763 - RNA, 2505 nt, Artificial Sequence
  Description of Artificial Sequence: Synthetic coding sequence
augaaacauacacuggcucuguuggcaccacuguugggauuaggucuaggauuggcacuaucucaauuagcugcuggcgcaaccgacuguaaguuccucggcccagccgaacaucucaccuuuacuccugccgcucgagccaggugguuagcgccuagggugagagcacccgggcugcuggauucacuguaugguaccgugcgccgcuuucugucagucguccaguugaauccauuuccaucggagcuagucaaagcacuguugaacgaacucgcaagcguuaaaguaaacgagguggugagguacgaagcuggcuacguggugugcgcuguaaucgccggguuguaccugcuccucguucccaccgcaggguuguguuucuguuguuguagaugccaucgacgcugcggaggacgaguaaagaccgaacauaaggcccuggcuugcgaacgcgccgcucugaugguguuccugcuucuuacaacucuauuacugcucauaggaguggugugcgccuucgugacaaaucagcgaacacaugagcagaugggacccagcauagaggccaugccagagacucugcucucucucugggggcugguauccgaugucccccaggagcugcaggccguugcccagcaguuuucgcucccccaggaacaggucagcgaagaacuugauggcgugggugucucaaucggcucugcuauccacacccaacucaggucaagcgucuauccucugcucgcugcagugggcagucuaggacagguucuccaggugucagugcaucacuuacagacauugaacgcuacagucguggaacuccaggcaggucagcaagaucuggaaccugccauacgagagcaucgugacaggcuccuggaacuccugcaggaggcccgcugccagggagacugugccggagcgcugagcugggcucguacacucgagcugggagcagacuuuucccagguucccaguguagaccaugugcuccaccaguugaaggggguaccugaagcuaauuuuucauccaugguccaggaagagaacuccacuuucaaugcccuuccagcgcuggccgcuaugcagacuagcucaguggugcaggagcucaaaaaagcuguggcucaacagccagagggcguucgcaccuuagcugaaggauuuccuggccucgaagccgcuagcaggugggcccaagccuuacaggagguagaagaguccucacggccuuacuugcaagaaguccagagguacgagacuuaucgguggauuguaggaugugugcuaugcuccguggucuuguuuguggugcugugcaaccugcugggucucaaccucgguaucuggggccugucagcuagagacgaucccucucaucccgaggcaaaaggagaagcuggggcucgcuuucuaauggccggcguaggccuuuccuuucuguuugcugccccccugauccuacugguguuugcaacauucuuagucggugguaacguccagaccuuagugugucagagcugggagaauggcgagcuguucgaguucgcugauacucccggaaaccugccacccucaaugaaucucucucaguugcuuggacuacggaagaacaucaguauacaccaagcuuaucagcaaugcaaagaaggcgcugccuuguggaccguguugcagcugaaugacaguuaugaucuggaggagcaccuagauaucaaccaguacaccaacaaacugcgccaggaguugcagagucugaagguggacacacaaucccuggaucuccugucuagcgccgcccggagggaucuggaagccuugcagucuaguggcuuacagaggauucauuacccugacuuucuggugcaaauucagcggccaguggugaaaacgucuauggagcaacuggcccaggaacuacagggacucgcucaagcccaggauaacucuguguuaggucagcguuugcaggaagaagcucaggggcugagaaaucugcaccaggagaaggucgucccccagcagucuuuaguggcuaaacugaaucugucagugagggccuuggagagcagcgccccaaaccugcagcuugaaacuagcgacguguuggcuaaugucacuuacuuaaaaggagaguuacccgcgugggcagcacgcauccugagaaacguaucugaguguuuccucgcgagggaaaugggguacuuuucacaguaugucgcuuggguacgggaggaggucacucagaggauagcaaccugucaaccucugucaggagcauuagacaacagcagggugauccugugcgauaugauggccgacccauggaacgcguuuugguuuugucucgcauggugcaccuucuuucucauuccauccauuaucuuugcggugaaaaccuccaaguacuuccgcccuauucguaagaggcucagcucaacaaguagugaggagacccagcuguuucacaucccucgaguaacgucgcugaaacucuag

SEQ ID NO: 12764 - RNA, 1185 nt, Artificial Sequence
  Description of Artificial Sequence: Synthetic coding sequence
auguggagaugcccauuaggucugcuguuauugcugccacucgcaggccaccuugcgcugggcgcucagcaaggaagagggagacgugaauuggcaccaggauuacaccugagaggaaucagagacgccggggguagauacugccaggaacaagaucuuugcugccgcggcagagcggacgacugugcucugccguaucuuggagccauuugcuauugugacuuguucuguaacaggacugucuccgauugcugcccuuucccuccuauucaggguuguaugcauggugggcggauuuacccuguguuaggcacauauugggacaauugcaaccggugcaccugccaagaaaauagacaguggcagugugaccaggagccaugucuuguagaucccgauaugauaaaagcuauuaaucaaggcaacuacggauggcaagcgggcaaccacucagcuuuuugggggaugacucuggacgagggcauccguuauaggcugggaacaauccggcccuccuccagcguaaugaauaugcaugaaauuuauacuguccugaaccccggggaaguccugccgaccgcuuucgaagcgucugaaaaauggcccaaucugauacaugagccacucgaucaggggaacugcgcaggcagcugggccuuuucaaccgccgccguggcaagugaccguguguccauucauucucugggucauaugaccccuguguugucuccccaaaaccucuuguccugcgauacacaucagcaacagggaugccgaggcggaagacuugacggcgccuggugguuuuugcggcgucguggcguggugagcgaccacugcuacccuuucagcgggcgagagcgggacgaggcaggccccgcuccucccugcaugaugcacucccgagccaugggaagagguaaaaggcaggccacagcccauugcccuaauucuuauguuaauaacaaugacaucuaccaagugaccccuguauaccgccuggggucuaaugauaaagagauuaugaaagaacuaauggagaacgggccaguucaagcccuuauggaagugcaugaagacuuuuuccuguacaaaggaggaaucuauagccauacacccguguccuugggucggccugagcgauaucgucgacauggcacccauucaguaaaaaucacaggcuag

SEQ ID NO: 12765 - RNA, 303 nt, Artificial Sequence
  Description of Artificial Sequence: Synthetic coding sequence
auggccgcagcgcuggcacuuguggccggaguucugaguggugccguccucccauuguggucugcccugccacaguacaagaaaaaaauaacugaccggugcuuucaucacagcgaauguuacagcggcuguugccuuauggaccuugauucaggcggugcguuuugugccccccgcgccagaauuaccaugaucuguuuaccccagaccaaaggggcuaccaauaucauaugccccugcaggaugggauugaccugcauuuccaaagaucugaugugcucccgucgaugccauaugauuuag

SEQ ID NO: 12766 - RNA, 978 nt, Artificial Sequence
  Description of Artificial Sequence: Synthetic coding sequence
augagacucccaagaagggcugcccucggcuugcucccauuguuauuacugcugccacccgcuccagaagccgccaagaagccuaccccgugucaucguugcagggggcugguggacaaguucaaccaaggcauggucgacaccgcuaagaagaacuuugguggcggcaauaccgccugggaggagaagacacuuagcaaguaugagaguagcgagaucagauugcuggaaauucuggaaggguugugugagaguucugacuuugagugcaaucagaugcuggaggcgcaagaggagcauuuggaggccuggugguuacaguuaaaaucggaauaccccgaccuauucgagugguuuugcguaaagacccugaaagugugcuguagucccggaacauacggaccugauugucuggcaugucagggcggaucucagcggccauguucaggaaauggacacuguucuggcgaugguucucgccagggugaugggucguguagaugucauaugggguaccagggaccuuuauguacugacuguauggacggauacuucuccucucuucgcaaugaaacccacagcauuuguacggccugugacgaaagcuguaagaccuguuccggccuuacaaauagagacugcggggaaugcgaaguuggguggguuuuggacgaaggggcuugcguggaaugcgacucuagcugcguggggugcacuggcgaagguccgggcaauuguaaagaauguauauccggcuaugccagagagcacggccaaugugcggauguggaugagugcagcuuggcagagaaaaccugugugcgaaaaaaugaaaacugcuauaacaccccugguagcuauguaugugugugccccgacggguuugaagagacugaggaugcuugcguacccccagccgaggcugaagcgaccgagggggaaagcccgacacagcugccaagcagagaagaucuguag

SEQ ID NO: 12767 - RNA, 459 nt, Artificial Sequence
  Description of Artificial Sequence: Synthetic coding sequence
augcggggaccaggacacccacuuuuacucggcuuacuguugguccuuggggcugccgguaggggaagagggggagcagaaccucgggaaccagccgacgggcaagcacugcugagacuggugguagaacuuguucaagagcuccgcaaacaccacuccgcugaacauaaggggcugcaacugcuggguagagacugugcacucggucgcgcugaggcugcaggacuggggccaucccccgagcagcgcguggaaaucguuccccgcgaccuccguaugaaggauaaauuucuuaagcaucucaccggaccucuguacuuuucgccuaagugcuccaagcacuuccauagacuuuaucauaauacgagagacuguaccauacccgccuacuauaagcggugcgcaagacuuuugaccaggcuggccgugucgcccguuugcauggaagauaagcaauag

SEQ ID NO: 12768 - RNA, 411 nt, Artificial Sequence
  Description of Artificial Sequence: Synthetic coding sequence
auggccagaacgaagcaaacugcaaggaagaguacggguggaaaggccccucgaaagcagcuagcaaccaaggcugcaagaaagucugcacccgcuacugguggcgugaagaagccccaccgcuacagacccggaacggucgcccugcgagaaauaagacgguaccagaaauccaccgaacuguugaucaggaagcuuccuuuccagcgauuaguacgugaaauugcccaggacuuuaagacugaccucagguuccagagcuccgcugugauggcuuugcaggaagccagugaggcuuaucuggugggauuauucgaggauaccaaucugugugcaauucacgcuaagcguguuacuauaaugcccaaggauauacaacucgcucgacgcauuaggggagagagagccuag

SEQ ID NO: 12769 - RNA, 1209 nt, Artificial Sequence
  Description of Artificial Sequence: Synthetic coding sequence
augcgauugccacggcgggcagcacugggccugcuccccuuguuacuccugcucccaccugcuccagaagcugcaaagaaaccaacucccugucacagaugccggggucucguggacaaauucaaucaaggcaugguggauacugcgaaaaaaaauuucggcggugggaauacugcgugggaggagaaaacccuuaguaaguacgagagcuccgaaauacgccugcuugaaauucuggaggggcuuugugagucuucugauuucgaguguaaccagaugcuugaggcacaggaggagcaucuggaggccuggugguugcagcugaagucagaguacccugaccuauucgagugguuuugugugaaaacuuuaaaaguaugcugcucuccuggaacuuacgguccugacugucuugcaugccagggcggaucgcaaagaccuugcuccgggaacggccauuguagcggggauggaucaagacagggggauggaucuugccggugccacaugggguaccagggcccucucugcaccgauugcauggacgguuauuuuucuucacugcguaacgagacccacagcauaugcacggugcgcacaggacugagcgauuccuauccuccauguugccuaucucugggaugcuggaggggggucggucacgcuuggauccgagggaggaacacccauacucagcccgguuacagcucucgagucuggauagccgcauuuucuccagcuugugacgaaaguuguaaaaccuguaguggguugacgaauagggauugcggugagugugaagugggaugggugcuugacgaaggugccuguguagaugucgaugagugcgcugcagagccacccccgugcucagcugcccaauuuuguaaaaacgccaacggcucauacaccugcgaggaaugugauucguccugcgugggaugcacaggggaagggccuggcaauuguaaggaaugcaucucuggcuaugcccgcgaacacggccaaugugcggacguagaugagugcagucuagcggagaagacgugugucagaaagaaugaaaauuguuacaacacaccugggucauacgugugcgugugcccugaugguuucgaagaaaccgaagacgccugcguaccacccgcagaggcugaagccacagagggggagucucccacccaguugcccucucgagaggauuuguag

SEQ ID NO: 12770 - RNA, 633 nt, Artificial Sequence
  Description of Artificial Sequence: Synthetic coding sequence
augucugccggaaaaaugaugcgcacccucauaacaacccacccgcucccguuacuacuccuaccgcagcaacuucuacaacugguucaauuccaagaagucgauacugacuucgauuuuccagaggaggacaaaaaagaggaguuugaggagugucucgagaaauuuuucaguacaggaccagcccgcccccccacaaaagaaaaggugaagcgcagaguacucauugaacccggaaugccucuuaaucacaucgaauacugcaaccacgaaauuaugggcaaaaacguguacuauaaacaccguuggguggcagagcacuauuuccuuuuaaugcaguaugaugaacuucagaaaaucuguuacaacagauucgucccauguaagaacgguauccggaaaugcaacaggucaaaaggacugguagaaggcguguauuguaacuugacggaggccuuugaaauuccugcuugcaaguaugaaaguuuguacaggaagggauacguucugaucaccugcagcuggcagaacgagaugcaaaaaaggauuccacauacaauuaaugaccucguagaaccaccugaacaccgguccuuucucuccgaagacggggucuuugucaucagucccuag

SEQ ID NO: 12771 - RNA, 585 nt, Artificial Sequence
  Description of Artificial Sequence: Synthetic coding sequence
augacaaugagacauaauuggacccccgaucugucuccuuuguggguacuguugcugugugcacaugugguaacucuacuuguccgcgcgacucccgugucacagacuacuaccgcagcuacagccagcguacgcucuacuaaggacccuugcccuucccaaccuccaguauuuccagcagcuaagcaauguccugcccucgaagucaccuggcccgaaguugagguuccauuaaauggcacccuuaguuuaucaugcguagcuuguucacgauucccaaacuuuuccauucucuacugguuagguaacggcuccuucauagagcaucuccccggccgacugugggagggguccacaucuagggagaggggcaguacaggaacccaacugugcaaggcuuuagugcuggagcagcuuaccccugcccuucacuccacaaacuuuaguugcgugcuugucgauccagagcaaguggugcagagacacgugguucucgcacaacuuugggccggccugcgagcaacucugccgccaacccaggaggcccuccccucaagccauagcuccccucaacagcaaggauag

SEQ ID NO: 12772 - RNA, 4059 nt, Artificial Sequence
  Description of Artificial Sequence: Synthetic coding sequence
augaggcacggaguggcuugggcccucuuggucgcggccgcuuugggacugggcgcaagggggguacgaggggcuguggcauuggcagauuuuuacccuuuuggcgcagaacgcggugaugccgucacccccaaacaagacgacgguggcaguggauuacgcccgcuaagcguuccguuuccuuucuuuggggcugaacacaguggccuuuacguaaacaacaauggaaucauuaguuuucugaaagaagugagucaguuuacaccuguagccuuccccaucgcuaaagauagaugcguugucgccgccuuuugggcggaugucgauaaccggcgcgcgggugauguguacuaucgagaagccaccgauccagccaugcugagacgagcuacagaagauguccgccauuacuuuccagaacuccuugacuuuaaugcaacuuggguuuucguagcuaccugguacagggugaccuuuuuuggcggauccuccagcucgccaguaaacacguuccagaccgugcugauaacagacgguaaacucucuuuuacgaucuucaauuaugagucuauugucuggaccaccgguacccaugcuucaucuggggguaacgccacagggcucggcggcaucgccgcccaagccggguuuaacgcuggagauggucagcgauauuuuagcauccccggcuccaggaccgcagauauggccgaggucgaaacgacaacuaacgucgggguccccgggcgaugggccuucagaauugaugaugcccaggugagggugggcgguugcggccauacaaccuccgugugccucgcauuacguccaugccugaaugguggaaagugcauugacgacugcgugaccgggaaccccaguuauaccuguucuugcuugagcggcuuuaccgggcgcaggugucaccuggacgugaacgaaugcgcgucacagcccugccagaacgguggaacuuguacacauggcauaaauagcuuccguugccagugucccgcuggcuuugguggcccaaccugugagacagcccagagcccuugcgacacuaaagaaugccagcacggcggucagugccaggucgagaacggcuccgccgucugcgugugccaagcgggguacaccggggcugcgugugagauggauguugaugauugcuccccagacccaugucuuaauggcggcagcugcgucgaucuuguaggcaacuacaccugccucugcgcugagcccuuuaagggacuucgcugugaaaccggagaccauccaguuccagacgccugucugucugcaccaugucauaaugggggaaccuguguggacgcggaccagggguacgucugcgaaugcccggagggauucaugggccuugacuguagagagcgcgugcccgaugauugugaauguaggaauggggggcgcugucuaggcgccaauacuacccugugccagugcccucuuggguuuuucggguugcugugugaguucgagaucacugcaaugcccuguaacaugaauacucaauguccagauggcggauauuguauggaacaugguggcucauaccugugugugugucacacugaccacaacgcuucccauucacugcccucgccuugcgauuccgauccuugcuuuaauggugggucuugcgaugcccacgacgauuccuacaccugcgagugcccaagaggauuucaugggaaacauugugagaaggcucggccccaccuguguuccucaggaccuugcagaaauggcggcacuuguaaagaggccggcggcgaguaccauugcuccuguccguauagauucacuggaagacacugcgaaaucggaaaaccagauuccugcgccucuggacccugccacaacggcgggacguguuuucauuacauagggaaguacaagugcgacugcccccccggauucucgggaagacauugugagaucgcuccaucgccguguuuuaggucuccaugcgugaacgggggaacuugugaggaccgggacacggauuuuuuuugucacugucaggcaggcuacaugggaaggcgcugccaggcugaaguggacugcggacccccagaggaggugaaacacgcaacucuccgauucaaugggacacgccugggagcugucgcucucuaugcuugugaccggggauauagucugagcgcgcccucacgcaucagaguaugccaaccgcacggagucuggucugagcccccgcagugucuugaaaucgaugaguguaggucucaacccugucugcacggaggcagcugccaggaucgaguggccgguuauuuaugccucuguucaacaggcuacgagggcgcccauugugagcuagagcgagacgagugccgugcgcaccccugcaggaacggcggcucaugccggaaccuccccggagcuuacgugugcagauguccagcaggguucgugggcgugcauugcgaaacagaaguugacgcaugcgauuccucccccugucagcacggggggcgaugcgaauccggggguggggccuacuuaugcgugugccccgagagcuucuucggguaccauugugagaccguaucggacccauguuuuuccuccccauguggcgggcguggcuacugcuuagccucuaacgggucccacucauguaccuguaaaguaggauauacuggagaagauugcgcaaaagagcuguucccaccuacugcgcugaaaauggaacgaguggaagaaucaggggugagcaucucauggaacccaccuaacgggcccgccgcccgacagaugcuugacggcuacgcugugacauauguuuccucugacgguuccuauaggcgcacugacuuuguggaucggaccagaagcucccaccaauuacaagcuuuagccgcaggccgcgccuauaacauaucaguuuuuucugugaaacgcaacuccaauaauaagaacgauauuagucgcccggcagugcuccuggccaggacuaggccacgcccaguugagggguuugaaguuaccaacgugacugcuucaacaauuucugugcagugggcccuccaccgcauuagacacgcuaccgugucaggcgugcgcgucucaauccgacaucccgaagcacuccgcgaccaggcaacugacguugaccguagcguggaccgcuuuacuuucagagcccuuuugccuggaaagcgcuacaccauucagcugaccacucuguccggacuuaggggggaagaacaccccaccgagucucuagccacugccccuacccacguuuggacacggccgcuacccccagcuaaccucaccgcugcccgggucacugcuacuucugcccaugucgugugggacgccccuacuccaggcucacuccucgaagccuaugucaucaacguaacgacuagucagucaaccaagucuagauauguaccuaauggaaaguuagccagcuauacagugcgagaccuauugccaggucgccguuaucagcuuucagugauugcaguucagucaaccgaauugggcccacagcacucggagccugcgcaucuuuauauaaucacgucuccuagggacggcgccgaccgucgguggcaucagggaggccaccacccuagagugcucaagaaccggccccccccugcgcggcucccugaauugagguuacugaacgaccacagugccccagaaacuccgacacagcccccccgguucagcgagcugguggacggccgaggcaggguauccgcucgguuuggcgggagcccuaguaaggcugcuaccguccguucccacguucccgggaauuguucagagaauccaugccaaaacggcgggacgugcgucccuggagccgacgcucacucaugugauugcgggcccggguuuaagggccggagaugcgagcuagccuguauaaaagugucaaggccuuguacacggcucuuuagcgaaacuaaggcauucccaguuugggagggcgguguuugccaccaugugaagcaguccaagagccagaccuuggagaaguccuag

SEQ ID NO: 12773 - RNA, 957 nt, Artificial Sequence
  Description of Artificial Sequence: Synthetic coding sequence
augcuuccacugaccaugaccguucucauuuugcugcugcugccuacuggacaggcugcucccaaagacggagucacccgccccgauagugaaguacagcaccagcuccucccuaacccauuccagccagggcaggagcagcucggucugcugcagucauaccuuaagggccugggcagaacagagguccaacucgaacaccucucccgcgaacagguacuuuuauaucucuucgcccuccacgauuaugaccagucuggucagcuugauggacuggagcugcugagcauguuaaccgcagcguuggcccccggggccgcaaauuccccuacuacaaauccugucauucugauuguugauaagguucuggagacucaagaucuaaauggggacggccucaugacgcccgcagaauuaauuaauuucccagguguggcacuuaggcacguugagccaggggaaccgcucgcccccucaccucaggagccucaagcgguggggcgacagagucugcuugcaaagucuccucugcgacaggagacccaggaagccccuggaccucgggaggaagcuaagggacagguggaggcaaggagggaaucguuagauccaguucaggagcccggagggcaggcugaggccgacggcgacguucccgggccacggggggaagccgagggacaggcagaagcaaaaggggaugccccaggcccccggggagaggcaggcggacaggccgaggcugaaggagaugcuccaggaccucguggcgaagcugggggacaggccgaggcugagggggacgccccaggcccacgcggggaagccgguggacaggccgaggcucgagaaaauggagaggaagcuaaggaacucccgggcgaaacucuugagagcaagaauacccaaaacgacuucgaggugcacauaguacagguagaaaacgaugagauuuag

SEQ ID NO: 12774 - RNA, 816 nt, Artificial Sequence
  Description of Artificial Sequence: Synthetic coding sequence
augcaggccgcauguugguacgugcuauucuuguugcagccaaccguguaucuggugacaugcgcuaaucugacaaacggaggcaaaagcgaauugcugaaauccggaaguucaaaauccacucuuaagcacauuuggaccgaaaguucaaaggaucuaucuaucuccagacuccucagucaaaccuuucggggaaaagagaaugacaccgaucuugaucugagguaugacacacccgagcccuauuccgagcaggaccugugggacuggcugcgcaauuccaccgacuuacaggaaccucgcccccgugcuaaacgcagaccaauugucaagacagggaaauucaaaaaaauguucggauggggggacuuccauucuaauaucaagacuguaaaacucaaccuccugaucacagggaagauuguggaccacgguaacggaaccuucucgguguauuuuagacacaacuccacaggccaggguaacgugucaguuucuuugguacccccuacuaagauuguagaauucgaccuugcucaacagaccguuaucgacgcuaaagacaguaagucuuuuaacugucgcauagaauacgaaaagguggauaaagcaacaaaaaacacucugugcaauuaugacccuagcaagaccuguuaucaggagcagacacagagccacguguccuggcuuuguuccaagcccuucaaggugauuuguauuuacauuucuuuuuauuccaccgacuacaaacuuguucagaaagucugucccgacuacaacuaccacucugauacuccuuauuuucccagcgguuag

SEQ ID NO: 12775 - RNA, 999 nt, Artificial Sequence
  Description of Artificial Sequence: Synthetic coding sequence
augcuucuguuggccgcugccuuccuaguggcguucguccugcuucucuauaugguaucuccauuaaucuccccuaaaccucuugcucuacccggggcacaugugguggugacaggaggauccagcgggauuggcaaauguaucgcgaucgaaugcuauaagcagggugcuuuuaucacccugguggccagaaaugaggacaagcuccugcaggcuaagaaagagaucgaaaugcacucaauuaacgauaagcaaguagugcuguguauuaguguggaugugucccaggauuauaaucagguggaaaacguuauuaaacaggcgcaagaaaagcucggccccguugauaugcuggugaauugugcagguauggcagucucaggcaaauucgaagaucucgaggucagcacauuugagcgccuaauguccauaaauuaucuuggcagcguguauccuucucgugcaguuaucacuacgaugaaggagagacgggucggaagaauuguauucguguccagucaagcgggacaauugggacucuucggauucacagcauacucagcuagcaaguucgcgauucgcggacuggcagaagcacuccagauggaggucaaacccuauaauguuuacaucacuguggcuuauccuccagacacagauaccccaggguuugcugaagaaaaccgaacaaagccacuugagacccgucugaucucugaaaccacuucugucuguaagccugaacagguggccaagcaaaucgucaaagacgcuauucaggggaauuuuaauucaucucuggguuccgauggcuauauguugagugcucucacgugcgggauggccccugugaccagcauaacagaaggucuacaacaagucguuacaaugggucuuuuccgaacuauugcucuguuuuaccuuggaucauucgauagcaucguucgcagguguaugaugcaaagagagaagagcgagaacgcagauaaaacggcauag

SEQ ID NO: 12776 - RNA, 1497 nt, Artificial Sequence
  Description of Artificial Sequence: Synthetic coding sequence
augaguuucuccgccaccauucuguuuagcccuccaagcggcagugaggcuagauguugcuguugugccugcaaaagcgaaaccaacggaggcaacacgggaucacagggaggaaauccaccgccaagcacaccuauuaccgugaccggacacggucuggcagugcaaaguagcgaacaauuacugcacguaauuuaccagcggguugauaaggcugucggguuggccgaggcugcacuugggcuugcucgagccaauaacgaacucuugaagagacugcaggaagaagugggggaucugagacaagggaaggucaguauaccugacgaggauggcgagucccgagcucacucuagcccacccgaagagccaggcccucuaaaagaaucacccggcgaggccuucaaagcccugucugcugucgaggaggaaugcgacucuguugggagcggcgugcagguugugaucgaggaacugaggcaacucggcgccgcauccguaggaccagggccccuuggcuucccagcuacccaacgggauaugagguugcccggcugcacauuggccgcgucugaagccgccccucugcugaacccacugguugacgacuauguggcuagcgagggggcagugcagaggguucugguucccgcauaugcaaagcagcuuuccccagccacucagcuagcuauccaacgagcaacgccugagaccggacccgagaacggcacuaaguuacccccaccacguccugaagauaugcugaaugccgccgcggcauuagauagugcucuugaagagagcggcccuggaagcacaggcgagcugagacacagucugggacucacagugucccccugucgcacacgagguagcggacagaagaauuccagaagaaaacgagaucugguguuguccaaguugguucacaauguucacaaucauauaacaaacgauaagcgauucaacggcucagagagcaucaagagcucuuggaacauuagcguggugaaguuuuuacuggaaaagcugaaacaggaacuugugaccucuccccacaacuacacugauaaagaauugaagggagcuuguguggcauacuuuuugacuaagcggcgggaauaucggaauuccuugaauccuuuuaaagggcuuaaagagaaagaagaaaaaaaacuacguucucguagauauagauuauuugccaaccggagcagcauaaugcggcacuuugguccggaggaucaaagacuguggaacgauguuaccgaggaguugaugagcgacgaagaagacuccuugaacgagccugaucgacucccauccgccgaggcccagcuauugccuccggaguuauauaauccuaacuuucaggaggaagaagacgagggaggcgacgagaaugcccccgggucccccuccuucgaccaaccucauaaaacauguuguccugaccugaacuccuucaucgagauuaaaguugagaaggaugaguag

SEQ ID NO: 12777 - RNA, 966 nt, Artificial Sequence
  Description of Artificial Sequence: Synthetic coding sequence
augaggcugccccgucgcgccgcacucgggcugcucccccugcuguuauuguuaccuccggccccugaagccgcaaagaaaccgacaccaugccaccgguguagaggacugguggacaaguuuaaucagggaauggucgacacagcuaaaaagaacuuuggagguggcaacaccgccugggaggagaagacacugaguaaauacgaauccucugaaaucagacucuuagaaauccucgagggacugugugaaucaucugacuucgaaugcaaucagaugcuggaagcccaggaggaacaccucgaagccugguggcugcagcugaaaucagaguaucccgaccuuuucgaaugguucugcguuaaaacauugaaggucugcuguucuccaggcacauauggcccagacugccuggccugccagggcggcucacagagacccugcaguggcaacggacauugcucuggugauggaagcagacagggggacggaagcugcaggugccacaugggauaccagggcccuuuguguacggauugcauggacggauauuuuuccucacugcggaacgagacucauaguaucuguacugcuugcgacgaguccuguaagaccugcagcgggcugaccaaccgagauuguggggaaugugaagucggguggguguuggacgaaggagccuguguggacguggaugaaugugccgcugaaccaccaccuuguagcgcugcccaguucugcaaaaacgcuaacggaucuuacacaugcgaagacgucgacgaauguuccuuggcugaaaaaacaugugucagaaaaaacgagaacugcuacaacacucccggcucguacgucugcgucugccccgacggauucgaggagacugaggaugcgugcgugccgcccgcagaggccgaagccacagaaggugaaagcccuacccagcugccuagccgcgaggaucuguag

SEQ ID NO: 12778 - RNA, 711 nt, Artificial Sequence
  Description of Artificial Sequence: Synthetic coding sequence
augaugggcaucuucuuaguguacgucggcuuuguauuuuucucuguuuuguauguccagcagggacuuucuucucaagcaaaauuuaccgaauuuccgcgcaaugucacugcaacugaaggccaaaacgucgagauguccugcgcauuccaguccggcuccgcuucuguauaccuggaaauccaguggugguuccugaggggacccgaagaccuggacccaggggcagaaggcgccggcgcccagguugaguuacugcccgacagagauccagauagcgacggcaccaagauaaguacagucaaagugcagggaaaugacauuucccacaaacuacagauuucaaaagugcggaaaaaggacgaaggccuuuacgagugcagggugaccgacgcaaauuacggcgaguugcaggagcacaaggcucaggccuaucugaaaguuaacgcaaacagccaugcaagacgaaugcaggcuuucgaagccagcccuauguggcugcaagauaugaaaccccgcaaaaauguauccgccgccaucccgucuagcauccacggaagcgccaaucaacgcacccauuccacauccucuccccaaguugucgcuaaaauccccaagcaauccccccagagcggagcacgcaucgcaaccucccacggacugagcguacugcugcucgugugcggguucgucaagggggcccuucucuag

SEQ ID NO: 12779 - RNA, 273 nt, Artificial Sequence
  Description of Artificial Sequence: Synthetic coding sequence
augaacaugaagccugccacugcauccgcguugcuguugcugcuccucgggcucgcuuggacacagggcucccacggauggggugcagacgcuucaucccuccagaaacgugcaggcagagacgaccagaacuauaacuacaaucaacacgccuaucccacagcguauggcggcaaguacuccguuaagacgcccgcuaaagggggaguaagcccuucuucuuccgccucucgcguacagcccggacuucuucaaugggucaaauuuugguag

SEQ ID NO: 12780 - RNA, 360 nt, Artificial Sequence
  Description of Artificial Sequence: Synthetic coding sequence
augccugccguguuuaugcucgcuaguucuucugcucuucagugcggccgcggggucccccgauuucccaggacugaggucggagcggggcauuccgugaaugaagaaaccaaggccgaaaaaguuggaaaucaaaccucuguuauuccagcaacaagucgccaagcugcacuugguacaucguggacccaaagaaggacucagccgcuccaagaacggucccauuggcaccccaggggaaauaacgccucggguauggguggccauaggauguuucccggcccccucagaggcccugccgcccaggugcuugaaaaugaaugcgguagcuugggaagagcagcugagggacgaucuuag

SEQ ID NO: 12781 - RNA, 639 nt, Artificial Sequence
  Description of Artificial Sequence: Synthetic coding sequence
augcuguccagcguggucuucuggggacuuaucgcacugaucgguacaucaagaggaucuuaucccuucucucacucaaugaagccacaccugcaccccagauuguaucaugggugcuacggcgauauaaugacuaugaaaacgagcggagcuaccugcgaugcaaacagugugaugaauugcgguauuagaggcucugagauguucgccgagauggacuugagagcgauuaagccuuaccaaacccugauuaaagaggugggacaaagacauugcguggacccagcugugaucgccgcuaucaucucacgcgagagccauggagggucugugcuucaggacgggugggaccaccgcggucuuaaguucgggcucaugcagcuggauaagcagacuuaccacccugugggugccugggauagcaaggaacaccugucacaagcuaccggaauccugaccgaacguaucaaggccauucagaagaaguuuccaacauggucuguugcccaacauuuaaaaggggggcucucagccuucaagucugguauugaagcuaucgccacaccuucagacauagauaacgacuuugucaacgacaucauugcaagagcgaaguuuuacaaacgccagucauuuuag

SEQ ID NO: 12782 - RNA, 387 nt, Artificial Sequence
  Description of Artificial Sequence: Synthetic coding sequence
augcggguggcuagacggacacggaacguguguagauguccccgcgcggccggcccgggcgucccugagcccagagccgcucccuuaccucugcucgcuauggcgccuccuccagccugccggaguccuaugaguccucccccccccccccuuuugcuucuucugcuaucacucgcucugcuuggagcucgggccagggccgaaccugcugggucugccguaccugcucagagccguccaugugucgauugccaugccuucgaguuuaugcaacgcgcccuacaagaucuacgaaaaacugcaugcucucuugacgcgagaaccgaaacucugcugcuccaagccgaaaggagagcacugugugcuuguuggccugcaggacacuag

SEQ ID NO: 12783 - RNA, 399 nt, Artificial Sequence
  Description of Artificial Sequence: Synthetic coding sequence
augggcccacgaguucuucaaccuccucugcuucugcugcugcucgcccuguugcuggcagcucugccuuguggcgcggaggaagccucuccucugaggccugcucaagugacucuuucaccccccccagccgugacuaauggaagucagcccggagcuccccauaauucuacucacacccggccuccuggcgcuucuggauccgcauuaacaagguccuuuuacgugauccugggcuucuguggccuuacugcauuguacuuucuuauccgggcuuuuagacugaagaaaccacagcgacgacguuacgggcuacucgccaacacugaggacccaacagagauggccucauuagacuccgacgaggagacuguguuugaaucaaggaaucugcgcuag

SEQ ID NO: 12784 - RNA, 585 nt, Artificial Sequence
  Description of Artificial Sequence: Synthetic coding sequence
augagcgcccucugguuauuauuaggacugcuggcucugauggaccuuuccgagaguuccaauuggggcuguuacggaaauauucaaagccuggacaccccaggugcuagcuguggaaucggccgcagacacggcuuaaacuacugcggugugagagcuuccgaacggcuggcugaaaucgacaugccuuaccuucucaaguaccaaccuaugaugcaaacaauuggccagaaauacugcauggauccagcugugaucgccgguguguuauccaggaagucacccggugacaagauccucgugaauaugggcgauagaaccagcauggugcaggaccccggaucacaggcgccuacuucuuggauuuccgaaucccaagugucccagaccacagaggugcugacuacucgcaucaaagaaauucagcggcgauuuccaacauggaccccagaccaauacuugcgcggcgggcucugugccuacucagguggugccggauacguacguucaucgcaagaucugucgugugauuuuuguaaugaugugcucgcucgagcuaaguaucucaaacgccacggguuuuag

SEQ ID NO: 12785 - RNA, 441 nt, Artificial Sequence
  Description of Artificial Sequence: Synthetic coding sequence
auggucauuaccauuuauuacgauguuaaggugcgguucaucguacguggauguggucaauacauuuccuaccgaugccaggagaaaagaaauaccuauuucgccgaauacugguaccaggcccaauguugucaguacgauuauuguaauucuuggucuuccccacagcugcagagcagcuuacccgagccacacgacagaccccuagcccugccucucagcgacucucagauccagugguuuuaucaggcccucaaccugucauugcccuugccuaacuuccacgcaggcacugagcccgauggauuggaccccaugguuacgcucucccugaauuuaggccuuagcuuugccgaacuuagacggauguauuuguuccuaaauagcagcggacuacucguauuaccucaggccgggcucuuaaccccccaccccucuuag

SEQ ID NO: 12786 - RNA, 234 nt, Artificial Sequence
  Description of Artificial Sequence: Synthetic coding sequence
augggcaguucuggacuccuaucucuccuugugcuuuucguccuccuugcaaacguacagggccccgggcuuacagacugguuauucccccgcagaugcccuaaaaucagagaggaaugcgaauuccaggaaagggacguaugcacaaaagaccgacagugucaggauaauaaaaaguguugcguguucagcugugggaaaaagugucuggaccuuaaacaaggaaagcaguag

SEQ ID NO: 12787 - RNA, 444 nt, Artificial Sequence
  Description of Artificial Sequence: Synthetic coding sequence
auggggcaggaggugcacggauccuguugggccuugggcgcaggaggggggcagagacaauggguuggacggucaaugcccccauuagcuccucaauuaugucgcgcaguguuccuuguucccauacuguuacuauuacaagucaaaccccuuaacggcucucccggccccaaagacggcucccagaccgaaaagaccccauccgcggaccagaaccaggaacaguucgaggagcacuuuguugcaaguuccguuggcgaaauguggcaagucguggacauggcacagcaggaagaagaccaguccaguaaaaccgcugcgguucacaagcacaguuuccaucugucguuuuguuuuuccuuggccagugugaugguauucucuggggggccccucagaaggacuuuccccaauauacagcugugcuucaugcugacccacuag

SEQ ID NO: 12788 - RNA, 1695 nt, Artificial Sequence
  Description of Artificial Sequence: Synthetic coding sequence
auggcuccuaagaaauugagcugccuaagaucucugcuguuaccacuguccuuaacacugcugcugccucaggcagauacucgaucauuuguggucgacaggggccacgauagauuccuacuggacggcgcccccuucagguauguuuccggcucucugcacuauuuucgggugccucgcgugcugugggccgaccgcuugcucaagaugagauggagugggcucaaugcaauucaguucuaugugccguggaauuaucaugaaccucaaccgggcgucuacaauuucaauggaagcagggaucugaucgccuucuuaaacgaggccgcccuggccaaccuucuggugauucugagaccaggcccauauaucugugcugagugggagaugggagggcuuccuaguuggcuccugagaaagccggagauucauuuacgaacaagugacccagcugacaauaugacaaaaaucuuuaccuugcucagaaaguacgagccccauggaccacuugugaacagugaguauuacacgggguggcuggacuacugggggcagaaccacagcacuaggucaguuucugccgugaccaagggcuuggagaauaugcugaaguuaggcgccucagugaacauguacauguuccauggggggaccaacuucggauacuggaauggcgccgacaaaaagggaagguuucugcccaucacgacaagcuaugacuacgacgccccuauuuccgaagccggagaccccacccccaaacuuuuugcccuuagggacgugauuagcaaguuccaagagguuccacucgguccccugccccccccaaguccaaaaaugaugcuuggucccguuacgcuccaccugguuggccaucugcuggcauuccuagaccugcuguguccucguggaccaauccacagcauacugccuaugacauuugaagcaguuaaacaagaccacggcuucaugcuguaccgcacauauaugacucauacuaucuuugaaccuacacccuucugggugcccaauaauggcguccaugaucgcgcauauguaaugguugacggaguuuuucagggggucgucgagcgcaacaugagagauaagcucuuucugacagguaagcuggggucuaaacuagacauucuaguggagaacaugggcagauuauccuucggcucuaacucauccgauuucaaaggucugcucaagccacccauucuaggucaaaccauccugacgcaguggaugauguucccccugaaaauagacaaccugguuaaguggugguucccguuacagcucccgaaauggcccuacccucaggcuccuaguggaccgaccuuuuacucgaaaaccuuuccuaucuugggcucagucggcgacacguuuuuguaccugccugguuggacuaaaggucaggucuggauuaacggcuucaaccugggccgcuauuggacaaaacaggggccacaacagacauuauacgugccucgauuccuacuguucccccgcggugcccucaauaaaaucacccuucucgaacucgaagacguuccucuccagccucagguucaguuuuuagauaaaccaauccugaacagcaccucaacacuacauagaacucauaucaauagccuuucagccgauacacucagcgcuagugagccgauggaacuuagcgggcacuag

SEQ ID NO: 12789 - RNA, 423 nt, Artificial Sequence
  Description of Artificial Sequence: Synthetic coding sequence
auguuuuuuacuaucucucgcaaaaacaugucgcagaagcucagccuccugcuccuggucuuuggacugauuuggggacugauguuacuucauuacacauuucagcagccucggcaucagaguagcgucaaacugagggaacaaauuuuagaccugucgaagcgauacgugaaggcucucgcagaggaaaacaagaauacaguggacguggagaauggagcuuccauggccggcuaugcugaucucaagagaaccaucgcggucuugcuugaugauauacuccagaggcugguaaagcuggagaauaaaguggacuauauaguugugaacgggucugcugcaaacacaaccaacgggacauccgguaaccugguuccagugacgaccaacaagcguacaaacgucucagguucaauucgcuag

SEQ ID NO: 12790 - RNA, 528 nt, Artificial Sequence
  Description of Artificial Sequence: Synthetic coding sequence
augcuuccaccuauggcucugccuucuguuucauggaugcugcuuucuugcuugaugcuccugucacaaguccagggugaggaaccucaaagggaacugcccucugcuagaaucagauguccaaaaggcagcaaagcauauggaagucacugcuacgcguuguuccugucaccuaaaucauggacagaugccgaccuugccugccagaagaggccgucugggaaccucgugucaguccugucuggagccgaggguucuuuuguaagcucuuuagucaaaagcauaggaaacuccuacagcuauguguggauugggcugcacgacccaacucaaggaaccgagccuaacggggaggggugggaguggucuuccuccgaugucaugaauuacuucgcuugggaaaggaaucccucaacaauuagcucgcccggucauugcgcuucacuuucuagauccacugcuuuccuccgcuggaaagauuacaacuguaacgugcgucuccccuaugugugcaaauuuacugauuag

SEQ ID NO: 12791 - RNA, 381 nt, Artificial Sequence
  Description of Artificial Sequence: Synthetic coding sequence
augcaucuaagccagcuacuggcuugcgcgcugcugcugacccuacucagucuuagaccuagugaggcgaagccuggagccccaccaaagguaccaagaacuccaccggcugaggagcuggccgaaccccaagcggcgggagggggacagaaaaagggugacaaggccccuggcggcggaggagccaaucucaaaggugauagguccagauuacugcgagaucugaggguggacacaaagaguagagccgcaugggcccgacugcuccaagagcacccuaaugcaaggaaguauaaaggagcaaauaaaaaaggccugagcaaggguugcuucggacucaaacuggacagaaucggaucuaugucgggucucggaugcuag

SEQ ID NO: 12792 - RNA, 288 nt, Artificial Sequence
  Description of Artificial Sequence: Synthetic coding sequence
auggcacccccacccgcuuguagaaguccgauguccccuccucccccucccuugcuauuacuacuccucucacuagcacucuugggugcacgcgcgagggcugaaccagcaggcucugcuguccccgcccaguccagaccgugugucgacugccaugccuuugaauuuaugcagcgcgcccuccaagaccucaggaagacugcaugcucacuugacgcuagaacagagacccuguuauugcaagccgaaaggcgcgcccuuugugccugcuggccggcaggccacuag

SEQ ID NO: 12793 - RNA, 423 nt, Artificial Sequence
  Description of Artificial Sequence: Synthetic coding sequence
auguucuuuaccauuuccaggaagaauaugucccaaaagcuuucccuccuacuucugguauucgguuugauuuggggccugaugcuccuucauuacacauuucagcaaccucggcaccagagcucaguuaaguugcgugaacaaauucuugaccuauccaaaagguaugugaaagcguuggcugaggagaauaagaacaccgucgacguggaaaauggagccaguauggcuggcuacgccgaucucaagaggacuaucgcaguccuucuagaugacauacuucagcguuuagugaaguuagaaaacaagguugauuauauaguuguuaaugggagugcagcaaacaccaccaacgggacuuccggaaacuuagugccugugaccacuaacaaacgcaccaacgugagcggcaguauaagauag

SEQ ID NO: 12794 - RNA, 291 nt, Artificial Sequence
  Description of Artificial Sequence: Synthetic coding sequence
auggagcacaaagaagugguguuacucuuacuccuguuccugaagagcgggcagggcgagccauuggaugacuaugucaacacacaagguccaucucucuuuuccgugacaaagaagcagcugggggccggcucaagagaagaaugugcugccaagugugaagaggacaaggaguucaccugucgcgcuuuccaguaccauaguaaagagcagcagugugugaucauggccgagaaccgaaaaucaucaauuauaauuagaaugagggaugcuguguuguuugaaaaauag

SEQ ID NO: 12795 - RNA, 678 nt, Artificial Sequence
  Description of Artificial Sequence: Synthetic coding sequence
uaagcugaccucccgagcugcuggggagccggaccaugcuacacaggccauaaggugggugcgcuccggcgggauaccguaauaugcugcuguaggcauggcgacuacucuacaccauguuuauuuacaccaggcaaaccaaguagaaacccuucuccauggaaaagaacccucuggacucuguccgcacccugggcuggcccugcgggcuggaccggcgaagaacagaacgcuacuaagaccggccucauuacccguaggcccagacccuugaggcgucgcccacacccagccccagcuucuccuuugccagagaucauucggggcaauauuccaaggaugcucggaaaguucguaccugugaauugggaaccaccacagccccucccauuucccaaauaucugagaugcuauaggugccugcuggagacaaaggagcugggcugcuugcuuggaucggacaucugccugacgcccgcagggucaagcugcauuacacuucacaagaaaaauagcuccggaucagacgucauggugucugauuguagaucuaaggaacagauguccgacuguucaaauaccagaacauccccuguuaguggauuuuggaucuuuagccaguacugcuuccucgacuucuguaacgauccacaaaaucgcggcuuauacacccccuag

SEQ ID NO: 12796 - RNA, 684 nt, Artificial Sequence
  Description of Artificial Sequence: Synthetic coding sequence
augggagcugucaugggcacauucucuucccuccaaaccaaacagcgccgcccuuccaaagauaucgcuuggugguacuaucaauaccagagagauaagaucgaagacgaauuggaaaugaccaugguuugccaccgacccgagggucuagaacagcuagaagcucaaaccaauuucacaaaacgggaacugcagguguuauaucgaggguuuaaaaaugaaugccccagcggcgugguuaacgaggacaccuuuaaacaaaucuaugcccaguuuuucccucauggggacgcuaguacauacgcccauuaucuguucaaugcuuucgacacaacucaaacagggagcgucaaguuugaagacuuuguaacagcccugagcauuuuauugaggggcaccgugcacgagaaacuacgcuggacguucaacuuauacgacaucaacaaggauggauauauuaacaaagaggagaugauggacaucgugaaggcaauuuaugauaugaugggcaaauacacuuauccgguucugaaagaggauacaccccggcaacacguugacguauuuuuucagaagauggacaaaaauaaagacgguaucgugacucuggacgaguuucuugagucuugccaggaagaugauaauauuaugcguucccuucaguuguuccagaauguaauguag

SEQ ID NO: 12797 - RNA, 546 nt, Artificial Sequence
  Description of Artificial Sequence: Synthetic coding sequence
augcaggucaacuucguuagcuaugugcagcucacuucacgugcacuccccuccuugacagauagcaaaggcagcuuggugguaguuucaagccucuuagggaggguccccacaucauuuucuacuccuuauucugccgcuaaguuugcacuugacggcuucuuugggucccugcgucgcgaacucgauguucaggaugucaacguggcaaucacaaugugcguacucgggcuacgagacagagccuccgcagccgaagcuguaagguccucuacgucgcgucccagacagccagaacaccggggugugccacuucagagccagacugcuauguuucucccccccaccgugccuggagcacggacccugacugaaacuccacuucggggcuggccacagccaaagaugaagucuucuagacagaaauccaaaaccgagaagaaugaugggcaccuggaacccgucaccgcuugggaggugcaagucccacgcguucguagacugugccgcggccuggcccgaccacaucucuucggacacgacuag

SEQ ID NO: 12798 - RNA, 423 nt, Artificial Sequence
  Description of Artificial Sequence: Synthetic coding sequence
auguccgaccugcuccugcuuggauuaaucggcggacugacauugcugcugcugcugaccuugcuggcauucgcuggguauuccggguugcucgcugggguggaaguuucagccggcucgccccccauaagaaaugugaccgucgccuacaaguuucacaugggccuuuauggagagacaggccgacuuuuuacagagucuugcagcaucuccccaaagcucaggucuauugcggucuacuaugacaauccccauaugguucccccagacaaguguagaugcgccgugggaaguauccucuccgagggcgaggaaaguccaucuccagagcugaucgaucuguaucaaaaguuuggguucaaaguguuuaguuuuccggcuccaucacauguggugaccgccacuuuuccauauacaaccuag

SEQ ID NO: 12799 - RNA, 177 nt, Artificial Sequence
  Description of Artificial Sequence: Synthetic coding sequence
augggacccgaagcgcucucuucccucuuacuucuucuccugguugccucuggugacgccgauaugaaaggacacuuugacccagcgaaauguagguacgcauuaggcaugcaggauaggaccauccccgauucagauauuagugccucaagcuccuggucagauagcacggcguag

SEQ ID NO: 12800 - RNA, 2742 nt, Artificial Sequence
  Description of Artificial Sequence: Synthetic coding sequence
auggggccagaggcccugagcucucuacuuuugcuguuauuaguugcuaguggcgacgcggacaugaagggacacuucgacccugcuaaaugccgguaugcuuuaggcaugcaggacagaacuaucccugauucugauauaagugccucaucaucauggagugauucuacagccgcuagacauucccgacuggaaagcagugacggagauggagccuggugcccggcuggaagugucuuuccuaaagaagaagaauacuuacagguagaucugcagcgucugcaucuaguggcccuuguaggcacucagggacggcacgcgggaggacuggguaaggaguucucucguaguuacaggcugagguauuccagagacggcaggcgguggaugggguggaaggaccgcuggggacaggaagucaucuccggcaacgaagauccugagggaguugugcugaaagacuuggggccccccaugguggcgcggcuuguuagauucuacccaagggcugaccggguuaugagcgugugccucagaguggagcucuacggaugucuguggagagacggacuucucaguuauacagcgcccgucggucagaccauguaucugagcgaggccguguaucugaacgacucuacguacgaugggcacacugucggggggcuccaguacggaggauugggacaacucgcagacggagugguaggcuuggaugacuucaggaagucucaggaauugcggguuuggccuggguacgacuacgucgggugguccaaucacagcuuuuccucaggauacgucgagauggaguucgaguucgacagguuaagggcuuuccaggccaugcagguccacugcaacaacaugcacacuuuaggggccagacuucccgggggaguugaaugucgauuucgccgaggaccagcgauggcuugggagggagagccaaugcggcauaaucugggaggcaauuuaggcgauccaagggcucgcgccgugucuguacccuuggguggaagagucgccagguuccuucagugcagguuucuguuugcaggcccaugguuauuguucagcgagaucucauuuaucucugauguggucaauaauucaucuccagcacuuggcggcaccuucccgccugccccuugguggccccccgguccccccccuaccaacuucucaucacucgaacuagagccucgaggacaacagcccguggccaaagccgaaggauccccuacugcaauauugauuggcugccucgucgcuauuauacuguuacugcuucugauuauugcgcugaugcuuuggcggcuccauuggaggagacugcugucuaaggcugagcgcaggguacuggaagaagagcuuacaguccaccuguccgugccaggugacacaauccugaucaacaacaggccaggucccagagaacccccaccuuaccaggagcccagaccuagaggaaauccaccacauagugcuccgugcgugcccaauggaagcgcucugcuuuugaguaaccccgcuuaucgcuuacuucuagccacuuaugcccggcccccccgcggaccagggccaccaaccccagccugggccaagccuaccaauacucaagccuacaguggugacuauauggaacccgagaagccuggcgccccgcuucucccaccccccccucagaacaguguaccccacuacgccgaggccgauaucgugacccuccaaggagugacaggcggcaauaccuacgcaguaccugcacugccaccaggagccguaggggacgguccccccagaguggacuucccacgaucuagauugagauuuaaagaaaagcugggagaaggacaguuuggggagguucaucugugcgaaguagauucuccccaggaccugguuucucuggauuucccccucaauguccgaaaaggccauccucuucuagucgccguaaaaauucuccggccugacgcuacaaagaacgcccggaaugauuuccugaaagaaguuaagaucaugagccgccucaaagaucccaacaucaucagacuccuggggguguguguacaggaugacccgcuuuguaugauuacugacuacauggagaacggcgaccucaaucaguucuuguccgcccaccagcucgaagacaaggccgcggagggggcuccuggcgacgggcaggccgcgcaggggccuacuauuaguuacccaaugcuucugcacguugccgcccagaucgcuaguggaaugagguaucucgcuacucuuaacuucguccauagggaucuugccacccgcaauugccucgucggugaaaauuuuacgauuaagauugccgauuucgguaugucgcggaacuuauaugccggcgacuacuacagggugcagggccgggcugugcugccaauccgcuggauggcaugggaaugcauccuuaugggcaaguuuacuacugcuucugacguaugggcuuuuggugugacucucugggagguauugaugcugugcagggcacaaccguuuggccaauugacggaugagcaggugauagagaacgcaggcgaguucuucagggaucaggguaggcagguguaucucagccggccccccgcuugcccccagggccuguacgagcugaugcugagguguuggucccgcgaaagugagcagaggccuccauuuucccaguuacacagauuccuugcagaagaugcccucaacacaguguag

SEQ ID NO: 12801 - RNA, 1146 nt, Artificial Sequence
  Description of Artificial Sequence: Synthetic coding sequence
augcgucugcucgcguggcugauuuucuuggcuaacuggggaggugcccgggcugagccaggaaaauucuggcacauugcugauuugcaucuugaucccgacuacaaaguuucaaaagaucccuuccagguaugcccaagugccggcucacagccugucccggacgcugggcccuggggagacuacuugugugauucuccaugggcccugaucaauuccuccauauacgccaugaaagaaaucgaaccagagccugacuuuauucuuuggacuggcgacgauacgccucacgugccugacgaaaaacuuggggaggcugcuguccucgaaaucgucgaacgccuuaccaaacuaauuagggagguguuccccggagccuucuauugugaaaaauugcccgggcccuccggggccggaaggaucguuguacuaaacaccaacuuauacuacacuagcaaugcguugaccgccgacauggccgauccugggcagcaguuccagugguuagaagaugugcucacagacgccucuaaagcaggagauaugguuuauauaguaggccacgucccucccggcuucuucgaaaagacucagaacaaggccugguuccgggaaggguuuaacgagaaauaucugaaaguuguccggaagcaucacagagucauagcaggacaauucuuuggacaccaccacacagacucauuuagaaugcuuuacgaugacgccggugugccaaucucugccauguucauuacaccuggcgugaccccauggaagacaacucucccuggaguggucaauggugcgaacaauccagcaauccgggucuuugaauacgaccgcgccaccuugucacucaaggauauggugacuuacuuuaugaaucugagucaagccaacgcccagggcacgccacgcugggagcuggaauaccagucaacacugcagcgcuauuauguauauaacuccgucucuuacucggcaggggucugcgacgaggccuguuccaugcagcacguuugugcuaugcggcagguggauauugaugcauacacuaccugucuguaugccuccggaaccacaccugugccacagcuaccucugcugcucauggcuuugcucggauuguguaccuugguucucuag

SEQ ID NO: 12802 - RNA, 456 nt, Artificial Sequence
  Description of Artificial Sequence: Synthetic coding sequence
augcgcguagcaggggccgccaaacugguaguugccguggcuguuuuucuccucacauucuaugugaucagccaagucuucgagaucaaaauggacgcgucgcugggcaacuuguucgcccgaucugcucuugauacagcggccagaagcacaaaacccccaagauacaagugcggcaucucuaaggcuugcccagagaagcauuucgcguucaaaauggcuucaggcgcugccaacguggucggaccaaaaauuugccuggaagauaacgugcucaugagcggcguaaagaauaauguugggagagguauaaauguggcccuagcuaauggcaaaacuggcgaagugcucgauaccaaauauuucgacauguggggaggggacguugcaccauuuauagaauuucugaaggccauccaagacgggacuauugucuugauggguaccuacgacuag

SEQ ID NO: 12803 - RNA, 936 nt, Artificial Sequence
  Description of Artificial Sequence: Synthetic coding sequence
uaggccccuagcccuuguucccacuuuaacugcggcagucagguaacggacggaggcacaaucaaacaaaagaucuucaccuuugacgcuauguuuagcacgaauuacucacacauggaaaacuaccguaagcgcgaggaccuugucuaucagagcacagucagacuacccgagguccggauuucugauaacgggccuuaugaaugucauguggguauauaugaccgggccaccagagaaaaaguaguccuggcuagugggaacauuuuccugaacguuauggcaccuccaaccaguaucgaaguuguugcagcagacacucccgcacccuucagucgauaucaagcucaaaacuucacacuuguuugcaucgugucuggcgguaaaccggcaccuaugguguacuuuaaacgcgacggcgagcccauugaugcagugccacucucugaaccgccugcugccucuagcgggccccugcaggacucuaggcccuuccgcucucuacugcauagagauuuagacgauacuaaaaugcagaagagcuugucucuccucgaugccgagaacagaggcgggcggccuuacaccgagcgacccucccguggacuaacaccugacccaaauauccugcuucaaccuaccacugaaaauauaccugaaaccguggugucccgagaguuuccucguuggguucauagcgccgaacccacauauuuucugcgacacucccguacaccaucaagugauggaacuguggaggugagagcccugcuuaccuggacacugaauccucagauagauaaugaagcccucuucagcugcgaaguaaagcaucccgcucuguccaugcccaugcaagcugaggucacccuggucgcccccaaagggcccaagauaguuaugacacccucacgggcaagggugggugacaccuag

SEQ ID NO: 12804 - RNA, 978 nt, Artificial Sequence
  Description of Artificial Sequence: Synthetic coding sequence
augcaaggacgcguugcuggcucaugcgccccgcugggcuuguuacuggugugccuacaucuccccggacuguuugcuagauccauuggaguggucgaagaaaaggugucucagaaccuuggcaccaaccugccucagcugggccagccuagcagcaccgggcccucaaacagugaacacccccagccugcccuugacccccgcuccaaugaccuggcccggguaccccucaaacugagcgugccagcuucugauggauuuccaccugccggcggauccgcagugcaacgcuggccaccuaguuggggguugcccgcuauggauucguggccuccagaggacccauggcaaaugauggcagccgcugccgaggaccgucuuggcgaggcgcuuccugaggagcuguccuacuuaaguucugccgcugcccuagcccccggaucuggcccccugccgggcgagucaagcccugaugccacugggcucucuccuaaagcuuccuuacugcaccaggauagcgagucccgacgcuugccucggucaaauucauugggggcuggcggaaaaauacugucccagcguccccccuggagccugauucaccgagucuuaccagaucacccuuggggcacccucaauccuagugugagcuggggcggcggcgggccuggcaccgguuggggaacccgcccgaugccacauccagagggcauaugggggaucaacaaccagccacccgguacaucauggggaaacauaaaccgguaucccgguggaucuuggggaaacauaaaccgauauccuggcggcaguuggggcaauauuaaucgguauccuggaggaagcuggggaaacauccauuuauacccuggcaucaacaacccuuucccccccggaguucuucgacccccugguuccucuuggaacaucccagcuggauucccuaacccgccaaguccccggcugcaauggggcuag

SEQ ID NO: 12805 - RNA, 957 nt, Artificial Sequence
  Description of Artificial Sequence: Synthetic coding sequence
auggggcugcaccucaggccauauagagucgggcugcuuccugaugggcuguuguuucuucugcuguugcucaugcugcuggccgauccugcacuucccgcuggccgacaccccccagugguauuaggaugguucacaacuaagcaccccgggccaccuagcuuuuugaugguguggauguaugucucccuugcacuaggcagaccaagccacuggucaagcuggacucccgccaaggccgcuuggguaccaauuucuacuccaugguggcgggcccucugggcuggggccacccauggggugaggaugucugaaggucugccaaugacuggagcagagccucaaagacaaccgcaagcuuggaaggacaaauacauuagagcauuugucucacuuggggcgcccugggguggaguagccaaaacccugagaguucuugcuucuggagacaauaaucguaucccggugauugguccacugaaaauucgcgagcagcaaagaucugcagucuccacuuccuggcugcuuccauacaauuauaccugguccccugaaaagguuuucguacagacuccgaccaucaauuauacccugagagauuaccgcaaguuuuuccaggacauugguuuugaagacgggugguugaugcggcaggacacagaaggccuuguggaagcuacaaugcccccgggagugcagcugcacugcuuauacggcaccggaguaccaaccccagacagcuucuacuaugagaguuucccagaucgggacccaaagauuuguuucggagacggagauggcaccguaaaccuaaaauccgcacuacagugucaggcuuggcaauccagacaagagcaucagguacugcuccaggagcugccggggagugagcauauagagaugcuggccaacgcaacaacacucgcuuaucugaagcgcguauugcuagggccuuag

SEQ ID NO: 12806 - RNA, 1575 nt, Artificial Sequence
  Description of Artificial Sequence: Synthetic coding sequence
uacgcccucagagacaggcagggaaaugcuauuggaguuaccgcuugcgacauagauggagacggcagggaagaaaucuauuucuuaaauacaaacaaugcauucaguggaguugcuacauacacagauaagcuguuuaaguuccguaauaaccggugggaagauauucugucagacgaagucaacguugcgaggggggucgccagccuguuugcaggucggucugucgccugcgucgacaggaaaggcucagggcgguacagcauauacaucgcuaauuacgcuuacggaaaugugggaccugacgcucucauugagauggacccugaagcaucagacuuaucuagaggcauccuggcccucagggaugucgccgcggaggccggcgucagcaaauauacaggcgggaggggaguaucuguuggacccauccucaguucaucugccagcgacauuuuuugcgauaacgaaaaugggccaaacuuuuuguuccacaacagaggugauggaacauuuguugacgcugcugcaagugcaggagucgaugacccucaucagcacgguagaggaguggcuuuggcugacuucaauagagacggcaaaguggacauagucuacggaaacuggaauggcccccaucgguuguaccuccagaugucgacucacggaaagguccgguuccgcgacaucgccucuccuaaauucucuaugccuucucccgugcgaaccgugaucaccgccgauuuugacaacgaucaggagcuugagauuuucuuuaauaacaucgccuaucggaguagcuccgccaacagacuuuuucguguaaucaggcgagaacauggggauccacuaaucgaagaacuuaacccuggggacgcacucgaaccugaaggcagaggaacgggaggcgucgucacugacuuugacggagacggcaugcuugaucugauccugucgcauggagagucgauggcgcaaccccugucaguauuuagaggaaaucagggcuuuaauaauaauugguugagaguuguuccuaggacacgguucggagcguuugcaaggggggccaagguggugcuguauaccaagaaaagcggggcgcaucugcgcauuaucgacgguggcaguggcuaucuaugcgagauggaacccgucgcccauuucggucuuggaaaggaugaagcuucuaguguugaaguaacguggccagauggaaagauggugucuagaaacguagcuuccggugagaugaauucaguucuggagauucuguacccccgcgacgaggacacucuucaggacccagcucccuuagagacaccgaugaaugcuaguucaagccacagcugcgcacuggaaaccucacccuauguuuccacaccaauggaagcuaccggggcagggccuacucgcucagccguaggcgcgacuaguccuacccggauggcacagccggcauggggcuugucggcgucccaccgggcccccgcuccuccuccacccccacuucuccugccgcuaccucuccuccuuccuuuacuggaacugccucuccugcaccgcuccucuuag

SEQ ID NO: 12807 - RNA, 636 nt, Artificial Sequence
  Description of Artificial Sequence: Synthetic coding sequence
auggucucaagaauggucuccaccaugcuuagcggccuccuguucuggcuugcuuccggcuggacccccgcauucgcuuacuccccacggaccccagaccguguuuccgaggccgacauccaaaggcugcuacacggcgucauggaacaguuaggaauugcccgcccaaggguggaauauccagcucaccaagcaaugaaucuugugggaccgcagucuaucgaagguggcgcucacgaaggccugcaacaucugggaccauuuggcaauauaccuaauauaguggcagagcucacaggugacaauauuccuaaagacuucucugaagaccaggguuaucccgauccacccaacccuuguccaguagggaaaaccgacgacggcuguuuagagaacacaccugauacggcugaguucucccgggaguuccagcuccaccagcaccuuuuugauccggaacaugacuacccagggcucggcaaguggaauaaaaaguuacuguacgaaaagaugaaaggcggcgagaggaggaaacgcagauccgugaauccguaccugcagggccaacgcuuggauaacguagucgcaaaaaaauccguuccccauuucuccgacgaggauaaagaucccgaauag

SEQ ID NO: 12808 - RNA, 465 nt, Artificial Sequence
  Description of Artificial Sequence: Synthetic coding sequence
auggccuugggaguaccuaucuccgucuaccuccuguuuaacgccaugacugcccugaccgaagaagccgcagucacagucacuccaccgauuacggcucagcaaggcaauuggacagugaauaagaccgaagcggacaauauagaaggcccgaucgcccugaaauucucacaccugugccuggaagaccauaacuccuauugcaucaauggagccugugccuuucaccaugaacuggaaaaggcgauaugccgcugcuucacagguuacacaggagagcgaugugagcaucucacgcuaacaucuuacgcaguugacuccuacgagaaauacauugcuaucgguauaggugugggcuuguuguuaucuggauuccuugucauauuuuacugcuauaucaggaaacgcugccuaaaacugaaauccccuuacaaugucugcucuggagaacgccgcccucuuuag

SEQ ID NO: 12809 - RNA, 1446 nt, Artificial Sequence
  Description of Artificial Sequence: Synthetic coding sequence
auggggaaacugcgccccggcaggguggagugguuggcaagcgggcauacagagcgaccacaccucuuucaaaaucuguugcuuuuuuuaugggcacugcucaauuguggacuuggcguuuccgcccaaggacccggggaguggacuccuugggucagcuggacccgcuguucuucuucauguggacggggcguuucagugaggagucgccgcugccuacgcuuacccggcgaggagccauguuggggugauucucaugaguacaggcugugccaacugccagauuguccgccaggugcaguaccauuccgagaccugcagugcgcacuguauaaugggcggcccguguuggguacucagaagacuuaccaaugggugccuuuucauggcgcgccaaaccagugugaucuuaacugcuuagcagaagggcaugccuuuuaccauuccuucggccgugugcuagacggcacugccugcaguccuggagcccaaggcguuuguguugcuggccguugucuuucggcaggcugugauggauugcuaggaucuggcgccuuggaagauagguguggccgaugcggcggcgccaaugauaguugucucuuuguacagcggguuuucagagacgcaggcgccuuugcaggcuacuggaauguuacacugaucccggagggcgcacgccacauucgcguggagcaccguucaagaaaucaucuggcucuuaugggcggcgauggccgcuauguucugaacggccacuggguugucagccccccaggcacguaugaagcugccggaacccacguaguauauacacgcgauaccggaccccaagagacccugcaagccgcuggccccacuucacacgaccugcuguugcaggugcuccugcaggaaccuaauccaggcauugaguucgaauucugguuacccagagaacgauacucccccuuucaagcucgagugcaagcgcucggguggccccuccgccagccccaacccaggggcgucgagccucagccuccugcugcgcccgcuguuaccccggcgcaaacccccaccuuggcacccgacccaugccccccuugucccgacaccagaggaagggcccaucgccuguuacacuauugugguucugacuucguuuuccaggcucgcgugcucggacaucaucaccaagcgcaagagacccgcuaugaaguaaggauacagcugguguacaaaaaucguagccccuuaagagcaagggaauaugucugggcuccgggccacugucccuguccaaugcucgccccucaccgggacuacuugauggcugugcaacgacucgucucucccgacggaacacaagaucaguuacugcucccucaugcagguuacgcucguccguggagcccagcugaagacucccgcauucggcugaccgcgcgcagaugcccuggguag

SEQ ID NO: 12810 - RNA, 627 nt, Artificial Sequence
  Description of Artificial Sequence: Synthetic coding sequence
auggcagacaugcagaaucuggucgagagacucgagagagcagucggcaggcuugaagccgucagccauacaagcgauaugcaucgaggcuaugcagauucucccucuaaagcuggcgcugccccauauguucaagccuucgauagccuacucgccggcccaguggccgaauaucugaagaucaguaaagagaucgguggugaugugcagaagcaugccgagaugguucauacaggccugaagcuggagagagcacuccuggugacagccucccagugccaacaaccagccgagaacaagcuguccgacuuauuagcaccaauaucugagcagauuaaggaagucaucacauuccgcgaaaaaaauagggggucaaaacuguucaaucaucuguccgcuguguccgaguccauccaagcucugggcugggucgccauggccccgaaaccugggccuuacguuaaggaaaugaaugacgcugcaauguucuauacaaaccgaguguugaaggaguacaaggaugucgauaagaagcacguugacuggguuaaagcauaucugucuaucuggacugaauugcaggcguacaucaaagaguuucacacuacagggcucgccuggucauag

SEQ ID NO: 12811 - RNA, 1482 nt, Artificial Sequence
  Description of Artificial Sequence: Synthetic coding sequence
ucugaagccguguaccugaaugacagcaccuacgacggucacaccgucggaggccugcaguauggcgggcugggccagcuggcagauggugugguaggacuagacgacuucaggaaaagccaagagcuaagggucuggcccggcuaugacuacguggguuggagcaaccacuccuucucgagcggauaugucgaaauggaguuugaguuugauaggcuacgagcguuccaggcuaugcaggugcacuguaauaacaugcauaccuugggagcucggcuccccggggggguggagugccgguuccgcagaggaccggccauggcaugggagggggaaccaaugcggcauaacuuaggaggaaaucugggagacccccgagcuagggcaguguccguuccccuaggcggacggguggcacgguucuuacaaugucgguuccuuuucgccggucccuggcuccuauucagcgagauuaguuuuauaucagaugucgucaacaauagcucuccagcccucggcggaacuuucccaccagccccuugguggccuccuggaccaccucccaccaauuucucaucauuagaauuagaaccgagagggcagcagccuguggccaaggcugaggguucuccuacggcgauauugauuggcugucugguggcgaucauacuauugcuccuacuaauuauugcucucaugcuguggaggcuccauuggcguagacuucucucgaaaguacuggaaucccaccccagaacaagauccccaggccuaguuggaauaagaccgaccccucuuccugucucucccauggcucugagguguugcucgccaauacaaccuacagcaucauucuggccacuaacaccugugcccuuggaggcgcgcgcuccaccucacccucccgggccuaauccccccacaccaagaggggugacugggggcaauacguacgcuguuccugccuuacccccaggcgcagugggagauggcccuccucgcgucgacuuuccccgaucuagauugcgauucaaagagaaacugggcgaagggcaguuuggcgaagugcaucuaugugaaguggacagcccacaggaucucgugagucuagauuuuccgcugaaugugcggaagggucacccacugcuuguugcugucaagauucuucggccggacgccacgaaaaaugcacgaaaugacuuucucaaagaagucaaaauaauguccaggcugaaggacccuaacaucauacgguuacuuggcgugugcgugcaggaugauccccuguguaugaucacugacuauauggaaaacggcgaccugaaucaauuucucucggcccaccaacuugaggauaaggcugccgaaggggccccaggcgacggacaggccgcucaaggacccacaaucaguuaccccaugcuucuucacguggcagcucagaucgccucgggcaugcgguaucuggccaccuuaaacuag

SEQ ID NO: 12812 - RNA, 2319 nt, Artificial Sequence
  Description of Artificial Sequence: Synthetic coding sequence
augcaguuucaacugacccucuuuuugcaccucggcuggcucucuuauucuaaagcacaggacgauugcaaccggggagccugccacccuacgacaggggaccugcugguggggcguaauacacagcucauggccucuucaacgugcgggcucagcagagcacaaaaauauuguauacuauccuaccuugagggagaacagaagugcuucaucugugauagccgguucccauacgacccuuaugaccagcccaauagccauaccauugagaacgucaucgugagcuucgagccugacagagagaaaaagugguggcagucugagaauggccuugaucaugugucuauccgucuggaucuugaggcccuuuuccguuuuucacacuuaauauugacauucaagacauuccguccugcugcaaugcucguugagcggucaacugacuacggucauaacuggaaaguuuuuaaauauuuugccaaagauugcgcuaccucuuuccccaauauuacaucugggcaagcucaaggcguuggcgauauugugugugauucuaaguauucagauauagaaccuagcacuggaggcgaaguggugcugaaagugcuggauccuaguuuugagaucgagaacccguauagcccuuauauacaagaccuagucacucugaccaaucuccggauaaacuuuacaaagcuucauacccuuggcgaugcucuccucggacggcgccagaacgauucucucgacaaauauuauuacgcccucuaugagaugaucgucagaggcaguuguuuuugcaauggccaugcuuccgagugucggccgaugcaaaagaugcggggcgacguauuuaguccccccggaaugguucacgggcagugugucugccaacacaacacagacgggccuaauugugagagauguaaggacuucuuccaggaugcaccauggcggccagcugcggaucuacaggauaacgcaugccggagcuguagcuguaacucccauaguucccguugccacuucgauaugaccacuuaucucgccagcggcggcuuaucuggcggcgucugugaggacugccagcacaacaccgagggccagcacugugaucguugucguccccuguuuuaucgcgacccucucaaaaccaucucagaucccuacgccuguauaccaugcgaaugcgaccccgauggaaccauuagcggcggaauuugcgugucccauucggacccugcccugggcucuguggcugggcaaugcuugugcaaagaaaacguggagggagcuaaaugugaucagugcaagcccaaccacuauggcuuaagcgcuaccgacccgcuggguugucaaccuugugauuguaauccauugggcagucuaccauuccugacuugcgacgucgacacaggacagugucugugucucaguuaugugacaggggcccacugugaggagugcacagugggcuacuggggacuggggaaucacuugcacggaugcucccccugugauugugacaucggcggagccuauuccaacguuuguucacccaagaauggccagugugaguguaggccccauguuacaggccgauccugcucggagccagcaccgggcuacuuuuucgcgcccuuaaauuuuuaccuuuaugaagcugaagaagcaacuaccuugcagggauuggccccucugggaagugaaacauucggccagucccccgccguccacguugucuugggagaaccaguccccgggaauccgguaacuuggacagguccagguuuugcacgcguucugccaggcgcaggucucagguucgcggucaacaacauucccuuuccgguagacuuuaccauagccauccacuaugagacccagagcgcugcugauuggaccguucagaucgucguuaauccaccagggggcuccgaacauugcaucccaaagacccuacaaagcaaaccccagagcuuugcacugcccgccgccacacgcauuaugcuguugccaacaccuauaugucuugagccagauguacaguacucaauugauguuuauuucucccagcccuuacagggggaaagccacgcucauagucacguccuuguggauucugcugcagugcaauggcacaaucuggguagccugcagccaccuccacccgagugcaagcaguucagcuguuuuucuuucccuaguuccugggacuauagacauccacccccacaucucgcuaacuuuuguaucuuuagccgcgacggagucaguccacauuggccugguuggagccaaacaccagacuuaagauag

SEQ ID NO: 12813 - RNA, 1371 nt, Artificial Sequence
  Description of Artificial Sequence: Synthetic coding sequence
augggcagggcaggcgcagccgcuguaaucccuggucuugcacugcugugggccgugggucuuggcucagcagcaccauccccgcaucuuagguugucauuucaggaacugcaggccuggcacggucuccagaccuuuucucuggaaaggacuugcugcuaccaggcacuguugguugacgaggagaggggccgacuauuugugggugcggaaaaccauguagcuagccugaaccucgacaacauuucgaaacgcgcaaagaagcucgccuggcccgccccaguggaguggagggaggaaugcaacugggccgguaaggauauagguacagaaugcaugaauuucgugaagcugcugcacgccuauaaucggacgcacuugcuggcaugcgggacaggcgccuuucacccaaccugugcauucguggaggugggccaucgagcugaggagccuguguuaagacucgaucccgggagaauugaggauggcaaaggaaaaagucccuacgaccccaggcaccgggcugccagcguucuggucggcgaagaacuguacagcggaguggccgcagaccucauggggcgggauuuuacuauauuccguucccucgggcagaggcccagcuuacgcaccgagccgcacgacuccagguggcucaacgagccuaaguuuguuaaaguguucuggauaccugagagugagaauccagaugacgauaaaaucuacuucuuuuuccgcgaaacugcagucgaagcugcgcccgcacucggccguuuauccgucucucgcguuggccaaauuuguaggaaugacgugggcggucagagaucucuugugaauaaguggacuacauuucugaaagcuaggcuuguguguucuguaccuggcgucgaaggcgacacacacuuugaucagcuccaggacguuuuucugcucuccucucgugaucaucguacacccuuauuguacgcggucuuuaguaccaguagcucgaucuuccaggggagcgccgugugcguguauuccaugaaugacguucgcagggccuuucugggcccauucgcacacaaagagggcccaaugcaccagugggucagcuaccagggucgcguuccauauccgaggcaagccugugcccccgcuagaccccuggcuccaucuguucccccgaggacuagccaaacaauguccucaagcuugcgcggaacuaccccuaguuguacaacucugucgugcccucucggcggcgccuuguuuucguacaaacucgagccuaucacaccgucccucaagcugccuagaaccggacuucaaccguugacugauacaaugaccuccucuagucuugcucagacccuggcucgaugcuag

SEQ ID NO: 12814 - RNA, 333 nt, Artificial Sequence
  Description of Artificial Sequence: Synthetic coding sequence
cucuuuaugcugcacaagaucguacaggucuauaacucagaugugaucgacaagcagagcgccaguaugacaagcgauaaugcugaugauaaagcuguaauaauucuagugcccgugcgucucgggggagaaaggacuaauaccgacuaccuagaauucgugaagggaauuuugagucuugaguacugcguaggaauuauuggggggaaaccuaagcaaaguuacuauuucgcuggcuuucaggaugauuccuugaucuacauggacccccauuauugccaguccuucgucgacgucucuauaaaggauuuuccauuggagguuauacuuuag

SEQ ID NO: 12815 - RNA, 420 nt, Artificial Sequence
  Description of Artificial Sequence: Synthetic coding sequence
augggaccagaagcauuauccucacuacugcuucuuuugcucguagccucuggggacgcugacaugaaagggcacuuugacccugccaaaugucgcuacgcacuuggaaugcaagaucggacaauuccugauuccgacauaagcgcaaguuccagcuggagugacaguacugccgccagacacagccgucucgagagcucugacggggauggcgcgugguguccugcaggauccgucuuuccgaaggaggaagaauaucugcaggucgaucuccaaagacuccaucuggucgcccucgugggcacccaggggaggcaugccggaggacugggcaaagaauucuccaggucauaccgacugcgguacagcagagauggacgaagauggaugggauggaaagacagguggggccaggaauag

SEQ ID NO: 12816 - RNA, 570 nt, Artificial Sequence
  Description of Artificial Sequence: Synthetic coding sequence
augcucggcaucacaucuuguuccgaucagcaggcuaaagagggcgaaggacucgagggcagcucuaccgggagcagcagcgguaaccacgguggcuccggcggagguaacggccauaagccagggugcgagaagccugggaacgaggcccggggaucaggugagucugguauccagaauucagagacaagcccuggaauguuuaacuucgauaccuuuuggaagaacuucaaauccaaacucgguuucauaaacugggacgcgauuaauaaaaaccagguccccccaccauccacacgcgcacuucuguacuuuagccgccucugggaggacuucaagcaaaauacccccuuccugaacuggaaagccaucauugaaggcgcagacgcaaguucgcugcagaagagagcaggacgggacgaccagaauuauaauuacaaccaacacgcauacccuaccgcauauggcggcaaauauucagugaagacuccagcuaagggcgggguaucccccucauccuccgccagcagaguacaacccggucucuugcagugggugaaauucugguag

SEQ ID NO: 12817 - RNA, 438 nt, Artificial Sequence
  Description of Artificial Sequence: Synthetic coding sequence
auggcugacaugcagaaucugguagagagacuggagcgcgcagugggcagacuggaggcuguaucccauaccagcgacaugcaccgaggguacgccgauucccccucuaaagcuggcgcagcuccauauguccaggccuauauaaaggaauuucacacuacaggauuagcuugguccaagacaggucccguagcuaaagagcugagcgggcugccauccggaccuucagcgggaaguugcccuccuccccccccuccguguccaccuccacccccagugaguacuauuucuugcagcuaugagucugcgagccggagcaguuuauucgcccaaauaaaucagggagagucuauuacacacgcucuaaagcacgucucggacgauaugaaaacccacaaaaauccagcauuaaaggcgcaaagcggaccugucagauag

SEQ ID NO: 12818 - RNA, 264 nt, Artificial Sequence
  Description of Artificial Sequence: Synthetic coding sequence
ugcaaaagaaaacccuaccuccuuccauccauccgagagggcgccaggcugggcauccaggaaugcggaucacaguuucgccaugagagauggaacuguaugaucaccgccgccgcuacaacagccccaaugggagcuuccccguuauucggcuaugaacugucguccggcugccgccaaguagacgugucucgauuaccccuuccucgcuccuuucgucuccuuuguugugaaaacaugcuagagaaucaugucuucuucuag

SEQ ID NO: 12819 - RNA, 2535 nt, Artificial Sequence
  Description of Artificial Sequence: Synthetic coding sequence
augggacccggagcuccuuucgccagggugggauggccgcuuccucuuuuaguugugauggcugccggaguagcucccgucugggcaucacauucgccccauuugccccgaccccacagcagaguuccuccccauccgucuucugaacgccgagcaguguacaucggggccuuguuuccaauguccgggggcuggcccgggggacaagcgugccagccugcuguagagauggcgcucgaggacgucaacucccgccgagauauucugccagacuaugagcugaaacuaauucaucacgauaguaagugcgacccaggucaagcgacaaaguaccuguacgagcugcuuuauaacgacccaauuaaaauaauucugaugcccggcugcaguuccguaucuacgcuugucgcugaggcggcucgcauguggaacuuaauuguucuaucauacggcucaucauccccagcacugucaaaucggcagcgcuuucccaccuuuuucaggacacacccuuccgcuacacugcacaaucccacacgcgugaagcuguuugaaaaguggggauggaaaaagauugcaaccauucagcagacaacugaaguuuucacaaguacguuagaugaccucgaggaaagggugaaggaggcgggcauugaaauuaccuuccggcaaucuuucuucucugacccggcuguuccugugaagaaccuuaaacgccaggacgcacgaauaauuguaggucuuuuuuacgagacggaggcacgaaaaguguuuugcgaaguguauaaagagcgauuguucggaaagaaauaugucugguuccugaucgggugguaugccgauaacugguucaagaucuacgauccauccauaaauugcaccguugaugaaaugacugaggcaguugaaggccacaucaccaccgagauugugaugcugaaucccgcuaauacccgcagcauuaguaacaugacaucccaggaauuuguggaaaagcugaccaagagacugaagaggcaucccgaggaaaccggcgguuuccaggaggcaccucuggccuacgaugcuauuugggcccuugcccucgccuugaacaagacaucuggggggggagguagaaguggggugcggcuggaagauuucaacuacaauaaucagaccauaacagaucagaucuacagggccaugaauuccucuucguuugagggaguaaguggacacguaguauucgaugccucugggagccguauggccuggacgcuaaucgaacaacugcagggcggaucuuauaagaagauuggcuacuacgauagcacaaaagacgaccugucuuggagcaaaaccgacaaguggaucgggggcagcccacccgccgaucagacccuuguaauuaaaacuuuucguuuucugagucagaaacuguuuauaaguguuagcguccucagcagccucggaauaguguuagcugugguaugccugagcuucaacaucuacaauagucaugugagauauauccagaacagccagccaaaccucaacaaucucaccgcugucggcugcucccuggcacucgcggcuguguucccucuuggucuggauggcuaccauauuggaaggaaucaguuucccuuugugugucaagcccgccuguggcugcugggacugggguuuucccugggguacgguuccauguuuacuaaaaucuggugggugcacacaguguucaccaaaaaggaggaaaagaaggaauggcgcaagacgcuugaaccuuggaaguuguaugcaacaguuggacuguugguagggauggacgugcugacguuggccaucuggcagauuguggauccacuccaccgcacgaucgagacuuucgccaaagaggagccuaaggaggacaucgaugugucuauucugccccagcuugagcacugcucuuccaggaagaugaacacauggcucggcauauucuauggcuacaagggauuguuacuccugcugggcaucuucuuagcuuaugagacaaaaucuguuagcacggaaaaaaucaacgaccacagagccgugggcauggcaaucuacaaugucgccgucuuaugucugaucacugcucccguuaccaugauccuuagcagccagcaggacgccgcuuuugccuuugccagccuugcuaucgucuuuucgucauacauuacauuaguuguuuuguucguaccaaaaaugagacgacugaucacccgcggcgaguggcagagugaggcgcaggauacaaugaaaacggguucaucuaccaauaauaacgaggaggagaagucuaggcucuuggagaaagaaaaccgggagcuggaaaagauuauagccgaaaaggaagagcgggucucggaacugcgacaccagcuucaaucacggcagcagcugaggucacgcagacacccaccgaccccuccagaaccuuccggcggucuaccuagaggaccaccagaaccaccggaucgacucucgugugacggcucuaggguacaucugcuuuauaaguag

SEQ ID NO: 12820 - RNA, 2631 nt, Artificial Sequence
  Description of Artificial Sequence: Synthetic coding sequence
augggacccgaagcauuaagcucacuccuacuccugcugcuuguugcuuccggcgaugccgauaugaagggccacuucgacccugccaagugucgguaugcucugggaaugcaggaccgaacgauaccagauuccgauauaagugccucuucuagcuggucggauuccaccgccgcucgccauucucggcuugagucaagugauggcgauggggcuuggugccccgccggaagcguguuccccaaagaagaagaauacuugcaaguggacuugcagcgacugcauuuaguugcccugguggguacucagggaaggcacgcgggugggcuggguaaagaauuuucccggucuuaucgacugcgcuauagucgggauggaaggcgauggaugggcuggaaagacagauggggccaagaagugauaucaggaaacgaggacccugaaggaguugugcucaaggaccucggucccccuaugguggcgcggcuggugagauuuuacccacgcgccgacagggugaugucagugugucugagaguugaacuguacggcugucuuuggcgggacggacugcucucuuauacugcucccgugggccaaaccauguaucuuagugaagcgguguaccucaaugacaguaccuaugacggacauaccguggggggucuucaguacggcggacuggggcagcuggcugacgggguugucggccuggaugacuucagaaaaucacaggaguugaggguauggcccgguuacgacuacguuggcuggucgaaccacagcuuuagcagcggauacgucgagauggaauucgaauucgaccgacugagagccuuucaggcuaugcagguacacugcaauaacaugcauacccuaggagcucgacuuccaggaggaguggagugccgcuuuaggagaggucccgcuauggcaugggagggagagccaaugaggcacaaccuuggagggaaccucggugaccccagagcccgcgcugucagcguuccccugggcgggaggguggcgcgguuuuugcagugccgauuccucuuugcuggaccuuggcuguuguuuagcgaaauaaguuuuaucucggacgucgugaacaacucuucaccugcccuugggggaacguucccaccagccccuugguggccccccggaccucccccuacaaauuucagcagccuggagcuugagccucgcggacaacagccugucgcaaaagcggaaggaucaccaacagcaauccucauugggugcuuaguagcgauuauucuuuuacugcucuuaauuaucgcucugaugcuguggcggcuucauuggcggagacuacugucuaaggcagagcggaggguguuggaggaggagcucacuguucaccuuucuguaccuggagacacaauccugauaaacaauagacccggaccuagggagccuccccccuaucaggaacccaggccucgcgggaaucccccccauagcgcuccuugcguuccaaacggcagcgccuacagcggugauuacauggagccagaaaagccuggugcaccucugcugcccccccccccucagaacagcgucccacauuacgcugaagccgauaucgucacucuccagggcguuacaggcgguaauacuuacgccguucccgcccucccgccuggcgcagugggggauggccccccucgcguggacuuuccgcgcuccagacugcgguucaaagagaaguuaggggaaggccaguuuggggagguccauuugugcgaaguugacuccccacaggaccucgugucauuagauuuuccacugaaugucaggaaggggcacccccuccugguagcugugaaaauccugcggccugaugcaaccaagaacgcacggaacgauuuucucaaggaaguaaaaauaaugucccgacugaaggaucccaacauuauccgacugcuagggguguguguucaggaugauccucuuuguaugauuacugacuacauggaaaauggggaccuuaaccaguucuugucugcucaccagcuggaagauaaggcugcggaaggggccccaggcgacggccaggccgcucagggcccuacaaucuccuaucccaugcuucuccauguggccgcacagauugcuuccggcaugcguuacuuagcuacccuuaauuuuguucauagagaucuugccacucggaauugucugguaggugaaaacuuuaccauuaaaaucgcagauuucggaaugucuagaaaucuuuaugcaggggacuauuacaggguucaggggcgggcaguuuugccaauucgauggauggccugggagugcauucugaugggaaaguuuaccacagcuucugacgugugggcauuuggggugacucugugggagguucugaugcuuugccgagcucagccuuucggacagcugacagaugagcaggucauugagaacgccggugaauucuuucgcgaccaaggacggcagguguaccugaguaggccuccugccuguccacaggggcucuacgaguugaugcugagaugcuggagccgagaguccgagcagcggccaccauuuagccagcuucauagauuucuggccgaagaugcccucaacaccguuuag

SEQ ID NO: 12821 - RNA, 942 nt, Artificial Sequence
  Description of Artificial Sequence: Synthetic coding sequence
auguccgaccuacuccuucugggacuuauaggcgggcugacucuauugcuacuccugacccuccuggccuuugccggguauucaggguugcuugcaggcguugaggucucagcaggaucaccaccaauccguaacgugaccguugccuacaaauuucauaugggcuuguauggugaaacggguagguuguucacugaaagcuguucuauaagucccaaguugaggucuaucgcuguguauuaugacaauccgcacauggugccacccgauaagugucgaugcgcugugggcucuauccugagugaaggcgaggagagucccucaccagaacugaucgaucucuaucagaaguuugguuuuaagguguuuucguuuccugcuccaagucacguggucacagccacuuuucccuauaccaccauuuugagcaucuggcuggccacacgucgcguucacccagcacuagauaccuauauuaaagagagaaaacugugcgccuauccacgucuggaaaucuaccaagaggaccaaauccauuuuauguguccucuagcccgccaaggcgauuuuuaugugcccgaaaugaaagaaaccgaauggaaauggcgagggcuagucgaggcaauugacacgcagguggacggcacuggcgccgauaccaugagcgacacgucuucuguuagcuuggaaguuucaccugggucacgcgaaacauccgcagcaacacugucccccggggcaucaucacggggcugggacgauggggacaccaggagugaacacucguauuccgaaagcggagcuagugguucuuccuucgaggagcuggaucuugagggugaagguccgcugggugagagcagacuugauccuggaacugagccucuggggacaaccaaauggcucugggagccuaccgcuccugaaaaggggaaagaauag

SEQ ID NO: 12822 - RNA, 843 nt, Artificial Sequence
  Description of Artificial Sequence: Synthetic coding sequence
augaagacauuuacuuggacccugggcgucuuguucuuccugcucguagacacgggccauugccgcggggggcaguucaagaucaagaagauaaaucagcgaagauacccaagaacuauaaaggacaugauaacaaggauggaccuggaaaaucugaaggaugugcuuucccgucaaaaaagagagaucgacguucugcaacuggucguugacgucgauggaaauaucgucaaugagguuaagcugcugaggaaggaguccagaaauaugaauucaaggguuacccagcucuacaugcagcugcugcacgagauuauuagaaaacgagauaauagccucgagcugagucagcuugaaaacaaaauucuuaacgucacuacagagaugcugaaaauggccacuagauauagggagcuagaggugaaguaugcuucauugacagacuuagugaacaaucagagugucaugauuacccugcucgaagaacagugccugagaauuuucucucgucaggauacucacgugucuccgccgcugguccagguaguuccgcagcauauucccaacucccaacaguauacucccggauuacuaggaggcaaugaaauccaacgcgacccuggcuacccccgggacuuaaugccccccccagauuuggccacuucuccaacaaaaagcccauucaaaauuccaccgguaacguuuaucaacgaaggcccuuucaaagauugucaacaggccaaagaggcuggccacucuguaaacgguauuuucugggcagaauauagagguggcagcuacucucuucgggcugugcagaugaugaucaagccuaucgacuag

SEQ ID NO: 12823 - RNA, 522 nt, Artificial Sequence
  Description of Artificial Sequence: Synthetic coding sequence
augcacuggaaaaugcuccugcugcuguuguuguacuacaaugcugaagcaucuaugugucacagguggagccgcgccguucuuuuccccgccgcacaccgaccuaaacguuccaguucccucccccucaauccgguccuacagacgucacucgaagagguagagcuucuuuaugaauuccugcuugccgagcuugagaucucuccugaccugcaaauuagcauuaaggaugaggagcucgccucccugcgaaaggccucagauuuuagaaccguuuguaacaaugugauuccuaaaaguauccccgauauccgcagacuuuccgcuagucuguccucacacccagguauacuuaaaaaagaagacuuugaaagaacuguuuuaacccuugccuauaccgcuuacagaacugcucuuucccaugggcaucagaaggacauuugggcucagagccuggucagccuguuccaagcucuuagacacgaccucaugcggaguagucaaccuggcgugccacccuag

SEQ ID NO: 12824 - RNA, 309 nt, Artificial Sequence
  Description of Artificial Sequence: Synthetic coding sequence
auggaaaggggggcaggcgcaaagcucuuaccacugcuccuccugcuucgggcaaccggguuuacgugcgcucagacagacggcagaaauggauacacugcggugaucgaagucacuucaggaggaccuuggggggacugggcuuggccagagaugugccccgacggguucuuugcaaguggguuuucuuugaaaguggagccuccgcagggaauaccaggcgaugauacagcuuuaaauggaauacgguugcacugcgcucgcggaaacgugcuugguaacacucacgugcuaggccguauggaguag

SEQ ID NO: 12825 - RNA, 351 nt, Artificial Sequence
  Description of Artificial Sequence: Synthetic coding sequence
auggccgcuggauccgccccaaugcagcugcaucuccgcgcuaccaucaggaugaaggacggucucugugugccuagaaaguggauuuaccaccucacagagggaagcaccgauuugaggacagaggguaggcccgauaugaaaacugagcucuuuuccucaagcugcccuggggguauuaugcugaacgaaacuggacaggguuaucaaagguuccugcuguacaacagaucuccacacccaccugaaaaaugcguagaggaguucaaauccuuaaccuccugcuuggauagcaaagcuuuuuuacugacaccaaggaaucaagaggcuugcgaacuguccaacaauuag

SEQ ID NO: 12826 - RNA, 1137 nt, Artificial Sequence
  Description of Artificial Sequence: Synthetic coding sequence
uaauacagcggcgacuacauggaaccggaaaaaccuggugccccauuguuaccgcccccaccacaaaauuccgucccgcacuacgccgaggcugauauuguuacauuacaaggcguuacaggaggaaauaccuacgcuguaccugcauugccaccaggugccgugggggauggaccuccaagagucgauuucccccggucucgauuacgguucaaggaaaaguugggcgagggucaguuuggcgagguccaccuuugcgagguugacucaccccaggaucugguuaguuuagacuuuccacugaacguccgcaagggccaccccuuacugguugccgugaagauacuaagacccgaugccacuaaaaacgcaucauuuucccucuucagccgcaacgauuuccucaaggaggucaagaucaugucaagacugaaggaccccaacaucauccggcuucucggcguguguguccaggacgaccccuugugcaugauuaccgauuacauggagaacggcgacuuaaaccaguuccuuagcgcucaccagcucgaggauaaagccgcugagggugcucccggcgauggccaggcugcccaggguccaaccaucuccuacccaaugcuccugcacguugccgcccaaauagcaucagggaugagauaucuagccacccugaacuucgugcaccgggacuuagccacaaggaacugccugguuggcgaaaacuucaccaucaagauugcagauuuuggaaugucaagaaacuuguacgccggugacuacuacagaguucaaggcagagcuguacugccuauccgcuggauggcuugggaauguaucuuaauggguaaguucacaacagcguccgacgugugggcauucggagucacacugugggaggugcuaauguuauguagagcgcaaccuuuuggccaguuaacagaugagcagguuauugaaaacgcuggggaauuuuuucgagaucagggacgccagguguaccugucucgcccucccgccuguccacagggucuguacgaacugauguugagaugcuggucaagagaaagcgaacaacgcccucccuucucacagcuucacagguuucuugcugaggacgccuugaauacgguuuag

SEQ ID NO: 12827 - RNA, 942 nt, Artificial Sequence
  Description of Artificial Sequence: Synthetic coding sequence
auguccgaucugcugcucuugggcuuaaucggcggcuuaacguugcugcugcugcugacuuugcucgcauucgcugguuacaguggacuuuuggcagguguugaggugucagccggaucucccccaauuagaaaugugacggucgccuauaaguuucacaugggucuauacggcgaaaccggacgacuguucaccgaaaguuguaguaucagcccaaagcuuagguccaucgccgucuauuacgacaauccccacaugguuccuccugauaagugucgaugugccguuggaucaauccuuucugagggugaggaaagucccuccccagaacuaauagaccucuaucagaaauucgguuuuaaaguguucucuuuccccgcgccaucacacgucguuacggccacuuuucccuacaccaccauuuugucaauaugguuggcaacccgccgcgugcacccggcucuugauaccuacauuaaagaaaggaaguugugugccuauccaagacucgaaauuuaccaggaggaccagauccauuucauguguccucucgccaggcagggggauuuuuaugugcccgagaugaaggagaccgaauggaaguggagagggcuuguggaagcuaucgauacgcaaguggacggaaccggcgccgauaccaugucugacacaagcagcgugucucuggaggugucaccaggcagucgcgaaacauccgcagccacccucaguccaggggccagcagcagggggugggacgacggugacacacgcucugaacacagcuacagcgaaagcggggcaucaggaucaucguuugaagaauuagaucuagagggggagggaccauugggagagagcagacuagacccgggcacugaaccuuuagguaccaccaaauggcucugggagccaaccgccccagagaaagggaaagaauag

SEQ ID NO: 12828 - RNA, 420 nt, Artificial Sequence
  Description of Artificial Sequence: Synthetic coding sequence
auggggccugaggcgcugucgagccuccuacuacugcugcuuguggcuuccggugacgcagauaugaaaggacacuucgaucccgccaaaugucgcuacgcccuuggaaugcaagaucguaccauuccugauuccgacaucucugccuccucuucuugguccgacuccaccgccgcgcgccauagucggcucgaaagcucugacggcgacggcgcuuggugcccugcaggcucaguguuuccaaaggaagaagaauauuuacaggucgaccuacagcgacugcaucuggucgcccugguagguacacagggaaggcaugccggaggauugggaaaggaauucucucgaaguuaucgucuaagauauagccgagaugggcgcagauggauggguuggaaggaucguuggggccaggaguag

SEQ ID NO: 12829 - RNA, 342 nt, Artificial Sequence
  Description of Artificial Sequence: Synthetic coding sequence
auggauaauguccaaccuaaaauuaaacaucgccccuucuguuucagugugaaaggucacgugaagaugcugcgacucgccuuaaccguaacuagcaugacauuuuuuaucauugcacaagcccccgagccauacauuguaaucacuggguucgaaguuacagugauccucuucuuuauccugcuguacguucucagacuggacagacucaugaaguggcuguucuggccucuacucgacauuauuaacagucuugugaccaccguauucaugcuaauaguuagcgugcuagccuuaauccccgagacuaccacccucaccguugguggcggccuguucuag

SEQ ID NO: 12830 - RNA, 465 nt, Artificial Sequence
  Description of Artificial Sequence: Synthetic coding sequence
auguuuggcuggggagacuuucacuccaauaucaaaacaguaaagcugaaccugcuuauuacaggcaagaucguggaccaugguaacggaacuuuuaguguguacuucaggcauaacucuaccgggcaggguaauguaucugugucacuuguaccacccacaaagaucgucgaguuugaucuugcccaacaaacaguaauugaugcuaaagauagcaagaguuucaauugcaggauagaauaugaaaagguagacaaagcgaccaaaaauacccucuguaacuacgacccaaguaaaacgugcuaccaggagcaaacccagagucacguuagcugguuauguuccaagccauucaaagucauuugcauauacaucucuuucuauucuacugauuauaaacuggugcagaaagugugccccgacuacaauuaucacucagacacaccauauuucccaagcggguag

SEQ ID NO: 12831 - RNA, 531 nt, Artificial Sequence
  Description of Artificial Sequence: Synthetic coding sequence
auggccgauaugcagaaucucgucgaacgcuuagagcgugccguugggcgccuugaagcuguaucacauaccagcgacaugcacagaggguacgcagauucgccaucuaaagcaggcgccgcccccuacguacaggcauucgauagucugcucgccggcccuguugcagaguacuuaaagauuuccaaagagaucgggggggacguacagaaacacgcagagaugguacacaccggacugaagcuagagcgggcucuguuggugacggccucucagugucagcagccagccgagaacaaacuuucagaucuacucgcuccaaucucggaacagauaaaggaggugauuaccuuuagagagaagaaccguggcaguaagcucuucaaccaucucucugccgugagcgagagcauucaggcuuugggcuggguugcuauggcccccaaaccgggcccguacgugaaggagaugaaugacgcagcuauguuuuauacaaaccguguacugaaggaguauaaagaugucgacuag

SEQ ID NO: 12832 - RNA, 2535 nt, Artificial Sequence
  Description of Artificial Sequence: Synthetic coding sequence
augggacccggggcgcccuuugccagggucggauggccauugccccuccucgugguuauggccgcagguguugcucccguuugggcaucucacaguccacaucugccaagaccucacucccgaguuccuccccauccaucuagcgaacgcagggccguauauauuggcgcucuguuuccgaugaguggcggauggccugggggccaggccugccagccugccguagagauggcuuuggaagacgucaauucucgaagagacauuuugccggauuacgagcugaaacuuauccaccacgacuccaaaugcgacccaggacaggcaaccaaauaccuguacgagcugcuguauaaugacccuaucaagauaauccugaugcccggcugcaguuccguuaguacucuuguggcggaggcugcucggauguggaaucucaucguccucaguuacgguaguuccagccccgcgcucagcaaucgacagagguucccgaccuuuuuucgcacucacccuucugcuacacuucacaacccaacgcgagugaagcuguuugagaaguggggauggaagaagaucgcaacuauccagcaaaccacugaaguguuuacuagcacgcuggacgacuuggaagaacgagugaaagaagccggaauugaaaucacuuuuagacagucauuuuuuucagacccugcgguuccggucaagaauuuaaaaagacaggacgcccgaauuauugugggccuuuuuuacgaaacagaggcacggaagguuuuuugcgaaguuuacaaagagcgucuguucggaaagaaauacguaugguuccugauugggugguaugccgauaauugguucaagauauacgacccuucaaucaacuguaccgucgacgagaugacagaagccguugagggacauauuacaacagagaucgugaugcugaauccagccaauacgagaagcauuucaaacaugaccucccaggaauucguggagaaguugacuaagcgccugaagaggcauccugaagagaccgguggauuucaggaagcuccucuggccuacgacgcaauuugggcuuuggcgcuugcacugaacaagacuagcggcgggggaggucgauccgggguucggcuugaagacuucaauuacaacaaccagaccaucaccgaucagaucuaccgcgcgaugaauuccucuucuuucgagggcgugucgggacacguuguuuucgacgcuucaggaucaagaauggcuuggacccugaucgagcagcuccagggcggauccuauaaaaaaauuggcuauuaugauaguacgaaggacgaucucucuuggagcaaaacugacaaauggauaggaggcucgcccccagccgaccaaacucugguuaucaagaccuuucgguucuugucccagaaguuauuuauuucagugagcgugcucagcuccuuaggaauuguuuuagcuguagugugccuuucuuuuaacauuuauaauucccauguacguuauauacagaacucacaacccaacuugaauaaucugacagccguagguuguagccuugcccuggccgccguguuuccacuaggacucgauggauaccauaucggccgcaaucaguuucccuucgugugucaggcccggcuaugguugcuaggacuaggguuuucuuugggauacggauccauguuuacaaagauuugguggguccacacgguuuucaccaaaaaagaggaaaagaaagaguggcggaagacucuugagcccuggaaacuguaugcuaccguuggacugcucgucgggauggacguguugacccuggccauuuggcaaaucguugacccucuacacagaacaaucgagacguuugcgaaggaagagccaaaagaggacauugacguguccauccugccacagcuggagcauuguaguagucguaaaaugaauacauggcuuggcauuuuuuaugguuacaagggccuccuccugcuccugggcauauuccuugcuuacgagacuaagaguguguccaccgagaaaaucaaugaucaccgagcggugggcauggccaucuauaauguugccgugcugugucuuauaacagcccccguuacuaugauucuaaguucacagcaggacgcggcauuugcuuuugcuucucuggcuauuguguuuuccucuuacaucacacuaguuguucucuucgugcccaagaugaggcgucuuauaacucggggcgaguggcaaagcgaggcccaggacaccaugaagacuggauccuccacaaacaacaaugaagaggagaagucacgcuuacuggaaaaggagaaccgcgaacucgagaagaucauagccgaaaaggaggagcggguuagugagcuaaggcaucaguuacaaagcaggcaacaguugcguagucgcagacauccgcccacccccccggagccuucaggugggcuucccagaggccccccugagccaccugaccgacugucuugugaugggucucgaguacaucuccucuacaaauag

SEQ ID NO: 12833 - RNA, 2055 nt, Artificial Sequence
  Description of Artificial Sequence: Synthetic coding sequence
uagccccguucuuccacccaugugccccucguccugccucuacucguuuuacuguugcuagcaccugcccgccaggcagcugcucagaggugcccacaggcgugcaucugcgauaauucacgaaggcauguggccugccgauaccaaaauuuaaccgaagucccagacgcgaucccagagcugacacaaaggcuugaucuacagggcaaccugcugaaggucauacccgcagccgccuuccagggcgucccacaucucacgcaccucgaccuacgacauugcgaaguugagcugguggcagaaggggccuuuagagggcuugggaggcugcugcugcugaaccuggccagcaaccaucugcgugaacugccucaggaagccuuggacggccuuggcucacugcgacgccucgaguuagaaggaaaugcccuagaagagcuucgacccggcaccuuuggugccuuaggggcccuugcaacucucaaccuggcacacaaugcccuaguguaucugccugcgauggcauuucagggacuacugagagugcgcuggcuaagacucucccauaaugcgcugucugugcuggcucccgaggcucucgcagggcugccggcucugcgucgacugagccuccaucacaacgagcugcaggcuuugccagggccaguucuuagccaagcucgugguuuagcacggcuggaacuggggcacaauccuuugacauacgcaggcgaggaagacggcuuagcacugcccggccugcgugaacugcuucuugauggcggcgcgcugcaggcccucggcccgcgcgccuuugcucacuguccaaggcugcauacccuugaucuaagagguaaucagcuggauacauuaccaccucugcagggcccaggccaacuucgucggcuccguuugcaggggaauccacuuugguguggaugucaggcucguccccuacucgaguggcuggcgagggcucgggugaggagugauggugcgugccagggucccagaagacuacggggcgaggcuuuggacgcuuuacggccgugggaucugcgguguccaggcgaugccgcccaagaagaagaggaacuggaggagagagccguugccggcccgcgugccccaccaagaggaccaccccggggaccaggcgaagaacgugccguggccccuugcccaagggccugcguauguguucccgaguccagacacucaucaugugaggguuguggccuucaagcgguuccuaggggcuucccuucagacacccagcuccuggaccucaggaggaaucauuucccaagugucccaagggccgcuuuccccgggcugggacaccuugugucauuacaucuccagcacuguggcaucgcugagcucgaggcgggcgcgcuugcaggacuuggaagacucauuuaccuguaucuuagcgauaaccaguuggccggccuuucugcagcugcacuggaaggggcaccccgccucggauaccuuuaccuggaaagaaaccgcuuccuccaaguaccaggcgccgcccuaagagcccuuccuagccuauucucacuucacuugcaagacaacgccgucgacaggcuggcuccuggagaccugggcagaacccgcgcucugcggugggucuauuugucggguaaucguaucacggaggugucauugggggcccugggccccgcccgcgaacuggagaaacugcaccuagacaggaaucaauugagggaaguuccgacaggcgcacuagaaggguugccagcucuacuugaacugcagcucucuggaaauccccuucgcgccuuacgagacggcgcuuuucaaccggucgguaggagccuccagcaucuguuucugaacucuuccggcuuagaacagauuuguccuggcgcauuuaguggacugggccccggguugcagucacugcaccuucagaaaaaccaacucagggcccuaccagcccugccgucagcccgaaggaccccaaucaagggacggcaguguggggcugacaaaguugguaaagaaaaagggagacuuuag

SEQ ID NO: 12834 - RNA, 2259 nt, Artificial Sequence
  Description of Artificial Sequence: Synthetic coding sequence
auggcuagacaccugcuauugccguuggucaugcucgucaucucucccauuccuggcgccuuccaggacagugcccugaguccaacccaggaagaaccggaagaccuggacuguggacgcccagagccaucagcuagaauuguggguggaaguaaugcccagccuggcaccuggccuuggcaggugagucugcaccacggcggcggccauauauguggaggcucucuaauugcucccuccuggguuuugucugcagcgcauuguuuuaugacaaacggcacacuggagccggcagcugaguggucugugcuccugggaguccacagucaggaugguccccucgacggagcccacacgcgagccguagccgccauuguagugcccgcuaauuacagucaaguugaauugggagccgaucuugcccuuuugcgccuagccucacccgcuagucuggguccugccgucuggccagugugcuugccgcgcgcuagucaccguuuuguccacggcacagcguguugggccaccgguuggggagacgugcaggaggcugacccuuugcccuugccauggguccugcaggagguggaauuaagguugcugggagaagccaccugccagugcuuguacagucagccaggcccuuuuaaccuuaccuuacaaauucugccgggaaugcugugugccggguaccccgaaggacgccgggauaccugucagggggauucuggagggcccuuggugugcgaagaggggggucggugguuccaagccgggaucacuucuuucggcuucggaugugggcggagaaaccgaccagggguuuuuaccgcuguggcaaccuaugaagcauggauccgcgaacaaguaauggguuccgagcccggaccugcuuucccuacgcagccucaaaagacgcaguccgauccacaggaaccaagagaggagaacuguaccauugcgcucccggaguguggcaaagcucccaggccuggugcauggccaugggaggcgcaggucauggugccugguucucgcccuugccauggagcauugguuagcgagucuuggguacuugcuccagccucauguuuuuuggacccuaacuccagcgauagcccccccagggaccuggacgcauggcguguacugcugccauccagaccuagagcugaacguguggccagacucgugcagcacgaaaacgcuuccugggacaaugcuucagaucucgcucuauuacaauugagaaccccugugaaccugagugcagccagccguccaguuugccugccacaucccgagcacuacuuucuuccuggcucacggugccgucuugcccggugggggcgaggugagccagcuuuaggaccaggagcacuacuggaggccgaacuuuuaggcggcugguggugucacugucuguaugggcgacaaggcgccgcagugccucugcccggcgacccuccucacgcguugugucccgcauaucaggagaaagaggaggucggaucuugcuggaaugacucacgcuggucacugcugugccaggaagagggaaccugguuucuggccgggaucagagacuucccgucaggaugccugcggccucgggccuuuuucccucuucagacacacggcccuuggauaagucaugugacccggggagcauaccuggaggaccaacuagcuugggacugggggccagauggagaagaaacagagacucaaaccugucccccgcacacugagcacggggcuuguggacuuaggcuagaggcggcgccugucggcguuuuguggccuugguuagcugagguucacgucgccggagacagagucugcacgggcauucugcuugcaccagggugggugcuggccgccacucacugcguguuacggccuggcaguaccacugucccauauaucgaggucuaccugggaagggccggggccucuagucugccucaggggcaucaaaugaccagcgcccccccucuccucugucagaugacagagggaaguuggauccucgucggcauggccgugcagggaagcagagaacuguucgccgccauuggcccagaagaagcuuggaucucccagacggucggagaggcuaacuuccugccuccuuccgggucuccccacuggccuacagguggcagcaacuuauguccccccgagcucgccaaagccucaggcucuccacacgccguauauuuuuuguuacuacugacccuguugauacaaucauag

SEQ ID NO: 12835 - RNA, 453 nt, Artificial Sequence
  Description of Artificial Sequence: Synthetic coding sequence
augcgcuucauggcuggcccugccggaucacagucccugggcccauuaugcuuucacucauccccacaggcccuuuacaccguccugcugaucguacucgugaugaugucucugguuuucggaaaguucgugcccgucaauugggagccuccucaaccccucccauuccccaaguaucugcgaugcuacagaugucuccucgaaaccaaagaacuggggugccuguuggggucagacaucugccugacccccgccgguucuagcugcaucacacugcacaagaaaaauucuagcggcucugacguuauggucuccgacugccgaaguaaagaacaaaugagcgauugcuccaacacacgaacaagcccaguaucaggauuuuggauuuucucucaguauugcuuccuggacuuuuguaaugauccgcaaaaucggggacuuuauacgcccuag

SEQ ID NO: 12836 - RNA, 1161 nt, Artificial Sequence
  Description of Artificial Sequence: Synthetic coding sequence
augaaguuccaagggccacuagccugccuuuugcuggcgcugugucugggaucuggggaggcuggaccccuucaguccggggaagaauccacuggcacuaacaucggagaagcgcucggccauggccugggcgaugcgcuguccgaggguguaggcaaagcuauaggcaaagaagcaggaggagcagcaggcucuaaagucagcgaagcacuuggacaggguacuagggaagcaguugggacuggcgugcggcaagugcccggauucgggguggcagaugcccuggguaaucgcgucggagaggccgcgcacgcucuggggaauaccgggcaugagaucggaagacaagcagaagaugucaucagacacggcgccgaugccguccgugggagcuggcagggcgugcccgggcacaacggcgcuugggaaacuucaggaggccauggcauauuugguucucagggcggacuugguggucagggacagggaaauccaggcgggcuggggacgccgugggugcacggguaccccgggaacagugcagguaguuuugggaugaauccccagggagcacccugggggcagggaggcaacggaggacccccaaacuucgguaccaacacacagggggcaguggcacagccaggguacggcuccgugcgcgccagcaaccagaacgaaggguguaccaaccccccccccucugguucaggaggcggcagcucgaauucuggcggaggaucagggucucagucugggucuucugggagcggcuccaauggcgauaauaacaacgggucuagcagcggugguuccagcuccgggagcucuucuggcggcaguucaggcgguucuagcggaggcuccucuggaaauucuggcggaucccgaggugauucggggagcgaaucaucuuggggcucuucaacuggcagcaguaguggaaaccaugguggcucuggaggcggaaacgggcauaaaccgggcugugaaaagccaggcaaugaagccagaggaagcggcgaaagcgggauucagaauuccgagaccaguccaggcauguuuaacuuugacacuuuuuggaaaaauuucaagagcaaacugggauuuauuaacugggacgccauuaacaaagaccaacggagcagcaggaucccuuag

SEQ ID NO: 12837 - RNA, 1995 nt, Artificial Sequence
  Description of Artificial Sequence: Synthetic coding sequence
augaagacuggguuguuuuuccuuugccuacuaggcacugccgcugcaauuccaacaaacgcucgcuuacucagcgaucacuccaagccaacugcagaaacugucgccccugacaacaccgccaucccuuccuugcgagccgaggccgaggagaaugagaaagaaaccgccgucucgacugaggacgacagccaucacaaggccgagaaaucuucuguccugaaaaguaaggaggaaagucaugagcagucugcugagcagggaaagucaagcagccaggagcuuggccugaaggaccaggaagauuccgauggacacuuaucaguuaacuuggaguacgccccuacagagggaacucucgacauuaaagaggacauguccgaaccucaagagaagaagcuuagugaaaauacugacuuucuggccccgggagucagcucauucacugacuccaaucagcaggagagcauaacuaaaagggaggaaaaucaggaacagccgagaaauuacagccaucaucaacugaaccguagcaguaaacauagccaaggauugcgggaccaagggaaucaggagcaggaccccaauaucagcaauggagaggaagaggaggagaaggagcccggcgaagugggcacccacaaugacaaucaggaacgcaaaacugaacugccaagagagcacgcuaacucgaagcaggaagaggauaacacacagagcgaugacauccucgaggaaucggaucagccuacacaggucucaaagaugcaagaagaugaauuugaccaaggcaaccaagagcaggaagauaauuccaacgccgagauggaagaagagaaugccucaaacguuaauaagcauauccaggaaaccgaauggcagagccaagaaggcaaaacaggacuggaggccaucaguaaccauaaagagaccgaagaaaaaacagucuccgaggcccuacugauggagccaaccgaugaugguaacacgacaccaaggaaccacggggucgacgacgauggggacgacgauggcgaugauggcggcacggauggaccuaggcauuccgccagcgacgacuacuuuaucccuagccaggcguuuuuagaggcugagcgcgcccagucaauugccuaucaucucaagauagaggaacagcgcgagaaagugcacgaaaacgaaaauaucgggacuacugaaccaggugaacaucaagaagcuaagaaagcugagaauaguagcaacgaggaagagacaucuucagagggaaauaugcgaguccaugcgguggacaguugcaugagcuuccaguguaaacgcggccacauuuguaaagccgaccagcaggggaagccgcacugcguuugccaggacccaguuacaugccccccaacaaagccccuggaccaaguaugcggcacagacaaucaaacuuaugcaaguagcugccaucuauucgccacaaagugcaggcuggaagggacuaagaaaggccaucaguuacaguuagacuacuucggagccuguaaaucaauacccacauguacagauuuugagguuauacaguucccauugagaaugagagacuggcuaaagaacauccuuaugcaauuguacgaagcuaauucugagcaugccgguuaucucaacgagaaacaacgaaauaaagugaaaaagaucuaccucgaugagaagagguuguuggcgggggaccacccaauugaccuccuguugagagacuucaagaagaacuaccacauguacguguaucccguccacuggcaauuuagcgaguuggaucaacacccuauggaccgggugcuuacucacuccgagcuggcgccauuacgugccagccuaguuccuauggagcacugcauuacccgauuuuuugaggaaugcgaccccaacaaagacaagcauaucacauuaaaggaauggggccauuguuuugguauaaaggaagaagauaucgacgaaaaccuccuuuuuuag

SEQ ID NO: 12838 - RNA, 420 nt, Artificial Sequence
  Description of Artificial Sequence: Synthetic coding sequence
augggacccgaagcccugagcuccuuacugcugcuccuguugguagccaguggagaugcagauaugaagggacauuucgaucccgccaaguguagauacgcccuaggaaugcaggaccgaaccauucccgauagugauauuucggcauccuccaguuggagcgacuccacagccgcgagacauuccagguuggaaagcagugacggggacggggcuuggugcccugcaggcagugucuuucccaaggaggaggaauaucuccagguugaucuucagcgauuacaccucgucgcuuuggucgggacacagggaagacaugcuggcggccucggcaaggaauuuucccgcuccuacaggcuuagauauagcagggacgggcgacgauggaugggcuggaaggaccgaugggggcaagaauag

SEQ ID NO: 12839 - RNA, 285 nt, Artificial Sequence
  Description of Artificial Sequence: Synthetic coding sequence
augcaacacucacugguguucuucuucgcugugauuuuacaucuuucacaucuucuccacuuagaugcuagcauccaucccuuccgcuugccauuuuccuccaaaccauuccugcucauccccaugucaaacaccacccugccccauaccgcauggccgcuuaguuuucugcaucagacuguuaguacccugaaagcugucgccguuacacacagccucuggcaccuccagauucccguggacugccaagcuuguaacagaaagaguaagaagaucuacugcuag

SEQ ID NO: 12840 - RNA, 699 nt, Artificial Sequence
  Description of Artificial Sequence: Synthetic coding sequence
augcuuccuaaguccagacgcgcucugaccauucaggagauugccgcucucgccagaagcucauugcauggcauuagucaaguggucaaggaucaugucacaaaaccuaccgcuauggcgcagggccggguagcccaccuaaucgaauggaaaggcuggagcaaaccauccgauucaccagcggcccuggaaagugcguucucuuccuacagugaccugagcgaaggggagcaggaagcaagauucgcugcuggugucgcugagcaguuugcgauugcagaagcuaagcuuagggccuggagcucaguugacggggaagacucgacagaugauuccuacgacgaggacuucgcgggcggcauggauaccgauauggcgggacaguuaccacugggcccccaucugcaagaucuguuuacagggcauagguuuagucggcccguccgccaggggucuguggaacccgaauccgacuguucccaaacuguuuccccugauacgcuguguaguucauuguguagccuggaagacggccugcuggguagcccagcucgucuugccagccaauuacucggcgacgaacuuuugcuggcgaagcucccccccucccgagaaucagcuuuuaggaguuugggcccccuagaagcucaggauuccuuauacaauagcccucugaccgagaguugucuuaguccauag

SEQ ID NO: 12841 - RNA, 2631 nt, Artificial Sequence
  Description of Artificial Sequence: Synthetic coding sequence
augggacccgaggcauuguccagucugcugcugcuucuccugguggcgucuggagacgccgacaugaaagggcacuuugacccagccaagugcagguaugcguugggcaugcaagaccggaccauuccugauucugacauuuccgccucuuccuccuggucagauagcacagcagcuaggcacagccguuuggagaguuccgauggggauggggcuuggugcccagccggauccguguucccaaaagaagaagaguaucugcaggucgaccuccaaagguuacauuuagucgcccuuguaggcacacaggguagacacgcuggagggcuuggcaaagaguucucccguucauaccgguuaagguauagccgagauggccgcagauggaugggcuggaaagacagauggggccaagaaguaaucucagggaaugaggaccccgagggcguaguucuuaaggaucucggaccuccaaugguugcacgacugguacgauucuacccccgcgccgauagggugaugagugucugcuuacguguugaguuauacggcugccuguggcgagacggucuucucucguauacagcuccggucggccaaaccauguaccuuagcgaggcuguguaccucaaugacucaacguacgaugggcacacggucggggggcuucaguacgggggccugggacaacuggcagacgguguaguuggccucgacgauuuccggaaaucccaggagcugagggucuggccgggcuaugacuauguggguuggucaaaucauagcuuuagcucugguuacguggaaauggaauuugaguuugauagauuacgggccuuucaggccaugcagguacauugcaacaauaugcauaccuugggggcuagacugccuggaggcgucgaaugccgcuuuagacgggguccugccauggcaugggaaggugaaccgaugcggcacaaucuuggugggaacuuaggggacccccgggcuagagccguuagugucccacuuggcggccgcguugcacgguuucugcaaugcagauuuuuguuugccgggccguggcugcuuuuuagugaaaucucuuucaucuccgacguggucaauaauucaucaccugcccuaggcggcaccuucccuccugcucccugguggcccccugggccgccacccacaaacuuuucuucccuugaacuugagccucggggacaacaacccguugccaaggcugaggggucccccacagcuauucugauuggcugccucguugcgaucauacuauugcuucugcugauuauugcucugaugcucuggaggcuucauuggagaagacugcugucaaaagcugaacgcagaguacuggaggaagagcugacgguccaucuaagcgugccgggagauaccauacugauaaacaaccgcccagggccccgugaaccgccuccguaccaggaacccaggccgcgcgggaacccaccccacuccgcucccugugugccaaacgggucagcauacuccggagacuacauggagcccgagaagcccggcgccccgcugcuucccccacccccccagaacagugucccucauuacgcagaagccgacaucgugacccuacagggcgugaccggagguaacaccuacgcagugccugcuuuacccccaggggccgucggcgacgggccuccucgcguggauuuuccuagaagccgauuacgguuuaaagagaagcugggugagggccaauuuggagagguacauuugugcgaaguagacucuccacaagauuuggugucucucgacuuuccacuaaacguucguaagggacauccuuugcuuguugccgucaagauccugagaccggacgcaacuaaaaacgcuaggaaugacuuccuuaaggagguuaagauaaugucucggcuuaaggacccaaauaucauuagguuacucgguguuugcguucaggacgauccgcuauguaugaucacagacuacauggagaacggcgaccuaaaccaguuucucucagcacaccagcuggaggacaaggccgccgagggagcaccuggagauggacaggccgcccagggacccacgaucucuuacccaaugcucuugcaugucgccgcacagauugcgagcggcaugagauaucucgcaacucucaauuucgugcaccgagaccuggccacucguaacugccuggugggcgaaaacuucacaauuaagaucgccgacuucgggaugagcagaaaucuguaugccggagacuauuaccgcgugcaggggagagccguucucccuauccgcuggauggccugggaauguaucuugaugggcaaauuuacuacagcaucagaugugugggccuuuggugugacauuaugggaaguguugaugcuguguagggcgcaacccuuuggccaguuaacagaugaacaggugaucgagaacgcuggugaguucuucagggaccagggaaggcaggucuaccuuucucgcccgccugcuuguccacaaggccuguaugagcuuauguugcgcugcuggucgagggagucggagcagaggccuccuuuuucucagcuacacagauuucuggcagaggacgcccugaacaccguguag

SEQ ID NO: 12842 - RNA, 165 nt, Artificial Sequence
  Description of Artificial Sequence: Synthetic coding sequence
augugucgcgaaaccgccgguuacgggugguuacuggcaaguacugagcuguuaagccuccuggagccacucucaccccaguuacucaaagagcauauuucuugcacaagccagguagcugcaggagccaaagucacccccgauucugccguaugggccccguag

SEQ ID NO: 12843 - RNA, 2256 nt, Artificial Sequence
  Description of Artificial Sequence: Synthetic coding sequence
auggcauuuaggaccaucugugugcucgugggcguguuuaucuguuccauuugugugaaagguuccagccagccucaggccaggguguaccucaccuucgaugaguuaagagagacuaaaacuuccgaauacuuuucacugucacaucacccacuggauuauagaauucugcucauggaugaggaccaagacagaauuuacgucggaagcaaggaucauaucuugucccucaauauaaacaacauaucacaagaggcucugagcguauuuuggccugcaucgacaaucaaaguggaagaauguaagauggcagggaaagauccaacucaugguugugguaauuuuguaagaguaauucaaacauuuaacagaacucaccuauacgucugcgguuccggugcauucagcccaguuugcacguaucugaacagagggcggcgcagcgaggaucaaguuuuuaugaucgacucuaagugugaguccggaaaaggaagguguucauuuaaccccaacguuaacaccgugaguguaaugaucaacgaggaacucuuuagcggcauguacauugacuuuauggguacugaugcagcuauauuucggucacugaccaagcgcaacgccgugaggacagaucaacauaacagcaaaugguugagugaaccuauguuuguggacgcacacguuauccccgacggaacagacccuaacgaugcuaaggucuacuuuuucuuuaaggaaaaacuuaccgauaacaaccggucuacgaagcagauccauuccaugauugcccgcaucugcccuaaugauacuggcggcuugcggucgcucgugaauaaauggaccacuuuucugaaagcuagauuggucugcagcgucaccgacgaggauggaccggagacccacuucgaugaacucgaggauguguuucuucuugaaacagacaaucccagaacuacguuaguguauggaauuuucacaacuagcuccagcguguuuaaaggcagcgccguauguguguaccaccugagcgauauccaaacaguuuucaauggacccuucgcccauaaggagggcccaaaccaucaguugauuucauaucaggggaggauuccuuacccaagaccaggcaccugcccuggcggagccuucacccccaacaugaggaccaccaaggaguucccagaugacguagugaccuuuaucagaaaccacccccuuauguacaacuccauauaucccauucacaaaaggccucugaucgugcgaauagggaccgauuauaaauauaccaagauugcugucgaccggguuaaugcagccgacggccguuaccauguacucuucuuaggaacggauaggggaaccguacagaaggucgucguccugccaacgaauaauucaguaaguggagagcugauccuagaggagcuggagguuuuuaagaaucacgcaccaauuaccaccaugaagauuuccucuaagaagcagcagcuguacgugaguaguaaugaaggcgucagucaagucucauugcacagaugccauauuuacggcacagccugugcagacuguugccuggcgagagacccauacugugcaugggauggacacagcugcucacgauucuauccuaccgguaagcgaagaucccgcaggcaggacguccgccacggcaacccauugacccaaugccguggcuuuaaucugaaggcuuaccgcaaugccgccgagaucguccaguacggcguuaagaacaacacuacuuuucuggagugcgcuccgaaguccccgcaggcuagcauuaaguggcuacuccagaaggauaaggaucggcggaaagaggugaagcuuaacgagagaauuauugccaccucucaggggcuucugauucgcagcgugcaggguucagaucaggggcuauaccacugcauugcuaccgaaaauucuuuuaaacaaacuauugccaagaucaacuuuaagguuuuggauagcgaaauggucgccgugguaaccgacaaguggucacccuggaccugggccucuagugucagagcccuuccuuuccaccccaaagacauaaugggcgcuuucagccauuccgaaaugcagaugauuaaucaguacuguaaggacacucgacaacaacaccaacagggugaugagagccagaagaugaggggggauuacggcaaguuaaaagcucucaucaauagucguaagagucggaaucgaagaaaucaacugccugaaagcuag

SEQ ID NO: 12844 - RNA, 630 nt, Artificial Sequence
  Description of Artificial Sequence: Synthetic coding sequence
augggaccugaagcucugaguucacuucuacuguuguugcucgucgcaaguggagacgcggauaugaaaggccauuucgaccccgcaaaauguagguaugccuugggaaugcaggaccggaccauacccgauucugacauaagcgcaaguucuagcugguccgacucuacugcugcacggcacagcagauuggaauccagugacggcgacggagccuggugucccgcgggaucuguguucccaaaagaggaggaauacuugcagguggaccuucagaggcuccaccucguggcccugguaggcacccaggggcgacaugccgguggguuagguaaggaauucagcagaagcuauagacugcgauacucacgagauggccgcagguggaugggauggaaggaucgcuggggacaggaagugauuucugggaaugaagauccagaaggcguuguucugaaggacuuggguccuccaaugguggcccggcuuguuagauucuacccucgcgcugaccggguaaugagcgugugcuuaaggguggaguuguauggcugccuguggagagaugggcuguugaguuauacugcacccguagggcagacaauguaccugagugaggcugucuauuag

SEQ ID NO: 12845 - RNA, 315 nt, Artificial Sequence
  Description of Artificial Sequence: Synthetic coding sequence
augagcgaucuuuugcugcucggcuuaaucggugggcuuacucucuugcuccuacuuacacuucucgccuuugccggauacucgggucucuuagcugggguggaagugucugcaggaaguccuccaauucguaaugucacuguugcuuauaaauuucacaugggucuguacggugagacagggaggcuuuuuaccgaaucuugcuccauuagccccaaauugaggucaaucgccguguauuacgacaacccccauauggucccuccugauaaauguaggugcgcugugggcagcauucucagugaaggugaguag

SEQ ID NO: 12846 - RNA, 2631 nt, Artificial Sequence
  Description of Artificial Sequence: Synthetic coding sequence
augggaccggaggcccuuucaucccuccuacugcugcuucuuguggccucaggcgaugcugauaugaagggccacuuugacccggcaaaaugccgauacgcauuagguaugcaggaucgcaccauucccgacucagauauuucggccucuaguucguggucggauaguacagccgcccggcauucccggcuugaaaguuccgacggcgacggagcauggugccccgccgggagcguauuuccaaaggaggaagaauaucuccaggucgaccugcaacggcugcaccugguugcauuggucggaacacagggccgucacgcaggcggguuaggcaaggaguucaguagaucguauaggcuccgcuacagccgggacgguagacgcuggaugggauggaaggaccgguggggucaggaagucauuagcgguaacgaggauccagaaggugucgugcugaaagacuuaggcccgccuauggucgcccgacucguaagguucuauccucgggcggaccgggugaugaguguuugccugcgggucgagcuguauggaugcuuauggagagauggccuguugucauacaccgccccaguaggccagaccauguaccuaucagaagccguguaccucaacgacuccacauaugaugggcacaccguuggaggucugcaauauggagguuugggacaguuggcugacggagucguaggacuggaugacuucagaaagucucaggaguuacguguuuggccaggcuacgacuacguuggguggagcaaccacucauucucuaguggauaugucgaaauggaguuugaguucgaccgacucagggcguuucaggcuaugcagguucauuguaacaauaugcacacgcuaggcgcccgccuaccuggagggguugagugcagguuccggagagguccagcgauggccugggagggggaacccaugaggcauaaccugggaggcaaucugggagauccgagggcgcgggccguuuccgugccgcugggcgggagaguggcucgcuuccuccaaugccgguuccuauucgccggaccguggcuucucuuuucugagauuuccuucauaagugacguagucaauaauucuucaccagcacuaggaggaacauuuccaccagccccuugguggccaccuggcccgccaccaacaaacuuuagcaguuuggagcuggagccccguggacagcaacccgucgcuaaggcugagggauccccaacagccaucuugauugggugccugguagcuauuauccugcuccuucugcucaucauugcucucaugcucuggcggcugcacuggcgcaggcugcucagcaaagcagaacgucgggugcuugaggaggaacuuacugugcaucuguccgugccuggcgacacaauuuugauuaauaaucggccuggcccgcgcgaaccaccuccuuaccaggaaccucggccaagaggaaacccuccccacucggcccccugcguucccaauggcagcgcguauaguggugacuauauggaacccgagaaaccuggagcucccuuacuaccuccucccccucagaacagcgucccgcauuacgccgaggcugauauugugacucugcagggagugaccggggggaacaccuaugcagugccagcgcuccccccaggagcgguaggagauggacccccaagaguggauuucccccggagcaggcugcgcuuuaaggagaagcugggugagggacaguucggugaggugcaucugugcgaaguggacagcccucaggauuuggugucauuagauuucccucugaaugugagaaagggccacccccugcuuguugccgucaagauucugcgucccgacgcuaccaagaacgccagaaacgacuuccucaaggaggucaaaauuaugaguaggcuuaaggauccaaauaucauacggcugcuggggguguguguacaagaugacccccuuugcaugaucaccgacuauauggagaauggcgaucugaaccaauuccugucagcccaucagcuugaggacaaggcugcugagggggccccgggcgacggacaggcugcgcagggacccaccaucuccuauccuaugcuucuccauguggcugcccagaucgccucugggaugagguaccuugcuacccucaauuuuguucacagggaucucgcuacgagaaauugucuggugggugagaauuuuacgauuaagaucgcugacuucggaaugagccgcaaccuguacgcaggcgauuacuaucgcguccagggaagagcagugcuacccauaagguggauggcuugggaguguauccugauggggaaauuuacuacagcuagcgacguuugggcauucggcguuacucugugggaaguacucaugcuuugccgcgcccagccuuucggucaacugacggacgagcaggucauugagaacgccggugaauuuuuuagagaccaagguagacaaguguaucucucgaggcccccagccugcccucagggucuguacgaacugaugcuccgaugcuggucgagagagagugaacagaggccuccguuuucucagcugcauagguucuuagccgaggacgcacuuaauacuguguag

SEQ ID NO: 12847 - RNA, 1053 nt, Artificial Sequence
  Description of Artificial Sequence: Synthetic coding sequence
auggaggcauucgcgcuggggccagcccgucggggucggcgucgcacaagagccgccggaucucugcuauccagggcggcaauccucuuauuuauauccgcguuccugguucgggucccuagcucagucgggcauuuagugagacucccccgugccuuucggcugaccaaagacucagugaagaucguagguaguacauccuuucccguuaaagccuaugugaugcuccaccagaaguccccucacguuuuaugcgugacccagcagcuccgcaaugcagaacuuaucgaccccaguuuucagugguauggacccaaagggaaagucguaagcgaaaaccggaccgcucagauaaccucaaccgguucucugguuuuucagaauuuugaggagaguaugucuggaauauacacuuguuuucuggaguacaagcccaccgucgaagagaucgugaagcgacuacagcugaaguacgccaucuaugcauaucgcgaaccccacuacuacuaucaguucaccgcccgauaucacgccgcccccugcaauucgauauacaacauuuccuuugaaaagaaacugcugcaaauacugagcaaacuacugcucgauuuauccugugaaauuagucugcuaaaaagugagugccauaggguuaaaaugcagagagcgggacuacaaaaugagcuguuuuuugcauuuagcguaagcucucucgauacagaaaaaggaccuaaaagguguaccgaucauaauugugagccauauaagaggcuguuuaaggcaaagaauuugauagagcgguucuuuaaucagcagguggaaaucuuaggaaggagagcagaacaguugccacagauauacuacaucgaaggcacccuccagaugguuuggauuaacagaugcuuccccgguuacggaaugaacguccaacagcaccccaagugucccgagugcuguguuauaugcucacccggaucauacaauccuagagaugggauccauugccuccaguguaacuccagcuuaguguacggagcuaaaacgugucuguag

SEQ ID NO: 12848 - RNA, 1392 nt, Artificial Sequence
  Description of Artificial Sequence: Synthetic coding sequence
ugacuggcacugguccugugcacuguugacagccggccucccgcccagcuagcucugucccacgcugguagguugcucgcgucuagcaccgcagccagcgugccuaauacucugcguuuagaauuacgagggccucagccccgcgaugaaggauuuuacucaugcuccgcccguucuccacugggccaagccaacacuucucucgagcuucggcuugagggcguuagggucaucuuagccccagaggccgccgugcccgaaggggcuccuauaaccgugacaugcgcagaucccgcugcccacgccccaacucucuacacgugguaucacaaugggcgguggcuccaggaggggccugcugcuucccuaucauuccuuguggcuaccagggcucacgcgggagcauacuccugccaggcacaggaugcacaagguaccagaaguucaagaccagcugcacuccagguuuuauacgccccccaagacgcggugcucagcuccuucagggauucccgcgcccgcaguauggccgugauccaguguaccguggacucagagccucccgccgagcuugcucuaagucaugauggcaaaguguuagcaacauccuccggcgugcacagccuugcuucagggacaggucauguacaggucgccagaaacgcacugcggcuacaagugcaggacguaccugcaggcgacgauaccuacguauguacggcccaaaaccuucucgguucaaucuccacaauugguagacuacagguugagggcgcacgcgugguugcugagccagggcuggacguuccugaaggcgcugcacuuaaccugagcugucgacugcucgguggcccaggacccguugggaacuccacauucgcgugguucuggaacgaccgccggcugcacgccgagccuguacccaccuuagcuuucacccaugucgcaagagcgcaggccggaauguaucacugucucgccgagcugccgaccggcgcagcagcaucagcucccguaauguugaggguccuguaucccccaaaaacgccuacaaugaugguguuuguggaaccugaagggggccucagaggaauacuggauugccggguggacagcgaaccucucgcuagccugacgcuacaucuggguagcagacugguggcuucaucucagccccagggagccccugccgagccgcacauucauguucuggcaagcccuaaugcacucaggguugacauugaggcacugaggccuucugaucagggcgaauacauuuguuccgcgucuaacguacuugguuccgccuccaccucgaccuacuuuggcgucaggggagagggacgcgggcuccacuuaccggggcacuccgcgcagaaaccaucauccuag

SEQ ID NO: 12849 - RNA, 1398 nt, Artificial Sequence
  Description of Artificial Sequence: Synthetic coding sequence
augaaguuccaaggaccucuggcuugucuguuauuggcacucugcuugggcuccggcgaggccggaccccuucaaaguggggaagagucuacagggacaaauaucggagaagcccucgggcacggguugggggacgcucuguccgagggggugggcaaagcaaucggcaaggaagcgggcggggcggcaggaagcaagguaucggaagcccucggccagggaacuagagaggcugucggcacuggugucaggcagguuccaggauuuggcguggccgacgcacucgggaacagaguuggagaggcggcccacgcucucgguaacacuggccacgagaucgggagacaagcugaagacgugauuaggcauggugccgaugcagugcgcgguucauggcaaggcguuccaggccacaacggcgcuugggagacaucuggcgggcauggaauuuucggaucccagggugggcuaggaggacagggacagggaaauccugguggacuggguacucccugggugcauggcuaucccggcaauucagcuggguccuucggaaugaauccccagggggcaccguggggacagggagggaacggcggcccuccaaacuuuggaacuaauacacagggcgccguggcccagccuggcuauggcagcguucgugccucaaaucaaaaugagggcugcaccaaucccccaccguccgggucaggcggggggagcucuaauucugguggcucgagcacuggauccagcucuggaaaccauggcggcaguggaggggguaacggacauaagccugggugcgaaaagccugggaaugaggcccgcgggucaggagagagcggaauccagggguuccgcggucagggagugucauccaauaugcgcgaaauuucuaaggagggcaaccggcugcugggugguuccggagauaauuauaggggucaaggaucuuccuggggcaguggugggggcgacgcaguuggugggguuaacacggucaauagcgagaccuccccgggcauguucaacuucgauaccuuuuggaaaaauuuuaaguccaaacugggcuuuauuaauugggacgcuauaaacaaaaaucaggugccacccccgagcacccgggcacuucuguacuuuucuaggcugugggaagacuucaagcagaacacgccauucuugaauuggaaagcuaucaucgaaggugcugacgcguccagucugcagaagagggcugggcgugacgaccagaacuauaacuacaaccaacaugcuuauccaacagcauacggcgggaaauauucagucaagacgcccgcuaaaggugggguuucuccauccaguucagcaucgcgaguacaaccgggguuauugcaauggguaaaauuuugguag

SEQ ID NO: 12850 - RNA, 2700 nt, Artificial Sequence
  Description of Artificial Sequence: Synthetic coding sequence
augcuguuacuacugcuccuugcaccucucuuucugagaccuccgggcgccggcggugcccagaccccuaacgcuacuucagaaggaugccaaauuauucacccaccuugggagggcgggauuagauauaggggccugaccagagaccagguuaaggcaaucaacuucuugcccguggauuacgagaucgaguauguuugucgaggggaacgugaaguugugggaccgaaagugagaaagugccuugcuaauggaaguuggacugacauggacacaccaucccggugugugaauaggacgccucauucagaaagacgcgccguuuacauuggagcacuguucccuaugaguggaggauggccaggcggacaggcaugccaaccugcuguugaaauggcgcucgaggacgucaauaguaggcgggauauccucccagacuacgagcugaagcuuauccaucacgauuccaagugcgacccgggacaggcaacuaaauauuuguacgagcugcuuuauaacgacccgauaaaaauuaucuugaugccuggcuguucauccgugagcacccucgucgcugaagcugcgcggauguggaaccugauugugcuauccuaugggucauccaguccggcguugagcaaucggcagcgcuuccccaccuuuuuccgaacgcacccaucagccacucuucacaacccaacccgaguuaagcuguuugaaaaguggggcuggaagaaaauagccaccauacagcagaccaccgaagucuuuacauccacccuggacgacuuagaggagcgggucaaggaagcuggcauugaaauuacauuccgccaaagcuucuucagcgaucccgcugugcccguuaaaaacuugaaaaggcaggacgcgaggauuaucgugggacuguuuuaugagacugaagcucgcaaaguguuuugcgagguguauaaagaacgccuguuugguaaaaaguaugugugguuucuuaucggcugguaugcagacaauugguucaaaauuuacgauccauccauuaauuguacaguagaugagaugaccgaggccguggaggggcauauuacaacagaaauugucaugcucaaucccgcgaacacacgaucaauuuccaauaugaccucccaggaauucguggagaaauuaacaaaacgccuuaagagacauccagaagagacaggaggcuuccaggaggcaccccucgccuacgaugcaaucugggccuuggcccuugccuugaauaaaacuucuggaggagguggccgcucuggcgugcggcuggaggauuuuaauuacaauaaucagaccaucaccgaccagauuuaccgggcuaugaacucgagcagcuucgagggaguguccggccacgucguguuugaugcaucugggucccguauggccuggacucucaucgaacagcuacagggggguaguuauaaaaaaaucggcuauuacgacucuacaaaagaugaucuuuccugguccaaaacggacaaauggauaggcggcaguccgcccgccgaucagacccuugucauuaagacuuuucgguuccugagccagaagcuguucaucucugugagcguguugagcagccuagggauagugcuggcuguggucugucuguccuuuaacaucuauaacucacacguccgauauauccaaaacucccaaccaaacuugaacaaucugaccgccgugggcuguagccuggcuuuggccgcuguguucccacucggccuugacggguaucauauuggaagaaaucaguuuccuuucgugugucaggcgaggcuguggcucuuaggacugggcuuuagccuugguuacgggucgauguucacuaagaucuggugggugcauaccgucuuuaccaaaaaagaagagaagaaagaauggagaaaaacuuuggaaccuuggaaacuuuacgcgaccgugggcuugcugguaggcauggauguccugacccuggcaauuuggcagauuguggauccgcugcaucgaaccaucgagaccuuugcaaaagaagagccuaaggaggauauugacgugucaaucuuaccacaacuggaacauugcuccucccgcaaaaugaauacauggcugggcauauucuacggauacaaagggcugcugcugcuacuagggauauuucucgcuuaugaaacuaaguccgucagcacugaaaagauuaacgaucauagagccguggggauggccauuuacaauguggcagugcuuuguuugauaacagcacccgugaccaugauauuaucaucacagcaagaugcugccuuugcauuugcaucucuugccaucguguucagcucuuacauaacccuggugguguuguuugugccuaagaugagacgccuaaucacacgcggugaguggcagucugaagcacaggauacgaugaagacggguagcaguaccaacaacaaugaggaggaaaagucucgguuguuggagaaagaaaaucgagagcuggagaagaucauugccgaaaaggaagagagagucucagaacugcgacaucagcuucagucuaggcaacagcuacggagccgcagacauccuccaacccccccggagcccaguggaggcuugccacgaggacccccagaaccaccugaucgauugucaugcgacgggucccgaguucaccugcuguacaaguag

SEQ ID NO: 12851 - RNA, 381 nt, Artificial Sequence
  Description of Artificial Sequence: Synthetic coding sequence
augugguauguaagcacccgcggcguggcuccacgaguuaauuucgaaggcgcccuguucucuggcuacgcgccugauggaggcuuauuuaugccugaagaacuuccucagcuggacagagggacacugugccaauggucaacccugucuuaccccggccuugugaaggaacucugcgcgcuuuuuaucgggagcgaacuauugccaaaggacgagcugaacgaccuaaucgaccgggccuucucccgauuuagacacagggaagucgugcaccuuuccagauugcgaaacggucuuaaugugcuagagcuguggcacggcguaacguaugccuuuaaggaucugagccugaguugcacaacucaauuucugcaguauuag

SEQ ID NO: 12852 - RNA, 147 nt, Artificial Sequence
  Description of Artificial Sequence: Synthetic coding sequence
augccuccuuuccugauuacccuguuucuuuuccauucauguugccugcgagcuaacggccaucuacgcgagggaaugacauuauugaagaccgaauuugcuuuacaucuguaccaaagcguggccgcgugcagaaaugaaaccuag

SEQ ID NO: 12853 - RNA, 390 nt, Artificial Sequence
  Description of Artificial Sequence: Synthetic coding sequence
auggcagccggaucugccccuaugcaacugcaccuuagagccacaaucaggaugaaagacggauuaugcgucccccgaaaauggaucuaucaccucaccgaaggaagcaccgaccuuagaacugaggggagacccgacaugaagacggaacuguuuucaaguucaugucccgguggcauuauguuaaacgagacugggcaggguuaccagcgauuucuacuguacaaucgauccccacacccccccgagaaaugcguggaagaguucaagagccuuacaagcugcuuagauagcaaggccuuccuucuuaccccccgaaaccaggguaagggucugaagucucacaagacuggauugggccuuaccaaaucaagcgggguuaccggcuag

SEQ ID NO: 12854 - RNA, 462 nt, Artificial Sequence
  Description of Artificial Sequence: Synthetic coding sequence
augacaauacauaucuuaauccugcugcuucugcuugcuuucagcgcccagggggaucucgauacagccgcccggcguggccagcaucagguaccacagcauagaggacacguuugcuaccuggguguaugucguacgcauagauuagcugaaaucauauauuggauucguugccugcaucagggggcccucggcgagggccaaccccgggcgccuggcccacuccaauugugggcaccccccguggcccggggcggaucaccagcgagauuuccaggguucagaccagccgcccgaggccuggcacaguguccugcaagaugggugacuucuggaacugcuaggccccuccucggcuucaguuuaccaaucuguaugcuggagcuuuugcugcacaucucauccccacucacacccgcccccgagacagucuuuccuagccccucuccagguugugacuag

SEQ ID NO: 12855 - RNA, 450 nt, Artificial Sequence
  Description of Artificial Sequence: Synthetic coding sequence
auggguugguugacucgaaucgugugucuuuuuugggggguccuucugacagcaagagcuaacuaucagaaugggaaaaauaacgucccgagacugaaguuaagcuacaaggagauguuagaaucuaauaacguuauaaccuuuaauggacuggcuaauagcucaagcuaccacacuuuucugcuagacgaggagcggaguaggcucuacguaggggccaaagaccacauuuuuuccuucgacuuggugaacauuaaggauuuucagaaaaucguuuggccagugagcuacacaaggagggaugaauguaaaugggccggcaaagacauucugaaggaaugugcaaauuuuaucaaaguucucaaggcguacaaucagacccauuuauacgccugcgguaccggcgccuuccaccccauuugcacuuauauugaaauuggccaucauuag

SEQ ID NO: 12856 - RNA, 543 nt, Artificial Sequence
  Description of Artificial Sequence: Synthetic coding sequence
auggccgacaugcagaaccucguugaacggcucgagagggcuguaggacgguuggaagccguuucucauaccuccgacaugcacagaggcuacgcagacuccccauccaaagcaggagccgcacccuacguccaggcuuuugacucuuugcuugccgggccaguugccgaguauuuaaagauauccaaagagauuggaggagacguccaaaagcacgcagaaaugguucacaccgggcuuaaacuugagagggcacugcugguuaccgcgucacaaugccagcaaccugcugaaaauaaacugagcgaucuccuggcaccgaucucagagcagauaaaagaagugaucaccuucagggagaagaacaggggauccaaacucuucaaucaucuguccgcagucagugagucaauccaggcccucgggugggucgcuauggccccaaagcccgggcccuacgugaaagaaaugaaugacgccgcuauguuuuauacuaacagaguccugaaagaauauaaggauguugacaaaaagcacguuuag

SEQ ID NO: 12857 - RNA, 630 nt, Artificial Sequence
  Description of Artificial Sequence: Synthetic coding sequence
augggaccugaagccuuguccagucuuuuauugcuauuauuaguggcaucgggagacgcugauaugaagggucauuuugauccagcuaagugucgguaugcucucggaaugcaagaucgaacgauacccgacucggacauuagcgcguccucaagcuggagcgauuccacagcagcacggcacagcaggcuagaaucaucagacggggacggagcuugguguccggcuggguccguguucccaaaggaggaggaguaccugcaaguggaccugcagaggcuucaccuggucgcccuggucgggacacaggggagacacgccggaggacuuggcaaggaguuuucacguagcuauaggcuuagauauucuagagauggcaggagauggaugggauggaaggaccggugggggcaggaggugaucucagguaaugaagauccugaagggguggugcucaaggaucuugggcccccuaugguggcaagauugguaagauuuuacccccgcgcagaccgugugaugucagugugucuacggguugaguuguacggaugccuuuggagagacgguuuacugucauacaccgcaccgguuggccagacuauguacuugagugaagcaguguacuag

SEQ ID NO: 12858 - RNA, 630 nt, Artificial Sequence
  Description of Artificial Sequence: Synthetic coding sequence
auggggccagaagcacucuccuccuuacuccuccuucugcuggucgcuagcggagaugcagacaugaaagggcacuuugauccagcaaaaugccgguacgcccuggggaugcaagauagaacaauuccagacagcgacauaucagccucguccagcugguccgacucuacugcagcucgacacucccgacucgaaagcucagacggcgacggugcauggugccccgcgggaucuguuuuuccuaaggaggaggaguaccugcaggucgaccugcagcgucuccaccuuguggcacucguaggaacacagggcagacaugccggaggauuaggaaaggaguucuccagaucuuauagacugagauacucaagggacgguaggagguggauggguuggaaggauaggugggggcaggaggugaucaguggaaaugaggacccggaggguguaguccugaaggacuuggggcccccuaugguggcccgccuuguccgauuuuacccucgagcugaccgugugauguccguaugucuccggguugaacucuacggaugccuguggcgggaugggcugcucaguuacacugcaccaguaggacaaacaauguaccucucagaggccguuuacuag

SEQ ID NO: 12859 - RNA, 2631 nt, Artificial Sequence
  Description of Artificial Sequence: Synthetic coding sequence
augggucccgaggcccugagcucuuugcugcugcugcuguuagucgcuagcggggacgccgacaugaaaggccacuuugaucccgcuaaguguagauaugcccuggggaugcaggaccguaccaucccagacucugauaucuccgccagcaguucuuggucugauagcacggcagcucgccauucgaggcuugaauccagcgacggugauggagccuggugcccggccggguccguuuuccccaaggaggaagaguaccuccagguggaucuccagcgacuccaccuuguggcccuggugggcacgcagggaaggcaugcaggcggucuuggcaaagaauuuaguaggucguauagguugcgauauuccagggauggccgaagauggaugggcuggaaagacagguggggacaggaagucaucagcggcaacgaggaccccgagggugucgugcugaaggaucuuggucccccaaugguggcuagacugguccgcuucuauccaagggccgacagagugaugagcguaugucuucguguugaauuguacggcugucuguggcgcgacggccugcugucauacacagccccggugggacaaacaauguaucugagugaggccguauaccuaaaugauagcaccuacgacgggcauaccgugggcggucugcaguacggaggucuuggucagcuagcggacggggucguggggcuggaugacuuccggaagucccaggagcuacgaguguggccuggguaugauuacgucggcuggucuaaucacucguuuagcucuggcuacguagaaauggaguuugaauucgaccgacugcgugcauuccaagcuaugcagguacacugcaauaacaugcacacauugggcgcaaggcucccuggcgggguggagugucgcuuucgccgggggcccgcuauggcgugggagggugagccaaugagacauaaucugggcggcaaucuuggagacccacgcgcacgcgccguaagcguaccccuuggcggaaggguggcuagguuucugcaaugucgguuccuuuucgcgggcccuuggcucuuauuuuccgagauuaguuucauuucugauguugucaacaauagcaguccugcuuuagggggaacuuuccccccugcuccuugguggccuccaggaccccccccuaccaauuuuucaucacuggagcuggagccgaggggacagcaaccaguagcuaaggcagaaggaucucccaccgcuauauugaucgggugucugguugcaaucauucugcuguuacugcugauuaucgcccucauguuauggcgccuucauuggcgacggcuccucagcaaagcagagagaaggguguuagaagaggagcucacgguccaccuaagcguacccggugacaccauccugauuaauaaccgaccgggaccgcgggaaccuccuccguaccaggagccucggccccgaggcaaccccccccauucugcaccgugcguuccaaacggcucagcauacuccggugacuauauggaaccugagaagccgggcgcacccuuacuuccuccuccuccccagaauagugugccccacuacgcugaggcugauauuguaacacuccagggugugaccggcgguaacacuuacgcuguuccggcgcugcccccaggcgcugugggugaugguccgcccagaguggauuuuccucguagucguuugagguucaaagaaaagcugggugaaggacaguucggcgaagugcaucucugcgaaguagacagcccucaggauuuagucucccuggauuuuccucugaacguacggaaagggcauccacuacugguagccgugaaaauacucagaccugacgcgacuaagaaugcgcgcaaugacuuucugaaggaagugaagaucaugucaagacucaaggacccaaauauuauaagacugcugggggucuguguccaagacgacccacuauguaugaucaccgacuauauggaaaauggugaccugaaucaguuccugucugcacaucagcuagaggacaaggcagcagagggagcaccaggggacggccaagccgcccaggggccaaccaucaguuacccuaugcugcuccacguggccgcgcagauagcauccgguaugagauaucuggcuacucugaauuuuguacaucgcgaucuggccaccaggaauugccuagugggugaaaauuuuaccaucaagaucgcagauuucggcaugagccggaaccuuuacgcaggcgauuacuaccgcguccagggcagagcagugcucccaauaagguggauggccugggaauguauccuuauggguaaauuuaccacugcuucagacgucugggcuuucgguguaacucugugggagguauuaaugcuauguagggcccaacccuuuggccaauugaccgacgagcagguaaucgagaacgccggagaauucuuuagagaucagggcaggcaaguauaccugucucgcccaccagcuugcccccaaggucuauaugaacugaugcugcgcugcuggagucgggagagcgagcagcgccccccauucucucagcuccacagauuucuggcagaagacgcacucaauacuguuuag

SEQ ID NO: 12860 - RNA, 2103 nt, Artificial Sequence
  Description of Artificial Sequence: Synthetic coding sequence
auguuagccccauuccuuuugcuccuuacccacucuaggucaccgcucucuuuucgcccgugcucacaugugcccggugcuuugaucgcucagaagccgaugggcuccucgagguuggcagcccuccuccugccccuucuguuaauagucauagacuuauccgacuccgccggcaucggcuuccgccaucugccgcauuggaauacacgcugcccccuagcaucccacaccgaugauaguuuuacaggaucaucagccuacauucccuguagaacauggugggcccuuuucucgaccaaaccuuggugugugcgugucuggcacuguagucggugcuuaugucagcaucuauugucgggaggcucagggcugcagcguggauuauuucaccucuuagugcaaaagucgaaaaaaucuucuacguucaaauuuuaucggcgccauaagaugccugcuccugcucaacgaaagcuccuuccuagaagacauuuauccgaaaagagucaccauauuaguauccccagcccggacauuagucauaagggcuugagauccaaacggacucagccuagcgauccagagaccugggaaucccugcccagacuugacucccagaggcaugggggcccagaauucucguucgaucugcugcccgaagccagagcaauccgagucacuauuucaagcggccccgagguguccguuagacuaugccaccagugggcgcucgaaugugaggagcuuucuuccccauacgacguacagaagaucguuucuggagggcacaccgucgaacucccuuaugaguuccuccugccuugccugugcauugaggcgucuuaucuucaggaagacaccgugaggagaaaaaagugucccuuccagucuuggccugaagcauacgguagcgauuucuggaaauccgugcacuuuacugauuacucccaacauacucagaugguaauggcucugacccugaggugcccacucaagcuggaagccgcacuuugucaaagacacgacuggcacacccugugcaaagaccucccaaaugccacagcucgggaaagugacggcugguacgugcuugagaagguggaccuucauccucaguuauguuucaaguuuuccuuuggaaacagcucacauguugaauguccacaucagaccggcucccugacuucuuggaaugugucuauggacacccaagcgcagcagcugauucuacacuuuucaucgcgcaugcacgcaacuuuuagcgcagcuuggucacugccaggccucggccaggacacuuuggucccucccguguauaccgucucucaggcacgcggcucuucccccguuuccuuagaucuuauuauuccauuucugaggcccgggugcugcguauuaguuuggcgguccgauguacaguuugccuggaagcaccuguuaugucccgauguuaguuaccgccaccugggucugcucauccuugcccugcuggcucugcuuacauugcucggggucgugcuugcucugaccugucgaagaccgcaaagcggaccaggccccgcccggccaguguuacugcugcaugccgccgacuccgaagcccagcgucgccugguaggcgcucuggcugagcuccugcgagcugcccugggcggaggccgggaugucauuguggaccugugggagggcagacauguggcucgcguggggccauugcccugguuaugggccgccaggacacgggucgcccgggagcagggcaccguccugcuucuguggucaggggccgaucugagacccgugaguggaccugacccacgggcugccccacugcucgcgcuccuacacgccgcgccacgaccacuccuccuccucgcguacuuuuccagacugugugccaagggugauaucccaccaccccuaagagcuuugccaagauaucggcuguuaagggaucugccucggcuguugagagcccuggacgcuagacccuuugccgaagcuaccucaugggguagacuaggggccaggcaaagaaggcagagucgguuggagcugugcagcagacuggaaagggaagccgcccgcuuggcagaucugggguag

SEQ ID NO: 12861 - RNA, 1194 nt, Artificial Sequence
  Description of Artificial Sequence: Synthetic coding sequence
augagguccuuguuauuacuuucagcuuucugcuuguuggaggcugcacuggcagccgagguuaagaagccagcagcagcggcugcaccaggcaccgccgaaaaguugaguccaaaggcagcaacccuggcagagagaucggcugggcuagccuucagucuauaucaggccauggccaaagaucaagccgucgagaacauacugguuagccccguggugguugccucuagccugggccugguuucacuuggcggaaaagcaacaacugcaucacaggcgaaagcaguacugagcgcagagcagcuccgcaaugugacguggaaguugggcagcagacucuacgguccauccucgguaucuuuugcagacgauuuugugcgaucuagcaagcaacacuacaacugugagcacucuaagauaaauuuucgcgauaagagaucugcucugcaaucaauuaacgagugggcugcacagacuaccgacggcaaguugccagaaguuacaaaagauguugagagaacagauggggcguuacuggugaacgccauguucuucaagccucacugggacgagaaauuccaucacaagaugguugacaaccgcgguuucauggugacaaggagcuauaccgugggugugaugaugaugcaccggacagggcucuauaacuacuacgacgacgaaaaagaaaaguugcaaaucgucgagaugccgcucgcccauaagcuauccaguuuaauuauccugaugccacaucaugucgaaccccuggaacggcuggagaaauuacuuacuaaggaacaauugaaaauauggauggggaagaugcaaaagaaagccguggcaaucucacuucccaagggugugguugaagugacccacgaucuucagaagcaucucgccggccuuggccugacagaagcgauagauaagaauaaggccgaucuaucuaggaugagugggaaaaaggauuuauaucuggcuucugucuuucacgccaccgcuuucgaacuggacacugacggcaaccccuucgaucaagacauauauggcagagaagaauuacguucgccuaaacuguucuaugcagaccacccguuuaucuuuuuagugcgggauacacagagugggagccuacuauucaucgggaggcuggugcgcccaaagggggauaagaugcgugacgaacuguag

SEQ ID NO: 12862 - RNA, 612 nt, Artificial Sequence
  Description of Artificial Sequence: Synthetic coding sequence
auggcugauaugcagaaucucguugagagacuggagcgcgcgguuggccggcuggaggcagugagucacacaucugacaugcaccgcggguacgcugauuccccuuccaaagcuggcgcggccccuuacguccaggccuuugacucccuccuggcgggaccuguagcagaguaccucaagauauccaaagaaauagggggagauguucagaagcacgccgaaaugguccacacggggcugaagcuggaacgcgcucuucuggugacggcuucacaaugccagcaaccugcagagaauaaauugucugaccugcucgcuccgauauccgagcagaucaaggaaguuauuaccuuucgagaaaagaacagaggcucaaaacuuuuuaaucauuugagugcaguuagugaauccauucaagcucuagguuggguggccauggcaccuaaacccggaccguauguuaaagaaaugaacgaugcagccauguuuuacacgaauagaguccugaaagaguauaaggauguugauaagaagcacguagauugggugaaggcuuauuugucaauuuggacggagcugcaggccuauauuaaggaguuccacaccaccuag

SEQ ID NO: 12863 - RNA, 1293 nt, Artificial Sequence
  Description of Artificial Sequence: Synthetic coding sequence
augagaaaauuaaugaagcaggugcaagaacagugcccuaauaucaccagaaucuacaguaucggaaaauccuaccaagguuuaaaguuguacguuauggagaugucugacaagccgggagagcacgagcuuggagagccggagguucgauacgucgcuggaaugcauggcaacgaggcgcugggaagggagcugcugcuucuucuuaugcaguuucuaugccacgaguuccuacggggcaacccuagagucacuaggcuccugagugagaugcgcauucaccuguugcccagcaugaauccagauggcuaugaaauugcuuaccaucgcgggagcgaguuaguugggugggcagagggccgcuggaauaaccaaucgauagaucuuaaccauaauuuugccgacuuaaauaccccucugugggaagcucaagacgacggaaaggucccucacaucgugccaaaucaucauuuaccuuuaccgaccuacuacaccuugccaaacgccacaguugcccccgagacacgagccguaaucaaauggaugaagcguauacccuuuguguuaagugccaaucuacauggaggcgagcugguugucaguuacccguuugacaugacccgaaccccuugggccgcucgggaguuaacuccaaccccagaugacgcaguuuuucgcuggcucucuacuguuuacgccggcaguaaccucgcaaugcaggauacuucacgcagacccugucauagccaggauuuuagcguccacggaaacauuaucaauggcgcugacuggcacacggucccgggaucuaugaacgacuucuccuaucugcacacaaacuguuucgaagucacgguugaacuguccugugacaaauucccucaugagaaugaacuaccacaggagugggagaauaacaaagacgcucuccuuaccuaucucgaacaggucagaaugggcaucgcgggcgucgucagggacaaggacacagaguuggggauugcagacgcugucauugcuguugacggcauaaaucaugauguaacaaccgcuuggggcggagacuacuggaggcucuugacccccggggauuauauggugacugccuccgccgaaggcuaccacuccguaacucggaacugcagggugaccuuugaggagggccccuucccuugcaacuuuguccuaacuaaaacacccaaacagagacugcgcgaauugcucgcugcgggcgccaaaguuccgccagaucuucggcggcgcuuagagcggcugagagggcagaaggauuag

SEQ ID NO: 12864 - RNA, 1680 nt, Artificial Sequence
  Description of Artificial Sequence: Synthetic coding sequence
auguggacuaacuucuuuaaacuuagacuuuucugcugucuguuggcugugcucauggucguuguguuggugaucaacgugacccagguagaauaccucgaucacgagacagucucggcaaccuucauugauagcaguggacaauucgucuccucccaaguaacuggaauuucacgcaauccauacuguggcuaugaccagcagacuuuaaguucacaagagcgaauggaagaggacagucuguuagcugcccuucaccgccaggugccagacguggggccugucccauuugucaaguccaccgauccguccucuagcuacuucgucauucugaauucugcagccuucuucaaggugggcucccagcucgagguccugguccauguccaagauuuucaacgcaaacccaagaaguauggaggugacuaccuccaggcaaggauccacucccugaaacugcaggcuggggccgucggaagggucguugacuaccagaaugguuuuuacaaaguguucuuuacacuccuuuggccaggcaaagugaaggucagcgugucucuugugcaccccagcgaagguauccggguacugcaacgccuucaggaggacaagccggaucgggucuauuuuaagagccucuucagaucuggcagaauaucggagacaacagaguguaaugugugucugcccgggaaucucccccuuugcaacuuuacugaccuauacacaggcgaacccugguucugcuucaaaccaaagaagcugcccuguagcagccguaucacgcacuucaaaggcggguaucuaaagggccuucucacugccgcagaaagugccuucuuccagaguggaguuaacaucaagaugccugugaacucuucaggcccagauugggucacagugaucccuagacggaucaaggaaaccaacucacuggaacugucccaggggagcggcaccuuccccucggguuacuacuauaaagaucaauggcggccacgcaaguucaaaaugagacaguuuaacgaucccgauaacaucaccgaaugccuccagaggaagguugugcaccuguucggcgauucuacaauacgucaaugguuugaguaccuuacuaccuuugugcccgaccucguggaguuuaaucugggcucuccaaagaacgugggcccuuuccuugccguagaccaaaagcauaauauucuccugaaauaccggugccacgggccaccuaucagauuuaccacuguuuuuagcaacgaguugcacuauguggccaaugagcuuaacggaaucgugggcgggaaaaauaccguuguagcuauagcaguguggagucacuucagcacuuucccucuggaaguauacauccgccgucuaagaaauauccggcgagccguagugcgccuccucgaucgcucaccaaagaccgucgucguuauucgaaccgccaacgcccaagaguuagggccagaagugucucuuuucaacuccgacugguauaacuuccagcucgacacaauucuucggcgcauguuuagcgggguggggguauauuuaguugacgcaugggaaaugacacuggcucacuacuuaccacauaaacuccacccugaugagguuauuguuaagaaucagcuugacauguuucugucauuugugugcccucuggagaccuag

SEQ ID NO: 12865 - RNA, 8199 nt, Artificial Sequence
  Description of Artificial Sequence: Synthetic coding sequence
auggagcaaacagauuguaaaccguaccagccccugcccaagguaaaacacgaaauggaccucgcauauaccuccaguagcgaugaguccgaggacggcaggaaaccgagacaguccuacaauucucgugaaacauuacaugaguacaaucaggaacuccgcaugaauuacaacucacaaucacgaaagagaaaggaaguggaaaaguccacacaggagauggaauuuugcgagacaucucacacacucuguucagguuaccagaccgacaugcacagcgugucgcgccauggauaccagcuggagaugggguccgacguugauacugagaccgaaggagccgcuucuccagaccaugccuuacgcauguggauacgcggaaugaagagcgagcauucaucaugccugucuucucgggcaaacuccgcacuuucccugaccgauacggaccacgaaagaaagagcgacggggagaacggcuucaaguuuucaccuguguguugugacauggaggcccaggcaggaagcacccaggacgugcaaucauccccccacaaccaguucaccuuucggccacuaccucccccacccccaccuccccacgcuugcacaugugcccgaaagccaccucccgcggcggacagucuucagcgccgcucuaugaccaccaggucccagccuucaccagcagcaccugcucccccuaccucaacccaggauaguguccaucugcauaauaguuggguccugaauucuaacaucccccucgagacucggcacuuuuuguuuaagcacggaucuggcucaucugcuauuuuuucugccgccucacaaaauuauccuuugacuagcaauacuguguauucuccaccaccuaggccauuaccucggagcacauucucccgcccugcuuuuacuuucaacaagccauaucggugcuguaauuggaaauguacugcucuguccgcaacagccaucacaguuacucuggcccuccuacucgcauacgucauugccguucaucuuuucggccucacauggcaacugcagccuguggagggcgaguuauaugcaaacgggguaucuaagggcaaucgggggaccgaaaguauggauaccaccuauucuccuauuggcggaaagguuucggacaaguccgaaaagaaaguuuuccagaaagggagggccauugauaccggcgaggucgacaucggggcucagguaaugcaaacuauacccccuggucucuucuggcguuuucagauuaccauucaccauccuaucuaccugaaguuuaauaucuccuuggccaaggauucacugcuaggcauuuauggccgcaggaauauccccccaacccacacucaguucgacuucgucaaguugauggaugggaagcagcugguuaaacaggacagcaaggguagcgacgacacacagcacucuccacggaaucugauccugacaucucugcaggagacaggguucauugaguacauggaccagggcccaugguaucuugcuuucuacaacgacggcaaaaaaauggaacaagucuucguguugaccacugcaaucgaaauuauggaugauugcuccaccaacugcaacggaaacggagagugcauuaguggacacugucacugcuuucccggauuuuuaggccccgauugcgcuagagacuccugccccgugcugugcgggggaaauggcgaauaugaaaaaggacacugcguuugucgacacgguuggaagggaccggaaugcgacgugccggaagagcaauguaucgaucccacuuguuucggucacggcacauguauuaugggcguuuguaucugcgugccgggguauaaaggggaaaucugugaggaggaagacugucuggacccuauguguaguaaucacggcaucugugugaaaggcgagugucauugcuccacgggaugggggggaguuaacugcgagacuccucugcccgugugccaagaacaguguagcggacaugggaccuuuuugcucgacgccggaguauguucgugcgauccuaaauggaccgggagcgauugcucuacagagcuguguacgauggagugcggcucucacggagucuguuccagagggauuugucaaugugaggaaggcugggugggccccacuugugaggaaagaucuugucauagccacugcacugaacacggacaguguaaagauggcaagugcgagugcagccccgguugggagggagaccacuguacuaucgcucauuaucuggacgcaguaagagacggcugccccgggcugugcuucgggaaugguagguguacccuagaucagaacggcuggcacugugucugucaagucgggugguccgguaccgggugcaacgucgugauggagaugcuuugcggcgauaaccucgacaaugacggggacggcuugacggacugcguugacccugauuguugucagcagucuaacugcuacaucuccccacucugccaggggucuccggauccccuggaucugauucagcaaucccagacucuguuuucccagcauaccucccgccuguuuuacgaucgaaucaaguuucucauuggcaaagauucaacacaugucauuccuccagagguaaguuucgacagccgcagagcguguguuauaaggggacaggucguggcaaucgacgggacuccacuggucggcgucaaugugagcuuccugcaucauagugauuacggcuuuacaauaucacggcaagauggcaguuucgacuugguggcuaucggugggaucucggugauccugaucuuugaccgcucaccauuucuccccgaaaagcgcacgcuguggcugccauggaaccaauucauugugguagaaaaaguaacaaugcaaagagucgugagcgaccccccauccugugauauauccaacuucauaucuccaaauccaaucgugcuccccucaccccuuacaucauuugguggcuccuguccagaaagagggacaaucguaccagaacugcaagucguccaagaggagauucccauuccuagcucuuuugugagacuuuccuaccugucaagcaggacacccggcuacaagacauuauugcgcauccuccugacacacucuacaauaccugucggcaugauuaagguacaccuuaccguugcaguugaggggcgcuugacucagaagugguuucccgcugccaucaaccugguuuauacauuugccuggaacaaaacggacaucuacgggcagaaagucugggggcuggcagaggcccuggugagugugggauaugaauacgagacgugcccagacuuuauucucugggagcagaggacagugguguugcagggauucgaaauggaugcuucuaaccugggagguuggagccugaauaaacaucacauccucaacccacaauccggaauuauucauaagggaaauggcgagaauauguuuauuucacaacaaccaccugugauaaguaccauuauggggaauggucaucaacgcaguguugcauguacgaauugcaaugguccugcccacaauaauaagcuguucgccccuguggcuuuggccuccgggcccgacgguucuguauacgucggcgacuuuaacuucguucggcguauuuucccuagcggaaauucuguaucaauccuggagcuucgcaaucgcgacacucgacauucaacaucgcccgcgcacaaguauuaccuggcuauggauccugugagcgaaagucuuuaucugagcgacaccaauacucgcaagguguauaaacugaagucucuaguagagaccaaagauuuaaguaagaauuuugaggugguggccgggacaggagaccaguguuugccauucgaccagucccauuguggggauggugggcgcgccagcgaagccaguuuaaauuccccacgaggcaucacaguggacagacauggguuuaucuacuucgucgacggcaccaugauacggaagaucgaugagaacgccgucauaacaacagucaucgggagcaacggguugacguccacucagccacugaguugcgauaguggaauggacauuacacaaguucguuuagaauggccaaccgaucucgcugugaaucccauggauaauucucuguaugugcuggacaauaacauuguacuccagaucagugaaaaccggagagugcggauaaucgccggucggccuauucacugccaggugcccgguauagaucauuuucugguuagcaaaguagcuauccauucaacccuagagucugcgcgcgcaaucucugugucacauaguggccuguuauuuaucgccgagaccgacgagaggaaggugaaccggauccaacaggugacgaccaauggggagaucuacaucaucgcuggggccccaacugauugcgacuguaagauugacccuaauugcgacuguuuuucaggugacggaggcuacgcuaaggacgcuaagaugaaggcucccucuagccuagcaguuagccccgauggaaccuuauacguggccgaccuugggaacguucgaauucgcaccaucagcagaaaccaagcucauuugaacgauaugaauauuuacgagauugccucacccgccgaccaagagcucuaucaguuuacagugaacggaacgcaccuucauacccugaaucuuaucacgagggauuauguuuauaacuuuacguauaacagcgaaggggaucuuggcgccaucaccagcuccaaugguaacucggugcacauucggagagaugcaggaggcaugccuuuauggcucguuguuccaggcggccaagucuauuggcugacuauuaguuccaacgguguccuuaaaaggguauccgcacagggcuauaaccuugcucucaugaccuauccaggaaauacuggccucuuagcuaccaagaguaacgagaauggcuggacgacaguguacgaguaugauccugaaggacaucugaccaaugcuacauuucccaccggcgaagucagcagcuuucacucugaucuggagaaguuaacgaaggucgaacuggacacguccaaccgagaaaacguccugauguccacaaaccugacagccaccagcacuaucuauauucuuaaacaggagaauacacagucgaccuaccgcgucaacccugauggcucucugcgcguuacauuugccuccggaauggaaauuggcuugagcagcgagccucauauccuggcaggcgccgugaacccuacacugggcaagugcaacaucagcuugccaggcgaacacaacgcgaacuugaucgaguggcgccagcgaaaagagcagaacaagggcaacgugagcgccuucgagcgaagacuccgggcccauaacagaaaccugcucagcaucgacuuugaccacaucacgaggaccgguaaaaucuaugaugaccaccgaaaguuuacacuaagaauccuuuacgaucagaccggccgacccauccucugguccccagugucccgguacaaugaaguuaauauaacuuauuccccuagcgggcugguuaccuucauucaacgcgguacauggaaugaaaagauggaauacgaucagaguggcaagaucauuuccaggaccugggccgacgguaagaucuggaguuacacuuaccuugagaaguccgucaugcuacuguuacauagccagaggagauacaucuucgaauaugaccagccugacugucuccucucugugacuaugccuaguauggugcggcacucucugcaaaccauguugagcgucggguacuauagaaacaucuacacuccaccugacagcaguaccucuuucauccaggacuauucucgagacggucgccuccugcagacccuccaucugggaacuggcagaaggguccuuuacaaauacaccaaacaggcucgguuguccgaaguccuguaugacacaacucaggugacgcuaacauacgaggagagcagugggguuauaaagaccauucacuugaugcaugacggcuucauuugcacgauuagauauagacagacaggcccuuugaucggacgacaaauuuucagguuuuccgaagagggucuggugaacgcccgcuucgacuauucguacaauaauuuucggguuacuaguaugcaggcggucauuaaugaaacuccgcuccccauagaucuguaucgcuacguugaugucucaggccgcacugaacaguucgguaaauucucugucauuaacuacgauuuaaaccagguaauaacaaccacagugaugaagcauacuaagaucuuuuccgccaauggccagguuauugaagugcaguaugagauucuuaaagccauagcuuacuggaugacaauccaguaugacaaugugggaaggauggugauaugcgauauccgcguagggguugacgcaaacauuacucgauacuuuuacgaauaugacgcugacggccagcugcagacggugucagugaacgauaaaacucaguggcgcuacagcuacgaucucaaugggaauauuaaucuccuuagccacgguaaguccgcccguuugacgccccuaagauaugaccuccgggaccggaucacaagguuaggcgagauacaguauaaaauggaugaagacggcuuucugcgacaacgcgguaacgauaucuuugaauacaauagcaacggucuguuacagaaggccuauaacaaagcgagcgguuggaccguacaguacuauuacgauggacucgguagacgggucgccagcaaaucuucuuuggggcagcaucuccaguucuucuaugccgaccugacuaauccgaucaggguuacucaccuguauaaucacacaucuagcgagaucacaucucuguacuacgaccuccagggccaccuaauugcuauggaacucuccucuggggaagaguauuacgucgccugcgauaauacaggaacaccacuggcagucuucucuucacggggacaagugauuaaagagauccuguacacuccguauggcgauauuuaucacgauacauaucccgauuuucaggugauuauugguuuucacgguggguuauaugacuuccugacuaaacuggugcaucucggccagagagauuacgaugugguggcuggccgcuggacgacaccgaaccaucauaucuggaagcaacuuaaccuacucccaaagccauucaaucuguauaguuuugaaaacaauuaucccgucggaaaaauccaggacguagcgaaguauaccaccgacauucgaucuuggcuggaacucuuuggcuuccagcuccauaacgugcugcccggguuuccgaaacccgagcuggaaaaccuggaacugaccuacgaguuacugcgcuugcagaccaagacucaggaaugggaccccgggaaaacaauacugggcauacagugcgaacuccagaaacagcugagaaauuucauuucccucgaucagcuaccaaugaccccaagguauaacgaugggcguugccuggagggcggcaaacagccacgcuuugccgcagugcccuccguguuuggaaaggguaucaaauuugcaauaaaggauggcauugucaccgcggauaucaucggggucgccaaugaggauucacguagguuggcugcaauacuuaacaacgcccauuaccuggaaaaccugcauuucacuauugagggccgcgacacucauuacuucaucaaacuuggaucauuggaagaagaucugguguuaauaggcaauacaggcggacggcggauccuggaaaaugggguaaacgucaccgucagccaaaugacuagcguccuuaacggaaggaccaggcgcuucgccgacauccagcuucaacauggagcacucugcuucaauauccgguauggaaccaccguagaggaggaaaagaaccauguucucgaaaucgcccgccagagggcuguggcucaggcauggacaaaggagcagcggagacugcaggagggagaggaagggauucgcgcguggaccgagggcgaaaaacagcagcucuuaucaaccggacggguccaagguuaugauggguauuuugugcuuuccguggaacaguaccuugaacuuuccgauucugcaaacaauauccauuuuaugcgacagucagagauaggcagacgauag

SEQ ID NO: 12866 - RNA, 264 nt, Artificial Sequence
  Description of Artificial Sequence: Synthetic coding sequence
augaaagugcuacuguugacaggccucggcgcucuguucuuugccuacuauugggacgauaacuucgacccugccucuuuacagggagcacgcguguugcugaccggagcuaaugccggaguuggagaagagcuugcuuaucacuaugcuagauuaggcucgcaccugguuuugacugcacacacugaggcucugcuccagaaggcucgaugguugacuuuaguaguaucuacgcuggggggccgcggaaaauggauuacauag

SEQ ID NO: 12867 - RNA, 1233 nt, Artificial Sequence
  Description of Artificial Sequence: Synthetic coding sequence
augcgcgcauguauuagccugguucuagcggugcucuguggcuuggcaugggccggcaagaucgaguccugcgccucuagguguaacgagaaauucaaccgcgacgcugccugucaaugcgaucgacggugucuguggcacggcaacugcugcgaggauuacgaacauuuauguacagaagaucauaaagaaucugagccacucccccagcuugaggaagagacagaggaagcccuagccagcaaccuguauucagccccuacgucuugccagggccgaugcuaugaggccuuugacaaacaucaccaaugucacugcaaugcgcguugucaggaauucggcaauuguuguaaggauuucgagagucuuuguagcgaccacgaaguaucacacuccucugacgcaauuaccaaggaggagauacagucuaucucugaaaaaaucuaccgcgccgacaccaacaaggcccaaaaggaagauauugugcugaauucucagaacuguaucagccccuccgagacuagaaaccagguggaccgguguccaaaaccacucuucaccuacgucaaugaaaagcuauucucuaaacccaccuacgcagcguuuaucaaccuucucaacaauuaucagagggcuacugggcacggcgagcacuucuccgcacaagagcuggccgaacaagacgccuuccugcgcgagauuaugaaaaccgccgugaugaaggaacuuuauaguuuucugcaccaccagaauagguaugggucugagcaggaauuugucgacgaucugaaaaauaugugguuuggccuuuauuccaggggaaaugaagagggggacuccucuggcuucgaacauguguuuaguggcgaaguaaagaaagggaaagugaccggauuucacaauuggauccgauuuuacuuagaggaaaaggagggucugguggacuauuauucacacauuuaugacgggccuugggauagcuacccugacguccuggcuaugcaguuuaacugggauggguauuauaaggagguagggagugcuuucaucggguccucaccugaauuugaguucgcacuguacucauuauguuucauugcacgcccagggaaggugugucaauuaagucuaggcggauacccccucgcgguccgcacuuauacaugggauaaaucaaccuacggcaauggaaaaaaguacaucgccaccgccuauaucgugaguucuacuuag

SEQ ID NO: 12868 - RNA, 351 nt, Artificial Sequence
  Description of Artificial Sequence: Synthetic coding sequence
auggcagcgggaagugcaccuaugcagcugcaucugcgagcuacaauccgaaugaaagauggucucuguguuccccggaaauggauuuaucaucucacagaagguucaacugaccuacgaaccgagggucgaccagauaugaaaacagaacuguucucauccaguuguccuggcgggauuaugcucaacgagaccggacagggguaccaaagguuccucuuguauaacagauccccacauccaccagaaaaaugcguugaggaguucaaaucgcuaacuagcugucucgauuccaaagccuuccugcuaaccccccguaaccaggaggccugcgagcugucaaacaacuag

SEQ ID NO: 12869 - RNA, 1200 nt, Artificial Sequence
  Description of Artificial Sequence: Synthetic coding sequence
augagcgcccgcgggcgcugggaagggggcggcagacgcgccugccggggaagccuuggcuuggcacgggcccaaggcgcagaacgaguaacuucaagcgaacaaagaccagcuauggcaagucugggacuucugcugcugcuauugcucaccgcauugccaccacuuuggucuagcucacuacccggccuggacaccgcagaguccaaagcuacaauugcugaucugaucuugucagcucuggaaagggcaaccguauucuuggaacaaagacugccggaaauuaauuuagacggcauggucggaguaaggguccuggaggagcaguuaaagucggugagagaaaaaugggcacaagagccgcuucuucaaccccuuagccugagggucggcaugcugggcgagaaacuagaggccgcuauucaacgcagucugcauuaucucaaacugucugacccuaaauaucugcgagaauuucaacugacacugcagccuggcuucuggaagcuuccacacgcguggauccacaccgacgcaagccuggucuacccuaccuuugguccccaggacagcuucuccgaggaacggagcgacgucugccucgugcagcuacuagguacgggaacugauucaucggagcccugcggacucucagauuuaugucggucucugaugacaaagcccggauguagcggguauugcuugagccaccagcuucucuucuuucucugggcccggaugcgggguuguacccaggggccccuccagcagucacaagauuauauuaaccuguucugcgcaaauaugauggaccugaauaggagagcagaagccauuggguacgcauaucccaccagggauaucuuuauggagaauaucauguuuugcggcaugggcggauuuucagauuuuuauaaacugcgaugguuggaggccauuuuguccuggcagaagcagcaggaaggcuguuuuggcgaacccgacgcugaagaugaagagcucagcaaagccauacaguaucagcaacacuucagucgacgggugaaaaggagagaaaaacaguuuccagacgggugcucuagucacaauacugcaacggcaguugccgcacuuggcggguuccuguauauucuggcagaauauccacccgcuaaccgcgagccacaucccaguacccccccuccuccaagcagucgguag

SEQ ID NO: 12870 - RNA, 510 nt, Artificial Sequence
  Description of Artificial Sequence: Synthetic coding sequence
augcuuucuucagucguguucuggggacucaucgcacugaucggaacaucgcgaggcucauaccccuuuucacauagcaugaagccacaccugcacccuaggcucuaucacgggugcuacggcgacauuaugaccaugaagacaucuggugccacaugcgaugcuaacucuguuaugaacugugguauuagaggguccgaaauguucgcggaaauggaccugcgcgccauuaaacccuaccagacacucaucaaggaggucggacagaggcacugcgucgauccagcaguuaucgccgccauuauuucuagggagagucacggggggagugugcuucaggacggaugggaucauagaggccugaaguuuggguugaugcaacuggauaagcaaaccuaccacccuguuggugcaugggauuccaaagagcaucuaucacaggccacggggauacuuacggaaagaaucaaggcaauucagaagaaauuuccuaccuggaguguggcuuag

SEQ ID NO: 12871 - RNA, 468 nt, Artificial Sequence
  Description of Artificial Sequence: Synthetic coding sequence
augacuagucucaaauguggugagaaccuguacaugucauccgcuuccaguucauggucacaagcaauucaguccugguucgaugaauauaacgacuuugacuucggugucgguccuaagacucccaacgccguugugggccacuauacacaggucgugugguauagcaguuaccuuguaggcugcggcaacgccuauuguccaaaucaaaaggugcugaaguauuauuauguaugucaauauugucccgcggggaauugggccaacaggcuguacgucccauaugagcagggagcuccuugugcaagcugucccgacaauugugacgacggacugugcacuaaugguugcaaguacgaggaccucuauucuaacugcaagagccuaaaguuaacacugacuugcaagcaccagcucgugcgugauucuugcaaagccucaugcaacuguuccaauucuaucuacuag

SEQ ID NO: 12872 - RNA, 2886 nt, Artificial Sequence
  Description of Artificial Sequence: Synthetic coding sequence
augcucuuacuguugcugcuggccccccucuuccucaggccuccuggagcagguggcgcccagacuccaaacgcuacuucugaaggaugccaaauuauucacccaccuugggaaggcggaauccgcuaucgcgggcugacuagggaucaagucaaggccauaaauuucuugccaguugacuaugagauagaguauguguguaggggcgagagagaggucgugggaccuaaaguucgcaaaugccuugcuaacggguccuggacugauauggauacaccaaguagaugcgugagaauaugcagcaaguccuaucugacucucgaaaauggcaaaguguuccugacaggaggggaccuacccgccuuggacggagccagagucgacuuccggugcgacccggacuuucaccucgugggcaguucacguagcauuugcucccagggacaguggucuacaccaaaaccacacugccaggucaacaggaccccgcacagcgagcgccgagccgucuauaucggcgcacucuucccuaugucgggaggcuggccagggggacaggcuugccagccagcugucgagauggcccuggaggacgugaauagcagaagggacauccuacccgauuaugaauugaagcucauccaccaugacagcaagugcgacccgggucaggcgacaaaguaucuguaugaacuguuguacaacgacccuauaaagauaauccugaugcccgguugcucuaguguuucuacucuuguugccgaagccgcccgaauguggaaucugaucgugcugucuuacggcucaucuagccccgcacucucgaacaggcaacgguuuccaacauucuucagaacccaccccuccgcuacauuacauaacccgacucgcgugaaacucuucgagaaguggggcuggaagaaaaucgccacuauacaacaaacaaccgaggucuuuacgucaacccuugaugacuuggaagagagggugaaagaggccgggaucgagaucaccuucaggcaguccuucuuuagcgaccccgcagucccugugaagaaucugaaacggcaagaugcucgcaucaucgucggccuguucuaugagacggaagcacggaagguguucugcgaaguguacaaggagaggcuguucggaaaaaaguacgugugguuuuuaauugguugguaugccgauaacugguuuaaaauuuaugaucccaguauuaacugcaccgucgaugagaugacagaagcagucgaggggcauaucaccacggaaauuguuauguugaacccugcgaacacuagguccaucuccaauaugacaagccaggaauuuguugaaaaacugacuaaacggcugaaaaggcacccagaagaaaccggcggcuuccaggaggccccccucgcauacgacgccaucugggcauuggcucuggccuugaauaagacaucaggcggaggaggaaggucuggagucagacuagaagauuucaacuauaacaaucaaacuauuacagaccagauuuaucgcgcaaugaauucaagcucuuucgagggcgugucggggcacguaguguucgaugcuucuggaagcagaauggccuggacucuaauugaacagcuccagggggggaguuacaaaaaaaucggguauuacgauucuacgaaagacgacuugucguggagcaagacugauaaguggaucggaggaucgccgccugcugaucaaacacucguaauaaagaccuucagauucuugucacaaaaacuuuuuauuaguguuuccgugcuguccagccuggggauaguccuugcaguugugugcuugucauuuaauaucuauaacucucacgugagauacauccagaauucccagccuaacuugaauaaccuaacagcagucggauguagccuagcgcucgccgccguguucccgcuaggauuagauggcuaucacauuggccggaaucaguuccccuucguuugucaggccagguuguggcuccucggccugggguuuaguuuaggcuacggaucaauguucaccaagauaugguggguccacaccguauucaccaagaaggaggagaaaaaggaauggcguaagacccuugaaccuuggaagcuuuacgcuacagugggacugcucguuggaauggaugucuugacccuagccaucuggcagauugucgacccucugcauaggacuauagagacuuuugccaaagaggaaccaaaggaagacauugacguuuccauccuuccucagcuagagcacugcagcucccgaaagaugaauacauggcucggaaucuuuuacggcuacaagggauuacuguugcuccuggggauuuuuuuagcuuacgaaaccaagucugugaguaccgaaaaaaucaacgaucacagagcggugggaauggccaucuacaauguggcaguucugugcuugaucaccgcacccgugacaaugauucugaguucacaacaagacgcggccuucgccuuugccucccuugccaucgucuuuucuucuuacauuaccuuagugguucuguucguaccgaagaugagaagacucaucacuaggggggaauggcagucggaagcccaggauaccaugaagacuggcucuaguacuaacaacaaugaggaggagaaaagcagauugcuggagaaggagaaccgcgagcucgaaaagauuaucgcugagaaggaagagagagucagugagcuucgucaucaguuacagucucgucagcagcucaggagcaggagacacccuccuaccccaccggagccuucuggcggacuuccacgcggacccccugagcccccugaucgacugaguugugauggcucucgcgugcaucuucuguacaaauag

SEQ ID NO: 12873 - RNA, 444 nt, Artificial Sequence
  Description of Artificial Sequence: Synthetic coding sequence
auggccgguccauggacuuuuacacugcuguguggccuucuagcggccacucugauccaggccacccuaucgccuaccgccguucugauccugggaccuaaggugaucaaggaaaaacuaacgcaagagcugaaagaccacaacgccacuucaauucuucaacaguuaccacuucuaucugccaugcgcgaaaaacccgccgggggaauacccguccugggaucgcucguuaacaccguuuugaagcauaucauaugguugaaagugaucacugcaaauauucuucaacuacagguaaagccaagcgccaacgaucaggagcuguuagugaaaaucccccuggauaugguggcuggcuuuaacaccccacuugucaagacuaucguagaauuccacaugacaacugaggcacaagcaacaauccgcauggacaccagugccuag

SEQ ID NO: 12874 - RNA, 948 nt, Artificial Sequence
  Description of Artificial Sequence: Synthetic coding sequence
augaaggugcuuuugcugaccggccuaggagcucuguucuucgcuuacuauugggacgauaauuuugacccugcuucacugcaaggagcccgcgucuuacugaccggcgcgaaugcuggugugggugaagaacuggcuuaucauuaugcucgacugggcucacaccuugugcugaccgcccacacagaagcucuguugcaaaaaguuguaggaaauugucggaagcuuggggcccccaagguguuuuauauugcugcagauauggcuagcccagaggcgcccgaaucuguggugcaauucgcacuggauaaacugggagggcuagacuaucuugucuuaaaccauaucggaggagcaccugccggaacacgggcucguagcccccaggcuacacgcuggcucaugcaagucaauuuugucucauauguacaacuuacuaguagagcccugccuucucugacggacuccaaagguucacuugucgucguguccucccuguuagguagggucccuacaucauucaguacucccuacucugcggcaaaguucgcgcuggauggguucuucggaucccuacgccgagagcuggacguucaggacgugaauguugccaucaccaugugcguacucgggcucagggaccgggcuagugcugcugaagccguacgcuccucuacuucgaggccucgccagccggaacaucgaggggucccucuacagagccagacggccauguuuuugccuccaacagugccuggcgcccguacguuaacagaaaccccacuccgaggauggccacagccaaagaugaaaucaucacggcagaaaucaaagacagaaaaaaacgacggacaucucgaaccaguaacagccugggaagugcagguucccagaguucggcggcugugccguggucuugccaggccacaucuuuuugggcaugauuag

SEQ ID NO: 12875 - RNA, 285 nt, Artificial Sequence
  Description of Artificial Sequence: Synthetic coding sequence
augcagcacagucucgucuuuuuuuucgcagucauucuccauuuaucccacuuacuacaccuugacgccagcauucauccauucaggcuucccuucucuucuaagcccuuccucuuaaucccaaugucaaacacuacacugccacauacagccuggccacuauccuuuuugcaucagaccgucucaacacugaaggcuguagcggucacacauucacuuuggcacuugcagaucccuguugacugccaagcuuguaaccggaagagcaagaaaaucuauugcuag

SEQ ID NO: 12876 - RNA, 783 nt, Artificial Sequence
  Description of Artificial Sequence: Synthetic coding sequence
auggaaaaguuuaauacaaucucaguguccaagugcaacaaagagaccguggcaaugaaggaaaaaugcaaguuugguaugacguccaccauccccucugggcauguuuggaggaacaccuggaaucccguaagcugcagccuggcgaccgucaaaaugaaggagugcuugcgcggcaaacucauuuaucugaugggggacagcacuauccgucaguggauggaauacuucaaggcuucaauaaacacacugaaauccguagaucugcaugagagcggaaaguugcagcaccaacuggcaguggaccuggaucgaaacauuaacauacaguggcagaaauacuguuauccccuuauuggaagcaugacuuauagcgugaaagagauggaguaucugaccagagcaauugaucgaacaggaggggaaaagaauaccgucauagugaucagccucggccagcacuuucgccccuuccccaucgacguguuuauaaggcgcgcccugaauguacauaaagcaauucagcaccugcuauuaagaagucccgacacgaugguuaucaucaagaccgagaauauucgcgaaauguauaacgaugcagaacgcuucuccgacuuucacgguuacauccaguauuugauuaucaaagauaucuuccaagaccucucaguguccauuaucgaugcaugggauaucaccaucgcguacggcacuaauaacgugcacccaccccaacacgugguagggaaccaaaucaauauauuacugaauuacaucugcuag

SEQ ID NO: 12877 - RNA, 1644 nt, Artificial Sequence
  Description of Artificial Sequence: Synthetic coding sequence
augaguucaaacacuaugcuccagaagacccuguuaauauuaaucucauuuucaguagugacuuggaugauuuucaucaucucacagaacuuuaccaagcugugguccgcccuaaacuuaucaaucucuguucacuauuggaauaauucagcgaagagucucuucccuaaaacaagccuaaucccccuaaagccguuaacugaaacugagcugcggauuaaggaaauaauugagaagcucgaucagcagaucccuccaagaccauuuacccacguaaauacaacgacuuccgcaacgcauuccaccgcuacaaucuugaacccuagagacacauauugucguggggaccagcuggauauccuccucgaggugcgagaccaccugggacaacgaaaacaguauggcggagauuuuuuaagggcaaggaugucaucucccgcauugacagccggggcuucuggcaaagugauggacuucaauaacggaacuuaccugguauccuucacucuuuuuugggaaggacaggucucccuuucacuacugcugauucacccuuccgagggagccagcgcacucuggcgggcccgaaaucaaggguacgauaaaauaauuuucaaaggaaaguuugugaaugguaccucccaugucuucaccgaguguggacugacccugaacagcaaugcggagcuuugcgaguauuuagaugaccgcgaucaagaggccuuuuauuguaugaaaccccagcacaugccaugugaggcucugacuuauaugacgacccgcaaucgagaagucucauaucugacagacaaggagaacagccucuuccaccggagcaaagugggcguggaaaugaugaaagauaggaagcauauugacguuacuaacuguaacaagcgagaaaaaauugaggagacaugucaagucggaaugaagccccccguccccggaggcuauacgcugcaggggaaguggauaacaacauuuuguaaccaggugcagcucgacacaaucaagauaaacggaugccucaagggcaagcucauuuauuuacuuggugacuccacauugagacaguggaucuacuauuuucccaagguuguuaagacucugaaguuuuucgacuugcacgagaccggcauauucaagaagcauuuacugcuggacgccgaaagacacacucagauacaauggaagaagcauuccuauccauucgugacuuuucagcuguacucauuaauagaccaugauuauauuccccgagagauugaccgccuuucaggugacaagaauacugcaauagugaucacguucggacagcauuuccgucccuuucccauugacauauucauucgccgggccaucgguguucagaaggcaauagagagacuguuucugagaucuccugcaacgaaggugaucauaaaaacugagaauauuagggagaugcacauugagacagaacgguuuggcgacuuucauggauauauucauuaccucauaaugaaagacaucuucaaagaucugaauguuggcauaaucgacgccugggauaugacaauagcauauggaacagacacaauucacccucccgaucacgugaucggcaaccagauuaauauguuucuuaauuauauaugcuag

SEQ ID NO: 12878 - RNA, 399 nt, Artificial Sequence
  Description of Artificial Sequence: Synthetic coding sequence
augcugauguuauucguguuuggcgugcuauuacaugaagucuccuuaagcgggcagaaugaagcgccacccaacacucauuccaucccaggcgaaccccuuuauaacuaugcuucaauucgccucccagaagaacauaucccauucuuccugcauaacaaccgucacaucgcuacagucugucgcaaagacucccucuguccauacaagaagcaccuggaaaaacuaaaauauugcuggggcuaugaaaagagcugcaagccugaauucagauuugguuauccugugugcuccuaugucgacauggguuggaccgauacacuggaguccgccgaggacaucuuuuggaagcaggccgauuuuggcuacgcucgggaaaggcucgaagagaugcacuag

SEQ ID NO: 12879 - RNA, 861 nt, Artificial Sequence
  Description of Artificial Sequence: Synthetic coding sequence
augggcucagcgcuguucgucaaaaaagaacuccagcuccaggcaaacuuccuggguaacgucaaaagacucuacgaggcugaaguuuucucaacggauuucagcaaucccuccaucgcacaggcccgaaucaacucucacgugaaaaagaaaacccagggcaaggucguagacauaauccagggacuggaucuccuaacagcuaugguguuaguuaaccacauuuucuuuaaggcuaagugggagaaaccuuuucacccugaguauacccgcaaaaacuuccccuuucugguaggagagcagguuacuguccaugugccaaugaugcaucagaaagagcaguuugccuuuggggucgacacagaacuaaacugcuucguccugcagauggacuacaagggcgacgcugucgcuuuuuuugucuuacccagcaaggguaaaaugcgccagcuggagcaggcccugucugcuagaacguuacguaaguggucucacagucuacagaaaagauggauugagguuuuuauccccagguuuucuaucagugcgaguuauaauuuggaaacuauucucccaaaaaugggaauucaaaauguauuugauaaaaaugccgauuuuaguggcauugccaaaagggauucauugcagguauccaaagccacccacaaagcuguucuggauguguccgaggaaggaaccgaagccacugcagccacgacaaccaaauuuauagucagaagcaaggacggaccguccuacuuuaccgugucauuuaaucgaacuuuucucaugaugaucaccaauaaagccacagaugggauccucuucuugggcaagguugaaaacccuaccaaaaguuag

SEQ ID NO: 12880 - RNA, 60 nt, Artificial Sequence
  Description of Artificial Sequence: Synthetic coding sequence
auggggugguugaccaggauuguuugcuuguuuuggggagugcuucuaacggccagguag

SEQ ID NO: 12881 - RNA, 1197 nt, Artificial Sequence
  Description of Artificial Sequence: Synthetic coding sequence
augaaauuccagggcccucuugccugucuccucuuggcacucugucuggggagcggggaggcuggaccccuccaaucaggagaggaguccacuggaacaaauauuggcgaggcauugggacacggguuaggagacgcccucucugagggagucgggaaagcuauagggaaggaggcagggggagcugcggguagcaaagugucugaggcccuuggucagggaacucgcgaagcugucggcacaggagugcgccaagugccagguuuuggcguagcagacgcgcuagguaauagagucggagaggcugcccaugcccuagggaacaccggacacgagauuggacggcaagcagaagacgucaucagacacggagcagacgcuguaagggguagcuggcaagggguuccaggacacaauggggcaugggagacaucugggggacacgggauuuucgguucccagggaggacugggcgggcaaggacaagguaacccagggggccuuggaacaccuuggguucacggguacccagguaauucagcuggaaguuucggaaugaacccgcagggagcuccuuggggccagggaggaaacgggggaccaccaaauuucggaaccaauacccaaggggccguugcgcagcccggguacgguagugugcgcgcaaguaaucaaaacgaaggaugcaccaauccuccccccagcggauccggugguggaucuagcaauucaggcggugguagugggagccagagcggauccucgggaucuggcaguaacggggacaauaacaauggaucuagcuccgggggguccucaaguggcucgagcucagggggaucauccggcgggucaucuggugguucuuccggcaacuccggcgggucaaggggagacaguggcuccgaauccuccuggggaucaucuacaggcucaaguagcggcaaucacgguggaucaggcggugggaacggacacaaaccuggaugcgaaaaacccggaaacgaagcucgcgggagcggcgagucuggcauccaggguuuccgcgggcaaggaguguccaguaauaugcggaauagcgaaaccaguccugguauguuuaauuuugauacuuuuuggaagaacuucaagaguaaguugggcuuuauuaauugggacgccauuaauaaggaucagcgguccaguaggaucccauag

SEQ ID NO: 12882 - RNA, 81 nt, Artificial Sequence
  Description of Artificial Sequence: Synthetic coding sequence
auggcacccaagaaacuauccugucuccgaucacuguuguuaccccuuagccucacacuucucuuaccucaggcagauuag

SEQ ID NO: 12883 - RNA, 696 nt, Artificial Sequence
  Description of Artificial Sequence: Synthetic coding sequence
auggcccaauuauuucuuccgcugcuggcugcucuggucuuggcacaggcuccugcugcucuugcagacgugcuggagggagauucaucagguaucuacagaugugaaguccagcauggcauagacgauucaagcgacgcaguagagguaaaggugaaaggcgucgucuuuuuauaccgcgagggcucagcucgcuacgccuucaguuuuucgggugcccaggaggcgugcgcacgaaucggcgcccacaucgcaacgcccgaacagcucuaugcagcuuaccuugggggcuaugaacaaugcgacgcuggcuggcucuccgaccaaaccguuagguaccccauucagacuccuagagaagccuguuacggagacauggauggcuuuccaggcgugcggaacuacggagucguagaucccgacgaucucuaugauguguacugcuaugcugaagaccucaauggugaguuauucuugggugaucccccagagaaauugacccuggaggaggcccgugccuacugucaggagaggggagccgaaauugcaacuacaggacaacuuuacgcugcaugggacgggggucucgaccacugcucuccaggauggcucgcugauggguccguacgguacccaauugucaccccaagccaacgcuguggaggcgggcucccaggaguaaagacgcuguucuag

SEQ ID NO: 12884 - RNA, 600 nt, Artificial Sequence
  Description of Artificial Sequence: Synthetic coding sequence
auggacgagcuguuaccccugaucccggugcuggaacaauauaagacagacgcuaaacugaucacucaguuuaaggaggaaauucgcaaucuaagcgccguacuaacgggcauucaggaggaaaucggggccuacgauuaugaagaacuucaccaaagaguguugucccucgagacacgacuccgggauugcaugaagaaacuaacuugcgggaaacuaaugaaaaucaccggccccguuaccgugaagacaucugguacaagguucggcgccuggaugacagauccccuggccucugagaagaauaaucgaguuugguacauggauagcuacacuaacaauaaaauaguuagggaguauaagagcaucgcugauuuuguuagcggagcagaaucucgaacuuauaaucuaccguucaagugggcuggcacuaaccauguaguuuauaacggaucacucuacuuuaacaaauaucagucuaacaucaucauuaaguauagcuucgauaugggcagaguccuggcucagcguucacuggaguacgccggcuuccacaacguuaccccgacucaugguguggauucccugaccaguacguag

SEQ ID NO: 12885 - RNA, 609 nt, Artificial Sequence
  Description of Artificial Sequence: Synthetic coding sequence
auggcugacaugcaaaacuuagucgaacgguuggagcgggcugugggucgucuggaggccgucagucacacaagugacaugcaucgcggcuacgccgacucucccucaaaggcgggcgcggcccccuaugugcaggcauucgacucucuccuggcgggaccaguugccgaguaucugaagaucucuaaggaaaucgggggugacguacagaaacacgcagaaaugguucacacuggucugaagcucgaaagagcucuucuugugaccgccagucagugucagcaacccgcugagaacaagcugagugaucuccuggcaccaauuucugagcaaaucaaggaggugauuacauuuagggaaaaaaaccgcggaucaaaacuuuucaaccaucuuucagcugucucugaaucuauacaggcacugggcuggguggccauggcaccgaaaccaggacccuacgucaaggagaugaacgaugcggcaauguucuauacuaacagaguacuuaaagaguacaaagauguggacaaaaagcauguugauuggguuaaagcauaucuaucuaucuggaccgagcugcaagcauacauaaaagaguuccauaccuag

SEQ ID NO: 12886 - RNA, 2886 nt, Artificial Sequence
  Description of Artificial Sequence: Synthetic coding sequence
augcuccuucuccugcuucuggcuccauuguuucucaggccacccggcgcuggaggagcacagaccccaaaugccacauccgagggcugccaaaucauacauccccccugggaaggcgguaucagguaucgcggacugacccgagaucaggugaaagcgauaaacuuccugccuguggauuaugaaauugaauacguuugccgcggggagagagaggugguuggcccuaaaguuaggaaaugccuggccaaugggucuuggacagacauggacacacccaguagaugugugcgcaucugcuccaagucauaccucacgcuggaaaauggcaagguguuccucacaggaggcgaucucccugcauuagauggcgcgagaguggacuucaggugugauccggacuuccacuugguuggcagcagucgcagcauuuguucccagggccaauggaguaccccaaagccccauugccaggugaaccggacuccacacucagagaggagggcaguuuauauaggagcucuguucccuaugucuggagguuggcccggcggccaggcgugccagccugcuguagaaauggcccuggaagacgugaacucucgucgcgacauccucccggacuaugaacuuaaacuaauccaccacgacucaaaaugugauccuggccaagccaccaaguaccuguacgaguuacuuuacaacgaucccaucaaaaucaucuugaugccuggcuguagcagcgugucuacacugguugcugaagccgcucggauguggaaucugauaguauuaagcuacgguuccagcucccccgcucuuagcaacagacaaagauuucccaccuucuuccgcacucaucccucugcaacccuccacaaccccacucgcgucaagcuguucgagaaguggggauggaaaaagauugccacuauccagcagacaacugagguauucacuucuacacuggacgaucuggaggaacgcguaaaagaggcagggauugaaauuacguuccgucagucauuuuucucugaccccgcagugccaguaaaaaaccugaagcggcaggacgcacgcauuauagucggacuguuuuaugaaacggaagcacggaaaguuuucugugaggucuauaaggaaagacuguucgggaaaaaauaugugugguuucugauagguugguacgcugauaauugguuuaagauuuacgaucccuccaucaauuguacuguggaugaaaugaccgaagccguagaaggucacauuacuaccgaaauugugaugcuuaauccugcuaauacuagguccauuucaaauaugaccucacaggaguucguggaaaaacuuaccaagcggcugaagcggcaucccgaggagaccggaggguuccaggaggcccccuuggcuuaugacgcgauuugggcccuggcccuggcucuaaauaaaacuagugggggcggcggaaggucaggugucaggcuggaggauuuuaauuauaacaaucaaacgauaaccgaucagaucuauagggccaugaauuccucuucauucgaggggguguccggccaugucguauuugacgcaagcggaucccguauggcauggacucucauagaacagcuccaaggcggcuccuacaagaaaauaggauauuaugacucuacaaaagaugaucucaguugguccaagaccgauaaguggaucggcggaucuccuccugcggaucagacccuugugauuaaaacuuuuagguuucucagucagaagcuguuuauaagcgugucaguucuaucuagucuaggaaucgugcuggccguggugugccugagcuuuaacauuuauaauucucaugugagguauauucagaacucccagcccaaucugaacaaucucaccgcugugggcuguagccuggcccuggcugcuguuuuuccuuuaggauuggaugguuaccacaucgggagaaaccaauuucccuucguuugccaggccagacucuggcuccugggccuagguuuuagucucggauacggcaguauguucaccaagaucugguggguccacacaguguuuacgaagaaggaagaaaagaaagaauggagaaaaacccuggagcccuggaaacucuacgccaccgugggccuauuagugggcauggacguguuaacccuggcaaucuggcaaauaguugacccacugcaucggaccauagagaccuuugcaaaggaggagccuaaagaagauaucgacguuagcauccuuccucaacuggagcacuguucaagucggaaaaugaacacauggcuuggaaucuucuacggauauaaagggcuucugcugcuccuaggcaucuuccuugcguacgaaacgaagagcgucagcacagagaagauuaacgaucaucgugcuguugggauggcaaucuacaacguggccguacucugucugauaacugcccccguaacaaugauauugaguucucagcaggaugcagccuucgccuucgcaucccuggcgauuguguucagcagcuacauuacucuaguggucuuauucguccccaagaugaggcgucucaucacacgaggggaauggcaaagugaagcucaggacacuaugaagacagguuccagcacaaacaauaaugaggaagagaagagccgccuauuagagaaagagaaucgggaacuugagaagauaauugccgaaaaagaagagcggguuagcgagcuuagacaucaacugcagucccgccaacaguugaggagccgucgccacccgccaacaccuccugaacccagugggggucucccacggggcccaccggagccgccugacagacugucaugugacggcucucgaguacaccugcuuuauaaauag

SEQ ID NO: 12887 - RNA, 351 nt, Artificial Sequence
  Description of Artificial Sequence: Synthetic coding sequence
auggccgccgguagcgcaccaaugcaauuacaccugagagccacaaucaggaugaaagacggguuaugugugcccagaaaguggauuuaucaccuaacagaggguaguaccgaccuaaggacugagggaagaccugauaugaaaacggaauuauuuuccucgaguugucccgguggaauuaugcuaaacgagacagggcagggauaucaacgauuucugcucuacaauaggagcccccacccucccgagaaguguguggaagaguuuaaaucccugacuagcugccuggacucgaaggcuuuccugcuuacacccaggaaccaagaagccugugagcuuaguaauaauuag

SEQ ID NO: 12888 - RNA, 2334 nt, Artificial Sequence
  Description of Artificial Sequence: Synthetic coding sequence
auggccgcagccggacucgucgcuguagccgcagccgccgaguacucaggaaccguugcaagcggagggaaucuccccggugugcacuguggacccucaucuggcgcuggcccuggguucgguccaggguccuggaguaggagucucgacagggcgcucgaggaagccgcagugacuggaguguugagucugagcgggcguaaacugagagaguucccacggggugcggccaaccacgaucuuaccgacacuacgagggccgaucugucacguaaccggcucagcgaaaucccuaucgaagcaugucacuucgugagucuggagaaccucaacuuguaccagaauuguauacguuacauuccugaagcgauucuaaacuugcaggccuugacauuucuuaacaucagcaggaaccagcucucuacacugccaguccaucucuguaacuuaccucuuaaggugcucauugccucaaacaauaaacuggucucuuugcccgaagaaaucggacauuuacgacauuugauggaacuggacgugucuuguaaugagauucagaccaucccaagccaaauuggcaacuuagaagcucugcgugaccugaacguccggaggaaccaucucgugcaccucccggaggaacuagccgaacugccccuuauucguuuggauuucagcugcaauaagauuaccacgaucccuguaugcuaccgaaaucugagacacuugcagacuauuacacucgacaauaauccccuccaaucuccuccugcacaaaucugcauuaaaggcaaagugcacauauucaaauaccucaacauccaggccuguaagauagcaccggaccuaccggauuacgaucgccggccccucgguuuugggucaugccacgaagagcuguacucuagccggccguacggcgcacucgacagcggguuuaacucuguugacagcggugacaaaagguggucagguaaugagccaacagaugaguucagugaucugccucuucgcguggcggagaucaccaaggagcagcgccugaggcgggagucccaguaucaagagaacagaggcagccucgucguaacaaauggcggcguggagcacgaucuggaccagaucgauuacauugacaguuguacugccgaagaggaggaggcagaaguuagacaacccaagggcccagacccagacucucugagcucacaguucauggccuacaucgagcagagaagaauuucacacgaggguagcccagugaaacccguggcgauucgcgaguuucaaaagacagaagacaugcgccgauaccuccaucagaaccgcguuccugcugagccuuccagcuugcucucgcucuccgcaagccacaaucagcugucacauacugaucuagaacuccaccagaggcgcgagcagcugguggaacggacacggagggaagcgcaacuugcggcauugcaguaugaagaagagaagauccggacuaagcaaauccagcgggaugccgugcuggauuucgucaagcagaaagcuagucaguccccacagaaacaacauccauuacucgacggaguggacggcgaguguccuuuuccaucccgucgcagccagcacacugacgauucagcccuaugcaugucccucucaggauugaaccaggucggaugcgccgcuacccugccccacuccagugcuuucacuccucuuaaguccgaugaucgcccaaaugcuuuacugaguucaccugcuacagagacaguacaucauucgcccgcuuacuccuucccugcagcuauucagcgcaaccagccacagcggcccgaaucuuuucuguucagggcaggggugagagccgagaccaacaaggggcaugccucuccauugccaccaagugcagcacccacaaccgacuccacagacuccaucacaggccagaacagcaggcagagagaggaagagcuggaacuuaucgaccagcuccggaagcauauugaguaucgacugaaaguaucacuucccugcgaucucggagccgccuugacagacggugugguucugugccaccuggcuaaccacguacggccccgcagcguuccuagcauccacgugcccuccccagccgugccuaaguugacaauggccaaauguaggcgaaauguagaaaauuuucuugaagcgugccgaaagaucgggguuccacaggagcagcuuugucucccauuacacauucuugaagaaaaaggucucucacagguggcugucacaguacaggcauuguuagaguuagccccuccgaaacagcagcagcaccagcucucagccgucuag

SEQ ID NO: 12889 - RNA, 834 nt, Artificial Sequence
  Description of Artificial Sequence: Synthetic coding sequence
auguugcaucccgagaccaguccuggcagagggcaucugcuggccguacuucuggcucuucuugguacaaccugggcggagguguggccgccacagcuccaggagcaggcgccuauggcuggagcucugaaucgaaaagagagcuuucuccugcuuucacuccacaaucgccugcgcagcugggugcagcccccagccgcagauaugcgucguuuauuagugugggcgacaagcucucagcugggauguggcagacaucuuuguagcgccggccaaacugcuauagaagcuuucgucugugccuacucaccuggaggcaauugggaaguaaauggaaagacaauuaucccuuauaagaagggagcuuggugcagccuuuguacugcaucugugucugggugcuuuaaagcaugggaccacgcaggugggcuuugugaaguaccucggaacccgugcagaaugucuugucagaaccacggacggcuuaacaucagcacuugccauugccacugccccccaggauauaccggacgguauugccaggggcaccugccgaacaguaacaugccccacucagcuauggggacgaagccaaaaaccccgggcgucccugcuauugguagucuugugagguguucccugcagugcguccacggucgauuuagggaagaagaguguucuuguguuugcgauaucggauacggcggggcacagugugcuagcgaaucuugucccagagcccccaaagagcccgccccccugaaaacuccucuacagugggguaucucuucacaggagcccgcaguuugccuguccuuucaacugauacaguag

SEQ ID NO: 12890 - RNA, 456 nt, Artificial Sequence
  Description of Artificial Sequence: Synthetic coding sequence
augucugaccuccuguugcucggucugauaggaggacucaccuuacuccuucugcugacucuacuugccuucgccggguacaguggccuucuggcuggggucgagguguccgcuggcucaccccccaucaggaauguuacaguggcuuacaaguuucacaugggcuuauacggagaaacagguaggcucuuuacugaaagcugcucaaucagcccaaagcuucgauccauugcuguauacuacgacaauccacauaugguuccaccggacaagugucggugcgcugucggcucuauuuuguccgagggugaagaaucccccagccccgaacucaucgaccuguaccaaaaguuuggauuuaaaguguucuccuucccugccccuucacauguuguaaccgccacauuccccuacaccacuauacugaguauuuggcucgcaaccagaaggguauag

SEQ ID NO: 12891 - RNA, 390 nt, Artificial Sequence
  Description of Artificial Sequence: Synthetic coding sequence
auggcagcgggcagcgccccaaugcagcuccaucugagggcuacaauucggaugaaagauggacuaugcgucccuagaaaauggaucuaccaucugacagagggaagcacagaccugagaaccgaaggcagaccagacaugaaaacagaacuuuuuaguucuucuugucccgggggcauaaugcugaacgaaacaggacaaggauaucagcgguuccugcucuacaauagauccccacaucccccugagaagugcgucgaagaauucaaguccuugacuucaugccuggacaguaaagcuuuccugcuuacaccacgaaaccaaggaaagggucucaaaucucacaaaacagggcuaggacucaccaagucaucuggcgugacggguuag

SEQ ID NO: 12892 - RNA, 390 nt, Artificial Sequence
  Description of Artificial Sequence: Synthetic coding sequence
auggccgcugguagcgcaccaaugcaacuccaccucagagccacuauaaggaugaaggacggacugugugugccucgaaaauggauuuaccauuugacugaggguucaacggauuuacgaaccgaggguagaccugauaugaagaccgaauuguuuagcucgaguugccccggcggcauaaugcuuaacgaaaccgggcaaggauaccaacgcuuccugcucuauaaccgcuccccacacccuccugaaaaaugugucgaggaauucaaguccuugaccucuugccuugacucaaaggccuuccuauugacaccaagaaaccagggaaaggggcugaagagccacaagaccggacuugggcugacaaagucgucaggcguaacgggcuag

SEQ ID NO: 12893 - RNA, 891 nt, Artificial Sequence
  Description of Artificial Sequence: Synthetic coding sequence
auggaggcccuucugcucggcgccgguuugcugcuaggcgcauacgugcuugucuacuacaaccuggugaaggcacccccuugcgguggcaugggcaaccucaggggucguaccgcagugguaaccggcauuaguucguguggcaggacacgggaagccuucaaucuguuguuacgcguuaaccacauagggccuuuccugcugacucacuugcugcugccaugccuaaaggcgugugcaccuaguagggugguggugguugccucugcagcacauugucgaggacgacuggauuuuaaaagguuggauaggccugucgucggcuggaggcaagagcuucgggcauacgccgauaccaagcuagcuaauguauuauuugccagggaauuagccaaucagcuugaagccacuggcgucaccuguuaugccgcccauccuggaccuguuaauuccgagcuguuuuugagacauguucccggcugguuaagaccucuccucaggccacuggccuggcucguacugagggcaccgcgcggcggcgcucagaccccccuauauugcgcucugcaggaaggcauugagccucuuaguggucgguauuucgccaacugccauguugaggaggucccccccgccgcgagggacgauagagcggcgcauagacucugggaggccucuaagcgacuggccggucuaggccccggagaagaugcugagcccgacgaagacccgcaaucagaggauuccgaggccccuuccucucugucaaccccacauccagaagagccgacagucagccagcccuacccaagcccacaguccagccccgauuugucuaaaaugacacauagaauucaggccaaaguugaacccgaaauucaauuauccuag

SEQ ID NO: 12894 - RNA, 567 nt, Artificial Sequence
  Description of Artificial Sequence: Synthetic coding sequence
auguuccaucaaauuugggcugccuugcucuauuucuacgguauaauucugaauucuaucuaccaguguccagagcauucccagcugacaaccuuaggcguggaugguaaggaauuccccgaagugcacuuagggcaaugguacuuuauagcaggcgcagcaccuacaaaagaagagcuggcuacuuuugauccuguggauaauauuguuuucaacauggcagcagguagugcuccaaugcagcugcaucugagagcuacaauucgaaugaaagacgggcugugugugccucgcaaauggaucuaccaccucacugaaggaaguacagacuugcgaaccgaaggcaggcccgacaugaaaaccgaguuguuuaguaguucuuguccgggaggaaucaugcugaacgagaccggccagggauaccagcgcuuuuugcuuuauaacagauccccacauccuccugagaaaugcguagaggaguucaaaagccugacaucuugucuagacucaaaggcuuuuuuauugacaccuaggaaucaggaggcuugcgaacuguccaauaacuag

SEQ ID NO: 12895 - RNA, 978 nt, Artificial Sequence
  Description of Artificial Sequence: Synthetic coding sequence
augcaggggcgcgucgcuggcucgugugcaccccugggccuccuccuagugugucugcaccuucccggccuguuugcccgcucaauugggguagucgaggagaaggugagccagaacuugggaaccaaucugccccagcugggccagccauccaguacgggcccuucaaauuccgagcacccucagccugcgcuagauccuagaagcaacgaucucgcuagagugccauugaaacuguccgugccugccucugauggcuucccaccugcuggaggaagugcuguucagagauggccacccuccuggggccugccugcaauggacaguuggccucccgaagaccccuggcagaugauggcugccgcggccgaagaccgcuuaggcgaagcccuucccgaagagcucucauauuuauccucagccgccgcacuggcaccugggagcggcccccuuccaggagaaagcuccccugaugcuacuggacuguccccuaaggcuagucuccuccaucaagauuccgagucgcggagacugccacgaucuaauucccucggugcaggggggaaaauacucucccagaggccaccguggagcuuaauucaucguguucuucccgaccauccuuggggaacccugaacccuucggugucauggggcggcggagggcccggaacaggcugggggacccguccgaugccccacccugaaggaauuugggggaucaacaaucagccucccggcaccuccuggggcaacauaaauagauacccuggaggaucuugggguaacauuaacagauauccagguggcucauggggcaauaucaauagauacccagguggcuccugggggaauauccaccucuacccuggaauaaauaauccguucccacccgggguccuucggccaccaggaucaagcuggaauaucccugcuggauuuccuaacccaccuuccccuagauuacaguggggguag

SEQ ID NO: 12896 - RNA, 2631 nt, Artificial Sequence
  Description of Artificial Sequence: Synthetic coding sequence
auggggcccgaggcgcugucgucucugcugcuguugcuuuuggucgccucuggugacgcugauaugaagggacauuucgacccugcaaaaugccgguacgcccuggguaugcaggacaggacaauacccgacagcgacaucucugcuagcucaagcuggucugauaguacugcugcucgccacagccgguuggagaguucugauggcgacggagcuuggugcccggccggaucuguguuuccuaaggaagaggaguaccugcaggucgaccuccagagacuucacuuaguggccuugguaggaacacaaggccggcacgccggagguuugggaaaagaguuuucgcgaagcuaucguuugagguauucaagggauggaaggcgauggauggguuggaaagaccgcuggggccaagaggugauuuccggcaacgaagacccagaaggaguugugcucaaagacuuggguccaccaauggucgcucggcuugugagauucuaucccagggccgaccgagugaugagcguuugccugaggguugagcucuacggcugucucuggagagaugggcugcugagcuacacugcucccguggggcagacuauguauuuaucugaggccguguaccugaaugacaguaccuacgauggccauacaguggguggcuuacaguacgggggauuagggcagcucgccgauggaguggucggccuugacgacuuccgaaagagccaggaacuacgcgucuggcccggcuaugauuaugucggauggucuaaccacucuuuuucuuccgguuauguagagauggaauucgaauucgaccgacugcgcgcauuucaggcaaugcaagugcauuguaacaacaugcauacccuuggcgcacgauugccagguggcguagagugccgcuucagacggggaccggcgauggcuugggaaggagagccaaugcgccauaaucugggaggaaaucuaggcgacccaagggcgcgcgcagucuccgucccgcuggguggcagagucgcgcgcuucuuacagugccguuuccucuucgccggcccguggcuccuguuuagugagauaagcuucauuucugaugucguuaacaauuccucgccugcccucgguggcacauuuccuccagccccuugguggccccccggacccccuccuacgaauuucagcucucucgagcuugagccacgcggccagcaacccguggccaaggcugagggcucuccuacugccauccuuauuggaugucuggucgcaauuauucugcuguugcuucucaucaucgcccuuaugcuguggagacuacauuggcgcagacuguugucaaaagccgagagacgcguucuagaggaagaauuaacuguacauuuaagcgugccuggagacaccauucugauuaacaacagacccggucccagagagccaccacccuaccaggaaccaagaccaaggggcaaucccccccacucugcuccaugugucccaaacgguagcgcauacucgggcgacuacauggagccugagaaacccggggcgccacugcuccccccucccccacagaacucugugccccauuaugcagaggcugacauugucacccuacaagggguuacaggugggaacaccuaugccgugcccgcucuccccccaggggcggucggcgaugguccuccuagggucgacuucccacggagcaggcucagauucaaagaaaagcucggggagggccaguucggggagguccauuugugugagguugacucuccucaggaucuggucucucuggacuuuccacugaacguccgcaagggccaucccuuguuaguggcuguaaagauucugaggccugacgcaacuaaaaacgccaggaaugauuuccucaaggaggucaagaucaugucccgacuuaaggauccuaacauuauuaggcuuuugggugugugcguucaagacgacccucuguguaugaucacagauuauauggaaaacggcgauuuaaaccaauuucuuucagcccaucaacucgaagacaaggccgcugagggggcccccggcgacggucaggcugcccagggaccuaccaucuccuaucccauguuguugcacguugcugcucagauugcgucugguaugcgauaccucgcuacucugaauuuuguccaucgugacuuggcuacucggaauugucuggucggggaaaacuucaccaucaagauagcagauuuuggcauguccagaaaccuguaugccggagauuacuacagagugcaggggcgagcaguucuuccuauccgcuggauggcgugggaguguauccugaugggcaaguucaccaccgcgagcgauguuugggccuuuggagugacauuaugggaaguucuuaugcucugucgcgcccagccuuuuggacagcugaccgacgagcaagugauugagaaugcuggcgaguucuuuagagaccaggggcggcagguguauuuaucucggccucccgccuguccacaaggauuauacgagcugaugcugcguugcuggucgagagagucagaacaaagaccgccauuuagucaacugcauagauuucuagcugaggaugcgcuaaacacgguuuag

SEQ ID NO: 12897 - RNA, 1482 nt, Artificial Sequence
  Description of Artificial Sequence: Synthetic coding sequence
auggcccuccucgcagggggauuaucuagggggcugggaucccaccccgcagccgcaggaagggacgcagucguuuucguguggcuccugcuuucuacgugguguacugcuccagcccgugccauucaggucacuguuucuaaucccuaccacguggucauacucuuccagccaguuacacuaccuugcaccuaccagaugacaucuacccccacucagccuauugugauuuggaaguacaaaucuuuuugccgggaccguaucgcugaugccuucucacccgccagcguggacaaucagcucaacgcccagcuggcugccgguaacccaggauauaacccauauguggaaugccaggauagcgugcgcacagucagaguggucgccacuaagcaggggaacgccguaacucuuggggauuauuaucagggaaggcgcauaaccaucacaggcauguacgcugcugggaaggccgcgacaucuggcgugcccuccaucuaugcaccaagcacuuaugcucaucugagucccgcuaaaacucccccccccccagcaaugauuccgauggggcccgccuauaacggcuauccugguggguaucccggggauguggacagauccaguagcgccggcggacagggcucguauguucccuuauuacgagacacggauuccagcguugccuccgaggugcgaucuggcuacagaauucaggcuagccaacaggacgacuccaugagaguauuguauuauauggaaaaggagcucgcuaauuucgaccccagucggccuggcccuccauccggcagaguggaaagagccaugucugagguaaccagcuuacacgaggaugacuggcgcuccagaccuucucggggccccgcucugacaccaaucagagaugaagagugggggggccauucaccgcgcagcccgcgggggugggaccaggagcccgcacgagagcaggcgggcggggguuggagggcaagacgcccccgagccagauccguggacgcucuggaugacuuaaccccaccuucuacugccgaaucuggcagccgcucuccgaccagcaacgguggccgaagcagagccuauaugcccccaagaucacgcucaagggaugaccuguaugaucaggaugauucucgugacuucccuaggucaagggacccacacuacgaugauuucagauccagagaacgccccccagcggaccccagaucucaucaccaucggaccagagauccaagagacaauggcucaagaucuggugaucugccauaugacggacgccuuuuggaagaagccguccgaaaaaaggggucagaggaaagaaggcggccccauaaagaagaggaggaagaggccuacuacccacccgcuccgcccccauacucagagaccgauagucaggccagcagagagcggagguuaaagaagaaccuagcccugaguagagagucccugguuguguag

SEQ ID NO: 12898 - RNA, 1788 nt, Artificial Sequence
  Description of Artificial Sequence: Synthetic coding sequence
auggacuucuuguuggcucucguccugguaucgucccuauaccugcaggccgccgccgaguucgauggccgcuggccaaggcagauugucagcagcaucggguugugccguuauggaggucggaucgauuguuguugggguugggcgcggcaaucuugggggcagugucagccggugugccagccgaggugcaagcacggagaaugcauugggcccaacaaaugcaaaugccaucccggguacgcuggcaaaacuuguaaucaagacgagcacauuccugcaccacuggaccagggaucugagcagccucuguuccagccguuggaucaucaggcuaccucccuucccucacgcgaucugaacgagugcggacugaaaccucgcccgugcaaacaccgcugcaugaacacuuaugggucguacaaauguuauugcuuaaauggcuauauguugaugcccgacgguuccuguaguuccgcccugacauguucaauggcuaauugccaguacggcugugacgugguuaaaggacagauccgcugucaaugcccuagucccggccuccaacuggcaccagacggaagaaccugcguagauguugacgagugugccacaggccgggcguccuguccuagauuuagacaaugcgugaauacuuucggcagcuacaucugcaaaugccacaagggguucgauuugauguacaucggaggaaaguaucagugccacgauauugacgagugcucacugggacaguaccaguguucauccuuugccagguguuauaacaucagagggaguuauaaguguaaauguaaagagggcuaucaaggugauggacucacuugcguguacauccccaaggugaugauagagccaucuggaccuauccaugugcccaaaggcaacggaacaauacugaagggugauacuggaaacaauaacuggauuccugaugucggguccacgugguggccccccaagacccccuauauucccccuaucaucaccaaccguccaacgagcaagccaacaacgaggccuacaccaaaaccaaccccaauccccacucccccaccgccaccuccucucccuacugaacugagaacgccacuucccccaacaacucccgaaaggccaacgacuggucugacuacuauugccccggcggccucuacaccaccuggcggaauuacgguggacaacaggguucagacagacccgcagaaaccacgcggugauguguucaucccucgucagccgucaaacgaucuguuugaaauauucgaaauugagcgcgguguguccgcagaugacgaggccaaggaugaucccggaguauuggugcacucauguaacuuugaucacggguugugcggauggaucagagaaaaagacaaugacuugcauugggagccaauacgagauccggccgguggucaguaucugaccgugucugcagcuaaagccccuggagguaaagcugcucgccuuguccugccguugggcaggcugaugcacaguggggaccucugccucuccuucagacauaaaguaacuggacuccacagugggacccuucaagucuucguccgcaaacauggggcacauggagcagccuuaugggggcgcaacgggggucauggguggagacagacucaaauuacacuacgcggcgccgauaucaagagcgugguauucaaaggagagaagcgaaggggacauaccggagagauuggacucgaugaugugaguuugaaaaagggccacuguucagaagaaagguag

SEQ ID NO: 12899 - RNA, 210 nt, Artificial Sequence
  Description of Artificial Sequence: Synthetic coding sequence
augaagaaucaagauaagaagaacggagcugcgaaacaaaguaauccuaagaguuccccaggucaaccagaagcaggcucauuugauagucuggaccuugaaaaagucaguuuggggcgcgcucucgccggucggagugagcugggaaucaguugucuugaacagggaacauggcgcauguuucugcgaggaaugauguguuggucauag

SEQ ID NO: 12900 - RNA, 483 nt, Artificial Sequence
  Description of Artificial Sequence: Synthetic coding sequence
auggcccgcgacuaugaccaucuguucaaacugcuuaucaucggcgauagcggcguuggaaaaucuucgcuucuauugcgguuugcagauaacacauucuccggauccuauauuaccacgaucggaguggauuucaaaauccgaacuguagagauuaacggcgaaaaagugaagcugcaaauuugggacacugccgggcaggaacgcuuuagaacaauuaccagcaccgcggaaacugcccugcgaucgcucccccagccugaagcucacggggguuccucuggugauucccuuaguuucgucccacuguuuaaggaauucucacccugcuucuguauaggcagaugccauagacacuuccugccgaggccacccaggguacccagacgcuguuggacguccccaccauucccaaccggagccccuuccucuccagccaaagcccccggccccggagaagaugccgcuaggagggcugacuag

SEQ ID NO: 12901 - RNA, 360 nt, Artificial Sequence
  Description of Artificial Sequence: Synthetic coding sequence
augaauaagauauuguccuccaccguaugcuuugggcuccuaacacugcucagugucuuaucuuuccugcagucuguucauggaaggccuuaccugacccaggguaacgagauuuuucccgacaagaaguacaccaaccgcgaagagcucuuacuugcacuucucaauaagaauuucgacuuucagcgacccuucaauaccgaccuggcccugccuaauaaacucgaggaacugaaccaacuggaaaagcuuaaggagcagcuaguggaagagaaggauucugaaacuucguacgcuguugauggccuguuuaguucacauccguccaaacgggcguguuuuuggaaguacugcguauag

SEQ ID NO: 12902 - RNA, 2514 nt, Artificial Sequence
  Description of Artificial Sequence: Synthetic coding sequence
auguuuaagugcuggucugugguguuagugcuuggauuuauuuuuuuagagagcgagggcaggccuacuaaggaaggcggauacggcuugaaaagcuaucagccacucaugcgauugagacacaaggagaaaaaucaggaaucuucaagaguaaagggguucaugauccaagacggaccguuuggcuccugugaaaauaaguacugcggucugggccgccacugcguuaccucucgcgaaaccgggcaggcugaaugugcuugcauggaccuaugcaagagacacuacaaacccguguguggauccgauggggaguucuaugagaaccacugugaagugcacagggcggccugucugaagaagcagaagaucaccaucguccacaacgaggauugcuucuuuaaaggagacaaguguaaaacaaccgaguauaguaagaugaaaaacaugcuccuugaccuucaaaaccaaaaguauauuaugcaggagaacgaaaauccuaacggugaugacaucagccggaaaaagcugcugguggaccagauguucaaauacuucgaugccgauuccaauggucucguagauauaaacgaacugacacaggugauuaagcaagaggagcucggaaaggaccucuucgacuguacucucuaugugcugcuuaaguacgacgauuuuaacgcugauaagcaccucgcccuugaagaauucuaccgugccuuccaaguaauccaauugucccucccugaagaucagaagcucucaaucaccgcagccacagucggacagucugccgugcugucgugcgcaauccagggaacacucaggccuccuauaauauggaaaagaaauaauaucauucuuaauaaccuugaccuggaagauauaaacgauuuuggagaugauggcucccuuuauauaacaaaggugacaacaacacaugucggcaacuacacauguuaugcagaugguuacgagcagguguaucagacccacauuuuucaggugaacguuccuccagugaucagggucuacccugaaagccaggcccgcgagccggggguuaccgcuagccuccgcugucaugcagaggggauucccaaaccucagcugggcuggcugaaaaauggcaucgacaucaccccuaaacucagcaagcagcugacccugcaggccaacggaucugaagugcacaucuccaacgugagguaugaagacaccggugccuauaccugcauugcaaagaaugaagcuggcguugaugaagacauaaguagccuguucguggaggacuccgccaggaagacaaggcuugggaucggcaauauguuuuauguuuuuuacgaagacgggauuaaggucauccagccgaucgaaugugaguuccagcgccauauuaaacccagcgaaaaauuguuaggguuccaggaugagguguguccuaaagcggagggugacgagguccagcgcugcguuugggcaagugcagugaacguaaaagauaaauuuauauacgucgcgcagccuacccuugauaggguccugauaguugacguacagagccagaaaguaguacaggcaguuaguacggauccaguccccgugaaacuccacuaugacaagucccaugaccagguuugggugcuaucuugggguacucucgaaaaaacuucaccaacucugcagguaauaacccuggccucggguaauguaccucaucauaccauccauacucaacccguggguaagcaguucgaucgggucgacgacuucuuuauccccacuacaacucugaucauuacccauaugcgcuuuggguuuauuuuacacaaagacgaggcugcccugcagaagaucgauuuggaaacuauguccuauaucaagaccaucaaucucaaagauuacaagugcgugccucagagccuggccuauacccaccugggcggcuacuacuucauuggcugcaagccugauucaaccggggcugucucaccucaggugaugguggacggcguaaccgauuccgugaucggcuuuaacagugaugugaccgggacaccuuacgugagcccugaugggcacuaccuaguuaguaucaacgacguaaaaggcuuagugagggugcaguacauuacuauacgcggggagauccaagaggcauucgacaucuacacaaaucuacacauuuccgaucuugcauuccagccgucauuuacagaggcccaccaguacaacauauacgguucgucaucuacccagacagaugucuuauucgucgagcucaguagcggcaaggucaagaugauaaagagccuuaaagagccucugaaagccgaagaguggcccuggaacaggaaaaacagacagauacaggacucugguuuauuugggcaguaucuuaugacacccuccaaggauucccucuucauucuggacggccgacugaacaaacugaacugugagauuacagaggucgaaaaggggaacacaguuauuugggucggugaugccuag

SEQ ID NO: 12903 - RNA, 648 nt, Artificial Sequence
  Description of Artificial Sequence: Synthetic coding sequence
auggccgacaugcaaaaucuuguggaacgcuuagagcgagccgucggacgccuggaagcugucucacauacuucggauaugcacagagguuacgcagauucuccaucuaaagcuggggccgcccccuauguacaggccuuugacucacuucucgcagguccuguugccgaguaccugaaaauuagcaaggagaucggcggcgacguucagaagcacgcagaaauggugcacacagggcuuaaauuggagcgcgcccugcugguaaccgcuucccaaugucaacagcccgcagagaauaagcuaagcgacuugcuagccccuauuuccgaacagauaaaagaaguuauaacguuucgggagaagaacagaggcucgaaauuauuuaaucaucugucggcagugagcgaguccauccaagcucugggguggguggccauggcgccgaaaccuggacccuacgugaaagagaugaacgacgccgccauguucuauacaaaucgaguccuuaaggaguauaaggacguugacaaaaagcacguggacugggugaaggcuuaucuuucaauuuggacugagcugcaggccuacaucaaggaguuucauacaacaggucucgccuggucaaaaacuggcccaguggcaaaguag

SEQ ID NO: 12904 - RNA, 3837 nt, Artificial Sequence
  Description of Artificial Sequence: Synthetic coding sequence
augaggcuccugcuccuugugccauugcugcuggcaccagcuccgggaucuucugcucccaaggugcgaaggcaguccgauaccuggggaccuuggucucaguggaguccuuguucgcgcacaugcggggggggggugaguuuuagagaacggccguguuauucucagaggagagauggagggucaucuugcgugggccccgcccgcagccaccgguccugucguacagaauccugccccgacggagcgagagauuuccgggccgaacaaugugccgaauuugauggugcugaauuucagggcagacgcuaucggugguugcccuauuauuccgccccuaauaagugugaacucaauuguaucccaaaaggggagaacuucuacuacaagcaucgcgaggcaguggucgauggcacacccugcgaaccuggcaagcgagauguguguguugacggcagcugccgcgugguuggcugugaucacgagcucgauaguucaaagcaggaagauaagugucugagaugcgguggagauggaacaaccuguuauccuguggcaggaacauuugacgccaacgaccuuagucggggcuauaaccaaaucuuaaucguucccaugggggccaccucaauauugauugaugaggccgcugccucccgaaacuuccuugccguuaagaacgugcggggcgaauauuacuugaacggacacuggaccaucgaagccgccagggcucugcccgcagccucuacgauucuacacuacgagcguggugcugagggcgaccuggcuccagaaaggcugcacgcccgggggccgacauccgaaccgcucgugaucgaacuuaucucccaggagccuaauccugguguucauuacgaauaccauuuaccccucaggaggcccucaccagguuucucauggagccacgggagcuggucugauuguucugcggagugugguggcggccaccaguccagacucguauucuguacaaucgaccacgaggccuaucccgaccacaugugccagcgccaaccacgaccugcagaccgccgguccuguaaccuccaccccuguccugaaacuaagcgauggaaggccggcccuugggcucccuguucugccaguuguggagggggcagucagaguagaaguguguauugcauuucaucagacggcgccgggauucaagaagccguggaagaagcggaaugugcuggacugcccggcaagcccccagcgauccaagcaugcaauuugcaaaggugcgcugccuggucuccggaaccauggggcgaaugcucuguaucuugcggcgugggcguaaggaagagguccgugacuugucgcggugaacgaggaucccuucuucacacggccgcgugcagcuuagaggaucgaccaccacucaccgaaccuugcguucaugaggacugcccacuguuaagugaucaagcguggcacgugggaaccuggggccugugcucuaaaucaugcaguuccgggacgcgucggcggcaagucaucugcgcaauugggccgccaucccauugcggaucccugcagcacagcaaaccaguugacguggagccauguaauacccaacccugccacuuaccccaggaagugcccagcaugcaggauguucauacuccagccagcaaccccuggaugccccuggguccacaggagagcccugcuuccgacucgagaggacaauggugggccgcacaggaacauccaucugccagaggcgaccaccgcggggagagaggcgacccuaggggggaucagggaacccaccucucugcccugggcccugcaccgucucuccagcagccccccuaucaacagccccuaaggaguggguccggcccucacgauugccgccacagcccccacggcuguugcccugacggccauaccgcaucucugggcccucaguggcagggcugcccgggcgcuccgugccagcagucgcgcuacggcuguugccccgaucggguuuccguugccgaagggccacaucaugccggcuguacgaagucauaugguggcgacaguacgggagguaugccaaggucucgggccguggcaucgaccguccauaauacccaucagccucaggcacagcaaaacgagccuagcgagugccggggaucucaauucggguguugcuacgacaacguugccacugccgcaggaccccucggagaggguugcgugggccaaccaucacaugcuuauccagugcgcugucugcuccccagcgcccaugggucuugugcugauugggcagccaggugguauuuuguagccagugugggucaauguaauagauucugguacggggggugucacgguaacgcuaauaauuuugcauccgaacaggaguguauguccagcugucagggcucucugcacggcccccgucgaccccagccuggugccucugggcggagcacccacaccgauggcgggggguccucucccgcgggcgaacaggagccaucacagcacagaacaggagcagccgugcagaggaagcccuggccuucaggcgggcuauggcgccaggaccagcaaccuggacccggagaggcaccucacacucaggccuucggagaguggcccuggggccaggaacugggaucaagggccccaggacuggggggcgaugcggggaguccugcaccuccauuccauagcucuuccuaccggaucucucuggccgguguggaacccucacucguucaagcugcccucggacaacugguaagacucuccugcagcgaugacaccgccccagagucccaggcugcauggcagaaggacggucagcccauuucauccgaucgccaccgguugcaguuugacggaucccucaucauccacccucuccaagccgaagaugccgguacguacuccuguggaucaacaagaccuggacgcgacucucaaaagauucagcugaggaucaucgguggggauauggccgucuugucagaggccgaacucagccgguuuccacagccccgggauccugcccaggacuuuggccaggcuggcgcagccggccccuugggcgcgauucccagcucucacccucagcccgcuaacagacuccggcuagaccagaaucagccgagggugguggaugccuccccaggacagagaauacgaaugacaugccgggcugaggguuuuccuccucccgcgaucgaauggcagcgcgacggccagcccgugucuucuccccgccaucaguugcaaccugacgggucauuaguaaucagucgcguggccguugaagacggaggcuucuauaccugcguugccuuuaauggacaggaccgcgaccagagguggguccaacugagagugcugggugagcuaaccaucagugggcuaccaccaacugucaccguuccggagggagacacugcuagacuucugugcguggucgccggggaaagcguuaacauccgguggagcaggaacggacugccgguacaggcagacggacaccgggugcaucaaagcccagauggaacucugcucauuuauaaccuccgcgccagagacgagggaucguauacuuguucugccuaucaagguucgcaagccgugucucggucuacugaggugaagguggugucgccagccccaacagcccaaccgagagauccuggccgcgauuguguggaccagccugaauuggcgaauugugaucugauccugcaggcccaacuuugcggaaaugaguauuauagcucguucuguugcgcauccugcucccgcuuucagccacacgcucaacccauuuggcaguag

SEQ ID NO: 12905 - RNA, 546 nt, Artificial Sequence
  Description of Artificial Sequence: Synthetic coding sequence
ugaaagggacaugccucacccuuacccccuucugcugcaccaaccaccgauucaacugauucuaucaccggccaaaauaguagacagagagaggaagaacucgagcucauugaccaguugcgcaaacauauagaguauagacuuaaggucagucuuccuugcgaccucggagcugcccuuacagauggagucguacugugucaccuagcgaaccacgucaggccacgcuccguccccucuauccacgugcccagucccgcuguuccaaaacuuacaauggcuaaguguagacgcaauguggagaacuuuuuggaagcuugccggaagaucggaguuccacaggacaaucucuguuccccgucugacauccugcagcucaaucuuagcguaaaaaggaccgucgagacccuacuaucucuaggggcucauagcgaagagucuaguuuugugugccuaucucuacagcuccuuggcuucgucgcguuuuacugcacaguaaugcugaccuuaugcgugcuguacuauuggcuuuuucccgcucgauag

SEQ ID NO: 12906 - RNA, 804 nt, Artificial Sequence
  Description of Artificial Sequence: Synthetic coding sequence
augggaccagaagcacuaucgagccugcugcuguuguuacuagucgccaguggugaugccgauaugaagggccauuucgauccagcaaagugcagguaugcacuggguaugcaggacagaacaaucccagacucagauauuagcgccucuuccucuuggucagauagcacggcggccaggcacucccggcuugagucuagugacggcgauggggcuugguguccagccggcucaguguuuccgaaagaggaggaauaccugcaaguggaccuucagagacuucauuuggucgcgcugguaggaacccaaggcagacacgcaggggguuuggggaaagaguucucaagaagcuacagauuaagauauucccgcgauggaaggcgauggauggguuggaaggacagguggggccaggagguuaucucugggaacgaagauccagaaggggucguccugaaggaccugggcccaccuaugguagcaagacuggugcgcuucuauccccgcgccgauagaguaaugagugugugccuaagaguugaacuuuauggaugucuguggcgggaugggcuacuaucuuacacagcaccggucggccagaccauguaccuaagcgaggccguguauuugaaugacucuaccuaugacggccacacuguugggggccugcaauaugggggcuuggggcagcuggcagacggagucguuggcuuggacgacuuccgcaagagucaggaacugcguguguggcccggguaugacuacgugggguggucuaaccauuccuucagcuccggcuacuag

SEQ ID NO: 12907 - RNA, 345 nt, Artificial Sequence
  Description of Artificial Sequence: Synthetic coding sequence
auggcacccaagaaacucuccugccuaagaagucuccuguuaccauugucccugacucuccuuuugccacaggcugacacaagaucuuuuguggucgauaggggacaugaucgcuuccucuuggacggugcuccuuuccguuauguguccggcagccuacacuauuucagagugccaagaguccugugggcggacaggcuccucaagaugcgauggagcgggcuuaaugcaauacaguucuauguacccuggaauuaccacgaaccccagcccgguguguacaauuuuaacgguagucgggauuugaucgccuuccuuaacgaagccgcccuggccaaucuguag

SEQ ID NO: 12908 - RNA, 507 nt, Artificial Sequence
  Description of Artificial Sequence: Synthetic coding sequence
gcaccccgcauggaaauguuucagggucuccugcuccugcugcugcuuagcaugggaggcacgugggcuucaaaagaaccccuucguccgagaugccgaccaaucaacgccacgcucgccguagaaaaagaagguugcccuguuuguauuaccgugaauaccacuauuugcgccgguuacugucccaccaugacucggguucuucaggggguucugccagcucuaccccaggugguuuguaauuaccgugacguccguuucgaauccauucggcucccaggauguccuagaggagugaacccggucguguccuacgcaguugcacuguccugucaaugugcccuaugucgaaggucuacaacggauugugggggcccuaaagaccauccauugacaugcgaugauccaagauuccaggacagcucuagcuccaaggccccuccccccaguuugcccagcccuuccaggcugccggguccauccgacaccccuauccuuccucaguag

SEQ ID NO: 12909 - RNA, 1203 nt, Artificial Sequence
  Description of Artificial Sequence: Synthetic coding sequence
auggagacucaagaacuucggggugcucuggcccugcuccugcugugcuuuuucacaagcgccucccaagaccuccaggugauagauuuacugacagucggcgagagucgccagaugguggcuguggccgaaaagauucgaacagcucuucugacagcaggcgauauuuaccuucugucuacuuucaggcugccaccaaagcaagggggcgugcucuucggacuauacagucgacaggauaauacucgaugguuggaggcaagcguggucgggaagaucaacaagguuacuaaugcucuccauucuauccugggggaaggcaacgugccugacccuaagcaucauuacgggguuagcggguuucaugagcaacggucucauuguagcccgaauccaugcuuccgggggguugacugcauggaaguguacgaguaucccggguaucgcugcggaccaugcccaccaggucuucagggaaacgguacacacuguagcgacaucaaugaaugcgcccacgcagacccauguuuccccgguucuucuuguauuaacacgaugcccggcuuccauugcgaagcuuguccacggggcuauaaaggcacucaggugagcggagugggaaucgacuaugcacgggccucaaaacagguaugcaaugauauagacgagugcaaugacgguaauaacggcggcugugacccaaauucuauauguacaaacaccguuggaagcuuuaagugcgggccuuguaggcugggauuucuagggaaucagucacagggaugucuacccgcccggaccugccacucgccagcucauagcccaugccacauucacgcacauugcuuauuugaaaggaacggugcggucucgugccagugcaacgugggaugggccggaaauggcaaugucugcggaacagacaccgauaucgauggauacccugaucaggcgcuccccuguauggauaauaacaaacauuguaagcaggauaauugccuucuuacuccuaauucuggacaagaggaugcagauaacgacggggugggagaucagugcgacgacgaugcugacggcgacgggaucaagaaugucgaggcuuccccaauggauuggaccauugcuuuaaagagcccaacacauuacagacagaccgguaugcggaccggcugggaaaugcuugcuacagccgcucugaaauag

SEQ ID NO: 12910 - RNA, 618 nt, Artificial Sequence
  Description of Artificial Sequence: Synthetic coding sequence
augaugcguacgcuuauuacaacgcauccccugccauugcucuuacuaccgcaacagcuguugcagcugguacaguuccaagaaguggauacagacuucgacuuccccgaagaagauaagaaggaagaguuugaggaaugccuggagaaguucuuuagcacaggcccugcacgaccaccgacuaaagaaaaaguuaagcguagggugcuuauugagccggguaugccucuaaaucauaucgaguacugcaaucacgaaauaaugggaaaaaauguguauuauaaacacagaugggucgcugaacacuacuuucuccucaugcaauacgaugagcuucagaaaaucuguuacaacagauuugugcccuguaagaacgggauucgaaaguguaaucgcucaaagggucuaguagaaggaguguauuguaauuugaccgaagccuucgaaaucccugcuugcaaauaugaaucccuguaucgcaagggguacgugcugauaaccugcaguuggcagaacgaaaugcaaaaacggauuccucauaccauaaacgaucucguggaacccccugaacacagaaguuuuuuguccgaagauggcguguucgugaucucgccauag

SEQ ID NO: 12911 - RNA, 177 nt, Artificial Sequence
  Description of Artificial Sequence: Synthetic coding sequence
auggaccugcuacaguuucucgcauuucuguucgugcugcuucuguccgggaugggcgcuacgggaacacuuagaacaagccucgaccccucacuggagaucuacaagaaaauguuugaagugaaacgcagagaacaacuacuggcccugaaaaaccuggcccaacugaaugacuag

SEQ ID NO: 12912 - RNA, 450 nt, Artificial Sequence
  Description of Artificial Sequence: Synthetic coding sequence
augaaggucauagccauuuugacucucuuacuguucuguucccccacccacagcagcuucuggcaguuucaaaggcgagucaagcacauaaccgggagguccgcuuucuuuuccuacuacggcuacgguuguuacugcggauugggugacaaagggauccccguggaugauaccgacagacacucucccagcucucccucccccuaugaaaaauuaaaagaauucucaugccagccuguucugaauaguuaucaguuucacaucgucaauggagccgugguguguggcugcacucucggcccuggagcgucaugucauugccgcuuaaaggcgugcgaaugcgauaagcaaagcgugcauuguuucaaagagucucugcccacuuaugagaagaacuucaagcaguucuccucacaaccucgcugcggaagacauaaacccuggugcuag

SEQ ID NO: 12913 - RNA, 237 nt, Artificial Sequence
  Description of Artificial Sequence: Synthetic coding sequence
augggcuccggccugccccugguacuuuuauugacgcuuuuagguucuucacacggcacuggccccggcaugacguugcagcugaaauuaaaggagagcuuccuuaccaacucuuccuaugaaaguucauuucuugagcuucucgaaaagcugugucugcuccuccaucuuccauccggcacguccguuacccuucaccaugcccgaucacagcaucacgugguauguaacacguag

SEQ ID NO: 12914 - RNA, 1461 nt, Artificial Sequence
  Description of Artificial Sequence: Synthetic coding sequence
augauuucaccaaguccuucgcaggaggaacuucagaccacacuggaagagaccgaucagucaacucaggaaccauuuaccaccaagauaccuagaacuacagagcuugcuaaaaccacccaggcaccccacagauucuauacaacugugaggccucguacuagcgauaaaccccauaucaggccugugcugaauaggacaaccacacgaccaacaagaccgaaacccagcgggaugccaaguggcaacgggguugguacuggcguaaaacaggcaccucggccaaguggcgcugaucgcaacguaucuguagacuccacccauccaacaaagaagccaggcacaagaaggcccccccuucccccuaggccuacacacccuaggcgaaagccccugccaccaaauaacgucaccggcaagccugggagcgcagggaucaucagcucaggaccuauaacgacaccuccccuucggucaacuccuagaccuaccggaacaccucuugagagaaucgagacagauauuaaacagccaacgguuccagccuccggagaagaguuggagaacaucaccgacuuuagcucuucccccacucgcgaaaccgauccauugggcaagcccagauucaaaggaccucaugugagauauauucagaagccggauaauagccccuguagcauuacagacagcguaaagcgguucccuaaagaggaggccacggaaggaaacgccacuuccccuccccagaauccaccuacaaacuugacagugguuacgguggaaggauguccgaguuucgugauacuugauugggaaaaaccccugaaugauaccgugacggaguacgagguuauuagccgagaaaacgggagcuuuagugggaagaauaagagcauacaaaugacuaaccagacauucaguacuguugagaaucugaagcccaauacuucauacgaauuccaaguaaaaccgaagaauccacugggagagggaccugugucuaacacugucgcuuuuagcacugaauccgccgacccacgcguguccgagccuguguccgcugggagagaugccauuuggacugaaagaccauuuaauucugacucuuauuccgaguguaaagggaaacaauacgucaaacgcacaugguacaagaaguucguuggggugcaacugugcaauucucugcgguauaagauuuaccucuccgacaguuuaacgggcaaguucuauaacaucggugaucagagaggccacggugaagaucauugccaguuuguggauagcuuccuugacgggaggacaggucaacaguuaacaucggaccaacugccuaucaaagagggguauuuccgcgcaguuagacaggaacccguccaauucggugagaucggagggcauacacagauuaacuacgugcaaugguacgagugcggcacgacaauaccaggaaagugguag

SEQ ID NO: 12915 - RNA, 243 nt, Artificial Sequence
  Description of Artificial Sequence: Synthetic coding sequence
ugaaacggcccuguucugugguucaaggggaccggcccuaauagaaagcucauuuacaacuuuaaacaagaacagaauccccgcccccccaagaauagaccugccggacgugccggaagccgggcccaccaugacgcgcauacgugccuguccgcccugccugagcggaacuccaccaauuauuuuguccagccaugcugcugccuaagguugcugggucugacuggucuacuaucaaaguag

SEQ ID NO: 12916 - RNA, 1341 nt, Artificial Sequence
  Description of Artificial Sequence: Synthetic coding sequence
augcugcaccccgagacuaguccuggacguggacaccugcucgccguucugcuggcgcugcugggaacgaccugggcugagguguggccaccacaguuacaggagcaagcaccaauggccggcgcccuuaaucgcaaagagagcuuccuccugcucucccuucacaauaggcucaggaguugggugcaaccaccagcugcggacaugagaagacuggacuggucggauagucuggcccagcuugcccaggcacgggcagcauugugcggaaucccuaccccuucacucgcgucaggccuguggagaacacuccaggugggcuggaacaugcagcuguuacccgcugggcucgcaucguucguggaaguugucuccuuaugguuugcugaggggcagagguauagccacgcugcaggugagugugcccggaaugccaccugcacccacuauacccaguugguuugggcaaccucaucccaauuggggugugguaggcaccuguguagcgcuggucagacagccauugaggccuucguuugugcuuacagcccgcgaggcaacugggaaguaaauggaaagacgaucaucccauacaaaaaaggugcguggugcucacuauguaccgccaguguaagcgggugcuucaaagccugggaccaugcaggagguuuaugugaagugccgaggaacccuugccggaugucgugucagaaccacgggaggcucaacauauccaccugccauugccacuguccaccuggauauacuggaagauacugccaaguaagguguucucugcaaugugugcauggccguuucagggaagaagagugcaguugcgucugugauaucggguacggaggagcucagugugcuacaaaagugcauuucccuuuccauaccugugacuuaagaaucgacggugacuguuuuauggucuccuccgaggccgauacguacuaucgagcgaggaugaaaugucagcgaaaaggaggcguccucgcucaaaucaagagccagaaggugcaggacauacuagcuuuuuaucucggaagguuagagacaacaaacgaaguuauugacuccgauuuugagacuaggaauuuuuggauaggacugacuuacaagaccgcaaaggacucauucaggugggcaacgggcgagcaccaggcauucaccucauucgcuuuuggccaacccgauaaccacggauucggaaauugugucgagcugcaggccucagcagcuuuuaauuggaacgaucagcgauguaaaacaaggaaccgguacauuugucaguuugcccaagaacauaucucacggugggggccugggaguuag

SEQ ID NO: 12917 - RNA, 432 nt, Artificial Sequence
  Description of Artificial Sequence: Synthetic coding sequence
augcaggcugcuugcugguacguucuguuucuucuccaaccuacggucuaucuagucaccugugcuaacuugacaaauggggguaagucugaacuucugaaguccgggucuucuaagagcacgcucaagcacauuuggacggaaucuuccaaagaucugucaauaagucgacugcuaagccagaccuuucguggcaaagaaaacgauaccgaccuugaucuucgcuaugacacucccgaaccuuacucagaacaagaucuaugggacuggcuccgaaacucaacugacuugcaagaaccuagaccaagggcuaaacgcaggccaauugugaagacagguaaguuuaaaaagauguuuggcuggggagacuuccacucuaauauuaaaacagugaagcucaaccuucugaucacugggaaaauuguggacuag

SEQ ID NO: 12918 - RNA, 783 nt, Artificial Sequence
  Description of Artificial Sequence: Synthetic coding sequence
augcagggagaaccauucgcaugcuugacccaccaggagccucuucccaagauguucaagcuguuaagccgggcguacgccgacgugcauccuaugaugauggaccggucugaaaauagguguggcggaaauuuucugaaaaggggcucuaucauaaacggcgccgacugguauucuuuuacugggggaaugagugauuuuaacuaccugcauacaaauugcuuugagauuacuguugaacuggguugcguaaaguuuccgccugaagaagcccuuuacauacuuuggcagcacaauaaagaaagcuuacucaauuucguugagaccgugcauaggggaaucaagggaguggugaccgacaaguucggcaaacccgugaagaaugcccgaauuagcguuaagggcaucagacacgauaucacuacugcuccagacggcgacuauuggcgccuccugccucccgggauccauaucgugauugcccaggcuccuggauaugcaaaagugauuaagaaggugaucauccccgcucggaugaaaagggcuggucgggucgauuucauccugcaaccucucggaaugggcccaaagaacuucauacacggucuccggagaacaggcccucacgauccucuugguggugccagcucccugggcgaagcuacagaaccggacccccugagagcucgccgccagcccuccgcggauggaagcaagccaugguggugguccuauuuuacuucuuugucuacccacagaccucgguggcucuugaaguacuag

SEQ ID NO: 12919 - RNA, 882 nt, Artificial Sequence
  Description of Artificial Sequence: Synthetic coding sequence
augucaagcgggggaggcucuagggggcuauuagcauggcuccuccucuugcagccauggccaggccaaaauugggcaggaauggcagcuccacgcuugcccaguccccugcuaucugaggaaggcggcgagaacccugaagcaucacccgcccccggcccagaggcggggccuccccuuaaucucuucacuuccuucccgggagacagcuugcucuguggccggacaccuuuacgaaucguuggcgguguggaugccgaggaaggucgguggcccuggcaagugucagugagaaccaaaggucggcauauaugcggagguacccuagugacugccacaugggugcugacugccggucauugcauuucaaguagauuucacuauuccgucaagaugggcgaucgcaguguguacaaugaaaacaccucaguggucgugagcgugcagagagcuuuuguccaccccaaguucuccaccgucaccacaauccgcaacgaccuggcacuacugcagcugcagcaccccgugaauuuuacuucuaacauacagcccaucugcauaccccaagagaauuuucaaguagagggcaggacgcgguguugggucacugggugggggaagacacccgagagggagaagcucgcuuccgagauccugcaggauguggaucaguauauuaugugcuacgaagaguguaauaaaaucauccagaaggcccugucuucaaccaaggacgucauuauaaaaggaaugguguguggcuauaaagaacaagguaaggacucaugccagggugacuccggggggagauuggcuugugaauauaacgacacaugggugcagguuggcauugugaguuggggaauugggugcggaagguag

SEQ ID NO: 12920 - RNA, 870 nt, Artificial Sequence
  Description of Artificial Sequence: Synthetic coding sequence
auguuuguguuacuauacgucaccuccuuugccaucugcgcuaguggacagccccgcggaaaucagcucaagggcgaaaacuacuccccccgcuauauuuguuccauuccagggcugccgggcccuccugggccacccggugccaacggcucuccaggaccccacggaaggaucgggcugcccgggagggacggucgugacggacguaagggcgagaaaggugagaagggaacugcaggucuacgcggcaagaccggaccacuagggcucgcaggcgaaaagggcgaucagggcgagacugguaaaaaaggaccaauugguccugagggagagaagggcgaagugggaccaauaggcccuccagguccaaagggggaucgcggcgagcaaggagacccaggccucccgggaguuugucggugcggcagcaucgugcuaaagagugcuuuuagcgucggcaucacaacaagcuauccugaggagagacugccuaucauuuuuaacaaggucuuguuuaacgagggugagcacuacaacccagcuacugguaaauuuaucugcgcauucccgggcaucuacuauuucaguuacgacaucacccuggcuaauaaacauuuggcaaucggacucguucacaacgggcaauacaggaucaaaaccuucgaugcuaauacggggaaccacgacguggccucuggguccacagugauauaccugcagccagaggacgaggugugguuggagauauuuuucacugaucagaauggacucuucucagacccuggaugggcagauucccuguuuucuggauucuugcuuuaugucgacacugacuaccuggauucgauauccgaagacgacgaguuguag

SEQ ID NO: 12921 - RNA, 2742 nt, Artificial Sequence
  Description of Artificial Sequence: Synthetic coding sequence
auggggccugaggcccuguccucauuacuccuucugcuccugguggcaagcggcgaugccgacaugaagggccacuuugauccugccaaaugucgcuacgcccuuggaaugcaggaucggacaauuccagacucugacauaagcgccucaaguagcuggucugacagcacagccgcccgccauucuaggcuugaauccagugacggcgacggcgccuggugcccggccggcaguguguucccgaaggaagaagaguauuuacagguggacuuacagaggcuacaucugguagcucucguugguacccagggacgacacgcuggcggacucgggaaagaguucagccgcagcuaucgccuacgguacucuagagaugggaggcgcuggaugggauggaaagacagguggggucaagaaguaauaagcggaaacgaagaucccgaaggaguuguccugaaagaucucgguccuccgaugguugcacgguuagugagauucuauccuagagcagacagagucaugucuguaugucuacgcguagagcucuacggcugucuuuggcgcgacggccuucugucuuacacugcgccagugggacaaacuauguaccucagcgaggcaguguaucugaaugacaguacuuaugacggccacaccguaggaggucugcaguauggaggacuggggcaguuggcugauggaguggugggccuugacgacuuuaggaagagccaggagcuuagggucuggccgggcuacgacuacguuggguggaguaaucacuccuucaguaguggcuacgucgaaauggaguucgaauuugaucgacugcgagccuuucaggcaaugcaggugcacugcaauaacaugcauaccuugggcgcccgcuuaccaggggggguugaaugcagauuuaggagaggcccagcaauggcgugggagggcgagccaaugcggcauaaucuggggggcaacuugggcgauccccgugcuagagcggugucugugccuuuagguggucgcguagcgagauuccuacaaugccgguuccucuucgcugguccuugguugcucuucagugaaauauccuuuauauccgacguugugaacaauuccucccccgcgcuagguggaacguucccacccgcgccaugguggccgccuggacccccccccacuaacuuuuccucgcuggaacuugaaccccgaggccagcagcccguagcaaaggcggaaggcagcccaaccgccauccucaucggaugccuaguggcuaucauccuccuucuguuacucauaauugcacugauguuguggcggcugcacuggcggcgacugcucucuaaggccgagagacggguauuggaggaggaacugaccguucaucuguccgugccaggugacacaauacuaaucaauaauaggccuggccccagagaacccccccccuaucaagaaccgagaccacgcgggaaucccccucauagcgcacccugcgugccgaacggaucugcccugcugcuuucuaaccccgccuaucgccuguuacucgccacuuacgcccggccaccccgcggacccggaccaccaacacccgcuugggccaaaccaacaaauacacaggccuacuccggugacuauauggaacccgaaaagccuggcgccccucugcugccccccccgccccagaacagcgugccccauuacgcugaagccgacaucgugacucugcaggggguaacaggggggaacaccuacgcaguacccgcccuuccacccggggcggucggggacggcccuccacgggucgauuucccucggucacgccugcgcuuuaaggaaaaguugggugagggccaguuuggcgagguacaccuuugugaaguggacagcccucaagaccuggugucguuagacuucccccucaauguccguaaaggacauccccugcugguggccgucaagauccugcggccugaugcaacaaaaaacgcucgcaaugauuuucugaaagaaguaaagaucaugagcaggcucaaggauccaaauaucauacgacugcuugggguguguguccaggacgacccguugugcaugauuacggauuacauggaaaacggcgaccugaaucaauuccuguccgcccaucaacucgaggacaaagcagcugagggugcuccuggcgauggucaagcugcucagggaccuacaauuucauacccgaugcugcugcauguugcugcccagauugccuccgggaugcgguaccuggcuacuuugaacuuugugcauagagaucuugcaacacgcaacugucugguuggcgagaauuuuacaaucaagauugcugacuuuggcaugucaagaaaccucuacgccggugacuacuacagaguacaaggucgagcagugcugcccauccgguggauggcuugggaaugcauacugaugggcaaauuuaccacggccagugacgucugggccuucggcgugaccuugugggagguccugauguugugccgggcccaacccuucggacaacucaccgacgaacaagugaucgagaaugcuggagaauuuuuccgggaccagggucggcaagucuauuuauccaggcccccugcaugcccucagggccuguacgaguugaugcuccggugcuggaguagagaaagcgagcaacgcccccccuucagucagcugcacagguuucucgcagaagacgcuuugaauacuguuuag

SEQ ID NO: 12922 - RNA, 1089 nt, Artificial Sequence
  Description of Artificial Sequence: Synthetic coding sequence
augcguaccuuguuuaaucuccuuuggcucgcccuugcuuguucgccuguucauaccacacugagcaaaagugacgccaagaaggcagcauccaaaacucuguuagagaaaucacaauucagugacaaaccggugcaagauaggggacucgugguuacagaucugaaggcugaauccguagugcuggagcaucguucauacugcagugccaaagccagggacagacauuucgcuggcgacgugcuggguuacguaacuccuuggaauucucacggguaugacgugacuaaagucuucggaucaaaguuuacucagauaucacccguuuggcugcaguugaaacgccgcggucgcgagauguucgaggucacaggccugcacgaugucgaucaaggguggaugagagccguacgaaaacaugcuaaaggccuccauauaguaccacgccugcucuucgaagauuggacguacgaugacuuucgcaacgugcuugacagugaagaugagaucgaggagcugagcaaaaccgugguucagguggcaaagaaucaacacuuugacggcuuugugguggaaguuuggaaucagcugcucagccaaaaaagaguaaccgaucaguuggggauguucacucacaaggaguuugaacagcuggcccccguucucgacgguuucucucucaugacuuacgauuauucuaccgcgcaccagccaggcccaaacgcaccucugagcugggugcgggcaugcgugcagguuuuagacccuaaaaguaaguggcgaucaaagauucugcucggccucaacuucuacggcauggacuacgcaacuucuaaagaugcaagggaaccaguugugggcgcccgguauauacagacacugaaggaucaucggccacgaauggugugggauucacaggccucagaacacuucuuugaauauaaaaaaagucgguccgggcggcacgucgucuuuuaucccacccugaagucacuccagguuaggcuggaacucgcucgcgaacucggcguuggugugagcaucugggaacucggccaaggcuuggacuacuucuaugauuuauuguag

SEQ ID NO: 12923 - RNA, 1350 nt, Artificial Sequence
  Description of Artificial Sequence: Synthetic coding sequence
augaaguuccagggaccgcuggcuugcuugcuguuagcccugugcuugggaucaggcgaggcaggaccccugcagucgggggaagagucaacagguaccaacauaggggaagcucuuggccacggauuaggcgacgcuuuguccgagggaguugggaaggcuauuggcaaagaggccggcggcgccgcaggauccaaagugagugaagcuuuaggucaggguacacgcgaagcugugggcacuggcguucgacaggugcccggcuuuggcguugcagacgcuuugggcaaucgcgucggggaggcagcacacgcucugggcaacacuggacacgagauuggacgacaggcugaggacgucaucagacacggggccgacgcgguuagaggguccuggcagggcguccccggacacaacggagccugggagacuuccggaggccauggcauuuuugggucccaggguggccuaggcggacagggacaagguaaucccggagggcugggaacuccguggguacauggauacccugguaacucagcugguagcuucgguaugaauccucagggugccccguggggacaggggggcaacgguggcccccccaacuucggcacuaauacacaaggcgcaguugcccagccaggcuauggcucugugagggcuucaaaucagaaugagggaugcacuaaucccccucccuccggaagcgggggugggucaagcaauagcgguggcuccucuacuggaucuucaagcggcaaccacggaggcagugggggcggcaacggccauaaaccaggcugcgaaaaaccgggcaacgaggcaagagguuccggugaaucaggcauccagggccaaggcaguucuuggggaaguggaggcggggacgcaguuggaggcguaaauacuguaaauagcgagacgucccccgggauguucaauuuugacacuuucuggaagaauuucaaaucuaaacucggauucaucaacugggaugcuauaaauaagaaccaagucccaccuccuaguacgcgcgcacuuuuauauuuuagucgacucugggaagauuuuaagcagaauacaccuuucuuaaacuggaaagcuaucaucgaaggugccgacgccagcucccugcagaaaagagccgggcgagacgaucagcccggggcgggcuggcaagagguugccgcugugacguccaagaacuacaauuacaaucagcaugcguaccccaccgcauacggggggaaauacuccgucaagaccccugccaaaggaggcgugucucccucuagcagugcuucccgggugcaaccagggcucuuacagugggugaaguucugguag

SEQ ID NO: 12924 - RNA, 735 nt, Artificial Sequence
  Description of Artificial Sequence: Synthetic coding sequence
auguggggagccccacucccccgccgaccaguaugggaugugaggucagcuucagccgguccucagcccugccuuggaggcaaaaugaaacuuaaucuuguccagauauucuucaugcugcugaugcuuuugcuuggcuuaggcaugggucugggccugggacuccacauggcuaccgccguucucgaagaaucagaccaaccacuuaaugaguucuggucaucugauagucaagauaaagccgaagcuacagaggaaggugacgggacacagaccacugagacacuggucuugucaaauaaggaaguggugcagcccgguuggccagaagaucccauccuaggggaggacgaagugggcgggaacaagaugcuuagagccuccgcucucuuccagagcaauaaagacuaucuacggcuggaucagacagaccgagagugcaacgacaugauggcccacaagaugaaggagcccagucaaucaugcauagcgcaguaugcuuuuauucaugaggaccuuaacacugugaaagccguaugcaacucucccguaauagccugcgaguuaaaaggcgggaaaugccacaaguccuccagacccuuugaccugacccucugugagcugucccagcccgaccaggucacaccuaauugcaauuaucugacuuccguaauaaaaaagcacaucauuaucacguguaacgauaugaaacggcagcuuccuacaggacaguag

SEQ ID NO: 12925 - RNA, 1728 nt, Artificial Sequence
  Description of Artificial Sequence: Synthetic coding sequence
auggcguccuggcuacggagaaaauugcgcgggaagcgccgaccagugauagcauuuugucuccugaugauucuuucagccauggcaguuacaagauucccuccccagagaccaucagcuggcccggauccaggccccauggagccgcaaggagugacaggcgccccagcuacccauauucgacaggcucuguccucuucaaggcgccagcgugcuaggaacaugggcuuuuggcgcagcagagcucugccccgaaauagcauucuuguaugugcugaagaacaagggcaucgugcaagagucgacagauccagggagagccccggcggggaccuccgccacccaggaaggguucguagggauaucacccuaaguggucauccccgccuuucuacucaacacguggugcucuuacgcgaggacgaagucggggaccccggaacgaaggacuuagggcacccacagcacgguuccccuauccaggaaacccaaagcgagguggucacuuugguuucacccuugccaggaucggauauggcggcccucccugcuuggcgggcuacaucagggcucacccuguggccucauacggccgaaggccgugaccuucuuggcgccgaaaauagggcccuuacaggaggccagcaggccgaggauccuacacucgcuaguggagcucaccaauggcccgggucugucgagaagcuccagggcucaguuuggugugacgcugagaccuuacuaagcucaucaaggacuggcggacaggcuccacccugguugaccgaucacgaugugcagaugcuacguuugcuagcacagggggaagugguggacaaggcacggguuccugcacauggccaagugcugcaggugggcuucucgaccgaggccgcucuccaagaucucaguucaccccgccugagucaauuguguagucagggccuguguggccucauaaagcggccaggcgacuuaccagagguguuaucuuuccacguggaccgugugcugggccugagacguucucuuccugcuguggcucggagguuucacuccccccuguuaccauauagguauacugacgguggugcuaggccaguuaucuggugggcacccgaugugcagcaucugagcgacccugaugaggaccagaacucucuugcgcucggcugguugcaguaucaggcccugcuggcgcauucauguaauuggcccggucaagcacccugccccggcauacaccacacugagugggcccggcuggcccucuucgacuuccuacugcaaguccacgaucgccucgaucguuacugcugcgguuuugaacccgagccuucugacccgugcguggaggagcgguugagggagaagugucagaauccugcagaacuuagacugguccacauccucguuagaagcagcgaccccucacaccuggucuauauugacaacgccggcaauuugcagcacccugaggauaagcugaacuuccgacugcuugagggaaucgacggcuuuccagagagcgcggucaaaguguuggcaagugggugccuccagaauaugcuacuuaagagcuugcagauggacccgguauucugggaaagucagggaggugcucagggccuuaagcagguccugcagaccuuagagcaacgcggucaggugcuucuugggcacauccaaaaacacaaccugacacucuuucgcgaugaagauccuuag

SEQ ID NO: 12926 - RNA, 390 nt, Artificial Sequence
  Description of Artificial Sequence: Synthetic coding sequence
auggcugcugguucagcgcccaugcagcugcauuuacgagccacuauucgcaugaaggauggacuuuguguuccaaggaaauggaucuaucaccugaccgaaggcaguaccgaucugcgcacugagggccguccagauaugaaaacagagcuguucucgagcucgugcccaggcgggaucaugcucaacgaaacaggacagggguaucagcgcuuccugcucuauaaucgcagcccgcaccccccggagaaguguguggaagaauucaaaucuuuaaccagcugucuagauaguaaggcauuccuccugacaccuaggaaccaaggaaaaggacugaaaucucauaagacugggcuggggcugaccaagucgaguggcgugacagguuag

SEQ ID NO: 12927 - RNA, 567 nt, Artificial Sequence
  Description of Artificial Sequence: Synthetic coding sequence
auguuucaccaaaucugggcugcgcugcuguacuucuacgguauuauacuuaacagcaucuaccaauguccagaacauucccaauugaccacccugggaguagaugggaaggaauucccugagguucaucuuggucagugguauuuuaucgcaggggcugccccuacgaaggaggaguuggccacuuuugacccaguggacaacaucguauuuaacauggccgccggcagugcaccaaugcaacuccaccuucgagcuaccauucgaaugaaagacggacugugcguuccacggaaauggauuuaccaucugacagaagggucuacagaucugcggacggaaggcagacccgacaugaagacagagcuguucucauccucuugccccggaggcaucaugcucaacgagacaggacagggcuaccagcgcuuucugcuguacaaucggucuccgcaucccccugaaaagugcgucgaggaguucaaaagccucacgagcugucuugacucuaaggcauuuuuacucaccccacgcaaccaagaggcuugcgaauuauccaacaacuag

SEQ ID NO: 12928 - RNA, 2676 nt, Artificial Sequence
  Description of Artificial Sequence: Synthetic coding sequence
auguuaccaaccgaggugccacagucgcaccccggaccauccgcuuugcuauugcuacagcuguugcucccacccacaucugcuuuuuucccaaacaucuggucucuccucgcagcccccggcagcaucacccaucaagauuuaaccgaggaagcagcccugaacgugacccuacagcuguuucuagagcaacccccaccuggucgaccuccuuugcgccuggaggauuuucugggcaggacauugcuugcugaugaucuguucgcagcuuacuuugggccgggcucuucacgccgguuccgggccgcguugggagaggugucacgcgcaaacgcugcacaggacuuuuuaccgacgucaagaaaugacccagaccugcacuucgaugcugagcgccugggacagggaagggcgcggcucgucggggcucugagggagaccguugucgcggccagagcccuggaucauacucuggcuagacaaagacugggagccgcacugcaugccuuacaggacuuuuacucacacucaaauuggguggaacugggcgagcagcagccucauccacaccuguuauggccgaggcaggaauugcagaaccuugcacagguagcugaucccacaugcagcgacugugaagagcugagcuguccccgcaauuggcucggguuuacccuucuuacaagcggcuacuuuggcacccaccccccgaaaccuccuggcaagugcucgcauggcgggcauuuugauaggaguagcucucaaccgccgcgaggugguaucaauaaagacucuacauccccaggauucuccccccaucauaugcugcaccuccaagccgccaagcuggcucucuuggccucuauccaggcguucucccuacuaaggucccgccugggcgacagagauuuuucaagguuguuggacauuacaccagcaaguucccugagcuuuguacuggauacaacugggagcaugggagaggaaaucaaugccgcaaagauucaggcacggcauuugguagaacagcgccgcggcuccccuauggaacccgugcacuacguccuggucccuuuccacgaucccggcuuuggaccaguguuuacuaccuccgauccugauagcuucuggcaacagcugaaugagauccacgcccugggaggcggcgacgagcccgagaugugccugagugccuuacagcuggcucuacugcacacaccgccucuguccgacauauuuguuuucaccgacgccagccccaaggaugcauuccugacuaaccaaguagaaagccugacacaggagcgucguugccgcgugaccuuucuuguuaccgaagacacgagcagaguccaggggagagcacggcgggagauucugucaccauuaagauuugaaccauacaaggccguggcccuggcuucagggggggaagugauuuucacaaaggaucagcacauuagagauguggccgcaauaguaggagagucuauggccgccuuggugacucugccccuggacccucccgugguaguuccugggcagccauugguguucucuguggaugggcuccuccagaaaaucacuguccgcauacauggcgacaucagcuccuuuuggauaaagaauccugcugggguuagccagggacaggaggaagggggaggaccacucggccacacgcgacgcuuuggccaguucuggauggucacuauggacgacccaccacagaccggaacgugggaaauccaggugaccgccgaagauacccccggcguccgggugcaggcccaaacaucucucgauuuccucuuccacuuuggcauucccauggaagaugguccacauccaggacuguauccucuuacccaacccgucgcuggauuacagacucagcugcugguagaagucaccggucucgggucucgcgccaaucccggcgauccccagccacauuuuucacacgucauucuacggggagucccugagggcgccgagcuggggcaggugccucuugaacccguaggaccccccgagaggggucuucuggcugcuucucuaagcccuacguuacugucaacgccccgccccuuuagucuggaacugaucggccaggaugccgcugggagacggcugcaucgcgcugccccucaaccuagcacaguggucccaguucugcuggaacucucaggcccuuccggcuuucucgccccagguucgaaggugccacugucccuacggauugccuccuuuagcgguccccaagaucucgacuugaggacauuugugaacccaucguucucucugaccucaaaccucucuagagcacaucucgagcugaaugaguccgcauggggcagguuguggcuggaggugcccgacagugccgccccugauuccguugugaugguaacuguuacggcgggcgguagagaggcuaaccccguccccccuacacacgcguuccugcgccugcugguguccgcucccgcgccucaggaucgccacacuacacccacaggauccagcgauccaaucuuaacaacagcuacaccugccuuuucucccuuuacguuggugacucagggaagggcuggggcaggacuggcagcggggucccccugguggggcaccguggguggagugcuucuacuacucgggcuugcaucaugguag

SEQ ID NO: 12929 - RNA, 2742 nt, Artificial Sequence
  Description of Artificial Sequence: Synthetic coding sequence
augggcccagaagcacuaagcucccuguugcugcucuuacugguggcaagcggcgacgcagauaugaaaggccauuucgauccugcuaaaugccgguacgcccugggcaugcaggaccguaccaucccagauucagacauaagugccucuaguucuuggagugacucaaccgcugcaaggcacucccgauuggaguccucagauggcgauggggccugguguccagcaggcucgguguuccccaaagaggaggaguaucuccaggucgaucuccagcgacuucaccuggucgcauugguugguacccagggcaggcacgcaggcgggcugggaaaagaguucucucgaaguuacaggcucagguacucaagagauggacgccgguggaugggauggaaggauagguggggucaggaggugauaagcgguaacgaggaucccgagggaguggugcucaaggaucuggguccacccaugguggcacggcuagugcgauuuuacccuagagcugaccgcguaaugucugugugucugaggguugaauuguacggcugccuuuggagagauggucucuugaguuacacagccccugugggccaaacaauguaucugagugaggcaguguaccugaacgauucaacauaugauggacauaccgugggggggcuccaguacggcggacugggccagcuggcagacggaguggugggucucgaugacuuccgaaaaucacaggaauugcggguguggccaggcuacgacuauguggguuggucuaaucauaguuucucuuccgguuacguggaaauggaauuugaguuugacaggcuccgagccuuucaagcuaugcaggugcauuguaacaacaugcacacacugggugcuaggcugccaggcggaguagagugccgcuuccgcagaggacccgcaauggcaugggagggagagcccaugcggcacaaccuuggcggcaaucuaggcgacccuagagccagggcggucucagucccucugggagguaggguggcccgcuuucugcaguguagguuucuguucgccgggccguggcuucucuucuccgaaaucuccuuuaucucagacguugucaacaauaguagucccgcucucgggggaacguucccccccgccccaugguggccuccuggaccacccccuacuaauuuuucuucucucgagcuagaacccagaggacagcagccaguggcaaaggcugaggggucaccuacugcaauuuuaaucgggugccugguggcuaucauucugcuccugcugcuuaucaucgcccugaugcuguggaggcuucauuggcggaggcuuuuaagcaaagccgaacgcaggguacuugaggaagagcugaccgugcauuugucugugccaggagacacaauccuuaucaacaacaggccuggcccaagggaaccaccaccauaucaggagcccagaccaagaggcaauccgccacauucagccccaugugucccaaaugguucugcccuucuccuuaguaauccagcuuaccgguuacuucuugcuacauacgccaggccuccgcggggaccggggccuccuaccccugcaugggccaagccaacaaauacccaagcuuacucuggcgacuauauggagccggagaagccuggagccccccugcucccucccccaccgcaaaauucagugccgcacuacgcugaggcggauaucguaacacugcaaggagucacaggcggaaauacuuaugccguucccgcucuucccccuggcgccgugggcgacggcccgccgagaguggauuuccccagaucucgcuugagauuuaaggaaaaauuaggagagggccaauuuggagagguucaucugugcgaaguggauucuccucaagacuugguuucccuggacuuuccacugaacguaaggaagggccacccucuucuggucgcuguaaagauucugagacccgaugccaccaagaaugcccguaaugacuuccugaaggaaguuaagauuaugucucgacugaaagacccaaacaucauuagguuacugggagucuguguucaggaugacccucuguguaugaucacugacuacauggaaaacggcgaccuuaaucaauuccucuccgcucaccaguuagaagauaaggcagccgagggcgccccaggagacggucaggccgcccagggacccacaauaagcuaccccaugcuccugcacguggccgcacagauugcuuccggaaugcgauaucuggccaccuugaacuucguccacagagaucucgcaacuagaaauugucuggugggagagaacuuuaccaucaagauugcugauuucgguaugucacggaaccuguacgcaggcgacuauuaccgcgugcagggacgggccguccugccaauacgcuggauggcaugggagugcauacuaaugggcaaauuuaccacugccagugaugucugggcauuuggagugacccugugggaggugcugaugcuaugcagggcacaaccauucggacagcugacggaugagcagguaauugaaaacgcaggcgaauuuuuccgcgaccaaggacgacagguauaucuuucccgaccccccgccugcccccagggacucuacgaacucaugcuuagaugcuggagccgagagagugagcagaggccccccuuuagucaacuccauagguucuuggccgaggaugcccugaauacaguguag

SEQ ID NO: 12930 - RNA, 453 nt, Artificial Sequence
  Description of Artificial Sequence: Synthetic coding sequence
augcgcuuuauggcuggcccugccgguucucagagucuuggaccccucuguuuucacucuagcccccaggccuuauacacggugcuccuaaucguccuugugaugaugucucuugucuuuggaaaauuuguuccugucaacugggaacccccucagccucucccauuuccaaaauaccuccgcugcuauaggugccuccuggaaacuaaggaacuggguugucuccuugggucugauaucugcuugaccccugcugguagcucuugcauaacccugcauaaaaagaauucuucggggagugacgugaugguaagcgacugccggucuaaggaacagaugagugauuguaguaacacccgaacuucaccugucucuggauucuggaucuuuucacaguauuguuuuuuggacuucuguaaugacccccagaauagaggacucuauacaccauag

SEQ ID NO: 12931 - RNA, 192 nt, Artificial Sequence
  Description of Artificial Sequence: Synthetic coding sequence
auggggcccgaagcccuguccucuuuguugcugcuguuauuaguugcuuccggcgaugcggauaugaagggccacuuugauccagccaagugccgauacgcccuugguaugcaagacagaacaauuccggacagugauauuuccgccucuucuucauggucugauaguacugcagccaggcauuccagauag

SEQ ID NO: 12932 - RNA, 1212 nt, Artificial Sequence
  Description of Artificial Sequence: Synthetic coding sequence
augcaggggacuccagguggcgggacuagacccggaccuagcccuguggaucgacgcacucugcucguuuuuagcuucauacuggcagcugccuuaggacaaaugaauuuuaccggugaucaagugcugagagugcuggcaaaagaugagaagcaacuaucccuccucggagaucuggaagggcugaagccgcaaaagguggacuuuuggcgaggucccgcgaggccgucccucccagucgauaugagggugcccuuuuccgagcugaaggauaucaaggcuuaucucgagucacacggucucgcauauuccauaaugaucaaggauauucagguccugcucgaugaggagagacaggcaauggcaaagagcagacgccuugagcggucaacaaacucguuuucuuacagcaguuaccauacccucgaagaaauauauuccuggauugacaauuuugucauggaacauuccgacaucgucucaaagauucaaauugggaauaguuuugaaaaccagaguauccuagugcucaaauuuaguacagguggcucuaggcacccugcuaucuggaucgacacagggauucauucaagggaauggaucacccaugcgaccggaauauggaccgccaauaagaucguaagcgacuacggcaaggaccgcguacuuacagauauacuaaacgcuauggauauuuucauagagcuugugacuaaucccgacggcuucgccuucacucauagcaugaauagacuguggcggaaaaacaaaagcauucggccuggaauuuucugcauuggcguggaucucaaccgcaacuggaagagcggcuuuggcgguaacggcucaaauucuaacccuuguuccgagacauaccacgguccaucaccccaguccgaaccagaaguggcagcuaucguaaauuuuaucacggcccacggaaauuuuaaggcacucauuucaauucacagcuauagccagaugcucauguaccccuacggacgccugcuugagccgguguccaaucagcgcgagcuuauguggccuguggggucucccuccaccgggccuaugacuguggcaucuagcacucccucugcccuaaguucaggcacucucgggucaauggcgucuuguugccguccacaucggaguucaccucgcccaagacgaaggggcuggagguuuggcccuucgugguccaccccuuag

SEQ ID NO: 12933 - RNA, 1542 nt, Artificial Sequence
  Description of Artificial Sequence: Synthetic coding sequence
auggcuccagccagaacuauggcccgcgcccgucucgcacccgcagggauaccagccguugcccuguggcugcugugcacauugggcuugcagggcacccaggccggaccuccccccgccccuccaggacugccagccggggccgacugccuuaauagcuuuacagcuggggugcccggcuuugugcuggauacaaacgcaagcguguccaauggcgcaaccuuccuggagucgccuacaguccgcagaggcugggacugcgugcgggcaugcuguacaacacagaacuguaaccuggcacugguggagcuccagccagacagaggugaagacgcaaucgcugccuguuuccugauuaacugucucuaugaacagaauuuuguguguaaauuugcaccuagagagggauucaucaacuacuuaacccgcgagguguaccgcucuuauagacagcuuagaacccagggauucggaggaagcgggaucccuaaagccugggccggcauugaucugaaaguacaaccucaggagccucuagugcuuaaagacgucgaaaauacagacuggcggcuucuuagaggcgauacugaugucaggguugagaggaaagauccuaaucagguagagcuauggggucugaaggaggguacuuacuuguuccaacucacagucaccucgagcgaccauccugaggauacagcaaacguuacuguaaccguguuaucaaccaagcaaaccgaagacuauugccuugccuccaauaaaguaggcagguguagaggcucauucccccggugguacuaugacccuaccgaacagaucuguaaaucauuuguuuauggcggcugucuaggcaacaaaaauaacuauuuacgagaggaagagugcauccucgccugccggggcguucaaggcccuucuauggaaaggaggcacccuguuuguucagguacuugccaaccaacacaauuccgcuguucuaacgguuguuguaucgacucuuucuuggagugugaugacacaccgaacugcccugaugccagcgaugaggcugccugcgagaaauauacgucugguuuugaugaacugcagcggauccauuuccccagcgauaaaggccauuguguugaccugccagauaccggacuuugcaaggaaagcaucccccggugguacuacaauccuuucucggagcauugcgcuagguuuacuuacgggggauguuauggcaauaaaaacaacuuugaggaggaacaacagugucuagagucaugcagaggaaucucgaagaaggauguguuugguuugcggcgcgaaauacccauacccucuacgggcuccguggagauggccguugcugucuuucugguuauaugcaucgucguggucguagccauucuugguuauugcuuuuucaaaaaucagagaaaggacuuccacggacaucaccaccauccgccuccaaccccagcuagcaguacagugagcacaacagaagauacugagcaccugguuuauaaccacacgacaagaccacuuuag

SEQ ID NO: 12934 - RNA, 798 nt, Artificial Sequence
  Description of Artificial Sequence: Synthetic coding sequence
auggccccauggucccacccauccgcucagcuucaaccuguggguggcgacgcugucucuccagcucucaugguacuucuuugccuuggccugucacugggcccgcgcacucacguucaggcugguaaucugaguaaagcaacccucugggcagagcccggguccgugaucucccggggaaauucagucacaauuagaugucaagguacgcuggaagcucaggaguaucggcuggugaaagaggggucgcccgaacccugggauacucaaaauccacuagagccaaaaaauaaggcacgcuucucaauucccagcaugacugagcaccacgcugggcgguaucgcugcuacuacuauuccccagccggcuggucugaaccuuccgacccauuagaguuggugguuacgggguuuuacaacaaaccaacucugagugcauuacccucgcccgugguuacuuccggcgaaaacgugacccugcagugugguuccagacugagguuugaucgcuuuaucuugacagaagaaggcgaccauaaauugucuuggacucuagauucacagcugacgccaucaggacaguuucaggcccuauuuccggucggucccgucacacccucacaccgcuggaugcugcguugcuacggcucucgucgccauauucuccaaguuuggagugaacccagugaccuccuggaaauaccggugagcggcgaagaggccacuguauucuccagcacuauccagggcucgcagacagguugcggagaacuguaucgucaggggagcccuuguuag

SEQ ID NO: 12935 - RNA, 795 nt, Artificial Sequence
  Description of Artificial Sequence: Synthetic coding sequence
auggaaaaaccuauccugaaaaaucuuaacgagaugcuuugcccaaucauugcuucugaagugaaagcucucaaugcuaaucugaguaccuuagaggugcuuaccaaaauugauaacuauacacuccucgacuauucgcuuauaucaucuccugagauuacagaaaacuaucucgauuuaaaccucaagggcgucuucuacccccucgagaaucugaccgacccaccauucucgccagugccuuuugugcugccugagagaucaaauagcaugcuuuacauaggcaucgcagaauauuucuucaagucggcguccuuugcccauuucacagccggaguguucaacgugaccuuaaguacagaggagaucaguaaccauuuuguccagaauucucaaggucucggcaauguccugagccgcguggccaguaccagcguggggcuagugauucucggucaaagauuggugugcucuuugucccucaacagguuuagacuggcucucccagaauccaauagaucuaauaucgagguacugcguuuugagaacauacugagcagcauccugcauuuuggugucuuaccucuugcgaacgccaaacuccagcagggguucccccugucaaauccacacaaauuccuguucgugaauagcgauaucgagguccucgaaggcuuucuucucaucagcacggaucucaaauaugaaaccucuuccaagcagcagccaucguuucacgugugggaaggacuaaaucuuauaucucgccaauggcgcgguaagucugcaccauag

SEQ ID NO: 12936 - RNA, 117 nt, Artificial Sequence
  Description of Artificial Sequence: Synthetic coding sequence
augaacaagauacuguccucuaccguuugcuucggacugcuaacuuuacugucuguucugagcuuccuccaauccgugcauggacgacccuaccuuacccaaggcaacgagauauag

SEQ ID NO: 12937 - RNA, 567 nt, Artificial Sequence
  Description of Artificial Sequence: Synthetic coding sequence
auguuucaucaaauaugggcugcccuacuuuauuucuacggcauaauccuuaauuccauauaccagugccccgagcacucacagcugaccacccuuggcgucgaugguaaggaauuuccugaaguccaccuuggccagugguacuuuaucgcuggagcagccccuacgaaagaggaacucgcaacauucgaccccguggauaauauuguguuuaacauggccgcuggguccgcaccuaugcagcugcaccugcgcgcgaccauuagaaugaaggauggccugugugugccacguaaauggaucuaccaccugacugaagguuccacagaccugagaacagaaggacgcccugacaugaagacugaacuguuuuccucuucuugucccggaggaauuauguugaacgagaccggccagggcuaccagcgguuuuugcucuacaauagauccccucaccccccggagaaaugcguagaagaguucaaaucgcucaccaguugucuggauucuaaagcuuuccugcuaaccccaaggaaccaagaagccugugagcugucuaacaacuag

SEQ ID NO: 12938 - RNA, 600 nt, Artificial Sequence
  Description of Artificial Sequence: Synthetic coding sequence
auggaaacuuucccauuacuccuccuuucauuaggccugguucuagccgaggccagcgaguccaccaugaagauaauaaaagaggaauucacagacgaggagaugcaguacgauauggccaagaguggacaggaaaaacaaacaauagaaaucuugaugaaucccauccuucuggugaagaauacaucucuuuccaugaguaaagacgauaugaguagcaccuugcugacuuuccgaucucugcacuacaaugauccuaaagggaauuccucaggaaacgacaaagaaugcuguaaugauaugacgguguggagaaagguaagcgaagccaauggcucaugcaaauggucaaacaacuucauacgauccuccaccgaagugaugagacgugugcaucgggcuccgagcugcaaauucguccagaacccaggcaucuccugcugugaaagucuugaacuugaaaacacagucugccaguuuacuaccggaaaacaauucccgcgcugccaguaccauucggugacaucucucgaaaaaauucuuaccguuuuaaccggccacucccugaugagcuggcuuguguguggcucuaagcuguag

SEQ ID NO: 12939 - RNA, 30 nt, Artificial Sequence
  Description of Artificial Sequence: Synthetic coding sequence
auggccccaaaaaaauuguccugucuauag

SEQ ID NO: 12940 - RNA, 831 nt, Artificial Sequence
  Description of Artificial Sequence: Synthetic coding sequence
auggcccccuccccacugcagcgucuucacugcggaccaagcccuaguccgaggcccacugagguacccagagggacugugucuguguccugccgguaucuaaagaauucccugcauguauucgucucugggggcgcuauuggaacuagcuccccagccuugcuugagugucaggagggcgugggcccagcuagacccuccuuacuaguuccucccccucccaggccccggcgacucgaucuggcuagaacacugccagcagaaagaaccgacucccagucgcuguauauuguauacaucgcccuucccggucguaccccucgcccggcucuggccuucgcguucuugaugccagcauguugcaaccgacccucaccuagaccuucuccugcccaccucacugccucuucaguucugcggcggcaacgucaugugcuggcugccucugcugccuccccuugucaguggucuggucuaagggucgcccacagccugagacagguggugucucuguguccuagaugcacgggcucuugucccuuuagcggcgcaugugcuucaucacugcccucuccucuuagcuguccucacucccacucuggguccuggggaacauggucgcaaggaaggcccugcaguucuaccgagguagcuggacuggcgcucuggccuacugauuuccuaagcugucugcuagacgcauccgaacugcagacucaggggucccacggauucuccuuuacacccaccgguuuuucuucaaaccggaagguuggcguaggcucuugucgcgauggagcugggcgaggcgcaaugggaggucuguucuag

SEQ ID NO: 12941 - RNA, 678 nt, Artificial Sequence
  Description of Artificial Sequence: Synthetic coding sequence
ugagccgaccuuccauccugcuggggcgcggggccuuguuauaccggccauaaaguuggggcgcugagaagagauacaguuaucuguuguugucggcacggggacuauuccacaccaugucuauuuacuccaggaaaacccagccggaacccuuccccuuggaagcgcacccuauggacauugucugcaccuugggccggucccgcggguuggacgggcgaggagcagaaugcuaccaaaacaggccucauaaccaggagaccucgaccccugcgccgaagaccacaccccgccccugcuucaccucuuccagaaaucauacggggcaacaucccaagaaugcuuggaaaguucguccccguuaauugggaaccuccgcagcccuugcccuuuccaaaguaccuccgauguuacaggugucuccuugagacuaaggaacugggaugccuacuugguuccgacauuugucugacaccagcaggcucaucauguaucacucugcauaaaaagaacucuuccggaucagaugucauggugucugauuguagaagcaaagaacagaugagcgauuguuccaauacuaggacuagcccugucagcggcuucuggauuuucagucaguacugcuuucuggacuucuguaaugacccucaaaauagaggacucuacacucccuag

SEQ ID NO: 12942 - RNA, 534 nt, Artificial Sequence
  Description of Artificial Sequence: Synthetic coding sequence
augguccccgccgcuggggcgcuucucuggguccugcuccuuaaccugggaccucgcgcagccggcgcccagggacuaacccagacaccuacggaaaugcagagagugucacugagauucgguggacccaugacuagaucguaccggucaacagcuaggaccggguugccuaggaagacuaggaucauccucgaagaugaaaaugaugcaauggcugaugccgaccgccucgccgggccagccgccgcugaacuccuggcagccaccgugaguacaggcuucucgcgguccucugcgauaaaugaggaggacggauccagcgaagagggcguagucauuaaugcaggaaaggacaguacauccagagagcucccgucagcaaccccuaauacagccggcagcagcaguaccagguuuaucgcaaacucucaagaacccgaaaucagauuaacgagcagccucccucgaucucccgggcgcagcacggaagacuugccucccugccaucugcuccggauuuguggaugguguuag

SEQ ID NO: 12943 - RNA, 912 nt, Artificial Sequence
  Description of Artificial Sequence: Synthetic coding sequence
augcuccaccccgaaacaucaccugggagaggccaucuccucgcuguauuacuugcccugcuugguacugccugggccgaagucuggccuccacagcugcaagagcaggcuccaauggccggggcacucaaucgaaaagaguccuuucuacuucuuucucuccacaaucgcuugcgauccuggguacagccuccugcagcugauaugcguagacuggacuggucugacucccuggcacaacucgcgcaggcccgagccgcccucugcggaaucccaacuccgucucuagccucuggcuuguggaggacucuccaggugggauggaacaugcaauuauuacccgcagguuuggcuaguuuuguggaagucguuagucugugguucgcugaaggccaacgcuacucccaugcugcaggugaaugcgcgaggaacgcgaccuguacucauuacacccaacuggugugggccaccagcagucagcucgggugcggacgucaucuguguuccgccggccaggccgccauugaggccuuuguuugcgcauauagcccacgcggaaacugggagguuaacgggaagaccaucgugccuuacaagaagggagccugguguaguuuguguacugcguccgugucagguugcuuuaaggcaugggaucacgccgguggauuaugcgaggugcccaggaaccccuguagaaugucuugccagaaucacggaaggcugaauaucagcacaugccacugucacugcccuccaggguacacagggagguacugucaaguucggugcucacugcagugcgugcacggccgguuccgggaagaggaauguuccugugugugcgacaucggguacggcgagccuaguguaccaccuaggugcauuuuuccgagcaccccugucacauag

SEQ ID NO: 12944 - RNA, 1482 nt, Artificial Sequence
  Description of Artificial Sequence: Synthetic coding sequence
uccgaagcaguguaucugaacgacucaacuuacgacggccauacugucgguggauugcaauauggcggacugggacagcuggcagacgggguggucggccuggaugauuuuaggaagucccaggagcuucgaguuuggcccggauacgacuauguuggauggucuaaccacucuuucagcucuggcuacguggaaauggaguucgaguuugacagauugcgagcguuccaagccaugcaaguccacugcaacaacaugcacacucucggugcucgucucccaggugggguggagugcagauuucgcagaggaccugccauggcuugggagggugaaccaaugaggcauaaccucggcgggaacuuaggcgauccuagagcccgcgcgguguccgugccucucggaggcagaguggcaagauuucugcagugccgauuucuguuugccggaccuuggcugcuguucucagagauuucguuuaucucggacgugguuaacaauagcagcccugcauugggugggaccuucccacccgcuccuugguggccacccggcccaccucccaccaacuucucuucccuugaauuagaaccaaggggacagcaaccuguugcgaaggcugaggguucgccgacugcaauccugauugggugucugguagcuauuauacuacuacuguuguugauuaucgcuuuaauguuauggcgucuccacuggcgacgcuuacuuucuaaggugcucgagucucauccgcgcaccagaucucccggccuggucgggauucgcccaacuccucuuccggugucaccgauggcgcugagaugcuguucucccauccagccaacugcaagcuuuuggcccuugacccccgugccgcuggaggcucgggcaccaccccacccaccugggcccaauccaccuaccccccggggcgucaccggcggcaacacauaugcagugccagcuuuaccaccuggugccgugggugauggaccuccucgaguugacuuuccuaggucuagacucagauucaaagagaaauugggugagggucaguuuggugaggugcaccuuugcgaaguggacucaccccaggacuuaguuucgcuggauuucccacugaaugugcggaagggacacccccuccugguggcugugaagauacugcgccccgaugcaacgaaaaaugccaggaacgauuuuuuaaaggagguaaaaaucauguccagauuaaaagauccgaacaucaucaggcugcucgggguaugcgugcaagaugauccacuguguaugaucacagauuauauggaaaacggcgaucucaaucaguuccugucagcccaucaacucgaagacaaagcugcagaaggcgccccaggagacggacaggccgcucaaggaccaaccaucuccuauccaaugcuguugcacguggcugcucagauugcgucuggcaugcgauauuuggcaacucugaauuag

SEQ ID NO: 12945 - RNA, 807 nt, Artificial Sequence
  Description of Artificial Sequence: Synthetic coding sequence
augaaacagauacuccacccagccuuggagacgaccgacccaugcucaacuggguucgucuuucccgcuaugacccuuuuuccuguuuugcuuuuucuugucgcugggcugcugccuuccuuuccggcuaacgaagauaaggaucccgccuucaccgcccugcugaccacccagacgcaaguccagagggagaucgucaacaaacauaacgaacugcggcgugcugugucaccaccggcgaggaacauguugaagauggaauggaacaaagaggcugcugccaacgcucagaagugggccaaucaguguaacuacagacauagcaacccuaaagaccgcaugaccucucuaaagugcggggagaaucuuuauaugucgagcgccaguaguagcuggucgcaggcuauccagucuugguuugaugaauacaacgauuucgauuuuggagugggcccgaagacaccgaacgcaguaguuggccauuacacucaggucgugugguauagcucuuacuuggucggcuguggaaaugccuauugucccaaccagaagguucugaaguacuacuauguuugccaauacugcccagccgggaacugggccaacaggcuguacgugcccuaugaacagggagcaccaugugcuaguugcccugacaauugcgacgacggacuguguacuaauggcuguaaauacgaagaccuguauucgaauugcaaaagucucaagcugaccuuaaccuguaaacaccaguugguucgugacagcugcaaggcaucuuguaacugcagcaacucaauauauuag

SEQ ID NO: 12946 - RNA, 372 nt, Artificial Sequence
  Description of Artificial Sequence: Synthetic coding sequence
augcucccaaaaucgagaagggcuuugacuauacaggagauagccgcucuagcacgguccucucugcacgguauuucccaggucgucaaagaucaugugaccaaacccaccgccauggcccaaggacguguggcccaucucaucgaauggaagggcuggucgaagccaucagacucaccggcugcccuggaaagcgcuuuuaguagcuauuccgaccugucagagggugagcaggaggcccgauucgccgcuggcguggcugaacaguucgcgauugccgaggcuaaacugagagccuggaguuccguggauggggaagauucaacggacgacaguuaugacgaagauuucgcaggaggcauggauacauag

SEQ ID NO: 12947 - RNA, 726 nt, Artificial Sequence
  Description of Artificial Sequence: Synthetic coding sequence
augggggccgugaugggcacauucaguucccugcagaccaagcagagacgcccgucuaaggauaaaauagaggaugagcuugagaugacaauggugugccaucgcccggaggggcucgaacagcuagaggcacaaacuaauuucacuaaacgggagcugcagguccucuaucggggcuucaagaacgagugcccuuccggagugguuaaugaagacacuuuuaaacagaucuaugcucaguuuuucccacacggugcucuaccgugccuggagggcucucccuguguugaauucuugccaccaucuccagccuuacucuuuugccucgucgacgccaguaccuaugcacacuauuuguucaacgccuucgacacaacucagacaggcuccgucaaguuugaggacuucgugaccgcccuaucgauuuuacuucgcggcacuguucaugagaaacucagguggacauucaaccuguaugauauuaacaaggauggauauaucaauaaggaagagaugauggauaucguaaaagcuauuuacgacaugauggggaaauacacuuacccaguacugaaggaagauacucccaggcagcacguagacguguuuuuucaaaaaauggauaaaaauaaggacggaauagucacccuggacgaauuucuagaaucaugucaagaagaugauaacaucaugcgaucacugcaauuauuucagaacgucauguag

SEQ ID NO: 12948 - RNA, 630 nt, Artificial Sequence
  Description of Artificial Sequence: Synthetic coding sequence
auggggccugaagcccucucuucccuccuacuguugcuucuuguggcuuccggagaugccgauaugaaagggcacuuugacccagccaaauguagauacgcccugggaaugcaggaccgcaccauuccugauucagacauuuccgcuaguagcuccugguccgacucuacagcugcuaggcacuccagacuagagagcagugacggcgacggcgcauggugcccagccggaagcguuuuccccaaggaggaggaauacuugcaaguagaccuacagcgacuccauuuaguugcgcuggugggaacucagggacgacacgccggcggcuuaggaaaagaguucuccagguccuauaggcugagguacucuagggaugggaggcguuggaugggcuggaaggauagguggggacaagaagugaucucagggaaugaagauccugaagggguugugcuuaaggaccucgggccgcccaugguugcaagauuggugagguucuauccacgagcugacagaguuaugucaguauguuugcgcguggaguuguauggcugccuguggcgggauggucuccucuccuauacugcaccugugggacaaacaauguaucugagugaagccguuuauuag

SEQ ID NO: 12949 - RNA, 312 nt, Artificial Sequence
  Description of Artificial Sequence: Synthetic coding sequence
augagacaacgccugcugccuagcgucaccagucucuuacuuguggcgcugcuguucccagguucaucucaggcaaggcacguuaaccacuccgcaaccgaagcccugggagagcugagagagagagcaccugggcaagggaccaacggauuucagcuccuuagacacgcugugaaacgugaucuucucccuccgagaacaccuccuuaccaaguucacauaagccaccaggaagccaggggaccuucuuuuaagauuugcguuggauuccuaggaccuagaugggcgaggggcugcucuaccgguaauuag

SEQ ID NO: 12950 - RNA, 426 nt, Artificial Sequence
  Description of Artificial Sequence: Synthetic coding sequence
augaaaaccggauuauuuuuucuuugcuuguuaggcacagccgcagcaauacccacaaacgcaagacuacucucagaucacuccaagccgaccgcagagacaguagcuccagacaauaccgccauaccaagcuugcgugcagaggccgaggaaaaugaaaaagaaacugcuguuucuacugaggaugacucccaucacaaagccgaaaaauccagcguccugaagucaaaagaggagucccacgagcagagcgccgaacaaggaaaaucgagcagucaggagcuaggccugaaagaccaggaggacucugacggucaccugucuguuaaccuagaguaugccccuacagagggcacacuggacaucaaggaggacauguccgagccccaggaaaagaagcucuccgaaaacaccgauuuuuuguag

SEQ ID NO: 12951 - RNA, 642 nt, Artificial Sequence
  Description of Artificial Sequence: Synthetic coding sequence
augcgacuugccggucccuuacgcaucguugugcuagucgucuccgugggcgugaccuggaucgucgugucaauccugcuggggggccccgguucagguuuuccaagaauucagcagcucuuuacaucaccggagucgagugugacagccgcgccuagagcaagaaaauacaaaugcggccucccacagccgugccccgaagaacaccuugcauuccgggucguuagcggugcagcaaacgugaucggacccaagauuugucucgaggacaaaaugcugaugucuagugucaaggacaauguggggcgugggcugaacauugcccucgugaaugacguaaacgaucuguugaaguucaucagaccucuccacgaaggcacucugguguuuguggcuucuuaugaugauccugccaccaaaaugaacgaggagacacguaagcuauuuagcgaacugggaagccgaaacgccaaagagcuggcauucagagauuccuggguuuucgugggcgccaagggcgugcaaaacaaaucuccauucgaacaacacgugaagaacuccaagcacucuaacaaauaugaaggguggccugaggcacuugagauggaaggguguaucccccggagauccacugcaagcuag

SEQ ID NO: 12952 - RNA, 2700 nt, Artificial Sequence
  Description of Artificial Sequence: Synthetic coding sequence
auguuauuacuucugcugcucgcuccacuguucuugaggccaccuggugccggcggcgcucagacaccaaacgcuacaucagaagggugccaaauuauccaccccccaugggagggcggcauccgguauagaggcuugacccgggaucagguaaaagcuauaaauuuccucccaguggacuacgagauugaauacgugugcagaggagaaagagaagucgucggcccuaaaguucguaagugucuggcaaacggcaguuggaccgacauggauacaccgagccgauguguaaaccggacaccucauuccgagaggcgggccguguacauuggggcacucuuuccaaugagcggaggguggccggguggucaggccugccagccugcggucgaaauggcacuggaagaugugaacagcaggcgcgauauacugccugauuacgaguugaagcugauccaccacgauagcaaaugcgaccccggacaggccaccaaauaucuguacgagcuauuguauaaugacccuaucaaaauuauuuuaaugcccgguuguuccaguguuuccaccuuggucgcagaggcugcaagaauguggaaccucauuguuuugucuuauggcuccagcagcccugcacugaguaaccgucagcgcuucccuacuuucuuccgcacucauccaucugccacguugcacaauccuacuaggguuaaguuguucgaaaagugggguuggaaaaagauugcgacaauucagcagacaaccgagguauuuacuagcacacuggacgauuuggaggaacgcgucaaggaggccggaauugagaucacauuuagacagagcuucuuuuccgauccugccgugccagugaagaaccugaagcgucaggaugcccgcaucaucgucggucuguucuaugaaacggaggcacgaaaaguauucugcgaagucuauaaagaaagacuauucggaaagaaauacguuugguuucugauaggcugguacgcugacaacugguuuaaaauauacgauccaucuauuaauugcacagucgaugaaaugacggaggcugucgaagggcauauuacuacagaaaucguuaugcugaacccggcaaacaccagaucaaucuccaauaugaccucucaagaguuugucgaaaaguugacuaaacgacuaaagcgccauccagaagaaacugggggcuuccaggaagcccccuuggcuuaugacgcuauuugggcccuggcgcuugcauugaauaagacgaguggcgggggcggaagauccggugugaggcuggaagauuucaauuacaauaaucaaacuauuacagaucagauuuauagagccaugaacucuuccucauucgaggggguaucuggccaugugguuuuugacgcaucuggcagccggauggccuggacacuuauugagcaguugcagggugggagcuacaagaagaucggguauuacgacuccacuaaggacgaccugucaugguccaagacagacaaguggauuggaggcagcccaccagcagaccagacgcuagucauaaagacuuucagguuccucucacaaaaacuguucauuucggugucagugcugucuucacugggcauagugcucgccguaguaugcuuaaguuucaauauuuauaauucccacgugcgguauauccaaaacagucagcccaaucugaacaaccucaccgcuguugggugcucacuggcguuggcagccguauucccacugggacuugacgguuaccacaucggucgcaaccaauucccuuuuguuugccaggcucgcuuguggcuccugggccuuggguucucgcuaggcuauggaucuauguucaccaaaauaugguggguucacaccguguucaccaaaaaggaagagaagaaagaguggcgaaagacauuagaaccuuggaaauuauacgcgacaguaggguuacuggugggcauggaugugcugacauuagcaauauggcagauugucgauccacuucaucgcaccauugagacuuuugcaaaagaagagcccaaggaggauaucgacguguccauccugccccagcucgagcauugcaguagccgaaaaaugaacaccuggcuugguaucuucuacggauacaagggccuacuucugcucuugggaaucuucuuggcguaugaaaccaaaagcguauccacggagaagaucaaugaccaccgcgcaguggggauggccaucuauaacgucgcuguucuuugccuuaucacagccccgguuacuaugauacuguccucacagcaggaugccgccuucgcguucgccagucucgcaaucguguucucuagcuacaucacucuggucgugcuguuuguuccuaagaugcgacgccuaauuacucgcggagaauggcaaagugaagcccaggacaccaugaaaacagguagcucuacaaacaauaacgaggaagagaagagccgucuuuuggaaaaagaaaaucgugaacuggaaaagaucaucgcugaaaaagaggagagagucucagaacugaggcaccagcuccagagccgccagcagcuucggagcaggaggcacccccccaccccccccgaaccuucgggaggucugcccaggggccccccagaaccaccugauagacugucuugcgacggaucaaggguucaccuguuauacaaguag

SEQ ID NO: 12953 - RNA, 192 nt, Artificial Sequence
  Description of Artificial Sequence: Synthetic coding sequence
augggcccugaggcucucagcagucuucucuugcuccuucugguugccuccggggaugcugacaugaaaggacauuuugaccccgccaaaugccgcuacgcccuuggaaugcaggacagaaccauuccugacucagauaucagugcgucuucaucguggucugacaguacugcggcucgccacagcagguag

SEQ ID NO: 12954 - RNA, 489 nt, Artificial Sequence
  Description of Artificial Sequence: Synthetic coding sequence
gacgaagaucgauacaccacuuguuggccaaaaacauggcuugcaaaggacugccccgcuuuaagaauuauauccguggaauacgauaccucucucagugacuggcgcgcucggugccccauggaaaggaaaaguauugcuuuccgcucuaaugaacugcuuagaaaacugagagccgcugguguuggagaccgacccguuguguggauuagucauagcaugggcggccugcuaguuaaaaaaauguuguuagaagcuaguacuaagcccgagaugaguaccgugauaaauaauacccggggcaucaucuuuuauagcguuccucaucacggcucaagguuggcagaguauagcguuaauauucgguaucuguuauuucccagucuagaagucaaggagcuguccaagggaaacaccuucugucauaaaggaaacugggguuacaucaacauaagcuacaccgaaaaaaaaaaaaaguuccugccauag

SEQ ID NO: 12955 - RNA, 1083 nt, Artificial Sequence
  Description of Artificial Sequence: Synthetic coding sequence
augccugaauugguagugaccgcccucuuagcuccuagcagauuaagccucaaacuguugagagcauucauguggucguugguguuuagugucgcacugguggccgcugccguguacgggugcauagccuugacccauguucuguguagaccgcgacgugggugcugcgggagaaggagaucugcuagcccugccugccugagugauccuagucucggcgagcauggcuuccuuaaccucaagagcucuggcuuaagacuccacuaugugucugcgggccgaggcaacgguccucuuauguuguuuuuacauggcuucccugagaauugguucuccuggcgguaucagcuucgggaauuccagucccgguuccacguagucgccguggauuuaaggggauacgggcccagcgaugccccuagagacgucgauuguuauaccauugaccugcugcucguugacauaaaagacgugauucugggucucggcuauucaaaguguauacucgucgcccaugauuggggggcucuccuggccuggcauuucucaaucuacuacccaucucuuguugaaagaauggucguugucagcggcgcuccaauguccgucuaccaagacuauagcuuacaucacauaucucaguucuuucgaucucauuacauguuccuguuucagcuaccauggcuuccagaaaagcugcuuagcauguccgauuuucaaauucugaagacgacucugacucacaggaagaccgggaucccuugccugacccccuccgaacuugaggccuucuuguauaauuuuagucagcccggaggacugacugguccccuaaauuacuacagaaaccuauuucgcaacuucccauuggaaccucaggaauugacaacacccacccuguugcuguggggagagaaagauaccuaccuggagcucggucuggucgaagcgauugguagcagauuugucccgggccgccuggaagcacacauccugccuggcaucggccacuggaucccucaaagcaacccacaggagaugcaccaguauaugugggcuuuccuucaagaucuguuggauuag

SEQ ID NO: 12956 - RNA, 678 nt, Artificial Sequence
  Description of Artificial Sequence: Synthetic coding sequence
ugagcggaucugccaaguugcuggggcgcuggaccuuguuauaccggccacaaaguuggcgcccugagacgagacacuguaauaugcugcugucgccacggcgauuauuccacaccaugccuguucacucccgguaaacccuccaggaacccaucuccguggaagcgaacccuuuggacacuuucagcucccugggcugggcccgcaggauggacaggugaggaacagaaugcuacaaaaacaggucugaucacacgaagaccacgcccacuucggcggagaccucacccugcccccgcaucuccguugcccgagaucaucaggggaaauaucccgagaaugcuuggcaaguucgucccugugaacugggagccuccucagccccugccuuucccgaaauaucuucguuguuaccggugccuacuggaaacaaaggaguuaggcugucuguugggcucagacauuugucucaccccagcaggauccucaugcaucacacugcacaagaaaaacucuuccggcucagacguuaugguuucggauuguagaucaaaggaacaaaugucugauugcaguaauacaagaaccucucccgucucuggauuuuggaucuucucccaguacugcuuucuugacuucugcaaugacccucaaaaccgcgguuuauauaccccuuag

SEQ ID NO: 12957 - RNA, 192 nt, Artificial Sequence
  Description of Artificial Sequence: Synthetic coding sequence
augaagcacguauuaaaucuguaucuacuaggcgucguuuuaaccuuacuguccaucuucguuagagugauggaauccuuagagggcuugcuugaguccccgaguccaggcacuucauggacaaccagaucacagcuggcaaacaccgaacccacaaaaggacuaccagaucauccuucccgcagcauguag

SEQ ID NO: 12958 - RNA, 5235 nt, Artificial Sequence
  Description of Artificial Sequence: Synthetic coding sequence
augcgauuauuaugggggcugauaugggcuuccuccuucuuuacccugagccuacagaagccuagauuguuacuuuucucucccucugugguccauuuaggcgugccacucucggugggaguacagcugcaagacgugccccgcgggcagguggucaaaggguccguguuccugaggaauccaucccggaacaacgugcccuguucccccaaagucgacuucaccuugucuagugaacgcgauuucgcccugcugagucuccaagucccacugaaggaugcaaaguccugcggccuccaccaguugcugcguggaccugaagugcagcuggucgcgcacagccccuggcugaaggauagccugagucgcaccacuaacauucaaggcaucaaccucuuguucucuucacgacgggggcauuuguuuuugcagaccgaccagcccaucuauaacccugggcagagaguccgcuaccgcguguucgcccucgaucagaagaugcggccuucgacagauaccauuaccgugaugguggagaacucucauggacugcgcguuagaaaaaaagagguuuauaugccuagcucuaucuuucaggaugauuucgugaucccagauaucucggagcccgggacauggaaaauaagugcucgguucagcgacggucuggaguccaacucauccacucaguucgaagucaagaaguauguccucccaaacuucgaaguaaagaucacgccagguaaacccuauauccugacaguuccgggacaccucgacgagaugcagcuggacauccaggcacgguacauuuacgguaaaccugugcagggcguggcguacgugcgguucggucugcuggaugaggaugggaaaaagacuuucuuucgcggccuugagucccagacaaaguuagucaacggacaaucccacauuagccugucuaaagccgaauuucaggacgcccuugagaagcuuaacaugggcauuacugacuugcagggacuucgacuguaugucgccgcagcaauuaucgaguauccaggaggagagauggaggaggccgaacucacaagcugguauuucguuagcucuccuuucagcuuagacuugagcaaaacuaagagacaucuggugccuggcgcccccuuucuccuccaagcacuugucagggagaugagcggguccccugccucgggaauuccuguaaaggugagugcaaccgugucaucaccaggguccgugccagagguccaggauauucagcagaacacggacggcagcggucaggugucuauucccaucauuauuccacaaacaaucuccgagcuccaacugaguguaagcgccgggagcccgcacccagcgaucgcccgccugacugucgccgccccgccaagcggaggccccggcuuucuuucuauagagcgaccagacucccgcccuccaagagucggggacacucucaaccugaaucugcgcgcuguggggucuggcgcaaccuuuucacauuacuauuauaugauuuugucuaggggccagauugucuuuaugaaucgagagccgaagaggacacugacuagugugaguguuuucguagaucaucaccuagcuccaaguuuuuauuucguggcuuucuauuaucauggcgaucauccaguggcuaacucacugcggguagacguccaggcaggagccugcgagggaaagcuugagcuuucuguggauggggccaagcaguauagaaacggagagucugugaaacuccaccuggagacagauagccucgcacugguugcacucggagcacuggauaccgcacucuacgcugccggcagcaagucccacaaaccucuuaacaugggcaaaguguuugaagcgaugaacucauaugaccugggcugcgggccaggcggaggggauucugcccugcaggucuuccaggcggcagggcuggccuucagcgacggugaccaguggacucugagccguaaaagacugaguugcccuaaggaaaagacuacaagaaaaaaaaggaauguuaauuuucagaaggccaucaacgaaaagcugggucaauacgcaucaccaaccgcuaaacgcugcugccaagauggagucaccagacugcccaugaugcggaguugcgagcaacgcgcagccaggguccaacagccagacugccgagaacccuuccuauccugcugccaauuugcagagucacugcggaaaaagucucgugacaagggacaggccggacuccagcgggcucuugaaauccuucaggaggaagaccuuauugaugaagacgauauuccugugcgauccuucuucccugagaauuggcucuggaggguggagacaguugaucgcuuucagauucugacucucuggcugccagacucacucacuacaugggaaauucacgguuuaagucucaguaagacuaaaggucuuugugucgcgacgcccgugcaacuucgcguuuuucgggaguuccaccuacaucugcggcugcccauguccgugcgacgguuugagcaacuggagcuucggcccgugcuuuacaauuaucuggacaagaaucugaccguaagcgugcacgugucaccaguggaaggccucugucucgcuggcggcgggggcuuggcucagcagguucuggugccagcgggauccgcccguccuguagcuuuuucagucguucccacggcggccgcagccgugucucugaaaguugucgccaggggcagcuucgaguuuccugugggggaugcgguuucaaagguccuccaaauugagaaggaaggggccauccaucgcgaagagcuggucuaugagcuuaacccccucgaucaucgggggagaacccucgaaauacccggaaauagugauccgaacaugaucccugauggugacuucaacuccuacgugaggguuacagccucugaccccuuggauacauuggguucugagggggcccuuucacccggcggaguggcaucgcuucugcgguuaccccgagggugcggcgaacagaccaugauauaccuggcaccgacccuugccgccucacgcuauuuagacaagaccgagcaaugguccaccuuacccccagagaccaaagaccacgccguggaccuuauacagaaggguuacaugcguauucaacaguucaggaaagccgauggcucauaugccgccugguuaagucgugggucuagcacauggcugaccgccuuugugcugaaagugcugagccuggcccaggaacagguaggggguuccccagaaaagcugcaggagaccucuaacuggcugcugagccagcagcaggccgacgguucauuccaggaucuuaguccugucauccaucgaagcaugcaagggggguuagugggaaaugaugagacagucgcacuuacagcguucguaacaauugcucugcaccacggacuggcagucuuccaggaugagggcgcugagccacugaaacagcgcguggaagccuccaucagcaaggccuccucuuuuuugggugaaaaggccagugcagggcucuugggcgcacaugccgcugcgaucacugcuuaugcucucacccucacaaaggcuccggccgaucuccggggagucgcccacaacaaucugauggcaauggcgcaggaaacuggggacaaccucuacuggggcucuguuacugggagucagucaaacgccgucucucccaccccagcuccucgcaaucccuccgaccccaugccucaggccccugcacuauggaucgaaacuacagcauacgcacuucuacauuugcuccugcacgaggguaaagccgaaauggcagaccaggcugcggcuuggcugacacgccaagggucuuuucagggcggcuuccguucaacucaagacaccgugauugcucucgacgcccuaagcgccuacuggauugccagccacacuacugaggaacgggggcugaacguaacucuaucauccacgggccgcaacggcuucaagucacaugcccugcagcugaauaacagacaaauucguggccucgaggaagagcugcaauuuagcuuagguucuaaaauuaacgugaaggucggcggcaacucaaaggguacucugaaggugcugcgaacguauaacguucuugauaugaagaacaccaccugucaggaucugcagaucgaggugacagucaagggacaugucgaauacacuauggaggcgaacgaggacuacgaagacuaugaauacgaugagcuucccgccaaagacgacccugacgcaccucugcagcccguaacuccauuacagcuguuugaaggacgaaggaaccggcggcgaagggaagcgccaaaagucguugaagagcaggagaguagaguacacuacacuguaugcauauggaggaauggcaaagugggccuuucuggaauggccaucgcagacgugacacucuugaguggauuucaugcgcuacgagcugaucucgagaagcuaacuucucuguccgacagauacgugucucauuuugaaacagaagguccacacgugcucuuguacuucgacucugugccgacaagccgugaaugcgugggauuugaggcaguucaggaagugccuguagggcucgugcagccugcuuccgcuacuuuguacgacuacuacaaccccgaaaggagauguuccguuuuuuauggcgccccuuccaaaagucggcugcuagccaccuugugcucagcagaagugugucagugcgccgaagggaaguguccgaggcaacggcgcgcucuggaacggggcuuacaagaugaggacggcuacagaaugaaguucgccugcuauuacccuagaguggaguauggcuuccaagugaagguucugcgggaagacuccagagccgcuuucaggcuguuugaaacaaaaauuacucaaguacugcauuuuacuaaagacgugaaagccgccgcaaaucagaugcgcaauuuccuggugagagcaucaugcaggcuacggcuggaacccgguaaagaauaccugauuaugggauuagacggggcaacauaugaucuggaaggacauccucaguacuugcucgacuccaacucguggaucgaggaaaugccaagcgagcgcuuaugccggagcacaagacaaagagccgccugcgcccagcuuaaugauuuucuccaggaguauggcacccagggaugccaggucuag

SEQ ID NO: 12959 - RNA, 792 nt, Artificial Sequence
  Description of Artificial Sequence: Synthetic coding sequence
auggcagauaugcagaaccucguggaaagacuugagagagccguuggccgacuagaagccgugagucacacguccgacaugcaccggggauacgcagacaguccuuccaaaggagccgccccauacguacaggcauucgacagucugcuugcugguccuguagccgaguaccuaaaaauuagcaaagaaauaggaggcgacgugcagaagcaugcugaaauggugcacacgggucucaagcucgagagagcacugcugguaacagccucucaaugccagcaaccugccgaaaauaaauugucugaccuucuggcucccauauccgaacagaucaaagaggugauuacuuuucgggagaagaaucgggguucaaagcuauucaaccaucucagugcugugagcgaaucaauccaggcucuaggcugggucgccauggcccccaaacccggccccuauguuaaggagaugaaugaugcugccauguuuuacacuaacagggugcuaaaagaguacaaagacgucgacaaaaaacauguugauuggguuaaagcguaccucucgauuuggacggaauugcaggcguacaucaaagaguuccauacuacuggacuggcuuggaguaaaaccggcccaguugccaaagagcugagcggucugcccaguggaccauccgcuggcaguugcccuccaccucccccaccuugcccaccacccccacccgucagcacaauuucuuguuccuacgagagcgcaucccgcucuucacucuucgcgcagaucaaccaggguuag

SEQ ID NO: 12960 - RNA, 501 nt, Artificial Sequence
  Description of Artificial Sequence: Synthetic coding sequence
augggcccugaggcacucagcucucuucugcuucugcuacuaguggcaucaggagacgcagacaugaaagggcauuuugaccccgccaaaugccgauacgcccugggcaugcaagaccgcacaauucccgacagcgauauuucagcuagcucaagcugguccgauucuaccgcugcccgacauucgcgucuggagucuuccgacggcgauggcgcuuggugccccgccgguagcguuuucccgaaggaggaggaauaccuccaggucgaucuccaaaggcuccaccugguagcuuugguggguacacaaggccggcacgcaggaggccuggguaaagaguucucucggucuuaucgucucagauauucacgcgacggaaggcgguggaugggguggaaagacaggugggggcaagaaguaauuuccgggaaugaagauccagaaggcgugguauuaaaagaccucggcccgccaauggucgcaaggcucguucgauuuuag

SEQ ID NO: 12961 - RNA, 2349 nt, Artificial Sequence
  Description of Artificial Sequence: Synthetic coding sequence
aguauccugaggguagaagccguagaugccgacuguuccccucaauuuucccagauuuguucauaugagaucaucaccccagacgucccguucacagucgacaaagauggcuacauaaaaaauacugagaagcucaauuauggcaaggaacaccaauauaagcugacggucacugcuuaugauugcggcaaaaagagggccacugaagacgugcuagugaagauuaguaucaaacccaccugcacaccggguuggcagggauggaauaaccggaucgaguacgaaccugggacuggggccuuagccguguucccaaacauccaccucgagacuugcgaugagccaguggcaucugugcaggcgacuguagaauuagagacgucgcacauuggcaaggguugcgacagagacaccuacucagagaagucacuacacagacucugcggugcagcugccgggacagccgagcugcuuccuagccccagcgggucccugaauuggacaaugggccuccccacagacaauggccaugacucagaccagguauuugaauucaacgguacccaggcagucaggauucccgacggaguggugucaguuucaccuaaagagccguuuacuauaucugucuggaugcgccacgguccauucggacguaagaaggagacuauccucugcuccucugacaagaccgauaugaaccgccaucacuacucacucuauguucacggcugucgccucaucuuccuguuccgacaggaccccagcgaggaaaagaaauacagaccugcagaguuccauuggaagcugaaucaagucugcgaugaagaguggcaccacuacguccucaacgucgaauucccaagcguaacccuguacguggacgguacgucacacgagccguuuucggugaccgaggauuauccucugcaccccuccaagaucgaaacccagcugguagucggcgcaugcuggcaagggggggaccugcacaugacacaauucuucagaggaaaucuggcaggccuuacacugcggaguggcaaacuggccgacaagaaggugauugacugucucuauacuuguaaagagggccuggaucuccagguccuggaagauuccggaagaggcguucaaauucaggcccaucccucacagcucguuuugacuuuggaaggagaggaccugggagagcucgauaaggcaaugcaacacauauccuauuugaauuccaggcaguuucccaccccaggcauuagaagacugaagauuacguccaccauuaagugcuucaaugaggcuacuuguauuagcguucccccgguagacggcuauguaaugguucugcagccagaagagccaaaaaucucucuaucagggguccaccacuucgccagggcagcuagugaguuugagucuuccgaggguguguuucucuuuccugaauugagaaucauuagcacuauuacccgggaggucgagccugagggggauggcgcugaagacccaaccgugcaggagucccugguauccgaggagauaguacacgaucuggacacuugugaaguuaccguggagggggaagaacuuaaccacgagcaggaaagcuuggaaguggacauggcacgccugcaacaaaaagggauugaggugagcucuuccgaacuuggaaugacuuucaccggagucgacacaauggcaucuuacgaggaagugcuccaucugcugagguaccguaacuggcaugcccgaucucuccucgaucgaaaauuuaaacugauuugcucagagcugaacggcagauacaucuccaacgaguucaagguugaggucaacgugauucacacugcgaauccaauggagcaugcgaaccauauggccgcccaaccucaguuuguccauccagaacacagauccuucguugacuuaucuggacacaacuuggcaaauccccauccuuuugccgucgugccgucuacagccacagugguuauaguggugugugucucuuuccuuguuuuuaugauuauccucggcguguucagaauacgggccgcccacaggaggaccaugcgcgaucaggacaccggcaaagaaaaugaaauggauugggacgacucagcucuuacaauuacagugaaccccauggagaccuacgaagaccagcacucuagcgaggaggaggaggaggaggaagaggaagaagaaagcgaggacggcgaggaagaggacgauauuacgagcgccgaguccgaauccagcgaagaagaagaaggcgagcaaggagauccccaaaaugcuacuagacaacagcaacuggagugggacgauaguacguuaucuuacuag

SEQ ID NO: 12962 - RNA, 531 nt, Artificial Sequence
  Description of Artificial Sequence: Synthetic coding sequence
auggcacgacgucacugcuuuuccuacugguuauugguuuguuggcuugucgucacaguggccgaagccuuaucaacauuuuaucuccaacaacacauuaaccuucacauggacaaaaaacgcuaucugaggcuccucgagauccacaagauuaugcguacccugccuacagccaggagccuacacuccccacuucaccucccccggggcguucgaucgcagggaccuucacccagccagcggcacccuggaguacccagcauuuucuuccacgagggccccgaaucuauucucgguuuucagaccgaucuuucuagucugcagggcgugacuacuguuuuccauuccagucacuuuaucgggcauacuguaacgcuacugaucggcauuagcccugaggaggauagucgcgaggaggcccaucucagaaaggccgagcgugaggagaaacccaagcacacagaggcaaaaaaaagcuuauccuuccgcaaaaaacaacagaaagacuuuugcuucaucuuccgaaacuag

SEQ ID NO: 12963 - RNA, 1182 nt, Artificial Sequence
  Description of Artificial Sequence: Synthetic coding sequence
augaggacuuuguucaauuuauugugguuagcccucgcuugcucuccggugcacacuacccucaguaaguccgacgcaaagaaggcggcuuccaagacucuccuagagaaaucccaauucagcgacaaaccugugcaggaccggggccuuguagugacagaucucaaggcagagucugugguguuagagcacagaucuuauugcuccgccaaagccagagaccggcacuucgccggagacgucuuaggcuacgugacccccuggaacucucauggauaugacguuacaaaaguauuuggaucuaaguucacucagauuagcccagugugguugcagcugaaaaggcgcggacgugagauguucgaaguuacaggacugcaugaugucgaccagggguggaugcgggcagugaggaaacaugcuaagggccuccacauugucccccgcuuguuguucgaggacuggacuuacgacgauuuuagaaauguacuggacucagaggacgagauugaagagcucucuaaaacaguugugcagguagcaaagaaucagcauuuugacggcuuugugguggaaguguggaaccagcuucugucucaaaagcgcguggggcucauucacaugcugacucaccuggcugaagcacugcaccaggccagacuacuggcacuccuugugauuccgcccgcaauaacuccagguacagaucagcuggggauguuuacacauaaagaauuugagcaacuagccccugucuuagauggcuucucucugaugaccuaugacuacagcacagcccaccaaccuggccccaaugcuccauuguccugggugcgcgccuguguccaggugcuggacccaaaauccaaauggagaucuaaaauucuucugggucugaauuucuacggcauggacuaugcuacaucuaaggacgcgagagagccaguugugggcgcaagauacauccagacucugaaggaucauaggccgagaaugguuugggacucucaggccagcgagcacuucuuugaguacaaaaaauccagaagcggacggcacgugguguuuuacccaacacugaaaucccugcaagugcgccuggaacuggcgcgagaacucggcgugggagugaguauuugggaacugggccagggauuggacuacuucuacgauuuacucuag

SEQ ID NO: 12964 - RNA, 324 nt, Artificial Sequence
  Description of Artificial Sequence: Synthetic coding sequence
augcuacccugccuggcacugcuauuacuuauggaacugucggugugcacaguagcaggagacgguggcgaagaacagacccuuucgacggaggcugagaccugggagggagcagguccgagcauucagcugcagcugcaggaaguaaaaacagguaaggcaagucaauucuuuggcuugauggggaagcgagucggggggcggccauugauacaaccuagacgcaagaaagcguaucaguuggagcauaccuuccaaggauugcucgguaaacggucacuuuuuacugaaggacgggaagacgaggcccagggaagugaguag

SEQ ID NO: 12965 - RNA, 1086 nt, Artificial Sequence
  Description of Artificial Sequence: Synthetic coding sequence
augggcaucauccagagcauacuggccacuagccgugacuguuacucauuuaaaaagaaacccauuccgaagaagccuacuauguuggcgcuggcuaagauccugcucaucucgacacuuuucuauuccuuacuguccgggucucacgguaaagaaaaucaggacaucaacaccacucaaaauauagcugagguguucaagacaauggaaaacaagccaauaucuuuggaguccgaggcaaaucugaauuccgauaaggaaaacauuaccacaagcaacuuaaaggccagccacucacccccccucaacuugccuaacaauucccacggcauaacagacuuuuccucuaauuccucagcugagcauagucucgguucccuuaagccgacauccaccauuucgaccucucccccucugauucacucauucguaaguaaagugccguggaaugccccaauagccgaugaagaccugcucccaauuucggcucacccuaaugcaacccccgcccugaguucugaaaauuucaccuggucucuggucaacgauacuguaaaaacuccagauaacaguucuauuaccgugucaaucuugucgucugaacccacaagcccaucugugaccccccucaucguugagccuuccgguugguugacuacgaauagcgacaguuucaccggcuucacaccuuaccaggaaaagacaacacuccaaccuacccuaaaguuuaccaauaauagcaaauuauucccuaauaccagugauccccagaaggagaaccgcaacacugggaucguguuuggcgcuauccuaggcgcuauucuaggagugucgcuccucacacuggucggauaccuucugugcgggaagcgaaaaacagauaguuuuagccaucgaagacuuuacgaugaucgcaacgaaccuguucuccgccucgacaacgcccccgaaccuuaugaugugucuuuugggaauucauccuacuauaauccaaccuugaaugauucagcuaugccugagagcgaagaaaacgcccgcgacggcauuccaauggacgauauuccaccucugaggaccuccgucuag

SEQ ID NO: 12966 - RNA, 279 nt, Artificial Sequence
  Description of Artificial Sequence: Synthetic coding sequence
augagagguccuggccauccccuguuauuggggcuacuguuagugcucggacccagccccgaacagcggguugaaauagugccccgagaucugagaaugaaggauaaguuucuaaaacaccugacugggccucucuauuucagccccaaguguaguaaacauuuucaccgccuuuaccauaacacacgugauuguaccaucccagccuauuacaaaaggugcgcuagacuacugacccggcucgcagugucacccgucugcauggaagacaaacaguag

SEQ ID NO: 12967 - RNA, 1125 nt, Artificial Sequence
  Description of Artificial Sequence: Synthetic coding sequence
ugacgcguaaggcgcggaccauuaccugcggauagaccucgcgcucuggguccugcuaggcgaugcucuagacacccccaccccgccccuuuccgggugugcagcgaaggggcagcacaccggcugcgaaggccagagcgccugccgcucccuaguagggccuugagaccuaggccagcgcauaccccuauucuaggcccagccccacgugcaugcccuggcgcuccucgggcgucagacucuccuaccugcgcugcagcugccgccacggcguggccaaggacacgggcuguugagagaaaagggugccaaguugcugccgccgccggcgugcgcggcacaggaugcccuucucgcgcagaccuggagaaggauuccuggaaugauacaaaggaggauguguuugugcaccagaccgcaauuaaaaaaaauaauccacguaaauaucugaggagcgucggugauggcgagacaguggaguuugacguggucgagggggagaagggagcugaggcagcaaaugugaccgggcccggcgguguacccgugcagggcuccaaauaugcugcggaucgcaaccauuauaggcgauaucccagaaggagaggcccgccccgcaacuaucagcagaauuaccaaaacagcgaguccggcgagaaaaacgaggguuccgagucggcuccggaaggacaagcccaacaaagacgaccguaccggcgaagacgcuuuccgccuuacuauaugagacgcccuuauggaagacggccgcaguauagcaacccaccugugcaaggugaaguaauggagggagcagauaaccaaggagccggagaacagggacgucccguucgccagaacauguacaggggguaucgcccgagauuuagaaggggacccccuagacagcgccagccacgggaggaugggaaugaggaggacaaagagaaccaaggggacgaaacucaggggcagcagccaccccagagacgguacagacggaacuuuaacuauaggcgaagacgaccagaaaaucccaagccacaggacgggaaagagacgaaagcugccgacccuccugcugaaaauagcuccgccccugaagcagaacaggggggcgcagaauag

SEQ ID NO: 12968 - RNA, 420 nt, Artificial Sequence
  Description of Artificial Sequence: Synthetic coding sequence
auggcccucagaaugcucugggcaggccaggcuaagggcauucucggugguugggggaucauaugcuuggucaugaguuuguuacuucagcaucccggugucuacuccaaauguuauuuucaggcccaggcgccuugucauuaugaaggaaaguacuucacacugggcgagucaugguugcggaaggauuguuuccacugcacuugcuuacauccuguuggcgucggcuguugugacacgagucagcauccaauugauuuucccgccggcugugagguaagacaggaagccggcaccugucaguucucucuggugcagaaaucugacccucggcugccauguaaggggggaggaccagacccagaauggggcucugccaauacaccaguuccgggcgcuccggcgccacacucuagcuag

SEQ ID NO: 12969 - RNA, 462 nt, Artificial Sequence
  Description of Artificial Sequence: Synthetic coding sequence
cauuauugcaaggaggguuacuaucgcgacaugggcaaacccauuacacaccggaaggcaugcaaggcaugcgacugccacccuguuggcgcagcaggcaagacaugcaaucagaccacaggccagugcccaugcaaggauggugugaccggaauaaccugcaacagaugcgcaaaaggauaucaacagucccgguccccaauagcuccaugcaucaagauucccguugcacccccgaccacugcagccucauccguggaggaacccgaggcagcccgucaacccaacacuuuccaggcagaggggcugucacugcucccaggagccgcugagaaagagggagcccggugcuggggauauagaagaaggcucggacauagggucgcacaggcugaguguaggggaccccggucuugggcuugggggcgaauuacauccucauucuccuuugcuagcaacuag

SEQ ID NO: 12970 - RNA, 213 nt, Artificial Sequence
  Description of Artificial Sequence: Synthetic coding sequence
augcucguuuuguuccuguugggaaccgucuuuuuguugugucccuacuggggcgagcugcacgauccgauuaagggccagucuauguaccauuauuccaagcucagcugcaugaccuccugcgaagauauuaauuuccugggauuuacuaagagaguagaguuaauuuguugugaccacucuaacuauugcaaccugccagaggggguguag

SEQ ID NO: 12971 - RNA, 567 nt, Artificial Sequence
  Description of Artificial Sequence: Synthetic coding sequence
auguuccaucagaucugggccgcucugcucuauuucuacgggaucauucugaacucaaucuaucagugccccgagcacagccagcugacuacguuaggaguggacggaaaagaguuuccagagguacaucucggucaaugguauuucaucgcaggcgccgccccaaccaaggaggaacucgccacguuugauccagucgauaauauuguuuucaauauggccgccgguucagcacccaugcagcugcaucucagagcaacaauccggaugaaggauggccugugcguacccagaaaguggauuuaccaucuuacagaaggaucuacugaccucagaacagaaggcaggccagacaugaaaacggaacuguucaguucaaguuguccaggcgguauuaugcuuaacgaaaccggccagggcuaucagagauuucugcuguacaaccgcuccccccaccccccagaaaaaugcgucgaagaguuuaaaucucuuaccagcugcuuagacucaaaggcuuuucuacugaccccuagaaaccaggaggccugcgaauugucaaacaauuag

SEQ ID NO: 12972 - RNA, 2316 nt, Artificial Sequence
  Description of Artificial Sequence: Synthetic coding sequence
auggggugguugacaaggaucguuugucucuuuuggggagugcucuuaaccgcuagggcaaacuaccagaacggaaaaaauaacgugccucggcuaaaauuauccuacaaagagauguuggagagcaauaacgucaucaccuucaauggccucgcaaauaguuccucauaccacacauucuugcuggacgaggaacguagccggcuguacguuggugccaaggaccauaucuucuccuucgaccuggucaacauuaaagacuuucagaagaucguguggcccgucucauacacgaggagagaugaaugcaagugggcgggcaaagacauucucaaggagugcgccaacuuuauuaagguucuuaaggccuauaaccagacacaccuuuacgccugcgguacaggcgccuuucaccccaucugcacauauauugagaucggccaucaccccgaggauaacauuuucaagcuugaaaacucacacuucgagaacggacgcgggaaaucccccuaugaccccaaguuacugacugccucucuacuaauugauggggagcucuacuccgguacugcugcugacuuuaugggccgcgacuuugccauuuuucguacccucggacaccaucauccuauucgaacugagcagcaugauucccgauggcuaaaugauccuaaauucaucucagcucacuuaaucucagaaucugacaaccccgaagaugauaagguguauuuuuuuuuccgagagaaugcuaucgacggcgaacauagcgggaaagccacucaugccaggauugggcaaauuugcaagaacgauuuuggcgggcacaggucccucgugaauaaguggacuacuuuucugaaagccagguuaaucuguucagugccaggcccaaacggaauagacacccacuuugaugaguugcaggauguguucuuaaugaacuucaaggauccgaagaauccgguaguauacggcguguucacgacgaguagcaauauuuucaaaggaucagccgucuguauguauucuaugucugacgugagacgaguuuuccucgggccauacgcacaccgugauggaccaaauuaucaauggguuccauaccaaggcaggguucccuacccacgucccggcacaugucccagcaagaccuucggcggguuugacagcaccaaggauuugcccgacgacgugauaacauucgccagaucucaccccgccauguacaacccgguuuucccaaugaauaacaggcccaucgugauuaagacggacgugaauuaucaauuuacacagaucgugguggaucgaguugaugccgaagauggacaguacgacguuauguucauagguaccgaugugggaacuguccucaagguugugaguauuccuaaggagacuugguacgauuuggaggagguguuacuggaagaaaugaccguuuuccgagagcccacggccauuagugcgauggaauuaagcacaaaacaacagcagcuguauaucggcaguaccgcaggggucgcccaacucccauuacaucgcugcgacauuuacggcaaggcuugugcagagugcugucuggcccgagacccuuauugcgcaugggacgggucugccugcucaagguauuuucccacugccaaaaggcgcacccggagacaggauauucggaauggagaucccuugacucacuguucggaucugcaccaugauaaccaucacggccacaguccagaggagagaaucaucuacggaguggaaaauaguucgacauuucuugagugcagcccaaaaagccagcgugcgcugguguacuggcaguuucagagacggaacgaggaaaggaaggaagaaaucagagucgacgaucacauaauuagaacggaucagggccugcugcuccgaagcuugcaacaaaaagacagcggcaacuaccugugucacgccguggaacaugguuuuauccaaacacuacugaaggugacccuggaggucaucgacacggagcaccucgaggaacuuuugcacaaagacgaugauggggacggauccaagacuaaagagaugucaaacucaaugacaccuucccagaaaguaugguaucgagacuucaugcaauuaaucaaccacccaaaccugaauacaauggacgaguucugugaacaaguuuggaagcgggaucggaagcaacgccggcagcgcccuggacacacgcccggcaauuccaacaaguggaagcaccuccaggaaaauaagaaaggucggaaucgccgaacucacgaguuugagcgagcgccucgaucaguauag

SEQ ID NO: 12973 - RNA, 1014 nt, Artificial Sequence
  Description of Artificial Sequence: Synthetic coding sequence
auggccagaccuaugaucaaagaggcacgcauggccuccuuguugcuggagaacccuuacuacggcuguaggaaacccaaagaucagguucggaguagucugaaaaauguuucugaucuguuugugauggggggggcccugguacucgaaucggcugcgcuccugcacugguuggagagagaggguuaugggccucugggaaugaccgguaucucuaugggaggccacauggccagucuggccgucucaaauuggcccaaacccaugcccuugauuccguguuuaagcuggagcacagccuccggugucuuuaccacgggagugcuuucuaaaucgauuaacuggagagaacuugagaaacaauauuacacgcagaccgucuacgaggaagagauaauccauauguuagaauauuguggcaccgacucguuuaagauggggcaggaauuugugaaacauuuuacuucuagcgccgauaaacugacgaaccucaaucugguuaguagaacacuuaaucuugacaucaguaaccaaguggugucccagaagccagccgacugucacaauuccuccaagacuuccgugagcgccaccuccgaaggccuucucuugcaggacacaaguaagaugaaacguuuuaaccagacacugucaacuaacaaauccgguuacaccagccgcaauccucaguccuaccaccuacucagcaaagaacagucucgaaauucacucaggaaagagagucuuauuuuuaugaaaggagugauggacgaauguacucaugucgcuaacuuuuccgucccugucgacccaucacugauuaucgucguacaagcuaaggaagacgccuacauuccaaggaccggcgugcgcucacugcaggaaauauggcccggcugcgaaauaagauacuuggaagguggucacauaucagccuaucuguucaaacaggggcuuuuucggcaagcaauuuacgaugcauuugaucguuuucugcacaaguacgccaacuag

SEQ ID NO: 12974 - RNA, 462 nt, Artificial Sequence
  Description of Artificial Sequence: Synthetic coding sequence
augggacccgaggcacucucaagcuuauugcugcuguuacuugucgcauccggggaugcagauaugaagggccacuuugauccggccaaauguagauacgcccugggcaugcaggaccgaacaauaccugacagcgacaucucugcgucaagcuccuggucggacucaaccgcugcaaggcauucaaggcuggaguccagcgauggagacggggccuggugcccagcugggagcguuuuuccgaaggaagaagaauacuugcagguugaucugcagcgccuccaccuuguugcccugguugguacucaaggucgccaugccggaggauugggcaaggaauuuucccguuccuauagauugcgguauucuagagaugguaggagauggaugggauggaaggaucgcuggggucaagaggucaucuccggcaacgaagaucccgagggagucgugcuuaaauag

SEQ ID NO: 12975 - RNA, 345 nt, Artificial Sequence
  Description of Artificial Sequence: Synthetic coding sequence
auggacaagucacuacugcuggaacucccuaucuuacucugcugcuuuagagcccugagcggcuccuugucaaugagaaacgacgcugugauugaaauaguacaauguagaaugugccaccugcaguuuccuggagagaaguguucccggggcagaggaauuugcacugccacaaccgaggaggccugcaugguugggagaauguucaagagagacgguaacccauggcuaacauucaugggauguuuaaagaacugcgccgaugugaaagggauacgauggucaguuuaucuggugaacuuccgauguugccgaucgcacgaccucuguaaugaagaucuguag

SEQ ID NO: 12976 - RNA, 630 nt, Artificial Sequence
  Description of Artificial Sequence: Synthetic coding sequence
augggcccggaggcguuaucaucucuccuucugcugcucuugguagcuuccggugaugccgacaugaaaggacacuuugaccccgcgaaguguagauacgcucugggaaugcaggacaggaccauucccgacagugacauuagugcauccuccucuuggucggauuccaccgcggcaagacacucaaggcucgaaucuucagauggugacggcgcgugguguccagccggcaguguuuuucccaaggaagaggaauaccugcaagucgaccuucagagacugcaccugguugcucuagucggcacccaaggaaggcaugccgggggccucggaaaggaauuuuccagauccuaccgguugcguuacucccgggacggacgaagguggaugggcuggaaggacagguggggccaggaagugaucucaggcaacgaggaccccgaggguguaguccugaaagaucugggaccucccaugguggccagacugguaagauuuuaucccagagcggacagggugaugagcguuugucugcgagucgagcuguacgggugccucuggagggacggacuguuaagcuacacagcuccuguaggccagacaauguaccugagugaagccgucuacuag

SEQ ID NO: 12977 - RNA, 639 nt, Artificial Sequence
  Description of Artificial Sequence: Synthetic coding sequence
gauuucgguuacugccccaggguauacugcgaaaaucagccaaugcuccccauaggcguucuugucaugguaggguuuacugucggaaagguucccgugcccgauauccggacaugccauuuuugcuugguggaagaucccucugucgguugcauuucugggagugaaaaguguacuauuagcucaucuucucuguguauggucaucacuauuuacuaugacgucaagguuagguucauuguacgagggugcggucaguacaucucauacaggugccaggagaagagaaauaccuauuucgcugaguauugguaccaggcccaaugcugccaguacgacuacugcaauucauggaguucuccacagcuacagucuucuuuaccugagccccaugacaggccccuggcauugccucugagcgacucccaaauucaaugguucuaccaggcccugaaucuaucccugccucuuccaaauuuccacgcugguacagagcccgacggccuggauccgaugguuacccugagucugaaccugggccuguccuucgcugaacuacgccggauguaucuguuucugaacucaucaggccugcucgugcuuccccaggcuggccugcugacgccccauccaucauag

SEQ ID NO: 12978 - RNA, 240 nt, Artificial Sequence
  Description of Artificial Sequence: Synthetic coding sequence
augaagcuacacucccuuaucucugugcuguugcuguucgucacauuaauucccaagggcaagacugguguaaucccuggacaaaaacaaugcauagcucugaaaggcgugugccgcgauaaacuuugcucgaccuuagacgauacaauuggaauauguaaugaaggaaagaaauguugucgacggugguggauccucgagccuuacccaaccccugucccgaaaggcaaaucgcccuag

SEQ ID NO: 12979 - RNA, 1620 nt, Artificial Sequence
  Description of Artificial Sequence: Synthetic coding sequence
augagugaaccccaggagaagaagcucucggaaaauacagacuuccucgcgcccggagugucuucauucacagauaguaaccagcaggagucgaucacuaaacgcgaggaaaaucaagagcagccaaggaacuauagucaccaucagcugaacagaagcagcaaacauagccagggacugagagaccaggggaaccaggagcaggauccaaauauuagcaacggcgaggaagaggaggaaaaggaaccaggggaaguggggacucacaacgacaaccaggaacgaaaaacugagcugccaagagagcacgcaaacuccaaacaagaagaggacaacacucagucagacgauauccucgaggaaagcgaucagccuacccaggucucuaaaaugcaagaagacgaauucgaucagggaaaucaggaacaggaagauaacagcaacgccgagauggaggaggaaaacgcaucuaacgugaacaagcauauucaagaaaccgaguggcaaucccaagagggcaagaccggccuagaagcuauaagcaaccacaaagagacagaggaaaagacugugucugaggcucugcugauggaaccuacagaugauggcaauacuacuccccguaaccacggugucgacgaugacggagacgacgacggagaugauggcggcaccgacgguccaagacauucagcuucugaugauuauuuuaucccuucccaggcguuucuggaggcugaacgcgcucagaguauugcuuaucauuuaaaaauugaggaacaacgagagaagguacacgagaaugaaaauaucggcacuacugaaccaggagagcaccaagaagcgaagaaggccgagaacaguagcaaugaagaggagaccaguucugaggguaacaugagaguucacgccgucgauucuuguaugagcuuccagugcaaaagaggccacaucugcaaagcugaccagcaggggaagccucacugcguuugucaggauccuguuacaugcccuccaacuaaaccccuggaccagguaugugggacugacaaccaaacuuacgcuucaaguugccaccuguucgcgacaaaauguaggcucgaggggaccaaaaaggggcaccagcugcagcuagauuacuucggggccuguaaaagcaucccaacauguacagauuuugaggucauucaguucccccuucgcaugagagacugguugaagaauauccugaugcagcucuaugaagccaauagugagcaugcaggguaucugaaugagaaacaacguaauaaggugaaaaagaucuaucuugaugagaagaggcuucuugccggcgaccauccaauagauuugcugcugagagauuucaaaaaaaauuaucauauguacgucuauccuguacauuggcaguucagcgaauuggaccagcaucccauggaccgaguccugacacacucugagcuggcgccccuucgugccucucugguccccauggagcauugcaucacacgguucuuugaggagugcgacccuaauaaagacaagcacauuacacugaaggaguggggccauuguuucggaauuaaggaagaggauauagacgaaaaucugcuuuuuuag

SEQ ID NO: 12980 - RNA, 2535 nt, Artificial Sequence
  Description of Artificial Sequence: Synthetic coding sequence
augggcccaggagccccguucgcaagaguugguuggccucugccauuacugguugugauggcagcuggcguggcaccggucugggcaagucacagcccccaccuccccagaccucacagccguguccccccacacccaagcucugaacggagggcaguguacaucggagcucuguuucccaugagcggaggauggccgggcggccaagccugucagccugcagucgaaauggcucuagaagaugucaacuccagaagggauauucugccagauuacgaguugaaacuaauucaccacgacagcaagugcgaccccgggcaagcaacaaaguaccucuaugaacuccuauauaaugauccuaucaaaaucauccuuaugcccggauguuccucggucagcacgcuaguggcugaggcugcuaggauguggaaucuaauaguucuuuccuacgguagcuccaguccagccuugaguaauagacagcgcuucccgaccuucuuccgcacucacccguccgcaacacugcacaauccaacuagggugaaauuguuugagaagugggguuggaaaaagaucgcgaccauccaacagacaaccgaagucuucacaucaaccuuagaugaccuugaagagcgaguuaaggaggcugguauugaaaucaccuuccgccaauccuucuucuccgacccugccgugccagucaaaaaucugaagcgacaggacgcuaggauuauaguuggcuuauuuuacgaaacugaagcaagaaagguuuuuugcgaaguuuacaaagagcgccuguucgggaaaaaguacguuugguuucugaucggcugguaugcggauaauugguuuaagaucuacgacccaaguauaaauuguacaguagaugaaaugacagaggccguggagggccauaucaccaccgaaaucguuaugcuuaauccagccaauaccagaaguaucucuaacaugacuagucaggaguuuguggaaaagcugacaaaaagacugaaaagacacccagaagaaaccggugguuuccaggaggcuccacuugcuuaugaugccaucugggcccuagcgcucgcauuaaacaagacuucaggugguggcgggcgcucuggaguuaggcuagaagacuuuaauuauaauaaccagacuauuacagaccaaaucuaccgugcaaugaacucaucaucuuuugaaggggugucaggacacgucguguucgacgccucaggcucgcgcauggccuggacacuuaucgagcagcuucaaggaggaaguuacaaaaaaauaggcuauuacgauucaaccaaagacgaccuaucgugguccaagacagauaaguggaucgggggcagcccgcccgcugaccaaacccuuguaauaaagacauuucgcuuuuugucucagaaacuguuuaucagcguguccguccucagcucccuuggcauuguguuggcaguggugugccugucuuuuaauaucuauaacucucacgugagguauauccaaaauagucaaccaaaucucaauaaucucacagcaguugguuguuccuuagcguuggcugcuguguucccccuaggauuagacggguaccauaucggaaggaaucaguucccauuuguuugccaggcucgguuauggcugcucggacuuggcuuuucacucggcuacggcucuauguucaccaagaucugguggguucacacaguguuuaccaagaaagaggaaaagaaagaguggagaaaaacucucgaaccauggaaauuguaugccacggugggccugcuggucgguauggaugugcuuacccuggcuaucuggcagauuguggacccccuccacagaaccaucgagacuuucgcgaaggaagaaccuaaagaagacaucgacgugucaaucuuaccucagcuagaacacugcagcagucggaagaugaacacuugguuggggauuuuuuauggguacaagggccugcuccuacugcugggaaucuuccuggccuaugagaccaaguccguuuccacugaaaaaaucaaugaccacagggccgucggcauggcuaucuacaaugucgcagucuugugccugaucacggccccugugaccaugauccugucuucgcagcaggacgcagccuuugcuuucgcgagccuggcgauuguguucuccagcuacauaacucucgugguacuuuucgucccuaagaugaggagguuaauuaccagaggcgaguggcaaagcgaagcacaggacaccaugaagacuggcaguagcacaaauaacaaugaagaggaaaagucucgcuuauuagaaaaggaaaaucgagagcucgaaaagaucaucgccgaaaaggaggaacgggugucagagcugcgccaccagcugcaaucucgacaacagcugagaucaagaagacauccuccgacaccucccgagcccagcggcgggcugccuagggggccaccagagccuccagauagacuuuccugcgauggcuccagagugcaucugcuguacaaguag

SEQ ID NO: 12981 - RNA, 993 nt, Artificial Sequence
  Description of Artificial Sequence: Synthetic coding sequence
augcagcuauuuuuguuacucugucugguacuccugagcccucagggugcuucccugcaccgccaucaccccagggaaaugaagaaacgcguugaagaucuucacgucggagcaaccguggcuccuucauccagacgcgacuucaccuuugaucuacuggguaaugcacuguucaccgaccucguuguggaccuucaggacaccuucgucagcgccaugaagaccuuauaucucgcagacaccuuccccacgaauuuuagagauucugcaggcgcuaugaaacaaaucaacgacuacguggcuaagcaaacaaagggaaagaucguagaucuguuaaagaaccuggacuccaaugcgguaguuaucauggucaauuauaucuuuuuuaaggcuaagugggagacgucauucaaccacaaagguacccaagagcaggauuucuaugucacuucagagacaguggugcgagucccaaugaugagccgcgaagaccaauaucacuaccuauuagaucgcaaucuaucguguagaguuguagggguuccauaucaagggaacgcuaccgcacuauuuauacugccgagcgaaggaaagaugcagcaagucgagaacgguuugagcgaaaagacacuacguaaauggcugaaaauguuuaagaagcgccagcucgaacuguaucucccaaaauuuagcaucgaaggaucauaucaguuggaaaagguccuucccucccuggggauuagcaauguguucaccucacaugcggaccugagcggcauuagcaaccacucaaauauccaggucagcgaaaugguccacaaagcugugguggaggucgaugagagugguacuagggccgcagccgcaacagggacaauuuucaccuuucggucugcucggcugaacucgcagaggcuggucuucaaucgaccauuccugauguuuaucguggacaauaauauccuuuuccucgguaaggucaaucggccauag

SEQ ID NO: 12982 - RNA, 2676 nt, Artificial Sequence
  Description of Artificial Sequence: Synthetic coding sequence
augcucccgacggaaguaccgcagucucacccuggaccuagcgcccugcucuuacugcagcuguugcugcccccuaccagcgcuuuuuuuccuaauaucuggucccugcuggccgccccagggaguaucacucaucaggacuuaacugaggaggcagcgcucaaugucacgcugcaguuauuucuggaacagccgccgccagguaggccuccgcugcgacuugaagacuuucugggacgcacacugcucgcugaugaccuguucgcggcuuacuucgggccuggcagcucuagacgguucagagcugcguuaggggaagucaguagagcuaaugcagcccaagacuuccugccuaccucaagaaacgacccggaccuacacuuugaugcagaaaggcucggacagggcagggcccgacuaguuggagcucuuagagagacugugguggccgcgcgugcccuagaccauacguuggcccgccaaagacucggugccgcccuacacgcucugcaagauuuuuauucucacaguaacuggguggagcugggugaacagcagccucauccacauuugcucuggcccaggcaggagcugcagaaucuugcacaggucgcugaccccacaugcucggacugcgaagaacugagcugcccgcguaacuggcuuggguuuacucugcuuacaucagguuauuuugggacucaccccccaaagccuccuggaaaguguagucacgguggccacuucgauagaucuagcucccagcccccacgcggugggauuaacaaagacagcaccucccccggcuuuagcccacaccacauguugcaucugcaggcagccaagcucgcgcuccucgccagcauucaggcuuucagucugcuuagaucuagauuaggagacagggacuucagucgccuguuggacauuacacccgccagcagccuaaguuuuguguuggauaccaccggaucaaugggggaggaaaucaaugccgcaaagauccaggcucgccaucugguggaacagcgcagggguucucccauggaacccgugcauuauguccuggugcccuuucaugacccaggcuucgggcccguauucacgacuuccgaucccgauagcuuuuggcagcaguugaaugaaauccacgcucuuggcggaggagacgagcccgaaaugugucugucagcccuccaacuggcucuccuucacacuccuccacucucugauauuuucguguuuacugacgcuuccccgaaagacgccuuuuugaccaaccagguagagagucuaacccaggaacgucgaugucgggucacuuuccuuguuaccgaggacaccagccgcguucagggcagagccaggcgcgaaauucucuccccacuuagauucgagcccuacaaggccguugcacucgcaucuggcggcgagguuaucuucacuaaggaccagcacauuagggaugucgccgcuaucguuggcgaguccauggcagcgcucgucacacucccccuggaucccccaguaguuguuccugggcagccacuaguuuucaguguggacgggcugcugcagaaaaucaccguacgcauccacggugacauuuccucauucuggaucaaaaaccccgcaggagucucgcagggacaggaagaggguggcggaccccuaggacauacacgccguuuugggcaguuuuggauggucaccauggacgauccuccccagacugguaccugggagauccaggucacagcagaagacacgcccggcguccggguucaggcucagacuucucuggacuuccucuuccauuucggaauuccaauggaggaugguccccaccccggccuuuacccgcucacccaaccaguugcaggucuccagacccagcucuugguggaaguuacagggcugggcucucgggcgaaucccggggacccacagccacacuuuagucauguuauucugagaggugucccugagggugccgagcuuggccaggucccacucgaaccuguugguccuccugagcguggucuccuugcugccucccuuucaccgacuuugcucuccacuccccggccauuuucuuuggagcuaaucggucaggacgcagccgggcgacgguugcacagggcugccccccagcccucuaccguggugcccguacuacuggagcucagcggcccuucagguuuccuagccccggguaguaaaguucccuuaagccuccgcauugccagcuucaguggcccacaggaucuggaccuucgcacuuuuguuaacccuaguuuuagccuuacgucuaaccuaagucgagcucaccucgaacucaacgaguccgcauggggccgccuguggcuugaggugcccgacagugccgcacccgacagcgucgucauggugacaguuacugccggcggucgcgaagcuaauccggugccgccaacucaugcuuuuuugaggcugcuugucuccgcuccagcuccccaggauagacauaccacaccaaccggcuccucugauccuauuuugaccacagcuacuccagcuuucucaccuuuuacccuggugacucagggcagggcaggcgcaggccucgcugcuggaagucccugguggggaaccgucggcggaguguuacuccuccucggccuugcuuccugguag

SEQ ID NO: 12983 - RNA, 708 nt, Artificial Sequence
  Description of Artificial Sequence: Synthetic coding sequence
augaaguacguauuuuaccugggggugcucgcuggcacuuucuucuuugccgacucaaguguacagaaagaagaucccgcgccauaccugguuuaccugaagagucauuucaaccccugcgucggugugcucauuaagccuagcuggguccucgcucccgcccauuguuaccuuccaaaccuuaaagugauguuaggaaauuucaagaguagaguacgagacgggacagaacagacaauuaaccccauucaaauuguuagauacuggaauuacagccacucugcgccacaagacgacuuaaugcugaucaaacuggccaaaccugcgaugcucaauccaaaagugcagccgcuuacucucgcaacaacuaauguuagaccuggaaccgucugucugcugagcggccucgacuggagccaagaaaauucuggaaggcauccggaucugcgccagaaucuagaggcuccugugaugucggauagggagugccaaaagaccgaacagggaaaaagccacagaaauucccugugcgugaaauucgugaagguguucucaagaauuuuuggggagguggcaguggcuaccgucauaugcaaagauaaguugcaggguaucgaaguggggcauuuuaugggcggggacguggguaucuacacuaauguguauaaguauguuucguggaucgagaauacggcaaaagauaaauag

SEQ ID NO: 12984 - RNA, 1386 nt, Artificial Sequence
  Description of Artificial Sequence: Synthetic coding sequence
augucacuggacauccagucacuugacauccagugcgaggaacugucagacgcacguugggccgaguuacugccgcuccuucagcagugccaggucguacggcucgaugacugugggcugaccgaggcaagaugcaaagauauauccagcgcccugagggugaauccugcccuggccgaacuuaaccugcggucgaacgaguugggagaugugggcguucacugugugcugcaaggccugcagaccccuagcugcaagauacagaagcuuuccuugcagaauuguugucuuacaggagcaggcugcggaguucucucuuccacauugcggacacuuccaacucugcaggagcuucaccugagugacaaucugcucggcgaugcaggcuuacagcuucugugcgagggccuguuggauccucagugccgcuuggagaagcuucaacuugaguacuguucccucucggcagcaucgugugagccuuuagcuuccgugcugcgcgccaagccggauuucaaggagcugaccguuagcaauaacgauauuaaugaagcagguguaaggguucuaugucaaggccuuaaggauucuccaugccagcuggaagcccugaagcucgaaucuuguggcgugacaucugacaacugcagagaucugugcggcaucguggccucaaaggccucacugcgagaauuagcccugggcuccaacaaacuuggggacgugggaauggccgagcugugccccggccuccuccaucccagcucaagauugcgcacccuguggauuugggaaugcggaaucaccgcaaaggguuguggagacuuauguaggguccucagagcuaaggaauccuugaaggaguugucacuggccggcaaugaguuaggcgacgaaggugcccggcugcucugugagaccuugcucgaacccggcugucagcuggagucacugugggucaaguccugcagcuuuaccgccgcuuguugcucucauuuuagcucaguccucgcucaaaaccguuuucugcucgaacuccagauaagcaauaauagacucgaggaugccgguguuagggaacugugucagggacugggccagcccggauccguguugagagugcuguggcuggccgauugugacguaucugacucaucaugcucgucccuggcugcaacccugcuggccaaucauucguugagagaacuggacuuaaguaacaacugccucggcgaugcuggcauccugcagcucguggaauccgucaggcaacccgggugucugcucgaacaacuggucuuauacgauauuuacuggucugaagagauggaagauaggcugcaggcgcuagaaaaagauaagccaucuuuacgcgugaucaguuag

SEQ ID NO: 12985 - RNA, 2676 nt, Artificial Sequence
  Description of Artificial Sequence: Synthetic coding sequence
augcugccuacugaaguaccacaaagucaucccggaccaagugcucuccuccuguuacagcuccuccugccaccaaccucggcguucuuccccaacauuugguccuuacuugcagcacccggguccaucacacaucaggaucugaccgaggaagccgcccucaauguuacacuacaacuuuuuuuggagcagcccccacccggccguccccccuuacgucuggaggacuucuugggccggacuuuauuggccgaugaucucuuugccgcauauuuuggaccagguagcuccaggcgguucagggcggcacuaggcgaaguuucucgcgccaaugcagcccaggauuuccuacccacuucaagaaacgauccggaccuccauuuugacgcugaacgcuuaggccagggcagagcacgauuagucggcgcucugagagaaaccgugguggcugccagggcuuuagaccacacgcuggcacggcagcggcugggcgccgcccugcacgcuuugcaagacuucuauagccacuccaauuggguggagcucggagagcagcaaccccacccucaucuguuauggccgaggcaagagcuacaaaaccuggcccagguagccgacccgacaugcagcgauugugaggagcuguccuguccgagaaacuggcuaggauucacccuucugacuuccggauacuucggaacccacccucccaagccccccgggaaauguucccaugggggucacuucgacagaucauccucacaaccaccgcgggguggaaucaacaaggacucaacuucucccggguuuagcccgcaucauaugcuccaucuccaagccgcuaaguuagcacugcuagcaucaauacaagccuucucacugcuuaggagccgacugggcgaucgggacuuuuccaggcuucucgauaucacaccagcaucaucccugaguuucguccuggauacaaccgggaguaugggcgaggaaaucaacgcagccaaaauucaggcaaggcauuuaguagaacagaggaggggauccccaauggagccggugcacuauguucuggugccauuucaugaccccggauuuggucccguuuuuaccacuucugaccccgacagcuucuggcagcaacugaacgaaauacaugcgcuuggcgguggagacgaaccagagaugugucugucagcacugcaacuggcccuccuccacacaccuccacuauccgauauuuuugucuucacagacgccucacccaaagaugccuuucugacaaaccaggucgagagcuuaacccaggagagaaggugucgcgucacauuccugguuaccgaggacaccuccagagugcagggccgugcccgccgggagauccucucaccacugcgauuugaacccuacaaagccguggcacuggcaucaggcggagaaguaauuuuuacuaaagaucaacacauccgggaugucgcagcaauugugggugaaagcauggcagcacuagugaccuugccgcuugacccaccagugguggugcccgggcagccccucgucuucucuguggauggacuccugcaaaagauuaccguucgaauacauggcgauauaucuuccuuuuggaucaagaauccggcaggcguaucucagggacaggaggaaggugguggcccucuuggccacacaagacgcuuuggccaguucuggauggucaccauggaugacccaccccagaccgggacaugggagauacaaguuacagccgaagacacuccaggggugcgggugcaggcccagaccucccucgacuuccuauuccauuuuggcaucccuauggaggauggaccccaucccggacuguacccacucacucagcccguagcuggccugcagacgcagcuucucgucgaaguaaccggcuuagggucccgcgcuaacccaggcgauccacagccacauuucucacaugucauucugcgaggcgugcccgagggugccgaguuaggccaaguuccacuugagccagucgggcccccugaaagaggacugcuggccgccucacugagcccuacacuucugagcaccccucgcccuuuuucucuugaacuaaucggccaagacgcugcggguagaaggcugcaccgagcggcuccacagccuucaacaguggugccagucuuguuggagcuaucaggaccaucaggcuuucuggcccccggcaguaagguuccucucucucuuaggauugccuccuucagcggaccgcaggaccucgaccugcggaccuucgugaacccuucuuuuucucuuacaucuaaucugucccgugcccacuuggaacugaaugagucagcguggggucgcuuguggcuggaggugccagacucugcugcuccugauagugucgucauggugacagugacugcaggggggagagaggcaaacccugucccacccacacacgccuuucugcggcugcugguuucugcccccgccccucaggaccgacauaccacucccacugguucuagcgauccuauacuaacaaccgcaacaccagccuucucucccuuuacauuaguaacacaaggccgggccggcgccggucuggccgccggaaguccaugguggggaacagucgggggcguucuccugcugcuuggacuagcaucuugguag

SEQ ID NO: 12986 - RNA, 501 nt, Artificial Sequence
  Description of Artificial Sequence: Synthetic coding sequence
auggggcccgaagcgcuuaguucauugcugcugcugcugcuugucgcguccggggacgccgauaugaagggccauuuugauccagccaagugccgauaugcuuuagguaugcaggauagaaccauacccgacagcgacaucuccgccaguuccucuuggucagacaguacugcagcgagacacuccagauuggaaagcagugauggcgacggggcgugguguccagcuggaaguguguuccccaaggaagaagaguaccuacaaguggaccugcagaggcugcaucucgucgcccuggucggaacacagggacgucacgcaggcggccucgggaaagaguucuccagaaguuaccgguuacgcuacagccgcgacggacgcagauggaugggcuggaaagaucgguggggccaagaaguuauauccggaaaugaggacccggaaggugugguuuugaaagaccugggacccccgaugguagcccgauuagugagauuuuag

SEQ ID NO: 12987 - RNA, 420 nt, Artificial Sequence
  Description of Artificial Sequence: Synthetic coding sequence
augcaggccgcuuguugguacgugcuguuccuccugcagccuaccguguaccuugugacaugugccaaucuaacgaauggagggaaaucugagcuacugaaguccggcaguucaaagucuacccugaaacauauauggacagagagcucuaaagaucugucaaucuccagguuacugucccaaaccuuuagaggcaaggaaaacgacacagaccucgaucuccgcuacgacacaccagaaccauacucagagcaggaucuuugggauugguuacguaacucgaccgacuugcaggaaccacgaccaagggcaaagaggcgccccauaguaaagacaggcaaguucaagaagauguucggcuggggagacuuucauuccaacaucaaaaccgucaagcucaaucugcugaucacaggauag

SEQ ID NO: 12988 - RNA, 2412 nt, Artificial Sequence
  Description of Artificial Sequence: Synthetic coding sequence
auggcugcugccggacugguggcuguggcugccgcggcggaguacucuggcaccgucgcuuccggaggcaaucugccuggcgugcauugcggaccgagcaguggggcagguccgggauucggcccagggucuuggucacggucucucgacagagcacuggaggaagccgcagucacaggggugcugagccugaguggcagaaagcugagagaguucccuaggggcgcugcaaaucacgaccucaccgacacaacaagggcugaucuguccaggaauaggcuguccgagauaccaauagaggccugucauuucgucagucucgagaaucugaaccucuaccagaauugcauucgguauauuccagaggcuaucuugaaccuccaagcuuugacuuucuugaauauuucuaggaaucaacuuucgacucuaccuguucaucuguguaaucugccacucaagguuuuaaucgcuagcaauaauaagcucgucucccuuccugaagaaauaggacaccuucgccaccuuauggaacuugacgucaguuguaacgagauucaaaccauuccgagucaaauuggaaaucuggaggcucuucgcgaucuuaaugugcguagaaaccaucugguccaccugccugaggaauuggcugagcuuccucucauccggcuggauuuuagcuguaauaaaaucacgacuauuccuguuugcuaccgcaaccuucgucauuugcagacgaucacucuggacaauaacccccugcaaucuccaccagcacaaauuuguauuaagggcaaagugcacauuuucaaguacuuaaauauccaggcgugcaaaaucgcccccgaccuucccgacuacgacagacgaccccuuggcuuuggcaguugccacgaagaacucuauucuaguagaccuuauggugcucuugauucaggguuuaacuccgucgacaguggggacaaaagaugguccggcaacgagcccaccgaugaguucuccgaccuuccccugcgaguggccgagaucacuaaagagcagcguuugaggagagagucccaauaucaggagaaccggggcuccuuagugguaacuaacggcggggucgagcaugaccuagaccagauagauuauaucgauagcuguaccgcggaggaggaggaggcagaggugcgucaaccaaaaggaccggaccccgacucacugucaucccaauucauggccuacaucgagcagcgccggaucagucaugaggggaguccgguaaagcccgucgcaauucgggaauuccagaaaaccgaggauaugcgccgcuaccuccaccagaaccgaguccccgcagaaccauccaguuuacucagccuguccgcaucccacaaucagcuuagccacacggaccuggagcuacaccagcggagagaacagcuuguggagcgaacucggcgggaggcccagcuagccgcacugcaguacgaggaagaaaagauuaggacuaaacagauccaacgugacgccguuuuagacuucgugaagcaaaaagcaucucagucaccccagaaacagcacccccugcuggauggcguggauggugaaugccccuuuccgagucgcagaucacagcauaccgaugauuccgcacucugcauguccuuauccggucuuaaucaagucggcugcgccgcuacucuuccacauuccagcgcuuucacuccacugaaguccgacgauaggcccaaugcauuguuaucaagcccagccaccgagacgguacaccauagcccggcauacagcuucccagccgcaauccagcgaaaccagccucagagaccagaaaguuuucuguuccgagcgggagugcgugcagaaaccaauaaaggacacgcuuccccucugccuccuucagccgcgccgacaacggacucaacugauucuauuaccgggcaaaacuccaggcagcgcgaagaggaacucgaauuaauagaucaacugcgaaaacauauagaguaccgacugaaagugucacugccaugcgaccuuggggccgcccugacugacggagugguccugugccacuuagcuaaccacguacggccaaggucagugccaagcauccauguuccaagcccagcuguuccuaaacuuacaauggcuaagugucggagaaacgucgagaacuuucuggaggcaugcaggaagauagggguaccacaggauaacuuguguagcccuucugauauccuacagcugaaucugagcguuaagcguacagucgaaacgcuguugucacuuggcgcacauuccgaggaaucuucuuucgugugccucagucugcagcugcucggcuucguggcauuuuauuguacugugaugcuuacuuuguguguccuguacuacugguuguuucccgcaagguag

SEQ ID NO: 12989 - RNA, 633 nt, Artificial Sequence
  Description of Artificial Sequence: Synthetic coding sequence
auguauaaagcucgcccaccugcuggguccggaggccccggggccgaaccuccugcgauggccgccccucgugggcgggcugccccuuggaccaccgcccugcugcuucuucuggccucucaaguucugucacccgguuccugugcugaugaggaggagguccccgaagaaugggucuugcuucaugucgugcagggacagaucggugcugggaauuacaguuaccugagacucaaucacgaaggaaaaauugugcugcguaugcgaucacugaagggcgaugcagaccuuuauguauccgcaagcucauuacaucccucuuucgacgauuaugaauugcagagcgccaccuguggacccgaugcaguuagcauuccagcacauuuuaggagaccagucggcauaggaguuuauggccaccccucacauuuggagagugaguucgagaugaaaguguacuacgacgggacaguggagcagcaccccuucggagaagccgccuauccagccgauggcgccgacgccggucagaagcacgcgggcgcgcccgaagacgcaucacaggaggaagaaagugugcuguggaccauacuuauuucaauccucaaacuaguccucgagauuuuguucuag

SEQ ID NO: 12990 - RNA, 486 nt, Artificial Sequence
  Description of Artificial Sequence: Synthetic coding sequence
ugauguccaacugagauuauugcuuucggagaucggcuggaggaauuuaggucaaucaauaccgaagugguggccugcucugucgauagccaauuuacucaccuggcuuggauuaauaccccgcgccggcagggugggcucggcccuauucgaaucccccuuuuaucugauuuaacacaucaaaucuccaaggauuacggcgucuaucuugaggauagugggcacacucuccgcggucuuuucauuaucgacgacaagggaauucuucggcaaauuacacugaaugacuugccaguugggaggagcguggaugaaacauugaggcugguccaggcauuucaguauaccgacaaacacggagaaguaugcccugccgguuggaaaccuggaucggaaacgaucaagcccgaagauacuaugaaagcaugguggcccagagaaucuuacaacccucguaguaguuggaaagcagaaguguuuagauag

SEQ ID NO: 12991 - RNA, 2886 nt, Artificial Sequence
  Description of Artificial Sequence: Synthetic coding sequence
augcuccuucuguuacugcuggccccucuauuucuuagaccuccuggggcaggaggcgcccaaaccccuaacgccacaucugagggcugucagauuauccauccucccugggagggaggcaucagauacagaggccuuacucgggaucaggugaaggcuauuaacuuccugccuguugacuaugaaauagaauauguaugccgaggggaaagagagguaguaggcccaaaaguaagaaaaugccuugccaacggcaguuggacagacauggauacgccaucgagauguguaaggauuuguagcaaaucauaccuuacccucgagaauggcaaagucuuccugacagggggggaucuuccggcguuggacggcgcuagaguggacuuuagaugugacccggauuuccaccuuguuggaucgagccgcagcaucugcagucaagggcaguggucaacaccuaaaccacacugccaggucaauaggaccccacacucggagaggcgggcaguguauaucggagcccuguuuccaaugucuggcggcuggccaggcggacaggcaugucagccagccgucgagauggcucuggaagacgugaauagccgcagagauauucugcccgauuaugaacuaaaauuaauccaccacgacucuaaaugcgauccagggcaagcgaccaaauaccuguacgaacugcuguauaacgauccuaucaagauuauccuaaugcccggcuguaguuccgugagcaccuugguggccgaggcugcuaggauguggaaucugauuguccuguccuauggcagcaguuccccggcccugucuaaucgucaacgcuuccccaccuuuuuuagaacccauccauccgcuacucuucacaaucccacgcgcguuaagcucuuugaaaaguggggguggaaaaaaauugcgacaauucagcagacuacggagguguucaccagcacacuagaugaucuggaggaacgaguuaaagaggcugguaucgagauaaccuuucgucaaucuuuuuucuccgauccggcuguaccuguuaagaaccuaaagcggcaggacgcacggauuauugucggauuguuuuacgagacagaagcacguaagguuuucugcgagguguauaaagagagacucuucgguaagaaauauguuugguuccugaucgguugguacgcugacaacugguuuaagaucuacgauccaucaaucaacugcacuguggaugagaugaccgaggcggucgagggucauauaacgacggagauugugaugcuuaaccccgccaauacuagaucuaucuccaauaugaccagccaggaguuuguagagaagcugacuaagcgcuugaaaagacacccugaagagacaggaggguuucaggaggcaccgcucgccuaugacgcaaucugggcccuggccuuggcccuaaacaagacaagcggcggcggcgggcggagcggcgugcgacucgaagauuucaauuacaacaaccagaccaucaccgaccagaucuaucgagccaugaauucuucuucuuuugagggggugucugggcacguaguguucgaugcgucaggaucccguauggccuggacucugaucgagcagcuccagggggguaguuacaagaaaauuggauauuacgauagcacuaaagaugauuugagcuggagcaagacggauaaguggaucgggggcagcccuccggcagaccagacacuggugaucaagacuuuccgguuuuuaucacaaaagcuauucaucuccguaucggugcuguccagccuggggauugugcuggccguggucugccucucuuuuaacauauauaacagccacgugagauauauccagaauucucagccuaaccuuaacaaucugaccgccguaggauguucccuagcccucgcugcagucuuuccccugggacuggauggauaccacauaggucggaaucaguuucccuucgugugucaggcaaggcuguggcuucuuggccugggauucuccuugggcuacgguucuauguuuacaaaaauuugguggguucauaccguguuuacaaagaaggaggagaaaaaggaguggaggaaaacccuggagccguggaaauuguacgcuacagugggcuugcuggugggaauggacguguuaacgcuggccaucuggcaaaucgucgaucccuuacaucgcacgauugagacuuucgccaaggaagagcccaaggaagauauugacgugucgauccugccucaacuagagcauugcuccagccgaaagaugaacaccuggcuggggauauuuuacggguacaaaggacugcugcuucugcucggaaucuuccuggcuuacgaaacaaaauccgucucaacagaaaaaaucaaugaucaccgcgcaguggguauggcuauuuacaacgucgccguccucugccugauaacagcacccgugacuaugauucugucuagccagcaggacgcagccuuugccuuugccucacuagccaucguguucaguuccuacaucacacuugucgugcuguucgugcccaagaugcgccgacucauuacucgcggagaauggcaaagcgaggcgcaggacacaaugaaaaccgguucaucaaccaauaauaaugaggaggagaaaucaagacugcucgagaaagaaaaccgcgaacuugagaaaaucaucgcugaaaaagaggaaaggguguccgaacuaagacaucagcuucaaucccggcagcagcugcgcagcaggcggcauccuccuacuccuccugagccaagcggcggacugccccggggucccccugagccacccgaccgguugucgugcgauggaucccgcguccaccugcuguauaaauag

SEQ ID NO: 12992 - RNA, 2853 nt, Artificial Sequence
  Description of Artificial Sequence: Synthetic coding sequence
augaccuggcguaugggcccccguuucaccauguuacuugccauguggcugguguguggguccgagccccauccccaugccacgauacggggcagccauggcggaaggaaggugccuuuagugagccccgacagcucacgcccagcaagguuucugcgccacaccggcaggagucgggggaucgaacggucaacauuggaagagcccaaccugcaaccccuacagcgccggagaagcguucccguccucagacuggcuagaccaacugaaccccccgcccgaucagacaucaacggcgcagccguacggccugaacaacggccagcugcuagagggaguccgagggaaaugauuagagacgaggguagcagugcucggagcagaauguugcgauuucccuccggcaguucaaguccuaauauccucgccaguuuugccggcaagaaccgggucugggugauuagcgcuccgcaugccucagaaggguauuaccgccucaugaugagucuucugaaggaugaugucuauugugaauuggccgaaagacauauccagcagaucguuuuauuucaucaagcgggagaggaaggggguaaagugaggcgcauuaccagugaaggccagauucuagagcagccucucgacccaucguugaucccuaaauugaugagcuuucuuaaguuggaaaaaggaaaauuuggcaugguccugcugaagaaaacccugcagguggaagaacgguacccauaccccgugagguuagaagcaauguaugaagugaucgaucaggggcccauuaggagaaucgagaagauccgccaaaagggguucgugcaaaaauguaaagccucaggcguugaaggacaggugguggccgaagggaacgacggcggcggcggagcagggcgccccucacuugggagcgagaagaagaaagaagacccccggagagcacagguccccccuacucgcgagagucgcgucaaaguccugcggaaauuggccgccacugcucccgcacucccucagccaccuucuaccccccgcgccacuacacugcccccugccccugcuacuaccguuacacggagcacaagcagagcuguuacggucgccgcacgccccaugaccacuaccgcuuuccccacaacacagagaccauggacuccaucacccucccacaggccuccaacaaccaccgaagugauuaccgcaaggcggccaagcguuagcgagaacuuguacccaccaucucguaaagaccagcauagggagaggccccagaccacacggaggccaagcaaggccaccucacuggaaaguuuuaccaaugccccuccaacuacaaucagugagccaagcacccgugccgccgggccuggaagguuucgcgauaacaggauggaccgccgcgaacacggccaccgggacccaaacguugugcccggcccucccaaaccugccaaagaaaagccacccaagaagaaagcucaggacaaaauccucagcaacgaauacgaggaaaaguaugaucuuucaagaccuacagccucucaguuggaggaugaacuucaggugggcaacguuccccuuaagaaggccaaggaguccaagaagcacgaaaaguuggagaaaccugagaaagaaaagaagaaaaagaugaaaaacgagaacgccgacaaacugcugaagagugagaagcagaugaaaaaaucagagaaaaaguccaagcaggaaaaggaaaagagcaagaaaaagaagggcggcaagacagaacaggacgguuaccagaagccuacuaauaaacauuuuacccagagcccaaagaagucuguugccgaccugcugggcagcuuugaggggaagcgccgacugcugcugaucacagcuccuaaagcggaaaauaacauguacguucagcaacgcgaugaguaccuagaauccuucuguaagauggccacaagaaagauaucugucaucacaauuuucggaccuguaaauaacuccacaaugaagauugaucauuuccagcuggacaacgagaaaccuaugagggucguagaugacgaggacuuggucgaucagaggcuuaucuccgaacuaagaaaggaguacggcaugaccuauaacgauuuuuucaugguacuuaccgacguggacuugcgcgugaaacaguacuacgaggugccaaucacaaugaagucuguguucgaucuuauugacacguuccagagccggauuaaagauauggaaaagcaaaagaaggaggggaucguuuguaaagaggacaagaaacagucacuagagaauuuucugagcagguuuagauggaggcgucgucuccucguuaucucugccccaaacgacgaagacugggcuuauucccagcaguuaagugccuuaucuggccaggccuguaacuucggucuccgacauauaaccauucucaaacugcucggggugggggaagaagugggcggaguuuuggagcuguuccccaucaaugguucuagcgucguggaaagagaggacgugccugcccaucuuguuaaggacaucagaaauuauuuccaaguguccccugaguauuuuucaaugcugcuugugggcaaagauggaaaugugaaaagcugguaucccagcccaauguggucgauggugaucguguacgaucuaaucgacucuaugcagcugcguagacaggagauggcuauccagcagucacugggaaugaggugucccgaagacgaauacgccggauaugguuaucacaguuaccaccagggcuaccaggauggcuaucaggacgauuacaggcaccaugaauccuaccaucauggcuacccauacuag

SEQ ID NO: 12993 - RNA, 351 nt, Artificial Sequence
  Description of Artificial Sequence: Synthetic coding sequence
auggcagcuggcuccgcaccgaugcagcuacacuugcgggcuaccauucguaugaaggacggguugugcgugccgcggaaauggauauaucaccugacagagggcucaacagaucugaggacggaaggcagaccggauaugaagaccgagcucuuuuccagcagcugcccaggaggaauuaugcuaaacgagacaggccagggcuaccagagauuucuguuguacaauaggucaccccacccuccugaaaaauguguugaagaguuuaaaucgcugacauccugccuggauagcaaggcuuuucugcucacuccacgcaaccaggaagcaugugagcugaguaacaacuag

SEQ ID NO: 12994 - RNA, 1251 nt, Artificial Sequence
  Description of Artificial Sequence: Synthetic coding sequence
augaaauuccaaggcccucuugcaugccuguugcuugcacucugcuugggcagcggugaagcaggacccuuacagaguggagaagaaucaacgggcacuaacauaggcgaagcccuagggcacgggcuaggggaugcccugucagaagggguuggaaaggccaucgggaaagaggcagggggcgcagcuggaaguaaggugucugaagcacuuggucaggggacaagggaggccguggggaccggagugcggcaggugccggguuuuggcgucgcugaugcacuggguaauagggugggcgaggcagcccaugcgcuaggaaauacaggccacgaaaucggaaggcaggccgaggaugugauucggcacggagcugaugcagugagaggaaguuggcagggugugccuggacacaauggcgccugggagacaagcgggggucauggcauuuuugggagucagggugggcuuggaggccaggggcagggcaaccccggaggacuuggcacuccuugggugcacggcuacccuggaaauagugcugguaguuuuggaaugaauccgcagggugccccauggggucagggaggaaaugggggaccccccaauuuuggaacaaacacccagggagcagucgcccagccaggcuacggaagugugcgugccucuaaucaaaaugagggcugcacaaauccacccccuagcgggucggggggggggucuagcaacucuggggggggcuccggaucccagucaggcagcucugggaguggcucaaauggugauaauaacaacggaagcucgucugggggaagcucuucugggagcucgucggggggcucuaguggcggcagcagcggcgggaguucugggaauagugguggcagccgaggcgacagcgggagcgaaucuucuugggguagcaguaccggcagcagcagcggaaaccaugguggcagcggcggaggaaacggucauaaacccggcugugaaaaacccggcaaugaggccaggggcucgggagaguccggaauacagggguuccggggacagggcguguccucaaacaugcgggaaauuucuaaagaggggaaucgccuguuaggcgggucuggagauaauuaccggaacuccgagacgaguccuggaauguucaauuuugauacuuucuggaaaaauuucaaaucuaaacugggcuucauuaacugggacgcgauaaauaaggaccaaagaaguagccguauccccuag

SEQ ID NO: 12995 - RNA, 150 nt, Artificial Sequence
  Description of Artificial Sequence: Synthetic coding sequence
auggcaccaccaucugugccuuuaguccuccugcuaguccugcugcugucccuggcugagacccccgcuucagcccccgcacaucgcucaucuacauuccccaaauggguuacaaaaacagaacgcggacgucagccccucagaucuuag

SEQ ID NO: 12996 - RNA, 978 nt, Artificial Sequence
  Description of Artificial Sequence: Synthetic coding sequence
augcagggacggguggcugguaguugcgcuccucuuggcuuauugcuagugugcuuacaccugcccgguuuguuugcccggucgauaggagugguggaggaaaaaguaucccagaauuuaggaacaaaccucccacagcuugggcagccuucuagcacaggaccuucuaacagcgagcacccgcagccagcacuggauccacgaucaaacgaccuugcaagagugccacucaagcugagcguccccgcuucggacgguuucccaccugcaggaggcagcgcgguucaacgguggccaccgucauggggauugccagcgauggauuccuggcccccugaggauccauggcagaugauggccgccgcugccgaagaccggcucggagaggcccucccagaggaacugucauaccuaucgucagccgccgcccuggcuccaggaaguggaccuuuacccggcgagagcagcccugacgcgacgggccuguccccaaaagccucucuguugcaucaagauucagaaucccggagacuccccaggucaaauucuuuaggggcuggagguaaaaucuugucgcagaggccacccuggagucuuauccaccgagugcucccagaccauccuugggggacgcugaacccuuccguuucuuggggagggggagggcccgguacugggugggggacgagacccaugccacacccagaaggcauauggggaauuaacaaucagcccccaggcacuucuugggguaacaucaacagguaccccggggguaguugggggaacauaaaucgguauccggggggauccuggggaaacauuaauagauacccgggcgguagcugggggaauauccaucuguauccuggaaucaacaauccuuuccccccaggggugcuucguccuccuggcucaucuuggaauauuccagcgggguuuccuaacccuccaaguccuagacuccaauggggauag

SEQ ID NO: 12997 - RNA, 390 nt, Artificial Sequence
  Description of Artificial Sequence: Synthetic coding sequence
auggccgccgguagugcacccaugcaacuccaccugcgagcaaccauucggaugaaggacggacucugugugccccggaaauggauuuaccauuugacagaaggguccacugaucuuaggacugagggccgaccagauaugaaaacggagcuguuuagcuccaguugcccaggaggcaucaugcucaaugaaaccggccagggauaucaaagauuccuguuguauaaucggucaccccacccacccgaaaagugugucgaagaguucaagagucucacaucaugucuugauaguaaggcguuucugcugacuccacguaaucaagggaaaggcuuaaagucucacaaaaccggauuggggcuuacgaaauccucuggagugacaggguag

SEQ ID NO: 12998 - RNA, 1056 nt, Artificial Sequence
  Description of Artificial Sequence: Synthetic coding sequence
auggcaggaaucccaggacuccuguuucuucucuucuuccuucucugugccguuggucagguuagcccuuauagugccccauggaagccuacguggccugcauaucgacucccugugguccuuccacagagcacacucaacuuagccaagcaguaccuaagcuacgagacacucuaugccaacggcagucggacagaaacacagguaggaauuuacauccugagcucuaguggagacggcgcccagcacagagacucagggaguuccggaaaaucccgaaggaagaggcagaucuacggguacgacucaagguucaguauauucgggaaggacuuucuacuaaacuaucccuuuagcacaucagugaagcugucaacaggcuguacaggaacgcucguggccgaaaagcacgugcugaccgcagcgcauugcauccacgauggcaaaaccuaugugaaaggcacucaaaagcuucgagugggauuucugaaaccaaaguuuaaagaugggggcaggggcgccaacgacuccaccuccgcuaugcccgaacagaugaaguuccaauggaucagggugaaacgcacgcacguuccaaagggguggauuaagggaaaugcaaacgacauuggcauggacuacgacuaugcucuccuggagcucaagaaaccacauaagagaaaguucaugaaaauaggaguguccccaccggcaaagcagcucccgggaggcagaauucauuuuucuggguaugacaacgaccggcccgggaaccuaguguacagauucugugacgucaaggacgagaccuacgaucugcucuaccaacagugugacgcccaacccggcgcgaguggguccgguguguauguccgcauguggaaacgccagcagcagaagugggagcgcaagauaaucggaauuuucucgggacaucaaugggucgacaugaacgggucaccacaagauuuuaauguggccgugagaauaacuccccugaaguaugcucaaauuuguuauuggauuaagggaaacuaccucgauugccgugaggguuag

SEQ ID NO: 12999 - RNA, 345 nt, Artificial Sequence
  Description of Artificial Sequence: Synthetic coding sequence
auggagagaggugccggcgccaaacuucucccacuacugcuucugcugcgggcaacaggauucacuugcgcccaaacagauggacguaacgguuauacggcugugaucgaagugaccuccggaggcccauggggcgauugggcauggccugagaugugcccagacgguuuuuucgcaagugguuuuagucugaaaguagagccuccucaggggauuccgggagacgauacugcccugaacggcaucaggcugcacugcgcaagggggaaugugcugggaaacacucacgugguugagagucagucaggcagauggggggcugguguggaagauccuuugggcuag

SEQ ID NO: 13000 - RNA, 825 nt, Artificial Sequence
  Description of Artificial Sequence: Synthetic coding sequence
auguggcggugcccccuuggccuuuuguuacuccugccacuagccggccaccucgcccucggagcacaacagggcagaggccggcgggagcucgcucccggccuacaccuacggggcaucagagacgccggagggagauacugucaggagcaggaucucuguuguagaggacgggcugaugauugcgcgcugccuuauuugggcgccaucugcuacugcgaccuuuuuugcaaccguaccguuuccgauuguuguccagacuucugggacuucugccugggagugcccccaccuuucccaccuauucagggcugcaugcacggggggaggauuuauccaguguugggaacauauugggauaauuguaauagauggccacccuuggaauguugggaucuucugccgccugcgcuuccagggcccgucugggcugcgcugggagccaaagaagagauggcaggaaaggacagaacuguauacugcccacuguugaugaaagcacugggugcucgagucggugaguguccaggaugucagagcccccagagaaugcugcccgagucaucccguguacucuugccgaggugugcugagggggagcagccuggaguucagagagggaaaggcagaaugagaaaggccuuucccgcacuacaaaccccauuagcccucccaucuagugcccccgccucacccggagcagggaaaccgucucacaccggcucuuggcuaccucugagacuucugaagcgccagcacuggcgaugggagccauggaccgccugcaaagaagcgguccagcaccucgugaucacagaguuauag

SEQ ID NO: 13001 - RNA, 438 nt, Artificial Sequence
  Description of Artificial Sequence: Synthetic coding sequence
auggcgcaacuguuccuaccacuccuagccgcucugguuuuggcccaggcucccgccgcccuggcagacguucuagaaggggacaguagugaagaucgggccuucaggguuagaauugccggugacgccccauugcagggcgugcuggguggugcacugacaaucccgugccacguacacuaccuuaggccacccccaagccgaagggccguacucggaucuccucgggucaaguggacauuccuuucucgugggagagaggccgaaguccuuguagccagaggcgugcgcgucaaagugaaugaggccuaccgauuucgcguggcccucccggcuuauccagcaucccugaccgaugucagccuggcacuuagcgaacuacgcccuaacgauagcgggaucuauagaugugagguccagcauggaaucgacgauuag

SEQ ID NO: 13002 - RNA, 567 nt, Artificial Sequence
  Description of Artificial Sequence: Synthetic coding sequence
auguuucaccaaauuugggccgcucuccuguauuucuacgguauuaucuuaaacucuaucuaccaauguccugagcauucccagcuuacuacccuagggguggacggcaaagaauuccccgagguccaucucggucagugguacuucauugcaggcgcagccccuacaaaagaggaauuagcgacauucgaccccguugacaacauagucuuuaacauggcugcagggucggcucccaugcagcugcacuugagagcuaccauuagaaugaaagacggacuuugugucccacggaaguggauauaccaccucacggaaggcucaaccgaucuuagaaccgaaggcagacccgauaugaagacagaacuuuucucuaguuccugucccggggguauaaugcugaaugagacaggccagggguaccagagguuccuguuauacaauagauccccccauccccccgaaaaguguguugaggaguucaagagccugacaucaugcuuagacaguaaggcuuuccuccugacccccaggaaccaagaagcuugcgagcucucaaauaauuag

SEQ ID NO: 13003 - RNA, 558 nt, Artificial Sequence
  Description of Artificial Sequence: Synthetic coding sequence
augggccccgccgggugugcuuucacccuauuacugcugcugggaauaagcgauagagacuaucauucagcgcugcaggaagcggaggugccgaucauagaccgacaggccugcgagcaacucuauaauccuauuggaauauucuugcccgcacuggaacccgucaucaaagaggacaagauuugcgccggcgauacacaaaacaugaaggauucuuguaagggagauucuggagggccccucaguugccauauugauggaguguggauccaaaccggaguagugagcuggggacuugaaugcggaaagucacugccaggaguuuauacuaaugugauauacuaccagaaauggaucaacgcgacaaucucacgcgcaaacaacuuggauuucucagauuuucuuuucccaauugugcuccuaucuuuggccuuauugcguccauccugugcguucggcccuaauacaauccacagagucgggacuguugcagaggccguugcauguauccaggggugggaagagaacgcuuggagguucucuccucgcggccguuag

SEQ ID NO: 13004 - RNA, 1653 nt, Artificial Sequence
  Description of Artificial Sequence: Synthetic coding sequence
ccagcccccgcaucucgcaaacucuugccacgucgccaccuuuccgagaagucucaccacauuagcaucccuaguccagauaucagccacaagggacugcgcuccaagcgaacacaacccagcgacccggaaaccugggaaagccuccccagauuagauagccagcgucauggggggccggaauuuaguuuugaccugcuucccgaggcucgggcaauuagaguuaccauuaguuccgggcccgagguauccgucaggcugugucaccagugggcgcuggaaugugaagaacucagcuccccauaugauguccagaaaaucgugucuggcggccacaccguggagcugccguacgaauuucugcugccaugccuuuguaucgaggccaguuaccuccaggaggauaccguccgcagaaaaaaauguccauuucagucauggccagaggcguaugggucagacuucuggaagucggugcacuucacagauuacucacaacauacccagauggugauggcccuaacccuuagauguccccucaaacucgaagccgcuuugugccagaggcacgacuggcacaccuuguguaaagacuuacccaacgcaacagcuagggagucugaugguugguacguucuggaaaaaguugaucugcauccucaguuguguuuuaaguuuucguucggcaauucaagucauguugaguguccacaccagacuggaucacuuacuucuuggaacgucucgauggacacccaggcgcagcaacucauuuuacacuuuaguucgcgaaugcaugcaaccuuuucugcugcauggucacugccaggccuuggccaggauacccugguucccccaguauauacugugagccaggccagaggcucaagcccagugagccuggaucucauaauccccuuucuacgccccggcugcugcgugcucguguggcggucagacgugcaguuugcauggaaacaucugcucugccccgaugugucauaucgacaccuuggacugcuuauucuugcgcugcucgcacuccuaacccugcuuggcguuguucuugcccugacuugccgacguccucaaagcgggcccggucccgcccgucccguguugcuauugcacgcugcugauagugaagcucaaaggcggcuggucggagccuuggccgaguugcuacgcgccgcacugggcgguggacgagaugugauaguugaccuuugggagggaagacauguggccagaguuggaccucuacccuggcucugggcugcgcgcacacgcguagcacgggagcagggcacaguguugcugcuauggucuggagcagaucugcggccaguaagcggaccagacccacgcgcggcaccucugcuggcccuacugcacgccgcuccgcgaccucugcugcugcucgcuuauuucucuaggcuuugugcaaaaggcgacauuccucccccccuacgggcccucccucgcuacagguuacuuagggauuugccaagacuccugagagcgcuggaugcccgccccuucgcggaggcgaccagcuggggcagacucggggcgcgacagcgucgacagucuagacuggaacugugcuccagacuugagagggaagcugcucgucucgccgaccugggauag

SEQ ID NO: 13005 - RNA, 816 nt, Artificial Sequence
  Description of Artificial Sequence: Synthetic coding sequence
auggguauugugugcgcgcaguguucauucauccucuuacugucaauuauccgcgcccggccucccccauuucuguuuugcccucucuccagccagcgaacagagucccccuacaagccgguacaucugggccugggccccacagacaaaguugccgcuauagcaauggcucgcauuaucgaccucgucccaugggacgacgggaguacacauguauacgccucaccagcuauccuccuucccauggaacgacagagaaaccaacucgcaggagugaagcaacaacuguaccaucccgcccugccuacucugcgccacauggaccgcgacacgguaaaagccugucucccugaugagcauugucagucaaccacauacugcagaaaagaugaauuugauaacgcccauuuuacgcugcugggggucccuaauaagccccugcaaugccuggauaucacggcuaccggccagaaacugagaaaccgauaucacgagggaaaauuggccccaaucgcacccggaauuaauagagucgacuggccauguuucaccagagccauugaagacuggucacauuuuguguccucggcaggagaguuuaagcugccuuguuuacggaagcgcgccgaaggccucucaggguacgcgguucgcuaccuuaaaccugacguuacacaaaccuggcgguauugucucucucagaacccaucucucgauagauauggacagaaaccacucccauucgacucccucaacacguuccgcucuuuugguucuucuuauucaagaguaaacuaucugacuccuuggcauuag

SEQ ID NO: 13006 - RNA, 1743 nt, Artificial Sequence
  Description of Artificial Sequence: Synthetic coding sequence
augcaccucagcgcuguguuuaaugcacuccuagucucugugcuggccgccguucuguggaagcacguucgacugcgcgagcacgccgccacacuggaggaagagcucgcucugagucgccaggccaccgagcccgcucccgcguuaagaauagacuacccaaaggcucugcagauuuugauggaaggcggaacccacauggugugcacaggucggacccacacggauaggauuugcagguucaaauggcugugcuacucuaaugaggccgaggaguuuauauucuuucauggcaacacgucaguaaugcuuccuaaucuuggaagccgccgguuccagccugccuugcuggacuuguccaccguggaagaccacaauacacaauauuucaacuucgucgaacugcccgccgccgcuuuacgauuuaugccuaaacccguguuugugccagauguugcccugauugccaacagauucaauccugacaacuugaugcauguuuuccacgacgaccuccugccccuguucuacacucuaaggcaguuccccggccucgcacaugaagcccggcucuucuucauggagggcuggggggaaggugcccacuucgaccuguauaaauugcuaaguccuaagcagccucugcugcgcgcccagcugaaaacucugggacgccuccuauguuucagccaugcuuuugucgggcugucuaaaauuaccacgugguaccaauauggcuucguucagccucagggcccuaaagcaaacauucucgucucaggcaaugaaauucggcaguucgcaagguuuaugacagaaaagcuaaaugugucgcacacgggcgugccacucggcgaagaauacauccuaguuuuuucacgcacccaaaauagauuaauccugaaugaggccgaguugcuucuggcucuagcccaagaguuucaaaugaaaaccgugacagucucucuggaggaccacaccuucgcugauguggugcgccuggucuccaaugcaagcaugcuagucuccaugcacggggcgcagcucguaacgacucuuuuccuccccaggggagccacugugguggaacuguucccguacgccgucaauccugaccauuacaccccuuacaagacucucgcaaugcugccuggcauggaucugcaguacgucgccuggcggaauaugaugccugagaacacaguuacccacccugagaggccgugggaucaggguggaaucacacacuuagacagagcugaacaggcacgcaucuuacaaucuagggagguccccaggcaucuuuguugccgcaacccugagugguuauuuaggauuuaccaggacaccaaaguugacauuccuaguuugauucagaccauacgccggguggugaaagggaggccuggcccuaggaagcaaaaguggaccgucgggcuuuaccccggaaaaguuagggaggcgcgcugucaggcaagcgugcacggcgccuccgaagccagacucacagugucguggcaaaucccauggaaucugaaauacuugaaagugcgcgaaguuaaguacgagguguggcugcaggagcagggcgagaacaccuaugugcccuacauucuggcacugcaaaaccacacuuuuacagaaaacaucaagcccuuuacgaccuaucuaguuuggguccgaugcaucuucaauaagauucuccucgguccauucgccgauguccuugucuguaauacuuag

SEQ ID NO: 13007 - RNA, 513 nt, Artificial Sequence
  Description of Artificial Sequence: Synthetic coding sequence
auggaguuugucgacguaaccgaaucuaaugcccguugggugcaagacuuccggcugaaagcauaugcaucaccagcgaaacuggaaagcauugacggggccagauaccacgcccuguuaauaccuucauguccuggugcucucaccgaucuggcaagcucugggucucucgcccgaauucugcagcacuuccacagcgagucuaaaccuaucugcgccguaggucacggaguugccgcauuguguugcgccaccaacgaagaucgcucaugggucuuugauucauauagccugaccggcccgucugugugugaacucguccgggccccuggauuugcacgccucccccugguaguugaagauuucgugaaggacaguggagccuguuuuucggccagcgagcccgaugcaguacacgugguguuagacagacacuuagugacggggcagaacgcuagcucaacagugccagcgguucagaaccuucuguuccuaugcggaucaaggaaauag

SEQ ID NO: 13008 - RNA, 1041 nt, Artificial Sequence
  Description of Artificial Sequence: Synthetic coding sequence
augcgccugcuuuuccuugcgguuuuaagaccacauaccggaaacgcggugacagcccagagagugcgugcucaucuggaggccgccggacaugugugcguguugaaagaugccuuugauuuugagagucggagugaaauugccaaccucauuuuagcugaaaauugcgaggccgcacuggcuuuacaccucuaccgaggcggccggcuucugcagggucacagaauccccuuuggcguaaucuucggcggaacugacgugaacgaagaugcuaaucaggcagagaaaaauaccgugauggggagaguacuggaggaagcccguuuugcuguggcuuucaccgagucuaugaaagaaauggcccaggcgcaguggccccacgcaaagggcaagguguacguccagagccaaggaaucgcgaccaccccuaaugccgcuuuuaauuggaauacuuuucugcagcgcagcgaaauuaaccagagugcagacaaucugcacauuuuucugcuuaucuguggcuugaggcagguuaaggauccacuguacuuagucgacgcauuuagugccuggcaccaggaggagcccaaugugcacuuagugaucgugggacccgaaguagacccggucuucaccagagaaguuaaagcuaaggugaaaagagcugcaggcgugcgccugauuggagagaugccccaggaggaucugcaugcugucguaaagaacugcuuugcuguagugaacagcuccguguccgaagggaugagcgcagccauucuggaggccauggauuuggaagugccugugcucgcacgaaacauuccaggaaacgccgcaguagugaagcaugaggucacugguuugcuguuuucuaacccucaggaguucguccaccuggcaaagcgccuugucucugacccugcucucgagaaggaaauugugguaaauggaagggaguacgugcggauguaccacucauggcagguugaacgugauacuuaucaacaacugauacgaaaauuagaagggaguacugaagacuag

SEQ ID NO: 13009 - RNA, 1482 nt, Artificial Sequence
  Description of Artificial Sequence: Synthetic coding sequence
uccgaggcuguguaccuuaaugacuccacuuacgauggacacaccguuggcggucuucaguacgggggucuggggcagcuugcugacggcgugguuggcuuggacgacuuccggaagagucaggagcuccgaguguggccaggcuaugauuaugugggcuggagcaaccauuccuucaguagcggauacgucgagauggaauuugaguuugaucgccuucgcgccuuccaggccaugcaggugcauuguaacaacaugcacacccucggagcccgccugcccggcgggguggaauguagguucagaagagguccggcaauggcuugggaaggugagccgaugcgacauaacuugggagggaacuugggggauccacgcgcccgagcugugucuguaccacugggcggccgcguggcaagauuuuuacagugccguuuccuguuugccggaccuuggcucuuauucucagaaaucuccuucaucucagauguggucaacaauucaucaccagcccuuggggguaccuuucccccggcgccuugguggccaccaggccccccaccuaccaauuucucuucucucgagcuagaacccagaggacagcaaccuguagccaaggccgaaggcucccccacagcaauccucauuggcugucuagucgccauaauccugcugcuccugcugaucaucgcccuaaugcuguggagacugcauuggagaagauuacucucgaagguccuggaaucgcauccucgcacuagaagucccggucugguugggauucguccaacccccuuacccgugucaccuauggccuugaggugcuguucccccauccagcccaccgcuaguuuuuggccacuuaccccagugccucuggaagcacgcgcaccuccucacccuccuggacccaaucccccuaccccacgggguguuacaggaggaaauacauaugccguuccggcucugcccccaggggccguuggugauggcccaccacggguagacuuuccuagaucccgccugagauucaaggagaagcugggcgaaggacaguucggagaagugcaccucugcgaaguggacuccccucaggaccucgugucuuuggauuucccccuuaauguccgcaaaggacacccucuguugguggcugugaaaauucugagacccgaugcaacgaagaacgcucggaaugauuuucuaaaagaagugaagaucaugagcaggcugaaggacccaaauauuaucaggcuccucgguguuuguguccaggacgauccucuuuguaugauaacagacuauauggaaaauggagacuuaaaucaguuucucucggcacaccagcuggaagacaaagccgccgagggagcaccuggggacggccaggcggcccaaggccccacuaucagcuacccuaugcuccugcacguagccgcucaaauagcuuccggcaugagauaccuggccaccuugaacuag

SEQ ID NO: 13010 - RNA, 354 nt, Artificial Sequence
  Description of Artificial Sequence: Synthetic coding sequence
auguuaauuuucuggaccauuacacuguuucugcucggggcugccaagggaaaagaagucugcuacgaagaucugggcugcuuuucugauaccgaaccaugggggggcacagccauucgaccucugaaaauccugcccuggucuccugagaaaauuggaacaagauuccugcucuacacuaacgaaaauccaaauaauuuccagauucuccuguuaagcgauccuagcaccaucgaggcgaguaacuuccaaauggaucguaagacccgguucaucauacacggauuuauugauaagggggacgaaucaugggugacugauauguguaaaccgggcgcauccccccgggccuag

SEQ ID NO: 13011 - RNA, 1581 nt, Artificial Sequence
  Description of Artificial Sequence: Synthetic coding sequence
augcaaggaccacuacuuuuaccuggacugugcuuccuacuuagccucuuuggagcugucacacagaaaacaaaaacaucuugcgcuaaguguccuccaaacgccucaugugugaauaauacccauugcaccugcaaccauggauacacuagcggcucuggccagaagcuguucacguucccccuggaaaccugcaaugccaucgagacccaggccauuaccgacaacuguuccgaggaacggaaaacguucaauuuaaacguacagaugaacagcauggauauucgcuguuccgauaucauucaaggggacacacaggggccuucggcaauugccuucauuuccuauagcucucucggaaacaucaucaaugcuacuuucuucgaggagauggauaaaaaggaccagguguauuugaauagucaggucgucuccgccgccauaggaccaaagaggaauguaucuuugagcaagucugugacccuaacguuucaacauguuaagaugacacccaguaccaaaaaagucuucuguguuuacuggaaauccacuggccaggggagccaguggagucgggacggcuguuuucucauucaugucaauaagagccacacgaugugcaauuguucucauuugucuagcuucgcaguuuuaauggcucugacuagccaagaagaggaucccguucugacagugauaacauaugugggauuaucagucagccucuugugccugcuacucgcagcucucacuuuccucuugugcaaggcuaucaggaacaccagcacuagccugcaucugcagcugagucuuugccuguuccuggcgcaccuccuguuccugguuggcauugauaggacggagccaaaggugcucuguaguaucaucgcuggggccuuacacuaccuguaucucgcagccuucaccuggaugcugcuggaaggcguccaccuuuuccucacugcccgaaaucugaccguaguuaauuauaguuccaucaacagacuuaugaaguggaucauguuccccgugggcuacggcgucccagcugucacaguugcaaucagugccgcuagcuggccucauuuguacggcacggccgauagguguuggcuccaccuugaucaaggcuucaugugguccuuucugggaccagucugcgcuauuuucucugccaaccucguucuguuuauccuaguauucuggauauuaaaacguaaacuguccagcuuaaauucugaggucucaacaauucagaauacccggaugcucgcguucaaagccacugcacaauuguuuauccugggcugcacuuggugucucggacuauugcaggugggcccugcagcacaagugauggccuaccuguucaccauaaucaauucccuccagggguucuucauauuucuuguauacugcuugcugucccaacagguccagaaacaguaucaaaaaugguuucgcgaaaucgucaaguccaaaucugaaucugaaacuuacacacucuccaguaaaaugggccccgacaguaaaccaucugagggcgauguuuucccaggucagguaaaacgaaaguauuag

SEQ ID NO: 13012 - RNA, 5832 nt, Artificial Sequence
  Description of Artificial Sequence: Synthetic coding sequence
ugaccuagucuggcuggacggggggcagggaggauggccccuggcgcucuccgcggagguugugaacagcgagcuccagggggcggagcuaggacggccgcgcugggaccuuggcccuggccaucacccgggccggcacccucucccggcgcugcccccccacggucccgaaagaugaguggcgcguuacuguggccauuacuuccauugcugcuucuguugcugucggcccgugaugguguccgcgccgcccaaccccaggcccccgguuaccugauagcugccccuucaguauucagagcagggguagaggaggucauuagcgugaccaucuucaacucucccagggaggucacaguacaggcucagcugguugcccaaggagaaccugucguucagucccaaggugcaauucuggauaagggaaccaucaaacuuaaagucccaacaggucucaggggccaggcucuccugaagguguggggucggggauggcaggccgaagaggggccuuuguuccacaaucagaccucagugacuguugacgggcgcggcgccucuguguuuauucagacggacaaacccguguauagaccucagcaccgcguucucaucucaauuuuuaccgugucaccgaauuugagacccgugaaugaaaaguuggaggcuuacauacuugacccacggggaucucgcaugauugaguggaggcaccuuaagccuuuuugcugcggcauuaccaauaugucauucccccucagcgaucagccugugcugggagagugguuuauauuuguugagaugcaggggcacgcuuacaacaaaucauucgagguacagaaguauguucugccaaaguucgaacugcugaucgacccgccucgcuacauccaggaccucgaugcaugugagacugggacugugcgagcaagguacacguuugggaaaccaguggccggcgcccuuaugaucaacaugaccguaaauggugucggguauuauucucacgaaguggguaggccaguacugagaacuaccaaaauauuagggagccgggacuucgacauuugcgugcgcgacaugauucccgcagacgugcccgagcauuuccgcggucggguuucaaucugggcaauggugacguccgucgauggaucccagcaggucgcuuuugaugauagcacacccguacagagacaacugguagauauucgguauuccaaggauacgagaaagcaguuuaagccaggccucgcguaugucgggaaaguugagcugucuuauccugacggcucgccagcggaggggguuaccgugcagauaaaagcugagcuuacaccuaaagacaauauuuacaccucagaagucgugagccagaggggccuggugggguucgaaaucccaucuaucccaacguccgcucaacacguguggcuggagacaaagguuauggcucucaacggcaaaccagugggcgcucaguaucugcccagcuaccucagccuugguaguugguauagucccucucaguguuaccugcaguugcagccuccaucacauccuuugcaggugggagaggaagccuacuuuuccgugaaaaguacuugcccauguaauuucacccuguauuacgaaguggcugcuagagggaauauugugcuguccgggcagcaaccggcgcacacuacucagcaaaggagcaagagagccgcgcccgccuuggaaaagcccauuagacugacucaccugagcgaaacagagccucccccagccccagaagcugaagucgacguuugcgugacaucucuccaccuggcggucacccccaguauggugccacucggccgccuacucguguuuuaugugcgggaaaauggcgaaggugucgcugacagucuccaguuugcagucgagaccuuuuuugaaaaccagguguccgugacguauucagcgaaugagacucaaccaggagaagucgucgaccugcgaauuagagcugcaagagggucuuguguuugcguggcggccguggauaagagcgucuaccugcuuaggagcgguuucagacugaccccagcccagguguuccaggaauuggaagacuaugacgugucugacucuuuuggugugaguagggaggauggcccuuuuuggugggccgguuuaaccgcacagaggcguaggcgaagcaguguguuuccuuggccguggggaauaacuaaagacucuggguucgcuuucacggagaccggccugguggugaugacugaucgggucucgcucaaccaucggcaggauggcggauuauacaccgacgaggcagugcccgccuuucagccgcacaccgggagucugguugcagucgcaccuucucggcacccucccaggacagagaagcgcaaaagaacauuuuucccugagacuuggauuuggcauugucugaacaucagugacccuagcggcgagggaacgcucaguguuaaagugcccgauuccaucacuucauggguaggcgaggccgucgcacucucaaccagccagggguugggcaucgccgaacccagcuuguuaaaaaccuuuaaacccuuuuucgucgauuuuaugcugccugcccuuauuauucgcggcgaacaggugaaaauacccuuauccgucuauaacuauaugggcacuugcgcugaaguuuacaugaaguugagcguacccaaaggaauacaguucgugggucauccuggaaagagacacgugacuaagaagaugugcguugcacccggggaagccgagcccauuugggucguccugucguucagcgauuugggguugaauaauaucacugccaaggcuuuggcuuacggcgauacgaacuguugccgagacgggagaucuagcaagcacccagaagagaaccaugccgacagaagagugccuaucggugucgaccaugugcggcgcaguguuauggucgaggcggaaggcgucccaagagcauacacauacuccgcguucuucuguccgucagagaggguacauaucuccacccccaacaaguaugaauuccaauacgugcagcgaccccucaggcuuacccgcuucgacgucgcuguuagggcgcacaaugacgcucguguugcucugagcagcggcccccaggacaccgcgggcaugauagaaaucguucuuggcgggcaccaaaauacccggucuuggaucucaacaucuaagaugggagagcccguagccagcgcacauacggccaagauccugucgugggacgaguuccguaccuuuuggauuucuuggcggggcggucucauccaggugggccauggacccgaaccuuccaacgagucagugaucguggccuggaccuuacccaggcccccugagguucaauucauagguuucagcacuggauggggguccaugggagaguuucggauauggaggaagauggaaguggacgaauccuauucggaggcuuucacgcucgguguuccccacggcgcaauuccagggucugagagggccacugcauccauuauuggagaugugaugggcccuacccuaaaucaccucaacaaucugcuacgucugccuuuuggcugcggggagcagaauaugauacacuucgcgcccaacguguucguccugaaguaccugcagaagacccagcagcugaguccugagguggagcgggagacaacagauuaccuugugcagggguaucagagacaacugacguacaaacgccaggacggcucguacucagcauuuggcgaacgggaugcaagcgggagcaugugguuaacggcuuucguauuaaaguccuuugcccaggcuagaagcuuuaucuucguagacccacgggagcuggccgcugccaaaagcuggauuauccagcagcagcaagcugacggaucauuccucgccgucggacgcgugcugaacaaagacauacaggguggaauucacgguacugugccgcuaaccgcguacguuguugucgcccuguuggagacuggcacagcuuccgaagaagaacguggauccaccgacaaggcgaggcacuuuuuagagagugcagcuccgcuggcgauggaccccuauuccugcgcauuaacuacauacgcucucacccuccuacguucucccgcugcucccgaagcacuuagaaaacugagaucacuugcaauuaugagggacggagugacgcauuggagccugagcaauuccugggacguagacaaagguacguuccugaguuucucugaccgcgucucucagucuguggucucagccgaaguggaaaugaccgccuaugcacuacugacuuacacucugcucggcgauguugcggccgccuugcccgucguuaaauggcugagucagcagaggaacgcucucggaggcuucuccuccacacaggacaccugcguugcccugcaggcuuuggcugaauacgcuauucucucuuaugcuggcggcaucaaucugaccgucucucuggcgucaacuaaccuggacuaccaggagacuuucgaacuccacagaaccaaucagaagguauuacagacugccgccauuccuucacucccaaccggcuuauucguuagugccaaaggcgaugggugcugccugaugcaaauugaugucaccuacaaugugccggauccuguggcuaagccagcuuuccaguugcuggugucacuccaggaaccugaggcccaaggccggccuccccccaugccugccagugcugcugaggguucccgaggagacuggccaccggccgacgacgacgaccccgcggccgaucaacaccaccaagaguauaagguuaugcuggaggugugcacccgcuggcuccacgcaggcucauccaauauggcagugcuggaggugccucuguugaguggcuucagagccgacaucgagucccuugaacagcuccugcuggacaaacauauggggaugaaacgcuacgagguggccgguagaagagugcucuuuuauuuugacgagaucccuagucgcugucuuacuugcguucgauuuagagcauuacgcgaaugcguagucggccgaacuuccgcccuccccguuuccguuuacgacuauuaugagccagccuucgaggcuaccagauuuuauaacgucuccacucacuccccucuggcacgcgagcugugugcaggcccagccuguaaugagguggaacgcgcaccugcacguggcccagggugguuuccuggagagucaggccccgccguggccccagaagaaggagcagcuauugcacggugcggcugcgaccaugauugcggagcccaggggaacccugugugugggagcgacggagucguguacgcgucugccugccgccugcgugaagcagccugccgccaggcugcaccguuggagccugcgccuccuuccugcugugccuuagaacaaagacugccugcaagcucuaguucaacguacggugaugaucuggccucagucgcacccgguccgcuucagcaagaugugaaacugaauggggccggccucgaggucgaagauucggacccagaaccugaaggcgaagcggaggacagaguuaccgccggcccgcggcccccuguaucuucuggcaaucuugaaucauccacgcagagcgcaucaccuuuucaucgguggggacaaacgcccgcuccacaacgacauucaggcagaguggugggagcucaucgacccggacugcucaguccuguuuucguauacagucccgcuuuccagagugggggagaagaaggacuguggaugaguaauaccuguacgcuacgguag

SEQ ID NO: 13013 - RNA, 456 nt, Artificial Sequence
  Description of Artificial Sequence: Synthetic coding sequence
auggaggccaccggaaccgaugaaguagacaaguuaaaaacuaaauuuaucuccgcauggaauaacaugaaauacuccuggguacucaagaccaagacauauuucagcagaaauucaccaguccugcuguugggcaagugcuaucauuucaaguacgaggacgaggacaaaacccuuccagcagaaucaggauguaccauugaggaucacgugauugcaggcaacguugaggaauuccggaaagauuucaucucccgaauuuggcugacuuauagagaagaauucccccaaaucgaaggguccgcacucaccacugacugcggauggggaugcacguugcgaacuggccaaaugcuucucgcgcagggccuaauccugcauuucuuaggcagagcauggacuuggccagaugcucugaacaucgagaauucagacuccgaguccuggaccagcuag

SEQ ID NO: 13014 - RNA, 2616 nt, Artificial Sequence
  Description of Artificial Sequence: Synthetic coding sequence
augcgcaaaccaaggaggaagagcaggcaaaaugcagagggccggcguucccccucuccauauucccucaaaugcucuccaacuagggaaacucucaccuacgcucaggcgcagaggaucguagaggucgauaucgacgggagauugcaccggaucagcaucuaugauccacugaagaucaucacagaagacgaacugacagcacaagauaucaccgaguguaauucaaauaaggagaauagcgagcaaccacaauuuccaggaaagagcaagaagccaucuagcaagggcaagaaaaaagagucgugcucgaagcacgccagcgguacaucuuuucaccucccacagccuagcuucaggaugguggauucuggcauacagcccgaggcuccuccguugccugccgcauauuaucgguacauugagaaacccccugaagaucuagacgcggaaguugaauaugacauggacgaagaggaucuggcuuggcuggauauggugaacgaaaaaaggcggguggauggacacagccuggucagcgccgacacuuucgaacugcuuguugaccgccuugaaaaggaaagcuauuuagagucucgaucauccggagcccagcagucccuaauugacgaggacgccuuuuguuguguaugucuggaugacgaaugucauaacucuaaugugauucuauucugcgauauuuguaaucucgcuguucaucaggaaugcuacggagugccauauaucccagaagggcaguggcucugucguugcugucuccaaagcccuucccgcccuguggacuguauacuguguccaaauaaaggaggagccuuuaagcagacgagugacgggcauugggcacaugucgugugcgcaauuuggauccccgaaguuuguuucgcaaauacuguguuucuggaaccuaucgaggggaucgacaauauuccuccagcaagauggaaacugacguguuauauuugcaaacagaaaggccuuggggccgccauccagugccacaagguaaacugcuacacagcuuuccauguaacuugcgcccagcgugccggccuguucaugaagaucgaacccaugagagagacaucucugaacgggacuaucuuuacugucagaaaaacagcuuacugcgaagcucacucuccaccgggcgccgcuacugcccgccgcaagggugauucuccaagaaguauuucugagacaggugaugaggagggccugaaagaaggugacggggaggaggaggaggaggaggaggucgaagaggaggaacaggaggcucaaggaggggugaguggcucccucaaaggcgugcccaaaaaauccaagaugucccugaaacaaaaaauuaaaaaagagccugaggaggcgggccaagacacuccuucaaccuuaccgaugcucgccguuccgcagauuccuuccuacagguugaauaagauuuguucaggacucucuuuucagcgcaagaaucaguucaugcaacgguuacauaauuacuggcuacucaagcgacaagcccggaaugguguuccuuuaauuagaagacuucacagucaucugcagagucagagaaaugccgagcaacgagagcaggacgagaagaccagugcaguuaaagaagaguugaaguauuggcagaagcuucggcacgauuuagaacgcgcgagauuacugaucgagcugauuagaaagagggagaagcuuaagagagaacaggugaaagugcaacaggcggcaauggagcuugagcugaugccuuuuaacguucugcugcgaacuacacuagaccuacugcaagaaaaagauccagcccacauuuucgccgaacccgugaaucugagugaggugccugauuaucuggaauucaucaguaaacccauggauuucagcaccaugcggcggaagcuugaaucccaucuguaucgcacccuggaagaguucgaggaagauuuuaaccugauugugaccaacugcaugaaauauaaugccaaagacacgaucuuucaucgcgcugcgguuagacuucgugaccugggcggggcaaucuugaggcaugcuaggcgacaggcggaaaacauugguuacgaucccgaacgugggacccaccucccagaaucgccgaaacucgaggauuucuaccguuuuaguugggaagauggaagaucccugcuccuaccuuuugaggaucguggcgaccuggagccauuggagcucgugugggcuaaguguaggggcuacccguccuaccccgcuuuaaucaucgauccgaagaugccuagagagggccuucuucauaauggagugccuaucccagugcccccccucgauguucuaaaguuaggagagcagaagcaggcugaagcgggggaaaagcucuucuugguacuguuuuucgauaauaagagaacauggcaguggcucccacgcgauaaggugcucccacugggcgucgaggauacuguggauaaguugaagaugcuugagggacggaaaaccagcaucagaaagucugugcagguugcuuacgaucgagcaaugauacauuugagcagggugagaggaccccacagcuucgugacuagcucuuaccuguag

SEQ ID NO: 13015 - RNA, 2700 nt, Artificial Sequence
  Description of Artificial Sequence: Synthetic coding sequence
augcugcuccuucuucugcucgcaccguuguuucugagaccaccgggcgccggaggcgcacagacuccaaacgcgacuagugaagguugccagaucauucacccaccgugggagggggguauuagguaccggggucuaacccgugaccaaguaaaagccaucaauuuccugcccguugauuaugagaucgaguacgugugccgaggggagagagaaguggugggaccuaaggugagaaaauguuuggccaauggcagcuggacagauauggacacucccagucguugcgugaacagaaccccccacagcgagagacgcgcuguuuauauuggugcucuguucccaaugucaggaggauggcccggcggccaggccugccagcccgcugucgaaauggcucuggaagacguuaacucucgucgcgauauccuuccugacuacgaguugaaacugauccaucacgacucuaaaugcgauccuggucaggccacaaaguaccuguaugaauuacuuuauaacgaccccauuaaaauuauccuuaugccgggauguuccaguguaagcacccuuguggccgaggccgcuagaauguggaaucucauagugcuguccuauggcucuucuucaccggcccucagcaaccgccagcgguuuccaacauuuuucagaacucacccuuccgcaacauuacauaaccccacucgcgugaaacucuuugagaaauggggguggaagaagaucgccaccauccagcaaaccaccgagguguucaccuccacccuugacgauuuggaagagcgaguaaaggaggccgggauagagauuaccuuucgacaaucguuuuucagugaccccgcuguucccgugaaaaaucuaaagcgccaggacgcccggaucauuguaggucuguuuuaugagacagaggcucgaaaaguauucugugaaguguauaaggaacgguuguucgggaagaaauaugugugguuucuuauuggcugguacgcugacaauugguucaaaauuuaugauccuuccauuaauugcaccgucgacgaaaugacugaagcuguggaaggccacauaacaacagagauugugaugcugaauccagccaacacaagaucuauuaguaacaugaccucucaggaauuuguggaaaaacugacuaaacgauugaagagacacccugaggagaccggaggcuuccaggaggcuccguuggcuuacgacgcuauaugggcauuagcucucgcacucaacaaaacuucugguggaggcgggagaucuggcguccggcucgaagauuucaacuacaauaaccaaacaaucacggaccagauuuaucgcgcaaugaacuccagcuccuucgaggggguuagcggucauguugucuuugacgccuccggaucucgcauggccuggacgcugaucgagcaacugcagggcgggaguuauaaaaagauaggcuacuacgauuccacaaaggaugaucugagcuggaguaaaaccgauaaguggaucggcggcucaccucccgcagaucaaaccuuggucauuaagacauuucgcuuccugagucagaagcuguuuauuagcguuuccgucuuaagcucacuaggcauagugcucgccguaguuugccucuccuucaauauuuauaacucacacguucguuacauucagaacucucagcccaaccucaauaaccucacagcuguagguugcagcuuggcccuugccgcaguguucccacuggguuuggacggguaccacauuggaagaaaccaauuuccguuugugugucaagcccgcuuauggcuccuuggucuuggauucucucuggguuaugguuccauguuuaccaagaucugguggguacacaccguuuucacgaagaaagaagaaaaaaaggaauggcggaagacucuggagccauggaagcuguaugccaccguggggcugcucgugggcauggacguuuuaacacuagcuaucuggcagaucguggauccauugcaucggacuauugaaaccuucgcaaaggaagaacccaaggaggacauagaugugagcauccugccacagcuggaacacuguuccagcagaaagaugaacacauggcuuggcaucuuuuacggcuauaaaggucuccuuuugcuucuuggcauuuuucuggccuaugaaaccaagucagucucaacagagaagaucaacgaucauagggccguggggauggccauauacaaugucgcugugcucugccugaucacugccccugugacgaugauccugucuucacaacaggaugcagcuuuugcuuuugccucacuagcuaucgucuucagcaguuacaucacguuaguuguacuguuugucccuaagaugcgcaggcugauaacccggggagaguggcagucugaggcccaggauacgaugaaaacaggaagcucaaccaauaauaaugaagaagagaagucgcggcuuuuagagaaagaaaacagagaguuagagaagaucauagcugagaaagaagagcggguuagcgaacugaggcaccaacuccagucgcggcagcagcugagaagcaggcggcauccgccuacuccuccugagccuagcggcggacugccccguggacccccggaaccuccagacaggcugucaugcgauggaaguaggguccaccuacuguauaaguag

SEQ ID NO: 13016 - RNA, 537 nt, Artificial Sequence
  Description of Artificial Sequence: Synthetic coding sequence
auggaaacauucccguugcuacuuuugucguugggauuaguucuagcugaggcaucagagagcacaaugaaaauuauaaaggaggaauuuacugaugaggagaugcaauacgacauggccaagagcggccaagagaagcaaacgauugagauuuugaugaacccgauucuguuagugaaaaauacaagccucagcaugagcaaggacgauaugagcucaacacuacugaccuuccgcucucugcauuauaaugaucccaaaggcaacucauccgggaaugauaaagaguguugcaacgauaugacgguuuggagaaaagugagcgaagcuaauggaucuuguaaguggucuaacaacuuuauucguucuucgacagaggugaugcgucgcguccauagagcacccucuugcaaauuugugcagaaucccggcauuaguuguugcgagucacuugaguuggaaaacacagugugucaguucacgacgggcaaacaguucccaaggugccaauaccauagcguaacaucccucgaauag

SEQ ID NO: 13017 - RNA, 2184 nt, Artificial Sequence
  Description of Artificial Sequence: Synthetic coding sequence
augauucugucacuucuuuucagccucggaggaccccuuggcuggggacugcucggggcaugggcccaggccucaucuaccagccucuccgauuuacagucuucgcggaccccuggggucuggaaagccgaggcggaagacacaggcaaagaccccguaggaagaaacuggugccccuauccaaugucaaaacuggugacucugcucgcguugugcaagaccgagaaguuucugauccacucucaacagccuuguccccagggagccccggauugucagaagguuaaggugauguauagaauggcccauaagccgguguaucaggugaagcagaaggugcugacaagcuuagccuggcgauguugccccgguuacacaggcccgaacugcgaacaccacggaccgauggcuguauggugcuggcccgaaccugauagucuucaggccaggcucggccaguugcagagaaaccugagcgaacugcacaugacgaccgcccgaagggaagaagaguugcaguauacauuagaagacaugcgcgccacucucacccgucauguggacgaaauuaaggagcuguacucagaaucagaugaaacauucgaccaaaucuccaaagucgaaaggcaggucgaagaacuccaggucaaccacacagcccugcgagaacuccgcgugauccugauggaaaagucucucaucauggaggaaaauaaagaagaggucgagcgacagcugcuugaauuaaaccuuacccuucagcauuugcagggcggacaugcggaucuuauaaaauaugugaaagacuguaauugucagaaguuguaccuugaucucgaugugauuagagaaggccaacgcgacgccaccagggcacuggaagagacacagguuagccuagacgaaaggcggcaacuggacgguucuucucugcaagcauuacagaacgccguagacgcuguaucccuggcuguggacgcccauaaggcugaaggugagagagccagggcugcaacaucacgccugcggucgcaagugcaggcguuggacgaugaagugggugcauuaaaagcagcagccgcggaggcgcgacacgaggugcgccaauugcauucagccuucgcagcccuucuagaagacgcacuaaggcacgaagccgugcucgcagcacuuuuuggggaagaaguccucgaggagaugagcgaacagacucccgguccacugccacuuagcuacgagcagauacgugucgcccugcaggacgccgccaguggacugcaggaacaggcccucgggugggacgagcuugccgcuagaguaacggcacuggagcaagccagcgagccaccuagaccggcugaacauuuagaaccuucacaugacgcaggccgcgaggaagcagcuacgaccgcacuggccgguuuggcccgugaacugcagucuuuauccaaugauguaaaaaacgugggccguuguugcgaagcugaggccggcgcaggugcugccucauugaaugccucacugcacggacuacacaaugcucuguucgcgacccaacgaucccuggagcagcaccagaggcuguuucacucucuguucgggaacuuccaggggcugauggaggccaaugugucuuuagaccuggguaaauugcaaacaaugcuaagccgcaaaggaaagaagcagcagaaagacuuagaagccccacggaagcgagauaagaaagaagccgagccccucgucgauauccgugugacagguccuguccccggugcccugggcgccgcucugugggaggcugguucuccuguggcguucuacgcuaguuucagcgaggguaccgcugcacuucagacuguaaaguucaacacuacuuacauuaacauuggcagcagcuauuucccagaacacggguacuuucgcgcgccagaacguggcguguaccuuuucgcggugucugucgaauucgggccuggucccggaaccggacaguuaguguuuggaggacaccaucgaaccccaguauguacuacuggccagggaaguggcucuacugccacaguguucgcaauggccgaacuucagaagggagagagggugugguucgaauuaacucaagggagcaucacuaagagaagccuuagcgguaccgccuucggcgguuuccucauguuuaagacuuag

SEQ ID NO: 13018 - RNA, 828 nt, Artificial Sequence
  Description of Artificial Sequence: Synthetic coding sequence
auggguagcgcucccugggcccccgugcuguuacuugcacugggacuccgaggacuccaggcuggcggagaguggcggaggccacccgcgcauucacccgugccagccccuccacugcgguuugcuuccccccacagcccucaagggccuggcccccggcucccaggugcccuccucccugcugcuucuggcccacugcaguuacgcgcacugcgucagcaggaucugccaagcgcauuaccaggcguaggucaggugcucggaccaggucgaggagcccacuuauugcuacauugggaacgcggacggcgcgucggacugaggcagcaacuagggcugagacgcggagcaggagguagggcuggcgguucuacaggacucagaggcgccccauugcugcgugagguugcagcaguuagaugcgccgugcacgccgcccgggcacacggagcugcagacgggggugcugguccuggccgcuugagaagagcugccccacgcgcuacaaccaggccaagggguccgggcuguccuaggcaccgacucagguggaagcuguggggcgacgcacagugucucccggaagacgaagucuccccuccugguggaggcggagcuggcggacaaagagcuagaagcuccugcggaagaccccguagacugcaacccgucuugccuggccgacauggagguucccugagacacggacccuugggggugagacaucucccugccgcggugaggagggagggcccagacccagcccuccacguacgcccagaaugcuugcaccgcgccggacacgauggguugccauugccccauuag

SEQ ID NO: 13019 - RNA, 351 nt, Artificial Sequence
  Description of Artificial Sequence: Synthetic coding sequence
auggcagcuggauccgccccaaugcagcuacacuugcgcgccacaauaagaaugaaagacgggcuguguguaccccggaaguggauuuaccaccucacagaggguucaaccgaccugaggacugaaggccgaccagacaugaagaccgagcuguuuuccucuucuugucccgggggcaucaugcucaacgagacuggacagggcuaccagcgauuccugcuguauaauaggaguccacauccaccagagaagugcguggaagaauuuaaaucccuuaccucuugccuggacagcaaggccuuuuuauuaaccccacgcaaccaggaagcuugcgaauugucuaacaacuag

SEQ ID NO: 13020 - RNA, 522 nt, Artificial Sequence
  Description of Artificial Sequence: Synthetic coding sequence
augcauuggaagaugcuccuccugcugcuauuguauuauaacgcugaagcaagcaugugucaccgcuggucuagggcgguccuguuuccagcugcccaccgaccaaagcguaguuccucccucccccugaaucccguccuccagacaucucucgaagaggucgaacuccucuacgaguuccuucucgccgagcucgaaauuagcccugaccugcagaucagcaucaaagaugaagaacucgcuucucuuagaaaggcuagcgacuuccgcacaguguguaauaaugucauuccuaagucaauucccgacauucggagauuguccgcaagccuuaguucccacccuggcauccucaaaaaagaagauuuugaacgaacgguguugacacuagcuuacacagccuacagaacggcucuaucacauggucaucaaaaggauauaugggcgcagucucugguaucuuuguuccaagcucuuaggcaugaucucaugcgcucaucacagcccggugucccuccuuag

SEQ ID NO: 13021 - RNA, 1482 nt, Artificial Sequence
  Description of Artificial Sequence: Synthetic coding sequence
uccgaagcuguguaucuaaacgauucuacauacgacggccauacgguuggcggacuucaauaugggggucugggacaacuggccgauggagugguuggacucgaugauuuccggaaaagccaagagcugcggguuuggcccggguacgauuacgucggauggucgaaucauagcuuuagcagcggauauguagagauggaguuugaguucgaccgccugcgggcauuccaggcaaugcaggugcacugcaacaauaugcacacccugggcgccagacugcccgguggcgucgagugcagauuuagacguggaccggcuauggcuugggagggcgaaccaaugagacacaaucuugggggaaaucugggcgacccacgcgcucgggcagugucagucccacuggggggucggguggcacgguuucuccagugucgcuucuuauucgcaggaccaugguuacucuucagugagauaaguuucaucagcgauguagucaacaauuccucaccugcccuggggggaacauuuccaccagcaccuugguggccaccaggaccccccccgacuaauuuuagcucucuagagcuggaaccaagagggcagcaaccaguggcaaaggcagaaggcagcccuacggcgaucuuaauugggugccuggucgccaucauccugcucuugcugcucauaauagcgcuaaugcuuuggagguugcauuggaggcggcuccucucuaagguacuugaaucucacccucguacaagaagucccggccuugugggaauacgaccaacccuucuuccaguaagcccuauggcucuacguuguugcucuccaauucaacccacugcuuccuuuuggccucuuacucccguuccacucgaggcucgugcuccuccacauccaccaggaccuaacccuccaacgccccgaggagugaccggaggaaacacuuaugcugugcccgccuugccuccuggcgccgugggcgauggacccccucgcguggauuucccucggucccgccugcgcuuuaaggaaaagcugggcgaaggacaauuuggagaaguucauuugugcgaaguggacaguccccaggaccuaguuucacucgacuucccuuugaauguccggaagggucauccucucuugguugcggugaaaauccuccggccagaugccaccaagaacgccaggaacgacuuccuuaaagaaguaaagauuaugagcaggcuuaaggacccuaacauaaucaggcugcuugggguuugcgugcaggacgacccguuauguaugaucaccgauuauauggagaauggcgaccugaaucaauuccugagcgcgcaccaguuggaggacaaggcugccgagggagcucccggcgacggacaggcugcccaaggcccuacuaucucuuacccuaugcugcuccauguggccgcgcagaucgccucuggcaugcguuaucucgcaacucugaauuag

SEQ ID NO: 13022 - RNA, 639 nt, Artificial Sequence
  Description of Artificial Sequence: Synthetic coding sequence
augggucuucaccuccggcccuaccgagucggccuccucccagauggacugcuauucuuauugcucuuacugaugcugcuugccgaccccgcucugccagccggccgccacccacccguaguucuaggagauaauaaucgcauuccgguuauuggcccuuugaagaucagggagcagcagaggucugccguaaguacgaguugguugcugccuuacaacuacacauggucuccagagaaaguguucgugcaaaccccaaccauaaauuacacucuacgcgacuaccggaaguucuuucaggacaucggcuucgaagaugguugguugaugaggcaggacaccgagggccuuguggaggcuacuaugcccccuggaguucagcuacacugucuuuacggcaccggcgugccaacuccugacucguucuauuacgaaaguuuccccgaucgugauccaaagaucuguuucggcgacggcgacggaacugucaaucugaaaucagcucuucagugccaggcauggcaaagcaggcaggagcaccaaguccuguugcaagagcuccccgggucugagcacaucgagaugcuugccaacgcuacaacccucgcuuaccucaaaaggguccuccuuggaccguag

SEQ ID NO: 13023 - RNA, 654 nt, Artificial Sequence
  Description of Artificial Sequence: Synthetic coding sequence
augagcgaccuccuucugcucggccucauuggcggacugacacugcugcugcuccugacacugcucgcuuuugcuggauacuccggcuugcuggcgggugucgagguguccgcuggaagcccacccauaagaaacguaacuguggccuacaaauuccacauggggcuauauggugagacaggccggcuguuuaccgaaucuugcucaauuaguccaaaacugcggaguaucgccgucuacuaugauaacccacauauggucccccccgacaaaugucgcugugcuguggguucaauucuuucugaaggagaagaaaguccaagucccgagcucaucgaucuuuaccagaaauucggcuuuaagguauucuccuuccccgcuccaagccacguggugaccgccaccuucccauauacuacaaucuuaaguaucuggcuugcgacccggagaguccacccugcucuugacacuuacaucaaagaacggaaauuaugugccuauccccgacuagaaaucuaccaagaggaucagauccauuucauguguccacuggcccgccagggagacuucuacgugccugaaaugaaagaaacagaauggaaguggcgcgggcugguugaggccauugacacccaaguggacggcaccggcuag

SEQ ID NO: 13024 - RNA, 345 nt, Artificial Sequence
  Description of Artificial Sequence: Synthetic coding sequence
augaagaccuucacauggaccuugggcguacuauucuuucuguugguggacacaggacauuguaggggaggucaauuuaagauaaagaaaauuaaccagcgccgguacccacgcgcaaccgacggcaaagaggaggccaagaagugugccuacaccuuccuuguccccgagcaacgaaucacuggucccaucugcguuaacacgaaaggccaggaugcuucuacuauuaaggacaugaucacacggauggaucuggagaaccugaaagacgugcuuagcagacagaaaagggagaucgacguguuacagcugguuguggauguagacggcaauauagucaacuag

SEQ ID NO: 13025 - RNA, 870 nt, Artificial Sequence
  Description of Artificial Sequence: Synthetic coding sequence
auguuuguucugcuguacguuaccaguuuugccaucugcgccaguggacagccuagaggaaaucagcucaagggagaaaauuacucaccucguuacaucugcuccaucccuggccugcccggcccucccggacccccaggcgcaaacggaucgccagggccacacgggagaauaggacuuccaggccgcgacgguagggacgggagaaagggcgaaaagggagagaagggcacggcagggcuacgcggaaagaccgguccucuaggauuggcaggugaaaagggcgaucaaggugaaacgggaaagaagggucccauaggcccggagggugaaaaaggagaaguuggaccaaucgguccaccaggacccaaaggcgauaggggagaacagggugaucccggccugccggggguuugccggugcggcuccauaguguugaaaagcgcuuuuagcguuggaaucaccacgaguuaccccgaggagagguugccuaucauuuuuaacaagguguuguucaaugagggagagcauuauaauccagccacuggcaaguucauuugcgcuuuucccgguaucuacuauuucagcuaugacauuacccuagcaaacaagcacuuggcgaucggacuggugcauaacgggcaguauaggauuaaaacuuucgacgccaauacagguaaucacgauguggcuucuggcuccacuguaauuuaucuacagccugaggacgaaguuuggcuggaaaucuuuuucaccgaccagaauggauuauucucugacccaggcugggcagauuccuuguuuucuggcuuucugcuguacguugauacagacuaucuggauaguauaagcgaagacgacgagcucuag

SEQ ID NO: 13026 - RNA, 1002 nt, Artificial Sequence
  Description of Artificial Sequence: Synthetic coding sequence
augguaucgaagucacgcuggaaguuauuagcgaugcuggcacucguuuugguggucauggugugguauucaauuuccagggaggaccgguacauugaacucuucuauuuccccauuccugaaaaaaaagagcccugccuccagggcgaagccgagaguaaagccagcaaacucuuuggaaacuauagcagagaccaacccauuuuucuuagauuggaggacuacuucugggucaagaccccaagcgcuuacgaacugccauacgggacgaaaggaagcgaggacuugcuccuccguguucuggcaauuaccuccucuaguauucccaagaacauacagagcuugcggugcaggagauguguugucguuggaaauggccaccguuugcggaauuccagccuuggcgaugccaucaacaaguaugacgugguaauccgacuaaacaacgcccccguugcaggauacgaaggagacguggggaguaagacuacuaugagguuguucuacccugaaagugcacauuucgaccccaaggucgagaacaacccugauacucuccucgucuuaguagcuuucaaagccauggauuuccacuggaucgaaacgaucuugucugauaaaaagagagugagaaaaggcuucuggaagcagcccccccuuauuugggacguuaacccaaagcagauuaggauccugaacccuuucuucauggagauugccgcagauaaauugcucucacugcccaugcagcagccucguaagauuaagcaaaagccuacuacuggccuguuggccauaacccuggccuuacaccugugugaccuaguccacaucgcaggauucggcuacccugacgccuacaacaagaaacagacaauacacuauuaugagcagauaacauuaaagucuauggcggguagcggacacaauguuagucaggaggcccucgcgauuaaacgaaugcuugagaugggcgcgaucaaaaaccucacuucuuuuuag

SEQ ID NO: 13027 - RNA, 531 nt, Artificial Sequence
  Description of Artificial Sequence: Synthetic coding sequence
augcgccugcugauccucacaugucuuguggcuguggcccucgcaaggccgaagcugccuuuaagguacccugaaagguuacagaacccgucugaauccagugaacccaucccccuggagucccgcgaggaauauaugaacggaaugaacaggagaaacauacugagagagaaacaaaccgacgagaucaaagauacacggaaugaguccacacagaacugugucgucgcagagcccgagaaaauggagucuucuaucaguucaucuuccgaggaacaguucugccgacugaaugaauacaaucagcuccagcuccaggcagcacacgcucaagaacagauccggagaaugaaugaaaacucccaugugcaggucccguuucagcagcuuaaccaguuggccgcuuacccuuaugcagucugguacuacccacagaucaugcaauauguuccguuuccucccuucagugauaucuccaacccuacugcccacgagaauuacgaaaaaaauaacgucaugcuccagugguag

SEQ ID NO: 13028 - RNA, 279 nt, Artificial Sequence
  Description of Artificial Sequence: Synthetic coding sequence
augaaacuuugcguaacaguguuaucacuacucguucugguggccgcuuucugcucacuugcccucucagccccaauggguagcgauccuccuacagcuuguugcuucucuuacaccgcuagaaaacucccacgaaauuuuguugucgacuauuaugaaacuaguucauuguguagucagcccgccguggucuuucagacaaaaaggggcaaacaaguaugugcggaccccagugaaucaugggugcaggaguacgucuacgauuuagaacugaacuag

SEQ ID NO: 13029 - RNA, 1656 nt, Artificial Sequence
  Description of Artificial Sequence: Synthetic coding sequence
augacuuggcgcaugggcccucgcuucacaaugcuucucgcuauguggcucguauguggaucggagccucacccccaugcaacaaucagaggcagccaugggggcaggaaggugccucugguuucucccgauucaagcaggccagcccgauuucuccggcacaccggccguagccgugggauugaacguuccaccuuagaggaacccaaccuccaaccucuccagaggcggagaucaguaccugugcugagacuggcaagacccagcagauucagggauaaccggauggacaggagggaacacggacaccgagaucccaacguaguccccgggccucccaaaccagcuaaagaaaagccgccuaaaaagaaggcccaagauaagauucugagcaaugaauacgaggaaaaauacgaccugucaagacccacagccucacagcuggaggacgaguugcaggugggaaacguuccccugaaaaaagccaaagaauccaaaaagcaugagaagcuggaaaagccagaaaaggagaagaagaagaagaugaagaaugaaaaugcagacaaacuccugaagagugaaaaacagaugaaaaagucagaaaaaaagucuaaacaggagaaggagaagucaaaaaagaagaagggcggcaaaacugaacaggauggcuaucaaaaacccacaaauaaacauuuuacacagaguccuaagaagucaguggcagaccuccuggggagcuucgagggaaaaaggcgguuacuucucaucacagcgcccaaagcagaaaauaacauguauguccaacagagggaugaguaccuggaaagcuucugcaaaauggccaccagaaagaucucugucaucacaaucuucggccccguuaauaauuccacaaugaagaucgaucacuuucagcuggauaacgagaaacccaugcguguggucgacgacgaggaucuggucgaccagcggcugauuucggaacuacgcaaagaguaugguaugacauauaacgacuucuuuaugguacuaacugaugucgacuugagggugaaacaguacuaugaggugccuaucaccaugaagaguguguucgaucucaucgacacguuucagaguagaaucaaagacauggagaagcagaaaaaggaagggaucguuuguaaagaggauaagaaacagagccuugagaauuuccuuagcagauucagauggcgccgaagacuacuugugaucucagccccaaacgaugaagacugggccuauagucagcagcugucagcacugucuggccaggcgugcaauuucggguccagcgugguggaaagagaagacguaccugcucauuuggugaaggauaucaggaauuauuuucaggugucuccugaauauuuuaguauguugcucgucggcaaagacggaaacgugaaaagcugguauccaagcccuauguggucuauggugauugucuaugauuuaauagauuccaugcaguugcgcagacaggaaauggcuauucaacagucauuaggcaugcggugccccgaagaugaguaugcaggcuauggauaucacagcuaucaccagggguaucaagacggcuaccaggacgacuaucgccaucacgagagcuaucaucaugguuauccuuacuag

SEQ ID NO: 13030 - RNA, 1245 nt, Artificial Sequence
  Description of Artificial Sequence: Synthetic coding sequence
augggagugucaaaacuggacaucuuguaccggagauuacuucucacgaaauuauuuauccggggguggggaaggccagaagacuugaaacgccucuuugaguucagaaagaugaucggaaaucgggagcggugucagaaccuggugagcucugauuaccccgugcacaucgauaaaaucgaagaacaaucugacugcaaaauucuggauggucacuucgugucccccauggcgcacuauguccccgauaucaugccaaucgagagcgugauugcccgguuccaguucaucguuccgaaagaguggaacucuaaguaucgcccuguuuguauacaccucgccggcacuggugaucaucauuacuggagacggcgcacucucauggcaaggccaaugaucaaagaggcacgcauggccagccugcugcucgaaaauccuuauuauggaugcagaaaaccaaaagaucaggucagaagcucacucaagaaugugagugauuuauucgugauggggggcgcucucguacucgagucagcugcccugcuucauugguuagaaagggaagguuacggaccgcuggguaugacagguauuucaaugggcggacauauggcuucgcuggccgucucuaacuggccuaaaccuaugccucuuaucccgugucugucauggagcaccgcuucaggggucuuuacaacuaccgacagcuucaagaugggccaggaauucgugaaacauuucacaagcucugccgauaaguugaccaaccugaaccucgugucacgaacucucaaucuggauaucucaaaucaggugguuucucagaaaccugcagacugucacaacuccucaaaaacgucaguaagcgcaaccagugagggccuuuuacugcaagauacguccaaaaugaagcguuuuaaccaaacacuguccaccaauaagucuggguacacuucacggaauccacaguccuaccacuugcucuccaaggagcagagccgaaacagccuccgcaaggagagucuaauuuucaugaaggguguuauggaugaauguacccauguggcaaacuucuccgugccaguggauccuucucugaucaucgugguucaggcuaaggaagacgcauacauuccaaggacaggcguccgaagucugcaggagauuuggccgggcugugaaauuagauaucucgaagguggacauauuagugcguaccuuuucaagcagggacuguuccgauag

SEQ ID NO: 13031 - RNA, 912 nt, Artificial Sequence
  Description of Artificial Sequence: Synthetic coding sequence
augagugaaccacagccugaucuggaaccgccucaacacggccucuacaugcuuuuucuuuuagugcugguguucuuuuugaugggauuagugggcuuuaugaucugucaugugcugaagaaaaaggguuacagaugcaggacgucuaggggauccgaaccggaugacgcucaacuucaaccuccugaggacgaugacaugaaugaggauacugucgagaggauagugcgauguauuauucagaacgaagcaaaugcagaggcacuuaaggagaugcucggagacucggaaggggagggcacagugcaauuauccuccguugaugccacaucuucacuccaggauggggccccaagccaccaccauacaguacacuuggggagcgcggcaccuugucugcacuguucaaggagcaagcggccgccacuggugagacaggggagauccaaagagggcaagaguagaccgcggacaggggagacgacuguguuuagcgugggccguuuuaggguuacucacaucgaaaaaagguacggacuucacgaacacagagacggaucucccaccgaucgcuccuggggcucuggcggcggucaggauccaggcgggggacagggcagcggcggcggccagcccaaagccgggaugccugcuauggagagacugccuccagagagaccacagccacagguauuagcgaguccucccgugcagaauggaggauuacgagacucaucccugacuccccgggcucucgaaggcaacccgcgcgcauccgcugagccuacccugcgggcggguggacguggucccucucccggcuuaccaacacaggaagcaaaugggcaaccgagcaagccagacacgagugaccaucaagucucacucccacaaggcgcaggguccauguag

SEQ ID NO: 13032 - RNA, 444 nt, Artificial Sequence
  Description of Artificial Sequence: Synthetic coding sequence
auggggcccgaagccuuaucaagucucuugcuguugcuguuaguggcgucuggggaugccgacaugaaaggccacuucgaucccgccaagugucgguaugcacuggggaugcaggacagaaccauccccgauuccgacaucucagcgucgagcaguuggucagacaguaccgcagcccgccacaguagauuggaauccagcgacggagauggugcuuggugccccgccgguagcgucuuucccaaggaagaggaguaccugcagguagauuugcaaagacuucaccugguggcccuugucggcacacaaggacggcaugcaggaggacugggcaaagaguuuucuaggaguuacagacugcgauauucccgcgaugguagacgcuggaugggguggaaggaccgauggggucaggaagugaucaguggaaaugaggaccccuag

SEQ ID NO: 13033 - RNA, 1173 nt, Artificial Sequence
  Description of Artificial Sequence: Synthetic coding sequence
augggcgcuacaacuauggaccagaaaucgcugugggcagggguagucguguuacugcugcuccaaggaggaucugccuacaaacuggucuguuacuuuaccaauuggagucaagacaggcaagagccuggaaaauuuacaccagaaaauauagaccccuuccucuguucucauuugaucuauucguuugcaucaauugaaaauaauaaagucauaaucaaggacaaaucagaggucaugcucuaccaaacuauuaacucacuaaaaacgaagaaccccaagcugaaaauccugcugucaaucgggggauauuuguucgggucuaagggcuuucacccuaugguggacuccucuaccucccgccuugaauucauuaacuccaucauauuguucuuacgaaaccacaacuuugaugguuuggacgugucuuggauauacccugaccagaaggaaaauacucauuuuacgguucuaauccaugagcuggccgaggcauuccaaaaggacuuuacaaaaucgacaaaggaaagacugcuccugacagcuggcguuuccgccggucgacaaaugaucgacaauucauaccagguugaaaagcuggccaaggaccucgacuucauaaaucugcugucuuucgauuuccaugggucaugggagaagccauuaauuaccggacacaacucgccacucucuaaggguuggcaggaccgcggccccuccuccuacuauaauguugaguacgcugugggauauuggauucauaagggaaugccaucugaaaaaguaguuaugggcaucccuacuuacgggcacagcuucacacuugcauccgcagagacaacuguuggagcaccagcuagcggccccggcgcagccggaccgaucacugaaagcuccggauuucuagcuuacuaugagauuugccaguuccugaaaggcgcuaaaauaacuagacuccaggaucaacaggugcccuacgccgugaaagggaaccagugggugggauacgacgacguuaagaguauggagacuaaggugcaguuccuuaagaaucuuaaccugggaggcgcgaugaucuggagcaucgacauggaugauuucaccgggaaaucuugcaaucaggggccauauccauugguccaggccgugaaacgcucuuuaggguccuuauag

SEQ ID NO: 13034 - RNA, 297 nt, Artificial Sequence
  Description of Artificial Sequence: Synthetic coding sequence
augaauaaacauuuucucuuccucuuucuccuguauugccucauuguggcagucacaucucuucaauguauuacuugucaccuacgcacacgaacggaucggugucgucgcggcuuuggagucugcacagcccagaagggcgaggcuuguauguuguuaaggauuuaucaacggaauacucuccaaauaaguuacauggucugucagaaauucugccgggauaugacuuucgaucuccggaaucguacauacguucauacuuguugcaacuacaacuacugcaauuuuaagcuuuag

SEQ ID NO: 13035 - RNA, 600 nt, Artificial Sequence
  Description of Artificial Sequence: Synthetic coding sequence
auggcauggggcggaguucacaccugcugcuuccaccugugcuguugcuguuccuggccccagggcgcuguuccugaagagcuccacaagcacccaggacagacucuguuguugcaaugccaguauucuccuaagagagggccauaucagccuaaauccuggugucagcagacuucaccuagcagaugcacacuguuaguuacuucuucaaaaccauggaccgccgugcaaaaaucacauuacacaaucugggauaaaccuaaugcaggguuuuucaacauaacaaugauucagcuaacucagaacgauagcgguuucuacuggugcggaauuuauaaugccucggaaaauauaaucacgguucugcguaacauuucuuuaguugucucaccagcacccacuacguccccgauguggacccugccuuggcuuccaaccagcacugcuugggaaccccagauacaggaaauuaaauuuagagcuccuacagacuccacacuguggaaaagcagagccccggcaugcuuaggcucuggggggccgagauuuuuggugcuaguucucuguggauuacugcuugcaaagggguuaaugcucuag

SEQ ID NO: 13036 - RNA, 2025 nt, Artificial Sequence
  Description of Artificial Sequence: Synthetic coding sequence
augacaaccgacgacaccgaggugccugccaugacucuagcuccuggccaugccgcccuggagacccaaacacuaucagccgaaaccucuuccagagcgucgacuccugcuggaccgauccccgaagcagagacucggggcgcuaagcgaauuuccccggcccgcgagacccguucguucaccaaaacuagccccaauuuuaugguauugaucgcaacuucagucgagacauccgccgccagugguagucccgaaggggcagguaugaccacaguccagacaauuacugggucagacccaagggaagccauuuuugacacacuguguacagacgauuccuccgaggaggccaagacguugaccauggacauccuuaccuuggcucacaccuccaccgaggccaagggccuuaguagugagucaucagcuagcucugacucuccucaccccgucaucaccccuucccgagcgagugagagcagugcgucuuccgauggaccccacccuguuauuacuccaucuagagccucugaguccucggcaucuucagaugguccccacccaguuauuaccccuuccagagcgucggagucauccgcuagcagugacgguccccaccccgugauuacucccaguagggccagcgaaagcagugcauccagcgacgggccacaucccgugaucacgccaagccgugccagugagucaagcgcgaguucagacggcccucacccugugaucacaccaucaagagcaagcgaaucaagugcauccagugaugggccccauccaguaaucacaccaaguagggcuucugaaucuuccgcaaguucagacggaccccauccaguuauuacaccuucucgcgcaagcgaaaguuccgccucuuccgacggcccucacccaguaauaacaccuucccgggcuucugaauccuccgccaguagugacggacugcauccggugaucacgccaucacgagccucugagagcuccgcaucuucagacggaccucacccaguuaucacccccucuagggccagcgaauccucagcguccucugacggcccccacccugugauuacacccagcuggucaccuggcucugacgugacacugcuggccgaggcccucguuaccguuacgaauaucgaaguuauuaauugcucuaucaccgaaauugaaaccacgacgucuucuauuccuggagcauccgauaccgaccugaucccuaccgagggagucaaggcuaguuccacgucugaucccccugcacugcccgacagcaccgaagccaagccgcauauuacggaaguuaccgccagugccgaaacacucuccacugcagggacaacagaauccgccgcaccagaugccacuguggguacaccccucccuacgaacucggccaccgaacgcgaagugaccgcccccggcgccacaacacucucaggugcucuagugaccguuagccguaacccccuggaggagacaagcgcccucucuguggaaacuccuucuuacgugaaagugucaggggccgcucccgugaguaucgaggccgguuccgcuguuggcaaaacaaccuccuucgcggguaguucugcuucuucauauucacccucugaggcagcucuuaaaaauuucacaccguccgagacgccgacuauggacauagccaccaaggguccauucccuaccagccgggacccccuuccuucuguuccgcccacgaccacaaacuccucucgugguaccaacucaacccuggccaagauuacaacuagcgcuaagacaacgaugaagccaccaacagccacaccaacaacugccaggacgcgccccacuacugacgugagcgcgggggagaauggcgguuuucuauugcugcggcuaucaguggcaagcccagaggaccuaaccgauccuagaguagcugagcgacugaugcaacagcuacacagagagcuucacgcccaugccccucacuuucaggucucacuuuugagaguucguagaggcuag

SEQ ID NO: 13037 - RNA, 738 nt, Artificial Sequence
  Description of Artificial Sequence: Synthetic coding sequence
augcaggcugccuggcuucugggggcucucguagugccucaacuccuggguuuuggccacggcgcacguggggcugagcgagagugggaagggggcuggggaggagcucaggaagaagagcgcgagagagaagcuuugaugcugaaacaucugcaagaagcucugggccuccccgcgggacgcggcgaugagaaccccgcaggcacgguugaaggcaaagaggacugggagauggaagaagaucagggagaagaggaggaggaggaggccaccccaacacccagcucuggccccagcccaagcccaacuccggaggauaucguuacauacauucuuggccgccuugcuggccuugaugcgggguugcaccaguugcacgucagacuucacgcacuggacaccagagucguugaauugacucaggggcuucgucagcugaggaaugcagcaggagacacaagagacgcaguucaagcacuucaggaggcacagggacgggccgaaagggaacacggacgucuugagggcuguuuaaaaggucuccgccugggacauaagugcuuucugcugucucgagauuucgaggcacagcccucugccagcccucacccucuuuccccugaucaaccgaacggggguacccuggaaaauuguguugcucaagcuagcgacgacgggucuuggugggaucaugacugccaaagacgauuguauuaugugugcgaauuucccuuuuag

SEQ ID NO: 13038 - RNA, 279 nt, Artificial Sequence
  Description of Artificial Sequence: Synthetic coding sequence
augaucuggaggucacgcgcaggggcugaacuuuucucucugauggccuugugggaauggauugcccugagcuuacacuguugggugcuggccguugccgccgugagugaucaacaugcuaccucccccuucgauuggcucuugucagacaaagguccguuucauagaucccaggaguauaccgauuucguugaucggucacgucaggguuuuucuaccagauauaagauuuaucgcaacaugggacacaucaguugcuacuugcugcuuugggaauag

SEQ ID NO: 13039 - RNA, 177 nt, Artificial Sequence
  Description of Artificial Sequence: Synthetic coding sequence
auggcagacaugcagaaccucguugaaagacuagaacgcgcagucggccguuuggaggccgugucucacacaucugacaugcauagaggauaugcugacaguccaagcaaagcaggcgccgcaccuuacguucaggcauucgauucacugcuggccgguccuguggccgaguacuag

SEQ ID NO: 13040 - RNA, 732 nt, Artificial Sequence
  Description of Artificial Sequence: Synthetic coding sequence
augggaccugaagcccugucuagccugcugcucuuauugcucgucgcuagcggcgacgcugauaugaaggggcacuuugaccccgccaaaugcagauaugcucucggaaugcaagacaggacuauccccgacucugauauuagcgccuccucaagcuggagcgacaguaccgcggccagacacucaagacuggaguccuccgauggagauggagcaugguguccagcagguaguguguuuccuaaggaagaagaauaucuucaaguggauuugcagcgacuccaucugguggccuugguggggacucaaggucggcacgcaggcggacucggcaaggaauucagucguucauaccguuuaagguauuccagagaugggcgaagguggaugggcuggaaagacagauggggccaggagguuauuucuggcaaugaggacccugagggagugguucugaaggacuugggaccacccaugguggcaagacuggugagauuuuauccacgggccgaucgcgucaugucagugugucuucgcguagaguuguacgggugucucuggcgagacugcaguauggguguuugggcaaguuggcagaugguuugguggggcuggaugacccugggcagggugcggaguugcggauccggccaggcuaugacuaugugggacggugccacuacugcauccccugucgcaauguggagguggucccucagccucacuggauag

SEQ ID NO: 13041 - RNA, 2535 nt, Artificial Sequence
  Description of Artificial Sequence: Synthetic coding sequence
augggcccuggugcaccguuugcucggguuggauggccacucccucugcugguuguuauggcagcuggaguggcaccagugugggccagccacucuccccaucuaccuaggccacauucacgggucccuccucacccaagcagcgaaagacgcgcaguuuacauaggagcccucuuuccaaugucuggcggcuggcccgguggucaggccugucagccugcaguugagauggcucucgaagacgugaacagcaggagagauauacugccugacuacgagcugaaacucauucaucaugacaguaagugcgauccugggcaggcgaccaaguaccuguacgaacuucuguacaaugauccuaucaaaauaauacuuaugccugggugcuccuccgucaguacccucgucgcugaggcagcacgaauguggaauuugauugugcugucauauggaucaucgagcccugcacuuaguaauagacagagauuccccacuuucuucaggacccacccuucugcaacucugcauaaccccaccagaguuaaacuguucgaaaaaugggguuggaagaagauugccacaauccaacaaacaacggaagucuuuacaagcacauuggaugauuuggaggagcggguuaaggaggcagggaucgagaucacauuccgccagaguuucuuuucagauccugcagucccuguaaagaacuugaaaagacaagacgccagaauaauugucggacuguucuaugagaccgaggcgcguaaggucuuuugugaggucuacaaggagagauuauucgguaagaaauauguuugguuucuuauuggcugguacgccgauaauugguuuaaaaucuacgauccaagcauuaacugcacuguugacgaaaugacggaggcugucgaggggcauaucaccacagagaucguuaugcucaauccagcgaacacaaggaguauuuccaacaugacaagucaagaauucguugaaaaguugacaaaacgccucaaacggcauccugaggaaacgggcggguuucaggaggccccucuggccuaugacgcgauaugggcucuagcauuagcacugaauaagacgagcggagguggugggcgcuccggcgugcgucuggaggacuucaacuauaacaaccaaacuauuacugaccagauuuacagagccaugaauuccaguucauuugagggaguguccggacaugucgucuuugacgcuuccggaucacgaauggcuuggacccugauugagcaacuccagggggggagcuacaagaagaucgguuacuacgauagcaccaaggacgaucugucaugguccaaaacagauaaauggaucgggggaucaccaccggcugaccagacacucgugauaaaaacuuuccgguuucucucucaaaagcuguucaucuccgucuccgucuuaucaagccucgggauuguccucgccgugguuugcuuauccuuuaacaucuacaauucccacgugcgcuacauucaaaacucucagccgaaccugaauaaccugaccgcaguugggugcuccuuagcucucgccgcgguguucccacugggccuagacggcuaccacauugggcgcaaucaguucccguucguaugccaagcccgccuguggcuccugggacucggguucucacucggcuacggcucuauguuuacuaaaaucugguggguccauacggucuuuacuaagaaggaagagaagaaagaauggcgcaaaacucuugaacccuggaaacuuuacgcaacugucggucuccuagucggcauggacgucuugaccuuagccauuuggcaaaucguugauccucuccaucgcacaauugaaacauucgccaaagaggaaccuaaggaagauauugacgucuccauucucccacagcuggagcauugcucaagccguaagaugaauacauggcuuggcauuuuuuauggauauaaaggccuguuacugcuacuggggauuuuccucgcuuacgaaacaaaguccgucucaaccgagaaaaucaacgaccauagagcggucggcauggcuaucuacaauguagcagugcucugccugaucacggccccggugacuaugauccugagcagccaacaggaugcggccuuugccuuugccucccucgccaucguuuuuagcuccuauaucacgcucguuguccucuucgugcccaaaaugaggcgccucauaacacgcggcgaguggcaaagugaggcccaggacacaaugaaaacgggaucaucaaccaauaacaaugaagaggagaaaagccgccugcuugagaaggaaaacagggaauuagagaaaauuauugccgagaaggaggagcguguuagcgagcugagacaccaauugcagagccgucagcaguugcggagcagaagacaucccccaaccccacccgagccauccgggggacugccccggggacccccagagccuccagaucgucuuuccugcgauggaaguagagugcaucuguuauacaaauag

SEQ ID NO: 13042 - RNA, 921 nt, Artificial Sequence
  Description of Artificial Sequence: Synthetic coding sequence
cgucggacuugcgcaggaccaggucgggcuggcggcgccaggagugcuucguggauguccagauugcgcgcauugcuaggauugggucuccuuguugccggaucccgggugccucgcaucaaaucacagacuauugcuugcaggucugggccuacuugguggggcccucaaagguuaaacucagguggacguugggauagugaggucauggcuagcaccguggugaaauaccugucucaggaagaagcucaagcugucgaccaagagcuguuuaaugaguaucaguucaguguggaccagcuuauggaacuugcugggcuguccugugcuaccgccaucgcgaaggcauacccaccuaccucuaugucuagauccccuccgaccguccuggugaucuguggccccgguaacaauggcggugacggccuuguaugugcacgccacuugaaacucuuuggguacgagccaaccaucuacuauccuaagcgcccaaacaaaccuuuguucacagcucucguuacacagugucaaaagauggauauuccuuuccugggugagaugcccgccgaaccuaugacuauugacgagcucuacgagcucguugucgacgccaucuuuggcuuuagcuuuaaaggggauguacgagaaccguuucacuccauccuguccguucuuaaagggcuuaccguaccuauagccaguaucgacaucccuucuggcugggauguggaaaaggggaaugccggcggaauucagccagaccuccuuauuagcuuaaccgcucccaagaagucugcaacccaauuuacaggaagguaccauuaucucggaggaagauucguucccccagcucuggaaaagaaguaucaauuaaaucugccuccuuacccugauacggaguguguuuaucggcugcaguag

SEQ ID NO: 13043 - RNA, 1137 nt, Artificial Sequence
  Description of Artificial Sequence: Synthetic coding sequence
ugauacucuggagauuacauggaaccugaaaagccuggagcacccuugcuccccccuccgccccaaaacucuguaccacauuacgccgaggcggacaucgucacucugcagggcguaacagguggcaauaccuacgccgugccagcccuuccacccggcgcugugggggacggaccucccaggguugauuucccacgcucacgucugcgauucaaggagaagcuaggcgaggggcaguuuggagaaguacaucugugugaagucgacaguccccaagacuugguaucccuugacuuuccccugaauguccgaaaaggccauccucuucucgucgccguaaaaauccugagacccgacgcuaccaagaaugcuagcuuuagccuguucucucgcaaugauuucuugaaagaaguaaaaaucaugagcaggcuaaaggacccuaauauuauccgucugcuggggguaugcguccaggacgacccccucuguaugauuaccgacuacauggagaacggggaccuuaaccaauuucucuccgcucaccagcuugaagauaaagcugccgaaggggcaccaggcgauggccaggcugcccaaggcccgacaauuucuuacccgaugcuccuucacguagcugcgcagaucgccucugggaugagguaccuugcaacuuugaacuuugugcaucgcgaucuggccacacggaacuguuuagugggcgagaacuuuacuauaaagaucgccgauuucgguaugucgcgcaaccucuacgcuggagauuauuauagggugcagggccgagccgugcuccccaucagguggauggcuugggaaugcauccucaugggcaaauuuaccacugcaagcgauguuugggcauucggcguuacucuuugggaaguccugauguuaugucgcgcacagcccuuuggccagcucaccgaugagcaggugaucgaaaaugcgggagaauucuuuagggaccagggaagacaaguguaucugucgagaccucccgcuuguccccagggccucuaugagcucauguugagaugcuggagucgcgaauccgagcagcggccuccuuucagucagcuucaccgauuucuagcggaggacgccuugaacaccguguag

SEQ ID NO: 13044 - RNA, 762 nt, Artificial Sequence
  Description of Artificial Sequence: Synthetic coding sequence
auggccccuuggucccacccgagcgcacagcugcagcccgugggcggugacgcaguaucgccugcgcuuauggugcugcuuugccugggcaaucugaguaaggccacccuaugggcugaaccagggagugucaucucaagagguaauagugugaccauacggugccaagggacccucgaggcucaggaauaccgguugguuaaagagggauccccagaaccgugggacacacagaacccccuggaaccuaagaauaaggcacgcuucucaauuccuucaaugacugaacaucacgccggcagguaccgauguuacuauuacucucccgcuggauggucagagccuagcgaccccuuggaacucgucguuacaggcuuuuacaauaaaccaacacuuucagcccucccaucacccguggucacuagcggagagaauguaacuuugcagugugggagcaggcuuagauuugaucgauucauucuuacagaggagggggaucacaaacuaucuuggacucuggauucacaacucacaccuagugggcaguuucaggcacuguuuccuguagggccaguuacaccaucucaccgauggaugcuuagaugcuacgguagccgcagacauauccuacaggucuggagcgagccuucagauuugcucgaaaucccggugucaggcgaagaggccacggucuucagcucaaccauccagggcagccagaccggcugcggagaacuguaucgucaaggcucaccaugcuag

SEQ ID NO: 13045 - RNA, 288 nt, Artificial Sequence
  Description of Artificial Sequence: Synthetic coding sequence
augaggaagccucggcgcaagagucggcagaaugccgaggggcgcagaagucccucucccuauucccuuaaguguucccccacccgugaaaccuugacuuacgcccaagcccagcgcaucguagaaguagacauagacggccguuuacaucgaaucucaauuuacgacccccucaagaucauuacggaagaugaguugacagcccaggacaucaccgaaugcaauaguaacaaagagaauucugaacaaccacaguuuccuggcaagucaaaaaaacccagcuccuag

SEQ ID NO: 13046 - RNA, 1311 nt, Artificial Sequence
  Description of Artificial Sequence: Synthetic coding sequence
augaaguuucagggaccccuggcauguuuacuguuagcccucuguuugggcucuggcgaggcgggcccccuacagucuggcgaagaauccacuggaacaaacaucggggaggcccuuggacacggauuaggcgacgccuugucagagggagucggaaaggcgauugggaaggaggcgggcggcgcugcuggaucaaaagucagcgaggcccugggacagggaaccagagaagcggucgggaccggaguuagacaggugccuggauucgguguugccgaugcccuugggaacagggucggcgaggcugcccacgcccugggcaacacaggccaugaaaucggaaggcaagcagaagacguaauacgccacggugccgacgcagugagaggaucauggcagggagugccuggucauaacggugccugggagacuuccggugggcaugguauuuuuggaagucagggaggccucggaggccagggacagggaaacccagggggucucgguacccccugggugcacggcuaccccgggaauucugccgggaguuuugguaugaacccucaaggcgcuccuugggggcaaggcggaaacgggggaccuccaaauuucgggacaaauacucaaggagccguugcacagccaggcuacggaucuguaagagcuucuaaucagaacgaagggugcacuaauccaccaccaagcgggucuggcggugggucaucuaauagcggggguggcuccgggagucagagcggcaguagugggucugggucgaacggggacaauaacaacgguagcuccuccggaggcuccucgagcggcagcucaagcggaggcaguagcggcggguccagcggcgggucgagcggaaauagcggcggaaguagaggagauagcggaucagagaguagcugggggagcagcacaggcaguagcuccgggaaccacggcgggaguggcgggggaaauggccacaagccuggaugcgagaagccagggaacgaggccaggggauccggagagucuggcauccaaggcuuccgcggccaaggggugucaucgaauaugagggagaucucaaaggaagggaacagacugcuaggcggauccggggacaacuauagggggcagggaagcucuuggggaucuggagggggcgaugccgugggcggcguuaauacugugaauuccgaaacaucaccuggcauguuuaacuuugacacguuuuggaaaaacuucaaaucuaagcugggcuucaucaauugggaugcgauuaauaaggaucagcggagcucaagaauaccuuag

SEQ ID NO: 13047 - RNA, 240 nt, Artificial Sequence
  Description of Artificial Sequence: Synthetic coding sequence
augccagcaugucgacuggguccacuagcugccgcacugcuccuaucucugcugcuuuuuggguucacacucgugucggggaccggggcggaaaaaacaggagucugcccagaacuacaggcugaccagaauugcacacaggaaugcguuagcgauagcgaaugugcagauaaucuuaaauguuguucagcugggugugcuacauuuugcucucugcccaauggucaacuggcugaguag

SEQ ID NO: 13048 - RNA, 2130 nt, Artificial Sequence
  Description of Artificial Sequence: Synthetic coding sequence
auggggugccugugggggcuggcucugccauuauucuuuuucugcugggaggucggcguauccggcucuagcgcaggaccuuccaccagacgagccgauacagcuaugacuacagacgacacagaagucccugcaaugacacucgcacccggccaugccgcucuagagacgcagacacuuucugccgagacaucuucucgugcuagcaccccagccgguccgaucccugaagcugagacaagaggagcaaaaagaauuucgccugcacgugaaaccaggagcuuuacgaaaacuucccccaauuucauggugcuuauagcuacguccguggagacgucugccgcaucaggcuccccugagggagcuggcaugaccacuguucagacuauaacgggcagcgacccacgcgaagccauuuucgacacucuguguaccgacgauucuagugaggaggccaagacccugacuauggacauucucacccuagcacacacaucaacagaagcaaagggccuaaguucugaguccuccgccaguagugacagcccucauccaguuauuacuccauccagggcaagcgagagcuccgcaucuagcgacgggccacacccggucauaacccccagucgagcuuccgaauccagugcuucauccgauggaccacacccagugauuacaccgucccgggccucugaauccagcgcuucuagcgacggcccccaucccgucaucacgccaagucgcgcuagugagagcucagcaucgucugacgggccgcaucccgugauuacccccucccgggcuuccgaaagcagugcaagcuccgauggaccucacccggucaucacaccaagucgugccucugagaguagugccucuucagacggaccucacccagucaucacaccgagcagagcuuccgagagcucagcuagcuccgaugggccccacccugucauaacaccaucacgggcauccgaguccagugccagcucugacgggccucaucccgugauaacaccaucuagggccucugagucaucggccucuuccgauggccugcaucccguuauaaccccuucaagagcguccgagucuucugcuagcucugacggcccacaccccguuaucacccccucuagggccagcgaaagcucagcaagcucugacgggccccauccuguaauuacacccucuuggucccccggcucugaugugacucuguuggccgaggcgcuggucaccgucaccaauauugaggugauuaacugcagcauuacagaaauugaaacuacuaccuccagcauucccggcgcuucagauacugaccugauuccuacugaagggguaaaagcgagcuccacgucugaccccccugcauuaccggacuccacggaggcaaaaccacauauaacugagguaacagccucggccgaaacucuuagcacagcgggaacgacagaguccgcggcaccugacgcuacugugggcacaccucuuccaacaaauuccgccacagaacgagaggugaccgcgccuggcgcaaccacucugucuggggcccuggugacuguuagccggaauccuuuagaggagaccagcgcucucuccgucgagacccccuccuaugucaagguaagcggcgcugcgcccgucagcauagaggcaggcagugcuguggggaaaacgacuaguuucgccggaucgagcgccucaucauacucaccuagcgaagcugcccucaagaauuucacaccauccgagaccccgacuauggacaucgccaccaagggccccuuccccacaagcagggaccccuuaccuagcgucccccccacuacgacgaacagcuccaggggaaccaacucaacccuugcaaagaucacgacuagcgccaagacaacuaugaagcccccuacugcuacuccaacgaccgcacgcacaagacccacaaccgauguuagcgcgggagagaacggaggguuucuuuuacuucgacuaaguguggccuccccugaggaccugacagacccaaggguggcagagaggcucaugcaacaguuacacagggaacugcaugcucaugcuccccauuuccaaguuagucuucuuaggguucgacgaggauag

SEQ ID NO: 13049 - RNA, 2067 nt, Artificial Sequence
  Description of Artificial Sequence: Synthetic coding sequence
augcugccuacugaaguuccacaaagccauccaggccccagugcuuuacugcuccuacagcugcuccuuccuccaaccagcgccuuuuucccuaacauuuggucccuacuugccgcccccgggucaaucacacaccaggaccugacugaggaggccgcccugaacgucacccugcaacuuuuucuggagcaacccccaccaggccggccgccucugcgguuggaggauuuccugggacguacccuccuggcugaugaucuguuugccgcguacuucgggccaggaucaucccgccgguuccgggccgcccuuggcgagguguccagagcuaaugcagcgcaggacuuucugcccaccucucgcaaugauccugaccuccacuucgaugcugagcggcuggggcaggggagagcucgacucguuggcgcacugcgugagacugucguggccgcucgugcccuagaucacacuuuggcaaggcaaaggcugggcgccgcccugcacgcacuccaagacuucuauucgcacucuaauuggguagaguuaggcgaacagcagccucacccccaccuccucuggccccgccaagagcuccagaaccuggcacagguggcugacccuaccugcucugacugugaggaguugucauguccccgaaauuggcucggauucaccuugcuuaccaguggcuacuucggcacccauccaccaaagccacccggcaaaugcucucacggcggccacuuugaucgaucuuccagucaacccccuaggggcgguaucaacaaagauucuacuucaccgggguucucuccacaccacaugcugcaccuccaggccgccaaauuagcacuauuagcuaguauccaggcuuucucucugcucagaucuagauugggcgaccgugacuuuagccggcugcucgauaucaccccugcaagcucacugaguuuugucuuggauacgacuggaucgaugggagaagaaauaaacgcagcuaagauccaagcccgacaccugguugagcagcgccgcggcucaccgauggagcccgugcauuacgugcuuguaccuuuccaugauccugguuuuggcccagucuuuacaaccucagacccagauucauucuggcagcagcucaaugagauucaugcccuuggcggcggagacgaaccugaaaugugucuuucugcccuacagcuggcgcuccugcacaccccacccuugagugacauuuucguguuuacugaugcgucccccaaagaugcuuuccugacuaaccagguagaaagucucacacaggagagacggugucgaguaacguuccugguuacagaggauacauccagggugcagggccgagcucggagggaaaucuugucaccuuugcguuuugaaccuuacaaagcuguggcguuagccagcgggggagaaguaaucuuuaccaaggaucagcacauacgggacguggcagcgaucguaggagaaagcauggcagcucuugugacauuaccgcuugaucccccaguagucgugccgggccagccauugguguuuucuguggauggccugcugcaaaaaaucacuguuagaauccauggcgacaucagcuccuucuggaucaagaaccccgccggagugagucaagggcaagaagagggaggagggcccuuaggccacacccggagguuugggcaauuuuggaugguaacgauggaugacccaccacagaccggaacaugggagauccaggucacagcagaggacacucccggugugcggguucaggcacaaaccucucuggacuuccuguuccauuucgguauuccuauggaagauggcccacacccaggguuauacccccuuacucagcccguggccggcuuacagacucagcuacuggucgagagucagucaugggggucuucagccgcuuuucugccacggcaccccucccgcgguccccgaggaugcagaacaagaccaggcgcccugggcgcacgcgggacaagcggcgcccggucuccucgaagccuggccguagcgcaugccgccguucacccuuag

SEQ ID NO: 13050 - RNA, 1257 nt, Artificial Sequence
  Description of Artificial Sequence: Synthetic coding sequence
aauaaccuuaaugucgggucugacacuaccagugaaacaagcuuuucucuaagcaaagaggccccucgugaacaccuggaccaccaagccgcucaccaacccuuuccgcgcccaagauuuaggcaggagaccggacauccaucacuccaacgagacuuuccccgcuccuuuuugcucgaucuuccaaauuuuccagaccucuccaaagcugacaucaacggccagaaccccaauauucagguuacaaucgagguggucgaugggccagacagcgaggcugauaaagaucagcacccagagaauaagccaucauggucagugcccaguccggauuggcgggccugguggcagcgaagucugucacucgccagggcgaauagcggggaccaagauuauaaauacgacaguacuucggaugacagcaauuuccuuaacccaccacgugguugggaucauacggcccccggacauagaaccuuugagaccaaggaucagcccgaauacgacucaacagacggggagggcgauuggucacucuggucagugugcucuguuacuugugguaaugggaaucagaaacgcacuaggaguugugguuacgccugcaccgccacagaaucccggaccugcgaccgaccuaacugcccagguaucgaggauaccuuucguacagcugccacagaagucucuuuacuugcgggcucugaagaauuuaaugcuacuaaacucuucgaaguggacacugauagcugugaacgcuggaugucuugcaagagcgaguuccucaaaaaguacaugcauaaagugaugaacgaccugccuaguugucccuguucuuacccaaccgagguggcuuacaguaccgccgacauauucgacaggaucaagcguaaagauuuuagauggaaagacgccagcggcccaaaggaaaaacuggagaucuauaagccuacugcccguuauugcaucagaucaaugcugucacuugaaaguacaaccuuggccgcccaacacugcuguuauggggauaauaugcagcugaucacuagagggaaaggggccggaacaccaaaucugauaagcaccgaguuuucagcagaguugcacuauaagguagauguguuaccuuggauaaucugcaagggggauugguccagguauaacgaagcacgccccccaaacaauggccagaaaugcaccgagagucccagugaugaagacuauaucaagcaguuucaggaggcaagagaguauuag

SEQ ID NO: 13051 - RNA, 693 nt, Artificial Sequence
  Description of Artificial Sequence: Synthetic coding sequence
augagauuagcaggaccucugaggauugucguucucguagugucggugggugucacauggaucguggugucaauccuccucggcggaccaggaagcggcuuuccccgaauccagcagcucuucaccaguccagaaaguucuguuaccgcggcucccagagcccggaaauacaagugcggccugccccagccaugcccugaagaacaucucgcuuuuagaguggucucuggggcggcuaaugucaucgguccuaagauuugccuggaagacaaaauguugaugagcaguguuaaagauaacguugggcgaggccugaacauugcuuugguuaauggagugagcggggagcucauagaggcccgggcuuuugacaugugggccggagacguaaaugaccuucugaaauuuauccgcccacuacacgaagguacucuuguauucguggcuagcuacgacgaccccgcaaccaagaugaacgaagaaacucgcaagcucuuuucugaacucgguucaagaaaugccaaggaacuugccuuccgcgauucaugggucuuugugggggccaaagguguacagaauaagagcccguuugagcagcauguuaagaacucuaagcauucuaauaaguacgagggauggccugaagcacucgaaauggagggguguaucccgcgacguucuacggcuucuuag

SEQ ID NO: 13052 - RNA, 192 nt, Artificial Sequence
  Description of Artificial Sequence: Synthetic coding sequence
auggggccggaagcgcucaguagucuacuccuacugcuuuugguagcgagcggcgacgcagauaugaaagggcacuuugauccagccaaaugccgcuacgcgcuagggaugcaagacagaacaauuccagacagugacaucucagccuccuccucaugguccgacuccaccgcugcucggcauucaagauag

SEQ ID NO: 13053 - RNA, 1014 nt, Artificial Sequence
  Description of Artificial Sequence: Synthetic coding sequence
auguugucacuuggugcccacagcgugaccaaaacccagauccuccagggccuuggcuucaaccugacucauacucccgaguccgcaauacaucagggguuucagcauuuagugcauucacugacggugccuagcaaggauuugacucugaagaugggcuccgccuuauucguaaaaaaagaacugcaauuacaggcgaauuucuuaggaaaugucaagagguuguaugaagccgagguuuuuucaacagauuuuagcaauccuaguaucgcucaggcaagaauuaauagccacguuaaaaaaaagacgcagggcaaagugguggacaucauucaaggccuugaccucuugaccgcaauggugcucgugaaucauaucuuuuuuaaggcuaaaugggaaaagccauuucacccugaguacacgagaaaaaacuuuccauuucuagucggcgagcagguuacagugcacgugccaaugaugcaccagaaggaacaguuugcauucggagucgauacggaguugaacuguuuuguacugcaaauggauuauaaaggcgaugcuguugcuuucuucguucugccaaguaaagggaagaugcgccagcuggaacaggcacuuucggcucgaacacuucggaaguggucacacagcuuacagaagcgcuggauugagguuuuuauaccgagauuuaguaucagugccuccuacaaucuggaaacuauccuaccaaagaugggcauucaaaauguguuugacaagaacgccgacuucuccggcaucgcaaagcgggauagucugcaagucagcaaagccacucauaaagcagugcuugaugugagugaggaggggacugaggccacugcugccacaacaacaaaguuuaucgugcgauccaaggacggcccuuccuacuuuacagugucuuucaacaggaccuuccucaugaugaucacuaacaaagcuacugaugggauucuguuucugggcaagguugagaaccccacaaagagcuag

SEQ ID NO: 13054 - RNA, 336 nt, Artificial Sequence
  Description of Artificial Sequence: Synthetic coding sequence
auguuuuuuacaauuucucgcaagaacaugucacagaagcugucccuucuacuccuaguguucgggcugauauggggacuaaugcugcuucacuacacuuuucagcagccucgacaccagucauccgucaagcugcgggaacagauucuggaucuaucuaagcgauacguuaaagcccuggccgaagaaaacaaaaauacuguggacguggaaaacggggcuaguauggcgggguaugccgacuuaaagagaaccaucgcugugcucuuagacgauauucugcaaagacuagugaaguuagagaauaaaguggauuauauugucgugaauggcuag

SEQ ID NO: 13055 - RNA, 498 nt, Artificial Sequence
  Description of Artificial Sequence: Synthetic coding sequence
auggaaauguuucaaggccuguuacugcugcuguuacuaucgaugggugguacuugggcaucaaaagagccccugcgcccuagaugccguccaauuaacgcuacucuggccgucgaaaaagagggcuguccuguauguaucaccgugaauaccacaaucugcgccggauacugucccaccaugacgcgaguccugcagggcguuuuaccugcuuuaccacaaguggugugcaacuaucgagauguacgguuugaaagcauaagacuccccggaugcccaagaggcguuaauccuguuguaagcuaugccguugcacucucuugccaaugcgcauugugucgcagguccacuacagauugugguggcccaaaagaucacccguugaccugcgaugaccccagauuucaggacagcucgucaagcaaagccccuccaccuucccugcccucacccucgagacugccugguccauccgacaccccaauccugccucaauag

SEQ ID NO: 13056 - RNA, 699 nt, Artificial Sequence
  Description of Artificial Sequence: Synthetic coding sequence
auggugcuccuucugguaauucugauaccugugcuugugucaucugccggcacuagugcacacuaugaaaugcuugguaccugcagaauggugugcgacccuuacgguggaaccaaggcaccuucgacggcagcuaccccagaucggggccuaaugcagagccucccgaccuuuauacaaggcccacccaugggccccccaggcgagaaaggagaacccggacgucaaggacuccccggaccucccggagcgccuggucugaacgcggccggcgccauuagcgccgcaacuuacagcacaguucccaaaaucgcguuuuacgccggauugaagagacagcacgaaggcuacgaaguccugaaguuugaugauguuguaaccaaucuggggaaucauuaugaucccaccaccggcaaauuuacuuguucuauuccuggcaucuauuuuuucacauaccacgugcugaugcgggguggugauggcacuagcaugugggccgaucuuuguaaaaacaaccaggugagggcuucugccaucgcgcaagaugcagaccaaaauuaugauuaugcuagcaacagugugguguuacauuuggaaccuggcgaugagguguacauuaaacucgacggagggaaagcucauggcggcaacaacaauaaguacaguacuuucucugguuucaucaucuaugcagauuag

SEQ ID NO: 13057 - RNA, 501 nt, Artificial Sequence
  Description of Artificial Sequence: Synthetic coding sequence
augggcccagaggcacucagcucccuacuguuacuguugcuuguggccuccggagacgcugauaugaaaggccauuuugaucccgccaagugucgcuaugcacugggcaugcaagauagaacaauccccgacagugauauuucagcguccagcagcuggagugauucuaccgcagcgagacauucuagacuggaguccagugauggugacggugccuggugucccgcuggauccguauuucccaaagaagaagaguaccugcagguggauuugcaaagacugcaucucguggcccugguagggacucaagggagacacgcuggcgggcucggcaaagaauucucacguucuuacagguugcgauacagccgugauggccgaagauggaugggguggaaggaccgauggggucaggaagugauaucaggcaaugaggaucccgaaggugugguccugaaagauuugggcccucccauggucgcacgucuggugagguuuuag

SEQ ID NO: 13058 - RNA, 627 nt, Artificial Sequence
  Description of Artificial Sequence: Synthetic coding sequence
augaucauuaaacacuucuucggcacugucuuaguucuccuggcaucaacaacaauauucucccuugaucugaaacucauuauuuuccaacaacggcagguuaaccaagaaagccugaaacuuuugaauaagcuccaaacacuguccauacaacaguguuugccucauagaaaaaacuuccucuugccgcagaagucucuguccccucagcaguaccaaaagggacauacuuuggcaauacugcaugagauguugcagcagauuuuuuccuuguuccgggccaauauuucauuggaugggugggaggagaaucauacagaaaaguuccugauacaacuccaucagcaacuggaauacuuggaagcccugaugggccuggaagccgagaagcugagugguacgcuuggaucagacaaccuucgccugcaagugaaaauguauuucagacggauacaugacuaucucgagaaucaggauuacuccacaugcgcaugggcuauuguacaaguagagauuucuagaugucuauucuucguguucagcuugacugaaaaacuuucuaaacaaggcagaccguuaaacgauaugaagcaggagcuaacuaccgaauuccgcaguccaagguag

SEQ ID NO: 13059 - RNA, 2241 nt, Artificial Sequence
  Description of Artificial Sequence: Synthetic coding sequence
augccuuuucggcacaagccugggucugucuuuagcguggagggcgagaacuuagaucuggcuaugucaaaagaagaaguaguggcuaugauaggagaugggccauguguggugaagacauugacuaggcaccaucuguacugcgaacccccuguggagcagccacuccccagacaccacgcccugcgcgaggcuccugacucuuugccggaauucacaguacagaugggaaaucugagauucucucucggccaugugcaguacgauggagaguccccuggugcauuuccgguugcggcacaggugggguugggaguuggaacaucccuccuggccuuaggcguuaucauuaucgugcuuauguauaggcguaaaaguaagcaggcccugagagauuauaaaaaaguccagauacagcucgaaaacuuggaauccuccguucgcgaucgcuguaaaaaggaauucacugacuuaaugaccgagaugacugaucucacgagugaccuauuggguuccgguauaccauuucuggacuauaaaguguacgcggagcguaucuucuuuccaggccauagggagucaccccuucacagagaccugggcguucccgaaaguaggagaccgaccgucgaacagggucuugggcaguuaagcaaucuccugaauaguaaacucuucuuaacuaaguuuauucauacgcucgaaucccaacggaccuuuucagcacgagaucgcgcauacguagcaagccuucucacugucgcacugcacgggaagcuggaguauuucaccgauauccuccggacacuccuuuccgaccugguugcccaauaugucgcaaagaauccaaaguugaugcugcgccgcaccgaaacagucguugagaagcugcuaacgaacuggaugucgaucuguuuguacacguuuguucgcgauucugugggggagccgcucuacauguuguuucgcggaaucaagcaccaaguugacaaagggccaguggauuccguaacagggaaggccaaauauacccugaaugacaauagauuauugagagaagauguggaauaucgcccgcucacauugaaugcauuguuggccguggguccuggcgcuggcgaggcucagggcguuccugucaaaguccucgacugcgauacuaucagccaggcaaaggaaaaaaugcucgaucagcuuuacaaaggugugccccuaacacaaaggccugacccccgcacccuggacguggaauggagguccggcgucgcaggccaccuuauccucucugacgaagauguuacuagugaagugcagggacuuuggcgcagacugaacaccuugcagcacuauaaagugccggauggggcuaccguugcccucgugccgugccugacuaaacacgugcuaagagaaaaucaggauuacgugcccggcgagcgaacucccaugcuggaggacguggacgagggaggaauccguccuuggcaccuugucaagccaagugacgaaccagaaccaccacgcccuagacgaggcucacuccgagggggugaacgcgagcgcgcuaaggcgauuccugagaucuaccugacccgucugcugucaaugaaagguacgcuucaaaaauucgucgaugaucuuuuccagguaauucucucuacaucucgaccugugccccuugccgugaaguauuuuuuugaucuuuuagacgaacaggcucagcagcacgggauaucggaccaggauaccauucacauauggaagacuaacucgcugccccuaagguucuggauuaauauuaucaaaaauccacaguucguguucgacgugcagaccucugauaauauggacgccguuuuacucguuaucgcacaaacuuuuauggacgcauguacccuggcagaucacaaacucggacgagacucacccaucaauaagcuccuauaugcuagggacauuccucgcuacaagagaaugguggagagauacuaugcagauauucgccaaacaguuccugccagugaucaggaaaugaauucaguguuggccgaacucagcuggaacuauuccggggaucuuggcgcgcgaguggcccuucaugagcuuuauaaauacauaaacaaguacuacgaccaaauuaucacugcacuggaggaggacgguaccgcccaaaaaaugcagcucggcuacagacugcagcagaucgcagcggcuguggagaauaaagugacagaccuuuag

SEQ ID NO: 13060 - RNA, 603 nt, Artificial Sequence
  Description of Artificial Sequence: Synthetic coding sequence
auggccuggggaggagugcacacaugcuguuuucaccugugcugcugcugcuccuggccucagggggccguaccugaagagcuccauaagcacccuggccagaccuuauugcugcagugucaauacuccccuaagcguggaccuuaccaaccaaaguccuggugucaacaaacaaguccuaguaggugcacccuccuggucaccucuagcaagccauggacugccgugcaaaagagucacuauacuaucugggacaaacccaacgcaggauucuuuaauauuacaaugauacaacuaacccaaaaugacuccgguuuuuacuggugcgggauuuauaaugcuucggagaauaucaucacgguuuugcgaaacauuagccuagucgugucgcccgcuccaacuacaucucccauguggacgcugcccuggcuuccuaccuccaccgugcugauuacuucaccugagggcacuaguggccauccuucuaucaaugguuccgaaaccagaaaaucuagggccccugccuguuuggguucuggcgguccuagguucuuaguuuuagugcucuguggccugcugcuggcgaagggacugaugcuuuag

SEQ ID NO: 13061 - RNA, 114 nt, Artificial Sequence
  Description of Artificial Sequence: Synthetic coding sequence
augggcuggcuuacgcggaucgugugucuauucuggggcgugcucuugaccgcucgggcaaauuaccagaacgggaagaauaauguaccaagacugaaauuaucauacaaauag

SEQ ID NO: 13062 - RNA, 525 nt, Artificial Sequence
  Description of Artificial Sequence: Synthetic coding sequence
augagacuccucgcguuucugucucuccuugcccuggugcuccaggaaaccgggacugcgagccuuccgagaaaagaacgaaagagaagagaagaacagaugccaagagagggagacucguuugaagugcugccuuuacggaaugacguccugaacccugacaauuauggugaaguaauugaccuuuccaauuaugaggagcucacagacuauggcgaccaauugcccgaggugaagguaaccucccuggcaccggccaccagcaucucgccugcuaaaucgaccacagcuccuggaacuccaaguagcaacccaaccaugacaaggcccaccacagcgggauuguuacuauccagccagccuaaucacgaagauauccccccucugccaagacggaccgcauaccucuaugcaagguuuaaucguauuucucgaauccgcgcagaggauuuuaagggacugacaaagcucaaacguauagauuuaucuaacaacuugauuucgucuauugauaacgacgccuag

SEQ ID NO: 13063 - RNA, 657 nt, Artificial Sequence
  Description of Artificial Sequence: Synthetic coding sequence
auggguagggucuuccucacgggagaaaaggcuaauagcauccugaaaagauacccccgcgcgaauggauuuuuugaggagaucagacagggaaauauagagagggaguguaaagaggaguuuugcacguucgaagaggcccgugaagccuucgaaaacaaugaaaaaacaaaggaauucuggagcacguauacaaaggcucagcagggagaaagcaacagggggucagauugguuccaguuuuauuugacauucccauugauuuucggauuauucaucauacuguuaguaauuuuccuuauauggcgguguuuucugcgaaauaaaaccagaaggcagacagucacagaaggucacauacccuuuccgcagcaccuuaacauuauuacaccccccccuccccccgacgagguauucgacuccucgggacuaucaccaggauuucugggauacguugucgguagaagugauucugucuccacuagauuguccaacugcgacccccccccgacuuaugaagaagcuaccggacaggucaaucuacaacgcucagaaaccgaaccccaccucgacccgccaccagaguaugaggacaucgugaacuccaauucugccuccgcuaucccaauggugccaguggugaccacuauaaaauag

SEQ ID NO: 13064 - RNA, 2535 nt, Artificial Sequence
  Description of Artificial Sequence: Synthetic coding sequence
auggggcccggggccccguuugcccgaguuggcuggccacucccccuguuaguugugauggccgccgggguggccccgguuugggccucucacaguccucaccuuccccguccacauucacguguaccuccccacccuagcucagaacggagagccguguacauuggcgcccuguuccccaugucagguggcuggccugggggacaggcuugccaacccgccguugaaauggcauuggaagacgucaauaguagacgcgauauucugccagauuaugagcugaaacucauucaucaugauaguaagugcgauccuggacaggcaacaaaguaucuguacgaauuacucuauaacgacccaauuaagauaauccugaugccuggguguucuucaguguccacucucguggcugaggccgccagaauguggaaucucaucguucugagcuaugguuccaguucuccugcucuguccaacaggcagcgauucccuaccuuuuucaggacgcaccccagcgcaacguugcauaaucccacacgcgugaaacuguuugagaaauggggauggaagaagaucgccaccauucaacaaacuacugaaguguucacuaguacacuggacgaccuggaggagagagugaaagaagccggcauagagaucacuuuccggcagucuuuuuuuuccgaucccgcgguacccgucaaaaaucuuaagcggcaggaugcgagaauuauugugggccucuuuuacgagaccgaagcccgcaaaguuuucugcgagguguauaaagaacgccuguucgguaagaaguaugucugguuucugauugggugguaugcagauaacugguuuaagauauaugaccccucaaucaacuguacgguugacgagaugacagaggcaguggagggccacauaacaaccgagauagucaugcugaauccugccaacacccguucaaucagcaacaugacuucacaagaguucguggaaaaacucaccaaacgucugaagaggcaccccgaagagacgggugguuuccaggaagcgccucuggcauaugacgcaauuugggcacucgcucucgcacugaauaagaccaguggaggugggggccgauccggggucaggcuggaggacuucaacuauaacaaccagacuauaacagaucagauauaccgggcaaugaauuccaguuccuucgaaggcguuucugggcacgugguguuugacgcaucaggcucaaggauggccuggacucucauagagcagcuccagggagguuccuacaaaaagaucgguuacuacgacucaaccaaggacgaccuguccuggaguaaaacggacaaguggaucggagguuccccuccagcagaccaaacuuuaguuaucaaaacuuuucgauucuuaucccagaagcuguucaucucaguuagugucuugagcucacugggcauugucuuggcagucguuugccucucuuuuaauauuuauaacagccauguucgcuacauccaaaauucacaaccaaaucuuaauaaucuaacugcagucggcugcucccuggcucucgcugcuguguuuccacugggacuggaugguuaccacauuggacggaaucaguucccauucgugugucaggcucgccuaugguuacuggggcucggcuuuagccugggcuacgggucuauguucacaaaaaucugguggguucauacaguuuucacuaaaaaggaggagaaaaaagaauggcguaaaacacuagaacccuggaaacucuacgcuacggucggccuacucguggguauggacguccugacccuggcaaucuggcagauuguggacccacugcauaggacaauagagacuuucgcuaaagaagaaccuaaggaagauauugacguuucaauccucccccagcuugaacauuguuccucacgaaaaaugaacacauggcuugggauuuucuacggguauaagggccuacugcugcuguuagggauuuuccuugccuacgagacuaagagcguaaguaccgaaaaaaucaaugaccauagagcaguuggcauggccauauacaacguggcugugcucugcuugaucacggcuccagugacuaugauccugucaagucagcaagacgcagcuuuugcauucgcaucacuagcuauuguguucucaaguuacauuacucuggugguccuguucgugccuaaaaugcgccgccugaucacccgcggcgaauggcaaucagaggcccaggauacaaugaaaacuggaucaucaacaaacaacaaugaggaggaaaaaucuagacuacucgagaaggagaaucgggaguuggagaaaaucaucgccgagaaagaggaacgaguuagcgaacugagacaccaacugcagaguagacagcaguuaaggaguaggaggcauccacccaccccgcccgaaccuagcggaggccucccacguggaccacccgagcccccugauaggcugagcugugaugguagucgagugcaccuccucuauaaguag

SEQ ID NO: 13065 - RNA, 2007 nt, Artificial Sequence
  Description of Artificial Sequence: Synthetic coding sequence
auggaccuuguccucaagcggugucuacuccaccuugcagucauuggagcguugcuugcaguaggcgcaaccaaggugcccaggaaccaggauuggcucggggugucccgccaacugcgaaccaaggcuuggaacaggcagcuguacccggaguggacagaagcccagaggcuggacuguuggcguggcggccaggugucguuaaaggugagcaacgacggaccaacacugauaggugccaacgccuccuucucgaucgcucuaaacuuuccaggcagccagaaaguucugccagauggacaggugauuuggguuaauaauacgaucaucaacgggagccaggugugggguggacaacccguguacccccaagagacugaugaugccugcauuuucccugauggaggcccuugcccaagcggaucuuggagccaaaaacgcagcuucgucuauguuuggaaaacuuggggccaguacuggcaggugcucggaggcccugugagcggcuuguccauagggaccggccgcgcuaugcugggcacucacacaauggaggucaccguuuaucaccggcgaggcaguagaucuuaugucccacuggcccauucaagcucagccuuuaccauaaccgaucaagugcccuucuccgucucggugucucaguuacgggcauuggauggaggcaauaagcacuucuugaggaaccagccacugacuuuugcacuucaauuacaugauccaucaggauaccuggccgaagccgaucucucguacacuugggauuuuggcgacagcaguggaacacugaucucaagagcauuagugguuacucacacuuaccuggagcccggccccgugaccgcacagguaguauugcaggccgcuauuccccuaacuagcugugguagcagucccguucccggaacgaccgacgggcaucgaccuaccgcggaagcacccaauaccacggcaggccaggugcccacaacugaggucgucgguacaacuccuggacaggcucccaccgcggagcccucuggcaccacgagcguccaggugccaacuacggaagucaucaguacugcaccuguacaaaugcccaccgcggaauccacugguaugacuccagaaaaagucccuguguccgagguaauggguacuacgcuagcggagaugucuacgcccgaggccacuggaaugaccccugccgaggugucaauugugguccuguccgguaccacugcugcacaggucacaaccacagaauggguugaaacaacagcccgagaacugccuauucccgagccugaagggccugacgcgucaagcaucaugucuaccgagagcaucacgggaagucugggcccacuacuggacgggacggcaacacugcggcuugugaaacggcaggugccgcucgauugcgugcuguacagguacggcuccuucucgguaacacuggacaucgugcagggaauagagucugcugagauccugcaggccguccccucaggcgaaggggacgcuuucgaacugacugucuccugccaaggcggcuugccaaaagaagccugcauggaaauuaguuccccuggcugccaaccaccugcucagcgcuugugccagcccguccuaccuucacccgccugucagcuugucuugcaucagaucuugaagggcgguaguggaacguacugucuuaaugugucccuggccgacacgaauucucuugccguuguuucaacacaguuaauuaugccugugccugguaucuugcucacgggccaggaagcgggauuaggacagguuccucucauugucggcauacugcuagugcugauggccgucguacuggcaagccuuauuuaccgcagaagacuuaugaaacaggacuucagcgucccacaacuuccucacucuagcucacacuggcucagauugccucggauuuuuugcucgugucccaucggagagaauucaccacugcuuucagggcaacaaguguag

SEQ ID NO: 13066 - RNA, 525 nt, Artificial Sequence
  Description of Artificial Sequence: Synthetic coding sequence
auggccgacaugcagaaucugguggagagacuggaacgcgcugucggccgccuugaggccgugagccauacaucugauaugcaucggggcuacgcugacagcccuuccaaagcaggcgcugcucccuacguccaggccuucgauagccuccucgccggucccgucgcugaauacuuaaaaaucucaaaagaaauuggaggggacgugcagaaacaugcugaaaugguccauacaggccuuaaguuggagagggcccuccuuguuacugcgucucagugucaacaacccgccgagaauaagcucucugaucuucuggcgcccaucucugaacagaucaaagagguuaucacauuccgagaaaagaaucgcgguuccaaacuguucaaucaccugucagcaguaucugagucgauucaggcucugggauggguggcaauggcgcccaaacccggacccuaugugaaagagaugaacgaugcagccauguucuacaccaaccgcguccugaaagaguauaaagauuag

SEQ ID NO: 13067 - RNA, 1368 nt, Artificial Sequence
  Description of Artificial Sequence: Synthetic coding sequence
augcuucaucccgaaacuucccccggacgcggacaccuucuggccgugcugcucgcccuccugggaacggcaugggcggaggucuggccuccacagcuacaagagcaggcaccuauggccggcgcacugaaucggaaggaauccuuucugcuacucaguuugcacaacaggcugagguccugggugcagccuccugcggcagacaugcgaaggcuugacuggucugacucccuagcccagcuggcucaagcaagagcagccuuguguggaaccccaaccccuucacuggcaucaggacuuuggagaacuuuacaggugggguggaacaugcagcugcuuccugcuggacugguuuccuuugucgaggucguaucuuuaugguucgcagagggccagcgauauagccaugcagccggcgagugugcuagaaacgcgaccugcacucauuacacacagcugguaugggcuacguccucccagcucgguuguggcaggcaccugugcucugcgggucaggcagccauugaagcguucgugugugcuuauucaccacguggcaacugggaagugaacggaaagaccauuguccccuacaagaagggggccugguguucacugugcacugcuucagucucggguugcuucaaggcgugggaucaugcuggaggauugugugaagugcccagaaacccauguaggaugaguugccagaaccauggcagacugaacauuagcaccugucacugccacugccccccuggcuacacggggagauacugccaggugagaugcucuuugcagugcgugcacgguagguucagggaggaggaguguaguugcgucugcgacauuggauacgggggagcucagugugcaacaaaagugcacuuucccuuccacacgugcgauuuacgaauagauggggacuguuucaugguguccucggaggcagauaccuauuacagagcuagaaugaagugccagaggaaagggggcguguuagcccagauuaaaucucagaagguccaggauaucuuagcuuuuuaccucggcagacuagaaaccacaaaugaagugaucgacucugauuucgaaacuaggaauuucuggaucggacuaacuuauaaaacugccaaagacucuuuccgaugggccacgggagaacaccaggccuuuacaagcuucgcauucggacagccggacaaccacggccuuguguggcuguccgccgcaaugggauuuggaaacuguguagaguugcaggcuagugcugccuuuaacuggaaugaccagagaugcaaaacgcgaaaccgauacauuugccaauuugcucaagaacauaucucacgauggggcccuggcucauag

SEQ ID NO: 13068 - RNA, 297 nt, Artificial Sequence
  Description of Artificial Sequence: Synthetic coding sequence
augguacuggccaugcuuggagcccugcacccacgagcgggccugucacucuuucuucauuugauccuagcugucgcucuuuugcgaucacagccucugcgcucccaacgcucagugccggaggcauuuagugccccgcucgaguugucacagccacucucuggacugguugacgauuacgguauccucccuaagcacccaaggccccgcgguccucgccccuuacugucucgagcccaacagaggaaacgcgaugguccugaucucgcugaauacuacuaugacgcccaccuguag

SEQ ID NO: 13069 - RNA, 2742 nt, Artificial Sequence
  Description of Artificial Sequence: Synthetic coding sequence
auggguccagaggcauugagcucauuauuauuacuucuccugguggcaagcggagacgccgauaugaaaggacauuuugacccugccaaaugccgcuaugcucugggaaugcaggaccgcaccauccccgauucggauaucuccgcaagcuccagcuggucugacucuaccgcggcucgacauucuagguuggaguccuccgauggcgauggugcaugguguccggcaggcucugucuuuccuaaagaagaggaguaucugcaaguugaccuccaacgacugcauuuaguagcucuggucggcacccaggguaggcacgccgggggucucggaaaggaauuuagccggucuuacagauuaagauauucgcgugaugggcgaagguggaugggauggaaggaccgcuggggccaggaagugaucaguggaaacgaggacccagaaggaguuguucugaaagaucuggguccccccauggucgcgcguuuaguucgguucuacccuagggccgaucgagucaugucagugugucugcggguugagcuauacggguguuuauggcgagacggccuauugagcuauacugcacccgucggucaaacuauguaccuuucugaggccguguaccugaacgauagcacauaugauggccacacagucggaggacugcaauacggagggcugggacaacuugcagacggaguuguuggccuggaugauuuucgaaaaucgcaggagcugaggguuuggcccggcuacgauuauguuggauggucaaaucauagcuuuucaucuggcuacguggagauggaguucgaguucgaccgccuucgugcuuuucaggcaaugcaggugcauugcaauaacaugcauacucucggugcucgacucccugguggaguggagugucgcuucaggcggggcccugcaauggcgugggaaggagaaccuaugcgucauaaccuuggcggcaacuuaggagacccccgugcgcgagcugucucugugccucugggcgguagaguggcaagauuucugcagugccgcuuccuuuuugcaggccccuggcugcucuucuccgagauuucuuucaucuccgacguggugaauaauucaagcccugccuugggcggaaccuuuccaccugcccccugguggccccccgggccaccccccaccaauuuuaguagcuuggagcuggagcccaggggucagcagccuguagccaaagccgaggggaguccuaccgcuauuuugaucgggugucuggucgcaauuauauuguugcuacugcuaauuaucgcccuaaugcuguggcgauugcacuggagacgacuguuauccaaggcggaacggcggguacuggaggaagaacugacugugcauuuguccgugccuggcgauacuaucuuaaucaauaacagaccaggcccucgggagccacccccuuaucaggaaccccguccgcgcggaaauccaccccacucagccccgugcgugcccaauggaucagccuugcuccugucuaaucccgccuacaggcuccugcuugcaacauaugcccgaccaccacgcggcccaggaccuccuacccccgcgugggcgaagccaacuaauacgcaggccuauagcggggauuacauggaacccgaaaagccaggugcaccacuucugccuccccccccucagaacuccgugccucauuaugcugaagcagacauuguuacucuccaaggcguuacagguggcaacacguacgcagugcccgcucugccaccaggcgcaguaggagacggaccaccacguguagauuuuccucguuccaggcugcgguucaaagagaagcuuggggaagggcaguuuggcgagguucaccucugcgaaguagauagcccacaggaccuggucuccuuagacuucccccugaacguaagaaaaggucauccgcuccugguggcugucaaaauucuucgcccggacgccaccaagaacgcacggaaugacuuucugaaagaggugaaaauaaugagccgucugaaagauccuaacauuauucgacuucucggcgugugcgugcaggaugaccccuuguguaugauaacagauuauauggagaauggugaucuaaaucaguuccuguccgcucaucagcucgaagacaaggccgcagaaggugcuccaggagacggccaagccgcacaagguccgaccauuuccuauccgaugcuguugcauguugcugcccaaauugcuagcgguaugcguuaccuagccacucugaacuucguccacagagaccuugcuaccagaaauugccuggugggugaaaauuucacuauaaaaaucgcggacuucggaauguccagaaaccuguaugcuggcgauuacuaccguguacagggacgcgcugugcugccgauuagguggauggcuugggaaugcauucucauggggaaguuuaccaccgccucagaugugugggcauuuggcgugaccuuaugggaggugcugaugcugugcagggcacagcccuucgggcagcuuaccgaugagcaggucauugagaaugcaggcgaguuuuuccgcgaucagggacgccaaguauaccucagccggcccccggcuugcccucagggauuguaugagcuaaugcugcgaugcuggagucgcgaguccgaacaaagaccaccauucucacagcugcacagauuucuagcugaggaugcacugaauacagucuag

SEQ ID NO: 13070 - RNA, 678 nt, Artificial Sequence
  Description of Artificial Sequence: Synthetic coding sequence
uaagccgacuugccgucaugcuggggugcugggccuuguuacacugggcacaaaguuggcgccuugcgccgggauacaguuauuuguugcuguaggcacggugauuauucuacaccuugccuguucacccccggaaaaccuucacggaaccccucacccuggaaacggacacucuggacacuuucugcuccuugggcuggcccggccggauggacuggcgaggaacagaacgccacaaaaacgggccuuauuacgagaagaccccggccccugcgacgccggccucacccugcaccagcuagcccgcuaccugagauuauucgugguaacauuccucgcaugcucgguaaguuuguacccgugaacugggaaccuccucagcccuugcccuucccaaaguaucugagguguuaccgauguuuacuugagaccaaagagcuuggaugucucuuaggcucugauauaugucugacacccgccgguagcagcuguauaacccuacacaagaagaacucuuccgguuccgacgucaugguuucagacuguagaucaaaagaacagaugagugacuguucgaacacuagaacaucccccgugucaggauuuuggauauuuagccaauauugcuuucuggacuuuugcaaugacccucagaacagaggccuguauaccccuuag

SEQ ID NO: 13071 - RNA, 405 nt, Artificial Sequence
  Description of Artificial Sequence: Synthetic coding sequence
augccucgcugcagaugguugaguuugauccuucucacgauuccuuuagcucuuguagcccgcaaggacccuaaaaaaaacgagacaggcguauugaggaaguuaaagcccguuaacgcaucgaaugcaaaugugaaacagugccuuugguucgcuaugcaagaguauaauaaggaguccgaggauaaguauguuuuccuaguaguuaagacacugcaggcccagcuccagguaacaaaucugcuagaguacuuaaucgacguagagauagcccggucugauuguagaaagccacucaguacuaaugaaauaugugccauacaggagaauagcaaacuuaaaagaaaacugagcugcucuuuccucgugggggcucugccauggaauggggaguuuaccguuuag

SEQ ID NO: 13072 - RNA, 1182 nt, Artificial Sequence
  Description of Artificial Sequence: Synthetic coding sequence
augcggacacuuuuuaaccuguuauggcuggcuuuagcuuguuccccugugcauacuacucuaagcaaaucggaugcaaaaaaggcagcuuccaagacucugcuugaaaaaucucaguucagcgauaaaccggugcaagaucgggggcugguuguuaccgaucugaaggcggaguccgucguguuggagcacagaagcuacuguucggcuaaagcacgcgaccgacacuucgcgggagauguucuuggcuacguaaccccuuggaacagccacggcuacgaugucaccaaaguguuuggcuccaaauuuacccaaaucagccccguauggcuccaacugaaacgaagaggccgagaaauguuugagguaacugguuuacaugacguugaucaggguuggaugcgagcggugcggaaacacgcaaagggacugcauaucgugccuagacugcuuuucgaggacuggaccuaugaugacuuccgcaacguccuggauagugaagacgagauugaagaacucucaaagacagucgugcagguggccaagaaccagcacuucgauggcuuugucguggaaguuuggaaccaacugcugucucagaagcgagugggauugauccauauguugacgcaccuugcggaagcccugcaccaggcaagacuucuggccuuacucgucauuccgccagccaucacccccgggaccgaccagcuugggauguuuacucauaaagaguuugaacagcuggcaccuguccuggauggcuucagcuuaaugacauacgauuauucuacggcacaucaacccggccccaaugcaccacucucgugggucagagcuuguguccagguguuagaccccaaaucaaaguggcgcucuaaaauucugcugggauuaaauuucuaugguauggacuacgcaacuucuaaggacgcuagagagccuguugugggugcccgcuacauccagacccucaaagaccaucgcccacgcauggugugggacagucaggcuuccgagcacuucuuugaauacaagaagucgcggucggggcggcacgugguguuuuacccuaccuugaagucucugcaagugaggcuggagcuagccagggaauuaggugucgggguguccauaugggaacugggucagggguuggacuacuucuacgauuuauuguag

SEQ ID NO: 13073 - RNA, 678 nt, Artificial Sequence
  Description of Artificial Sequence: Synthetic coding sequence
uaggcggaccuccccuccugcuggggugccggcccauguuauacugggcacaagguuggagccuugaggagagauacugucaucugcugcuguaggcauggugauuacuccacccccugcuuguuuacucccggaaaaccauccagaaacccuuccccuuggaaaagaacucuauggaccuuauccgcgcccugggcuggaccagcaggcuggaccggagaggagcaaaacgccacaaagaccggucucaucaccaggcggcccaggccacuuagaagacguccucauccagccccugccuccccauuaccggaaauuauacggggaaacauuccacggaugcuugggaaguuuguccccgugaacugggagccaccacaaccacugccauuucccaaauaccucagaugcuacaggugccuacucgaaacuaaggaauugggcugucugcugggauccgacaucugcuuaacaccugcaggcuccucguguaucacccuccauaaaaagaauagcucgggcucugaugugauggucagcgacugccgaucuaaagagcagaugagcgacugcagcaauacacgcacgagcccggugaguggcuucuggauuuuuagucaguauuguuuccuggacuucuguaaugacccucaaaaccgaggucuguauacaccauag

SEQ ID NO: 13074 - RNA, 1410 nt, Artificial Sequence
  Description of Artificial Sequence: Synthetic coding sequence
augaugcgacucgguggaaggcuuguguuaaauacaaaggaggagcuugcaaaugagcggcugaugacacugaaaaucgccgaaaugaaggaagccaugcguacccuuauuuucccaccuucuaugcauuucuuucaggccaaacaucucaucgaacggagucaaguguucaacauucugagaaugaugccuaagggagcugcccugcacuugcaugacaucgggaucguaacuauggacuggcugguuagaaauguuacauaccggccucacugucacauuugcuuuaccccaagaggcauuaugcaguuccgguuugcccauccaacgccuagaccauccgaaaagugcucgaaauggauucuccuggaggacuauaggaaacgcgugcagaauguuacagaguucgacgacagccuguugcgcaauuucacucuuguaacccaacauccagaggucauuuacacaaaccagaaugucgugugguccaaguucgagacaauauuuuucacaauaagcggcuugauccacuacgccccaguauuucgagauuauguguuccgauccaugcaagaguuuuacgaggauaacgugcuguauauggaaauccgugcccggcugcugcccguguacgagcugagcggcgagcaucaugacgaggaguggagugugaaaacuuaccaggagguggcacagaaauucguugaaacucacccugaauuuauuggcaucaaaauuauauauuccgaccacaggaguaaagauguugcagugaucgcagaaagcauuagaauggcuaugggguuacgcauaaaauuuccaacagugguggccggcuuugaccuggugggacaugaagacacaggacauuccuuacaugacuauaaagaagcccuuaugaucccggccaaggauggcgugaaacugcccuauuucuuccaugcaggcgagaccgauuggcagggcacauccauagauagaaauauccuggacgcccugaugcugaacacuaccaggauaggacauggcuuugcucugucaaagcacccggccguccgcacauacagcuggaagaaagacaucccaauugaagugugcccuauuucgaaccagguguuaaaguuaguaucugaucucaggaaccaucccgucgccacauugauggccaccggucacccaaugguaauuagcagugacgacccagcaauguucggggccaaaggacucagcuacgauuucuaugagguguuuauggggaucggugggaugaaggcagaucucagaacacucaaacagcuagcaaugaacucuauuaaguacuccacacugcuggaaucagagaagaauaccuuuauggagauuuggaagaagagaugggacaaguuuaucgccgauguugcgaccaaauag

SEQ ID NO: 13075 - RNA, 1137 nt, Artificial Sequence
  Description of Artificial Sequence: Synthetic coding sequence
ugauacuccggagauuacauggagccugagaaaccaggagcuccacuacuaccacccccaccccagaauucagugccccauuacgcggaggcagacauagugacgcuccaaggcguaacuggcggaaauacauacgccguucccgccuugccaccuggcgccgucggagauggaccaccccgaguggacuuuccacgcagucgccugagguucaaagaaaagcugggcgagggccaauucggagaagugcacuugugugagguggacucuccacaagaucuagucuccuuagauuucccgcugaacguucggaagggccacccacuauugguggccguaaaaauauugcgucccgaugcuaccaagaaugcaucuuuuucuuuguuuucucgaaaugacuuccuuaaagaaguuaaaaucaugucgagguuaaaggacccaaauauuauccgccuucugggaguuugcguucaagaugauccacugugcaugaucacagauuacauggaaaacggagauuugaaccaguuccugagcgcccaccagcuggaagauaaggcugccgaaggggcuccaggcgacggacaggcagcucaaggaccaaccauuuccuauccuauguuacuccacguggcugcccaaaucgcaucaggaaugagauaccucgcaacacuaaacuucguucacagagauuuagcaacacguaauugucugguuggggagaacuucacaauuaagaucgcggauuucgguaugucucggaacuuauacgcuggggauuauuaccgcguacaggggcgugcaguucuaccuauuagauggauggccugggaguguauccugaugggcaaauuuacuacugcaagugacgucugggcguuuggcgugacgcucugggagguacugaugcucugcagagcucagccuuuugggcaacuaaccgacgagcagguaaucgagaacgccggcgaguuuuucagggaucaagggaggcagguguaucugagccgaccaccugcaugcccccaggguuuauacgaacugaugcuuagaugcuggaguagggaaucugaacagcgcccacccuuuucccaacugcauagauuccuggcggaggacgcuuugaauacgguauag

SEQ ID NO: 13076 - RNA, 678 nt, Artificial Sequence
  Description of Artificial Sequence: Synthetic coding sequence
ugagccgaccugccaucuugcuggggagcugggcccuguuauaccggccauaaggugggcgcucuaagaagagauaccgugauuugcugcugcaggcacggggauuauucuacacccuguuuauucacgccaggcaagcccuccaggaacccaucccccuggaagcgaacgcuguggacccucagcgccccgugggccgggccugccggcuggacaggcgaggagcagaacgcaacaaagacgggauugauuacaagaaggccuagaccucuccggcgucgcccacaucccgcccccgcuagcccacugccagaaauuauacguggcaauauuccaagaauguuaggaaaauuuguucccgugaauugggaaccaccucaaccacuccccuucccaaaauaucuccguuguuaucgcugccuccuugagacaaaggaacuugguugucuccucggaucugacaucugccucaccccugcaggauccaguuguauuacuuugcacaaaaagaauagcagugggagugacgugaugguguccgauugucgaaguaaggaacagaugagugauuguucuaauacgaggaccuccccaguguccggcuucuggaucuuuucucaauauuguuuucuggauuuuugcaacgauccucagaacagaggguuguacaccccguag

SEQ ID NO: 13077 - RNA, 846 nt, Artificial Sequence
  Description of Artificial Sequence: Synthetic coding sequence
augcuucccaaaagcagacgggcacuuaccauucaggagauagccgcauuggcucgaucaucguugcacggcaucagucaggucgucaaagaucacgucacaaaaccaacugccauggcccagggccgcguggcucaccugauugaguggaagggauggucuaagccuuccgauagucccgccgcacucgaaagcgcauucucaucguacucugacuuguccgaaggagaacaggaggcgcguuucgcugcuggaguggccgagcaguucgccauagcagaagcuaagcugcgagcaugguccagcguggacggggaagauuccacagacgacagcuaugacgaagacuuugccggagggauggauaccgauauggccggacagcucccccugggaccccaccugcaggaucuguuuacuggucauagauucagccggccugugagacaggguucuguagaacccgagagcgauuguucccagacggugagcccggacacccuuuguuccagccuauguucucucgaagacgggcugcuaggaagcccagcaagauuggcaucacaguuacucggagaugaacugcuucuggcgaaacugcccccaaguagagaaucagccuuucggucucuggggccccucgaggcgcaagacagcuuauauaauucaccuuugacagaaucaugucucucaccagccgaggaggagccagccccaugcaaggacugccaaccccuaugcccuccucugaccgguagcugggagcggcagcgucaggcuucugaccuggccagcuccgguguggugucccuggacgaagacgaggccgaaccagaagagcaguag

SEQ ID NO: 13078 - RNA, 1110 nt, Artificial Sequence
  Description of Artificial Sequence: Synthetic coding sequence
augaaauuccagggacccuuagcuugccuacuucuggccuugugcuuaggauccggagaagccggcccucuucagucuggggaagagaguacuggaacaaacaucggggaagcacuggggcauggccugggagacgccuuaucugagggagucggaaaagcaaucggcaaggaggcugguggggcagcgggcuccaaggugagcgaagcacuuggucaggggacacgcgaagccgucggcacuggaguacggcagguaccuggauucggugucgcggacgcacugggcaaccgcgucggggaggcggcacacgcgcugggcaauacgggacacgaaauugggaggcaggcugaagacgucauuaggcacggcgcugacgcagugcggggcagcuggcaggguguaccaggacacaauggcgcgugggagaccagcggcggacacggcauuuuuggaagccaaggcggucugggugggcagggccagggcaacccugggggacuggggacaccuugggugcacggcuauccagggaacagugccggaucuuuugguaugaauccgcagggggccccuuggggacaggguggaaacggagguccaccuaauuuugguaccaauacucagggggcugucgcacaaccgggguauggcucgguucgggcuucaaaucagaacgaaggcuguacaaaucccccccccagcggguccggugggggauccagcaauucuggcggcgguagcggcucacagagcgggucuagcgguuccgggucuaacggcgacaauaacaaugggaguucgucagggggaagcagcaguggcagcuccucaggaggaucuucuggcggaaguagcggcggcagcaguggcaacaguggagggaguagaggcgacagcggcagcgagucuucaugggggaguucaaccggguccaguucgggcaaucauggaggcagcggaggcggcaauggacauaaaccgggcaauucagagaccucuccuggaauguucaacuuugauacuuuuuggaagaacuucaaaucaaagcugggguucaucaacugggaugcuauaaacaaagaccaaagaucuagcaggaucccguag

SEQ ID NO: 13079 - RNA, 420 nt, Artificial Sequence
  Description of Artificial Sequence: Synthetic coding sequence
augggaccugaggcucucagcucucuuuugcugcugcuucugguagcuucaggugaugcagauaugaaaggccacuuugauccagccaagugcagauacgcccuggggaugcaagacaggacuaucccggacucugacauauccgcaucuaguucauggucggauucaaccgccgccaggcauucucgcuuggagagcucugauggagauggcgcauggugcccugccgguucaguuuuccccaaggaagaggaauacuugcaaguggaucuccagagacugcaccuuguagcucuugugggcacccagggcaggcacgccgguggccuugggaaagaguuuucacggucauauagacugagauauagccgggacggccgccgcuggauggguuggaaggacagguggggacaagaauag

SEQ ID NO: 13080 - RNA, 516 nt, Artificial Sequence
  Description of Artificial Sequence: Synthetic coding sequence
augcggcacaaccuuggagguaacuugggcgaucccagagcccgcgcuguuucugugccacuugguggaagagucgccagauucuuacaaugcagauuucuguuugcgggcccuuggcuccucuuuucugaaauuagcuuuauuagugacguggugaauaacucaaguccagcucugggcggcacuuuucccccagcuccuugguggccccccggcccuccccccacgaauuuuuccucccuggaacucgaaccuagagggcagcagccaguagccaaagccgaaggcaguccuacugccauccugaucggaugccuaguggccauuauccugcuuuuacuccugaucaucgcccuaaugcuguggaggcugcauuggcgccgucuguugaguaaaguguuggagagccauccacguacaagaucuccuggccuggucggcauucggccgacuccucucccugugucaccuauggcgcucgugcaucuaugcgaagucgauuccccgcaggacuag

SEQ ID NO: 13081 - RNA, 192 nt, Artificial Sequence
  Description of Artificial Sequence: Synthetic coding sequence
augggcccagaagcgcuuucuucccuguuacugcugcuacucgucgcuaguggcgaugcugauaugaaaggccauuucgacccugcuaagugccgguacgcucucgggaugcaggacaggacaauuccagacuccgacauaagcgccucaagcuccuggagcgacucuaccgccgcacgccacucaagauag

SEQ ID NO: 13082 - RNA, 1137 nt, Artificial Sequence
  Description of Artificial Sequence: Synthetic coding sequence
ugauauucuggcgauuauauggaacccgaaaaacccggcgcuccacuguuaccgccacccccccagaacagcgugccacauuaugccgaggccgacauagucacccugcagggugugacuggcgguaauacuuaugcagugccagcgcugccacccggagccgugggcgacggcccuccccgaguugacuuuccccgcagcaggcuaagauuuaaagaaaaacuuggcgaaggacaguucggcgaaguacaucuaugcgagguugauaguccacaggaucucgugagucucgacuuucccuugaaugugcgaaaggggcauccucuccugguggccgugaaaauccucagaccggacgcaacuaaaaaugccagcuucucccucuuuucccgcaacgacuuuuugaaggaggucaaaauuaugucucggcucaaagauccuaauauaauacgauugcucggcgucuguguucaggaugauccacuaugcaugaucacagacuauauggagaauggcgaccuaaaccaguuucucagugcacaccagcucgaggacaaagcugcagaaggcgcuccaggcgacggacaagccgcacaagggcccaccaucaguuauccuaugcugcugcacgucgcugcgcagaucgccucugggaugcgcuacuuggccacgcucaacuucguucacagggaucuugcaacacgaaauugccuuguuggggaaaacuuuacaauuaaaaucgccgacuuuggaaugagcagaaaucuguaugcaggcgauuacuaucggguccaggggcgagccguacuacccauccgcuggauggccugggaguguauccugauggguaaauucaccacagcaagcgacgugugggcguucggcgugacgcugugggaagugcugaugcugugucgcgcgcaacccuucggccaacugaccgacgaacagguaaucgagaacgccggcgaauucuuccgagaucaaggccgccaagucuauuugagcaggccuccugccuguccucagggauuguaugaguugauguugcgauguuggagcagagagucagagcagaggccaccauuuagccagcuucacagguuccucgccgaggacgcucucaauaccguuuag

SEQ ID NO: 13083 - RNA, 2535 nt, Artificial Sequence
  Description of Artificial Sequence: Synthetic coding sequence
augggaccaggggccccuuucgcuagggucgguuggccacugccucugcuaguugugauggcugcaggggucgcuccgguaugggcuucccacucuccucaccucccccggccucauucucgaguaccaccccaucccucuucagaacggcgcgcaguauauaucggggccuuauucccaaugucaggcggcuggccaggcgggcaggccugccagccugcugucgagauggcuuuagaagaugugaacaguagacgcgacauccugccugacuaugagcuuaaacugauccaucaugauuccaagugcgauccaggacaggcgacuaaguaccuuuaugaacuguuguacaacgaucccaucaaaaucauuuugaugccgggcugcucauccguuucuacacuugucgcugaagcugccaggauguggaacuugauuguucugagcuauggcucuagcucucccgcucuuuccaauagacaacgcuuucccaccuucuuuaggacucaccccucugcuacucugcauaauccuaccagaguuaaacuguuugagaaguggggauggaagaagauugccacaauccagcagaccaccgagguauuuacauccacgcuugaugacuuggaggaaaggguaaaggaagcuggaaucgagaucaccuuccggcagagcuuuuuuagcgacccugccgugcccguuaaaaaccucaaacgacaggacgcccguaucauagugggccuuuuuuacgaaaccgaagcacggaagguguucugcgagguguauaaagagaggcuuuucggcaagaaauaugugugguuccugauuggcugguacgccgacaauugguucaaaauauacgaucccucaauuaauuguaccgucgacgagaugacagaggcugucgaaggccacaucacaacugaaauuguuauguuaaacccugccaauacucggucaauuagcaauaugacgagccaggaguuugucgagaaacuaacuaagcggcuuaagcgucacccugaggagaccggggguuuccaggaagcaccucucgccuacgaugccaucugggcuuuggcccuugcucugaauaagaccucuggaggggguggacgcucugggguaaggcuugaagacuucaauuauaacaaucaaaccauuaccgaccagauuuaucgcgccaugaacuccucgucuuucgaggguguuagcggacauguuguauuugacgcaucuggguccagaauggccuggacuuuaaucgaacaguugcaggguggaagcuauaaaaagauagguuacuacgauuccacuaaggaugaccucucuuggaguaaaacugauaaguggaucggcggcucaccucccgcugaucagacgcuggucauuaaaacauuccgauuuuugucccagaaguuauucaucagcguaagcgucuuaaguucucuagguauaguccucgcugucgugugccucuccuucaauauauacaauucccauguccgguacauccagaacucccagccuaaucugaacaacuugaccgcagugggcuguucccuggcccuggcugcuguauucccacuuggacuagauggauaccauauuggcagaaaucaauucccauuugucugccaagcacgacuuugguuacugggacugggcuucucauuggguuaugggagcauguucacgaagauaugguggguucacacgguguucaccaagaaggaggaaaagaaagaauggagaaagacuuuagagcccuggaagcuuuacgccaccgugggacugcugguggggauggauguuuugacgcuugcaauuuggcagaucgucgauccccugcauaggacaauugaaacuuucgcuaaagaagaacccaaagaagacauugauguguccauucuuccccagcucgagcacugcucuuccagaaagaugaauacauggcuggggauuuucuacggcuacaaaggccuccuguugcugcugggaaucuuccuggcauacgagaccaagagcgugagcacugaaaagaucaacgaccaccgggcaguugguauggcuaucuacaauguagcaguucuguguuugaucaccgccccugugaccaugauccugucaucccaacaggacgcugccuucgcuuucgcgagccuugcaauuguuuuuaguaguuauaucaccuuaguggugcucuuuguuccaaagaugcggcggcuuaucacucguggcgaguggcaguccgaagcccaggacacaaugaagacuggaaguuccacaaauaacaaugaggaggagaagucucgacucuuagagaaggagaauagggaacucgagaaaauaauugccgagaaggaagagagagugagcgaacucagacaccaacuacagucucgucagcaacuucgcucgcgcaggcauccaccuacgccccccgagcccaguggaggucuaccucggggucccccugaacccccagaucggcuaaguugugauggaucacgaguucaccuccucuacaaguag

SEQ ID NO: 13084 - RNA, 339 nt, Artificial Sequence
  Description of Artificial Sequence: Synthetic coding sequence
augcugacagccgcauuagccccuggugcagcgaauuccccuacuacuaacccaguaauuuugauuguggauaaggugcuugaaacccaagaccugaauggagacggacugaugacucccgcugagcugauuaauuuccccggcguggcucugcgcccguacccaccguacauuggugugggccccaauucuaacaugugcuccaggucagaucucccugaagacuccaauacucucuaccccggaagccaccuguggcugcgccacgcccucaauuccaaagguaaucuugacgcaagacuggacggcggagaaaaagcuaugcagccucaaugguag

SEQ ID NO: 13085 - RNA, 2676 nt, Artificial Sequence
  Description of Artificial Sequence: Synthetic coding sequence
auguugccgacggagguaccucagagccacccuggcccauccgcuuuacuguuguugcaguuacuacugcccccuacuagugcauucuucccuaacauuuggucccugcuggccgcccccggaagcaucacccaucaggaucuaaccgaagaggcagcccugaacgugacacuucagcuguuccucgaacaaccccccccaggaagaccgccucuacgccucgaagauuuucuuggacgaacacugcucgcagaugaucuguuugcugccuacuuuggcccugguucuucucgccgauuuagggccgcccugggugaggugaguagagcgaacgcagcgcaggauuuccugcccacuucuaggaacgaccccgaccuucauuuugacgccgaacgacugggucagggucgggcacgucugguuggugcgcugcgggagacugugguggcugcacgagcauuagaucacacacucgcuaggcagcggcugggcgccgccuugcaugcccuccaggauuucuauucgcacucaaauuggguggagcuuggcgagcagcaaccacacccccaucuuuuauggccaaggcaagaauuacaaaaccucgcucagguggccgauccgaccuguagugauugcgaagaauugagcuguccacggaacuggcuggguuucacauuguuaacgucgggguacuucggaacccacccaccuaagccgcccggcaagugcucccaugggggucacuuugaucguagcucaagucagccaccuagaggagguauuaauaaagacucuacuagucccggcuucucaccacaucauaugcugcaccuacaagcagcgaagcuggcauuacucgcgagcauccaggcuuucagccugcugagaucccgacugggugaccgcgauuuuucccggcugcuggauaucaccccagcaucuucacuaagcuucgugcucgauaccacaggcuccaugggcgaagaaaucaaugcggcaaagauccaggcccgccaucuuguugaacagcggcgagguaguccuauggaacccguucauuacguacuggucccuuuccaugacccuggcuuuggccccguguuuacuacaagcgauccggauuccuuuuggcagcagcugaacgagauucacgcucuggguggcggagaugaacccgaaaugugccuaagugccuuacaguuagcccugcuccacacucccccucuaagugauauuuucguguucaccgaugccaguccuaaagacgcuuuuuugaccaaccaggucgagucacugacccaggagcgccggugcagagugaccuuuuuagucacagaagauaccucgcgcguccaggggagagcucgucgcgagauucuguccccucugagauucgaaccuuauaaagcaguugcgcuggccagugguggggaggugaucuuuaccaaagaccagcacauuagggacguagcugccauugucggggaaucaauggccgcucuagucacucugccuuuggauccuccaguaguaguccccggacaaccccugguguuuaguguugaugggcuccuucaaaaaauuacugugcggauucacggggauauuucuucuuuuuggaucaagaaccccgcaggagugagucagggucaagaggaaggcggcggaccgcuuggccacacgcgccgguucgggcaguuuuggaugguaacuauggacgaucccccccagacuggaacaugggagauacaggucacagcugaggauacaccugguguccgcgugcaggcucagacgucucuagauuuucuguuucacuucggcauucccauggaggacgguccgcaucccggguuguauccacuuacccagccuguagccggacugcagacucaguugcucgucgagguaaccggcuugggcagcagagcuaaccccggagauccacaaccccauuucagucauguuauccuucgcggcgugcccgaaggcgcugaguuggggcagguaccgcuggagccagucgggcccccugagaggggacuccuggcggccucacucucucccaccuuacugucaacuccacgccccuucagccuggaacuuaucggucaggacgcugcaggcagacggcuacaccgggcugcgccucagccuuccacugugguccccguguuacuggaacugagcggacccucuggauuucucgccccaggcaguaagguacccuugagccuuaggaucgccuccuuuuccgggccccaggaucucgaucuacguacauucguuaacccaucuuucucucugacaagcaaccuuucgcgcgcccaccuggaacuuaaugaaucagccuggggucgccuuugguuagagguuccagauucggcugcacccgacuccgugguuaugguuacagucacagcuggaggccgcgaagccaaccccguuccccccacucaugcauuucugagacuccucgucagcgcccccgccccgcaagaucggcauaccacaccuacaggcucaucagacccuauucuuaccaccgcuacacccgcauuuucacccuucacccuggugacucagggccgcgcgggcgcaggacuggcugcuggaucaccuugguggggaaccgucggcggcguucuguuguugcugggucucgccagcugguag

SEQ ID NO: 13086 - RNA, 2742 nt, Artificial Sequence
  Description of Artificial Sequence: Synthetic coding sequence
augggcccugaagcccugaguucucuucuguuguuacuccucguggccagcggcgacgcugauaugaaaggucacuucgaucccgcaaaaugccgauaugcauuggggaugcaggaccggacuauccccgacuccgauauaagugcaucaagcuccuggagugauuccacugccgcacggcauucccgauuggaaaguagcgacggugauggcgcuuggugucccgcuggcucugucuucccaaaagaagaggaauaucugcaaguggaccuccagcgauugcacuuaguugcgcuuguggggacacagggccgccacgccggagggcuaggaaaagaauucucgagaucauauagacuucgauacucccgugacggccggcguuggauggguuggaaagacagaugggggcaagaggugauaucgggcaacgaagauccugagggaguggugcuaaaggaucuaggaccaccaauggucgcaagacucgugcgcuucuauccgagagccgaccguguaaugucuguuugccuccgaguugagcucuacggaugccuuuggcgagacgggcugcugucuuacacagcuccagucggacagacaauguacuugucagaagccguguaucucaacgauucuaccuacgauggccacacgguuggaggacugcaauacgggggucuggggcaacuugcugacggagugguaggccuggacgauuuccgaaagucccaggaguugagggucuggccaggcuacgauuaugucggguggucaaaccacaguuucaguagcggauacgucgaaauggaauuugaguucgaucgcuugcgcgcauuucaggcaaugcagguucauugcaauaauaugcacacccugggggccagacugccuggagggguugagugcagguuuagacgaggcccagccauggcuugggaaggcgagcccaugaggcacaaucuaggaggcaaucugggggaccccagagcaagggccgugucggugccuuuagggggccggguugcccgguuucugcaaugcagguuucuguuugcuggaccuuggcuauuauuuucagaaaucuccuucauuagugacgucguuaacaauucuucuccugcuuuaggcggcacuuuucccccugcuccuugguggcccccuggacccccuccaacaaauuuuaguagucuggaacucgagccccgcggccagcagccuguggccaaggcggagggcucuccuaccgcuauccucaucggcuguuuaguggcuauuauucugcuguuacuucugauaaucgcccugaugcuuuggcgccuucauuggcggcggcuuuugagcaaggccgaaaggcgaguguuggaggaagagcucacuguccauuuguccgugccuggugauacgauuuugaucaauaacagaccaggcccccgggagccccccccguaccaagaaccucgaccaaggggcaaucccccucauagcgcccccugugugcccaacgggagugcgcuucuucugaguaauccggccuacaggcucuugcucgccacuuacgcucggccuccuaggggccccgggccgcccacuccagccugggcgaagcccaccaauacacaagcuuacucaggugacuacauggagcccgaaaagccaggugccccuuuauugccucccccuccucagaauaguguaccucacuacgccgaagcugauaucgugacccuccagggcgucacuggggggaacacguaugccguucccgcacucccuccuggagccguaggagauggaccaccucgggucgacuuuccccgcucccggcugcguuucaaagagaaguuaggcgaagggcaguuuggcgaagugcaccucugugaaguagauagcccccaagaccuggugucccuggauuuuccacucaacguucggaaggggcacccucuguugguggccgugaagauccugcgacccgaugcaacaaaaaaugcaagaaacgauuucuugaaagaagugaagaucaugucuagacucaaggauccuaacauuauuagacuucugggcguguguguucaggaugacccacugugcaugaucaccgacuauauggagaacggcgaucuuaaucaguuccuuuccgcccaucaacucgaagauaaggcagccgagggggcgcccggggauggacaggccgcucaaggccccaccauuucauaccccaugcugcuccauguggccgcccagaucgccuccggcaugcgguaucuggccaccuuaaacuucguucacagggaccuggcuacacgcaauugccucgugggcgaaaacuucacaauaaagaucgcagacuucgguaugucacgaaaccuauacgcgggugacuacuacaggguucagggucgagcagugcugcccauucgauggauggcaugggagugcauucugauggggaaguuuaccacggccuccgacgugugggccuuuggaguuacucucugggaggugcucauguuguguagagcucaaccauuugggcaacuuacugacgaacaggugauagagaaugcuggcgaauuuuucagggaucagggacgccagguuuacuugagccggccgccugcgugcccacagggucuguaugagcucaugcuccguuguuggucgagagagagugagcagagaccuccauuuagccagcugcauagguucuuagccgaagacgcccugaacaccguguag

SEQ ID NO: 13087 - RNA, 390 nt, Artificial Sequence
  Description of Artificial Sequence: Synthetic coding sequence
auggccgcuggaucagcccccaugcagcugcaucuuagagcuaccauaagaaugaaggauggguuaugcgugccuagaaaauggauauaucacuuaacugaggguuccaccgaccugcgcacugagggcagaccagacaugaaaacugaacuguuuucuuccucgugcccagggggcauuauguugaaugaaacuggacagggcuaccagagguuucuucucuauaauagguccccccacccgccugagaaauguguggaagaauuuaaaagccuuacaucaugccuggauagcaaagcauuucuucucacgccacgaaaucaggguaaaggacugaaaucacauaaaacaggccuuggccucacuaaauccucaggagugaccggguag

SEQ ID NO: 13088 - RNA, 846 nt, Artificial Sequence
  Description of Artificial Sequence: Synthetic coding sequence
augcucccgaagagccguagggcacucacuauccaagagaucgcggcacuugcgcggaguucuuugcaugggaucucacaagucgucaaagaccauguaacaaagccaacagccauggcccaggggcgcgucgcacaucugaucgaauggaaaggcuggagcaagccgucugacaguccagcugcucuugaaagcgcauucuccucuuacagcgaccuuucagaaggugaacaagaagcccgguuugcagcuggagucgccgagcaguuugcuauagccgaggcuaagcuccgggccuggaguaguguugacggggaagauucuaccgacgauucauaugacgaggacuucgcuggaggcauggauaccgauauggcgggccaacuaccacuggggccucaccuucaggaccuuuucacaggucauagauucagccgaccaguacgccaagggucuguggagcccgagagugauuguagucagaccgucucacccgacacacuguguucaagccuguguucauuggaggauggauuguugggauccccugccagacuggcuagccagcuguugggagaugaacugcugcucgcgaaauuaccgccuagccgggagucugcuuuucgcucuuugggcccuuuagaagcacaggacagucuguauaacucgcccuuaacagagagcugcuugucuccagcugaagaagaaccugcccccugcaaggacugccagccccuuugucccccccuaacugggucaugggagcggcaacggcaggcauccgaucuggcuucuagcggugucgucagccucgacgaggacgaggcggaacccgaggaacaauag

SEQ ID NO: 13089 - RNA, 444 nt, Artificial Sequence
  Description of Artificial Sequence: Synthetic coding sequence
augggacccgaagcacuauccucucugcuccugcuucuguuaguggccucuggcgacgcagauaugaaaggacacuuugacccugccaagugccgauacgcauuagggaugcaggacaggaccauacccgacucggacauuagugcgagcagcucauggucugauucgaccgcagcgcgucauucucgguuggaauccucagacggcgauggggccuggugcccugccggcagcguuuuuccuaaggaggaggaguaccugcagguggaucuucagcgcuuacaccugguggcgcucgucgggacgcaagggaggcaugcaggcggacuuggcaaagaauuuucuagaaguuaucgauuacgcuacucccgggauggccggcguuggaugggcuggaaagaccgguggggacaggaagugauaucagggaacgaggacccguag

SEQ ID NO: 13090 - RNA, 2631 nt, Artificial Sequence
  Description of Artificial Sequence: Synthetic coding sequence
auggggccugaagcccucaguucacugcucuuacuguugcugguggcaagcggagaugcugauaugaagggccacuuugauccagcuaagugucgguaugcacugggaaugcaggaucgcacgaucccagacucagacaucuccgcaaguagcucuuggagcgauuccaccgcugcucgccacucccgacucgagaguuccgauggcgacggggcuuggugcccugcugggucugucuuuccaaaagaggaggaauaccuucaaguugaucugcagcgucuucaucugguugcccucgucggaacacaggggagacacgcgggggggcucgggaaggaauucucuagguccuauagacugagguacagcagagacggccggagauggaugggauggaaagaccgcuggggucaagaagugauuagugguaacgaagaucccgaggggguugugcucaaagaucucggcccaccuaugguggcuagacucguuagauuuuauccucgagccgauagagugaugucuguguguuuaagaguugagcuguauggaugucuuuggcgcgacggucuuuugaguuacacugcccccguuggucaaacuauguaucugagcgaggcugucuaucucaaugacuccacauaugacgggcacacugucgggggccugcaguacggcggcuuaggacaacuagcugacggcguaguggggcucgacgacuucagaaagagccaagaauugaggguguggcccggguacgauuacguaggcuggucuaaccacaguuuuagcucagguuacgucgagauggaguuugaguuugacagacugcgcgccuuucaagccaugcaggugcauugcaacaauaugcauacccucggugcacgauugccuggcgguguggagugucgguuucguaggggaccugccauggcaugggaaggagaacccaugcggcauaaucucggagggaaccugggggauccucgagcccgcgcuguaagcguaccucucggaggacggguggccagauucuugcagugcagauucuuguucgccggacccuggcuacuguuuuccgaaaucucuuucauaucugacguggucaacaauucuucucccgccuugggcgguacuuuucccccugcuccaugguggccucccggcccgcccccuaccaacuucuccaguuuggagcucgagccacggggacagcagccgguggccaaagccgaaggaagcccgacagccauccugaucggcugccugguggccaucauucuguugcugcugcuuaucauugcacugauguuguggcgccugcacuggcggcgccugcucaguaaggccgagcgucgagugcucgaggaggagcugacagugcaccugucagugcccggcgacacuaucuugaucaacaaucgccccggucccagggaacccccaccuuaucaggaaccuagacccagaggcaauccaccucauagugcgcccugugucccaaauggcucugccuauuccggagacuacauggagccugaaaaaccaggggcuccacugcugccccccccaccacaaaauucuguuccccacuaugcugaagcagacaucgucacuuugcaaggcgucacaggcgggaacaccuacgccgucccggcccucccgccaggagccgugggcgaugggccaccacggguggauuucccucggagcaggcucagauuuaaggagaaauugggcgaaggacaguucggcgagguccaucuaugcgagguggacucaccucaagaucugguuagucuggauuucccucucaacguacgcaaaggacacccucugcugguagccgucaaaauccucagaccugaugcgaccaagaaugccagaaacgacuuccucaaggagguaaagauaaugucacggcugaaagaucccaacaucauaagacugcucggcgucuguguccaagacgauccgcugugcaugauuacagacuauauggagaacggagaucuuaaucaguuccugagcgcccaccagcuugaagacaaggcugccgaaggugcacccggugacggccaggccgcacaggggccgacaaucuccuacccaaugcugcuucacguggccgcacaaaucgcuucugggaugagauaccuggcaacgcugaauuucgugcacagggaucuggcuacuagaaauugccuugugggugaaaacuucacaauuaagaucgccgacuuuggaaugucucggaaccuuuaugcgggcgauuacuaucgaguucagggacgcgcggugcuuccuauccgguggauggcaugggagugcauuuugauggggaaguuuacuacagcuagugaugugugggcuuucggugucacuuugugggagguuuugaugcucuguagagcccaaccauucggacaacuuaccgacgaacaaguaauagagaaugcaggagaauucuuuagggaccaggggcggcagguguaucugucucggccccccgccugcccgcaaggucucuaugaacuaauguugaggugcugguccagggaguccgagcaacggcccccuuuuagucagcuccaucguuuucuggccgaggacgccuugaauaccguuuag

SEQ ID NO: 13091 - RNA, 1749 nt, Artificial Sequence
  Description of Artificial Sequence: Synthetic coding sequence
auggauuuccuccuugcccucguucuugugucaucucucuaccugcaggccgcagcggaauuugauggcagauggccucgacaaauugugucuucgauuggcuugugcagguauggcggccggauagacuguuguugggggugggcucggcagucuuggggccagugccaaccauuuuauguacuccggcagcguauagcuagaaucaggugucagcugaaggcagucugucagccaagauguaagcacggggaguguauuggucccaauaaaugcaaaugucauccuggcuaugccggcaaaaccugcaaucaggaccucaaugaaugcggguuaaaaccucggccaugcaagcaccgauguaugaacaccuauggaucauauaagugcuacugucuuaacggguauaugcuuaugcccgacggcuccugcucuagcgccuugacaugcuccauggccaacugucaguacgguugcgauguggucaagggucagauccguugccagugccccaguccuggcuuacaguuagcuccugacggccgcacauguguagauguggaugaaugcgcuacaggcagagcuucuugcccacgauuucgucaaugcgucaacacuuuugguuccuauauuugcaagugccauaagggauucgaucuuauguacauugggggcaaauaccagugccaugauaucgaugaauguucacuuggacaguaccaaugcuccagcuuugcgcgcugcuauaacauaaggggcaguuacaagugcaaguguaaagagggcuaccagggcgacgguuugacaugugucuacauuccaaaagugaugauagagccuuccggccccauucauguaccaaagggcaauggaacuaucuugaaaggagauacugguaacaauaauuggauaccagacguuggcagcaccugguggccaccuaaaacaccuuauauucccccaauuauuacaaaccgcccgaccuccaaaccuacuacgagaccaacuccgaagccgacuccaauccccacucccccacccccuccaccuuugccuacagaacuaagaaccccucucccuccaacuacgcccgagcggccaacgacuggacucacaacaauugcccccgcagcauccacacccccuggugggauuacgguggauaauagggugcagacugacccccaaaaaccccgcggagacguguucauuccccggcagccaaguaaugauuuguucgagaucuuugaaauugagagaggaguguccgcugacgaugaagcuaaagacgaccccggcguauugguccacagcugcaacuuugaucacggcuuguguggcuggauccgggaaaaagauaaugaucugcacugggaaccuaucagagacccugccggcggacaguaccuaaccguuuccgcugccaaagccccugguggaaaggcagcccgcuugguucucccgcugggacgcuuaaugcauucaggagaccucugccucucuuuccgucacaaagucacaggguuacacucuggcacccuacaaguguuugugcggaagcacggggcccauggagcugcacucuggggcagaaacggcggccacggcuggagacagacucagauuaccuuacggggcgccgacaucaagucuguggucuuuaagggggaaaaacgcagaggucauaccggcgagauuggccuggacgaugugucccugaagaagggccauuguagugaagaaagguag

SEQ ID NO: 13092 - RNA, 1602 nt, Artificial Sequence
  Description of Artificial Sequence: Synthetic coding sequence
augggcaguucucgcuuggcggcucuucugcucccacugcuccugauuguuauagaccuguccgacuccgccggcauaggguuccggcaccugccacacuggaauacccgcugcccucucgccagccacacagaugacuccuucacaggcagcuccgcauacaucccuugccggacuuggugggcacuguucuccacgaaaccaugguguguccggguguggcacuguucaagaugucucugccaacaccuccugucuggcggcuccggacugcaacgcggucuguuccaucuucugguacagaaaucuaagaaaucuaguacuuuuaaauuuuauagacgccacaagaugcccgccccggcccagcgcaaguuauugccacguagacaucucuccgagaagucgcaucauaucaguauaccaagcccagauaucucacacaaaggucugcgguccaagcgcacacagccuagugacccugagacaugggaauccuugccaaggcuugauucucagcgacauggcgggccagaguucucuuucgaccugcucccagaggcacgagcgaucagggugacaaucaguagcggccccgagguuagcgugaggcuaugccaccagugggcguuggagugugaagagcugucuucuccauacgacgugcagaaaauaguguccggcggccacacagucgaacugccauaugaguuuuugcugccaugucugugcauugaagccucauauuuacaagaggacaccguuagacguaaaaagugcccguuccaguccuggccugaggccuacggcucugauuuuuggaaaaguguucacuuuacggauuacucccagcacacucagaugguuauggcucugacauuaaggugcccacugaaguuagaggcggcucugugccaaaggcaugauuggcacacccugugcaaggaccuucccaacgcaacugcacgcgaguccgauggcugguacgugcucgagaaggucgaucuacacccucaauuguguuucaaguuuuccuucggcaauagcucgcaugucgaguguccccaccaaaccggcucacuuacaucauggaacguguccauggacacacaggcacagcaguugauuuugcacuucagcucucggaugcacgcaacguuuucugcugcauggucacugccaggucugggccaggauacacuugugccuccugucuauacuguuucccaggcccgaggaaguuccccugugucucuggaucugaucauacccuuucuucggccagggugcuguguccuucuccacgccucauuaucuagucccggcggugaggacgcauggcuuauagguguggguggaagugucccaagcggcguggcuguacgguguccagugugccuugaagcccccuuagucuccgguugccugcugcagaccccuggggcccucgauccuggcacagccgguccaccacaucccaccgggugcugcucuggaccucauuuaccagcgccaacuguaaggccuggacccucugcugccagcgcucccccugcgagaggaggccuaggcggagccgccgcccccggcggaagcgccggcuag

SEQ ID NO: 13093 - RNA, 1293 nt, Artificial Sequence
  Description of Artificial Sequence: Synthetic coding sequence
augggggugucuaaacuggauauccuuuaucggcgccugcucuugacaaaguuauucauacgcgggugggggcgcccugaagaccucaagagacuguuugaauuucgcaagaugauuggcaacagggaaaggugccagaauuuagucucuuccgacuaccccgugcauaucgacaaaauugaagagcaaagcgacugcaagauucuggauggacauuuugugucuccaauggcccacuacguuccagacaucaugcccauugaaucugugauugcucgcuuccaguuuaucgucccuaaagaauggaacucaaaauaccgaccugucugcauucaucuggcaggcaccggcgaccaucacuacuggagaaggagaacccugauggcucggcccaugauuaaagaggcuagaauggccagucuacuucuugagaauccuuacuacgggugccgcaaacccaaggaccagguuaggucaucguugaagaacgucucugaucuuuucguuauggggggggccuugguguuggaaucagcagcauugcuccacuggcuugagcgcgaaggauauggaccacuaggcaugaccgguauuuccaugggcggucacauggcaagccuggccgugaguaauuggcccaagccuaugccgcuuauucccugccucuccuggucaaccgcauccgggguguuuaccaccaccgacaguuucaaaaugggccaggaguuuguuaagcacuuuacuaguagcgccgacaagcugaccaaucugaauuuagucucucguacucugaaccucgauauuuccaaccagguaguaucucagaagccagccgauugucauaauucuucaaagacgagcguuuccgccaccucugagggccugcugcuacaggacacuucuaaaaugaagagauucaaucagacacuguccacgaacaagagcggauauacaucuaggaacccacagucguaccacuuauugucaaaagagcaaucccgcaauucccugcgaaaggagucccugaucuucaugaagggagugauggacgaauguacccaugucgcuaauuucagcguaccaguggacccaucauugauuauugugguucaggccaaggaggacgccuauauaccacgaacaggcguacggucacugcaagaaaucuggccaggaugugaaaucagauaccuggagggaggucacaucucggcuuacuuguucaagcagggauuauuuagacaggccaucuacgacgccuucgaucgcuuccuucacaaauaugcuaauuag

SEQ ID NO: 13094 - RNA, 2631 nt, Artificial Sequence
  Description of Artificial Sequence: Synthetic coding sequence
auggggccugaggcucucucgucucugcugcugcugcuguugguggcaucuggcgacgcagacaugaaaggacauuucgaccccgcgaaaugccguuacgcucuuggcaugcaggaucggacaaucccugauagugauauuucggccagcuccucuuggucugacaguacugccgcuagacacucucgacuugagucuuccgauggggacggugccuggugccccgccgguucuguguuuccuaaggaggaagaguaccugcagguggacuugcagagacugcaccuuguugcacugguaggcacccaagggaggcaugccggaggccuuggcaaggaguuuucaagaucuuauagacuucgguacagucgcgacggcagacgguggaugggguggaaagaucgguggggccaggaggucaucucugguaacgaagaucccgaaggcgucgugcucaaggaucucggcccaccgaugguggcacggcuugugagauuuuacccccgggcagauagagucaugagugucuguuugcgaguagaacucuauggaugucuguggcgggacggauuacucaguuacacagcgcccgucggccagaccauguaucugucugaggccgucuauuuaaaugauucuacauaugacggacauacugugggggggcugcaauaugggggguuggggcagcucgcugauggcgugguggggcuggacgauuucagaaagucucaggagcugagaguguggccuggauacgauuacguggguuggucaaaucacagcuuuaguagcggcuauguugaaauggaguucgaauucgacagguugagggcuuuccaggcuaugcaggugcauugcaauaauaugcauacacugggcgcuagauugcccggcggcguggaguguagguuucgccggggucccgcaauggcuugggaaggggagccaaugagacauaaucucggcggaaauuugggagaucccagggcuagagccgugucugugcccuugggugguagaguugcacgguuucuccaaugucguuuccucuucgcuggaccauggcugcuguuuucagaaaucucauucauaucggauguugucaacaacaguucuccugcucuuggggggaccuucccuccagcccccugguggccgccaggcccuccaccuacaaauuuuagcucccuggaguuggaacccagaggccagcaaccuguggccaaggccgaaggcuccccgaccgcuauccugauuggcugccuaguagcaauuauucugcugcuccuguugaucaucgcuuugaugcuguggagacugcacuggcgucgccuccuaagcaaggcagagaggcguguauuagaggaggaauugaccguacaccuuucagucccaggggacacuauccugaucaacaaccgcccuggcccgagagagccuccuccuuaucaagagccacguccgagagggaauccaccgcauucagcacccugcgucccaaaugguagcgccuacucaggagacuacauggaaccagagaagccaggggcaccccuccucccuccgccaccacagaauucagugccucauuaugcagaggcagauaucguuacacugcagggagugaccggcggcaacaccuacgcaguacccgcgcucccaccgggugcagugggcgacggccccccucgcguggacuucccaaggagucggcuaagguuuaaagagaaguugggcgaaggccaguucggagagguccaucugugcgagguggacucuccccaggaccuggugucauuggacuucccucuaaauguuaggaaagggcacccucuacucguagccgucaaaauccuucguccagacgcaacuaaaaaugcaagaaaugauuuuuuaaaagaggucaagaucauguccaggcucaaagauccuaacaucauucggcuucuggggguuugcguacaggacgacccucuuugcaugauaaccgacuauauggagaacggagaccugaaucaguuccugucugcucaccagcuugaagauaaggcugcugagggugcuccaggagacggacaagccgcccagggucccacaauuagcuauccaauguuacuucacgucgccgcucagauagcgucugggaugagauauuuggcaacccuuaauuuugugcacagagaucuugcuacaagaaauugccuggugggugagaacuucacuauuaagaucgccgauuucgggaugagucgcaaucucuacgccggcgacuacuaucgaguacaaggcagggcgguccugcccauaagauggauggcaugggaguguauccugauggggaaauuuaccaccgcuuccgaugugugggcuuucggggugacacugugggaagugcuuauguuguguagagcccaaccauucgggcaguugacugacgagcaggucaucgagaaugcgggugaauucuucagagaccagggccgacagguguaucucucaaggcccccggcuuguccccagggcuuauaugaauugaugcuuaggugcuggaguagagaguccgagcagaggcccccguuuagccagcugcaccgcuuccuggccgaagaugcgcugaauacaguauag

SEQ ID NO: 13095 - RNA, 237 nt, Artificial Sequence
  Description of Artificial Sequence: Synthetic coding sequence
augggcagcggccucccgcuaguacuccugcugacccuccuagguagcagucauggcaccgggccuggcaugacacuccagcuuaaacuuaaggaaaguuuucugacuaauuccuccuaugaaucuagcuuccuugaacuacuggagaagcucugucugcuccuccaccuuccaucagguacguccguaacauuacaucacgcucgaagccagcaccacgugguuuguaauacuuag

SEQ ID NO: 13096 - RNA, 2631 nt, Artificial Sequence
  Description of Artificial Sequence: Synthetic coding sequence
auggguccggaggcacugucgucccugcuccugcuucucuugguggccagcggcgacgcugacaugaagggccauuuugauccagccaagugucgguaugcacuaggaaugcaggaccgcacuaucccggauagugauauuuccgcuucaucaaguuggucagacuccacagccgcucggcacucaagacuugagucuagugacggggauggggcaugguguccugccggaucaguguuucccaaggaggaggaguaucugcagguugaucugcagcgguugcaucucguggcucuuguagggacacaaggcagacaugcugggggccuuggcaaggaauucucacgauccuaucgacugcgcuacucaagagacggcagacgcuggaugggcuggaaggauagguggggacaggaagucaucaguggaaacgaggauccagagggugugguucucaaggaucucgggccacccauggucgcuaggcucgugcgauucuauccgagagcugauagggugaugucugucugccugagaguagaacuguacgguugucuguggcgugacggcuuacuuuccuauacggccccugugggacaaacgauguaucucagugaagccguguaucuuaaugacaguacuuaugacggacacacagucgggggacuccaguacggcggccugggccagcuugccgacgggguagugggccucgacgauuuccggaagucccaggagcugcggguguggccuggcuaugauuacgucggcuggagcaaucauuccuuuagcagcgguuaugucgaaauggaauucgaguuugaucgguugagggccuuccaggcaaugcagguacacugcaacaacaugcacacuuuaggugcuagauuaccaggaggcguugaaugccgguucaggcgcgguccugccauggcgugggagggggagccaaugcgccauaaccuuggcggaaauuugggcgacccuagagcucgagccgugucuguccccuugggcggacgcguggcucgauuucugcagugccgauuccucuuugccggaccuuggcuucucuuuucugaaauuuccuucauuucugauguggucaacaacucuucaccugcucucggcgggaccuuccccccagcacccugguggccacccggaccccccccuaccaacuucucuagucuggaguuagagccucggggucagcaacccgucgcuaaggccgaaggguccccgacagcuauucucaucggcugucugguagccaucauucuccuucugcuccugauaauagcuuugaugcuguggcgccuucauuggagaagacuccuguccaaagcggagcgucguguccuggaagaagaacucacuguacaucuuagcgugccuggggauacaauccuaaucaauaacagaccuggcccuagagaaccaccccccuaccaggagccccguccccgcgguaaucccccucauagcgcccccugcguucccaaugguagcgcauacagcggagauuacauggagccagagaaaccaggugcuccucuccugccuccuccaccacaaaauuccguuccacacuaugcagaagcagauaucguuacccugcagggcgugacagggggcaauacuuaugccguucccgccuugccaccuggagcagugggggauggaccacccaggguggacuuuccuagaucucgucuuagauuuaaagaaaaacucggugaaggccaguuuggcgaaguucaccuuugugaagucgacagcccccaggaucuggucagccuggauuucccacucaacgugaggaaagggcacccccucuugguggccgugaagauccugcggccagaugccacuaaaaaugcgcgaaaugauuuucuuaaggagguaaagauuaugagcagacugaaggauccaaauaucauuaggcugcugggcguaugcgugcaggaugaccccuugugcaugauuacagacuauauggagaacggcgaucugaaccaauuccuguccgcucaucagcuggaggacaaggcugccgaaggagcgccgggugacgggcaagccgcucaagggcccacgaucagcuaucccaugcuacuucacguagcugcccagaucgcgaguggcaugcgcuaccucgcaaccuugaacuuuguccauagggacuuggccacccggaauugccuggucggagagaacuucacgauuaagauugccgauuucggaaugucccgcaacuuguacgccggggauuauuaucgcguucagggcagggccgugcugccaauuagauggauggccugggaguguauccugaugggaaaguuuaccacugccucugaugucugggcauuuggggugacgcugugggaaguucuaaugcuuugucgggcacagccauucggccaacugacagacgagcaggucaucgaaaacgccggggaauucuucagggaccaggggagacagguguaccugagcagacccccugccuguccacaagggcucuaugagcugauguugcgcugcuggagcagggaaucggaacagcgcccacccuucucccagcugcaccgcuuucucgccgaggacgcgcuuaacacaguauag

SEQ ID NO: 13097 - RNA, 1257 nt, Artificial Sequence
  Description of Artificial Sequence: Synthetic coding sequence
augcguacauuauucaaucugcuguggcuugcgcuggccugcagucccguucacaccacucugaguaagucugacgccaagaaagccgcuagcaagacacuguuggagaagguaaaauucugcaguugcugcccuggaugguccgcgauggcccguuccuggcugacugcuaccagcgcgacccaaagccaguuuagcgacaagcccgugcaagauagaggauuggucgugacugaccuuaaagccgagucaguaguucuugagcacaggucauacugcuccgcaaaagcccgugaccggcacuucgcaggcgauguccucggcuaugugacgccuuggaauagccacggguacgacgugaccaaaguguuuggauccaaguucacacagauuucgccaguaugguugcagcuuaaaagacgcgggagagagauguuugagguuacuggacuacacgacguagaccagggcuggaugcgcgcaguccgcaagcacgcuaagggguugcacaucguaccacgacuccucuuugaggacuggacuuacgaugacuuucgcaacguccuggauuccgaagacgaaaucgaagaguuaagcaagacagucgugcaggucgcaaaaaaccaacauuuugauggguuugugguagaggucuggaaccaacuguuaucucagaagcgcguuggccugauucacauguuaacacaucuggccgaggcauuacaccaggcucguuugcuggcauuacucgugaucccuccagcaauuacccccggcaccgaucagcuggguauguucacucauaaagaguuugagcaguuagcacccgugcuugauggcuucucauuaaugacauacgauuauucuacggcacaccaaccagguccaaaugcgccccugucuuggguuagagcguguguccaaguguuggacccuaaaagcaaguggagaucaaaaauccugcugggacuuaacuucuauggcauggacuaugcuacuucuaaggacgcccgggaacccgucgugggugcucgguacauccagacucuaaaagaccauaggccuaggauggugugggauucacaggcgucagaacacuucuuugaguauaagaaaagccgcagcggcaggcauguugucuuuuacccaacccugaaguccuugcaaguccgacuggagcuggcucgggaacucggaguaggaguguccaucugggaacuugggcaaggccucgacuacuuuuacgaccuucuguag

SEQ ID NO: 13098 - RNA, 390 nt, Artificial Sequence
  Description of Artificial Sequence: Synthetic coding sequence
augcgcaaaccccgaagaaaauccaggcagaaugccgagggaagacgcucaccuagccccuauucucucaaaugcucuccuacgagagaaacacuaacauacgcucaggcccaaaggauuguggaaguggacaucgauggccgccugcauaggauaaguauuuacgacccguugaaaaucaucaccgaggacgagcucacagcucaggauaucacugaaugcaauagcaauaaagagaauucagaacagccucaguucccaggaaagucuaaaaagccuuccucaaaaggcaaaaagaaggaaaguugcucaaagcacgccuccggaacuucauuccaccucccccagcccucauuccgcaugguugauucaggcauacagccagaguag

SEQ ID NO: 13099 - RNA, 315 nt, Artificial Sequence
  Description of Artificial Sequence: Synthetic coding sequence
augcgaguagugacuauagucauccuccugugcuuuugcaaagcagcagaauuaagaaaagcuagccccgguagcgugcgaucucgaguaaaucauggacgggccggugggggaaggaggggaucaaauccagugaaacgauaugcucccggacugcccugcgacguuuauacguaccuccacgagaaguaccucgauugccaggaacggaaacuaguauauguguuaccaggguggccccaggaccuacugcacaugcuccuugccagaaauaagaucaggacacucaagaauaauauguucagcaaguucuag

SEQ ID NO: 13100 - RNA, 639 nt, Artificial Sequence
  Description of Artificial Sequence: Synthetic coding sequence
gauuuuggcuauugcccccgggucuauugcgagaaucagccuaugcugcccauaggcgugcuggugauggucggauuuacagugggcaagguccccgugccugacaucagaacaugccacuucugcuuaguggaagauccuucaguugguuguauuuccggaagcgagaaguguaccaucaguuccucaagccucuguauggugaucacgaucuauuaugacgucaaaguccgcuucauaguccgagggugcggccaguauauuucuuaucguugucaagaaaaaagaaacaccuauuuugccgaauacugguaccaagcacaauguugucaguaugacuacugcaauucguggucuaguccucagcugcagucaucacuccccgaaccccaugauaggccccuugcccuuccacuguccgacucucagauucagugguucuaccaggcuuuaaaccuuagccugccacugccuaacuuucacgcuggaacugagcccgauggccucgauccuauggucacccugucccuuaaccucggucucuccuuugccgagcugcggcgaauguaucuuuuucugaauucaucaggucuuuuagugcugccucaagcugggcuguugacuccacauccaucauag

SEQ ID NO: 13101 - RNA, 1005 nt, Artificial Sequence
  Description of Artificial Sequence: Synthetic coding sequence
augcucgcucuugccaaaauuuuacugauuucuacccuguuuuauuccuuguugagugggagucauggaaaagaaaaucaagacaucaauaccacccagaacaucgcugaagucuucaaaacuauggaaaacaagccuauuaguuuggaaucugaagcaaauuugaauucugauaaggagaauauaaccacuaguaaucucaaagcuagucauuccccuccacuuaacuugccuaauaacucucauggaaucacagauuuuagcagcaacagcuccgcggagcacucccucgggagccucaaacccacuucuaccauuucaaccucuccgccacuuauccacucuuuugugagcaaggucccauggaaugcgccaauugcagaugaagaucucuuacccauaagcgcucauccuaacgccacuccagcucuuucgagugaaaacuuuaccuggagcuuagugaaugauacagucaaaacacccgacaauagcagcaucacagucucaauucugagcagcgagcccaccagcccuuccgugacuccucucauugucgaacccucuggcuggcugaccaccaacuccgacucuuucacuggcuucacaccguaccaagagaagacaaccuuacaacccacauugaaauucacaaauaacucuaaacuuuuuccuaauacgucugauccucagaaggagaauaggaauaccgguaucguauuuggggccauucuuggagcaauacucgguguuucauugcucacuuuagucggcuaucugcugugcggcaagagaaagacagacucuuucucacacagaagguuauacgaugaucgcaaugagccaguguugcggcuggauaacgcaccugaaccuuaugauguguccuuuggaaacucaaguuauuacaaccccacgcuaaaugacuccgcaaugccugagagugaagaaaacgcccgcgacggaaucccaauggaugauauuccuccucugcguacaaguguguag

SEQ ID NO: 13102 - RNA, 987 nt, Artificial Sequence
  Description of Artificial Sequence: Synthetic coding sequence
auggggccugcgggcugcgcauucacucugcuacuucucuugggcauaagcguguguggacagcccgucuauucuuccagagucguaggcggacaggacgcugcggcuggcagguggccguggcaagugucacugcacuucgaucacaauuuuauuugcggcgggucucuaguguccgaaagacuuauuuugacggcugcacacugcauacagcccacauggaccacuuucucguacaccgucugguugggcucuauuaccguuggagacucccgaaaacgcgugaaguauuacguauccaagaucguuauucaucccaaauaucaggacacaacugcugauguggcucugcuuaaacugagcucucaggucacguucacuagugcuauacugccgauuugucucccuuccgucacaaagcagcuugcaauuccccccuucuguuggguuacuggguggggaaaagugaaagaaucaagugacagagacuaucauagcgcccuccaggaagcggaagugccgauaauugaucgacaggcuugugaacaguuauacaaccccaucggcauauuuuuaccagcccucgaaccaguaaucaaagaggacaaaaucugugcaggggacacccagaacaugaaggauuccuguaagggagauucuggcgggccuuugagcugccacauugacggaguguggauucagacaggcguggugagcuggggucuugaguguggcaagagucuucccggggucuacacgaacgugaucuauuaccagaaauggauuaaugcgacaauuucuagggccaacaaucuggacuuuuccgacuuccuguuccccaucguguuacugagccucgcucuacucaggcccucaugugcauuuggcccuaauaccauucaccgggucgguacagucgcagaggcuguggcaugcauucaaggaugggaagaaaacgcauggcgguuuucuccccggggaagauag

SEQ ID NO: 13103 - RNA, 453 nt, Artificial Sequence
  Description of Artificial Sequence: Synthetic coding sequence
augcgcuuuauggccggccccgccgggucccaaagcuuagguccccucuguuuucauucuaguccccaggcacuguauaccgugcugcugauugugcucguuaugaugucacugguguucggaaaguuugugccagucaauugggagccuccccagccucugcccuucccaaaauaccuucgcuguuaucgcugucugcuggagacaaaagaacuuggcugccuccuuggcagcgacauuugccugacccccgccggaucaagcugcauuacucuccacaagaagaauuccucuggcuccgaugucaugguaucggauugucgaucuaaagaacaaaugucagauuguucgaacacaaggacuucuccugugagcggguuuuggauuuuuucucaauauugcuuucuggauuuuugcaaugacccgcaaaacaggggucuauauacacccuag

SEQ ID NO: 13104 - RNA, 234 nt, Artificial Sequence
  Description of Artificial Sequence: Synthetic coding sequence
augcgagucgccggcgccgcuaagcugguugucgcuguggcugucuuccuucugacauuuuacgugauuucacaaguauuugagauuaagauggaugcuagcuugggaaauuuauuugcuaggagugcccuugacacugcugcccguucaacuaagcccccucguuacaagugcggcaucaguaaagccugucccgaaaagcauuuugccuucaagauggccaguggggccuag

SEQ ID NO: 13105 - RNA, 1143 nt, Artificial Sequence
  Description of Artificial Sequence: Synthetic coding sequence
auggcucugacgccaggauggggauccuccgccgguccaguccgccccgagcuguggcugcuacuuugggccgccgcuuggcgucucggcgcaagugccuguccagcucuuugcacauguacagggacuaccgucgauugucacgggacaggccuccaggcaauaccuaaaaacauuccuaggaacacugagagacuggagcugaauggcaacaacauuaccagaauccauaaaaacgauuucgcagggcuuaaacagcuccgcgucuuacaacugauggagaaccaaaucggagcaguagaacgcggagcuuucgacgauaugaaagaacucgaacgguuagaccucuccgagaaugcaauccaagcaauacccaggaaggcuuuucguggggcgaccgaucucaagaacuuacagcuagacaaaaaucaaaucagcuguauugaggaaggcgccuuucgagccuuaagaggccuugaaguccugacacugaacaauaacaacaucacgacaaucccaguaucuagcuucaaucacaugccaaagcuucgaaccuucagacuccacagcaaccaccuguuuugugacugccaucucgcauggcuuucgcaguggcuucgucagaggccuacuaucggacuauuuacccaauguuccggccccgcaagucucaggggacuuaaugucgcagaaguacagaaaucagaguuuagcugcucaggacagggcgaagcagggcgcguccccacaugcacccuguccuccgguuccugcccugcuauguguacgugcucuaacggcauuguggacugucgaggcaaaggacucacagcuauaccagcuaacuuaccugaaaccaugacugaaaucagacuggaacucaauggaaucaagagcauuccaccuggcgcauucucaccguauaggaagcugaggcgcauagaccugucuaacaaccagaucgcagagauugcccccgaugccuuucagggcuuaaggucauuaaacucuuugguacuuuacgguaauaagauuaccgaucugcccaggggcguguuuggcggacuguauacucugcagcuccuacugcuuaaugcuaacaagauuaacuguauaagaccggaugccuuccaagaucuguag

SEQ ID NO: 13106 - RNA, 558 nt, Artificial Sequence
  Description of Artificial Sequence: Synthetic coding sequence
augcccggcugguuaacgcuccccacuuuaugcagauuucugcuuugggcguucacuauuuuccacaaggcucaaggagaccccgcaagccauccaggcccacacuacuuacugccacccauccaugaaguuauacauucucauagaggugcaaccgcgacccugccuuguguccugggaaccacuccgccaucuuacaaggugcgcuggaguaaggucgagccaggcgagcugagagagacacugauuuuaauaaccaacggccuacaugcccgcggauaugggccauugggcggacgugcacggaugcggcgggggcaucgucuagacgcaucauuagugaucgcuggggugaggcuagaggacgaaggcagauacagaugugagcugaucaauggcauagaagaugaaucuguugcgcucacccuuucacuugaaggugucgucuuuccauaccaacccucucgcggaagauaccaguucaauuacuaugaagcgaagcaggcaugcgaagaacaggauggacgucucgccaccuauagccaauuguaccaguag

SEQ ID NO: 13107 - RNA, 375 nt, Artificial Sequence
  Description of Artificial Sequence: Synthetic coding sequence
augcuuaugcuauucguguuuggcguacugcugcacgaaguuaguuugagcggucaaaacgaggccccaccaaauacucauagcauccccggagagccacucuacaacuacgcauccauucgucucccugaagagcacaucccuuuuuuccugcauaauaaccggcauauugcgacugucugccguaaagacucgcuuugucccuacaagaaacaucuugagaaacugaaguacuguuggggauaugaaaagaguugcaaaccugaauuccguuuuggauaccccgugugcucauacgucgauauggguuggacagacacacuugagucagccgaggauauauuuuggaagcaggcagauuucggcuacgccuag

SEQ ID NO: 13108 - RNA, 5859 nt, Artificial Sequence
  Description of Artificial Sequence: Synthetic coding sequence
augccagcucuggggcccgcacuacugcaggcacucugggccggaugggugcucacucuccagccgcuacccccaaccgcauucacuccaaaugggacguaucuucagcaccucgcuagagaucccacaagcggaacccuguacuugggcgcaacaaacuuucuguuccaacuuucccccggauugcagcucgaagcaacagugucaacaggaccgguacuggauucuagagauugcuugccuccugugaugccggacgaguguccccaggcccaaccuacgaauaaucccaaccaguuacugcucgugucuccaggcgccuuaguaguauguggaagcguccaccaaggggucugcgagcaaagaagacuggggcagcuggagcagcuccugcugcgcccugagcgcccuggugacacucaguacguugcagcgaaugacccugcugugucaacagucggccuggucgcccagggacuugcgggcgaaccacugcuguucgugggucgcgguuacacauccaggggaguuggaggggguauuccuccaaucaccacgagagcacucuggccgccagacccacaagccgccuucuccuaugaagagacagcuaagcuggcggugggcagacucucugaguauagccaccacuuugugucggcauucgcccgaggugcuuccgcauauuuccuuuuccugcgccgcgaccugcaagcccaauccagagccuuccgagccuaugugucuagggugugccuccgcgaucagcacuacuacagcuacgucgaacuaccacuggccugugagggaggacguuacggccugauucaggccgcugccgucgcuacuucucgcgaaguggcccacggggaaguccuguucgccgcuuuuagcucagccgcuccacccacugucggucggccucccucggcagcugccggagcuagcggggcuagcgcacugugcgcuuuuccauuagacgaaguugaucgccucgcaaaucguacacgggacgcaugcuacacuagagagggccgggccgaggacgguaccgaaguggcauacaucgaguacgacgugaacagugacugugcccagcuaccaguagacacucuugaugcuuauccuuguggauccgaccacacaccaucccccauggccaguagagugccccuggaagccaccccaaucuuagaguggccugggauccagcugacagcagucgccgugacaauggaagauggucacacaaucgcuuuuuugggagacucucagggccagcuucacagaguguaucuggggccugguucggaugggcauccauauaguacccagucaauucagcaggggucagcugugagucgcgaucucacuuuugacgggaccuucgagcaccuuuacgugaugacacaguccacuuuguuaaaagucccuguggccaguugugcucagcacuuagacugugccucuugucucgcccaucgggacccuuauugcggcuggugcguucugcucggaaggugcagcaggcgcagcgagugcucucgaggccaggguccugaacaguggcugugguccuuucagccugaacugggaugccuccagguggccgccaugucuccugcgaauaucucacgggaggaaacacgcgaaguguuucucagcgugccggaccuucccccacuguggccuggcgaaaguuacucuugucacuuuggcgagcaucaaagccccgcucuucugacuggaagugguguuaugugucccucucccgauccaagugaagccccuguauugccccgcggcgccgauuacguaagugugaguguugagcucagguuuggggcagucgucaucgcaaaaacaagccugaguuucuacgauugcgucgcagugaccgagcugagaccgagcgcccagugccaggcuugcgugagcucuagauggggcuguaauugguguguguggcagcaccucuguacacauaaggcuaguugcgaugcaggccccaugguugcaucucaucaaagcccauuggucucuccagaucccccagcaaggggggauggagacuccgccgagcuggagggaccucccgcgccacucauccugcccaguagccuggacuaccaguacgauacuccaggccuaugggaauuggaggaggcuacacugggcgcauccucaugccccugcguggaaucggugcagggauccacuuugaugcccguccacguggagagagagauuagacuuuuggggagaaauuugcaucucuuccaggauggcccaggagauaacgagugcgugauggagcucgaaggacucgaggugguagucgaagcaaggguagagugcgaaccucccccagauacacaaugucaugucacgugccagcagcaucaacucucauaugaagcgcuccaaccggagcucaggguggggcuguuuuugagacgggcgggucgucugcgaguugauuccgccgaaggacuccacguuguccucuaugauugcucugugggccacggagauugcucuagaugucaaacagccaugccacaguacggguguguauggugcgagggugagagaccucgaugcguaacacgagaggcauguggggaagcggaggcaguggccacacagugcccagccccacuaauucacagcguugaaccccugacagggcccguggacgguggaacuaggguuacuauuagggggaguaaccuuggucaacaugugcaggaugugcugggcauggugaccguugcugguguucccugugcagucgacgcccaggaauacgaagugucauccagucuugucuguaucacgggugccucaggcgaagaggucgcuggcgcaaccgcgguggaggugccuggacgggggcggggcgugagugagcaugauuucgccuaccaggaucccaaaguccacaguauuuuuccagccagagggccacgagcaggugggaccagacugacucugaacgggaguaagcuccuuacaggucggcucgaagauauuagaguagugguaggggaucagccaugucaccugcugcccgagcagcagucagaacagcugcgaugcgagaccagcccccgccccacacccgcaacccugccaguggccgugugguuuggagcuacagagagaaggcuccagcgcggacaguucaaauauacgcuagacccgaacaucaccucugcuggucccaccaaguccuuccugucuggcggccgggagauuugcgugcgcgggcagaacuuagaugugguucaaacgcccaggauccgggugacugucgucucaaggaugcugcaaccaucacaggguuugggaagacgacgucgaguuguuccagaaacagcaugcaguuugggcccuucuugcagcucucaacaauuugaagagcccugccacguaaauuccagucagcugauaacaugucggacaccagcucugccuggacuucccgaagacccaugggugcguguggaguucauacuggauaaucugguauuugacuucgcaacauugaaccccacccccuucucuuacgaagccgaccccacccugcagcccuuaaacccugaggaucccacaaugcccuucagacacaagccugggagcgucuuuucaguugaaggggagaacuuagauuuggccaugagcaaggaagaagugguggcaaugaucggcgauggacccugcgucgugaagacccuuacgaggcaucaccucuauugcgaacccccugucgaacagccccugccaaggcaccacgcccuucgugaggcacccgauaguuugcccgaguucacuguucagaugggaaaccuccguuuuucuuugggccacguccaguaugauggagaaucuccaggagccuucccaguggcagcucaggugggccuggguguagggacuagucuucuggcccuuggugugauaauuauaguacugauguaccgaaggaaaucaaaacaggcucugcgcgacuacaagaaaguacaaauucagcuggagaaucuagaaagcagcgugcgcgaccgguguaaaaaggaguuuacagacuugaugacugagaugaccgaucugaccuccgaccuucucgggucaggaauucccuucuuggauuauaaaguuuaugcugagcgcaucuucuuuccaggccaucgggaguccccucugcacagggacuuggguguaccugaaagcaggcgcccuacuguggaacagggccugggacaacuuucuaaccuucuaaauagcaaacuguuucuaacuaaauucauccacacucuggagagccaacguaccuucucugccagggaucgcgcauacguagccucuuuacugacagucgcccugcauggaaagcuggaauacuucaccgauauucugaggacgcuccugagcgaucuagucgcucaguacguggccaagaaccccaagcugaugcugagaagaaccgagaccgugguggaaaaauugcugacuaauuggauguccaucugucucuacacguuugucagagacucugugggcgagccucuauacauguuauuuagaggcaucaagcaucagguggauaagggcccagucgauuccgugacagggaaagcuaaauauacacugaacgauaaucgccuacuacgagaggacguggaguauaggccucucacucuuaacgcccuucuggcuguaggacccggagccggcgaggcgcaaggagucccaguuaaaguacucgauugugacaccaucagucaggcgaaggagaaaaugcuugaccagcuguauaaagggguuccccugacgcagagaccagauccucggacacuggauguggaguggcgaucuggcgucgccggccacuugauauugagugaugaagaugucacaagugaagugcaaggccuguggcgaagacugaacacgcugcagcacuauaagguaccggacggcgcaacuguggcguuggucccgugucuuacuaagcaugugcuucgugaaaaucaggauuauguuccaggcgagagaacccccaugcuggaagacguggaugaaggggguauccggcccuggcacuugguuaaaccgagcgaugaacccgaacccccacgaccacgccggggcucccuccgcggaggugagcgagagagagcuaaagcuaucccagagaucuauuuaacccgcuugcuuuccaugaaaggcacacuccagaaguucguugaugaucuauuucaggugauucucuccaccagucguccugucccacuugccgucaaauacuucuuugaucuacuggacgagcaggcccagcagcacgggauuagugaccaggacacaauucauauuuggaagacuaauagccucccccucagguucuggaucaacaucauuaagaauccccaguuuguguucgaugugcagaccucagacaauauggaugccgugcuccuugugaucgcccagaccuuuauggaugccuguacuuuagccgaccauaaacuggggagggauucaccgauaaacaagcuucucuaugcucgcgacaucccucguuauaagcgaauggucgaaagguacuaugccgacaucaggcagaccgugccagccucugaucaagaaaugaacaguguccuugcugaacugucauggaacuauuccggagaccugggagcaagaguagcccuccaugaacucuacaaguacaucaauaaguauuaugaucagauuauuacagcccucgaggaagaugggacugcucagaagaugcaacuuggcuacaggcuacagcagaucgcggcugccguugaaaauaaagucaccgaucucuag

SEQ ID NO: 13109 - RNA, 612 nt, Artificial Sequence
  Description of Artificial Sequence: Synthetic coding sequence
augcgcaccgugguguuaacaaugaaggccagcgugaucgaaauguuuuuagugcuauuaguaacuggcguccacagcaauaaagaaacagcaaaaaaaaucaagaggcccaaguucaccgucccccaaauuaacugugaugucaaggccgggaagauaauugaccccgaguucauaguaaaguguccugcuggaugucaagauccuaaguaucacguguauggaaccgacgucuacgcaagcuauucuucgguauguggagcugccguucacucuggggucuuggauaauuccggugggaagauccucguacgcaagguugcuggacagagcggauauaaagggaguuauagcaacggcgugcagucucuuucguugcccagguggcgugaaaguuucaucgugcucgagaguaagccgaagaaaggggucaccuacccuagcgcucucaccuacaguucaucaaaguccccagcggcucaagccggcaaauguucccgcguuaucgaaucuaaaccuucugagaguaugaauacgcggcgcguacucggcgauagcggggaaauaaauauucugacaggucaggcuccacuggcucuggcaauuuuuuag

SEQ ID NO: 13110 - RNA, 2511 nt, Artificial Sequence
  Description of Artificial Sequence: Synthetic coding sequence
auggaaacucaagaacuccgcggugcuuuggcuuuacuguugcugugcuucuucacaucugccagucaggaccuucaagugauagacuuacuuacuguuggugaaucaaggcagaugguggcagucgcugaaaaaauuaggacagcacugcuaacugccggggauaucuaccugcuuuccaccuuuagauugccccccaaacagggcggagugcuguucggcuuauauagucgucaggauaauacacguugguuggaagccucagucgucgggaaaauuaauaaagugacaaacgcccugcacucaaucuugggcgagcagacuaaggcguuggugacccagcuuacacucuuuaaccagauccuggucgaacugagagaugauauccgugaccaggucaaggagaugucucugaucaggaauaccaucauggagugccaggugugcgguuuccaugaacagaggagccauugcucuccgaacccgugcuuccgcggagucgacugcauggaaguauaugaguacccaggguacagauguggcccuugcccccccggccugcaggggaacggaacucacuguucagauaucaaugagugugcucacgcggaucccugcuuuccgggcagcagcugcauaaauacaaugccgggauuccacugcgaagcaugucccaggggguacaagggaacacaagugagcgggguuggcauugacuacgcccgggcgaguaaacaggugugcaaugauaucgaugaguguaacgacgggaacaauggcggcugugauccaaacuccauuugcacgaauaccguuggcucuuucaagugcggacccugcagguugggcuuucugggcaaccagagccagggaugucuuccggcgcgcaccugucauucgccagcacauucuccuugucacauccacgcgcacugcuuguuugaaaggaauggcgcagucucuugccagugcaacguuggcugggccggcaauggcaacguaugcggcacagauacugauauagacggauacccagaccaggcacucccuugcauggacaauaacaaacauuguaagcaggacaauugccuuuuaacccccaacuccggacaggaagaugcugauaaugacggcgucggagaucagugugacgacgaugcugacggugauggcaucaaaaauguugaggacaacugucgacuuuucccgaauaaggaucaacagaacucagacaccgacuccuuuggagacgccugugauaacuguccuaacguuccaaacaaugaucaaaaggacacugacgguaacggcgaaggcgacgccugcgauaaugacgucgacggcgacgggaucccaaacggccucgacaauuguccuaagguuccuaauccauugcagaccgauagggaugaagacggcgugggggacgccugugacaguuguccggaaaugucuaacccuacccaaacagaugccgacagcgauuuggucggugauguaugcgacacaaaugaggacucugacggugaugggcaccaggauaccaaggacaauugcccacaguuaccgaacucgagccaacuagauucagauaacgauggccuuggcgacgaaugcgauggggaugaugauaacgacggaaucccggacuacguuccacccgguccugacaacuguaggcuggucccuaacccaaaccagaaggacagugauggcaauggcguaggggacgugugcgaagaugacuucgacaacgaugcagugguugacccucuggacgucuguccugagagcgcggaggugacucucaccgacuuucgcgccuaucagaccguggugcuugacccugagggggacgcucagaucgaucccaauuggguuguccugaaccaaggcauggagauugugcagacaaugaacagcgacccgggacuugccgucggguacacugcauucaauggcgucgacuuugagggcaccuuccacgugaacaccgugacagacgaugauuaugccggcuuccuguucagcuaccaggacagcggcagauuuuaugugguaauguggaagcagacagagcagacuuacuggcaggccacucccuuucgcgcaguugcacagccugguuugcagcugaaagccguuacguccgugaguggccccggagagcauuuaaggaacgcauuguggcauaccggccacacacccgaucaggugagauuguuguggacagacccgagaaacgugggcuggcgcgauaaaaccucauacagauggcagcugcuccauagaccccagguaggguacaucagagugaaauuauacgaagguccucaacuugucgcagacagcggagugauuaucgacacaagcaugagaggaggacgacucgggguguucugcuuuucccaggaaaacauuauauggucuaaccugcaguauagguguaacgacacgguuccagaggacuucgaaccauuccggcgacagcuccugcaaggacgcguuuag

SEQ ID NO: 13111 - RNA, 1311 nt, Artificial Sequence
  Description of Artificial Sequence: Synthetic coding sequence
auguggagaugcccucuggggcugcugcugcugcugcccuuggcaggucaccuggcccugggcgcccagcaggggagaggaagaagagagcuggcccccggccuucaccugcggggaauccgagacgccggaggccguuauugucaggagcaggaucugugcuguagagggcgggcugaugauugcgcacuuccauaccugggggccaucugcuacugugacuuguuuuguaauagaacagugagugauuguugucccgacuuuugggacuuuugucugggcguuccccccccuuuuccacccauucaggguugcaugcacggaggaagaaucuacccuguacucggaacguacugggauaauugcaaucggugcuggcaagccggcaaccauucggccuucuggggcaugacucucgacgaagguauuagguacagacuggggacuauaagaccgagcagcagugugaugaacaugcaugagauauauaccguccugaacccuggagaagugcugcccaccgcguuugaggcgucggaaaaauggcccaaccugauccacgagccguuggaccaaggcaacugcgccgguuccugggcuuucuccacagccgcuguggcuuccgacagggucucaauccauagccucggacauaugacaccuguguugucaccccagaaccuucugaguugcgauacucaccagcagcagggaugccggggggguagauuagauggcgcuuggugguuccuacggcgaaggggaguggugagugaccauuguuacccauuuucaggcagggagcgagaugaagcugggccagccccccccuguaugaugcauagucgagccaugggccguggaaagagacaggccacggcgcauugccccaauucauaugucaauaacaacgacaucuaccagguaacccccguguacagacuugggucuaaugacaaagaaaucaugaaggaacucauggagaaugguccggugcaggcucugauggaagugcaugaagauuuuuuucuguauaaaggagggauauacucacacacaccuguuagccugggcaggccagaacguuaccgcagacacgguacucauaguguaaagaucacaggauggggggaagagacccugccugacgggagaacucugaaguacuggacugccgcaaauucuuggggcccagcuuggggagagagagggcacuuuaggauuguccggggcgucaaugagugugacauugagucuuuuguguugggcguguggggccgaguaggaauggaagacaugggacaccauuag

SEQ ID NO: 13112 - RNA, 942 nt, Artificial Sequence
  Description of Artificial Sequence: Synthetic coding sequence
augucugaucuguuacugcugggacuuauugggggccugacucuccugcugcugcugacauuauuggcauuugcaggcuauucugggcuucucgcugggguagaagugucugcugguagcccgccgauuaggaacgugaccguugcauacaaauuucacaugggucuuuauggugagacaggacggcucuuuacggaaucuugcaguauuaguccaaaacuccgcucuaucgcugucuauuaugauaauccccacaugguuccccccgauaaaugcaggugcgccgugggaaguauccugagugaaggugaagaauccccguccccagagcugaucgacuuauaucaaaaguucggcuucaagguguuuucuuuuccugcuccgagccacgugguuaccgccaccuucccuuacacaacaauucucucaaucugguuggcaacucgccgaguccacccggcgcucgacacguauauaaaggaacgcaagcuuugugccuacccgagguuggaaaucuaccaggaggaccagauucacuuuauguguccuuuggcuagacaaggagacuuuuacgugcccgagaugaaggagacggaguggaaguggcggggauugguagaggcaauagauacacagguugacgggaccggagccgacacuauguccgacaccagcagcgucagucuagaggucagcccaggcagcagggagacgucagcagcaacuuugagccccggggcaucaucaagagggugggacgauggagacacacgaagugaacauagcuacagcgaguccggcgccagugguaguuccuucgaggagcuggacuuagaaggugaggggccccugggggaaagccggcucgacccaggcacagagccucucggcacaacuaaguggcuuugggagccuacugccccagagaaggguaaggaauag

SEQ ID NO: 13113 - RNA, 213 nt, Artificial Sequence
  Description of Artificial Sequence: Synthetic coding sequence
augguggcaccagccgcacgagucuuucugcgagcggugagagcugcacugaccuccacaguuccugaccugcugugcuuauuggcucgcggauccccucgaggacuggcuuccggccggcugccccucgccgugcauagcgcccagcaugggccagguaguggggccccuugguuacgcaucgcuagacgugcccuuucccaacgcaucuag

SEQ ID NO: 13114 - RNA, 642 nt, Artificial Sequence
  Description of Artificial Sequence: Synthetic coding sequence
auggcucagcuguucuugccacuacuugccgcucuugugcuugcucaggccccugccgcccuagccgaugucuuagaaggggacaguucggaggacagggcuuuucgaguuagaaucgcgggagaugccccgcuucagggcguucuggguggugcucucaccauuccaugucaugugcauuacuugcgaccccccccaucccgacgagcagugcucggcucaccccgggucaaauggaccuuccugucucgcggcagagaggccgagguguugguggcccguggagugagagucaaaguuaacgaagcguaucgguuuaggguggccuugccagcuuacccagcaucacucaccgacguuagucucgcccucagugagcucaggccuaacgauagugguauuuaucgaugugaggugcaacacgggaucgaugauucuucagacgcaguagaggucaagguuaaggggguuguuuuucuguaccgcgagggcucugcacgcuacgccuucucauucucaggcgcucaggaagcaugcgcacgcaucggagcucacaucgccacucccgaacaacucuaugccgccuaccugggcgguuacgaacagugugacgccggaugguuaagcgaccagacaguauag

SEQ ID NO: 13115 - RNA, 237 nt, Artificial Sequence
  Description of Artificial Sequence: Synthetic coding sequence
augggaagcggccucccccuugugcuuuugcuuaccuuacuugguagcagucauggcacugguccggguaugaccuuacaguuaaaauuaaaagaguccuucuugacuaacagcaguuacgaaucuucuuuuuuggaacugcuugagaaacuaugucuccuccugcaucugcccucugguacaucuguaacccuacaucacgcuagaucacaacaccacgucgugugcaacaccuag

SEQ ID NO: 13116 - RNA, 651 nt, Artificial Sequence
  Description of Artificial Sequence: Synthetic coding sequence
auguccgaucugcuccuuuugggucucaucgggggucugacccuuuuauugcuccugaccuugcuggccuucgcaggauauucaggccugcucgcuggaguagaaguaucugccggcucuccaccaauccgcaauguuacugucgcguacaaguuccacaugggccuguauggggaaacugggagacuguucacugagucaugcucuauaagcccaaaacugagaucaauagcuguauacuaugauaacccccacauggugccuccagauaaauguaggugugccguagguucaauucugucugaaggcgaagaauccccaucuccugaacuuaucgaucuguaccagaaguucggcuuuaaagucuucuccuucccugcacccagucauguaguuaccgcaaccuuccccuauacaacaauccugucgauauggcuugccacacgccgcguucacccggcccucgacacauauauuaaagagaggaagcucugugcguauccacgguuagagauuuaccaggaggaccagauccauuuuaugugucccuuagcccgacaaggggacuucuauguuccagagaugaaagaaacugaauggaaauggcgcggccuaguggaagcuaucgauacacagguggaugguacauag

SEQ ID NO: 13117 - RNA, 453 nt, Artificial Sequence
  Description of Artificial Sequence: Synthetic coding sequence
augagauuuauggccgggccagccggaucccaaucacuggggccucucugcuuucauuccuccccacaggcuuuauauacugugcugcucaucgugcuggugaugaugucuuuaguguucggaaaguucguccccguuaacugggaacccccacagcccuugcccuuuccuaaauauuugagguguuaccgguguuuacuugagacuaaggaauuagggugccugcuagggagugacauuugcuugacccccgcugguucuucauguaucaccuuacacaaaaagaacucuuccgggucggaugugaugguuagugacugccgaagcaaggaacagaugucagacugcucuaauacacgaacuucuccaguuuccggcuucuggauuuuuagccaauacugcuuccucgauuucugcaaugauccacagaaccguggacuguacacacccuag

SEQ ID NO: 13118 - RNA, 171 nt, Artificial Sequence
  Description of Artificial Sequence: Synthetic coding sequence
augaagaccggccuuuuuuuucugugccuccucgggacagccgcugccauuccaacaaaugcacgccuccuaagcgaucauucuaagccuacugccgaaacagucgcccccgauaacaccgcuauuccaucucuacgggccgaagccgaagaaaacgagaaagagacuuag

SEQ ID NO: 13119 - RNA, 2346 nt, Artificial Sequence
  Description of Artificial Sequence: Synthetic coding sequence
auggcaguggcagaagucucaagaaccugcuugcuuacagugcggguguuacaagcacaccgucucccuucaaaagauuuggugacaccaucugauugcuauguuacacugugguuaccuacagcaugcucucacaggcuucaaacgcgcaccgucaaaaacaguucaaguccugucuggaaccaaagcuuucacuuuagaauccaccggcagcucaagaacgucauggagcugaaggucuucgaccaggaucucguaacgggcgaugacccaguacugaguguguuguucgaugcagggacccuucgugcaggcgaauuucgcagagagagcuucucgcugucaccgcaaggcgaggggaggcuggaaguggaguucaggcugcagucacuggccgacagaggggaauggcugguaagcaacgguguuuuagucgcuagagagcucucauguuugcacgugcaacuggaggaaacaggggaucaaaaaaguagugaacauagaguccaguugguggucccuggcagcugcgagggcccccaggaagcaucugugggcaccggaacuuuucgcuuccauugcccagccuguugggagcaggaacugucuaucagacugcaggacgcacccgaggaacaguugaaagcuccacucuccgcucucccuaguggccagguggucagauuagucuuccccaccucgcaggaaccccugaugagggucgagcuuaagaaagaagcgggauugcgcgaauuggcgguccgcuugggguuuggcccuugcgcagaggaacaggccuuccucucuaggcgaaagcaagugguagccgcugcccugaggcaggcccuacaacuggauggggaccugcaggaagacgaaaucccagugguggcuaucauggcaaccggaggagggauucgcgccaugacgucucucuacggacaguuggccggacuuaaggaacugggacugcucgacuguguaucuuacauuacaggcgcuucagguuccacaugggcacuagcaaaccucuaugaagaucccgaauggucccaaaaagaccuggcugggcccacugaguuguugaaaacacaggucacaaagaauaagcuaggagugcucgccccgucccaauugcagcgguacaggcaggaguuggcugaaagggcacggcugggauaucccucauguuuuacuaaucuaugggccuugaucaacgaggcacuucugcacgaugagccccacgaucauaagcuguccgaccagcgagaggcccugucccacggccagaacccucugccaauuuacugcgcccucaauacaaaagggcagagccugaccacauucgaauuuggugaguggugugaguuuagccccuacgaaguuggcuuucccaaguacggagcauucauccccucugaguuguucgguagcgaauucuucaugggccaauugaugaagcgauugcccgagucuagaaucuguuucuuggaagguauauggaguaaccuguacgcugcuaacuuacaggacagccuuuauugggcauccgagccuagccaguucugggauagguggguuagaaaucaagcaaauuuagacaaggagcaaguaccucuccugaagauagaggagcccccauccaccgcaggccggaucgcagaguucuuuaccgaccuuuugaccuggcgcccucuggcgcaggcuacacauaauuuuuuacgcggauugcacuuccauaaagacuauuuucagcacccacacuuuucgacuuggaaggcaaccacauuggacggcuugccaaaucagcucacaccuucugagccucauuuaugucugcuagacgugggcuaucuuaucaauaccuccuguuuaccucugcuccaaccgacgcgugacgucgaccugauacucucccucgacuacaaccuacauggcgcguuccagcagcuccagcugcugggccgauuuugucaggaacaggggauacccuucccuccuauuuccccaucacccgaagagcagcuccaaccccgggagugccacaccuucucggauccgacuuguccgggggcacccgccgugcuccauuuuccacuagugagcgacucuuucagggaguacuccgccccuggaguacgucguacuccagaagaagcugcagccggagaagucaauuuaucuucaagcgauucuccguaucauuacaccaaagugacuuauucucaagaagacgucgacaaauugcuacaccugacucacuacaacgucugcaacaaucaggagcagcugcuggaggcccugcggcaggcgguccagagacgcagacaacggaggccacacuag

SEQ ID NO: 13120 - RNA, 219 nt, Artificial Sequence
  Description of Artificial Sequence: Synthetic coding sequence
auggccgcugcuacgagaggguguagaccauggggcagccuccucgggcuccucggauuagugagugccgccgccgcugcuugggauuuggcuagucugcgcuguacccugggcgccuucugcgagugcgacuuucgaccugauuugccugagggauccgaagagcuugggccucgggaaccgcacugccuuuggccccugccacucccucugcguuag

SEQ ID NO: 13121 - RNA, 243 nt, Artificial Sequence
  Description of Artificial Sequence: Synthetic coding sequence
augaaaguguuuuuucuguucgcugucuuauucugucugguacagaccaauaguggcgauguuccccccggcauuagaaauacgaucugucacaugcaacaaggcaucugucgccuguucuuuugucacaguggagaaaaaaaacgagacaucugcagcgaccccuggaauagauguugcgugucuaacaccgaugaagagggaaaggagaagccagaaauggacgggcgcagugguaucuag

SEQ ID NO: 13122 - RNA, 861 nt, Artificial Sequence
  Description of Artificial Sequence: Synthetic coding sequence
auggggcccgaagcacugucuucgcuacugcugcuguugcugguggcauccggcgaugcagauaugaaggggcacuuugacccugcuaagugucguuacgccuugggaaugcaggauaggacaaucccagauagugacaucuccgcuuccagcaguuggucagauuccacugcagcacgacauagccgcuuagagagcagugacggggauggggcaugguguccugcaggaucgguguuccccaaggaggaggaguaccugcagguggaccugcagcggcuucaccucguagcccugguggggacacaggggagacacgcuggaggacuaggaaaggaguuuucgcggucuuaucgcuugcgauauucucgggaugggcggcgcuggaugggauggaaagaucgaugggggcaagaggugaucagcggaaaugaggauccagaaggcguuguacucaaggaccugggacccccuaugguggcaagacuggucagauucuauccucgcgcugaccgcguuaugagcguuugccucagaguggaguuguacgggugccuuuggagggauggacuauuaaguuauacugccccugugggacaaaccauguaucuuucugaggccguuuaucuuaacgacucaacauaugaugggcacacgguaggugggcugcaguauggcgggcucggacaguuggcagacgggguggugggcuuagaugauuuucguaaaagucaggaacugaggguuuggccuggcuacgacuauguggguuggucuaaccacagcuuuuccuccggcuauguugagauggaguuugaauuugauagacugcgggcauuccaagcaaugcaggugcacuag

SEQ ID NO: 13123 - RNA, 858 nt, Artificial Sequence
  Description of Artificial Sequence: Synthetic coding sequence
augcggggccaaggacgaaaggaaucccugagugauucaagggacuuggaugggucuuaugaccagcucaccggccauccgcccgggccgacaaagaaggcucugaaacaaagauuccucaaacuccuuccuugcuguggaccacaggcccuccccaguguuagugagauugguaggguuuuuagguuccuuggcgacucaucucucccaucugcuuuagccgcaccagcaucgcuccggccucacagaccucgguugcuggacccagacagcguggacgacgaauucgaacugagcacagucugucacagaccagaaggcuuggaacagcuacaagagcagacaaaguuuaccagaaaggaacuacagguguuauacaggggguuuaagaacgaaugccccagcggaauagugaaugaagaaaauuuuaagcaaaucuacucccaguucuuuccgcagggcgacucuuccacguacgcuacauuccucuucaaugcauuugacacaaaccacgacggauccgucucguucgaagacuuuguggcaggccugucugugauacugagaggcacuguagacgauagacucaacugggccuucaaucuguaugaucucaauaaggauggcuguaucacaaaggaggagauguuggacauuaugaagagcauauacgauaugaugggaaaauacacauacccugcccuccgagaggaggccccacgggagcacgucgaaucuuuuuuccaaaaaauggaucguaacaaggacggcguugucaccaucgaggaauuuaucgagucaugucaaaaagaugagaauauaaugaggucuaugcaguuguucgauaacgucaucuag

SEQ ID NO: 13124 - RNA, 1311 nt, Artificial Sequence
  Description of Artificial Sequence: Synthetic coding sequence
augcaggguacuccagggggagguacacgccccggccccagcccaguggacagaaggacccugcugguguuuucuuucauacuagcggccgcccuuggacagaugaauuucacgggggaucagguuuuacguguacuggcaaaggaugaaaaacagcugucgcuccugggggaccuggagggucugaaaccgcagaaaguagauuuuuggaggggccccgccagaccgucucuaccuguagacaugcgggucccuuucucugaguugaaagauaucaaggccuaccuugagagccacggccucgccuacaguauaaugaucaaagacauucagguuuuacuggaugaagaacgacaggcuauggcgaagagcaggcgccuggagcggagcacaaacucauuuagcuauaguagcuaucacacccucgaagagauuuacagcuggauugauaacuucguuauggaacacuccgauaucguuagcaaaauccagaucggcaacagcuucgaaaaccagagcauccuagugcucaaguuuagcaccggcggcucacgacaucccgcuauuuggauagauaccgggauucacucacgggaguggaucacccacgcuacgggcauuuggacagccaauaagauuguaucugauuacgguaaagaccgcguacugacugacauucuuaacgcaauggacauuuucaucgaacuggugacuaaccccgacggauucgccuuuacccacucaaugaaucgucucuggcgcaaaaacaagagcauacgcccuggcauuuuuuguaucggcguugaucucaacaggaauuggaagucuggcuucgguggcaacggcucaaacucuaauccuuguucagagacauaucacggaccuuccccucaaucagaaccagaggucgccgcaaucguuaauuucauuaccgcccacgggaauuucaaagcucugaucuccauccauagcuacucacagaugcuuauguauccguacggcaggcucuuggaaccugugagcaaucagcgugaauuguacgaucuggccaaagacgcuguggaggcccuuuacaagguacaugguauugaauacauuuucgguuccauuuccacuacucuguacgucgcgagcgggaucacaguggacugggccuaugacucuggcaucaaauaugccuuuagcuucgaacugagggacacagggcaguacggauuucuucucccugcuacgcagaucauccccacggcgcaagagaccuggauggcacuacggacaaucauggaacacacacucaaccauccuuauuag

SEQ ID NO: 13125 - RNA, 1218 nt, Artificial Sequence
  Description of Artificial Sequence: Synthetic coding sequence
auggacacgauuuuucuguggucacuucuacuguuguuuuucggaagccaagcaucacguuguagcgcucagaagaauacugaauucgccguggaucuuuaucaggaggugagccugucucauaaagacaacaucaucuucuccccacuggggauuacacuggugcuggagauggugcaacugggagccaagggaaaagcacagcaacagauuagacaaacuuuaaagcaacaggaaaccagcgccggagaggaauucuucguacucaaguccuuuuuuagugccaucagcgagaagaagcaggaauucacuuuuaaucuggcuaacgcccuauaucugcaggagggguucacugugaaagagcaguaccuacacgguaauaaggaguucuuccagagcgcaaucaagcucguggauuuucaagacgcuaaggccugugcggagaugaucucuacuuggguugagaggaagacagacggcaagaucaaggauauguucucaggggaggaauucggcccucugacccgauuaguccucguuaacgcaauuuacuuuaagggugauuggaaacagaaauuccgcaaagaagacacccagcugauaaauuuuacaaagaaaaacggcucuaccgugaagaucccuaugaugaaagcuuuacuaagaaccaaguauggguauuucucugagucauccuugaacuaccagguccuggagcuuuccuauaaaggcgaugaguucagccuuauuaucauacugccagcugaagguauggauauugaggagguagagaagcugauaacugcccaacagauuuugaaauggcucagugagaugcaggaggaagaagucgagauaagccugccuagauuuaaagucgagcaaaagguggacuucaaagauguauuguacaguuugaauaucaccgaaauauucucaggaggaugugaucucagcggcaucaccgauaguucagaaguguauguaucccaggucacgcagaagguguucuuugaaauaaacgaagacgggucugaggccgcaaccucuacuggcauccacauccccguaaucaugucacuggcacaaucucaguucaucgcuaaucauccuuuucuguucauaaugaagcacaacccaaccgaauccauccuuuuuauggggagagucacaaaccccgacacucaggagauuaagggcagagauuuagacucccuguag

SEQ ID NO: 13126 - RNA, 300 nt, Artificial Sequence
  Description of Artificial Sequence: Synthetic coding sequence
augcucgcacugcuaguguugguuacgguagcgcuggccucugcacaccacggcggagaacacuuugagggggaaaaagucuuuagagugaacguagaggaugaaaaucacauuaauauaauuagagaacucgcuucaacuacacagauugacuuuuggaagcccgauuccgucacgcagauuaagccacacagcaccguugauuuuagaguaaaggccgaagacacagugaccguagaaaauguccuaaaacagaaugagcugcaguauaagguguugauuuccaaucugagaaacuag

SEQ ID NO: 13127 - RNA, 471 nt, Artificial Sequence
  Description of Artificial Sequence: Synthetic coding sequence
auguuauuguuauuacuucuagccccucuguucuuacgcccuccuggagcuggcggagcccagaccccaaaugcuacaucugaaggaugucaaauuauccauccuccuugggaaggugguauccgcuaccgggggcugacuagggaucaagucaaggccaucaacuuccuuccgguggacuaugagauugaauacgucugccggggcgagcgggaagucguuggucccaagguacguaaaugucuugcaaaugguucuuggacggacauggauaccccaucuagaugugugagaaucugcuccaaguccuaccugacacuugaaaauggaaaaguauucuugacuggaggcgauuuacccgcccuggauggagcccgaguggacuuccgcugugaucccgacuuccaucuuguuggcuccagucgcucgauuugcagccaaggccaguggucuacucccaaaccucauuag

SEQ ID NO: 13128 - RNA, 249 nt, Artificial Sequence
  Description of Artificial Sequence: Synthetic coding sequence
augggccguguuuuccuuacuggugagaaagcaaauucuauccugaagagauacccccgagcaaauggauucuuugaggaaauccgacaaggcaacaucgaacgggagugcaaagaagaauucuguaccuucgaggaagcaagagaggccuuugaaaauaacgagaaaacaggacuaguauuacucccucgccuggagugcucaugcgaacacggcagcuugcagccccaguuacccgucccuaaauag

SEQ ID NO: 13129 - RNA, 372 nt, Artificial Sequence
  Description of Artificial Sequence: Synthetic coding sequence
augcagggcaccccaggcggaggaacuagaccuggcccguccccaguugauagaaggacacuccuugucuuuagcuuuauccuugccgccgcccuagggcagaugaacuucacuggugaccaggugcuaagggugcuggcaaaggacgaaaaacagcugagucuccucggcgaucucgagggguugaaaccccagaaaguagauuuuuggcgcgggccugcccgcccuucuuuaccaguagacaugcggguacccuuuucagaacugaaggacauuaaggcguauuuggaaucucacggacuggcauacucuauaaugauuaaggauauacaggugcuacuugacgaagagcgacaggcuauggcuaaauag

SEQ ID NO: 13130 - RNA, 840 nt, Artificial Sequence
  Description of Artificial Sequence: Synthetic coding sequence
augggcagggucuucuuaacuggagagaaggccaauaguauccugaaacgguauccacgagccaacggguuuuucgaggagaucaggcagggcaacauugaaagggaaugcaaggaggaauuuugcacuuucgaggaggcgcgagaagccuucgagaauaacgaaaagacgauuacaggagugauucuacuggcagucggugugugggggaaacugacgcugggcaccuacauaagccuuaucgcugaaaauucuacuaaugccccauacguguuaauuggaaccggaaccacaauaguugucuucggacucuucggcuguuuugcaacaugucggggcaguccuuggauguugaagcuguacgccauguuucuaucgcucguuuucuuagccgaacuuguugcagguauuagcggauuuguauuccggcacgaaauuaaggauacuuuucugagaacauacacagaugccaugcagacauauaauggaaacgaugaaagaucccgcgccguugaccaugugcaaaggucccugucauguuguggcgugcaaaauuauacaaauuggaguacaagcccuuauuuccucgaacacgguauuccaccaucuugcuguaugaaugagacagauuguaauccgcaggacuuacacaaccuuacaguggcugcuacaaaagugaaucagaaggguuguuacgaucuugucacaagcuuuauggagacaaacaugggaauaaucgccggagucgccuucggcauugcguucagccaguuaauaggcauguugcucgccuguugucugucacgguuuaucaccgccaaccaguaugagaugguguag

SEQ ID NO: 13131 - RNA, 564 nt, Artificial Sequence
  Description of Artificial Sequence: Synthetic coding sequence
auguggugcgccagccccguggcuguuguugcuuuuugcgcuggccugcuugucagccauccugugcugacccaggggcaagaagccggugggcguccaggugccgacugcgagguaugcaaggaauuccuuaaccguuucuacaagagucucauagauagaggugugaacuuuucguuggacacaaucgaaaaagaguugauauccuucugccuggauaccaagggcaaggaaaauagauuguguuauuaucugggagcuacaaaggacgccgcuacgaaaauccugagcgaagugacacgccccaugaguguucacaugccugccaugaagauuugcgaaaaguugaagaaguuggacagccagauuugugagcucaaauacgagaagacauuggaucuugcuagcguagaucuacggaaaaugagaguagcggagcucaaacaaauucugcacagcuggggagaggaaugcagggcuugugccgagaagacggacuaugugaacuugauccaggaauuggcaccaaaauacgccgcaacucacccuaagaccgaauuguag

SEQ ID NO: 13132 - RNA, 1311 nt, Artificial Sequence
  Description of Artificial Sequence: Synthetic coding sequence
augcaagguacuccuggcggaggcacucgaccugguccauccccaguggaccgacggacucuucugguguucagcuucauucuagcggcugcacugggccagaugaauuucaccggcgaucaaguucugcgcguacuggccaaagacgaaaaacaacuuagccugcugggagacuuggagggucugaagccacagaaagucgacuuuuggaggggcccagccaggccguccuuaccuguggacaugagagugccguuuucugaacuuaaagacaucaaagccuaucuugagucccauggccuggcuuauuccauuaugauuaaggauauccagguccugcuugacgaagagagacaagccauggcaaagagucgaagacuggagagaagcaccaacuccuuuucuuacucuagcuaccacacccuugaagagauuuacagcuggauugauaauuucgugauggaacacagcgacauugucagcaagauacagauugggaauuccuuugagaaucagagcauccugguccucaaguuuuccacuggaggaucucgccauccugcaauauggaucgacaccggaauucacagcagagaauggauuacccacgcuaccggcauuuggacagcuaauaagaucgugucagauuauggcaaagacagaguccuuaccgacauccuuaacgcaauggauaucuuuaucgagcuagugacaaacccagauggguuugcguuuacacauucaaugaacaggcuguggaggaaaaacaaaucuaucaggcccggcauauucugcaucggcguugaucuuaaccggaauuggaaguccggguuuggcggcaacggcucaaacuccaauccauguucugaaaccuaccaugggcccaguccccagucagagccagagguggcggccaucgugaacuuuaucaccgcccacgggaauuucaaagcccugauuaguauacauagcuauagccagauguugauguaccccuauggucgacuacuggagcccgugucaaaucagagagaacuguacgaccuugccaaggacgccgucgaagcacuguacaaaguccauggaaucgaguacauuuuugguaguaucaguacuacacuuuauguggcaucuggaaucaccguagauugggccuacgauuccggcauaaaauacgcuuucuccuuugaacuuagagauacuggucaguauggauuccuguugccugccacgcagauaauuccaaccgcacaggagaccuggauggcucuucgcaccauuauggaacauacauuaaaccacccguauuag

SEQ ID NO: 13133 - RNA, 450 nt, Artificial Sequence
  Description of Artificial Sequence: Synthetic coding sequence
augggucgcguguuccucaccggcgagaaagcuaauuccauccucaagagauauccgcgggcaaacggguuuuucgaagaaaucaggcaggggaauauagagagagaaugcaaagaggaauuuuguaccuucgaagaagcaagagaggcauucgaaaacaaugagaagacaaaagaguuuuggucuacguacaccaaggcccagcaaggagaauccaacaggggaagcgacugguuccaauuuuaucucaccuuuccacugauuuuuggucuuuuuaucauuuuacucgugauuuuccugauuuggcguuguuuucuuaggaacaagacaagaaggcaaacgguuacugaggggcacaucccauuuccacagcaccugaacauuauuacuccaccucccccaccagacgaggucuucgauuccagcggccucuccccaggcuuuuuauag

SEQ ID NO: 13134 - RNA, 936 nt, Artificial Sequence
  Description of Artificial Sequence: Synthetic coding sequence
augcuuuaccagacuauaaauucucugaagacuaagaaucccaagcuuaaaauucugcugaguaucggaggguaccuauucggaucuaagggauuucauccaaugguggacagcagcacaucgcgccuugaguucauuaauucuaucauccuguuccugaggaaucacaacuucgacgguuuagaugucucauggaucuacccugaucaaaaagagaauacacacuuuaccgucuugauccacgaacucgcugaggcauuucagaaagauuuuacaaaaucaaccaaggaacggcucuugcuuaccgcgggcgucagcgcuggcagacaaaugauugauaauucuuaccaaguggagaaacuggccaaggaucuggacuuuauuaaccuacucuccuuugauuuccacgguaguugggagaaaccucucaucaccggacauaauagcccccuuagcaaggguuggcaagacagagggccuucaucauacuacaauguggaguaugccguugguuauuggauccacaaaggaaugccgucagaaaaggugguuaugggcaucccgacguauggacacucuuucacucuggcguccgccgagaccacagugggcgcccccgcaucugggccaggagccgcagggccuaucacagagaguucaggcuuucucgccuauuaugaaaucugccaguuucucaagggcgccaagaucaccagacugcaggaucaacaggugccauacgcagugaagggcaaucagugggucggcuacgacgauguaaaaucuauggaaaccaaaguucaguucuuaaagaaucucaaccuggggggugcuaugaucuggaguaucgauauggaugauuuuaccgggaagagcuguaaucagggucccuauccccugguucaggcugucaaacguagccuuggaagccuguag

SEQ ID NO: 13135 - RNA, 621 nt, Artificial Sequence
  Description of Artificial Sequence: Synthetic coding sequence
auggauacgaucuucuuguggagccuuuuguuacucuucuucgguucgcaagcaucccguuguuccgcgcagaagaacaccgaauuugcaguagacuuguaucaggaggucucucuaucccacaaagacaacauuaucuucuccccccucggaaucacauugguguuagagaugguccaacugggcgcuaaggggaaggcucagcagcaaaucaggcaaacccuuaaacagcaggagacuucagcgggggaagaauuuuucgugcugaagucauucuucucagccaucagugaaaaaaaacaggaauucacauucaaucuagcuaacgcacuuuaucuucaggaagguuucacagucaaggagcaguaccugcauggcaauaaggaguuuuuucaguccgcuaucaaacuugucgacuuucaggaugcaaaggccugugccgagaugauuaguacuuggguggaacgcaaaacugacggcaaaaucaaagacauguuuaguggcgaagaauucgguccucucacacggcuaguccuggucaaugccaucuacuuuaaaggagacuggaaacagaaauuccgcaaggaagauacucaacugauuaacuuuacgaagaaguag

SEQ ID NO: 13136 - RNA, 1218 nt, Artificial Sequence
  Description of Artificial Sequence: Synthetic coding sequence
auggacaccaucuuccuguggucucuucuucucuuauucuucggaucucaagccagcaggugcucugcccaaaaaaacaccgaguuugcaguggacuuguaucaagaaguaucacugucccauaaagauaacaucauauuuagcccccuggguaucacucuggugcucgaaauggugcagcugggcgcaaaaggcaaggcgcaacagcagauaagacagacgcucaaacaacaggagacguccgcaggcgaggaguuuuucguucugaagucguucuucucugcuauuuccgagaaaaaacaagaauuuaccuucaaccuggcgaaugcucuguaccugcaggaagguuuuacaguuaaggaacaguaucugcacggcaauaaggaguuuuuccaguccgccaucaaauuaguggacuuucaggacgcuaaggcuugcgccgaaaugauauccaccuggguugagagaaagacugaugggaagauuaaggauauguucucaggggaagaauuugggccucugaccagguuaguguugguuaacgcuauuuauuuuaaaggagacuggaaacagaaauuucgaaaggaggacacacaacugauaaacuuuacuaagaaaaauggcucuaccguuaagauuccuaugaugaaagcgcugcugcggaccaaauauggauacuucucagagaguagccugaauuaucaaguguuagagcuuucguacaagggagacgaauuuucucuaauuauuauacuaccagccgaagguauggacaucgaggaaguggagaaacugauuacagcucagcagauucugaaauggcugagugagaugcaggaggaggaaguggagauaucacugccaagauucaaaguggagcagaagguggacuucaaggauguguuguacucucuuaauaucacggaaaucuucaguggaggcugcgaccucuccgguaucacagauuccucagaaguuuacguuucucaggugacccagaagguuuuuuuugaaaucaacgaggauggaagugaggccgcuacaucgacggguauucacauccccgugaucaugaguuuagcgcaaucacaauucaucgccaaccauccuuucuuguuuaucaugaagcacaauccuaccgagucaauucuauuuaugggaagggugaccaaucccgacacacaagagaucaaagguagagaucuggacaguuuguag

SEQ ID NO: 13137 - RNA, 399 nt, Artificial Sequence
  Description of Artificial Sequence: Synthetic coding sequence
augcuuaucuucuggacaauuacacucuuuuugcuuggagccgcuaagggaaaagaagucuguuaugaagaccugggaugcuucagugauaccgaacccuggggaggcaccgcaauuagaccccuuaaaauauuaccuuggucuccugaaaagauuggcacccgauucuuauuguauacgaacgaaaaccccaauaacuuccaaauccuguugcuguccgauccuaguacaauugaagccucuaacuuucagauggaucgaaaaacuagauucauuauucacggguuuaucgacaaaggugacgagaguuggguuacagacaugugcaagaagcuuuucgaaguggaggaagucaacuguaucugcguggauuggaagaagggaucucaggcaacauag

SEQ ID NO: 13138 - RNA, 606 nt, Artificial Sequence
  Description of Artificial Sequence: Synthetic coding sequence
augaaggugcacaugcucguuggcguacuagugauggucggcuucacaguugguaaaguccccgucccugauauaagaaccugucauuucugccugguagaagauccgucugugggguguaucucuggcagugaaaagugcacgaucucuaguucuagucugugcauggugaucaccauauacuacgacgucaagguccgcuucauuguccgagguugugggcaguacaucucguacagaugucaggagaagcggaauacuuauuucgccgaguacugguaucaagcucagugcugccaauacgacuacugcaauucauggucaucuccucaacugcaaaguagcuuaccugagccucacgaccgaccccuggcccucccucuaagcgauagccagauccagugguuuuaccaagcacucaaccuuucccuuccucuuccuaacuuccacgccggcacugagcccgacggucuggaucccaugguaacccuuucucugaauuuggggcucagcuucgcugaguugaggcgaauguaucuauucuuaaauucgucuggccuuuuggugcugccucaggcuggacuauugaccccucaccccucguag

SEQ ID NO: 13139 - RNA, 1086 nt, Artificial Sequence
  Description of Artificial Sequence: Synthetic coding sequence
auggcaucacucggccuucuccuccuuuugcuacugacugcccuucccccucuuuggagcuccucguuaccggggcuugauacggcugagagcaaagcuacuauugcugaccugauuuuguccgcccuugaacgcgcgacugucuuuuuagaacaaaggcugccagaaauaaaucuggaugggauggucggagugcgggugcuagaagaacaacucaagucuguccgcgagaagugggcccaggagccacuguugcagcccuugagccugcggguagggaugcucggcgagaaacuggaagccgcuauucagagaagccugcauuaccuuaaacuuagugacccaaaguaccuucgcgaauuccaguuaacauugcagccgggguucuggaaacugccucacgcauggauccacaccgacgcgagccucgucuauccuaccuucggcccacaggacucauuuuccgaagaacgaagcgacgucuguuuggugcaacugcuugggaccgguacugauucuuccgagcccuguggacucucugaccucugccgcucauugaugaccaagccuggcugcucuggguauuguuugucccaccaguuacuguucuuuuugugggccaggaugagaggcugcacacaggggccucugcaacagucacaagauuauauuaaucuguuuugugccaacaugauggacuuaaacagaagggccgaggccaucggcuacgccuauccuacacgugauauuuucauggagaacauaauguuuugcggcauggggggcuuuagcgacuuuuauaaguuacgcuggcuggaagcaauucugagcuggcagaagcagcaggaaggcuguuuuggcgaacccgaugcugaggacgaggagcugagcaaggccauucaguaccagcagcacuucagccgcagaguuaagcggcgggagaagcaauuucccgacgguugcuccucucauaacaccgccaccgccguagccgcccuggggggcuuccuuuauauuuuagcugaguacccgccugcuaaccgcgagccucacccuucaaccccaccuccaccuucuaguagauag

SEQ ID NO: 13140 - RNA, 162 nt, Artificial Sequence
  Description of Artificial Sequence: Synthetic coding sequence
auguggacaaauuuuuucaaauuaagguuauucuguugucugcucgcagugcugauggucgucguacugguuauaaauguuacccaagucgaguaccuggaccaugaaaccgugucugccaccuucauugauuccucugggcaguuugucucuucucaauag

SEQ ID NO: 13141 - RNA, 1305 nt, Artificial Sequence
  Description of Artificial Sequence: Synthetic coding sequence
auggccucucugggacugcuacuccucuugcuuuugacagccuuacccccucugugguccuccagucugccaggccuugacaccgccgagagcaaggcuacaauugcagaucucauacuguccgcguuagagagggcuaccguguucuuggaacaaagauugcccgaaauaaaccuugacggaaugguaggagugcguguccuggaagaacagcuuaaauccgucagggagaagugggcccaagaaccucucuugcaaccucugagccuccgcguaggcaugcucggugagaaacuggaagcugccauccagagaucacuucauuaucugaaacucagugaucccaaauaccuacgagaguuucaguugaccuugcagccgggcuucuggaaacucccacacgcauggauacacaccgacgccucucuugucuaucccacguuuggaccucaggauucauuuagcgaagagcgcucagauguuugccucguccagcuccucggcaccggcaccgacuccucagaaccuugcggacuuucagaccucugucgcagccuuaugacaaagccgggguguuccggcuauugcuugagccaccaacugcuauuuuucuugugggcgaggaugagagggugcacucagggaccccugcaacagagucaggauuauauaaaccuguuuugcgcaaauaugauggaccuuaauagacgagcugaggcuauuggcuaugccuaccccacgcgcgauaucuuuauggaaaauuccguuacaggccacccuguauucuaccucccacucugugacaguuuucuaccuccuaaagccgcucccgugacagaauuauacacugacggccccguuauguuuuguggaaugggaggauuuucagauuuuuacaagcucagguggcucgaggccaucuugagcuggcaaaaacaacaagagggcuguuuuggcgagcccgaugccgaggaugaagagcuguccaaggcaauccaauaucagcagcauuucucucgacgcgucaaacgcagagagaaacaguuccccgacucacgcagcguggcgcaagccggcguccaauggagaaauuuaggcucccugcagccucugccccccgguuucaagcaguuuuccugucuuauccuuccgucaucaugggauuauagaucgguccccccauaucuggccaacuucuacaucuuccugguugagacgggcuuccaccacguggcccaugcaggauuggagcuccuuauuaguagggacccucccacgucaggcagccagucgguuggacuuuag

SEQ ID NO: 13142 - RNA, 1311 nt, Artificial Sequence
  Description of Artificial Sequence: Synthetic coding sequence
augcagggcacgccaggcggcggaaccaggccaggucccaguccaguggacagacgcacucugcugguguuuaguuucauacuugcugcagcucucggucagaugaacuuuaccggggaccagguccuccggguguuggcaaaggacgaaaaacaacugucccucuuaggggaucuggaaggacugaaaccucagaagguggauuuuuggaggggcccggcacggccaucucucccgguugacaugagggugccguuuagcgaauuaaaggauauuaaagccuaccuggaaucacacggucucgcauacucuauaaugauuaaagauauucagguguugcuugacgaagaacggcaggcuauggcuaagucccgaagauuagaacggaguacaaacaguuuuucauauucuucuuaccauacucuggaggaaauauacuccuggauugauaacuuugugauggagcacuccgacaucgugucuaagauacagauagggaauagcuucgaaaaccagucuauucugguguugaaauuuaguacaggcggcaguagacaucccgcuaucuggauugacacuggcauucauucccgcgaauggaucacgcacgcaaccggcauauggacugcaaacaaaauugugagcgacuauggaaaagaucgagugcugaccgauaucuuaaaugcaauggauaucuucaucgaacucguuacaaauccagacggcuuugcauuuacacauucaaugaauaggcuguggcgcaaaaacaaaucaauccggccuggaauauucuguauagguguggacuuaaacaggaauuggaagagugguuucggaggaaacggcucaaauucuaaucccugcuccgaaaccuaucacggaccaucgccucaguccgaaccagagguggcugccauuguuaauuuuaucaccgcccacgggaauuuuaaggcccuuauaucuauucacagcuauagucagaugcugauguauccuuacgguaggcugcuugagccaguuagcaaucagagagagcuguacgauuuggcaaaggaugcuguggaagcacuguacaagguacacgguauugaguauauauucgggaguauaucuacgacccuauacguggccucagggaucacaguagacugggcauacgauaguggcauuaaauacgcuuucuccuuugagcuccgcgacacgggacaauaugguuuucuucucccggcaacacaaaucauucccacugcucaggagacauggauggcccuacgcacuauaauggaacauacccucaaucacccauauuag

SEQ ID NO: 13143 - RNA, 1218 nt, Artificial Sequence
  Description of Artificial Sequence: Synthetic coding sequence
auggacacgauuuuccucuggucauuacuacugcucuucuuuggcagccaggcgucaagauguuccgcucagaaaaacacugaguuugccguagaucucuaucaagaggucagccucucacauaaggauaauauaauauucuccccccuaggcauuacccucguguuggagaugguucaacugggggccaaggguaaggcucaacaacagauucgccagacccucaagcagcaggagacaucggcaggcgaagaguuuuucgugcucaaaucauuuuuuagcgcaaucucagaaaagaaacaggaauucacguucaaucuagccaaugcacuuuaucuucaggaaggcuucaccguuaaggaacaguaucugcaugguaacaaggaguuuuuccagucugccauuaaguuggucgauuuucaggaugcuaaagcuugugcagaaaugaucucuaccuggguugaaaggaaaaccgacggcaagaucaaagacauguuuagcggcgaggaguucggcccuuugacucgucugguccucgugaacgcaauuuauuuuaagggugacuggaaacagaaguucagaaaagaggauacacaauugauaaacuucaccaaaaaaaacggauccaccgugaaaaucccaaugaugaaggcucuucuucggaccaaauacggcuauuucuccgaaucaucucugaacuaccaggugcuggaacugaguuauaagggcgaugaguucucucugaucaucauccugccugcugaggguauggauauugaggagguggaaaaacugauaaccgcccagcagauccugaaguggcugagugaaaugcaggaggaagagguugagaucucccuccccagguucaaggucgaacagaagguggauuuuaaagaugugcucuauucucuuaauauaaccgagauuuucagcggaggaugcgaccucagcggaauuacugauucaagcgaggucuaugugucccaggugacccagaaaguauucuuugagaucaaugaagauggaucagaggcagcuaccucgacagguauucacaucccuguuauaaugucucucgcccagucacaguucaucgcaaaccacccguuucucuuuaucaugaaacacaaccccaccgagaguauucuguuuaugggaagaguaacuaauccugauacccaggaaauaaaaggccgcgaccuugacucucucuag

SEQ ID NO: 13144 - RNA, 510 nt, Artificial Sequence
  Description of Artificial Sequence: Synthetic coding sequence
auguuauaucaaacaaucaauucccugaagacaaagaaucccaaacugaaaaucuugcuguccaucggcggauacuuauucggcucuaagggguuucaccccaugguggauaguucuaccucccgccuggaguuuaucaauucuaucauucucuuccuuaggaaucacaacuucgauggacuugaugugucuuggaucuaucccgaccagaaagaaaacacccacuuuacaguuuuaauucaugaauuggccgaagcauuccagaaagauuuuaccaagagcaccaaggagcgucuguuauuaaccgccggcgucagugcgggccgacaaaugauugacaauaguuaccaaguagagaaguuagcuaaggaucuggacuuuaucaacuugcugucguucgauuuccauggcagcugggagaagccacuaauuacaggccacaacuccccccuuaguaaagguuggcaggaccgcggcccuucuuccuacuacaacguggaauacgcauag

SEQ ID NO: 13145 - RNA, 1209 nt, Artificial Sequence
  Description of Artificial Sequence: Synthetic coding sequence
auggccucuuugggacuccuguuacuucugcuccucaccgcucuuccuccucuguggagcaguagccugcccggucuugauaccgccgagucaaaagccaccauugccgaccugauccucuccgcacuggaaagggcuacaguuuucuuggaacaaagacugccugagauuaaucuggauggcauggugggggucagggugcuugaggaacagcugaaauccguucgagagaagugggcccaggaaccauuacugcaaccuuuaucccucaggguuggcauguugggagagaaacucgaagcugccauccagcgaucucugcacuaucuuaaacuauccgaccccaaguaccucagagaauuccaacuaacguuacagccgggguucuggaaacugccucacgcguggauucacacugacgcuagccuggucuacccgacuuuuggaccgcaggauucuuuuucggaggaacgaagugaugucugucucguucagcuccuuggaacaggaacggauucaucugagccaugcggauugucugaccucugccgaucccugaugaccaaaccaggcugcuccggguauugucugagucaucaguuacuguuuuuuuugugggcccgcaugcggggguguacacaaggcccucugcagcaaucucaggacuacaucaaccuuuucugugccaauaugauggauuugaaccgaagagcagaggccaucggauacgcauacccaaccagggacaucuucauggaaaauaucauguucugcggcaugggaggguuuagcgauuucuauaaacugcgauggcuagaggcaauucugaguuggcagaaacagcaagaggguugcuuuggcgaacccgacgcugaggacgaggaacuuuccaaggccauucaguaucagcaacacuuuucuaggcgggucaagagacgggagaaacaguuuccagacucacggucgguggcucaggccggagugcaguggcgaaaccuuggaagcuuacagccuuuaccuccgggcuucaagcaguucucuugucugauccugccuuccuccugggacuauagguccguuccgccuuaccuugccaauuucuacaucuuccucguggagaccggcuuucaccacgucgcacaugccgguuuagagcuccugauuagucgagauccuccuacuagcggcagucaguccgugggauuauag

SEQ ID NO: 13146 - RNA, 1680 nt, Artificial Sequence
  Description of Artificial Sequence: Synthetic coding sequence
auguggaccaacuuuuuuaaacuacgucucuucugcugccuguuggccguuuugaugguagugguacuggucauaaaugugacccagguggaauaccuugaccacgagacggugagcgcgaccuucauagauucaaguggucaguuugucuccucccaggucacaggcaucucucgaaaucccuacuguggauacgaucagcagacccucucuucccaggagcguauggaggaagauagucucuuagccgcacugcaucgucaggugccggacguuggcccuguccccuuugugaagucuacagacccuucuagcucguauuucgucauccuuaauuccgcagccuuuuuuaaagugggaucucagcuagaagugcuggugcacguccaggacuuucagcggaagcccaaaaaguacgguggggacuaucuccaggcacgcauccauucacucaaacugcaagcaggcgccgugggccgggucguggauuaucaaaacggguucuacaagguuuucuuuacgcuucucuggccggguaagguuaagguaucuguuucccuggugcauccaagcgaaggcauccgaguccugcagcgguuacaggaagauaaaccugacaggguguacuuuaagagccuuuuucgguccgguaggaucucagaaacuaccgaaugcaacgugugccugcccgggaaucugccccuaugcaacuuuaccgaccuguacacaggugaaccuugguuuuguuucaaaccgaaaaaacuucccugcucauccaggauuacccauuucaaaggcggauaucugaagggcuugcucaccgcagcugagagcgcguuuuuucaaagcggaguaaacauuaagaugcccguuaauaguagcgguccggacuggguuaccgugauaccucgucggaucaaggaaacgaacucacuggagcucagccagggcucuggcacauuuccuagcggcuacuacuacaaggaccaguggcguccaagaaaguuuaaaaugcggcaguucaacgacccagacaauauaacggaaugucuucaaagaaagguugugcaccuguucggagauaguaccauccgccaaugguuugaguaucuuacuacauuuguaccagacuugguugaauucaauuuggggucccccaaaaacgugggucccuuucuagcggucgaucagaaacacaacauucuucucaaguauaggugccauggaccaccgauucgcuucacuacaguguucaguaaugaacugcacuaugucgcuaacgagcucaacgggauugugggaggcaagaauacaguaguggccauugccguguggucccacuuuucgacguucccucuugaaguuuacaucagaagacugcggaauaucaggcgcgccguugugcgcuuguuggauaggagcccuaaaacugugguugugauacggaccgcaaacgcgcaagaguuaggcccagaggugagcuuauuuaauagcgauugguacaacuuucagcucgacacaauccuaaggcgcauguuuaguggagucggcguguacuuaguugaugcaugggagaugacccuugcacacuaccucccucacaaacuccacccagaugaagucauaguaaaaaaccagcuggauauguuuuugagcuuuguuugcccacuggagacauag

SEQ ID NO: 13147 - RNA, 402 nt, Artificial Sequence
  Description of Artificial Sequence: Synthetic coding sequence
auggcaaugguuucugccaugagcugggugcuguaucucuggaucuccgcuugugcaaugcuccucugucaugggaguuuacagcacacuuuccagcaacaccaccugcaccgcccagagggggguaccugugaggucauugcugcacaccgcugcuguaacaaaaaucggaucgaagagcggucucaaaccgugaaauguuccugucucccuggcaaggucgccgggacaacaagaaacagacccucaugcguggaugcaucuauugugauugguaagugguggugugaaauggaacccugccuugaaggagaagaguguaagacacucccggacaacucaggauggaugugcgcuaccgggaacaaaaucaagacaacaagaauccacccccggacauag

SEQ ID NO: 13148 - RNA, 606 nt, Artificial Sequence
  Description of Artificial Sequence: Synthetic coding sequence
augaaaguccacaugcugguuggagugcuggugaugguuggauuuacuguuggaaaggugcccgugccugacauccguacuugucacuuuugccuaguugaggaccccucugucggcuguauuagcggauccgagaaguguacaauuuccaguucaucucucuguauggucaucacaauuuauuacgacgucaaagugagauucaucguaagagggugugggcaguacauauccuaucgaugucaggagaaaagaaauaccuacuuugcugaauauugguaucaggcccagugcugccaguacgauuauuguaacuccuggucuucaccucaacugcagagcagucucccugagccucaugacagaccuuuggcccugccccuuagcgacucccaaauucagugguucuaccaggccuuaaaccuuagccuaccgcuaccaaauuuucacgcuggaacugaacccgauggccuggacccuaugguaacucuaucacuaaaucugggacuaagcuuugccgagcugagaagaauguacuuauuuuugaauucaucagggcugcuggugcuaccccaagccggucugcugacuccccauccguccuag

SEQ ID NO: 13149 - RNA, 606 nt, Artificial Sequence
  Description of Artificial Sequence: Synthetic coding sequence
augaagguacauaugcuuguuggggugcuggugauggugggauuuacagucggaaaggugcccgugccugacauacgcaccugccacuuuugucucguggaagauccuagcguaggcuguauuuccggcucagagaaauguaccauuuccucuaguucgcucuguauggugaucaccauuuacuaugauguaaaggugcgguuuaucguccgcggaugugggcaauacauuucuuauagaugucaggagaagcgcaacacauacuuugccgaguauugguaccaagcucaguguugucaguacgauuacuguaauucuugguccucuccgcaacuucagucuucacugcccgaaccccacgacagacccuuggcccuucccuugagugacagccagauacaaugguucuaccaagcuuuaaaucuuucuuugccacugccaaacuuccaugcuggcacugaaccagauggccucgaccccauggugaccuugucuuugaaucucggccugaguuuugcugaacugcgccguauguaucuuuucuugaacucuagugggcugcucguacuuccacaagccggauugcuuacgccacacccaagcuag

SEQ ID NO: 13150 - RNA, 732 nt, Artificial Sequence
  Description of Artificial Sequence: Synthetic coding sequence
augggacccgaagcucuuuccucucugcugcugcuccugcucguggccucuggggacgccgauaugaaaggccauuucgaucccgcuaaguguagguaugccuugggaaugcaagaccgaacuauucccgacagcgacauuucagcuaguucaagcugguccgauagcaccgccgcaaggcauucuaggcucgagagcucagacggagauggagcaugguguccugccgggucagucuuccccaaagaagaagaguaccuccagguugaucuucaaaggcugcaccuggucgcccuuguugggacucagggccgucaugcuggagggcugggcaaggaguuuagccgaucguauaggcucagauacucacgagaugguaggagauggaugggauggaaggaucgauggggucaggaggugauuuccgguaaugaggacccagagggggugguguugaaagauuugggcccacccaugguugccagacuggucagauuuuauccuagagccgaucgggugaugucagugugucucaggguggaacuuuaugggugcuuguggcgcgauugcucaaugggagugugggcuucauggcagaugguuuggugggguuggaugacccuuggacgugugagaucuuguggcucugggcaggccaugacaaugugggauggggccacgacugccucuccgguagcaauguggcgcuggagucugucucugacgggauag

SEQ ID NO: 13151 - RNA, 258 nt, Artificial Sequence
  Description of Artificial Sequence: Synthetic coding sequence
augaagauaccggugcugccggccguuguuuuacugagucuguuaguguuacacagcgcacaaggagcuacucucggcgggccugaagaggagagcacuaucgaaaacuacgcuucaaggcccgaagcauuuaaggcugaugaauuccuaaauuggcaugcuuuauucgaaucaauuaagcgaaaacucccuuuucucaacugggaugcauuucccaaacugaaaggucugcggucagccaccccagacgcucaguag

SEQ ID NO: 13152 - RNA, 348 nt, Artificial Sequence
  Description of Artificial Sequence: Synthetic coding sequence
augggaagaguguuccuuacaggcgaaaaggccaacucaauucugaaaagauauccucgugcaaacgguuuuuuugaagagauacgacaggguaacaucgagcgagaaugcaaggaggaguuuugcacauuugaagaggcucgcgaggccuucgagaauaacgaaaagacuaaggaauuuuggagcaccuauacuaaggcccagcagggggagagcaaccguggcagugauugguuucaguucuaccuuacuuuuccucuuaucuuuggacuauuuauuauucugcucguuauuuuucuaauuuggcggugcuuucuucggaauaagacucggcggcagacaguguag

SEQ ID NO: 13153 - RNA, 606 nt, Artificial Sequence
  Description of Artificial Sequence: Synthetic coding sequence
augaaaguccauaugcugguggguguucuggugauggugggauucacaguugggaaagugccuguccccgacauucgcaccugucacuuuugccucguagaagacccguccguuggauguauuucaggaagcgaaaaguguacaauuucuuccagcagccugugcauggucauaacaaucuacuacgacguaaaaguucguuucauugugcggggcugcggacaauacauuagcuaccgcugccaggaaaaaaggaauaccuacuuugcugaguacugguaccaggcacagugcugucaguacgauuauuguaacuccuggucuucuccacaguuacaguccucgcucccagaaccucaugaucgcccucucgcuuugccacuguccgacagccaaauccaaugguucuaccaggcucuuaaccucucuuuacccuuaccuaacuuucacgccggcacggaaccagaugggcucgaccccauggugacauugucauuaaacuuaggacugucauuugcugagcuuagacguauguaucuguuccugaauuccagcggcuuacuaguccuuccacaggcugggcuucugacuccccauccaucuuag

SEQ ID NO: 13154 - RNA, 1311 nt, Artificial Sequence
  Description of Artificial Sequence: Synthetic coding sequence
augcaaggaacgccaggaggcgggacucguccggggccuaguccuguggaucgcaggacguugcugguauuuuccuucauccuggccgccgcauugggacagaugaauuucacuggagaucaagucuugcgggugcucgcaaaagacgagaagcagcuuucccuguuaggagaucuggagggucucaagccucagaaaguagauuucuggcgagguccagcaaggcccucccugcccguagacaugcgcgugcccuucucagagcuaaaagacauaaaagccuacuuagagucccacggacuggccuauaguaucaugauaaaggauauccagguuuuauuagaugaggagcgucaggcaauggccaaaucacgaagauuggaaaggucaacuaacaguuuuucuuacuccucuuaucauacucucgaagaaaucuauuccuggaucgauaacuucgugauggagcacucugacaucguuuccaaaauucagauuggaaauucguucgaaaaccagucuauucugguauuaaaauuuucuacaggcggcagccggcaccccgccaucuggauagauacggggauccacucucgggaauggauuacucaugcgaccggaauuuggacagcgaauaaaauaguguccgauuacgguaaggaccgggugcugaccgacauucuuaacgcaauggauaucuucaucgagcuugucaccaaccccgacggguuugcuuuuacgcacucuaugaaccgacuguggcguaaaaauaaaucaauccgaccgggcauuuucugcaucggcguggaucugaaucgcaauuggaagucuggcuucggcgguaauggcuccaacucuaacccauguagugaaacuuaucacggcccgucuccucaaucugagccagagguugccgccaucgucaacuuuaucacagcccacgggaauuuuaaagcccuuauuagcauacauucauacucccagaugcucauguaucccuacgggagguugcuggaaccaguuagcaaccagcgcgaacuguacgacuuagcuaaggaugcagucgaggcuuuauauaaaguacacgguauagaguacauuuucggcaguauuucuaccacucuauacguagccucugggauaacgguugauugggccuacgacucaggaauuaaguacgccuuuucauucgaauugcgagauacaggccaguacggauuucugcucccagcuacacaaaucaucccuaccgcccaggaaacguggauggccuugcggaccauuauggagcacacccuuaaccacccuuauuag

SEQ ID NO: 13155 - RNA, 606 nt, Artificial Sequence
  Description of Artificial Sequence: Synthetic coding sequence
augggagccaccacaauggaccagaagagccugugggccggcgucgugguacucuugcuucuucaaggaggcuccgcuuauaagcugguguguuacuucacuaacuggucacaggaucgacaagagccgggaaaauucacuccagagaacaucgacccauucuugugcucccaucugauauacucuuuugccucaaucgagaauaacaaaguaaucaucaaggacaagucugaaguuaugcucuaucaaaccaucaacucccugaaaaccaagaacccaaaacucaagauucugcucuccaucgguggauaucuguuugguagcaagggauuucacccgaugguugacucuuccacgucccggcuagaguucauaaacucaauuauacuguuuuugcgcaaucacaacuucgauggauuagaugugucuuggauauacccagaucaaaaggaaaacacccauuucacagugcugauccaugaacuggcagaggcauuucagaaggauuucacaaagagcacgaaagagagacuacuauuaacagcagguguuagcgcugggcggcagaugaucgacaacucuuaccaggucgagaaacucgcuuag

SEQ ID NO: 13156 - RNA, 75 nt, Artificial Sequence
  Description of Artificial Sequence: Synthetic coding sequence
augcucguggaugggccauccgaacguccugcucucuguuuucugcuacuggcugucgcaauguccuucuucuag

SEQ ID NO: 13157 - RNA, 252 nt, Artificial Sequence
  Description of Artificial Sequence: Synthetic coding sequence
augagaccccgcggauuaccaccacuccugguuguucuucuggguugcugggcauccgugucagcccaaacugaugccaccccugcagucacuacugaaggcuugaacucuaccgaagccgcacucgccaccuuuggaaccuuuccgaguacucgcccucccggcaccccucgugccccugguccuucuagcgggccgcgacccacuccaguuaccgaugguagccauagcguuacacaagcuggagucuag

SEQ ID NO: 13158 - RNA, 1254 nt, Artificial Sequence
  Description of Artificial Sequence: Synthetic coding sequence
augcuagcccuucuuguacuugugacuguggcacucgcuagcgcucaucacggaggagagcacuuugagggugagaaagucuuuagggugaacgucgaggacgagaaccacaucaacaucauacgggaacucgccucuacgacucaaaucgauuucuggaaaccagauucugugacacagauuaaaccucacucuacaguggauuuuagggugaaagcugaggacacugugacuguggagaacgugcugaagcaaaacgaguugcaguacaaagugcuuauaagcaaucuccgaaacgucguugaggcacaguucgacucucgcgugcgggcuaccggccauucauaugagaaguacaacaaaugggagacaauugaagcguggacucagcaggucgcuacagagaacccagcccucaucucuagaagcgugauagggacaacauucgagggaagagccauuuaucuccuaaaagugggcaaagcuggucagaauaagccagcuaucuuuauggauugcggauuucacgcuagggaguggaucuccccggccuucugccaaugguuuguuagagaagcagucagaacauauggaagagagauccagguaacggaacuccuugauaagcuggauuucuauguccucccaguguugaacaucgacggcuacauauauaccuggaccaagagucgauuuuggcggaagacacggucaacgcauacgggcucuuccuguauuggaacagauccuaaccgcaauuuugacgccggauggugugagauuggagccuccaggaauccaugcgacgaaaccuacuguggaccugcggcugaguccgagaaagaaacaaaagccuuagccgacuuuauaaggaacaaacugagcagcaucaaggccuacuuaacgauccacuccuacagucaaaugaugaucuacccauauuccuaugccuacaaacucggggagaacaacgccgaauuaaaugcucuagcaaaggcuacagugaaagaacuggccucacugcacgggaccaaguacacuuauggcccuggugcuacuacaauuuaucccgccgccggcgguagcgaugauugggcuuacgaucaggguaucagauacucuuucacuuucgaacugcgcgacaccggcagauacggcuuccuucuacccgaaucacaaauaagagcuacuugugaagagacauuccuggcaauaaaguaugucgcuucuuacguucuugagcacuuauacuag

SEQ ID NO: 13159 - RNA, 1680 nt, Artificial Sequence
  Description of Artificial Sequence: Synthetic coding sequence
auguggaccaacuuuuucaaguugcggcucuucuguugccugcuggccgugcugaugguggugguauugguaauaaacguaacccagguggaguacuuggaucaugagaccgugagcgcuacuuuuaucgacuccucaggucaguuugucagcucucaagugaccgguauuagcaggaacccuuacugcggauaugaucagcagacccuuaguagucaagagagaauggaggaggauagucuccuugcggcccuucauaggcaggugcccgaugucggcccagucccguuuguuaaguccacagacccaucaucgucuuacuucgugauucuuaacagcgccgcuuucuucaaggucggaucccaacuggaggucuuaguucauguucaggacuuccaaaggaaaccuaagaaguaugggggggauuacuuacaggcucggauucacagucugaaacuucaagcuggggcugugggacggguggucgacuaccagaaugguuuuuauaaaguguucuuuacgcuuuuguggcccggcaaagucaagguuagcguuucacucgugcaucccuccgagggaauccgaguacugcagaggcuccaggaggacaaaccugacagaguguauuuuaagucccuauuucgaucaggacgaauaucagaaaccacugaauguaauguuugcuuaccagggaauuugccucucugcaacuuuaccgaucuauauaccggcgaaccaugguucugcuucaaaccuaaaaaacucccaugcucuucucgcauuacucauuucaaagguggcuaccucaagggccuccugacugcagccgagagugcguucuuccaaucaggcgugaacauuaaaaugcccgugaacuccagcggaccggauugggugaccgugauacccaggcgaaucaaagagacuaacucucuggaacugagucagggaucuggcacuuuucccucaggauauuacuacaaagaccaguggcggccucguaaguucaagaugcgccaguucaaugauccugacaauauaaccgaauguuuacagcggaaagucgugcacuuguuuggggauuccacuauuaggcagugguuugaauaucugacgaccuuugugcccgaccucguggaauucaaccucggcucacccaagaaugugggucccuuucucgcgguggaccaaaagcacaauauccuuuuaaaauacaggugccacggccccccuauacgguucaccacagucuucuccaaugaacuacauuauguggccaaugagcugaaugggauugucggcggcaagaauacaguugucgcaauugcuguauggucccauuucucuacguuuccccuugaaguuuauauucgaagguugcgcaacauacgcagggcugugguuaggcugcuugaucgcucacccaagacugucguugucauuaggacggcgaacgcucaggagcugggucccgaggucucccucuucaacucugacugguacaacuuccaauuagauacgauccuucggagaauguucagcggugucggagucuaucucguugacgccugggaaaugacacuggcacacuauuuaccccacaagcugcacccugaugagguuaucguuaagaaucagcuugacauguuucucuccuuugugugcccauuagagacuuag

SEQ ID NO: 13160 - RNA, 99 nt, Artificial Sequence
  Description of Artificial Sequence: Synthetic coding sequence
augcaggguacuccaggcggcggaaccagaccaggcccuagucccguggaucgacgaacucuacugguguuuucuuucauccuagcagcugcgcuguag

SEQ ID NO: 13161 - RNA, 180 nt, Artificial Sequence
  Description of Artificial Sequence: Synthetic coding sequence
augcuggcccuccucguacuggucaccguagcauuagcuucagcccaccauggaggggaacacuucgagggcgagaaaguguuuagggucaacgucgaagaugagaaucacauuaauaucauucgagaacuugccucuaccacucagauugauuuuuggaaaccagacagcgugaccuag

SEQ ID NO: 13162 - RNA, 303 nt, Artificial Sequence
  Description of Artificial Sequence: Synthetic coding sequence
augcggccaagaggucugccaccccucuuggucgugcugcucggaugcugggcuucagucucugcgcagacggacgcuacccccgcagucaccacagaaggcuugaacucgacagaggcagcccuugccacguuugggaccuuccccuccacgagaccgcccggaaccccuagagcuccagggccauccuccggaccucgcccuaccccaguuacugacggcggauaucacgugccagccccaggugugcacuccgacccuacuucucgaggccagccucgguguugcucucucugucucuag

SEQ ID NO: 13163 - RNA, 234 nt, Artificial Sequence
  Description of Artificial Sequence: Synthetic coding sequence
augcgaaguccgagaaugcgagucugugcgaagaguguucugcuuucucauuggcucuuccuggccuauguguugaugguguguugcaagcugauguccgccucaucucagcaucuccgggggcaugcuggucaucaucaaauaaagcaagguacgugugaagugguagcaguccauagguguuguaacaagaauaggaucgaagaaagaucccagacugucaaaugcucguag

SEQ ID NO: 13164 - RNA, 12 nt, Artificial Sequence
  Description of Artificial Sequence: Synthetic coding sequence
auguggacauag

SEQ ID NO: 13165 - RNA, 402 nt, Artificial Sequence
  Description of Artificial Sequence: Synthetic coding sequence
auggcaauggucucugcgaugucuuggguguuguaucucuggaucucggcaugcgcuauguuguugugucacggaucacuucagcacacuuuucagcagcaccaccugcauaggcccgaaggcgguaccugcgaaguaauugccgcacaucgcugcugcaacaaaaaccgcaucgaggagcggagccagaccgugaaaugcuccugccugccagguaaggucgcuggcaccacaaggaaucggccgucuuguguagaugcuaguauagugauugguaagugguggugcgagauggagccaugucuggaaggagaggaauguaagacacugccggauaauaguggguggaugugugccacaggaaauaagauuaagacgaccagaauucacccgagaacuuag

SEQ ID NO: 13166 - RNA, 600 nt, Artificial Sequence
  Description of Artificial Sequence: Synthetic coding sequence
augacaaugcgacauaacuggacaccagaucuaucaccucuguggguccugcuacuuugugcccacguggucacucugcugguaagagcuacccccgucucucagaccacuacugcagcuacugcaagugugagaucuaccaaagacccuugcccaagucaacccccgguguucccagcagcgaagcaaugcccugcucuggaggugaccuggcccgagguggaaguuccucugaacggaacgcuuucucuuuccuguguggccuguucuagauuccccaacuuuucuaucuuauauuggcuuggcaauggcagcuucaucgagcacuuaccaggcagacugugggaagggagcacuagcagagaacgcggcucuacaggcacacagcuguguaaggcauuaguacuggaacaguuaacacccgcucuacacucgaccaacuuuaguugcguacugguggaccccgagcaggugguccagcggcacgucgugcuggcucagcucuggguucgaucgccuagaaggggguugcaggaacaagaagaauuguguuuccauaugugggguggaaaggggggccuuugucagucuagcuuguag

SEQ ID NO: 13167 - RNA, 1044 nt, Artificial Sequence
  Description of Artificial Sequence: Synthetic coding sequence
auggggguugugcaguacggagacaacccagcuacgcauuucaacuugaagacccauacgaauucacgcgaucuaaagacagcuaucgaaaagaucacgcaaagggguggccuaagcaaugugggccgagcuauaagcuuugugacuaagaauuuuuuuucgaaggccaacgguaauaggaguggggccccuaauguugugguagugaugguggauggauggccaaccgacaaaguagaagaggcaagccgacuggcucgagagucugggaucaauaucuuuuucaucacuaucgagggggccgccgaaaacgagaaacaguauguugucgagcccaauuuugccaacaaggccgugugccgcacuaacggguuuuauucccuccauguucaauccugguucggccuccauaagacccugcagccuuuggucaaacgggugugcgauacagaucgcuuggcuuguuccaaaaccuguuugaauucugccgauaucggguucgugaucgacggcaguucuagcguugggacagggaacuuuagaaccgucuugcaguuugugacgaacuugaccaaagaauuugaaauaucugacacagacacccggauaggagcaguccaguauacguacgaacaacgauuggaguucggauuugacaaauauuccucuaagccagacauacucaaugcuauaaagaggguggguuacuggucugguggcaccuccaccggcgcugcuaucaauuucgcuuuagagcagcuauuuaagaaauccaaacccaauaaaaggaaacugaugauccugaucaccgacggaagaucuuacgaugacguuagaauccccgcgauggccgcacaucugaagggaguuauuaccuaugcaauaggcguggccugggccgcucaggaggaacucgagguuauugccacacauccugcacgcgaucauucuuuuuucgucgacgaguucgauaaccugcaccaguacgucccuagaauuauccagaacaucugcacugaauucaauucucagccuagaaacuag

SEQ ID NO: 13168 - RNA, 27 nt, Artificial Sequence
  Description of Artificial Sequence: Synthetic coding sequence
augcaaggaacaccagggggcggcuag

SEQ ID NO: 13169 - RNA, 369 nt, Artificial Sequence
  Description of Artificial Sequence: Synthetic coding sequence
auguuguaucagacaaucaacucucuuaagaccaaaaauccuaaguuaaaaauucugcugucaauuggcggguaccucuuuggaaguaaagguuuucauccaaugguggacaguaguacuucucguuuagaauuuauaaauaguaucauccuguuucugaggaaucauaauuuugacggacuggacgugagcuggauuuauccagaucagaaggagaacacgcauuuuaccgugcugauccaugagcuggccgaggcuuuccaaaaagauuucacgaaguccacuaaagaacgcuuauuacucacugccggggucagcgccggacgacagaugaucgauaacuccuaccagguagaaaaacuggccuag

SEQ ID NO: 13170 - RNA, 309 nt, Artificial Sequence
  Description of Artificial Sequence: Synthetic coding sequence
augcggguuagugggguguuacggcugcuggcucugaucuucgcaaucguuaccaccuggauguucaucagaucuuacaugagcuuuucuaugaaaaccauucgccuaccaagauggcuugccgccagccccaccaaagaaauucaggugaaaaaauauaagugcggacugauaaaaccaugcccagcaaauuauuuugccuuuaagaucugcucuggagccgcuaauguggugggaccaacaaugugcuuugaggaucggaugaucaugagcccaguaaaaaauaacguggggagaggccugaauuag

SEQ ID NO: 13171 - RNA, 660 nt, Artificial Sequence
  Description of Artificial Sequence: Synthetic coding sequence
augaaacuccugcugugggccugcaucguaugcgucgcuuuugcccggaaaagacgcuuucccuuuauuggugaggaugauaacgacgacggccacccuuugcaccccagccugaauauccccuacggcauacgcaaucugcccccucccuuguacuaucggcccguaaacacaguacccagcuauccggguaacacuuacaccgacaccgggcugcccuccuaucccuggauucugacuucaccaggauuucccuacguuuaucacauccgcgguuucccgcuugccacacaguugaaugugccuccucugccucccagaggcuuuccuuucgucccccccucgagauuuuuuagcgccgccgcugcccccgccgccccaccaauugcagccgagcccgcagccgcugcgccccugacagcuaccccgguugccgcugaacccgccgccggggccccugucgccgccgagcccgccgcugaagccccugugggcgccgaaccggcugccgaagcaccuguggcagccgaaccagccgcagaggccccagugggaguggaacccgcugcugaggagcccuccccagcagaaccagcaacagcuaagcccgcugcuccagagccucacccuagcccuagccucgaacaagcaaaccaauag

SEQ ID NO: 13172 - RNA, 1869 nt, Artificial Sequence
  Description of Artificial Sequence: Synthetic coding sequence
augggcaagagugaagguccaguggggaugguggaguccgcagggcgggcgggacaaaagcggccagguuuccucgagggcggucuguuguugcuauuguuauuagucacagcugcgcuggucgcccucggaguacuguacgccgaucgccgagguaaacagcugccgagacuagcaagucggcuuuguuuucugcaagaagagcgcaccuuugucaaacgcaagccaagagguauucccgaggcucaagagguuucagaggucugcacuacuccuggcuguguaauugccgcagccaggauuuugcagaauauggaucccacuaccgaaccaugugaugauuuuuaucaguucgcuuguggagggugguuacgccgacacguaauucccgaaacaaauuccagauauucaaucuucgauguucuucgcgaugaauuagaaguaauuuugaaagccguucucgagaauagcacugcuaaggcaacaguuccccaagaagagagacaugacguaauugcucuguaccauagaaugggccuugaagaacuccaaagucaguucggcuuaaaagguuuuaauuggacauuguucauccagaccguguugagcucaguuaaaaucaagcugcugcccgaugaggagguggugguauaugguaucccguaccugcaaaaccuggagaacaucaucgauaccuauagugccaggaccauucaaaauuaucugguguggcggcucgugcucgacaggaucgggucccugagccagagauucaaagacacucgugucaauuacaggaaggcacuguuugggacaaugguggaagagguacgguggcgggaaugcgugggcuaugucaacagcaauauggagaacgcaguagguagccuguauguuagagaggcguucccaggugacaguaagagcaugguuagggagcugaucgacaaggugcguaccgucuuuguggagaccuuagaugagcuuggcuggauggacgaggagucuaagaagaaggcacaggagaaagcuauguccauaagggaacagaucggucacccagauuauauacuggaggaaaugaacagacgucuagacgaggaguauucuaaucuaaacuuuucagaggacuuguacuuugaaaacuccuuacaaaaccucaaagugggcgcccagcgcagccuacgcaagcugcgggaaaaagucgaucccaaccuguggaucauuggugcugcaguaguaaaugcguucuacucaccaaaccgcaaccagaucguuuuccccgcugguauacuacagcccccuuucuucaguaaagagcagccacaggcucucaauuucgguggcauuggcauggugauuggacacgagauuacccaugguuucgacgacaauggccguaauuucgacaagaaugggaacaugauggacugguggucgaacuuuagcacgcagcacuuucgggaacagucugaauguaugauuuaccaguacggaaauuacuccugggaucucgcggaugaacaaaaugugaacggcuucaacacacugggugaaaacauugcagauaauggcgggguacgccaggcuuacaaggcuuaccugaaguggauggccgagggcggaaaagaccaacagcugccuggauuagaccugacacacgaacagcuuuuuuucauaaacuaugcccaaguuuggugugguucuuauaggccugaguuugccauccagucaauaaaaacugacgugcacagcccacuuaaauaucgcgugcuugggagucugcagaaucuggcugcauuugcagauaccuuccauugcgcuagagggacccccaugcaucccaaggagcguuguagagucugguag

SEQ ID NO: 13173 - RNA, 168 nt, Artificial Sequence
  Description of Artificial Sequence: Synthetic coding sequence
auggggccagaagcccuaucaucccuucuccuacuccuauuagucgccuccggugacgcagauaugaaaggccauuuugaucccgcaaaguguagguacgcucugggcaugcaggaccgcacaauaccugauuccgacaucagcgcuaguuccuccuggucugauuag

SEQ ID NO: 13174 - RNA, 156 nt, Artificial Sequence
  Description of Artificial Sequence: Synthetic coding sequence
augggaccagaagcacugucaucucucuuguuguuguugcucguggccucuggagaugcggauaugaaaggccacuucgacccugcuaagugccgguacgcccugggcaugcaagaucgaaccauucccgacagcgauaucucagccucuucauag

SEQ ID NO: 13175 - RNA, 1620 nt, Artificial Sequence
  Description of Artificial Sequence: Synthetic coding sequence
augucugagccucaggaaaaaaaacugagcgagaauacggacuuccucgcucccggcguguccucuuuuaccgauucgaaucagcaggaauccaucacaaagcgcgaggaaaaccaggagcagccacggaauuacucucaccaccaacuuaacagaagcuccaaacacucccaaggccuccgugaccagggcaaccaggaacaggauccuaauaucucgaacggagaggaggaggaagagaaagagccaggcgaagugggcacucacaaugacaaucaagagcggaagaccgagcuaccgcgggaacacgccaauucaaagcaagaagaggacaauacccagucagacgacauacuugaggaaagugaccaacccacacaagucucaaaaaugcaagaggacgaguucgaccagggcaaccaggaacaggaagauaacucuaaugcugaaauggaggaagagaacgcaagcaacguuaacaagcacauccaagagacggaauggcagucacaagaaggaaagacaggauuggaggccauuucaaaccacaaagaaacagaggagaagacgguguccgaggcucuguuaauggaaccuaccgaugacggcaacaccacacccaggaaccacgguguagacgacgacggcgacgacgacggcgacgacggcgggacagacggcccaagacauuccgccagcgacgauuauuucauacccucucaagcauuucuggaagccgaacgugcucaaagcauagcauaccaccucaaaauugaggaacagagagagaaaguccacgagaaugaaaacauagggaccacggaaccgggcgaacaccaagaggccaaaaaggccgaaaacucaaguaaugaggaggagacaucuagcgaagguaauaugcgaguucacgcaguggacuccuguaugucguuccaguguaaacggggacacauuugcaaggcggaucaacagggcaaaccacauugugugugucaggauccugugacauguccaccaacuaaaccccucgaucagguuuguggcacugacaaccagacauaugccagcagcugccaucucuucgcuacuaagugccgccuggaaggaaccaaaaagggacaccagcuucaacuggacuacuuuggggccugcaagagcauaccgaccugcacugacuuugaagugauucaguuuccauugcggaugcgcgauuggcucaaaaauauccugaugcaacucuaugaagcuaacuccgagcacgcagguuaccucaacgaaaaacaacgcaauaagguaaaaaagauuuaucuugaugaaaagcgccuccuggcaggcgaccaccccaucgaccuucuccugcgagauuucaaaaaaaauuaucauauguauguguacccaguacacuggcaguucagugaacuugaccagcauccuauggacagggucuuaacgcacucugagcuggccccacuacgugcgucccucguccccauggagcacugcauaacccgguuuuuugaagaaugcgaucccaauaaagauaaacacauuacacugaaagaguggggacauugcuuugggaucaaagaggaagauaucgacgaaaauuuacuuuucuag

SEQ ID NO: 13176 - RNA, 591 nt, Artificial Sequence
  Description of Artificial Sequence: Synthetic coding sequence
augccacaccucgcaucacucuucaccgcaagcucgagaugcuguccccauccacucagaccagaggguagcggagccaugggaccugaagccuuaagcucccugcuucucuugcuguuagucgcuagcggugacgccgacaugaaaggucacuuugacccagcuaagugucguuacgcccuagguaugcaagacagaaccaucccugauuccgacaucagcgcuuccaguaguuggagcgacagcacggccgcacggcacagccggcuggagaguagcgauggcgacggagccuggugcccggcugggucgguguucccuaaagaagaagaauaccuacagguggaccugcaacggcugcaccuggucgcucugguggggacacagggucgucacgcugggggccuaggcaaagaauuuucgcguuccuacaggcugagauacucccgcgacgguagaagauggauggguuggaaagacagguggggccaagaagucaucucuggcaacgaggacccagagggaguugugcugaaagaucucgggcccccgauggucgcaagacugguaagguucuacccccgcgcauag

SEQ ID NO: 13177 - RNA, 162 nt, Artificial Sequence
  Description of Artificial Sequence: Synthetic coding sequence
auguugccgugccuugcuuuacuccuccuuauggaacugagcguaugcacagucgcgggcgauggaggagaagagcaaacauugucuaccgaagcggagacaugggucauugucgccuuggaggugcugcuugggagggguucugaugagggaagaggauag

SEQ ID NO: 13178 - RNA, 126 nt, Artificial Sequence
  Description of Artificial Sequence: Synthetic coding sequence
augggcccugaagcucuuuccucccugcuacugcuguuacucguugccuccggcgacgcugacaugaaaggacacuuugacccagccaaauguagguacgcccucggaaugcaggauagaacauag

SEQ ID NO: 13179 - RNA, 222 nt, Artificial Sequence
  Description of Artificial Sequence: Synthetic coding sequence
augggcccugaagcauugaguucuuuacuauugcugcuccuaguugcaaguggcgacgccgauaugaagggacauuuugaccccgcuaaaugccgguacgcccuuggcaugcaagaucgaacgauucccgauagcgauaucucugccagcucuaguugguccgacuccaccgccgcaagacauagucggcucgaaucuagcgacggcgauggugcgugguag

SEQ ID NO: 13180 - RNA, 369 nt, Artificial Sequence
  Description of Artificial Sequence: Synthetic coding sequence
augggucccgaagcucugagcucauugcuacugcugcuacucguugcgucaggugaugccgauaugaaggggcacuuugaccccgcuaagugccguuacgcacugggcaugcaggaccgcacaauuccggauagcgauauuuccgccuccucauccuggagcgacagcaccgccgcuagacacucgagguuggaaucuagugauggggauggggcgugguguccggccggcaguguuuucccuaaagaagaagaguaccuccaagucgaccugcagagacuccaccuuguggcuuuagucggaacacaaggucggcaugcaggaggccugggaaaagaguuuagucgcagcuaucgucugcguuauuag

SEQ ID NO: 13181 - RNA, 483 nt, Artificial Sequence
  Description of Artificial Sequence: Synthetic coding sequence
augggacccgaagcucucucuucauugcuguugcugcugcucgucgcuaguggagaugcugacaugaaaggacacuuugaccccgcaaaauguagguacgcccugggaaugcaggaccgcacgaucccggauagcgauauuagcgcaucuucaagcugguccgacuccacggcagcccgacauucucgucuugagagcagcgauggcgacggcgcuugguguccugccgggaguguauucccuaaggaagaggaauaccuccagguggaucugcagcgucugcaucugguagcuuuagucgguacucaaggacgccaugccgggggucugggaaaggaauucagccggaguuauaggcugcguuauucgagagacggccguagauggaugggguggaaagaucguuggggucaggaagucauuuccggcaacgaagaucccgaaggcguaguguugaaagaucuugguccuccuauggucuag

SEQ ID NO: 13182 - RNA, 540 nt, Artificial Sequence
  Description of Artificial Sequence: Synthetic coding sequence
auggggaguuccggccuccuaagucuccuaguguuauuugucuugcuggcuaaugugcagggacccggccugacugacuggcuguucccgagaagaugucccaaaauaagagaagagugcgaguuccaagaacgagacgugugcaccaaggauagacaaugucaggauaacaaaaaguguugugucuuuaguugcggcaaaaagugccuugacuuaaaacaagacgugugugaaaugccaaaggaaacugggcccugucuggcguauuuucuucacuggugguacgauaagaaagacaacaccugcaguauguuuguuuauggugggugucaggguaauaacaacaauuuccaguccaaggcgaauugucugaacacguguaagaacaagcagcccuguccuaagauuaaaguugaaugcgagguggaagagauugaccaaugcaccaagccacgcgauugucccgaaaauaugaaguguugucccuucucccgcggcaagaaguguuuagauuuccgcaaggcuucccuuuccacauag

SEQ ID NO: 13183 - RNA, 438 nt, Artificial Sequence
  Description of Artificial Sequence: Synthetic coding sequence
auguuauuuaggaaccgauuccugcuucugcucgcccuugccgcacuucuggcuuucgugucacuuucccuacaguuuuuccacuugauccccgugucgacucccaagaauggaauguccaguaaauccaggaagagaauuaugccggaccccgugacugagccucccgugaccgaccccguuuaugaagcucugcucuacuguaauauucccucuguagcugagagaaguauggaaggacaugccccacaccacuuuaagcugguuuccguccacguauucauccgccacggugacagguacccucuguaugugauucccaagacuaaacgcccugaaauagauuguacacugguggccaaccgaaagcccuaucacccuaaacucgaagcuuucauaagccauaugucaaaaggcagcggagcauccuucgaauag

SEQ ID NO: 13184 - RNA, 399 nt, Artificial Sequence
  Description of Artificial Sequence: Synthetic coding sequence
auggggccugaggcucuuaguagucuccuacugcugcuacuagucgcuagcggagacgcggacaugaagggacauuucgaccccgcaaaguguagguacgcccuuggaaugcaagaccgaacuauuccagauucugauaucucugcaucuuccucguggucagauagcacugccgccaggcauagcagacuggaguccucagacggcgacggagccuggugcccagccgguagcguguuuccgaaggaggaggaauaucugcaagucgaucugcaacgccugcaucuaguggcauuaguagguacucagggcagacacgcagggggacucggaaaagaauucucccgguccuauaggcuccgcuauagcagggacggccgaagguggaugggaugguag

SEQ ID NO: 13185 - RNA, 306 nt, Artificial Sequence
  Description of Artificial Sequence: Synthetic coding sequence
auggggcccgaggccuuaucaucacuucuuuuacuccucuuaguugccucuggugacgcagacaugaaaggucauuuugacccagcuaaaugccgauacgcacuuggaaugcaggacagaaccauaccagacagcgacaucagcgcaucauccucuuggucugacucaaccgcagcaaggcacucucgucuggaaaguagcgacggcgauggagccuggugucccgccggaagcguguucccaaaggaggaggaguaccugcaagucgaccuucagcgccuucaucucguggcacucguggguuag

SEQ ID NO: 13186 - RNA, 393 nt, Artificial Sequence
  Description of Artificial Sequence: Synthetic coding sequence
augcuggccccacuuuuucugugcuguuugagaaaucuguucaggaagcuuauuuccuuccagcccccccaguuaggucgaacuaacaugcauuauagcaagcucccacgcaccgccaucgaaacagaauuuaagcaaaacgucgggccccccccgaaggaucucacugccgaagucuauuuucccuccauuaagucccgcucucaccuccccgccguguuuuauaaucaguauuucaagcaucccaaaugcgucggagaguaugggccgaaaaacggagcugaacgccagaucgaggaacgcaagguucugcccaccacgaugauguuuuccaugcuugccgauuguguauugaagucuacccccauccccauucugggugucgcaauguag

SEQ ID NO: 13187 - RNA, 420 nt, Artificial Sequence
  Description of Artificial Sequence: Synthetic coding sequence
augcccgcgaucgccguccucgcugccgcugcugccgcaugguguuuccuucagguagaaagccgucauuuagacgcucucgcaggcggagccgggccaaaccacggcaauuuuuuggacaacgaccaauggcucuccaccguuucgcaguacgaccgggacaaguacuggaaccgauuucgcgaugaugauuacuuuaggaacuggaacccaaacaagcccuuugaccaggcccucgaucccucuaaagaucccugucugaaggugaagugcuccccccacaaagugugcgugacucaggacuaccagaccgcgcucugcgucucccggaaacaccuguuaccuaggcaaaagaaggguaaugucgcccagaagcacuggguagguccaucuaaucuggugaaguguaaaccuugcuag

SEQ ID NO: 13188 - RNA, 510 nt, Artificial Sequence
  Description of Artificial Sequence: Synthetic coding sequence
augcgucuccugauucucaccugucugguggcugucgcccuugcccggcccaaacugccacugcgcuacccugaaagacugcagaacccaagugagucgucagagcccauuccacuggaaagccgcgaagaguacaugaacgguaugaauagacagaggaacauucugcgcgaaaaacagacagaugagaucaaaaauugcguggucgccgaaccugagaaaauggagaguagcaucagcuccagcagcgaagaacaguuuugcagacugaacgaguacaaucaacugcagcuccaggccgcucaugcgcaggagcagauucgcaggaugaacgaaaauagccaugugcagguuccuuuucaacagcuaaaccaacuggccgccuacccuuaugcagugugguacuacccucaaauuaugcaauacguacccuuuccacccuucagugacauaucuaacccgaccgcucacgaaaacuaugaaaaaaacaacgugaugcuucagugguag

SEQ ID NO: 13189 - RNA, 921 nt, Artificial Sequence
  Description of Artificial Sequence: Synthetic coding sequence
augaagaaggacgagccaccccuggacuuucccgauacccuggaaggcuuugaguacgccuucaacgagaagggccaacucagacacauaaagacaggcgagccauucguguucaacuauagggaagaucugcauagauggaaccaaaagagauaugaggcacucggugagauuaucacgaaauacguguacgagcugcuagagaaagacugcaaccuaaagaaaguguccauuccugaagguuauggagugauaguccucaaccccaacgaaaacuauauugaagucgagaagccaaagauccacguacagaguuccucugauucaagcgacgaacccgccgaaaagagggaacggaaagacaagguaaguaaagaaacaaagaagagacgcgauuuuuacgaaaaauaucggaacccacaacgcgagaaagagaugaugcaauuauacauccgugaaaacggcucuccggaggagcaugccauuuacgugugggaccacuuuauagcucaagccgccgcggagaauguauuuuucguagcccacaguuacggaggccuggcauuugucgagcugaugauacagcgagaagcugacgugaagaacaaaguuacugcagucgccuugaccgacucuguccauaaugucuggcaccaggaagccggcaaaacaauuagggaauggaugcgcgagaacugcuguaauuggguuaguuccuccgagccucuugacaccuccguugagagcaugcugccagacugccccaggguuuccgcuggcacagauagacaugaacugacguccuggaagaguuuuccuucaauuuucaaguucuuuacagaggccagugaggcgaagacaagcaguuuaaaacccgccgugacccgacguucucaucguauuaagcaugaagaauuguag

SEQ ID NO: 13190 - RNA, 2862 nt, Artificial Sequence
  Description of Artificial Sequence: Synthetic coding sequence
ugacaacugugcuggcucccuuugcuagccccucuuuuauuacuccgaccccccggaguucagagugcuggaccuauuagagcauucgugguuccacacucacacauggacgugggcuggguguacacugugcaggagucuaugagagcuuacgccgccaacgucuauacuucugucguagaggaacuggcucgcggccagcagcggagguuuauugccguggagcaagaguucuuucgucuguggugggauggcguugcgucagaccagcagaaauaccaagugcggcaguuacuggaggagggaagacuugaauuugucaucggaggccaagucaugcaugacgaagcaguaacccauuuggacgaccagauacuucaauugacagaagggcauggauuccuauacgagacguucgggauacgaccucaauuuaguuggcaugucgauccguuuggugcguccgcaaccacaccaacauuguucgcccuugcuggcuuuaacgcucacuugggguccagaauagacuacgaucugaaagccgccaugcaggaagccaggggguuacaguuuguguggagaggcagcccuuccuuaagugaaagacaagagauauuuacucacaucauggaccaguauucuuacugcaccccaucacacauuccuuucucgaaccgcucuggauuuuauuggaacgggguggccguguucccgaagccaccucaagacggaguguacccgaauauguccgagccuguuaccccugccaauauuaaucuauaugccgaggcucuagucgcuaacguuaagcagagggcggccugguuccguaccccucacgugcuguggccauggggcugcgauaagcaguuuuucaacgcaagcgugcaguucgcaaacauggacccucugcuggaucauauuaacucccacgcugccgagcucggcguuucugugcaguacgccacccuuggggacuacuuccgagccuuacacgcccugaacguuacauggcgggugcgagaccaucacgauuucuugccuuauuccacugagccuuuucaggcuuggacuggcuuuuacaccucccgguccucucugaagggguuagccagacgugcgucugcacugcuguaugccggggaaaguauguucaccagauaucucuggccggccccaagaggacaccuugacccuacuugggcacuccaacagcuccagcagcugagaugggcuguuagcgagguacagcaucacgaugccauuaccggaacagaauccccaaagguucgagacauguacgcuacccaccucgccagcggaaugcuggggaugcggaaacugauggcuucuauuguacuggacgagcugcagccgcaggcccccauggcugcaucuuccgacgccggucccgcagggcauuucgcaagcguguacaaucccuuggcauggaccguuaccacaauuguuaccuuaaccgugggauuuccaggcgucagggugacagaugaggccggucaucccgucccuucucagauucaaaauucuaccgagacuccguccgcuuacgacuugcugauucucacgaccauccccggcuugucuuaucggcacuacaauauuagaccaacugcuggugcccaggaaggcacacaggagccggcugccacuguugcaaguacucugcaguucggcaggcggcugagacguagaacgagucaugccggucgguaccucguacccguggcaaacgacugcuacauaguucuccucgaucaagacacaaacuugaugcauuccauaugggagaggcaguccaaccggacaguucgcguaacucaagaauucuuagaauaccacgugaauggugacgugaagcaaggcccaauuagugauaauuaccuuuucaccccaggcaaggccgcuguccccgcaugggaggcaguugagauggagaucguugcaggccaauuaguuacagaaauacgacaguauuuuuacaggaacaugaccgcucaaaacuauacguacgcaauccggagccgacugacacacgucccgcagggacaugacggcgagcuacucugccaccgcaucgaacaagaauaucaggcagggccccuggagcuuaaucgcgaagcggucuuacggacaucaacaaaucugaauagccagcaagugauuuauagcgacaauaacggauaccagaugcagcgucgaccguacgucucuuacgugaauaauucuauugcccgcaauuacuacccuauggugcaauccgcauuuauggaggacggaaaaucaaggcuggugcuucucuccgagcgcgcccacgggaucaguucucagggcaacgggcagguggaaguuaugcuccaccggaggcuguggaauaacuucgauugggaccucggcuauaaccuuacccucaacgacacgaguguggugcacccaguccuuugguugcucuuaggcucauggagucugacaaccgcucugcgccagaggagugcucuagcucugcagcaccgcccugucguguuauucggagaucucgcgggaacugccccaaaacuaccuggcccucaacagcaggaggccguaacgcuuccuccaaaccuccaccuccagauacucaguauaccuggauggagguauuccuccaaucacacggagcauucccaaaaucugcggaagggacacagaggcgaagcccaagcugaucuccgacgagugcuguugcggcuauaucaucucuaugaagucggagaggauccaguucuaucucaacccguuacugugaaucuggaggugaauuuuccuacuccuauucagaccauaagccaggguagcaagccuuag

SEQ ID NO: 13191 - RNA, 459 nt, Artificial Sequence
  Description of Artificial Sequence: Synthetic coding sequence
augcgauucaagacuacugccaaggauggacuucugcucuggaggggggauucaccaaugagaccaaacuccgauuuuauaucucugggccugcgggauggagcucucguguuuucuuauaaucucggaucaggaguugcaucuauuaugguuaauggaaguuuuaaugacgguagauggcacaggguaaaagcuguucgugauggucagagcgggaaaauuacuguggacgauuacggggcucgcacaggcaaaaguccggggaugaugcgacagcugaacauuaauggugcucucuacguugggggcaugaaagaaauugcgcugcauacaaaccgacaauauaugagaggccuggugggauguauaagccauuucacauugaguacggacuaccauauuagucuaguugaagaugccguggacgguaagaauaucaacacuugcggugccaaauag

SEQ ID NO: 13192 - RNA, 1701 nt, Artificial Sequence
  Description of Artificial Sequence: Synthetic coding sequence
auggauuuuuuacuugcacuuguuuuggucucaucucuauaucuucaggccgcugcagaauucgacgggagauggcccagacaaauuguuucgucuauuggcuugugcagguauggaggcagaauugacuguugcugggguugggcucgacaguccuggggacagugucagcccgugugccagccacggugcaaacauggagaguguaucggucccaauaagugcaaaugucacccaggcuaugccgggaaaacuuguaaccaggacgaacauauuccugccccccuggaccaaggcagugagcagccacuguuucaaccccuggaucaccaagccacaucccugcccucccgggacuugaacgaaugcggccucaaacccaggccuugcaaacaucgcugcaugaacaccuacggaucuuacaaaugcuacugccugaauggcuacaugcugaugcccgaugggaguuguuccucugcucucacaugcucgauggcaaauugucaauacgggugcgaugucgucaaaggccaaauaaggugccaauguccuagccccggacuucaauuggccccagauggcaggaccugcgucgacguugaugagugcgccacuggccgcgccuccugcccccgcuuccggcagugugugaacaccuucgggagcuacaucugcaagugccacaaaggguucgaucucauguauaucggaggaaaauaccaaugccaugauauagaugaaugcucccuuggccaguaucaguguagcucguuugcacggugcuauaauauaagaggaucauauaaaugcaaauguaaggaaggcuaucagggcgaugggcugaccugcgucuacauaccgaaaguuaugaucgagccauccgggccgauacacgugccuaagggcaacggaaccauccugaaaggcgacacagggaauaauaauuggauaccugacguaggaaguacaugguggccuccuaagacuccguacauaccuccaaucaucaccaaccgccccaccagcaaaccaacaacccgaccaacuccuaaaccaacccccauacccaccccuccucccccgccaccccugccaacugaacuucguacgccccugccuccuaccacaccagagcggccuacuacuggacuaacaaccaucgccccagcugcaucuacuccuccugguggcauuacuguagauaaccgcgugcagaccgauccucaaaagccgagaggggacguuuucucuguguuggugcacucuuguaacuucgaccacggacugugcggauggauacgagagaaagacaaugaccuucacugggagccaaucagggauccagccggugggcaguaccugacaguguccgcugcuaaagcaccaggaggaaaggcugcucggcugguucuuccccucgguagacugaugcauucaggcgacuuguguuuaagcuuucggcauaagguaacugggcugcauucuggaacgcuccagguguucgugagaaagcacggcgcucauggggcagcucucuggggccgcaacgguggccacggcuggaggcaaacacaaaucacacuucggggagcagacaucaagagugugguuuucaagggagagaagcggcgaggccauacaggcgaaaucgguuuggaugaugugagccugaaaaaaggacauuguucugaggagagauag

SEQ ID NO: 13193 - RNA, 213 nt, Artificial Sequence
  Description of Artificial Sequence: Synthetic coding sequence
auggguccagaagccuuauccucccuccuuuugcugcuuuuaguugcauccggugacgcugacaugaaggggcacuucgauccagccaaaugccgcuacgcccuggguaugcaggaucgcacgauacccgauagugacauuucagcaaguuccucuuggagugauagcacggcagcaagacauuccagauuggagaguucugacggcgauuag

SEQ ID NO: 13194 - RNA, 237 nt, Artificial Sequence
  Description of Artificial Sequence: Synthetic coding sequence
augggucccgaagcauugucuucccuacugcugcugcugcugguugccuccggagaugcugauaugaagggccauuuugaccccgccaaguguagguacgcuuuggggaugcaagaccgcacuauuccagacuccgacaucucugcuucuuccucauggucugacucuaccgccgcccgacauucaagacuugagagcagcgauggcgacggcgcaugguguccugccgguucuuag

SEQ ID NO: 13195 - RNA, 339 nt, Artificial Sequence
  Description of Artificial Sequence: Synthetic coding sequence
augagauucaaaacuaccgccaaggauggucuguuauuguggagaggcgauucaccaaugcgucccaacagugacuuuauuucacugggucuccgcgacggcgcccucguguuuucuuacaaucuggggaguggaguagcuagcauuaugguuaauggaucauuuaacgacggccguuggcaucgggugaaggcaguucgcgacggucagucuggcaagauaacagucgacgauuacggugcccgcacaggcaaaucuccaggcaugaugagacaguuaaacaucaauggggcauuauacguaggcggcaugaaagaaaucgcucuucauacaaacuag

SEQ ID NO: 13196 - RNA, 2685 nt, Artificial Sequence
  Description of Artificial Sequence: Synthetic coding sequence
auguccuugccucgcugcuguccccauccccuccggccagaggguucuggagccaugggaccugaggcacucagcagccuacugcucuuguuauugguggcgaguggagaugccgacaugaaaggucacuucgacccagccaagugcagguacgcucuuggcaugcaggaucgcacgauucccgacucugauauuucugcuucauccuccuggagcgacucaacugcggccagacauuccagacucgaaagcucagauggugacggggcgugguguccagccggcagcguauucccaaaggaggaagaguaccugcaaguugauuugcagcgccuucacuugguggcccuuguagguacccaggguagacaugccggagggcuugguaaagaauuuuccagaucuuacagacugcgcuacagccgggauggcagaagauggaugggcuggaaagaccgguggggacaggaagugauuuccggaaaugaggauccagaggguguagugcuaaaagaccucggaccuccaaugguggcucggcuugugagguucuacccucgcgcugaccggguuaugagugugugccugcgcgucgagcuuuauggcugccuguggagagaugguuuauugucuuacacugcucccguuggccaaaccauguacuuaucggaagcaguguacuuaaaugauuccacguaugacggacauacagucgggggcuugcaauauggggggcugggacagcuggccgauggcguagugggguuggacgacuuucggaaaucucaggagcugagaguuuggccuggguaugacuauguuggcuggagcaaccauucauuuagcucuggguacgucgaaauggaauuugaguuugaccgccucagagcuuuccaggccaugcaggugcacugcaacaacaugcacacucucggcgcgcgccuuccagggggagucgaauguagauuucgccgggguccggccauggcuugggaaggcgagcccaugcgacacaaccugggcggcaauuuaggugauccacgggcucgggccguuagugugccuuuggggggucguguggcccgcuuccuucaauguagguuccucuuugcuggccccuggcugcuguucagcgagaucuccuuuauuucagacguagucaauaacagcucaccagcuuugggaggcacauucccccccgcaccuugguggccuccagguccccccccuaccaauuucuccagcuuggaauuggaaccccggggccagcagcccguggcuaaggcugaggguucaccgacagcaauucugaucggaugucuuguggccauaauuuugcugcuauugcugaucauagcacucaugcuguggcgccugcacuggcgccgacugcuuucuaaagcugagcgaagaguucucgaggaagaauuaacgguacauuuauccgugccuggcgacaccauucucaucaacaauagaccaggacccagagaaccuccacccuaccaagaaccaaggccacgcggaaaccccccgcauucggcuccgugcguccccaauggauccgcuuacuccggagacuauauggagccugagaaaccaggcgcaccacuccuacccccccccccccagaacucugucccacacuacgcagaggcagacaucgugacgcugcagggugucacuggugguaacacauacgccguucccgcauugccgccuggagcugugggggauggaccacccaggguggauuucccucgaagucggcuucgguucaaagagaagcugggggagggacaguuuggcgagguccaucugugcgaaguggauucaccucaggacuugguuucuuuggauuucccacugaacguuaggaaagggcacccacugcugguggcuguaaaaauucugagacccgaugcaacuaagaaugcucguaacgauuucuugaaagaaguuaagaucaugucucgauuaaaggacccuaauauuauucgacuucuuggcgucugcguucaggaugaccccuuaugcaugauaaccgacuacauggagaauggcgaucugaaccaauuucugagugcucaucagcuggaggauaaggcagccgagggugcgccaggagauggccaagccgcacagggaccgaccaucuccuacccuauguugcuacacguagccgcccagaucgcguccgggaugagauacuuggcuacacugaacuuugugcauagggaccuugccacacguaauugccuuguuggggagaauuucaccaucaagauagccgacuuugggaugucuagaaaucuguacgcuggcgauuauuaccggguccagggccgcgccgugcucccaauccgguggauggcuugggaauguauacugaugggaaaauuuaccacagccuccgacguaugggcuuuuggugugacacugugggaagucuugaugcuaugcagagcacaaccuuuuggccaauugacggaugaacaggugauugagaacgccggagaauuuuuuagagaucaggggcgccaggucuaucuuucccguccgcccgcaugcccacaagggcuguaugaacugaugcuccggugcuggucuagagaaagcgaacagagaccccccuucagccagcugcacagauuccuggccgaggacgcucugaacacgguuuag

SEQ ID NO: 13197 - RNA, 384 nt, Artificial Sequence
  Description of Artificial Sequence: Synthetic coding sequence
augggcccagaagcacuguccucucuucuguugcuguugcugguugccuccggggaugccgacaugaaaggacauuucgauccagcuaaaugccguuaugcacugggcaugcaagaccggaccauccccgauucggacaucagcgccuccaguuccugguccgauucaacagccgcccgccauucccgccuagaaagcucugauggggacggggccuggugcccugcggguuccguguuuccgaaggaagaggaauauuugcagguagauuuacagagacugcauuugguggcacugguaggaacccaaggucggcacgcuggaggacugggaaaggaauucucuagaagcuaucgccugcgcuacucucgcgacggcagauag

SEQ ID NO: 13198 - RNA, 1113 nt, Artificial Sequence
  Description of Artificial Sequence: Synthetic coding sequence
augaaaaaagacgaaccaccguuagauuuuccugauaccuuggaaggguuugaguacgcuuucaacgaaaaaggccaguugcgccacaucaagacaggugagccauucgucuuuaacuauagggaggaccuccauagauggaaccagaagcgcuaugaagcucuuggagagaucauuacaaaguaugucuacgagcuccuggagaaagauuguaaccucaaaaaaguaucaaucccugucgacgcaacagaaucagaacccaagucguucaucuuuaugagugaagaugcauuaaccaauccccagaagcugaugguguuaauucacggcucaggggugguucgggccggccagugggcucgacguuugaucaucaaugaagaucuggacuccgggacgcagauucccuuuauuaagcgcgcaguggccgagggauacggagugauagugcugaauccaaaugagaacuauauagaggucgaaaagcccaagauccacguccagucuucaucggauaguagcgaugaaccugcugagaagcgcgagcgcaaggacaaagucuccaaggaaacuaagaagagaagggacuucuaugaaaaguacagaaauccccaacgugaaaaagagaugaugcagcuauacaucagggaaaaugguaguccugaggagcaugccaucuacgucugggaccacuucaucgcacaagccgccgccgagaauguauucuucguggcacauaguuauggaggccuagccuucguggaauuaaugauacaaagagaggcugaugucaaaaacaaagugacggcuguggcacugacugauucaguacauaacguuuggcaccaagaggcaggcaagacuauccgagaguggaugagagaaaauuguugcaauuggguauccuccagcgaaccccucgauacuucaguugaaucuauguuaccugacugcccuagagucucugcugggaccgaccgacaugagcugacuucuuggaaaagcuuucccuccauuuuuaaauucuuuaccgaagcgagugaagccaagaccaguuccuugaaaccagccgucacccggaggucacacaggaucaagcaugaggagcuguag

SEQ ID NO: 13199 - RNA, 435 nt, Artificial Sequence
  Description of Artificial Sequence: Synthetic coding sequence
augaaaaccggacuguucuuuuuaugccucuuaggaacugcggcggcuauccccacuaacgcccggcuucuguccgaucauuccaagccgaccgcagaaacaguagcccccgauaauaccgcaauccccagccuucgugcugaagccgaagagaaugaaaaagaaacagccgugagcaccgaagaugauucgcaccacaaggccgagaaaaguucaguacuaaagagcaaagaagagucccacgaacagagcgccgagcagggaaaaucaucaagucaggaacugggguuaaaagaccaagaagauucagauggccaccuuagcguuaaucuggaguacgccccaacugaaggcacacuggacaucaaggaagacauguccgagccucaggaaaaaaaauuaagcgagaauaccgauuuucuagcaccuggauag

SEQ ID NO: 13200 - RNA, 1341 nt, Artificial Sequence
  Description of Artificial Sequence: Synthetic coding sequence
cugaccuugcacucuuuaacuuguuaugaagaucuugugaccuuuuuacaacaguccauccaucaguuugaaguggggccuuacggaugcauccugcugacacugucagcuauccucucuagauccacugaacugaucagacaggacuucgacguaccaacaucccauuuaauuggcgcacacggcuacugcacacaagagcuggucaaccuucuacuaacuggcaaggcugucucuaacguguucaaugaugugguggagcuagacagcggagaugggaacauaacacuacuccgagggaucgcugcccggagcgacauaggcuuuuugucucuauucgaacacuacaauaugugccagguaggcugcuucuuaaaaacccccagguuccccauuuggguugugugcucugagagucacuucagcaucuuguucucuuugcagcccggccugcugcgggacuggcgcacagagcgacuguucgaccuuuauuauuaugacggcuuggcuaaccagcaagaacagauuagguuaaccaucgauacgacucagaccauuucugaagacacagauaaugaccucgugccaccgcuggaacuauguaucagaacuaauaucggauccgcucucggcuucaaauacccaguuggcaauaaccaaacagcagugcaagauaacguaaagguuagucuggccuuuggccuaucgauugcgacgcuggcgcagucuguuggucacaucuccggcgcccacuugaacccggcaguuacuuuggggcugcuccuuucaugccagauuuccaucuucagagccuugauguacaucaucgcucagugcguuggagcuauuguggccacggccauccuguccggcauaacauccucucugacaggcaacagccuuggcagaaaugaucuggcugacgguguuaacucaggacagggacucggcauugaaaucauaggcacccugcagcugguacugugugugcuggccacuacagacagaaggagacgcgaucuugggggcucagccccacucgcuauugguuugagugucgcauugggacauuugcuggcgaucgauuacaccgguugcggaauuaaccccgcuagaucuuucggaagcgcuguaauuacucacaacuuuagcaaccacuggauauuuuggguggggcccuuuaucgguggugcccuggcugucuugauauacgacuuuauauuggccccgcgaaguagugaccugaccgauagagugaagguguggacaagcgggcaggucgaagaguaugaucucgaugccgacgacaucaacucuagaguggaaaugaagcccaaguag

SEQ ID NO: 13201 - RNA, 81 nt, Artificial Sequence
  Description of Artificial Sequence: Synthetic coding sequence
augaaacucuuacugugggcuuguauuguguguguggccuucgcucgaaaaaaugccggacuuggcuuucugugguuguag

SEQ ID NO: 13202 - RNA, 348 nt, Artificial Sequence
  Description of Artificial Sequence: Synthetic coding sequence
augggucccgaagcccuuucuagucugcuguuacugcuguuaguggccuccggagaugccgauaugaaaggacauuuugauccagcuaaaugucgcuaugcccuuggaaugcaggaccgaacaauucccgauucagacaucucugccagcuccucuuggagcgauucaaccgcggcuaggcacucucgucuggaguccucagacggugauggugcauggugccccgcaggaucuguuuuucccaaggaagaggaguaccuccagguggauuugcagaggcugcaccugguugcccuggucggaacucagggucgucacgcagggggacuuggaaaggaauucuccuag

SEQ ID NO: 13203 - RNA, 165 nt, Artificial Sequence
  Description of Artificial Sequence: Synthetic coding sequence
auguauaucccccuagaucccgacuacaacgcugauugucccaacgucacugccccugugugugcgagcaacggucauaccuuucagaacgaaugcuucuuuuguguggaacagagagaauuucacuauaggauuaaauucgaaaaguacggaaaaugcgauuag

SEQ ID NO: 13204 - RNA, 351 nt, Artificial Sequence
  Description of Artificial Sequence: Synthetic coding sequence
augguucugcugcauuggugccuacucuggcugcuguucccacuuucaucacguacgcagaagcuuccaacacgagacgaagaacuguuucaaaugcagaucagagauaaggccuucuuucacgacucuagcgucauccccgacggcgccgaaaucuccucuuaccuguuuagggacacaccuaaaagauacuucuucguaguggaagaggacaauacaccuuugucaguuaccgugacacccugcgaugcccccuuggaauggaaauuaucucugcaggagcugccagaggaucguucgggagaaggcucaggagaucuugaaccucuggaacaacagaagcaacaguag

SEQ ID NO: 13205 - RNA, 432 nt, Artificial Sequence
  Description of Artificial Sequence: Synthetic coding sequence
auggggccugaagcacucuccuccuuacuucugcugcuccuggucgcauccggcgaugcagauaugaaaggccauuuugauccagccaaguguagguacgcacugggcaugcaggauagaacuaucccagauucugauauuagcgccagcucauccuggucggacuccacugcagcaaggcacucacggcuagaaucuucagacggcgacggagcaugguguccugcugggaguguuuuuccaaaagaagaagaauauuuacaagucgaccuucaaagacugcaucucguggcacuggugggaacccagggucgccacgccgguggauuaggcaaagaauucucuaggagcuacaggcugagguauucacgagacggaaggagguggaugggguggaaagacagauggggacaggagguuaucagcgguuag

SEQ ID NO: 13206 - RNA, 747 nt, Artificial Sequence
  Description of Artificial Sequence: Synthetic coding sequence
auggagcugcugcaagugaccauccuguuccuucugccgagcauuugcagcagcaacagcaccggaguguuagaagcagcuaauaacagccugguugucacuaccaccaagcccuccaucacaaccccaaauacugaaucccugcaaaagaacguuguaacgcccacuacagguacuaccccaaaggguacuaucacuaacgaguuacugaagaugucccuaaugagcaccgcuaccuuccugaccucuaaagaugaaggcuugaaagccaccacuacugauguacgcaaaaacgauagcauuauaucaaaugucaccguuacuucgguuacacuuccaaacgcaguaagcacgcuacaaaguucaaaacccaaaagcuccgugcuccaacccgaugcuucuccaucuaaaacaggcacacucacuagcaucccagugaccauuccagagaauaccagccaaucacaaguuaucggcaccgaaggugguaagaaugccucuacuagugcaaccucacgguccuacuccuccaucauccugcccguugugaucgcucuuaucguuaucacacugucaguguucgugcuggucggauuguaucgaaugugcuggaaggcugacccugggacaccagaaaacgguaaugaccaaccucaaucagauaaggagagugugaaguuacugacugucaaaacuauuucacaugaaucaggcgaacauuccgcccaaggcaaaacuaaaaacuag

SEQ ID NO: 13207 - RNA, 363 nt, Artificial Sequence
  Description of Artificial Sequence: Synthetic coding sequence
augaagaccggacuauuuuuccucugucugcugggaaccgcagcugcuauuccuaccaacgccagauugcuguccgaucauuccaaaccgaccgcagaaacgguggccccugacaauacggcaaucccaucgcucagggccgaggcagaagaaaaugaaaaggaaacugcugucucuaccgaagaugauucucaccauaaggcagagaaaagcucugugcugaagucuaaagaggaaucccaugaacaaagcgccgaacaaggaaagucuucaucucaagaauuaggcuugaaggaccaggaagacucagacggccaccugucaguaaacuuggaauaugcaccaaccgaaggaacccuguag

SEQ ID NO: 13208 - RNA, 339 nt, Artificial Sequence
  Description of Artificial Sequence: Synthetic coding sequence
augggucccgaagcccugucaagccuguuacuucuccugcucguugccaguggcgacgcugauaugaaaggacauuuugacccugcaaaaugccgcuaugcacuugguaugcaggacagaacgauuccagauagcgacaucucugccuccuccucauggucggauucuacugcagcgaggcauucccgacuggaaagcagugauggcgacggggcuuggugucccgccggauccguauucccaaaggaagaagaauaccugcaaguugaucugcagagauugcaucugguggcucucguggggacucaaggaaggcaugcugggggacuugggaaauag

SEQ ID NO: 13209 - RNA, 513 nt, Artificial Sequence
  Description of Artificial Sequence: Synthetic coding sequence
augggcccagaggcacucagcaguuuacugcuccugcugcugguugcaucuggggacgcggauaugaaagggcacuuugaccccgcgaaaugccguuacgcacuaggcaugcaagaucguacuauaccugauagcgacauaagcgcaagcucuaguuggucugacucaacugcugcucgccacucuagacuggagucauccgauggugacggugccugguguccugcuggcucuguauucccaaaggaagaagaguaccuccagguugaucuccaacgguugcaccucguggcacuggucggcacccagggucgccaugccggcggacuagguaaggaguuuagcagaucuuauagauugcgguacagccgggacgggcggagguggaugggcuggaaagaccguuggggccaggagguuaucaguggaaaugaggacccagagggaguugugcuaaaggacuuaggcccacccaugguggcucgacugguccgcuuuuauccaagagcauag

SEQ ID NO: 13210 - RNA, 417 nt, Artificial Sequence
  Description of Artificial Sequence: Synthetic coding sequence
auggguccugaggcacuuuccagcuuacuacugcucuugcucguggccuccggagacgcagacaugaaaggccauuucgaccccgcuaaaugucguuacgcccucgggaugcaagacaggacaauucccgauucggacaucagugcuaguucuaguuggucggauucaacggccgcacggcauucuagauuggaaucuagcgacggagacggugccuggugcccugcgggcucuguuuuuccgaaggaagaggaauaucuccaaguugaccuccagaggcugcaucucguggcucugguggguacucagggcagacaugcagguggauuagggaaagaguucucccgcucauacaggcugagauacucucgggauggacgaagguggaugggauggaaagauaggugggggcaguag

SEQ ID NO: 13211 - RNA, 285 nt, Artificial Sequence
  Description of Artificial Sequence: Synthetic coding sequence
auggcugcauucccacauaagauuauuuuuuuucugguuugcucaacuuugacccacguugcauucuccgggauuuucaauaagagagacuucacacgauggccuaaaccuagauguaaaauguauauuccccuugauccagauuacaacgccgauugcccaaacguuacagcuccugugugcgcuaguaauggacacaccuuccaaaacgaguguuucuucugcguggaacagcgugaauuucauuaccgcaucaaguuugagaaguacgggaagugugauuag

SEQ ID NO: 13212 - RNA, 156 nt, Artificial Sequence
  Description of Artificial Sequence: Synthetic coding sequence
augggcccagaggccuuguccagcuuacugcuccuucugcucguggccucaggcgaugcagauaugaaaggacacuuugaccccgccaaaugccguuacgcuuuagggaugcaggaccgcaccauuccagauuccgacaucagugccucgucguag

SEQ ID NO: 13213 - RNA, 2760 nt, Artificial Sequence
  Description of Artificial Sequence: Synthetic coding sequence
augggcccagaagcucuuagcagccuacugcugcugcugcuggucgcaucaggcgacgccgauaugaagggucauuuugaccccgcaaaaugcagauacgcccucgguaugcaggaccguacuauucccgacucugauauuagcgcuucaucuucguggagugauucuaccgcagcgaggcacuccaggcucgaaaguucugauggagacggcgccuggugccccgcugggaguguguucccaaaggaagaagaguacuuacagguugaccuccaacgccuucacuugguggcacuugugggcacccagggccgucacgcagguggacugggcaaagaauucagcagaucuuacagacucagguauagccgggaugggaggcgguggaugggguggaaagacagauggggccaggaggugauuuccggcaaugaagauccagagggggugguucuuaaagaccugggacccccaaugguggcuagauugguacguuucuacccgcgcgcagacagggucaugagcguuugucuccgcguggagcucuauggaugccuguggagagacggucuucuaucuuauacggcgccagucggccagacgauguaccucagcgaggcuguuuaccucaaugacaguacuuacgauggucauacaguugggggccuacaauauggagggcuuggacaguuagccgauggcguugugggccuggaugauuuccggaagagucaagaguuacggguauggccgggcuacgauuacgucggguggucuaaucauaguuucagcucuggauauguggagauggaguucgaguuugacagguugagggccuuucaggccaugcagguacacugcaacaauaugcacaccuuaggugccagacuaccgggaggcguggagugccgguuucgacgcgguccugccauggcuugggagggugaaccaaugagacacaaucucgguggaaaucugggagacccgagggccagagccgugucaguuccauuagguggcaggguagccagguuucugcagugccgauuuuuauucgccgguccuugguugcuauucucagaaaucaguuucaucucugauguggucaacaauucuucuccagcacugggaggaacuuucccccccgcaccuugguggcccccgggcccaccuccuacaaacuucaguucccuggaacuggagccccggggucagcagcccgucgccaaggccgaggggucuccgaccgcuauccugauugguugccuagucgccauuauccuacugcuccugcucauaaucgcccugaugcuuuggcggcuacauuggcggcgacuguuaaguaaggcagaacgcagagugcucgaggaagaguugaccgugcaucucuccgugccaggcgauacaauccuuauuaauaaucgaccgggaccccgugaacccccaccauaccaagaacccaggccuaggggcaacccaccucacucugccccaugugucccuaacggcuccgcccuguugcucuccaacccagcuuauagguuacugcuagcaacauacgcaaggcccccacgcggucccggcccuccuacccccgcuugggcuaaaccgacaaacacccaggccuacuccggugauuacauggaaccugagaaacccggagcgccacuuuugcccccucccccucagaacucugucccacauuaugccgaagcggacaucguaacucuccagggagugaccggggggaauacauacgccgucccagcucucccccccggcgccgugggugacggcccgcccagaguggauuucccaagaucacggcuucguuucaaagaaaaacugggagagggacaauucggggaagugcaucucugcgagguggacaguccacaggaucuaguuagccucgacuucccauuaaauguuaggaaaggccauccauuguuaguugccgugaagauacugcgcccagaugcaaccaaaaacgccucuuuuagucuguuuuccaggaaugacuuccugaaggaggugaagaucaugagcagguuaaaggacccuaacauaauaaggcugcucggagucugcguccaggacgauccucuguguaugauuacugacuacauggaaaacggggaucugaaucaguuccuuagcgcccaucaguuagaagacaaggccgcugaaggugcccccggggacggucaagcugcccaaggcccuacaaucucauaucccaugcuucuucauguugcagcucaaauugccucagguaugcgguaucuugcuacacuaaacuuuguucaucgggaucuugccacucggaacugucuggugggagaaaauuucacaaucaaaaucgcggauuucgguaugagucggaaucucuacgcuggcgauuacuaucggguccagggaagggccguacuaccuaucagauggauggcaugggagugcauucugauggggaaguuuacuaccgcaucggacgugugggcuuucgggguaacccucugggaggucuuaauguugugucgggcccagccuuuuggacagcugacagacgagcaagugaucgagaacgccggugaguuuuucagagaucaggggagacagguuuaccucucccggccuccagcauguccgcaagggcuuuaugaguuaauguugagauguuggagucgggaguccgaacagcgacccccguuuagucagcuucaccgcuucuuagccgaggaugcucugaauacaguauag

SEQ ID NO: 13214 - RNA, 318 nt, Artificial Sequence
  Description of Artificial Sequence: Synthetic coding sequence
augggugucucaaaguuagacauuuuguacagaaggcuucuccucaccaagcuguucauacgcggaugggggcgcccagaagauuugaagaggcuguuugaauucaggaaaaugauagguaacagggaaagaugccaaaaccuaguguccucggauuaccccguacauauagauaagaucgaggagcaaucagauuguaagauucuugacggccauuuugugaguccaauggcucacuacguacccgacauuaugcccaucgaaagcgugaucgccagguuccaguuuauugugccuaaggaauggaacaguaaguag

SEQ ID NO: 13215 - RNA, 126 nt, Artificial Sequence
  Description of Artificial Sequence: Synthetic coding sequence
augaaauuaagugguauguuucuacuccuuagccuugcacucuuuuguuuucuuaccggcgucuuuucacaggggggucaggucgacugcggugaguuucaagaucccaaaguguacuguaccuag

SEQ ID NO: 13216 - RNA, 459 nt, Artificial Sequence
  Description of Artificial Sequence: Synthetic coding sequence
augcguuuuaagacaacagccaaggauggacugcuguuguggaggggagauucuccuaugcggccuaacagcgacuucauaucucucgggcuaagggacggggcauuagucuuuucauacaaucuugggucagguguagccagcauuauggugaacggaagcuucaaugauggccgcuggcauagagucaaagcugugagggauggccagucggggaaaauaacaguugacgauuacggugcucgcacaggcaaaucuccaggcaugaugcggcagcugaauaucaacggggcuuuguaugucggaggaaugaaggagaucgcccugcacacgaaccgccaguacaugagaggccuggugggcugcauaucacacuuuacacuuuccacggauuaccacauaucauugguggaagaugcaguggacggaaagaauauuaacaccuguggugcuaaguag

SEQ ID NO: 13217 - RNA, 1611 nt, Artificial Sequence
  Description of Artificial Sequence: Synthetic coding sequence
auggacuuuuugcucgcgcuggugcuugugagcucccuguaccugcaggcggcugccgaauucgacggcagauggccacggcagaucgugucuucaauuggccugugucgguacgguggcagaaucgauuguugcuggggaugggcccggcaaucauggggccagugccaaccaguuugucaaccacgguguaaacauggggaauguaucggacccaacaaaugcaagugccacccaggauacgccggaaagacaugcaaccaagaccuuaacgaauguggacuaaaaccaagaccuuguaaacaucgcugcaugaacacuuaugguagcuacaagugcuacugucuuaauggcuacauguugaugccugacggcucuuguuccagcgcacugaccuguucaauggccaauugccaguacggaugcgacguggugaaaggccagaucagaugccaaugcccaaguccgggguugcaguuagcccccgauggcaggacaugcguugacgucgacgaaugcgccaccggaagagccaguugcccaagauucaggcagugcgugaauacauuuggaucuuacaucuguaagugccauaaagguuucgauuuaauguauauaggaggcaaauaucagugucacgacauugacgagugcucacucggccaauaucagugcucuaguuuugcuagaugcuauaauauacguggauccuauaaauguaaauguaaagaagguuaucagggagauggacuuaccugcguauauauucccaaggugaugaucgagccgagcggccccauccacgucccaaaagguaacgguaccauucugaagggagauacuggaaacaauaauuggauccccgauguuggaagcaccugguggccgccuaaaacccccuacauuccaccgauuauaacaaaccgcccuaccucaaagccuacuaccagacccaccccuaaaccaacuccgauccccacgccaccuccuccuccuccucugccaaccgaacugcgaacuccucucccgcccacuacucccgagaggccaacaaccggccucacaacuauugcgccagcagcgucaaccccacccgguggaauaacuguggacaacagaguccagacggacccucagaagccacgcggcgauguguucagcguucuagugcacagcuguaauuucgaccauggccuguguggauggauuagagagaaagauaacgaccugcacugggaacccauacgagacccugcugggggucaguaccucacagugucugcagccaaagcaccaggaggcaaggcagcgcggcuggucuugccucugggcaggcucaugcacuccggggaccugugucuuagcuuucgucacaaaguuacaggacuucacuccggcacccuacaggucuucgucagaaagcacggggcccauggagcugcacuguggggcagaaaugggggacauggcuggcggcaaacucaaaucacccugcgaggcgccgauauuaaaucaguaguguuuaagggagaaaagagaaggggccauacaggagaaaucggacucgaugauguaucucugaaaaaagggcauuguucggaagagcgguag

SEQ ID NO: 13218 - RNA, 288 nt, Artificial Sequence
  Description of Artificial Sequence: Synthetic coding sequence
augcuuuuucgaaaucgcuuucugcugcuccucgccuuagcugcccuucuagcauuugugagccuuuccuugcaauucuuccaccucauaccugucagcacucccaaaaacggaauguccucuaaaucccguaaaagaaucaugccugauccagucacugaaccuccuguuaccgaccccgucuacgaggcccuucuauacuguaauauccccucuguggccgagaggucaauggagggccaugcuccacaccacuuuaaacugguaagcguccacguguucaucuag

SEQ ID NO: 13219 - RNA, 213 nt, Artificial Sequence
  Description of Artificial Sequence: Synthetic coding sequence
auggccucugaucucauucguacaauuuuggccguggcucugauuucaaaacuuggaaccgcaguagaugcggagcucaugccuagcggugcgauccugcagaacaaaagagaaaaccugcccagaguuugucaugcacuagcauuucucgggauggcaagaugucaagaucuguucuuggucagacugcaaggauggaaacuugguaccuag

SEQ ID NO: 13220 - RNA, 417 nt, Artificial Sequence
  Description of Artificial Sequence: Synthetic coding sequence
auggguccagaagcucugagcagcuuguuguuauugcuacucgucgccuccggggacgcagauaugaagggacauuucgacccagccaagugucgauacgcccuugggaugcaggacaggacuaucccagacagcgacauuagugcguccucaaguuggucugauaguaccgcugcccgccacagucgucucgagagcucagacggggauggagcuugguguccggccggaagcgucuucccgaaagaggaggaguauuuacagguugauuugcagcgauuacaccugguugcccugguuggaacucagggucgucaugccggcggguugggcaaagaguuuagucgcagcuaccgcuugagauauucaagggacggucguagauggaugggauggaaggaucgguggggucaguag

SEQ ID NO: 13221 - RNA, 219 nt, Artificial Sequence
  Description of Artificial Sequence: Synthetic coding sequence
auggcugucucgguccuccggcugacaguaguucugggacuccuggugcucuuucugaccugcuacgccgacgauaagccggacaagccugaugauaaaccugaugacaguggcaaagacccaaagccugauuuuccaaaguuuuuaagccugcuggguacugaaauaaucgagaaugcaguggaguucauccuucguucgaugucaagaucuaccuag

SEQ ID NO: 13222 - RNA, 438 nt, Artificial Sequence
  Description of Artificial Sequence: Synthetic coding sequence
augguacuauugcacuggugccuccugugguuacuguucccuuugucgagccgcacacagaaguuaccuacuagagaugaagaacuguuccagaugcagaucagagauaaggcguuuuuccacgacucaagcguuaucccggacggagcugagaucagcucuuaucuguuccgagauacacccaagcgguacuucuucgucguugaagaggauaacacaccacuaucggugacugucacccccugcgaugccccccuggaauggaaacugagucugcaagaacuucccgaggacagaucuggcgaaggaagcggugacuuagaaccccuggaacaacagaaacagcagaucauuaacgaagaaggaacugaacuuuucagcuauaaagguaaugacgucgaguauuucauuuccaguucaucuccuucugguuuguag

SEQ ID NO: 13223 - RNA, 258 nt, Artificial Sequence
  Description of Artificial Sequence: Synthetic coding sequence
augggcccagaggccuugucuagccugcuucuccuacuacuaguggcuagcggugacgccgauaugaagggccacuuugauccagcuaaaugccgauacgcauugggaaugcaggaccguacaaucccggacagcgauaucucagccucaucauccuggagcgauucaacagcugcacgucacucucgucucgagucaucggauggcgauggugcuugguguccugcaggaagcgucuuucccaaagaagaggaauag

SEQ ID NO: 13224 - RNA, 1410 nt, Artificial Sequence
  Description of Artificial Sequence: Synthetic coding sequence
augcugaaaguacacuauccuaaguuuggagucuccgaagacugccuauaccugaauauuuaugcccccgcucacgcagauacuggauccaaauugccgguguugguaugguuuccugggggagcuuucaagacgggaagcgcgucaaucuuugacgggucugcccucgccgcauacgaggauguacuuguaguuguugugcaauacagacucggaauuuuuggguuuuucacuacgugggaucaacaugcacccgggaacugggcguucaaggaccaggucgcagcccuguccugggugcaaaaaaacauagaguuuuucgguggcgauccauccagugugacaauuuucggagaauccgccggagcuaucucuguuucuucucugauucuuucaccuauggcaaagggcuuguuccauaaggccaucauggagucugguguugccaucaucccauaccucgaggcgcacgacuaugagaagagcgaggaccuucaaguggucgcucauuuuugugguaauaacgcaucugacucugaagcccuccucagaugucugcgaacuaagccuagcaaagagcuucugaccuugucacagaaaaccaaauccuucacaagagucguggauggggcuuuuuucccuaaugaaccccuugaucugcugucccagaaggcguuuaaagcaauccccagcaucauagguguuaauaaucacgagugcggauucuuacugccuaugaaagaagcaccugaaaucuuguccggcuccaauaagucucuggccuugcaucuuauccagaauauccugcauaucccuccacaguaccuucaucucguggcaaaugaguacuuccaugacaaacacuccuuaaccgaaauucgggauagucugcucgacuugcugggggauguguucuuuguggucccugccuuaaucacagcccguuaccaccgcgaugcuggcgccccuguuuacuucuaugaauucaggcaccggccucagugcuucgaagauacgaagccagcguuugugaaagccgaucaugcagacgaggugcgcuuuguuuuuggcggggccuuucuuaaaggcgacauugucauguuugagggcgccaccgaagaggagaaacugcugaguagaaaaaugaugaaguacugggccacauucgcuaggacaggcaaccccaauggaaaugaccucagucucuggccugcauauaaccugaccgaacaauaccugcagcuugauuugaauaugucccugggccagaggcucaaagaacccagaguggauuuuuggacaucgacaaucccccugauucugagcgccagugacauguugcauaguccucuaaguucccuuaccuuucugucccugcuucagccauucuucuucuuuugugcgccuuag

SEQ ID NO: 13225 - RNA, 393 nt, Artificial Sequence
  Description of Artificial Sequence: Synthetic coding sequence
augcugcccuucuuguuuuucagcacacucuucucaagcaucuuuaccgaggcacaaaaacaguacugggugugcaauucuuccgacgccaguauuucauacacuuacugcggacgcgacuuaaaacagcuguacuucaauuuauauaucaccgugaacacuaugaaucugcccaagagaaaggaggucauauguagaggaucagacgacgauuacagcuucuguagggcacucaaaggcgaaacagugaacacuacuauuucuuucucuuuuaaaggaaucaaguucuccaaggggaaguacaagugcgugguggaggcuauuucagguagcccugaagagaugcuuuucugccuggaauuugugauuuuacaccagccgaacuccaauuag

SEQ ID NO: 13226 - RNA, 318 nt, Artificial Sequence
  Description of Artificial Sequence: Synthetic coding sequence
augaagugcacagcuagagaguggcugagggugacaacagugcuguuuauggcaagagccauucccgcgaugguggugcccaacgcaacccuguuagaaaaacugcuugaaaaauacauggaugaggacggagagugguggauagcaaagcagagggggaaacgcgccauuacagauaaugacaugcagagcauucucgaucuacacaacaagcuucguucacagguauacccaacagcaucgaauauggaguauaugacaugggacguagaauuggaacgguccgcugaguccugggccgagucgugucuuugguag

SEQ ID NO: 13227 - RNA, 567 nt, Artificial Sequence
  Description of Artificial Sequence: Synthetic coding sequence
augacaauggucugccaucgaccagagggauuagagcagcucgaagcgcagacgaauuuuaccaaaagagaacugcaggugcuuuaccgcggcuuuaagaacgagugcccuuccggaguuguaaaugaggauacauucaagcagauauaugcgcaguucuuuccucacggagaugcaucaacauaugcccacuaucuauuuaacgcauucgacaccacacagacaggaucagugaaauucgaggauuuugugacugcccugaguauuuuguuacgagguaccguacaugagaaacuacgguggacguuuaacuuguaugauauuaauaaagacggcuauauuaauaaggaggaaaugauggacauugucaaagcuauuuaugauaugauggggaaguauacguaucccguucugaaggaggacaccccucgacagcacgucgacguauucuuccagaaaauggacaaaaauaaagacggcauagugacccuggacgaguuuuuagaaaguugucaagaagaugacaauauaaugagguccuugcaguuguuccaaaacgugauguag

SEQ ID NO: 13228 - RNA, 1275 nt, Artificial Sequence
  Description of Artificial Sequence: Synthetic coding sequence
augccgcccuuucugaucacauuauuuuuguuccauucaugcugucugagggcuaauggacaucuccgugaaggaaugaccuuacuaaagacagaguucgcccugcauuuguaucagucugucgccgcaugucgcaacgaaacuaacuucguaauuucuccagcaggcgucuccuugcccuuagaaauccugcaauuuggugccgaaggcucuacuggccagcaacuggcugaugcccucggguauacagugcacgauaaacgaguaaaagacuucuugcacgccguguaugcaacuuuaccuacaucaucccagggcacagaaauggagcuggcuugcagcuuauuugugcagguuggcaccccacugagcccguguuuuguggagcaugugucauggugggcaaacagcucuuuagaaccugccgauuuaagugagccuaauucuaccgcaauacagacuuccgaaggggcuucacgggaaacggcgggggggggcccaucugagggaccagguggauggccuugggagcagguguccgccgccuucgcgcagcucguucuggucucuacuaugucuuuccaaggcacauggagaaaacgcuuuagcucaacggacacgcagauccuaccuuucacuugugccuacggccucguguuacaagugccuaugaugcaucagacaacugaaguuaacuauggccaguuccaggacaccgcaggccaccaggucggaguccuugaauugcccuaucucggcucugcuguaucccuuuuccuuguuuugccccgcgauaaagacacuccuuugagucacauagagccccaucugacugcuaguaccauucaccucuggacgacaucccugcgacgcgcccggauggacguguuccugcccagguuucggauccaaaaucaguucaaucucaagagcauccugaacagcugggggguuaccgaucuauuugacccacugaaagcuaaucugaagggaauuucgggccaggauggguuuuacgugucagaggcaauccacaaagccaagaucgagguguuggaggaagggacgaaagccucaggcgccacggcgcugcuucugcucaagagaucccgaauuccaauauuuaaggcggaucggccauucauuuauuuccugcgggaaccaaacaccgggauuacugucuucuuugaccguauacagaucaucuaccaaugccuauccagcaauaaaggcuccuuuguucacuauccccugaagaacaaacauucuuuuuag

SEQ ID NO: 13229 - RNA, 1815 nt, Artificial Sequence
  Description of Artificial Sequence: Synthetic coding sequence
auggccguacugguuuguccggcuagcugccacggccuaaaagaauuccgcauacgacgaggaauguggcgauugugccugguuuauuacuucuacccugcaagcagcacacucuacguccugaggauagauguccuaaacuauaccaguaaggacgaaggacccucugccgaaggcccccagagaaauacccgucuaggauggauccagggcaaacaggugaccguguuaggcagccccgucccaguuaacguguuuuugggagugccuuucgccgcucccccuuuaggaucccugagguucacuaacccccagcccgcguccccuugggauaaucuucgggaggcuacuaguuauccaaaccugugucuacagaauucugaguggcuguugcuugaucagcauaugcugaaagugcacuaccccaaauucggaguguccgaagacugcuuauaucucaauaucuacgcucccgcccacgcagauaccgguagcaagcucccaguccuaguuugguuuccaggcggggcuuuuaagaccggcucagccuccaucuuugaugguucugcacucgcagcuuaugaggauguccuggucgugguagugcaauauagacucgguauuuuuggauuuuucacuacaugggaucagcacgccccggggaauugggccuucaaggaucaggucgccgcccuaucuuggguccaaaagaacauagaguuuuucggcggagaucccagcucaguuacgauauuuggcgaguccgcuggugcaauuagcgucuccucucugauucuaucccccauggccaaaggucuuuuucacaaggccauuauggagucuggugucgcaauuauccccuaucuagaagcccaugacuacgaaaaaucugaggaucugcaagugguagcacacuuuugcggaaacaacgccagugacucggaggcccuucugcgaugucuuagaacgaagccuaguaaagaacugcuaacccucucccagaagaccaaaucguuuacacgcgucguggacggcgccuucuuuccaaaugagccccuggaucugcucucgcaaaaggccuuuaaggcuauaccaucuauuauaggaguaaacaaucacgaauguggguuccuauugccuaugaaggaggccccugaaauccugucuggcuccaacaaaucuuuagcacugcaucugauccagaauauccuucauauucccccccaguaucugcaucuaguggcuaaugaauacuuucacgacaagcacucacucacagagaucagggacucuuuacuugaccuacugggcgacguuuuuuuuguugugccagcuuugauuacugcaagauaccaucgcgaugccggcgcaccaguauauuuuuacgaauuccggcauaggccccaaugcuuugaggacaccaagccugcuuucgucaaagccgaucacgcagaugagguccgguucguguucggaggcgccuuccuuaagggcgauaucgugauguuugagggcgcgacggaagaggagaaacugcuuucucggaagaugaugaaguacugggcuaccuucgcccguaccgggaaccccaauggaaaugaccugucacucuggccugcauauaaccuaacggaacaguaucugcaauuagaccuaaacaugucuuuggggcaaagacugaaggagccacgugucgacuucuggacuucuacuaucccccucauucucagcgccucagauaugcuacauuccccccuuucaagccucaccuuuuugucucugcugcagccuuuuuucuuuuuuugugcccccuag

SEQ ID NO: 13230 - RNA, 939 nt, Artificial Sequence
  Description of Artificial Sequence: Synthetic coding sequence
augaauauuuggggucagauuuggccaaaagcaguguaccuagucugcaauuacucucccaagggaaacugguggggccacgccccuuacaaacauggacgaccauguagcgcuugcccucccucauuuggcggcgguugucgugagaaccuguguuacaaggagggguccgacagguacuacccuccucgcgaggaggaaaccaacgaaauugagaggcaacaaagccaagugcaugauacccauguaaggacucgguccgaugacagcucuagaaacgaggugauuucugcgcaacagaugagucagaucgugaguugugagguacgccugcgcgaccaguguaaggggacgacguguaauagauacgagugcccagccggcugcuuagacagcaaagcaaaggucaucgggucugugcauuacgaaaugcagucuuccauuugccgugcugccauucacuacggaaucauugauaacgacgggggaugggucgauaucacuaggcaagguaggaaacacuacuucaucaaauccaacaggaauggcauccagaccauuggaaaguaucagucugccaacagcuuuacagucuccaaagucaccgugcaggccguaacuugugaaaccaccgucgaacaacugugucccuuucauaagcccgcuucgcauugucccagaguguacugcccgcguaauugcaugcaagcgaauccacacuacgcacgggucaucgggacucguguuuauagcgaccugaguucaauaugcagggccgccguccaugccggaguagugagaaaucauggcggauauguugacgucaugccaguggauaaacguaagacuuauaucgcgagcuuucagaauggcauauucagcgagucacugcagaaccccccuggcggcaaggccuuuagaguguuugcagucguguag

SEQ ID NO: 13231 - RNA, 777 nt, Artificial Sequence
  Description of Artificial Sequence: Synthetic coding sequence
augauugcuauaucugccgugagcucagcccuccucuucucccuccuuugugaagccucaacaguaguucugcugaacucuaccgacagcagccccccaacaaauaacuuuacugauauugaagcagcgcucaaggcucaacuggacucagcugacauuccaaaggccagacgaaaaagauacaucucucagaacgauaugauugcuauuuuagauuaucauaaccaggugagaggcaagguuuuucccccugccgcgaacauggaauacauggugugggaugaaaauuuggcuaaaucagccgaggcuugggccgccacuuguauuugggaccauggcccgaguuaucugcuuagauuucuggggcagaauuugagcgugcgcacaggcagguauagaucuauccuucaacuggucaaaccuugguacgaugaggugaaagacuaugccuuucccuacccucaggacuguaacccucggugccccaugagauguuucggcccaauguguacucauuacacucagaugguaugggcuacauccaauaggaucggcugcgccauccauacuugucaaaacaugaacgucuggggaaguguuuggagacgugcugucuauuugguuugcaacuacgcaccgaaaggcaacuggauaggagaggcuccauauaaagucggcgucccauguucuucaugcccucccagcuaugggggcucauguaccgauaaucuguguuuccccggggugacauccaauuacuuauacugguucaaguag

SEQ ID NO: 13232 - RNA, 1215 nt, Artificial Sequence
  Description of Artificial Sequence: Synthetic coding sequence
augccacccuuccucauuacacuauuucuguuucauucuuguugccuacgagcaaacgggcaucugagagaggggaugacacucuuaaagacugaguucgcacugcaccuguaucaaaguguagccgcuugccgcaacgagaccaacuuuguuauaucaccugcgggggucagccugccucuggaaauccugcaguuuggggcagagggcaguaccggucaacaguuggcggaugcacugggauauaccguucaugacaaaaggguuaaggacuuucugcacgccgucuaugccacucuucccacguccucccagggaaccgagauggagcuggcuuguucucuguucgugcagguugguaccccccuauccccauguuuuguggaacaugucaguuggugggcuaacucgucccucgaaccugcugacuugagugaaccuaacucaacugcgauccagacaagugaaggagccagccgugagaccgccggcggcggcccuucagaagggccugggggcuggcccugggagcaggucucagccgccuuugcucagcucgugcucgucucuaccaugucauuccaaggaacuuggcgaaagagauuuuccucaacugacacacagauucucccauuuacgugcgcguauggccuaguacugcaggugccuaugaugcaucagaccacagagguuaauuauggccaguuccaggauacugcagggcaucaggucggcguucucgaacugcccuaccuggguagcgccgugucacuguuucuugugcucccucgggacaaggauaccccucugagccacauagagccgcaccuaacugccuccaccauucaucuguggacuaccagccugcggcgcgcaagaauggauguguuucugccaagguuccgaauucagaaucaauucaaccugaagucaauccuaaauucuuggggggugacugacuuauucgauccgcugaaagccaaccucaaaggaaucucaggccaagauggcuucuaugugucggaagcgauucacaaagcaaaaauagagguucuagaggagggaacaaaagcuucaggcgccacagccuuacuccugcuuaaaagaucucgcauuccuauuuucaaagccgacagaccauuuauuuacuuccugcgugagccuaacaccgguuuuguguuuaguauuggacggguuucgaacccucuggacuag

SEQ ID NO: 13233 - RNA, 936 nt, Artificial Sequence
  Description of Artificial Sequence: Synthetic coding sequence
augcuuuaucaaacuauuaauagccuuaaaacuaaaaacccgaagcucaagaucuuacuuucaaucgggggauaccuguucgguagcaaaggcuuucauccaaugguggacucaucgaccaguagacuggaguucauaaauagcauuauacucuuuuugagaaaccacaauuucgauggccuggacgugagcuggauuuaccccgaucagaaagaaaacacgcauuuuacuguucugauucaugagcuggcagaagccuuccaaaaggacuucaccaagucgaccaaagaaaggcugcuguuaacagcuggugugucagcgggccggcagaugauugauaacaguuaucaaguggagaagcuggcuaaagaccucgauuuuaucaauuugcucucguuugacuuucacgguuccugggaaaagccgcugaucacaggacauaacucgccuuugucaaaaggcuggcaggacagaggucccaguucuuacuacaacguggaguaugcaguggguuauuggauacacaaggguaugccuagugaaaagguugugauggguaucccaaccuacggacacucuuucaccuuggcaagugcagaaaccacugucggugccccugcuuccggaccaggagcugccggcccuaucacagagucuucugguuuucucgcuuauuacgagaucugucaguuccuuaagggcgcaaaaauuacuaggcugcaggaucagcagguuccuuacgccgucaaagguaaucaguggguggguuaugaugacgucaagucaauggaaaccaaagugcaauuccucaaaaacuugaaccugggaggggcgaugaucuggucaaucgauauggacgacuuuacagggaaaagcuguaaucagggaccuuauccuuuggugcaagccgugaagaggucuuuagggagucucuag

SEQ ID NO: 13234 - RNA, 555 nt, Artificial Sequence
  Description of Artificial Sequence: Synthetic coding sequence
auggcuagcgagcgacucccuaacagacccgcaugucuacuuguagcauccggagcagccgaaggcgugagcgcccagaguuuccuacauugcuucaccauggcauccaccgccuuuaaccuacaggucgcaacgccaggaggcaaggcaauggaguucguagacguaacagagaguaaugcccgauggguacaggauuucagauugaaggcuuaugcaucaccagccaaacuggagucuauugaugagcccauuugugccgucggucacggggucgccgcccucuguugugccacuaaugaggaucgcucuugggucuuugauaguuauagucugaccggaccauccguuugcgagcugguccgggcuccaggauuugcgcgacuuccucucgugguggaggauuucguuaaggacucuggggcaugcuuuucagcguccgagccggacgccgugcacguaguccuggauagacaucuugucaccggucagaacgccaguucuacaguuccagccguacagaacuuacuuuuccucugcggauccagaaaauag

SEQ ID NO: 13235 - RNA, 1257 nt, Artificial Sequence
  Description of Artificial Sequence: Synthetic coding sequence
augcggucauugcuguugcugagcgcauucugcuuacuggaggccgcccuggccgccgaagugaaaaaaccugcugccgccgcggcccccggcaccgccgaaaaacugucuccgaaggccgcuacgcuggcagaaagaagcgccggucuugcauuuagccucuaccaagcaauggccaaggaccaggcuguggagaauauccuugugucucccgugguugucgcuucaucgcugggacuggucucccuugggggcaaagcaaccacagcaucccaagcaaaagcuguguuguccgcagaacaacugcgcgaugaggaggugcacgccggacuuggagagcuacuccggagcuugucuaauagcacagccagaaaugugacuuggaaacuaggcucuagguuguacggaccuucuaguguauccuucgcugacgauuuugugaggaguucaaagcagcauuauaacugugagcauuccaagaucaauuuucgcgacaagcggucugcuuuacaguccauaaacgaaugggcagcucagaccacggacggcaaacucccggaggucacaaaagacguggaaaggaccgauggagcccugcuggucaaugcuauguucuucaaaccccacugggaugagaaguuucaucacaaaaugguggacaaccgcggcuucauggugacccggucuuauacugucggcgugaugaugaugcacaggacaggacuuuauaauuauuaugaugacgaaaaagagaaacugcagauuguugagaugccccucgcucauaagcugagcucacugaucauucuuaugccgcaccauguagaaccucuggaaagacuggagaaacugcuuaccaaggaacaacuuaagauuuggaugggaaaaaugcaaaaaaaagccgucgcuauuucacuccccaaaggugucguugaagugacgcaugaccuacaaaaacacuuagcgggacugggucugacagaggcgauugacaagaauaaagcugacuuaucucgaaugucuggaaagaaagaucuguaccuggcauccguguuccacgccacugccuuugagcuggacacugacggcaacccauuugaccaggauaucuauggcagagaagagcuucgaagcccuaagcuuuuuuacgccgaccauccuuuuauauuucuggugcgggauacucagucuggguccuuacuguuuauuggccgcuuggugcgcccaaaaggugauaaaaugagagacgaacuauag

SEQ ID NO: 13236 - RNA, 1425 nt, Artificial Sequence
  Description of Artificial Sequence: Synthetic coding sequence
auggaccguaacccauccccaccacccccugggcgagacaaggaagaggaagaggaaguugccggaggggacugcaucggcucuaccguguacaguaaacacugguuguuuggagugcuuuccggacuaauucagaucgucagcccagagaauaccaaaaguucaagcgaugaugaagaacagcuuaccgaacucgacgaggaaauggaaaacgagaucuguagaguuugggacaugaguauggacgaggauguugcccuuuuuuugcaggaauucaacgcaccugacaucuuuauggggguguuagccaaaucuaagugcccccgccugagggaaaucuguguggguauacuggguaacauggccuguuuucaggaaauuuguguauccauuucuucagauaagaaccugggccagguuuugcuucacuguuuauacgauucugacccucccacucuacuugaaacuaguagguuacugcugacaugucuuagucaagcggagguggcaucuguguggguggagcgcauccaggagcauccggccauuuaugacucaaucuguuuuauuaugaguaguaguaccaacguagaccuccucgugaaaguuggcgaggugguggacaaguuauucgaccuggaugagaaacugaugcuggaaugggugagaaacggagccgcccagccauuggaucaaccacaagaggaaagcgaagaacagccaguguuccgacuggucccuuguauccucgaggccgccaagcaggucaggucugaaaaucccgaguggcuggacgucuauaugcauauucugcaauugcucacaacagucgacgacggcauccaagcuauuguucauugccccgauacaggcaaagacaucuggaaucuuuuauucgaccucgugugucacgaauucugccaaagcgaugaucccccuauuaucuuacaggagcaaaagacagugcuugcaucuguauuuuccgugcuuagcgcgauuuacgcuucucagacugaacaagaauaccugaaaauugagaaaguagaccugccccuuaucgacucucugauccgcguccuucagaacauggaacaaugccagaaaaagccggaaaauuccgccgaaucaaauacugaagaaaccaaaaggacggaccuaacccaggaugauuuccaucugaagauucugaaggacauucucugcgaguuucucucuaauauuuuucaggcacucacgaaagagacaguggcacagggggucaaagaagggcaguuaucgaaacagaaguguaguagcgcauuccagaauuugcugccuuuuuacucuccaguaguggaagacuuuauaaagauccugagagaggucgacaaggcccuagcugacgacuuggagaaaaacuucccuucccugaaagugcagaccuag

SEQ ID NO: 13237 - RNA, 438 nt, Artificial Sequence
  Description of Artificial Sequence: Synthetic coding sequence
auguuaacaagacuugugcugucagcccaucucagcucaacuaccuccccgcccuggacucacgccgcuaucucuugggaacuggauaacguucucaugcccucaccacgcaucuggccgcaaguuaccccuacagguaggagcgcaucugucagaucagaggggaauacuuccuccuuauggaacuuuagcgcaggacaggacguccacgccaucgugacaaggacuugcgagucuguccugucuucggccgucuauacacaugguugcggaugcgugcguagcgcaacaaauaucaccugucaauccaguggucagcaacgucaggcggcccggcaggaagaagagaauagcauuuguaaggcucacgacucccgcgagggaagguuagguuaccccuugagugcacaucaaccugguucuggagguccuaacuag

SEQ ID NO: 13238 - RNA, 1728 nt, Artificial Sequence
  Description of Artificial Sequence: Synthetic coding sequence
uagauuuucggcgggucuauucauuacuuuaggguucccagagaguacuggcgugaucggcuccugaaaaugaaagccugcggacuuaacacgcucacuacuuacguacccuggaaccuacacgaaccugagcgggguaaauucgacuuuaguggaaacuuggaccuggaggccuuuguccuaauggcagccgagauugggcuguggguaauucuaaggccaggaccauacaucuguucugaaauggaucugggaggucuccccucuuggcuccuccaggaucccggaaugagacuccgaacaaccuauaagggguucaccgaggcuguugaucuguacuuugaucauuugaugucucggguugugccucuacaauacaaaaggggugggcccaucaucgcuguucagguugagaaugaauacggcucuuacaacaaagauccggccuauaugccauacgugaagaaggcacuugaggaccgcgggauaguggaacucuugcugacuuccgacaacaaagauggccucucuaaaggaaucguacaaggcguccucgccacuaucaaucuccaguccacgcacgaauugcaacugcugaccacauuucucuucaauguccagggaacucagcccaaaaugguuauggaauauuggacuggaugguuugauuccuggggcggaccucacaacaucuuagauaguagcgaaguucugaagacugucagugcgaucguugacgccggaucuuccaucaaccuguacauguuucacggcgggacgaacuucggauucaugaauggagccaugcauuuccaugauuacaaauccgacgucacuagcuaugauuacgacgcgguguuaacagaggccggugauuauacagccaaguacaugaaacugcgugauuuuuucggaucaaucagcgguaucccauuaccgccuccaccggacuuacugccaaagaugcccuacgaaccccugaccccagugcuguaccugucacucugggacgcccucaaauaucucggcgaaccuauuaaaagugaaaaaccaaucaacauggagaaucuaccugugaauggcggcaauggacaguccuucggcuacauccuauaugaaacaagcauaacuuccuccggaaucuugucaggacacgugcaugauagaggacagguguucgugaacacugugagcauaggauuucucgacuacaaaaccaccaaaaucgcagucccucugauccaaggauacacaguccuuagaauacugguggagaaucggggacgcgugaacuacggggagaauaucgacgaccaacgcaaaggcuugaucgggaaccuuuaucuuaaugauagcccucuuaagaauuuucggaucuacucacuggauaugaagaagucauuuuuucagagguuugggcuugauaaguggucuagccucccugagaccccaacgcuccccgcuuucuucuugggcucucugagcauaucuucuacgcccugcgauacguuccugaaguuagagggaugggagaaaggcguaguauuuauuaauggacagaaucucggacgauacuggaacaucggaccgcaaaagacuuuguaccuucccggacccuggcuaaguucaggaaucaaucaagucaucgucuuugaagagacaauggccggccccgcacuccaguucacggaaacaccacaccucggacgcaaccaguacaucaaguag

SEQ ID NO: 13239 - RNA, 255 nt, Artificial Sequence
  Description of Artificial Sequence: Synthetic coding sequence
augcgcaccuuguucaaccugcuaugguuagcccucgcaugcucuccuguucauacgacccugaguaaaucugacgcuaaaaaggcagcauccaagacuuugcucgagaaaagccaguucagcgauaagccugugcaggaccggggccucguggugacagaccucaaagcagagaguguuguccucgaacaucgcaguuacuguuccgccaaagcccgagauagacacuuugccggagacguacuugguuacuag

SEQ ID NO: 13240 - RNA, 744 nt, Artificial Sequence
  Description of Artificial Sequence: Synthetic coding sequence
augcggucucugcuucuucugucugccuucugucugcuggaggcagcucuggcugcggaaguaaagaaaccugccgcugcagcagccccugggaccgccgaaaaauugagccccaaggcugcgacacuggcagaaaggagcgccggcuuagcuuuuagucuuuaucaggcaauggcaaaagaucaggccguagaaaauaucuuggugagcccagucgucguggcguccuccuugggccugguuagcuuaggcggaaaagcaacaacagccucgcaagcaaaggccguucucucugccgaacagcuuagagaugaagaaguucacgccggucucggcgaacuacuuaggucacucucuaacaguacggcccggaaugugacauggaaauuagggaguagauuguacggccccaguagcgucucuuucgcagacgacuucguucgguccaguaagcagcauuacaauugugaacauucaaagaucaacuuucgugauaagagaagcgcccuacaguccaucaaugagugggcggcgcagaccacugacggaaaacugccagaagucacaaaagauguggagcguacugacggcgcacugcuagugaacgccauguucuuuaaaccacacugggaugaaaaguuucaccacaaaauggucgauaaccgcggguucaugguuacacguagcuacacagucggagucaugaugaugcaccguaccgggcucuacaacuauuaugacuag

SEQ ID NO: 13241 - RNA, 117 nt, Artificial Sequence
  Description of Artificial Sequence: Synthetic coding sequence
augcggacauuguuuaaccucuuauggcuugcucuugccugcuccccuguccacaccacacucuccaaaagcgacgccaagaaagcagcuagcaaaaccuugcuugaaaaaguguag

SEQ ID NO: 13242 - RNA, 750 nt, Artificial Sequence
  Description of Artificial Sequence: Synthetic coding sequence
augcgaagccugcuguuacuuagugcuuucuguuugcuggaagcugcccucgcggccgaagugaaaaagccugcugccgcagccgcgcccggaacugccgagaaacucucacccaaggccgccacuuuagcugaacgcagcgccggauuggcauucucacucuaucaggccauggccaaggaucaagcuguugagaacauucuggugucuccugucguuguugccagcucccuugggcucguuucucucggagguaaggcgacaacugcaucucaagcaaaagcagugcucucagcggagcaacuucgcgacgaggaagugcacgcagggcuuggugagcuuuuacggagccucagcaauagcacugcucggaacguaacguggaagcucggcagucgguuauacggaccaucuaguguuucguuugccgaugauuuugugaggaguuccaagcagcacuauaauugugaacacaguaagauuaauuuucgagacaaaaggagugcccuucagucuauuaaugaaugggccgcacagaccacggaugggaaacugccugaagucacgaaggaugucgagagaacagauggagcuuugcucgucaaugccauguucuucaagccacauugggaugaaaaguuucaccacaaaaugguagauaaucgcggcuucauggugacaagauccuacacagugggugugaugaugaugcauaggaccggccuguacaacuacuaugacgacgaauag

SEQ ID NO: 13243 - RNA, 201 nt, Artificial Sequence
  Description of Artificial Sequence: Synthetic coding sequence
augaaaccuuuacucgugguuuuuguguucuuauuccuuugggaucccguuuuggccgguauuaauucacuaagcucugaaaugcacaagaaguguuacaaaaacggaaucuguagacucgagugcuaugagagcgagauguugguugccuacuguauguuccagcuggaguguugcgugaaagggaauccagcgccauag

SEQ ID NO: 13244 - RNA, 1002 nt, Artificial Sequence
  Description of Artificial Sequence: Synthetic coding sequence
auggugucaaaaaguagauggaaacugcuggcuaugcuggccuuagugcuggugguuauggugugguauaguauaucacgagaggaccgguauaucgaacuauucuauuuuccaauccccgaaaaaaaggaaccaugcuuacagggcgaagcugaaagcaaggcaagcaaacuguuugguaauuacagcagagaucagccaauuuuucucagacuggaagauuauuucugggucaaaacucccagcgccuaugagcucccuuauggcacaaaggggagcgaagaccuucuguugcgagugcuggcaaucacauccucauccauucccaagaacauucaguccuuaagaugcagacggugcguggugguuggcaacggccaucgccuccggaacuccucguugggggaugcuaucaauaaguacgacguugucauaaggcuaaauaaugccccaguggccggcuaugaaggcgacgucggcagcaagacgaccaugcggcuuuuuuacccugaaucugcccacuuugacccuaagguagagaacaaucccgacacucuccucgugcugguggcuuuuaaggccauggacuuccauuggauugagaccauuuugagcgacaagaaacgcgugcgaaagggcuucuggaagcaaccaccacugaucugggaugucaaccccaagcagauucgcauauugaaccccuucuuuauggagauugccgcugacaagcugcuuucccuuccaaugcagcagccucgcaagauuaaacaaaaaccaacaaccggacucuuagcuaucacgcuugcccugcaucugugcgaucucgugcacauugccgguuuuggguaccccgacgcuuacaacaagaaacagacaauucacuauuacgagcagauuacacugaaaagcauggcugggucaggucacaacgucucacaggaagcccucgcaauuaagcggauguuagaaaugggggcuauuaaaaaccugacaagcuucuag

SEQ ID NO: 13245 - RNA, 645 nt, Artificial Sequence
  Description of Artificial Sequence: Synthetic coding sequence
augaggccuaagaccggacaggucgggugugagacgccugaagaacucggaccuggaccgagacagcgguggcccuugcugcugcuuggcuuggccaugguggcccacggacuucucagaccaaugguugccccccagucaggggacccugacccaggcgccaguguugguaguucccgaaguucccugaggucacuuuggggcagauuacuauugcagccuuccccacagcgggcugauccacguuguuggccgagaggguuuugguccgaaccccaaagucuguguuacguauucggcacuggaacaaaggucacagugcugggacaacccaaagccaaucccacgguaacccuguuucccccuagcucugaagaacugcaggccaacaaggcuacauuagugugccugaucuccgacuucuaucccggagccgugacaguggcauggaaggcagaugguucucccgugaaggcuggggucgaaaccacaaagccuagcaagcaaucuaacaacaaauaugcggcuaguuccuaccuaagucugaccccggaacaauggaaaucacauagaucuuauagcugccagguuacucaugagggcucaacaguggaaaaaaccguagcuccuacagaaugcucauag

SEQ ID NO: 13246 - RNA, 1050 nt, Artificial Sequence
  Description of Artificial Sequence: Synthetic coding sequence
ugacucuauaagaaccgcuuggggucuggcggucgcggccgaugcaucaagcagggagaaaauugguauucuccaacggaauuugaagcuauggccggccgugcaucaucaaaagacuggaagagauccauaagguaugcugguaggcccuuacagugccucauccaggacggcauucuaaacccccacgccgccagcuguacaugugcugcaugcugcgaugauaugacucuguccggcccggugagauuauuugugccguauaagaggcguaaaaaggagaaugaguuaccaaccaccccugugaagaaggacuccccuaagaauaucacucuucuccccgccacugccgcuacaaccuucacuguaacaccaaguggccagauuacaaccuccggagcccucaccuucgaccgcgccagcacaguugaagcaacagccgugauuuccgagucuccagcccagggggaugucuucgcaggcgcaacagugcaagaggccagcgugcagcccccaugcagggcaagucaucccgagccccauuaccccggauaccaggauucuugucagauagcucccuuuccugaagcugcgcugcccacgagccaccccaagauugugcucaccucccuucccgcguuagccguaccaccccccacaccaacaaaggcagcgccaccugcccucgugaacggcuuggagcuuagcgagccucgauccuggcuguaucucgaagaaauggugaacucccugcucaauacugcucaacagcugaagacacuguuugagcaagcuaaacacgcaaguaccuauagagaagccgcaacgaaccaagcuaagauccacgcugacgcagaaagaaaggaacagagcugcguaaacugcgggcgagaggcaaugagcgaaugcacugguugccacaaggugaacuacuguagcaccuucugucagcgcaaaagguggucucuuacgaugcucacuucgcuagucucaauuucauggcuucgcgcgauuuugccuugccaaccuccaaagguccuagggcuguag

SEQ ID NO: 13247 - RNA, 600 nt, Artificial Sequence
  Description of Artificial Sequence: Synthetic coding sequence
augucacucgacauccagagucucgauauucagugcgaagagcucucugaugcaagaugggccgagcucuuaccucuccuccagcagugccagguagugcgacuggacgacuguggacuuaccgaggcaagguguaaagauaucucuagcgcucugcguguuaauccagcuuuagcugaacucaaccuaagaucgaacgaacucggggauguaggcguucacugcgugcuacagggucuucaaaccccuuccugcaaaauucagaaacugagccuccagaacuguugucugacaggcgccggcugcgggguccugucuucaacacugagaacacugccgacacuccaggaauugcaucugucugauaaucugcuuggcgaugccggucugcagcugcugugcgaaggcuuacucgauccccagugcagguuagaaaaacugcaguuagaguauuguucacucuccgccgccucaugugagccucucgccuccguccugcgggccaaacccgauuucaaagaauuaacagugaguaauaacgauauaaacgaggccggcguucggguauuaugccaggguuuaaaagauaguccuuguuag

SEQ ID NO: 13248 - RNA, 465 nt, Artificial Sequence
  Description of Artificial Sequence: Synthetic coding sequence
auggcugggaucccaggccuccuuuuccugcuauucuuccuacucugcgcagucgggcaggugagucccuacucggcacccuggaagccgaccuggccggccuauagacuuccaguaguucucccgcaauccaccuugaaucuugcuaagccugauuucggcgccgaagcaaaauuagaaguaaguagcucuuguggcccacaaugucacaaaggcacaccucuccccacauaugaggaagcgaagcaauaccucaguuaugaaacccuauacgccaacggaucgcgcacagagacacaagugggcaucuacauccugucuaguuccggggacggcgcacagcauagagauuccgggucaagugguaagucccgccggaagcgacaaauuuacgguuaugacagcagauuuucuauuuuugggaaggacuuucuucugaauuacccuuucagcaccuccguauag

SEQ ID NO: 13249 - RNA, 936 nt, Artificial Sequence
  Description of Artificial Sequence: Synthetic coding sequence
auggggaucauucaaucaauacucgcuaccagccgggacugcuacucuuucaaaaaaaaacccauaccuaaaaaacccaccaugcuggcauuggccaagauucuucucaucucuacacuuuucuacucucuucuuagcggaucccacggaaaggagaaucaagauaucaacaccacgcagaauauugcugagguguuuaaaacaauggagaacaaaccgaucagucuggagagcgaggcaaaucuuaauagcgacaaggaaaacauuacgaccucuaaucuuaaagcaucucacaguccuccccucaaucugccuaauaacucucauggcaucacugauuucucauccaauaguagcgcagagcacucauuagguagccugaaaccuacuagcacaaucuccaccuccccuccccuaauacacagcuuugugaguaaaguccccuggaacgcaccaauagccgaugaggaccuucuuccaauuuccgcacauccaaaugccacacccgcacugucuucagagaauuucaccuggagccugguuaacgacacagugaagacgcccgacaauuccuccaucaccguaagcauacugucuucugaaccgaccagccccagcguaacuccccugaucguggagccaagcggguggcuaacgaccaauucagauucauuuaccggauucacgccuuaucaggagaagacgacacugcagccaacuuugaaguuuacaaacaacagcaaacucuuuccaaauacaucagauccccaaaaaguguugaggcucgauaaugcaccagagccauacgacguuucauuugggaacucaagcuacuauaaccccacucugaacgauuccgcuaugccagaauccgaagaaaacgcacgugacggcauuccuauggacgauauuccgccacucagaaccucuguguag

SEQ ID NO: 13250 - RNA, 1404 nt, Artificial Sequence
  Description of Artificial Sequence: Synthetic coding sequence
auguugauauuuuggacaauuacgcucuuucugcugggugcugcaaaaggaaaagaaguuuguuaugaagaccuaggaugcuucagugauacugaaccuuggggcggaaccgcgauaaggccacugaagaucuugcccuggucccccgaaaagauaggcacaagauuccucuuguauaccaacgaaaacccgaacaacuuucaaauccuguuacucuccgauccuaguacgaucgaagcgaguaacuuucagauggaucggaagacucgguucaucauucauggauuuauugacaagggagacgagagcugggucacugacauguguaagaagcuguucgaaguggaggaagugaacugcaucugcguugauuggaagaaggguucccaggccaccuauacgcaggccgccaacaacgucagagucgucggagcccagguagcacagaugcuugauauauuacugacagaguauucauacccgcccagcaaagugcaccugauaggccauucucugggggcucacguggcgggggaggcagguaguaaaacccccggucugagucgaauaacugggcuagaucccguagaagcuucuuuugagucgacuccugaggaaguaaggcucgacccuuccgaugcggauuucguggacgugauccauaccgacgcugccccucuaauccccuuccuggguuucgggacaaaccagcagaugggacaccuggacuuuuuucccaauggcggcgaaaguaugccaggaugcaagaagaaugcccucucgcagaucguugaucuggauggaauuugggcaggaacaagggauuuuguugcauguaaucaccuucgcucuuauaaauacuaccuggagucaauucuuaacccugauggcuucgcggcguaucccuguacuucguauaagagcuuugaauccgacaaaugcuuuccuugcccagaucaagguugcccucaaaugggccauuacgcugauaaguuugccggcagaacaucagaggagcaacagaaguuuuuucugaauaccggugaagccucaaacuucgcgcgguggagauauggcguaucaauuacccuguccgggagaacagcaacuggacagaucaagguugcacucuucgggaacaaaggaaacacacaccaauacagcauuuuccgcggaauacugaagccgggguccacccauagcuacgaguuugacgccaagcuggacguggguacuauagagaaggucaaguuucuuuggaacaacaacguaauuaacccaacauuaccuaaggugggggcuacaaaaaucaccguacagaagggagaggaaaagaccguuuauaacuucuguagcgaagauaccgugcgagaagacacucucuuaacacuuacucccuguuag

SEQ ID NO: 13251 - RNA, 81 nt, Artificial Sequence
  Description of Artificial Sequence: Synthetic coding sequence
augcgcacucuguuuaaucuguuauggcuugcccuagcuugcucuccuguucacacgacccuaaguaaauccgacgccuag

SEQ ID NO: 13252 - RNA, 549 nt, Artificial Sequence
  Description of Artificial Sequence: Synthetic coding sequence
augaggagaaugugggcgacucagggucucgcuguugcuuuggcccuuaguguucugccaggauccagagcacugcgcccgggagacugugagguuuguaucagcuaccugggccgcuucuaccaagaucugaaggaccgcgaugugacuuuuucccccgcaacuaucgagaaugaacugaucaaauucugcagagaggcucgugggaaagagaauagacuguguuacuauaucggagcuacagaugacgccgcuacuaaaaucaucaacgaaguauccaaaccuuuggcccaccauauacccgucgaaaagaucugugaaaagcuaaaaaagaaggauucucaaauuugugaacugaaauaugauaagcaaaucgauuugucaacuguggaccugaagaagcucaggguuaaggagcugaaaaagauccucgaugauuggggugaaacaugcaagggcugugcggaaaagagcgacuauaucaggaaaauaaacgagcuuaugccgaaauacgcuccuaaagccgcaucugcuagaacugaccuuuag

SEQ ID NO: 13253 - RNA, 153 nt, Artificial Sequence
  Description of Artificial Sequence: Synthetic coding sequence
augaagguuuuuuuccuguuugcuguccuguucugcuugguacagaccaauagcguccauauuucucaucgcgaggcacgcggcccaucauuuagaauaugcguagauuuccugggaccgaggugggcgagaggauguuccacugguaauuag

SEQ ID NO: 13254 - RNA, 666 nt, Artificial Sequence
  Description of Artificial Sequence: Synthetic coding sequence
augggugccaccacaauggaccagaaaucucuuugggcuggugugguaguuuugcuccucuuacagggcggcuccgcuuauaagcucguuugcuacuucacaaauuggucacaggaucgccaagaaccagguaaguuuaccccagaaaacauagaccccuuccugugcagccaccugauauauuccuucgcuuccaucgagaacaauaaggucauaaucaaagauaagucggaggugaugcucuaucagacaaucaacucccuaaagacaaagaauccaaaacugaaaauucugcucucuauuggaggauaccuuuuugguucuaaggguuuccacccuauggucgauuccuccaccucccgccuugaauuuaucaauucuauaaucuuguuucuucgaaaucacaauuucgacggccuugacgugucauggaucuacccugaucagaaggagaauacucacuucaccguuuugauccacgagcuggccgaagcuuuccagaaggacuuuacuaagucaaccaaagaaaggcuccugcuaacagcuggcguuagugcuggcaggcagaugauugacaacagcuaccaggucgaaaaacuugccaaagaucucgauuuuaucaaucuucugagcuucgacuuucauggcaguugggaaaagccauag

SEQ ID NO: 13255 - RNA, 1257 nt, Artificial Sequence
  Description of Artificial Sequence: Synthetic coding sequence
augcguacacucuucaaucuauuauggcuagcacuggcuugcuccccuguucacaccacccuauccaaauccgacgcgaagaaagcagcaaguaaaacguuacuugaaaaggucaaauuuuguucgugcugcccgggauggucugcaauggcgaggucauggcugaccgcaacaucugccacacagagccaauucucugacaagccugugcaggauagggggcucguuguaacugaccugaaggccgagagcgucguccuggagcaccgguccuauuguuccgcuaaggcaagggauaggcacuucgcaggcgacgugcugggguacguaaccccauggaacucucacgguuaugacgucaccaagguuuucggcucuaaauuuacccagaucucaccuguuuggcuacaacucaagcgcaggggccgcgagauguucgaagugacuggacugcaugacguggaccaggguuggaugagagccguaagaaagcacgcuaaaggccuccacauaguaccucgucugcuuuucgaggacuggacuuaugacgauuuccgaaacguguuagacagugaagaugagaucgaggagcuuuccaaaaccgucguucagguggcaaagaaccaacauuucgacggcuucguaguggagguuuggaaucaguugcugucucagaagcgggucggccucauccacaugcuaacccaccuggccgaggcacuucaccaggcgcgucuauuggcauuacuugugaucccccccgccauuaccccuggaacugaccagcuaggaauguucacccacaaggaguuugagcaacuggccccuguauuagauggcuucucgcugaugaccuacgacuacucuacugcucaucaaccuggccccaaugcuccucucaguugggucagggcaugcguccaaguacuggauccuaaaaguaaguggcgguccaagauccugcugggccucaauuucuauggcauggacuacgccacuuccaaggaugcaagagaacccgucgugggagcaagguauauccaaacccugaaagaccaucggccucggauggugugggauucacaggcuucagaacacuuuuuugaguacaaaaagagucgaagcggucgacacgucguguuuuacccaaccuuaaaaagucuucaagugaggcuggagcuggcucgggaacugggugugggggucagcauuugggaacuaggucagggucuggacuacuuuuaugaucuacuguag

SEQ ID NO: 13256 - RNA, 612 nt, Artificial Sequence
  Description of Artificial Sequence: Synthetic coding sequence
augcguagccugcuacuguuguccgccuucugccucuuggaagccgcccuugccgccgaggugaagaaacccgcagccgcagcagccccagggaccgcugagaaacuuucaccuaaagcagcuacucuggcggagaggagcgcuggucuagcauucucucucuaucaggcuauggcuaaagaucaggccguggagaacauuuuggugucucccgugguaguggccucaucgcucggguuaguaucucuaggcggaaaagcuacuacagcuucacaggcaaaggcagugcugagcgccgagcaacugagagaugaggagguccacgcgggcuuaggggagcuccuucgcuccuuaaguaacucaacugcacggaauguuacauggaaacuugggucuagauuguacggucccaguucaguuucauucgcugaugauuucguacgauccucaaagcaacauuacaauugcgaacacagcaaaaucaacuuucgcgacaagcggagcgcacuccagagcauuaacgagugggcggcccaaacaaccgacgguaaacuuccagaggugacuaaggauguggagagaacugacggagcuuugcuggugaacgccuag

SEQ ID NO: 13257 - RNA, 492 nt, Artificial Sequence
  Description of Artificial Sequence: Synthetic coding sequence
augaggucccuucugcuccugucugcauuuuguuugcuggaggccgcccuugcugcagaagugaaaaaaccugccgcagcugcagcgccaggcaccgccgaaaagcuaagcccuaaggcagcaacauuggcugagcgaucagccggguuggcuuucucucucuaucaggcuauggccaaagaccaggccguugagaacauacucguaucuccaguggugguagcuaguagucuuggacuugugucucugggagguaaggcuacuaccgccucucaggcuaaggccguauuaucagccgagcaacuccgugacgaagagguccacgcaggucugggagaacucuugcgaucucugucaaauucaacugcucggaacgucacuuggaagcugggaagucgguuguauggaccuucuucugugucauucgcugaugacuuugugcgcaguuccaagcagcacuauaauugcgagcauucuaaaaucaacuuuuag

SEQ ID NO: 13258 - RNA, 570 nt, Artificial Sequence
  Description of Artificial Sequence: Synthetic coding sequence
augucacuagauauccagucauuagacauccagugugaggaguugucggaugcucggugggcagagcucuugccguugcuucaacagugccaggugguaagacuggaugacugcggguugacagaagcccguuguaaagauauuaguagugcacuuagagugaacccagcucuggccgagcucaaucucaggaguaacgaacugggcgaugucggcguccauuguguguuacaaggucuccaaacuccuuccuguaagauucagaaacugucccuccagaauugcugucucaccggagcaggaugcggggucuuaagcucuacgcuucgcacauugcccacucugcaggagcuccaccugucugacaaccugcugggcgacgcaggccuucagcucuugugugagggacugcucgacccgcaauguagacuugagaaguuacagcucgaguauuguucucucucagcggccucaugcgagccacuggcaucugucuuaagggccaaacccgauuucaaagaacucaccguuucuaauaaugauauaaaugaagcuggaguacggguguag

SEQ ID NO: 13259 - RNA, 585 nt, Artificial Sequence
  Description of Artificial Sequence: Synthetic coding sequence
augucucuggacauucagucucuggacauucaaugcgaggaacuuagugacgcgaggugggccgaguuacuuccccugcugcaacagugccagguagugcgacucgacgacuguggacugacggaggcaagauguaaagacaucucaucugcccuacgagugaaucccgcccuugcugaauugaaucugcggaguaaugaacucggcgaugucggcgugcacugcguguugcaggggcuucagaccccuucuuguaaaauucagaaguugucccuacaaaauuguugccugacaggcgcagguuguggagugcuuuccucaacucuucgaaccuuacccacccuccaagagcugcaccugucugauaacuuacugggcgaugccggucugcaguugcugugcgagggcuuguuggacccacaguguagacuagaaaagcuccaacuggaguauuguucucugagugcugccucaugcgaaccccuggccagcguccugcgugccaagcccgauuucaaagagcugacagucuccaauaacgauaucaacgaagcaggcgugcgcguauuaugccagggccuguag

SEQ ID NO: 13260 - RNA, 1086 nt, Artificial Sequence
  Description of Artificial Sequence: Synthetic coding sequence
augggaauuauacagucaaucuuggcuacuucgcgcgacuguuauagcuuuaagaaaaagccaauccccaagaagccaacuaugcuagcccuggcgaaaauacuucugauauccacacuguuuuauagccuccuuagcgguucacauggaaaagaaaaucaggauauuaacacuacccagaacaucgcagagguguucaaaacaauggagaauaagccaaucucacuggagagugaagccaaucucaacucggacaaagagaauauaaccaccuccaaccugaaagccagccauuccccccccuuaaaccuacccaacaacagccauggcauaacagauuucagcucgaauaguucugccgagcauagccucgggucccucaaaccuaccuccacuaucuccacauccccaccacuaauucauuccuucguaucgaaaguccccuggaacgcacccauugccgaugaggaccuacugcccaucucugcccaccccaaugccaccccagcucugucauccgaaaauuucacauggagccuugugaacgacacaguuaagaccccugauaacuccucuauuacuguaaguauucuguccucugagcccacuagccccucaguaacuccguuaaucgucgaaccaagcggauggcucacuacuaauagugacuccuucacuggcuuuaccccauaccaggaaaaaaccacccuacagcccacucucaaguuuacaaacaauaguaagcuuuuccccaacacuucugacccccaaaaagagaaucguaauacugggauuguguuuggagcuaucuuaggugcaauauugggcguuucuuuacugacgcucguaggcuaccucuuguguggcaaaaggaaaacagauuccuuuagccaucgccggcuuuacgacgaccggaacgaaccagugcuuagacuggauaaugcccccgaaccuuacgauguuagcuucggaaauucuagcuauuacaacccuacccuuaacgacuccgccaugcccgagagcgaggaaaacgcuagagacggaauaccaauggacgauauuccuccccuccgcacuaguguguag

SEQ ID NO: 13261 - RNA, 327 nt, Artificial Sequence
  Description of Artificial Sequence: Synthetic coding sequence
uaaccaaagucgaaauggaggucuaagauauuauugggccugaacuuuuauggaauggacuaugcuacaaguaaagaugcuagagagccuguggugggggcgagauauauacagacuuuaaaagaccauagaccaagaauggugugggauagccaagccagugaacauuucuuugaauacaaaaaauccagguccgguagacauguggucuucuauccuacguuaaagucccugcagguuaggcuugaauuagcccgcgaguugggaguaggggucagcaucugggaacuuggucagggccuugauuauuucuaugaucuacuuuag

SEQ ID NO: 13262 - RNA, 504 nt, Artificial Sequence
  Description of Artificial Sequence: Synthetic coding sequence
augagaucccuucuccuacucuccgccuucugucugcuggaagcugcacuugccgccgaagucaaaaagccugcugccgcagcugcgccagggaccgccgaaaaacugagucccaaagccgcgacccuggcagaacggucggccggccuugccuuuucucucuaccaagcaauggcaaaggaucaagcugucgagaauauucuggugagcccagucgucgucgcuucaucccugggccuggugucucugggagguaaggcuacaaccgcgucucaggcaaaagcaguccuaucagcugagcagcugcgggacgaagaaguacacgccggguugggcgagcuacuacgaucucugagcaacuccaccgccagaaacgugacuuggaaacucggcucacgccuguacggcccguccucugugagcuucgccgacgauuuuguuagaucgagcaagcaacauuacaacugugagcacaguaagaucaauuuucgggacaaacguuag

SEQ ID NO: 13263 - RNA, 1209 nt, Artificial Sequence
  Description of Artificial Sequence: Synthetic coding sequence
augaugguugcauuaaggggugccuccgcauugcugguacuuuuucuugccgccuuucucccuccaccccaguguacgcaggaucccgcaaugguccauuacauauaucaacgguuuagaguguuggaacagggucuugaaaaaugcacccaggcaaccagagcauauauucaagaauuccaggaguuuuccaagaacauuucaguuaugcuugguaggugucaaacauauaccagugaauauaagagcgcugucggaaaucuggcacugagggucgaacgggcacagcgggaaauugauuacauacaauaucugagggaggccgacgaaugcaucgaaucugaagacaagacacucgcugaaauguugcuccaggaggccgaggaggagaagaagauccggacgcuccugaacgcaucaugcgacaacaugcugauggguauuaaaucgcugaagaucgugaagaaaaugauggacacucacgguucauggaugaaggacgccguguacaacucaccaaaaguguaucugcugaucggaucucgaaacaauacggucugggaauucgcaaauauaagggcuuuuauggaggacaauaccaagccagcaccucggaagcagauccucacacucucauggcagggaaccggccaaguaauauacaaaggauuuuuguucuuucacaaccaggcaacaaguaaugagaucauaaaguacaaccuccagaaaagaacagucgaggaucgcaugcugcugcccggcggcguagggcgcgcgcugguguaccagcacaguccaucuaccuacauugaucuugcuguagaugaacacggacuuugggcaauucacucagggcccgguacccacagccaccuuguccucacuaaaaucgaaccagguacucugggaguggagcauucuugggauacacccuguagaucccaggacgcugaagccagcuucuugcugugugggguguuauacgucguauacagcacagguggccaggguccccaccguauaaccugcauauaugacccucucggcacaaucucugaagaagauuugccuaauuuauuuuuuccgaaacguccacguagccauucuaugauacacuacaacccaagagacaagcaacuguaugcguggaacgagggcaaccagauaaucuauaaacugcaaacuaaacgcaagcucccauuaaaauag

SEQ ID NO: 13264 - RNA, 975 nt, Artificial Sequence
  Description of Artificial Sequence: Synthetic coding sequence
augaggucauugcugcuguugagcgcauuuugccuccuugaagcugcccucgccgcugagguuaagaagccugccgcagccgcagcaccugggacagcugagaaacuguccccaaaagccgcaacccucgcagagcgaagcgccggacuugcuuucucucuguaucaggccauggccaaggaccaagcaguggagaacauccuggucaguccaguggugguggcuucaucucugggccuagucucacugggagggaaggccacgacugccagccaagccaaggccguccuguccgcugagcaauuacgcgaugaagagguucacgcuggccugggcgagcuccugcguucauuaagcaacaguaccgcgcgcaaugugaccuggaaauugggauccagacucuacggcccuagcucuguguccuucgccgaugacuuuguuagguccuccaagcagcacuauaacugugagcauucuaaaaucaacuucagagacaagcgcuccgcccugcaaucaauuaacgagugggcugcucagacaaccgacgggaagcugccagaggucaccaaagauguggagaggacagauggcgccuugcugguuaaugcuauguucuuuaaaccgcacugggaugaaaaauuucaucacaaaaugguggacaauaggggauuuaugguuacacguuccuacacugugggggugaugaugaugcaucgaacaggcuuguacaauuauuacgacgaugaaaaagagaaacuucagauuguggaaaugccgcuggcccacaagcuuuccucucucauaauucucaugccacaccauguggaaccacucgagcguuuagaaaaacugcuuacuaaggaacaguuaaaaauuuggaugggaaaaaugcagaagaaggcugucgccauuucccucccuaagggcguuguagagguuacccaugaucuccaggugagaggugggcccgcuuag

SEQ ID NO: 13265 - RNA, 990 nt, Artificial Sequence
  Description of Artificial Sequence: Synthetic coding sequence
auggugucuaagucacguuggaaacuccucgcgaugcuggccuuaguacucguagugaugguuugguauuccauuagcagagaagacaguuuuuauuuuccgaucccugaaaagaaggagcccugucugcagggugaggccgaaucuaaagcaaguaaacuguuuggaaacuauagccgagaucaacccaucuuucugcgcuuagaagauuacuucuggguuaaaacaccaucugcauacgagcugccuuacggaacaaaaggaucggaggaucugcucuuacggguauuggcaauuaccucuucuucuauuccuaaaaauauccagagccucagauguagacgcugcgugguagucgguaacggccacaggcuucgaaacucuaguuuaggggacgccaucaauaaguacgacguggugaucagacuuaacaacgcucccgucgccggauacgaaggggacguggggucaaagacuaccaugcgccuuuuuuauccugaaucugcccacuuugacccuaagguggagaacaacccugacacacugcucgugcuuguggcauucaaagcuauggacuuccacuggauagagaccauucucagcgauaagaagcgcgugcggaaaggcuucuggaaacaaccuccgcucauuugggacgugaaccccaaacagauaagaaucuuaaaccccuuuuucauggagauugcugcagacaaacucuugucccugccaaugcagcaaccacgcaaaauuaagcagaaaccaaccaccggccuguuggccaucacacucgcucugcacuuaugugaucucgugcacaucgcuggauuuggcuauccagaugcauacaauaagaaacaaaccauacauuauuacgaacagaucacucugaaaucgauggcugguaguggccacaauguaagccaggaagcccucgcaauuaaaagaaugcuggaaaugggagccaucaagaaucuaacauccuucuag

SEQ ID NO: 13266 - RNA, 351 nt, Artificial Sequence
  Description of Artificial Sequence: Synthetic coding sequence
augaggacgcuguuuaauuugcuguggcucgcccuugcguguagcccuguacauacuacccucuccaaaucugaugcgaagaaggcugccuccaaaaccuugcuagaaaagagucaauucucugauaagccaguacaggacaggggccucguggugaccgaccugaaagcagagucugugguuuuggagcaccguucuuacuguagcgccaaggcccgggaccgucacuucgcaggagacguccugggauacguaacuccauggaacagccacggcuacgaugugaccaaaguguucggauccaaguuuacccaaaucuccccagucuggcugcaacucaaacgccgguag

SEQ ID NO: 13267 - RNA, 282 nt, Artificial Sequence
  Description of Artificial Sequence: Synthetic coding sequence
auggauagcuugaggaagaugcugauuucaguugccaugcugggagccggggcaggugugggcuacgcacuguuagugauugugacgccaggagaacguaggaaacaagaaaugcucaaagagaugccguugcaagauccacgaaguagagaggaagccgccagaacucagcagcuguugcuggcuacacuacaggaagccgcaaccacucaggaaaacguggccuggcgaaaaaacuggaugguggggggcgaaggcggagcaggaggacgguccccuuag

SEQ ID NO: 13268 - RNA, 255 nt, Artificial Sequence
  Description of Artificial Sequence: Synthetic coding sequence
augagacccaagaccggccaggucggaugugaaacaccagaggaguuaggacccggcccgcggcagagguggccccuccugcugcugggucuagccauggucgcucacggucuacugcggcccauggucgccccccagucuggagacccugacccuggcgccucaguugguagcucaagaagcucucuuagaucacugugggggagaucagcccaaggccagccacacugucauucuguacccgcccuguuguag

SEQ ID NO: 13269 - RNA, 27 nt, Artificial Sequence
  Description of Artificial Sequence: Synthetic coding sequence
augagccucgauauucaaagucuguag

SEQ ID NO: 13270 - RNA, 576 nt, Artificial Sequence
  Description of Artificial Sequence: Synthetic coding sequence
augcugauauucuggacaauaacccuguuccugcuuggugcugcuaaagggaaggaaguauguuaugaagaucucggcugcuucucagacaccgaacccugggggggcacugcuauucggccucuaaagauacuccccuggucacccgaaaagauuggaacuagguuccugcuuuacacaaacgagaaucccaacaauuuucaaauccuucuccucucggacccaucaacuauugaggccagcaacuuucagauggacagaaaaacccgguuuaucauccauggauucauagacaagggagacgaaucuuggguaacagacaugugcaagaaacucuucgaaguugaagaggugaacuguauuugcguugauuggaaaaaaggcucccaggcaacauacacacaagccgccaauaauguucgcgucguuggugcucaggucgcccagaugcuugacaucuuguuaacggaauacagcuauccacccaguaaagugcaucugauaggacauucguuaggggcucacgucgcaggugaggcaggcucgaagacaccaggcuugucgagaaucacauag

SEQ ID NO: 13271 - RNA, 123 nt, Artificial Sequence
  Description of Artificial Sequence: Synthetic coding sequence
augucccuagauauccaaucgcuugauauccaaugcgaagaacuauccgacgccagaugggcagaguuauugccacuguuacagcaaugucagguaguaagauuagaugacugcggccuguag

SEQ ID NO: 13272 - RNA, 648 nt, Artificial Sequence
  Description of Artificial Sequence: Synthetic coding sequence
augcgcccuaaaaccggccaggugggaugugagacuccagaggaacugggacccgggccucggcagagauggccgcuguugcugcucggccuggcuauggucgcacaugggcuuuugagaccaaugguagcuccgcagagcggcgaucccgauccuggagcuuccgugggguccucucgauccucccugagaucucuguggggaucacgccuucuccuccagccuucgccucagagagcugauccuagaugcuggccuaggggauuuuggagcgagccucagucccuuugcuacguuuuuggcacugguacuaaggucacagucuugggccagccaaaggccaauccaacuguuacucuguuuccuccuucauccgaagagcuacaagccaauaaagccacacugguuuguuugauaagcgauuuuuaccccggcgccgugacaguggcauggaaagccgacggcucacccgugaaagccgggguugaaaccacaaaaccuagcaagcagucaaauaacaaguacgcugcgucuucuuaccuaucgcuuacccccgaacaguggaaaagccaucgauccuacuccugucaagucacgcacgaggggaguacagucgaaaaaacagucgccccuaccgaaugcagcuag

SEQ ID NO: 13273 - RNA, 999 nt, Artificial Sequence
  Description of Artificial Sequence: Synthetic coding sequence
augugccccgccggguggaaacuuuuggcgaugcuugccuuggugcugguggugaugguuugguauuccaucaguagggaagaccgcuauauagagcuguucuacuuuccaauucccgaaaagaaagaaccaugucugcagggagaggcugaaucaaaggcuucuaaguuauuugguaauuauuccagggaccagccaauuuuucuaagacucgaggauuacuuuuggguuaagacuccuagcgcguacgaauuacccuauggaacaaaagggagugaagaucuacuccugagggugcuggcuaucaccaguucaucuauuccaaaaaacauccagagcuugaggugccgcagauguguggucgugggcaacggucaccgauuaaggaauuccucccugggagacgcuaucaacaaauaugacgucgugauccggcuuaacaaugccccaguagcugguuaugagggggaugucggcuccaaaacaacuaugcgacuuuucuaccccgaauccgcucauuucgaucccaaaguggaaaauaaccccgauacccuacucguacuggucgcuuucaaggccauggacuuucacuggaucgagacaauacuguccgacaagaaaagggugagaaaggguuucuggaaacagccgccccuaauaugggacgugaacccaaagcagauccggauccugaacccauucuucauggaaauagcagcggauaaguuacugucccucccgaugcagcagccccgcaaaaucaagcagaaaccaaccaccggacuauuggcuaucacacuggcccuacaccugugcgacuuaguccauaucgccgguuuuggguauccagacgcguauaauaagaagcaaaccauucauuacuaugaacaaauaacccucaaaagcauggccggaucaggucauaacgugagucaagaagcccuggccaucaagcgaaugcucgaaaugggcgcaaucaagaaccugaccuccuucuag

SEQ ID NO: 13274 - RNA, 888 nt, Artificial Sequence
  Description of Artificial Sequence: Synthetic coding sequence
augcggucauugcuacuauugucugcuuuuugccugcuggaagcugcgcuggcagccgaagugaagaagccugccgcugccgcagccccuggcacugcggagaaacuuuccccuaaggcugcgacacucgcggagcgcuccgcaggccuugcuuucucauuauaccaagcuauggccaaagaucaagccguugaaaauauccuggucuccccuguugugguggccucgagccugggauuagucucccucggaggaaaggccacaaccgccagucaagcgaaggcuguccugucagccgaacagcuuagagacgaagaggugcacgcgggacucggggaacugcuccggagcuugaguaauaguacagcccgaaacgucacuuggaaacugggcucaagacucuacggcccuagcuccgucucauucgccgacgacuuugucagguccagcaagcaacauuacaacugugaacauuccaaaaucaacuuucgcgauaagagaucagcccuacaaaguauuaaugaaugggccgcccagacaacagaugguaaauugccggaggugacgaaggacguggagaggacggacggagcccugcuggucaaugccauguucuuuaagccccacugggacgaaaaauuccaucacaaaauggucgacaaucgcggauucaugguuacaaggucuuacaccgugggcgugaugaugaugcauagaaccggccucuacaauuauuaugacgacgaaaaagaaaaacugcagaucguugaaaugccucuagcucacaagcucucuucucugauuauucuuaugccucaccauguggagccauuggaacgccucgagaagcugcuaaccaaagaacagcugaagauauggaugggguag

SEQ ID NO: 13275 - RNA, 399 nt, Artificial Sequence
  Description of Artificial Sequence: Synthetic coding sequence
augagaacacuguuuaauuuguuauggcuggcccucgcuugcagcccaguucauacuacauuaagcaaaucugacgcaaagaaagcagcuucuaagacccugcuggagaagagucaguucuccgacaagccaguccaggauaggggacuuguuguuaccgaccuaaaagccgagaguguugucuuggaacaccggaguuauugcucagcuaaggccagggaccgccauuuugcaggggacguccugggcuaugugacucccuggaauagucauggauaugacgugaccaaaguguuugguucaaaauucacccagauaucccccguguggcugcagcucaaaaggcgaggacgugagauguucgaggucaccggacuucaugauguggaucagggguag

SEQ ID NO: 13276 - RNA, 360 nt, Artificial Sequence
  Description of Artificial Sequence: Synthetic coding sequence
augcgcacacuguucaauuuguuguggcuggcuuuggcgugcuccccugugcacacaacucuuucaaagucugaugccaagaaggcagcuagcaagacacuacuggaaaaaagccaauuuucugauaagcccgugcaagauagaggccugguugugacggaccuaaaggcugaauccgucgugcuugagcaucgaucauacuguagugcuaaagcacgagauagacacuucgccggugacgugcugggcuaugugaccccauggaauucucacggcuacgaugugacaaaaguuuuugguaguaaguuuacgcagaucagcccugucugguugcaauugaaaagaaggggucgggaguag

SEQ ID NO: 13277 - RNA, 390 nt, Artificial Sequence
  Description of Artificial Sequence: Synthetic coding sequence
augccuauggcuucuccccagacccuaguucuuuaccugcucguacuggccgucacagaagccugggggcaagaagcuguaaucccugggugucaucugcauccguuuaacguaacagugagaucggaucgacaagggaccugucagggcucucacguggcucaagccugugucggucauugugaguccucugcuuucccuucgcgguacaguguccucguggccucaggguauagacacaacaucaccucaguuagccaguguugcaccauaaguggcuuaaagaaaguuaagguacagcugcaauguguuggaagucggcgugaagagcucgaaauuuuuacagcccgggcuugccagugcgauaugugucgcuuaucccgcuacuag

SEQ ID NO: 13278 - RNA, 1386 nt, Artificial Sequence
  Description of Artificial Sequence: Synthetic coding sequence
augucccuggauauucagucucuggacauucaaugcgaagagcuuagugaugcucgcugggcagagcuguugccacugcugcagcaaugucagguggugagauuggacgauuguggucuuacagaagcaagaugcaaagauaucucaucugcccugcgugucaacccugcuuuggcugaacugaauuugcggagcaaugaacugggggauguggggguacauugugugcugcagggucugcagacacccucauguaaaauucagaaacugucccugcaaaauugcugucucaccggugcuggcugcgguguucugucuuccacacugaggacgcucccuacccuccaagaauugcaucugucugauaaucugcuuggcgacgcaggcuuacagcuccuaugcgaaggacuccuggacccucagugucgauuagagaaacuucaguuggaauacugcucauuguccgcggcuagcugugaaccuuuggccagcgugcugcgugcaaaaccugacuuuaaggagcucacugucagcaacaacgauauaaacgaagcaggcgucagggugcuuugucagggccugaaagauucacccugucaacuugaagcacugaaacuugagaguugcggggugacuucagauaauugccgcgaccucugugggauuguugcaucgaaagccucgcugcgcgaacucgcucucggcucgaacaagcucggcgacgugggcauggcugaacugugcccgggguugcuacauccaucaucuaggcugagaacauuauggauuugggaaugcgggauaaccgcuaaggggugcggcgaucuuugccguguguuacgugcgaaagaaucacugaaagagcucucccucgccggcaaugagcugggggaugaaggcgcaagacuacugugcgagaccuuguuagaaccaggaugccaacuggagucucuguggguuaaaucgugcucuuucacagccgcaugcuguucucauuuuucuucaguccuagcccaaaauagguuuuuauuggagcuccagauuagcaacaaccgccucgaggaugcuggcgucagggaacugugucaggguuugggccaacccggaagcgugcuacgggugcucuggcuugcagacugugacguuagugauucuaguugcucuagccuugcugcaacacugcucgcaaaccacucacugcgcgaacuggaucuguccaauaacugccugggagaugcggggauucuucagcucgucgaaucuguucgccagcccgguugccugcuugagcaguuggugcucuacgauaucuacuggagugaagagauggaggacaggcugcaagcccuggagaaggauaaaccaucacucagaguaauaucuuag

SEQ ID NO: 13279 - RNA, 453 nt, Artificial Sequence
  Description of Artificial Sequence: Synthetic coding sequence
augaggagucugcuccuauuguccgcuuuuugccugcucgaggcggcccuggcagcugaagucaaaaagcccgccgcagccgccgccccuggcacagccgagaagcuguccccuaaggcugccacucuggcagagcguagcgccggucuggcauucaguuuauaucaagcaauggccaaagaccaggccgucgaaaacauccucguaagucccguugugguggccucuuccuuaggacuggucucccucggugguaaagcaacaaccgcuucacaggcuaaagcaguccuuagcgccgagcagcugcgcgaugaggaagugcacgcaggccucggagagcuccuaaggucccucucuaauucuacugcccguaaugugacguggaaacugggcucucgauuauacggcccuucuucuguaucauucgcugaugacuucgucagaaguaguuag

SEQ ID NO: 13280 - RNA, 1257 nt, Artificial Sequence
  Description of Artificial Sequence: Synthetic coding sequence
augcgcagcuuacuucugcucucugccuucugccugcuggaagccgcacuggcugcagaagugaaaaagccagcagcugccgcagcccccggcacggcugaaaaacugaguccgaaagcagcaacccuagcugaaaggucugccgggcuggcuuuuagccuguaucaggccauggcuaaggaccaggcaguggagaauauccuggucucaccaguuguuguggcaucgucacuuggcuuagugucacucgggggaaaagccaccaccgcaagucaagcuaaggcuguucuuagcgcugaacagcugcgcgacgaagaggugcaugcaggguuaggcgaacuccugcggucuuugucuaauagcacagcccgaaacgugaccuggaagcugggcucucgucucuaugggccaucuagugugucauucgcagacgacuucguucggagcuccaagcagcacuacaacugcgaacacaguaaaaucaauuuucgggauaagagauccgcauuacagucgaucaacgagugggccgcacaaacaacagacgggaagcucccagaggugacgaaggacguugagaggaccgauggagcccugcuagugaaugcuauguuuuuuaagccacacugggacgagaaauuucaccauaagaugguggauaacaggggauuuauggugacccgcuccuauacugugggcguaaugaugaugcaccggaccggacuauacaauuacuaugacgaugaaaaggaaaaguuacagaucguugagaugccgcucgcacauaaauuaagcucccuuauuaucuugaugccccaucacguggagccccuugaaagauuggaaaaacuucugacaaaagaacagcugaagauauggauggguaaaaugcaaaagaaagcugucgccauuucccugccuaagggcguagucgaggugacacaugaucuccagaagcacuuggcggguuuaggauugaccgaagcuauugacaagaauaaagccgaccucagccgcaugagcgguaagaaggaucuguaucucgccucuguauuucacgccacagcguucgagcuagacacugacggcaaucccuuugaccaagacauuuauggacgcgaggaauugcguaguccuaaacucuuuuacgccgaucauccuuucaucuuccuaguaagagacacucagucgggcagucuccuuuuuauugguagacucguccgaccgaaaggagauaaaaugcgagacgagcuguag

SEQ ID NO: 13281 - RNA, 1002 nt, Artificial Sequence
  Description of Artificial Sequence: Synthetic coding sequence
augguaucgaaaucgcgauggaaguugcucgccaugcuggcccugguccucguugugaugguaugguauagcauuucaagagaagaucgauauauagaacuuuucuacuucccuauuccagagaaaaaagagccuugucuccagggagaggcugagucgaaggcgaguaaauuguucggcaauuauagucgggaccagccaauauucuugcgucucgaagauuauuuuuggguaaagacaccaagcgcauacgagcuuccuuauggcacuaaaggaagugaggaucuucuccucaggguguuggccauuacuagcucuuccaucccuaagaauauacagagucugcguugccgucgcugcguggugguuggcaauggccaucgccuucgcaauagcucauuaggagacgccaucaacaaauaugauguugugaucagacuuaacaacgcucccguggccggcuacgaaggugaugugggaucaaagacaacaaugcgccuguuuuaucccgaauccgcucacuuugauccuaagguugagaauaacccagauacucuccuaguguuggucgccuucaaagcgauggacuuucauuggaucgagacuauucucagcgauaaaaaaagaguucgcaagggauuuuggaaacagccaccucugaucugggacgucaacccuaagcagauacgaauucugaaccccuuuuucauggaaauugccgcugacaagcugcuaucccugccaaugcaacaaccuagaaagauaaaacagaagccaacaaccggucuuuuagcuauuacucuggcacuccacuuaugugaccugguacacauugcugguuuuggcuaccccgacgcuuacaauaagaaacagacaauccauuacuacgaacagaucacucucaaaagcauggccggcagcgggcacaacguuagccaggaggcucuagccaucaagcggaugcuggagaugggugcaauaaagaauuuaacuagcuucuag

SEQ ID NO: 13282 - RNA, 987 nt, Artificial Sequence
  Description of Artificial Sequence: Synthetic coding sequence
auguguccugccggguggaaacuucuugcaaugcuagcccugguucugguggugaugguuugguauucuaucucucgggaggacucauucuauuuuccaaucccagaaaaaaaagaacccugccuccagggggaagcugaaucaaaggcauccaaacucuuugggaauuauucaagggaccagccaauuuuucuccggcuagaagacuauuucugggugaagacucccagcgccuacgaguugccauaugggacaaagggaucagaggaucuccucuuaagagugcucgcuaucacaucuuccuccauuccuaagaacauccaaucccuacgaugccgacgaugugugguagugggcaacggacaccgacuaagaaauagcucgcugggggaugccauaaacaaauacgauguggugauacggcugaacaaugcaccuguugcuggcuacgaaggcgauguaggcuccaaaaccacuaugcgccuguucuauccugaauccgcccauuucgauccgaaaguagaaaacaacccagauacccuguugguacuaguggccuucaaagccauggacuuucacuggauugagacuauuuuaucugauaaaaagcgggugaggaagggauuuuggaaacagccuccacugauuugggacgucaaucccaagcagauccggauuuuaaacccauuuuuuauggaaaucgccgcagacaagcuacuaucacugccaaugcagcaaccacgcaaaauuaaacagaaaccaacuacgggacuuuuagccaucacucuggcacuccaccucugcgaccucguacacauugcuggguuuggcuauccugaugccuauaauaaaaaacagaccauacauuacuacgaacagauaacucucaaaagcauggcagguucuggucacaacguaucacaggaggcccuggcaauuaaacgaaugcucgaaaugggagcuauuaagaaucuuaccucauucuag

SEQ ID NO: 13283 - RNA, 585 nt, Artificial Sequence
  Description of Artificial Sequence: Synthetic coding sequence
augacaaugaggcacaacuggacacccgaccugagccccuuauggguuuuacugcugugcgcucacgugguaacccuucucguccgcgcaacacccgugagucagaccaccaccgccgcuacagcgucuguccggagcacaaaagacccguguccaagucagccaccaguuuucccagcagccaaacagugccccgcuuuggaaguuacauggccugagguggaggucccucuuaacggcacacuuuccuugagcugcguugcuuguagucgguucccgaacuucagcauuuuguacugguuaggcaacgguagcuucaucgaacaccuucccggccgccuuugggaggggaguaccagccgcgaacgcgggagcacuggaacucaacuaugcaaggcccucgugcuggaacagcucacuccugcucugcacuccacuaacuucuccugcgugcucguggacccugaacaaguggugcaaagacauguugugcucgcccagcucugggcuggauuacgcgcaacacugccucccacacaggaagcccugcccucgucccacucuuccccccagcagcaaggcuag

SEQ ID NO: 13284 - RNA, 1386 nt, Artificial Sequence
  Description of Artificial Sequence: Synthetic coding sequence
augagcuuagacauucaaagucucgacauccagugugaggaguuguccgacgcaaggugggccgaacuccuaccccugcugcaacaaugccagguggugcggcuggacgauuguggccugacugaggcuagaugcaaggauaucucuucagcccuaagaguaaaucccgcacuggcagaauuaaacuugaggucaaacgaacugggugauguggggguacauugcguccugcaggggcugcagacgccaaguugcaagauucagaaacucagccugcagaauuguugucuuacuggagcaggguguggcguacuuuccuccacccucaggacucuccccacucuacaggagcugcaccugucugacaaucugcuuggagacgcuggauugcaacugcugugugagggccugcuagacccgcagugcagacuugaaaaauugcaguuagaauacuguagccucucugccgccucgugcgaacccuuagcuucugugcugcgcgccaaacccgauuucaaggagcugacgguaucuaauaaugauauuaaugaggccggcgugaggguacuuugccagggacuuaaggauucaccgugucaguuggaggcucugaagcuggaauccuguggcgugaccagugacaauuguagagacuuguguggcaucguggcuaguaaagcuucccuuagagagcuggcucugggaucaaauaagcucggagacgugggaauggcugaauuguguccgggacuccuccauccaucuucgcgacucaggacccuguggauuugggaaugugguaucaccgcaaagggguguggggaucucugccgagugcugcgagccaaggagagccucaaagaacugagccucgccggaaaugagcugggcgaugagggagcuagauuacucugugagacacugcuggagccagggugccaguuagaauccuuauggguuaagagcugcaguuuuaccgcagcuuguuguagccacuuuucuagcgugcuugcccagaaccgcuuccuccuggaacugcagauauccaacaauagguuggaagaugcaggcguucgugaacugugucaaggucucgggcaaccuggcuccguccugcgcguucucuggcuggccgauugugaugucuccgacucaaguugcucaucacuggccgccacccuucuagcuaaccauucccuucgugagcucgacuugagcaauaacugucugggcgaugccggaauucuccaacuaguugagagcgugaggcagcccggaugucuccuggaacagcuaguccuguaugacaucuauuggagugaggagauggaggauagacuccaggcccuugagaaagacaaaccuucucuucgcgugauuaguuag

SEQ ID NO: 13285 - RNA, 1995 nt, Artificial Sequence
  Description of Artificial Sequence: Synthetic coding sequence
augccccaggcccccucgacugguuccuccuuaauccgggauccuucgauagcacacagaaacacacaaauacucuggaccgaggcuggcagagauuuagcucaggauacacgauacaccggggaggagagucugaccauuuuuguggacaagagaaaauuauccaagcgggccgaaggcagcgauucuacaacaaauuccuccaguguaacuuuggagacacugcaccagcucgccgcuagcuauuucaucgaccgcgacucgacauuaaggcgucugcaccacauacagaucgcaaguacugcaauuaagguuaccgagacccgcacuggaccgcugggaugcuccaacuacgauaauuuagacuccgugucuucagugcuuguucagucucccgaaaacaagauccaacugcaggguuugcagguacuccuuccugauuaccugcaggagagguuuguccaggccgcgcucucauauaucgcauguaacucagagggggaauuuauuuguaaggagaaugauuguuggugucauugcgggccuaaauuccccgaguguaauugccccaguauggauauucaggcaauggaagagaauuuacugagaauaaccgagaccuggaaagccuacaauucagacuuugaagagucagacgaguuuaaguuauucaugaaacgacuaccgaugaacuacuuccugaacacuuccacaaucaugcaucuguggaccauggacaguaacuuucagcgaagauaugaacagcuggagaacuccaugaaacaguuguuccugaaggcccagaagaucguucacaaacuguucucucugaguaagaggugccauaagcaaccacuuaucuccuuaccgcgccagcguacaucuacauauugguuaacacgcauucaaucauucuuauauuguaacgagaaugggcuccugggcaguuucuccgaagagacacacucaugcacaugcccaaaugaccaggugguguguacugcauuucugccuugcaccgucggugacgcaucggccugucugacaugugcuccggauaaccggaccaggugugggacuugcaacacaggcuacaugcugagccagggguuauguaagcccgaaguggcagagagcaccgaccauuauauugguuuugaaacugaucugcaggaucuggagaugaaguaucuguugcagaagaccgaccggaggauugaaguacacgcuauuuucaucucgaaugauaugaggcugaauucuugguucgaccccucuuggagaaagcguaugcuccugaccuugaaauccaauaaauacaaaucuucucucguccauaugauucugggccuuuccuuacagauuugucuaaccaaaaauagcacucucgagcccgucuuagccgucuacgugaauccuuuuggcggcagccacagcgagucuugguuuaugcccgugaaugagaauaguuuccccgacugggaaagaacgaaacuugaccucccccuccagugcuacaacuggacacucacccuugggaacaaguggaagacauucuucgagacagugcauauauaucugcgaaguagaaucaagagcaaugguccuaacggaaacgaguccauauacuacgagccacuggaauucaucgacccuagccggaaucucggguauaugaagaucaauaauauucaggucuucggauauuccaugcauuucgacccggaggcuaucagagaccuaauccugcagcuggauuauccuuacacucaagguagucaggacucugcccuguugcaacugcuggagauaagagaccgcguaaacaagcugucacccccaggacagcgccggcuggaccuguuuucuugcuugcuacgucaccguuugaagcucaguaccagugaagugguuaggauccagagcgcacugcaggcauuuaacgccaaacuuccgaacaccauggacuacgauaccaccaaguuauguagcuag

SEQ ID NO: 13286 - RNA, 459 nt, Artificial Sequence
  Description of Artificial Sequence: Synthetic coding sequence
auggcaagggacuaugaccaucuuuucaaacuccugauuauuggggauagcggcguggggaagucuucacugcuccugagguucgcugauaacacauucuccggaucguacaucacaacaaucggcguggacuucaagaucaggacuguagagauuaauggagaaaaggugaaauuacagauuugggauacugccggccaggagcgauuuaggacuaucacuaguaccuauuaucgaggaacacacggcgucauugugguauacgaugugaccucagcagaaagcuuugugaacgugaaaagaugguugcaugagauuaaccagaauugcgaugaugugugccggauuuuagauguacaguugcaccacggcgcaggcccaccaagcaaagaacgacagccagggaagaccgcugcagccacaacggaacgguguggggaggcccaugaagaacaguag

SEQ ID NO: 13287 - RNA, 696 nt, Artificial Sequence
  Description of Artificial Sequence: Synthetic coding sequence
auguuauauauaggcaucgccgaauacuuuuuuaaaucagccucauuugcccacuuuaccgcuggcguguucaaugugacccucuccacggaagaaauuucuaaucauuucguccagaauucucaaggauugggcaaugugcuuagcaggauagcugaaauauauauccucucccagccguuuauggucaggauuauggcuaccgagccaccuauuaucaaccugcagccuggaaacuuuacccuugacauuccugcuagcauuaugaugcuaacccaaccaaaaaauucaaccgucgaaacaauugucucaauggacuuuguugcaucuaccaguguagggcuggugauucuugggcagagacucguuugcucccucucgcucaaccgguuccgccuugcccucccggaaagcaaccgcucaaacauugaaguucuacgcuucgagaauauucuuagcucuauacuccacuuuggcgugcuucccuuagcaaaugcgaaacuccagcagggguucccuuuguccaauccacacaaguucuuguucgugaacagcgauaucgagguccuugagggauuucugcucaucagcaccgaccuuaaguacgaaacgucaucgaagcaacagcccucuuuucacguuugggaaggacugaaucugauuucccgccaguggcgcggcaaauccgccccuuag

SEQ ID NO: 13288 - RNA, 1911 nt, Artificial Sequence
  Description of Artificial Sequence: Synthetic coding sequence
augacuacauggucucuccgaaggagaccugcuagaacccugggguuauuacuacuaguggugcuagguuuuuuagugcugcgacggcuggacuggagcacccuggugccucugaggcugcgccacagacagcugggucuacaggcaaagggauggaauuuuaugcuggaggacucuacuuuuuggauauuugggggauccauucacuacuuuagggugccaagagaguacuggcgggaucggcugcuuaagaugaaggcuugcgggcugaacacccugacaaccuacgugccuuggaaucuacacgaaccagagcgcggcaaguuugacuuuucgggaaaccucgaccucgaagcguuugugcuuauggccgccgagauuggguugugggugaucuuaaggccugguccauacauaugcagcgagauggaucuagggggccugccgucauggcuguugcaggaccccgggaugcgucugcggacuaccuacaaaggcuucacugaggccguggacuuauauuuugaccaucugaugucucgcgucgucccccuacaguacaaaagaggugggccaaucaucgcggugcaaguugaaaaugaauacgggucuuacaacaaagaucccgcauacaugcccuauguaaagaaagcacucgaagaucgcggcaucguggaguuguuauugaccucugacaauaaagaugggcuguccaaaggaaucguccaaggagugcucgcgacgaucaaccugcagaguacgcacgaacuacagcuccuaaccacauuucuauucaacguacaggguacgcagccuaagauggugauggaguacuggaccgggugguucgacagcuggggagggccgcauaauaucuuagauaguucggaaguccuaaagaccgugagcgccaucguggacgccggcucgagcauaaaccucuauauguuucaugggggaacgaauuucgguuuuaugaacggggcaaugcauuuucaugacuacaaguccgaugucacuucauacgacuacgacgccguucucaccgaggccggggauuacacagcuaaguacaugaaacuccgugacuuuuucggcagcauuuccggcauuccacugcccccacccccagacuuacucccuaaaaugccuuacgagccuuugacaccuguccuguacuugucacugugggaugcccuuaaauaccugggagagccuauuaagucugagaaacccauuaacauggagaaucugcccgugaauggcggcaauggacagucuuucggguauauccucuacgaaaccuccauuacgucuuccggaauuuugaguggacauguccaugauaggggccagguguucguaaauaccguaaguaucggauuuuuagacuauaagaccaccaaaaucgccgucccccugauccaaggcuacaccgucuugcgaauccuaguugagaacagaggaagagucaacuacggcgagaacauugaugaccagcgcaaaggccucaucgggaacuuauacuugaacgacucaccacugaaaaauuuccggaucuacucauuggauaugaagaagaguuuuuuccaaagauucggacucgacaaauggucuucccuccccgagacaccuacguuaccagccuuuuuccuggguucacucucuauauccucaaccccgugcgauacauuuuugaaauuagagggcugggagaaaggagugguguucaucaacggacagaauuugggacgcuauuggaauaucggcccacagaagacgcuguauuuaccgggcccuuggcuuucauccggaauuaaucaagugaucgucuuugaggaaacaauggcugggccagccuugcaguucacggagacaccccaucuaggcaggaaccaguacauuaaguag

SEQ ID NO: 13289 - RNA, 1374 nt, Artificial Sequence
  Description of Artificial Sequence: Synthetic coding sequence
augggguguuccuugccccucagcuguaucaugguucguaguguggccugggcaggcuuuaugguucuucuuaugaucccuuggggaagugccgccaagcucguuugcuacuuuacaaauugggcacaguacagacagggagaggccagauuccugccaaaagaccuggauccaagccugugcacgcaccucauuuacgcauuugccggcaugacaaaccaccagcuaucuacaaccgaguggaaugaugagacacucuaucaggaguuuaauggucugaagaagauguuuaccgauauggucgcaaccgcuaacaacaggcagacauuugucaacagcgcaaucagguuucuuaggaaauauucauuugacggccucgaccucgacugggaauacccaggcagccaggggaguccugccguggacaaagaaagguucacuacucuggugcaagaccuggccaacgcuuuucagcaggaagcgcagacgucugggaaggagcgucugcugcugucugcagcuguuccagcggggcagaccuaugucgacgcuggcuacgaaguagauaaaauagcucaaaauuuggauuucgugaaccugauggcauacgauuuucacggguccugggagaaagucacaggacacaacagcccacucuauaagcgucaggaggagucuggcgccgcggcauccuugaauguggacgccgccgugcagcaguggcuucagaaaggcacccccgcuuccaagcucauucuaggcaugccaaccuacggucgcucauuuaccuuagcuagcucaagcgacacccgcguuggcgcacccgcaacugguucuggaacgccuggcccauuuacuaaggaagggggcauguuggccuauuacgagguguguaguuggaagggugcaaccaagcaaagaauacaggaccagaaaguucccuauauuuuuagagauaaucagugggucggcuuugaugauguugaguccuuuaaaaccaaggucaguuacuugaagcagaaaggccugggaggugcaauggugugggcucuggaccuggacgacuuugcuggcuuuagcugcaaccaaggucgauacccgcugauccagacacuacgccaagaauuaagccugccauaccuuccauccggcacgcccgaauuggaagugcccaagccugggcaaccauccgagccagaacacggacccagccccggccaggacacauuuugccagggcaaggcagaugggcuuuaccccaauccuagagagcgcucaucuuuuuacucuugcgcagccggcagacuguuccagcaguccuguccuaccggucucgucuucagcaauaguuguaaauguugcacuuggaauuag

SEQ ID NO: 13290 - RNA, 1125 nt, Artificial Sequence
  Description of Artificial Sequence: Synthetic coding sequence
auguacgugagcacccgugaaagauacaaguggcugcgguucagcgaggacugccuguaucugaacgucuacgcucccgcucgggcaccuggggacccccaacuuccagugaugguuugguuuccuggaggcgccuucaucgucggcgccgcuuccuccuacgaaggcuccgacuuggcugcucgcgagaagguggucuuaguguuccuacagcacagacugggaauauuugguuuccuccgauggcgggguagaacagacgacucucaugcaagggggaauuggggccuccuggaucagauggcagcucugcggugggugcaggagaauauugccgcauucgguggagacccaggaaacguuacuuuguucggacagucagcuggugccaugagcaucuccggcuugaugaugucuccacuugcgucuggucucuuucacagagcgauuagucaguccgggacugcucuuuucagauuguucaucacaaguaauccuuuaaaagucgcuaagaaagucgcccaccuggccgggugcaaccauaauucuacccagauccucgugaauugccuucgugcucugagugggacaaaagugaugagggugucuaauaagaugcgcuuccuccaacuaaauuuucagagagauccugaggagaucauauggucuaugaguccugugguugacgguguuguuauuccugacgacccauuagugcuuuugacccagggcaaagucuccucagugccguaucugcugggcgugaacaaucuggaguuuaacuggcuucugcccuacaucaugaaguucccccugaaccggcaggcgaugcgcaaagaaacaauaacuaaaaugcuauggucuacuagaacccugcugaacauuaccaaagaacaggugccuuuggucguggaagaauacuuggacaacgugaaugaacacgauuggaagaugcucaggaaucggaugauggauauugugcaagaugcgacauuugucuacgccacucuccagacugcacacuaccacagggaaacuccuaugauggguaucuguccggcgggacacgcuaccacaaggaugaagucuaccugcagcuggauccuuccucaagaaugggccuag

SEQ ID NO: 13291 - RNA, 384 nt, Artificial Sequence
  Description of Artificial Sequence: Synthetic coding sequence
augaagaccggacuguuuuuuuuaugccuucuuggcacugccgcagccauaccuacaaacgcccgccuguugucugaccauaguaagcccaccgccgagaccguagccccagauaacacugcuauuccaagccugcgcgcagaggcugaggagaacgagaaggagaccgcaguuucaaccgaagaugauucccaccacaaagccgaaaaaagcuccguucugaagagcaaagaagaaucgcaugaacaaagugccgagcaggggaagagcucaagccaggaguuaggauugaaggaucaagaggauucagacggccaucugagcguuaaccucgaguacgcaccuaccgagggaacacuugacauaaaagaggacaugaguuag

SEQ ID NO: 13292 - RNA, 285 nt, Artificial Sequence
  Description of Artificial Sequence: Synthetic coding sequence
augagaacccucgccauucuagccgcuauccuuuugguggcccuucaggcucaggcggagccccuacaggccagggccgacgaagucgcagcugcaccagagcagaucgcagcugacauuccugaagugguaguaucccuugcgugggacgaaucacuugccccuaaacacccagguaguagaaagaacauggcuuguuauugcagaauccccgcuugcauagccggagaaaggagauauggcaccuguauauaccaaggaagacucugggccuuuuguuguuag

SEQ ID NO: 13293 - RNA, 414 nt, Artificial Sequence
  Description of Artificial Sequence: Synthetic coding sequence
auggcugcgcucucaagagcucucggaccccuucggacgccugcuccuccccuguggaucggccucuuucuggucgcaaccggaucccagcagucucuagcacaaccacuccccggaaacacaaccgaagccaccccccgcucguuacgcgccuccggcucucugugcgguccacaugcgaaggcgccuuaccugugugaagccacacacgaacccgccgccgcccgaauucgagcacagguaccagauacucgcuggucucgcguggguggacaaagauuuuacucucgcguucucucucccuugcacaggggcccgaguggccacaccgaggccucagcccaacguagccacaugggaaagcuuaaggaaccucagccucaggaccacaagcccggauugggggccaguuag

SEQ ID NO: 13294 - RNA, 228 nt, Artificial Sequence
  Description of Artificial Sequence: Synthetic coding sequence
augcucaaggugcacuacccaaaauucggagugucagaggacugucuguaccuaaauaucuacgcgcccgcacaugcugauacaggcagcaaauuaccaguacucgugugguucccuggcggcgcuuucaagaccggcuccgcaucaauuuuugauggaucagcucuagcagcauaugaagaugugcuugugguuguggugcaguaucgacuugguauuuuuggguag

SEQ ID NO: 13295 - RNA, 1491 nt, Artificial Sequence
  Description of Artificial Sequence: Synthetic coding sequence
auggcacccgcuaggacaauggcuagagcacggcuggcccccgcagauugucugaauaguuuuaccgccggaguaccgggcuuugugcuggacacaaaugccagcgucucaaacggagccacuuuccucgaaucaccaaccguucgaagagguugggauugugugcgcgcauguuguacaacacagaacuguaauuuagcucugguggagcuccaaccugaucgaggugaggaugccauugccgccuguuuccuuaucaauugcuuguacgaacagaacuuugugugcaaguuugccccacgagaaggcuucaucaacuacuuaacuagagaggucuacagaucuuauagacagcugcgcacucagggauucgggggcucagggaucccuaaggcaugggccggaaucgaccugaagguccagccacaggaaccccugguuuuaaaagaugucgaaaacacugauuggcgccuauuaagaggggacaccgaugugcgaguggagcgaaaggacccgaaccagguagagcuguggggacuaaaagagggcacuuaccuuuuccagcugaccgucaccaguuccgaucauccagaggacacugcgaaugucaccgugacuguguuaucuacaaaacagacagaagauuauugccuggcaucaaauaaagugggacgcugccgcggcagcuuuccacggugguacuacgacccuaccgaacagauuugcaaaucauucguuuacggaggaugucuuggcaacaaaaauaacuauuugagagaagaagagugcauucuggcuugucgcggggugcaggguggaccccugcggggcucaagcggagcucaagccaccuuuccccagggcccguccauggagcggaggcauccuguuuguuccgggaccugccagccuacccaguuucgcuguuccaacggcugcuguauugauuccuuccuagaaugugacgacacuccuaacuguccggaugcuagcgacgaagcagccugugagaaauacacuucuggcuuugacgaacuccagcgaauccacuuccccuccgacaaaggccauuguguagaucugccggacacaggacugugcaaggagucuauuccgcgcugguacuauaauccuuuuagugaacauugugcaagauucaccuacgggggauguuacggcaacaagaauaacuucgaggaggagcagcagugccucgaauccugucgagguaucuccaagaaggacguuuucggauugcggcgagagauuccuauuccgaguacgggaucuguugaaauggcaguggcuguguucuugguaaucuguaucguggugguuguugccauccuuggauacuguuucuuuaaaaaucagcguaaggauuuucacgggcaccaucaucaccccccaccuacacccgcaucaagcaccguuuccacuaccgaggauacugagcaccugguguauaaucauacaacuaggccccucuag

SEQ ID NO: 13296 - RNA, 528 nt, Artificial Sequence
  Description of Artificial Sequence: Synthetic coding sequence
augccgccugguaccagagcaugcagggucccaaggccaggucgaagagcucccagaccucgccgcgacggcgagccaggcggccauggugucgcuccugcaagugcagaagaaguuggggcgagacccggauugcgcgcuguugcccgauugcuuccccaacagcaccugcaggcagguuacgugugugagagaaaagaucugcucgugaacggaugcugcaacguaaacgucccuucaaccaagcaguacuguugcgauggcuguuggccuaacgguuguugcucagccuaugaguauugugugaguugcugccuucaaccuaacaagcagcuccugcucgaacgcuuccuaaacagggccgcugucgcuuuucagaaccuguuuauggccguagaagaucauuuugaacucugccuugcaaaaugcaggacauccagucagucaguacagcacgaaaacaccuaucgugaccccauagcuaaguauugcuacggcgagagcccuccagaguuauucccugccuag

SEQ ID NO: 13297 - RNA, 1881 nt, Artificial Sequence
  Description of Artificial Sequence: Synthetic coding sequence
auggaccuaguucuuaagcggugccugcugcaccuggccgugaucggagcucuucuugcugugggcgcgacaaaagugccaagaaaccaggacugguugggaguaucucggcagcuuagaaccaaggcuuggaaccggcagcucuacccagaguggacagaagcgcaaagauuagacuguuggagagggggacaagucucgcugaaagucaguaaugauggcccuacauuaauuggcgcuaacgccuccuucucuaucgcacugaauuuuccagggucccaaaagguucugccagacgggcagguuauuuggguuaauaacacuauuaucaacggcgaccagguguggggcggucagccugucuauccacaggaaacggacgacgcuuguauuuucccagacggcggccccugcccuucuggcucuuggagucagaagcguagcuuugucuauguuuggaagaccuggggacaauacuggcaggugcuaggcggaccugugagcggccuguccaucggaaccggccgggccaugcuuggcacacauacaauggaaguuaccgucuaucaccggcgaggcucucggaguuaugugccccuagcgcacaguagcucagcguuuacuaucaccgaccaagugcccuuuuccguguccguuagccagcugcgggcccuggauggaggaaacaagcauuuccugaggaaucagccccugacuuucgcuuugcagcugcacgauccuaguggauaucucgccgaagccgaccuguccuacacaugggauuucggagauagcagcggaacacuaaucagcagggcccuggucgugacacacacuuaccuugaaccugggccugugacugcccagguggugcugcaagcagcaauuccccuuacuaguugcggcuccucuccagugccaggaacuacugauggccacagaccgacugccgaagccccuaauacuacugccggccaaguccccacaacugagguggucgggaccacacccggccaggccccuacugcugagccuuccggaaccaccagcguccaggucccuacgacagagguaaucucaaccgccccugugcagaugccaaccgcggaaucaacugcagcccaaguuacuacaaccgaauggguggagaccacugcucgugagcuucccauuccagagcccgaagguccggaugcuucuagcauaaugucaacggaaucaauuacagggucucuggguccacugcuugacggaacugcgacccuucggcuggugaagcgucaggugccacuggauugugucuuguacagauaugguaguuucagugugacauuggauauagugcaagggauagagucugcugagauccugcaagcagucccauccggcgaaggggacgcauuugagcucacgguguccugucaaggggggcugccaaaagaagccuguauggagaucucaucacccggaugccaaccaccagcacaacgucugugucagccugucuuaccaucccccgcaugccaacuuguguugcaccaaauccucaaggguggcagcggcacauacugcuugaacgugagccuggcagacaccaauucgcucgccgucgucagcacccagcugauuaugccugugccaggcaucuuguugaccggucaagaggccggacucggacagguuccucuuauugucgggauucuccucguacugauggcggugguguuggcuuccuugaucuaucgccgcagguuaaugaagcaagauuuuagcguaccacaacugccacacucuuccagccauuggcugcgccugccucgcaucuucuguuccuguccuauuggcgaaaacucuccacugcuuagcggccagcagguguag

SEQ ID NO: 13298 - RNA, 1611 nt, Artificial Sequence
  Description of Artificial Sequence: Synthetic coding sequence
augccaacccucugcucgagcuucggccugcagguccuuuuaccagaauaccuuagggaacgcuuuguugcugcugcucuuagcuauauuaccuguucgagcgagggcgagcuggugugcaaggagaaugacugcuggugcaaguguagucccaccuuuccugagugcaauugucccgaugcagauauucaggccauggaggauucacugcugcagauccaagauucuugggcuacucacaaccgccaguuugaagaaagcgaagaguuccaggcccuacugaagcgccugccagaugacagguuucuuaacaguacagcaauaucccaguucugggcuauggauaccucccuccaacacagguaccaacaacugggagcgggguugaaggugcuguucaaaaaaacacacagaauucuucggcgccuuuucaaccuguguaaaagaugccaucgacagccccgauuucgacugccgaaggagagcucaccaagaagcuuaucauacugguggaaucgcauccaaucccuacuguauuguggugagucgaccuucccuggcaccuuucuugagcagagucacagcuguacaugucccuaugaucaguccucgugccaaggccccauaccaugugcccugggagagggaccugccugugcgcauugcgcuccugauaauuccacucgcugugggagcugcaauccaggguaugugcuggcgcagggucuguguagaccagaaguugccgagucccuggaaaacuuccuaggauuagagacugaucugcaagaccuggaacugaaguaccuguuacaaaagcaggauagccggauugaaguacacuccaucuuuauuagcaacgauaugcgcuuaggcagcugguucgaucccuccuggagaaaaagaauguugcuuacccugaaaucaaauaaguacaaaccagguuuggugcacgugauguuagcucugucccuccagaucugcuugaccaaaaacaguacacucgaaccaguuauggcuaucuacgugaaccccuucggcgggucgcauucugaaaguugguucaugccugugaaugaggguagcuuccccgauugggaacgaacaaaugucgaugccgcugcacaaugucagaacuggacuauuacauuaggcaaccgauggaaaacauuuuuugagaccguccacgucuauuuacgaaguagaaucaaaagucuggacgauagcuccaaugaaacaaucuacuaugagccuuuggaaaugacugaucccaguaaaaaucucgguuauaugaagaucaauacucugcagguauuugguuauagccugccauucgacccugaugccauacgggaccucauuuugcaacucgauuacccauacacacagggcucccaagacagcgcccuuuugcaguugaucgaacuuagagaucgcgucaaccaguugucucccccuggcaaagugcgcuuggaccuuuuuucuugucuccuccggcaucgacuuaagcuggcuaauaaugagguaggacguauccagucuucccuacgcgccuuuaacagcaaauuacccaaucccguggaguacgagaccggcaagcuauguucuuag

SEQ ID NO: 13299 - RNA, 423 nt, Artificial Sequence
  Description of Artificial Sequence: Synthetic coding sequence
augucccagagcauagaaguccucaaucuuaggacccaacgagauuuccaguacgugcuuaagauggaaacccagaugaagggacuaaaagccaaguucagacagaucgaagacgaccgcaagacucucaugaccaaacauuuccaggagcugaaagagaagauggacgaacugcugccccuaauucccgugcuagagcaauauaagacugacgcgaaauuaauuacacaguucaaggaggaaauacggaaucuuuccgcggugcugaccgguauccaagaagagaucggggccuaugacuacgaggaauugcaccaaagaguacucucucucgaaacacgcuugcgagacugcaugaaaaaauugaucgaccugaagaaaagaaaggaggaagagaagcgacaacagaagggagaggcuuag

SEQ ID NO: 13300 - RNA, 1119 nt, Artificial Sequence
  Description of Artificial Sequence: Synthetic coding sequence
auggcuuauauugaacaacgcaggaucucgcacgaaggcucaccagugaagcccgucgccauccgggaguuucagaagaccgaggauaugcgccguuauuugcaucaaaauagagugcccgccgagccauccucccuucugagucugagcgcuucccauaaucagcucagccacaccgaccuggagcuccaccagcgacgggagcagcucguggagcgaacaagaagagaagcccagcuggccgcccugcaauaugaagaggaaaaaauucguaccaagcaaauccagcgugaugcaguccuggauuuuguaaagcagaaggcaagucagagcccgcagaagcagcacccucugcuggacggggucgauggcgagugucccuuuccaucucggcggagccaacacaccgacgacucugcgcuuugcaugucccucuccggccugaaccaagucggcugugccgccacccucccacauuccucagccuucacgcccuugaaaagugacgaucggccuaaugcucuguugagcucaccggcgacugagacugugcaucacuccccugcuuauaguuuucccgccgcuauucaacggaaucagccacaaaggcccgagucuuuuuuauuuagagcuggagugcgggccgaaaccaacaaggggcacgccaguccacugccuccuucagcugcuccaaccacugauuccaccgacaguauuacuggucagaacuccaggcaacgagaagaggaguuggaauuaauugaucagcuccggaaacauaucgaauaucgcuuaaaagucagccuccccugcgacuuaggcgccgcucugaccgacggaguaguucucugucaccucgccaaucauguccgcccucgcagcgucccuucaauucacgucccaagccccgccguuccaaagcucacuauggcaaaaugucgacguaauguagagaauuuccuugaggccuguaggaagauuggugugccacaagaacagcucugucugccccugcacauacucgaggaaaaaggacuuucgcagguagcugucacaguccaagcacuucuugaauuagcaccuccuaaacagcaacaacaucaacuaucugcaguguag

SEQ ID NO: 13301 - RNA, 1242 nt, Artificial Sequence
  Description of Artificial Sequence: Synthetic coding sequence
auggagaauauguugcuguggcuuauauuuuuuacgcccgguuggacccugauagacggaucugaaauggagugggacuuuauguggcaccugaggaaagugccuagaaucgucagcgaacgcacguuucaucugacaucuccggcuuuugaggcugaugcaaagaugaugguuaacacggucuguggaauagaaugccagaaggaauuacccacgcccucuuugucugagcuugaagacuaucuuucguaugagaccguuuucgaaaacggcacgcgaacccuuacgagggugaaaguccaagacuugguguuagaacccacacagaacaucacaaccaaggggguauccgugagaagaaaacgacaaguuuacgggacggauucucguuuuaguauacucgacaaaagguucuugacaaauuucccuuucucaacagccgugaagcuuucaacuggcugcagcgggauucugaucucuccccagcacgugcugaccgccgcccacugcgugcacgacgggaaagacuacgugaaaggaucuaagaaguuaaggguuggccuccugaagaugaggaacaaauccgguggaaagaagagacguggaucuaagcggagucggcgcgaagcaucagguggagaccagcgggaaggcacccgugagcacuuaagggagcgcgcuaaagguggacgccgacggaagaagagugguagagggcagaggauagccgagggacgcccgaguuuucaguggacaaggguuaaaaacacacacauacccaaggggugggccagggggggcaugggagacgcuacacuggacuaugacuaugcacuccuggagcucaagcgagcgcacaaaaagaaauacauggaacuuggcaucuccccaacaauuaaaaagaugccaggcgggaugauucacuucuccggauuugacaaugauagggcugaccagcucgucuaccgguuuugcagcguguccgacgagucuaaugaccugcucuaucaguacugcgacgcggaaucaggcucuacuggcagcgggguguaccugcggcugaaagacccugacaagaaaaauuggaaaaggaaaauuaucgccgucuacuccggucaccaguggguugauguacacggcguacaaaaggauuacaacguggccguccgaaucacaccucugaaguacgcccagauuugucucuggauucacggaaaugaugcaaacugugcauacggcuag

SEQ ID NO: 13302 - RNA, 2541 nt, Artificial Sequence
  Description of Artificial Sequence: Synthetic coding sequence
auguucaaaugcugguccgugguguugguacucgguuuuauuuuucucgaguccgagggcaggcccacaaaggaaggaggguaugggcucaaaaguuaccaaccccuuaugcggcugcgacauaaggagaaaaaccaagagaguagcagggugaaaggguuuaugauccaggaugggccuuucggcucuugcgaaaacaaauacuguggacucggaaggcauugugugacuagcagggagacaggucaggccgagugcgcaugcauggaccucuguaagcggcauuacaaaccaguguguggaagcgacggagaguuuuaugagaaccacugugaaguacacagggccgcuugucucaagaagcagaagaucacuaucgugcauaacgaggacugcuucuucaaaggugauaagugcaagaccacagaguacagcaagaugaaaaauaugcugcuggauuuacagaaccaaaaguauaucaugcaagagaaugaaaauccaaauggcgaugauauuagcagaaagaagcucuugguggaccagauguuuaaguauuucgacgccgacucgaauggccuuguggacauuaacgagcuuacacagguuauuaaacaggaagaacuggggaaagaucuguucgacugcacccuguacguacuucuuaaauacgaugauuucaacgcggacaaacaucucgcccuggaagaauuuuacagagccuuucaggugauccagcugagucugcccgaagaccagaaacugaguauaacagccgcgaccgugggccaguccgccgugcugucuugcgcgauccaggguacucugagacccccuauaaucuggaaaagaaauaacauuauucugaacaacuuagaucucgaggacaucaaugacuuuggggaugauggcucucuguauauaacaaaaguuacgacgacacacgugggaaauuacacaugcuaugccgauggcuacgaacagguguaucaaacacacauauuucagguuaacgucccgccagugauucgaguuuacccugagagucaggcccgggagccuggugucacugccucccuccgaugucacgcggaaggcaucccaaaaccucaguuaggaugguugaaaaaugggaucgauauaacuccgaagcugagcaaacagcuaacccuacaggccaauggaucggaagugcacauaaguaaugugagguacgaagauacaggcgcuuacacuuguaucgcuaaaaaugaggcagggguggaugaagauaucucuagccucuucguggaggacagcgcuagaaagacauuggcuaacaucuuauggagggaggagggacuuggcauugggaauauguuuuaugucuucuaugaggacggaaucaaagucauccagccaaucgaaugugaauuucagagacacaucaaacccagcgagaaacuccucgguuuucaggacgaagugugcccuaaagcggagggugacgaagugcagagguguguuugggccagcgcugugaaugucaaagacaaguuuaucuacguagcucaaccuacauuggaccguguacugaucguggaugugcagucucaaaaaguaguccaggccguguccacagacccggugcccgugaaauugcacuacgauaaaucucaugaccagguguggguccugucaugggggacuuuggaaaagaccaguccuacgcuccaggucaucacacucgccagcggaaauguaccucaucacaccauccauacacagccaguugguaaacaguucgaucgcguggacgauuuuuucauccccacaaccacuuuaaucaucacacauaugagguucggauucauccugcacaaggacgaagcugcgcuacaaaagauugaccuggaaacuauguccuacauuaaaacuauaaacuuaaaggacuauaagugcgugccacaaucacuggcauauacccaccuggggggcuacuauuuuauaggaugcaagccagauaguaccggcgcuguaucaccccagguuauggucgauggcgucaccgauucuguaauuggguuuaacuccgaugugacaggcacccccuacgucagcccugauggccacuaccucgugagcaucaaugacguuaaaggccuggugcgcgugcaguauauuacaauucgcggcgagauucaggaagcguucgauauuuacacaaaucuccauaucuccgaccuggcuuuccagccuuccuuuacugaggcacaccaguacaauauuuacggguccuccagcacccaaaccgacguccuauucguugaauugagcuccgguaaggugaagaugaucaaaucgcugaaggaaccgcuuaaagccgaagaguggccauggaaucguaagaauagacagauucaggacagcggguuauuuggucaguaccuuaugacgccuagcaaagacagucuuuucauucuagauggccgccuuaacaagcugaauugugaaaucacagaagucgaaaagggcaacaccgugauauggguuggggaugcuuag

SEQ ID NO: 13303 - RNA, 582 nt, Artificial Sequence
  Description of Artificial Sequence: Synthetic coding sequence
augcuggguguuuuggagcugcuauuacuuggagcugccuggcucgccgguccugcaagagggcagaaugaaacggaaccaauaguguuagaggggaaaugucucgugguaugcgauuccaauccaacaagcgacccuaccgguaccgcucuaggcauuagugugagaagugggagugcaaaggucgcuuucuccgcgauucgcuccacaaaccacgaaccuagcgagaugucuaaccggacgaugauuauuuacuuugaccaagugcuggugaacaucgggaauaacuucgauagugagaggucgaccuucauugcuccucgcaagggcauauacucauucaauuuccauguggugaaagucuacaacaggcaaacuauucaagucucccugaugcuaaacggcuggccugugaucagcgcuuucgcuggcgaccaggacguuacccgagaagcugcuucuaacggaguguugauacaaauggagaagggagauagggcuuauuugaaacucgaacgcggcaaccucauggggggguggaaguacucaacuuucagcggguuucuaguguucccccuguag

SEQ ID NO: 13304 - RNA, 813 nt, Artificial Sequence
  Description of Artificial Sequence: Synthetic coding sequence
augcacggcucauguucauucuuaaugcuucuacucccguuacuccuccuacuggucgccaccaccgguccaguaggggcucugacugaugaagaaaaacggcugaugguugaacugcauaaucucuaccgcgcacaagugucuccaaccgcuucagacaugcugcacaugagaugggacgaagaacuggccgccuucgcaaaggcauacgcaagacaaugcgucuggggacacaauaaagaacgaggcaggagaggcgagaaucuguuugccaucacugacgaaggcauggaugugccccuugccauggaagaauggcaccaugaaagagaacauuacaaucuguccgccgccacaugcagcccaggccagaugugcggucacuauacccaggugguuugggcaaagaccgaacguaucggcugugggucucauuucugcgaaaaacuacaagguguagaagagaccaauauugaauugcuuguauguaauuaugagccacccgggaacgugaaaggcaaaaggccauaccaagagggcacuccuugcagccaaugcccuucaggcuaccauugcaagaacagucucugugagccuauuggauccccagaagacgcccaagaccugccuuaccuuguuacugaagccccauccuuucgcgccacugaagccucugacucccguaagaugggagcggaggguccugacaagcccaguguggugucuggacucaauucagguccuggacacgugugggggccccuucucgguuuacuccuccuuccuccacuggugcuagcuggcauauucuag

SEQ ID NO: 13305 - RNA, 702 nt, Artificial Sequence
  Description of Artificial Sequence: Synthetic coding sequence
auggaucagguuuuuaugaucgacucaaaaugugagagcggcaaaggcagauguagcuucaaucccaaugucaacaccguuagcgugaugauuaaugaagagcuuuuuucugggauguauauugacuuuaugggaacggacgcagcuaucuucagaucgcucacgaaaagaaaugcugugcgcacagaccagcauaauagcaagugguuguccgaaccuauguucguggacgcccaugugauaccagauggcacagauccuaaugaugcuaaaguuuacuucuucuuuaaggagaaacugacagauaacaaccggucuaccaaacagauccacuccaugaucgcccguauuugcccuaacgauaccggagguuugaggucucuuguuaacaaguggaccacuuuccugaaagcucgauuagucugcuccgugaccgaugaagacggaccugagacgcauuuugacgagcuggaagauguuuuuuugcuagagaccgacaauccucgaacaacccuuguuuaugggaucuucacaaccucaagcucugucuucaagggauccgcugugugcguguaucaucuuuccgauauucagacuguguucaacggacccuuugcacacaaggaaggcccaaaccaccaguugauuucauaccaaggcagaaucccuuauccucggcccggcaccaacacguguguauag

SEQ ID NO: 13306 - RNA, 1368 nt, Artificial Sequence
  Description of Artificial Sequence: Synthetic coding sequence
augcuccauccugaaaccucccccggucggggccaucuccucgcuguucuguuagcucugcuggggacugcaugggccgaggucuggcccccacagcugcaagaacaagcaccgauggcaggcgcccucaaucggaaggaguccuuucuccuccucucuuugcauaacagacucagaaguugggugcagccuccagccgcagacaugagacgccucgacuggagcgacucacuggcgcagcuggcccaggcacgagcagcucuauguggcauccccacgccaagucucgccuccggccuauggagaacucuucaggugggauggaauaugcagcuacucccggcaggcuuggccagcuucgucgaggucgugagcuugugguucgcugaggggcagcgauacucgcaugcagccggggagugcgcgagaaacgccacauguacucacuauacgcagcuugucugggcaacaaguucacagcuagguuguggacgccaucugugcagcgccggccaagcagccauugaagccuucguuugugccuacuccccgcgggguaacugggaagugaacgggaagacuaucguccccuacaagaaaggagccugguguucucugugcaccgcaucaguuagcggcugcuuuaaggccugggaucaugcaggcggauuaugcgagguaccccggaaucccugucgcauguccugucagaaccacggcaggcugaacaucuccaccugccacugucacugcccacccggcuacaccgggagauauugucaaguaagaugcagccuacagugcgugcaugggcgguuuagggaagaggagugcagcugugucugcgauauuggauacggaggggcacaaugcgccacuaaaguccauuucccuuuucauaccugcgaccugagaaucgauggcgauugcuucaugguaaguagugaagccgacaccuacuaccgggcuagaaugaaaugucaacgcaaaggaggcgugcucgcacagauuaagagucagaaaguacaggacauucuggcuuucuaccuagggagauuggagacaaccaaugaagugaucgacucggacuuugagacaaggaacuuuuggaucggacugacuuauaagacugcgaaagacucguuccggugggcuacaggcgagcaccaagcauuuacaaguuuugcauuuggccagcccgacaaucacgggcucgucuggcuaagugccgcaaugggcuucggaaauugcguugagcugcaagccucagcagccuucaauuggaacaaucagagauguaagacaaggaacagauacauuugccaauuugcucaggaacauaucagccguuggggcccugggagcuag

SEQ ID NO: 13307 - RNA, 462 nt, Artificial Sequence
  Description of Artificial Sequence: Synthetic coding sequence
auggccagauucuggguaugugucgccggggccggcuuuuuucuggcuuuucugguccuccauucuagauucugcggaaguccagugcugagaaauuuuacuuuugcugucucauggcgcacagaaaaaauacuguacaggcucgacguugguuggccaaaacauccugaauacuuuaccggaacaacuuucugcgucgcgguggacucucuuaauggccugguguauauuggccaaaggggggauaacauaccaaaaauccucguauuuacagaagacggauacuuucuacgugccuggaacuauacggucgauacuccucacgggaucuucgcugcauccacauuguaugagcaguccgucuggauuacggauguggguucagacuucaugauacuguggcugcauggcgaaaaugggacaggccccgcaaaauucaauauuccccacagcgugacauag

SEQ ID NO: 13308 - RNA, 375 nt, Artificial Sequence
  Description of Artificial Sequence: Synthetic coding sequence
auguggcgaugcccccucgggcuuuugcuucuguugccucuggccggccacuuagcacuuggugcucagcaggggagaggucggagagaacuggcuccuggacuccaucugaggggaauacgagaugccggagggagauacugccaggaacaggaccugugcuguagaggaagggcugaugacugugcacugccuuaccuuggagcuaucugcuacugcgaucucuucuguaaccgcacugugucugacuguugccccgacuuuugggauuucugucuugguguuccacccccuuucccuccaauacaagcaccugcacggcgcaccggaagcggaagcgugacuaagaaucaugcaugguggauccagaccuag

SEQ ID NO: 13309 - RNA, 777 nt, Artificial Sequence
  Description of Artificial Sequence: Synthetic coding sequence
augaaaacguuguacuuggcugacacuuucccuacaaacuuucgagacuccgccggagcuaugaaacagaucaaugauuacguggccaagcagaccaaaggaaagauugucgaucuucucaagaaucuagauucuaacgcugucgucauuaugguaaauuacaucuucuuuaaagccaaaugggagacaucauucaaucauaaaggcacacaggagcaggacuuuuacguuacuucugaaacaguuguccgggugccaaugaugaguagggaggaccaauaucacuaucuccuagacaggaaucugucuugucgggucgugggcgucccuuaucagggcaacgcuacugccuuauuuauccugcccucagaaggcaagaugcagcagguggagaacgggcuaagcgaaaaaacacuacguaaauggcucaaaauguucaagaagcggcaguuggagcuguacuuacccaaguuuucuaucgaagguagcuaccagcucgaaaaagugcucccaucccucggcauuucaaauguguuuacaagccaugcagaucugucuggcauuuccaaucacuccaauauucaggucagcgagauggugcauaaagcgguaguagagguagaugagucaggaacucgugcugcagcggccaccggcacaauuuucacguuuaggagcgccaggcugaacucucaacggcuaguuuuuaauagaccuuuccuaauguucauaguagacaauaauauccuuuuccucggaaaggugaaccggccauag

SEQ ID NO: 13310 - RNA, 1731 nt, Artificial Sequence
  Description of Artificial Sequence: Synthetic coding sequence
augaucgucuucggaugggcuguguuccucgcuucaaggucccuuggccaaggucugcuauuaacccucgaagaacacauagcacacuuucugggcacaggaggagccgccacuacuaugggaaacuccuguaucugccgggaugauuccggaaccgaugacucugucgauacucagcagcaacaggcugaaaacagcgccguuccuacggcagacacuaggucgcagccuagggauccaguuagaccucccaggagaggucgagggccacacgaaccucggcggaagaagcaaaauguggacggccucguccuggacaccuuagcggugaucagaacacucgucgauaaugaccaggagccuccuuacaguaugauuacucuucaugaaauggcugagaccgacgaagguugguuggacgugguacagagucugauccgcgugauuccacuagaggauccacuaggaccagcaguaauaacacuccugcuggacgagugcccccucccaacuaaggaugcccuucaaaaauugacagaaauccugaaccuaaauggggaaguugcuugccaggacagcucacacccagccaagcacaggaauaccucugcuguacucgguugccuugcggagaaacuagccgguccggcauccaucggcuuauuaagcccugggauccuugaguaccucuuacaauguuugaagcuacaaucacaccccacagucaugcuguuugcccuaauagcccucgaaaaguuugcucagacuuccgagaauaaacugaccauuuccgagaguaguauuucugaccggcucguuacauuagaaaguugggccaacgacccugacuaucugaagaggcagguaggcuuuugcgcucaauggagucucgacaaucuguucuuaaaagaggggagacaacugacuuacgaaaagguaaaccucucaucgauucgagccaugcugaauuccaaugaugugagcgaguaucuuaagauuucaccacacggccucgaggcucgaugcgaugcauccuccuuugagagcgugaggugcaccuuuuguguggaugcaggcguaugguauuaugaaguuacgguggucacaagugggguuaugcagauagggugggcaacccgcgacagcaaguuucuuaaccacgaaggcuaugguauuggugaugacgaguauagcugugccuacgauggcugcagacaguugauaugguacaacgcccguuccaagccucauauccacccuugcuggaaagaaggggauacugugggauuccugcuugaccugaacgaaaaacagaugaucuuuuuccugaacggcaaccaauugcccccugagaaacagguauucucauccacaguaucuggcuuuuuugcugccgccaguuuuaugaguuaccaacagugcgaauucaacuuuggcgcuaaacccuucaaguacccaccuucuaugaaauuuuccacauucaaugauuaugcguuccugacugcugaggaaaagaucauccucccucgccaucgaagauuggcuuugcugaaacaaguaucuauuagagaaaacuguugcucucugugcugugaugagguugccgacacucaguugaaaccuugcggacauuccgacuugugcauggacugcgcccugcagcuggagaccuguccccuuugcagaaaggagaucgugagccggauucgacagauuucccauauuucuuag

SEQ ID NO: 13311 - RNA, 1359 nt, Artificial Sequence
  Description of Artificial Sequence: Synthetic coding sequence
auggcugauaugcacagaggauacgccgauucaccaagcaaggccggcgccgccccauauguacaagcauucgauagccugcuggcugguccuguugcagaguacuugaaaauaagcaaagaaaucggcggagacguccagaaacaugcagaaauggugcacacaggacucaagcuagaacgcgcacuccugguuacagcuucacagugccagcagccagcagagaacaaacugucugaucugcuggcaccaaucagcgaacagaucaaggaggugauaacuuuuagggaaaaaaacagaggaucgaaacuauuuaaccaucugagcgcagugagugagucaauacaagcccugggcuggguugcaauggccccaaagccuggucccuacgugaaggagaugaaugacgcagcuauguuuuacacaaacagggugcugaaggaauauaaggacgucgacaagaagcaugucgauuggguuaaagcguacuuauccauuuggacugaacuucaggcguacaucaaagaguuccauacaacaggcuuggcuuggaguaaaaccgguccgguugcuaaggaauugucaggacugccaucgggucccucagcaggguccugucccccuccuccuccuccguguccaccaccucccccuguguccacgaucucuugcaguuaugagagcgcaucacgaucuaguuuguuugcccagauuaaccagggagaaagcauuacccacgcucugaagcacguguccgacgauaugaaaacacauaagaaucccgcccucaaggcgcagagcggcccagugcgcagcggccccaagcccuuuagcgcuccuaaaccacaaacgucccccucucccaagcgagccaccaagaaggaacccgcgguguuggaauuggaaggaaagaaauggcggguggagaaccaggagaauguuaguaaucuggucauagaagacacugaacuuaaacagguggcauacauauauaagugcgugaauacuacauugcagaucaaagguaagauaaauagcauuacuguugauaacuguaagaaacugggucucgucuuugaugauguugugggcaucguagagaucauuaauagcaaagacguaaaggugcaagugaugggcaaagugcccacgaucucgauuaacaagacagacgguugccacgccuaucuuucgaagaacagcuuggacugugagauagucucagcaaaaucuucugagaugaacgugcucauucccacggagggaggggacuucaaugaauuccccgugccugagcaauuuaagacguuguggaacggccagaagcugguuaccacaguaacagagauugcaggcuag

SEQ ID NO: 13312 - RNA, 1533 nt, Artificial Sequence
  Description of Artificial Sequence: Synthetic coding sequence
augggcaggccuacucaguggccuucauuauugcuacugcugcuguugccaggaccgccaccgguugcgggacuggaagaugccgcauucccccaucugggagagagucuucagccucugccacgugcguguccauugcgauguaguuguccccgcguugacacuguagauugcgacggucucgacuuacgaguguucccagauaacaucacuagggcugcccaacaucuuucccugcagaauaaccagcugcaggaacuuccguacaaugaguuaagccgccugucaggccugcgaacccuuaacuugcacaacaaccugauuucuucagaaggucugccugacgaggccuucgagucacuuacacagcuucagcaucugugcgucgcacacaauaaacugucaguugcaccccaguuccuuccucggucccuccguguugccgaucuugcggccaaccaagugauggagauauucccgcugacauuuggcgagaagccagcucuccguucaguguacuugcauaauaaucaacucagcaaugcgggcuugccaccagacgcuuuucgaggcuccgaagcaaucgcuacucuuucauuaaguaacaaucaacuaucauaccugccaccaucucugccaccaucccuugagaggcugcauuuacagaauaacuuaauuagcaaggucccuaggggugcgcuuucucgccagacucaacugagggaacucuaccugcagcacaaucagcugaccgauaguggccuugacgcaaccacuuuuucuaaacugcacagccuggaguaucuugacuugagccacaaccagcugacaacgguuccagccggccugccucgcacccucgcuauacuccaucuuggccgaaaccguauucgacaaguggaagcagcuagacuccacggagcccgcggauugagauaucuccugcugcaacauaaccaguuggggaguaguggacugccagccggugcccucaggccacuucgcggccugcauacgcuucaccuguacggaaauggccuggauagagugccacccgcacucccuagacgccuucgugcccugguccugccucacaaucacguugcagcucugggagcaagggaucuuguggcgacuccuggccugacugagcuaaaucuugccuauaauagacuggccucugcaagaguccaucaccgugcuuuuagacgucugcgagcucuccgcagucuggacuuggccggcaaccagcuaacuagacuccccauggguuugccaacagggcugaggacauugcaguugcagagaaaccagcugagaaugcuggagcccgagccacuugcuggacucgaccaguugagggaacugagccucgcucauaaucgccugcgagucggcgauauuggaccagguacuuggcacgagcuccaggcacugcaagugagacaccgucucgucucccauacaguccccagggccccaccuucgcccugccugccaugccacgugccaaauauuuuagucaguugguag

SEQ ID NO: 13313 - RNA, 114 nt, Artificial Sequence
  Description of Artificial Sequence: Synthetic coding sequence
augaacuccacgcugaauuucuucauccaguccuacaauaaugcaagcaaugauacauaccuauaccgcguucaacgacuuaucagaucacaaaugcagcagguacacugcuag

SEQ ID NO: 13314 - RNA, 1266 nt, Artificial Sequence
  Description of Artificial Sequence: Synthetic coding sequence
augggcaggccaacucaguggccuucauuacuucugcugcuucuccucccuggcccccccccagucgccggauuagaggaugcagcuuucccucaucucggcgagagucugcagccccucccuagagcuugccccuuacgaugcagcugcccuagaguagauacaguggacugugauggccucgaccuucgcgucuuuccugacaacauuaccagggccgcccagcaccugucacuccagaacaaccaacuccaggaauuaccuuacaaugagcugucccgccugagcgggcuccgcacacuaaaucugcacaauaauuuaaucucuucagaggggcucccugacgaggcguucgaaagccugacacagcuccaacaccucugcguggcucacaacaaaaauaaucucaucucuaaagugccucggggggccuugucuaggcagacucagcugagggagcuguaccuucagcacaaucaacuuacggauagcggcuuagacgcaaccacauucaguaaacuucacagucuagaauaccuggauuugucccauaaccaauuaacuaccguccccgccggccugccacgcacucuggcuaucuugcaccuggggcgcaaucggauccggcagguagaggcggccaggcuacauggugccagaggccugagauacuugcuccuccagcacaaccagcugggguccagcggguuaccugcuggcgcucuacgaccucuuagaggccuccauacccugcauuuauacgggaauggucuggauagagucccccccgcacucccucgccgccugcgcgcccucguguuaccccauaaccacguggcugccuugggcgcaagagaccucguagcgacgcccggccuaaccgaguugaaucuagccuauaaucgucuggcuucagcacgugugcaucaucgcgccuuucggagacugcgagcccuuaggucucucgaccuggccggcaaucagcucacucgacugcccauggggcugccgacuggguuaaggacccugcagcuccagcgaaaccaacugcggaugcuagaaccagaaccacucgcuggucucgaccagcucagagaacucagucucgcacacaaccguuuacgugugggcgauauuggcccagggacuuggcacgaacugcaagcccugcaaguucgacacagacuggucucccacacugugcccagagcccccccuagccccuguuuacccugccacguaccuaauauucugguaaguugguag

SEQ ID NO: 13315 - RNA, 993 nt, Artificial Sequence
  Description of Artificial Sequence: Synthetic coding sequence
augaguuccuggucucggcagcgucccaaaucuccaggagggauacagccccacguuucucguacucuguuuuugcuuuuacuccuggcggcuagcgcaugggggguuacuuuaucaccuaaggacugucagguguuucgaagugaucauggaucaucuaucuccugccaaccacccgcagagauccccggcuaucuccccgccgacaccgugcaucuggccguagaauuuuucaaucucacacaccuaccugccaaucucuuacagggagcgucuaaauugcaggaauuacauuuaucuucaaacggcuuggagucccucucgccugaauuucugaggccaguaccacagcugcggguacuugaucugacccgcaaugccuugguucuuaaggagaaucaguuggaagugcuggaggugaguuggcugcacggccugaaagcccuagggcaccuagaucucaguggaaaccggcuccggaagcuaccccccggccugcuggcuaauuucacacuucugagaacccuggaucugggagaaaaucagcucgaaacccugccuccugacuuacugagaggaccucuucaacuggagcgccugcaccuggagggaaauaaacuccaaguccucggcaaagaucugcuccugccccagcccgaucugagauaccuguuccucaauggcaauaagcuggcacgcguggccgccggggcauuucagggacuuaggcagcuggacaugcuggaucucuccaacaacucgcucgcaucggugccagaagggcugugggcaucucugggccagccuaauugggauaugagggacggcuucgacaucuccggaaacccguggaucugugaucaaaaccugagugaucuguauagguggcuccaggcccagaaggacaaaauguucucccagaaugauacucguugugccggucccgaggcuguuaaaggacagacucugcucgccgucgccaagucccaguag

SEQ ID NO: 13316 - RNA, 1815 nt, Artificial Sequence
  Description of Artificial Sequence: Synthetic coding sequence
augaugagggcugugugggaggcccuugcugcccucgcugcugucgcuugucuuguuggugccguacggggaggucccggacucucgauguuugccgggcaggcugcucagccugacccuugcuccgacgaaaacggccauccccguagauguauccccgacuuugugaaugcagcguucgggaaggaugucagagucaguagcaccugcgggcgacccccugcacgauacugcguggugagcgagcggggagaagaacgccugcggaguugucauuuguguaaugccuccgaucccaagaaagcacauccaccugccuuccugacagaccucaacaacccacacaaccucacuuguuggcaaagugagaacuaccuucaauucccucauaaugugacacugacucugagccugggcaagaaguucgagguuacauauguuagucuucaguucuguucuccucggccggagagcauggccauuuacaaaucaauggacuacgguaggacauggguucccuuucaguuuuauuccacucagugccgcaaaauguauaauagaccacacagagccccuaucacaaagcagaaugaacaggaagccgucuguacagacucucauacagacaugaggccacugucaggcgggcucauagccuucuccacacuggaugguaggcccagugcccaugauuucgauaacagcccagugcuucaggauugggugaccgccaccgacauucguguugccuuuucccggcuucauacauuuggagaugagaacgaagacgauucagaacuugccagagauagcuauuucuacgcggugagcgauuuacaagugggggguagauguaagugcaacggccaugcagcccgguguguuagggaucgagacgauuccuuggugugugauuguaggcacaauaccgccggaccagaaugugacagauguaaacccuuccacuacgauagaccuuggcaacgggccacagcccgagaagcaaaugaguguguggcaugcaacuguaaccugcacgcccggagaugucguuuuaacauggaacuauacaagcugaguggccgaaaaucaggagggguguguuuaaacugcaggcacaacacggccggaagacacugucacuacuguaaagagggcuauuaccgcgauauggguaagccuaucacgcaucguaaggcauguaaggccugugauugccaucccgugggagcugcggggaagacaugcaaccaaacaaccggucagugcccuuguaaagauggagugaccggaauuaccuguaaucgaugcgcaaaaggguaccagcagucgcgcuccccaaucgcaccgugcauuaagauuccugucgcuccuccuaccacagcugcuagcuccguggaagagccggaagacugcgauucauauuguaaggcuagcaaggggaaacucaagaucaauaugaagaaguacuguaagaaggauuaugcuguacaaauccauauucugaaggcagacaaagccggggauugguggaaguuuaccgugaacaucauuagcguguacaagcagggaacgagcagaauacggcgcggugaccaaagccucuggaucaggaguagggauauugccugcaaguguccaaagaucaagccgcugaaaaaauacuugcugcucggcaaugcagaagacuccccugaccagucggguauuguggccgauaaaagcucacugguaauucaguggcgugacaccugggcccgccggcucaggaaauuucaacagcgcgagaagaaaggaaagugcaagaaggcauag

SEQ ID NO: 13317 - RNA, 948 nt, Artificial Sequence
  Description of Artificial Sequence: Synthetic coding sequence
augggccaggauagagaggaaacaaauauugaauuacuugucugcaauuacgagccccccgggaauguuaaaggaaaacguccauaucaagaaggcacuccauguagucaauguccuucugguuaccacugcaagaacucacuuugcgaaccgauuggcagucccgaagacgcucaggaccuaccuuaccuggugacugaggcaccuagcuuuagagcaacggaggcaucugauagccgcaaaaugggaacaccaucaucucuggccacaggcauaccugccuuucuggugaccgaagugucgggcucucuugccacaaaagcgcucccagcugucgaaacacaggccccgacgucucuggcaaccaaggacccaccuucuauggcuacagaagcacccccuugugugaccacagaggugcccagcauccucgccgcccauucccugcccucguuggacgaagagcccguuacguucccuaagucgacacaugugccuaucccgaaauccgcugacaagguaacagauaaaaccaagguuccaucucggagcccugagaacucacuagauccuaagaugagccuuaccggcgcacgggagcuguugccacacgcgcaggaggaagcugaagcggaggcggagcucccuccaagcagugaggugcucgcaucagucuuuccggcacaggauaagcccggcgaacugcaggcaacgcuagaucauacaggucacacuagcuccaagaguuuaccaaauuucccuaacacuucagcuaccgcaaacgcaacaggcggcagagcccuugcauuacaguccucacuuccuggggcagaagguccagauaaaccuagcgugguaagcggccugaacuccggaccuggacauguuuggggcccacugcucggucuacuccugcuccccccucugguguuggcugggauuuucuag

SEQ ID NO: 13318 - RNA, 207 nt, Artificial Sequence
  Description of Artificial Sequence: Synthetic coding sequence
augcaaguuucaaccgccgcccuggccgugcuucuuuguaccauggcccuguguaaucagguacucucagcuccccuugccgccgacacaccuaccgcuuguuguuucaguuacaccagucggcagaucccacagaacuucaucgccgacuacuucgaaaccuccucacaguguuccaagccuuccguuauggccgccccagguuag

SEQ ID NO: 13319 - RNA, 3369 nt, Artificial Sequence
  Description of Artificial Sequence: Synthetic coding sequence
augucccuacaggagauguuccgcuucccaaugggcuuguuacuuggcucuguauuacugguugccucagcaccugcaaccuuggagccgcccgguugcaguaacaaggaacagcaggugacuguuucccacaccuacaagauagaugugccaaaguccgcccuggugcagguggacgcagacccucagccccugucagacgacggcgcgucauugcuggcucugggcgaagcacgggaggaacagaacauuauuuuucgccacaacauaaggcugcagacuccacagaaggauugugaauuagccggcagcguccaggaucuucuugcuagggugaagaaauuggaagaagagaugguggagaugaaagagcagugcucagcccaaagaugcugucagggcgugacggaccugucccggcauugcuccggucacgguacauucucccucgagaccuguaguugccacugugaggaagggcgagaggguccggcaugcgaacggcuggccugucccggagccugcagcggucacgggagaugcguagauggucgcugucucugucacgaaccauacguaggcgcugacuguggauaucccgccugccccgagaauuguagcggacacggcgaguguguccgggggguaugucaaugucaugaagacuucauguccgaagacuguucagaaaagcggugccccggcgacuguuccgggcacggguuuugcgauaccggugaaugcuauugugaagaaggcuuuacaggacuggacugcgcgcagguugugacaccacagggccuccagcuguugaaaaacacggaagacagccugcuuguguccugggagcccucgucgcaggucgaccauuaucuguuaagcuacuauccccuaggcaaagaacuguccgguaaacagauccaggucccaaaagaacagcacuccuacgagauuuuaggccuccugccuggcacaaaauacauugucacucugagaaacgucaagaaugagguguccagcucuccucaacacuugcucgcgacgaccgaucucgcuguucucggaacugcaugggugacugaugagacagaaaauucucuggacgucgaaugggaaaaccccucgacugaagucgacuauuacaagcugagauacggcccuaugaccggccaggagguggccgaggugaccguacccaaauccagcgauccaaagucccgguaugauaucaccggacugcacccagggacugaguauaaaaucacagucgucccuaugcgcggcgaacuggaagguaaaccaauccucuuaaacggccgcacagagaucgauuccccuacaaauguagugaccgaccgcgugacggaggauacagcaacuguuuccugggacccagugcaagccgugauagacaaguauguugugcgcuacaccagcgcagacggagacacaaaggagauggcaguccacaaggacgaaucuuccacagugcugacaggcuugaagccuggcgaagcuuacaaaguguauguuugggcugagagaggcaaccaaggaaguaagaaggccgauacaaacgcccugaccgagaucgacagccccgcuaaccugguuacagauagagucacagagaauacugccacaauuuccugggaucccguccaggccaccaucgaucgguacguuguacgguacacuucggcgaaagauggcgaaaccagggaggugccagucgggaaagagcagaguucgacaguacugacuggccugcggccaggcguggaauauacaguucaugucugggcacagaagggugcccaagaguccaagaaggcugacacuaaggcccaaacagacauagauagcccucagaaucugguuacagacugggucacugagaacacagcgaccgugucaugggacccaguccaggccacuauugaucgauacgucgugcauuacacauccgcaaacggugaaacuagggaagugccgguggguaaggaacagagcaguacuguucuaacagggcuacggccaggcauggaauauacggugcaugugugggcccagaaaggcaaucaagagagcaaaaaagcugauaccaaggcucagacggagaucgacgggccuaagaaucucguaaccgauugggucacugaaaauauggccaccguguccugggaccccguucaggcaacuaucgacaaauauaugguacgcuacacuagcgcagauggggaaaccagggaggucccugugggaaaagaacauuccucaacugucuugaccgguuugcggccagggauggaguauauggugcacgucugggcucaaaaaggggcccaagagagcaagaaggcugacacuaaggcccagacugagcuggauccuccuaggaaucuccgaccuuccgcagugacccagagcgggggcauuuuaacuuggacgcccccguccgcucaaauccacggcuauauacuaacguaucaauuuccagauggaacugucaaagagaugcagcucgguagggaggaccagcgcuucgcucugcaaggacuggaacagggugcaacauacccagugucacuugucgcauuuaaggguggaagaaggaguagaaaugucucaaccacacugucaacagugggugcgcgcuuuccgcacccuuccgauuguagucaggugcagcagaacucuaacgccgccucaggguuauauaccauauaucuucacggugaugcauccaggccguuacaagucuacugcgauauggaaacugacggaggugguuggauugucuuucagagacgaaauacuggccagcucgacuucuucaagcguuggaggaguuauguggagggguucggcgaucccaugaaagaauuuuggcuuggacuugacaaacuccauaaucugaccacuggaaccccggccagauacgaggugagagucgaccugcagacagccaaugaaagugcuuacgccauauaugauuuuuuucaggucgccagcucuaaagagagauacaaguugaccguaggaaaauauagaggcacugccggcgacgccuuaacauaccauaauggguggaaguuuacaacuuucgaccgcgauaacgacauagcccuuucaaauugcgcacugacucaucauggaggguggugguacaaaaacugccaccucgcgaacccaaacgggcgcuacggagaaacaaagcauucugagggagugaauugggaacccuggaagggccacgaguucucaaucccuuauguagagcugaagauaaggccacacggguacucucgagagcccguccuuggaaggaagaaacgaacacuacgcggaagacugaggacauucuag

SEQ ID NO: 13320 - RNA, 897 nt, Artificial Sequence
  Description of Artificial Sequence: Synthetic coding sequence
augcuucacccagagacaagcccgggcaggggucacuuacuagcugugcuccuugcccugcugggaaccgcaugggcugaaguguggcccccucagcuacaggaacaggccccaauggccggagcucuaaaccgaaaggaaagcuuuuuguugcuuagccuccacaacagauugagauccuggguucagccaccagcugccgauaugagaaggcuggacugguccgacucccugaauuggcuuaaaccugggccccuauggaacccaaacccugagcccggcgucagaccugucgcgcauccagcuagcggacuggagcaugcggccugcccacgggcuuggcgcccucugcugaaguggucuuugugguucgccgagggucagagauauucccacgcugccggcgagugugcaagaaacgccacauguacacauuacacgcaacucgugugggccacaagcucacaguuagguugcggccggcauuugugcuccgcaggccaagcugcuauugaagcauuugucugugcuuauucaccucgggggaacugggaggucaaugggaagacgaucguucccuauaagaagggugccugguguagccuuugcacugcgucugucagcggaugcuuuaaggcuugggaccaugcaggcggucuaugugaagucccucguaacccaugccgcaugaguugccagaaucauggccgucuuaauaucuccacuugucacugucauuguccgccuggguacaccggaagguacugucaaguucgaugcagucugcaaugcguccauggacgauuucgggaggaagaguguucaugugugugugacauuggcuacgaaccuucugucccaccucgcugcauauuccccagcaccccaguaaccuag

SEQ ID NO: 13321 - RNA, 1728 nt, Artificial Sequence
  Description of Artificial Sequence: Synthetic coding sequence
auggaccugguccuuaaaagaugccugcuucaccucgcagucauuggagcucuucuggccguaggugcgacuaaaggaagccaaguuuggggcggccaaccagucuauccccaagagacugacgacgccuguauuuuuccagauggcgggccgugcccguccggcaguuggucucagaaacgguccuucgucuacguauggaaaacauggggccaguauuggcaggugcucggcggaccgguguccgggcugagcaucggcacgggccgugccaugcuuggaacccacacaauggaggucacgguuuaucacagaagagguucgcggucuuacgucccauuggcucauaguagcagugccuuuacuaucacggaccaaguccccuuuucaguguccguuagucagcuuagggcucuggaugguggcaauaagcauuuucuccggaaucagcccuuaaccuucgcauugcaguugcacgauccgucaggcuacuuagccgaggcagaccuuuccuauaccugggacuucggugacucgucgggcacccucaucagccgcgcucugguugucacacauaccuaucuggaaccuggacccguaacugcacagguugugcugcaggccgccauuccuuugacuagcuguggcucuagcccugucccagggaccaccgacggacacagacccacugcugaagcuccaaacacgaccgccggccagguaccuaccaccgaggucgucggaacuacacccggucaagccccaacagcagagccuucuggcaccaccagcguccaggugccuacuacugaggugaucuccaccgcaccgguucagaugccgacugcagagucuacugguaugacacccgagaaagugccaguuucugaggucaugggcacaacauuagcagagaugucaaccccagaagcgaccggcaugacgcccgcugaaguuaguauugucguucugucagggacuacagcagcccagguuacaacaacugaguggguagaaaccacagcacgugagcucccaauccccgagccagagggccccgacgccucuucaaucauguccaccgaaaguaucacugggucccucgggcccuugcuggacggcaccgccacccucagacugguuaagcgccaagugccccuagacugugugcuuuauagguacggaagcuuuagugucaccuuggauauugugcagggcauugagagcgccgagauucugcaggccguacccagcggggagggcgaugcauuugaacugaccgugucuugccaaggggggcugcccaaagaagcuugcauggagauuagcucacccgguugccagccgccagcucaacgccugugccaaccggucuuaccuucucccgccugucagcuggucuugcaccaaauuuuaaagggagggagcgggacauacugccucaaugugagucucgccgauacgaacucccuggcaguggucuccacacaacucaucaugcccggccaagaggcaggauuaggccaagugccuuugauugucggaauuuuguugguccucauggcaguggugcuugccagccucauauacagacgaaggcugaugaaacaggauuuuagcgugccccaacugccacacuccaguucgcauugguugagacugccacggauauucugcucaugcccaaucggggagaacaguccccugcugaguggccaacagguguag

SEQ ID NO: 13322 - RNA, 330 nt, Artificial Sequence
  Description of Artificial Sequence: Synthetic coding sequence
ugaaguggacagucucucaaaucucugaaugcuuccagugggcaccuggcucugauuuuaucaucuauuuucggacugcuccugcucguguuguuuauccuguuccuuacuuggugucguguacagaaacagaagcaucugccccuccgcgucaguacacggagacggggaagcuuggaggagaaccuguuucaugagauggagacaugccuuaaacgcgaggauccccauggcacccggacaucugacgauaccccuaaucacgguugcgaagacgcuucugacacuagccuacuuggagugcucccugcuucugaggcaacaaaguag

SEQ ID NO: 13323 - RNA, 312 nt, Artificial Sequence
  Description of Artificial Sequence: Synthetic coding sequence
augucaggaaggggcaaaggagggaaaggccugggaaaaggcggagcuaaacgacacagaaaagugcuucgggacaacauucagggcaucacgaagccugcuauccggagacuugcuagaagaggcggagugaaaagaaucuccggccuuauuuacgaagagacaagaggggugcugaaaguuuuucuggagaacgugauucgcgacgcagugacguacacugagcacgcaaaacguaaaaccgugacggccauggacgugguuuacgcuuuaaaaagacaggguaggacacucuacgguuucggugguuag

SEQ ID NO: 13324 - RNA, 2889 nt, Artificial Sequence
  Description of Artificial Sequence: Synthetic coding sequence
augcucaggcgaccggcaccagcucuagcuccagccgcuagauugcugcuugcggggcugcugugcggaggcggugucugggcugccaggguaaacaagcauaagccauggcucgagccgacuuaucaugggaucgugaccgaaaacgauaauacagugcuccuggaucccccgcugaucgcacuggacaaggacgccccccugcguuucgcagaauccuucgaggucacgguuacaaaggagggagagaucugugguuuuaaaauccacggccagaaugucccauuugacgcaguaguagucgacaagucuaccggagagggcgugauccggucaaaggaaaaacuagacugcgaguuacaaaaagauuacucuuucacaauacaggcauacgacugugggaaaggcccagacggaacuaacgugaaaaagucucauaaagcaacagugcacauacaggugaacgacguuaaugaguaugccccgguauucaaggagaaaucuuacaaggccacuguuaucgagggaaagcaguaugacuccauccugagaguugaggccguugacgcugacugcagcccucaguucucucagaucugcagcuacgagaucauuacaccugaugugccguuuaccguggauaaagacggauacaucaagaacaccgagaagcucaauuaugggaaggagcaccaauacaaacucaccgucacagcauaugauuguggcaaaaaacgagccaccgaggauguguuggugaagauuucuaucaaaccuacuugcaccccaggauggcaaggauggaauaacaggauugaguacgagccaggcaccggcgcucuugccguguuucccaauauccacuuagaaaccugcgacgagcccguagcauccgugcaggcgaccguggaauuggagaccucccacauuggaaagggcugcgaccgggauaccuauagugaaaaaagccuucacagacuuuguggcgcugccgccggcacugccgagcucuugccuucccccagugguucccugaauuggacaaugggccugcccacggauaauggacacgauucggaucagguguucgaguuuaacggcacccaggcaguaagaauccccgauggaguagucaguguuuccccaaaagaaccuuucacaauuuccguuuggaugcgucacgggccguucgggcgcaaaaaagaaacgauucugugcucaucugacaagaccgauaugaaucggcaucacuauuccuuguacguccacgguugcaggcuuaucuucuuguuccggcaggauccuagugaagaaaagaaauauagaccugcugaguuccacuggaaauuaaaccaggucugugaugaggaauggcaccacuacguucuaaacguugaguuucccagcguuacauuguaugucgacggcaccucacacgagcccuuuuccgugacagaagacuacccccugcauccgucaaagaucgaaacucaguuggucguuggggcauguuggcagggcggggaccugcacaugacucaauuuuucagagggaacuuagcggggcugacccucagauccggaaagcuggcugauaagaaggucaucgacuguuuguauacuugcaaggagggucuagauuugcagguccuagaggacaguggacgugggguacagauucaagcucaccccucccaacucgugcugacauuggagggcgaagaucucggggaauuggacaaggcuaugcagcacauuucguauuugaacucccgccaauucccaaccccggguauucgucgcuugaagaucaccaguaccauuaagugcuucaaugaagccaccuguauaagcgugcccccagucgacggauacguuauggugcuucaaccugaggaaccuaagauuucuuugucuggcgugcaccacuucgcuagagcugcaucggaguuugagucaagcgaaggaguguuccuguuucccgaacugagaaucaucucgaccauuacucgggagguggagccugaaggagacggagccgaggacccaaccguccaggaaucccugguuucugaagagauaguacaugaccuagacacaugugaggugacugucgaaggugaagaacugaaucacgagcaagagagccucgaaguggacauggcgcgacuccagcaaaagggaaucgaaguaaguuccucugaacuggggaugacuuuuaccggaguggauacgauggcaaguuacgaagaggugcuccaccugcuacgguaucgaaauuggcacgcccgcagccuccucgacagaaaauucaaguugauauguucugagcugaacggaagauacaucagcaaugaguuuaaaguggaagugaacgugauucauaccgccaauccuauggagcacgcuaaucacauggcugcucaaccccaguuugugcaccccgaacaccgcucuuucguggaucugucaggacauaacuuggccaacccucaucccuucgccgugguucccagcacugccaccguggugaucguuguuugcguguccuuucugguauucaugauuauccugggcguguuccguauccgcgccgcacacaggaggacaaugcgcgaucaagauacggguaaagagaaugaaauggacugggacgauagcgcuuuaaccauuacagucaaucccauggagacauacgaagaucagcacagcagcgaggaagaagaggaggaggaggaggaagaagaauccgaagacggagaggaggaggaugacaucacaagugccgaaagugaaagcuccgaagaagaggaaggcgagcagggcgauccccagaacgccaccaggcagcagcaacucgaaugggacgauucuacacucucauauuag

SEQ ID NO: 13325 - RNA, 912 nt, Artificial Sequence
  Description of Artificial Sequence: Synthetic coding sequence
augcugcacccugaaaccaguccuggccguggccaccuccucgccgucuugcuugcacuacucgggaccgcuugggcugagguuuggcccccccagcugcaggagcaggcgcccauggcgggugcgcucaaucgcaaggagucuuuccugcugcugucucuccauaaucgucugagaagcugggugcaaccccccgcugccgacaugagaagguuggacuggagcgauucccuggcacagcuugcucaggcacgcgcagccuuaugcggaacccccacgccaagcuuggccaguggacuguggcggacacuucagguuggguggaauaugcagcugcugccugcaggcuugguuucauucguggaagucguaucacugugguuugccgagggacaacgguacucccacgccgcaggggaaugcgcucgaaacgccacaugcacacauuacacccagcuggugugggccacauccucccaacuggguugcggcaggcacuuaugcuccgcuggccaggcagccauagaagccuuugugugcgcuuacucuccccggggcaauugggaagucaauggcaagacgaucgugcccuacaagaagggagcguggugcagucugugcaccgcaucugugucgggaugcuuuaaagcaugggaccaugccggggggcugugugagguacccaggaauccgugccggaugucuugccagaaucacggacgucugaauauaagcaccugccacugucacuguccucccggcuacacaggcagauauugccaggugagaugcucguuacaauguguucacgguagguuucgcgaagaggaaugcucaugcgugugugauauaggcuauggagaaccaagcguaccuccuagauguaucuuccccagcacuccugugaccuag

SEQ ID NO: 13326 - RNA, 1356 nt, Artificial Sequence
  Description of Artificial Sequence: Synthetic coding sequence
auggaagcaacgggaaccgacgagguggacaaacuaaagacaaaguuuauuuccgcguggaauaauaugaaauauuccuggguccucaaaaccaagaccuacuucaguaggaacagcccgguucuguuacuaggcaaaugcuaccauuucaaguaugaagaugaagacaagacacuaccugccgaguccggaugcacaauugaagaucaugucauugcgggcaacguggaagaguucagaaaagauuuuauaucacguaucuggcucacguacagggaggaguuuccacaaauugaaggaagugcacuuacgacugacugcggguggggaugcacgcugcgcaccggacagaugcucuuggcacagggcuuaauccuccacuuuuugggacgcgccuggacauggccugaugcccuuaacauugaaaauucagacucggaaucuuggaccucacacacagugaagaaguuuaccgccucauucgaagcaucuuuauccggcgagcgugaguuuaagacaccuacuaucagcuugaaagagaccaucgggaaguacagugaugaucacgaaaugagaaacgagguguaucaccgaaaaauuauuucuugguucggagauaguccucuggcccuauucggguugcaccagcugauagaauauggaaagaagagcggaaaaaaggcaggcgauugguauggcccugcgguggucgcucacauccugagaaaggcuguggaagaggcucgucauccagaucuccagggcaucacaauuuacguggcucaggauugcaccguguauaacagcgacgugauugacaaacaauccgcuuccaugacaagcgacaacgccgaugacaaagcugugaucauucugguccccgugcgacuggggggcgagaggacaaauaccgauuaccucgaguucgugaaagguauacucucacuugaauauugcguuggaauuaucggggggaaaccuaagcagucuuacuacuuugcgggguuccaggaugauagucuaauuuacauggauccacauuacugucagaguuucgucgaugugagcauaaaggauuuuccucuggagacauuucacugcccuagcccuaagaaaauguccuuuagaaaaauggacccaaguugcaccauuggguuuuacuguagaaacgugcaggauuucaaaagagcaucagaagagauuacuaaaaugcucaaguucaguucuaaagaaaaauauccgcuguucaccuucgucaacgggcacucacgggacuacgacuucacaaguacaacuaccaacgaggaagacuuauuuuccgaagacgaaaaaaagcagaaaaaaaaaaaaaaauag

SEQ ID NO: 13327 - RNA, 1557 nt, Artificial Sequence
  Description of Artificial Sequence: Synthetic coding sequence
augaggacuugggacuacagauggagccuggccuugguggcucaaaccgguguccacugcuguaacuugucgucucugcaaccccuuccaccuagguucaaaagguuuucaugucugucccuuucauccgggugggacuacaguaacucagguaauaugaagccaccuuuguugguuuuuaucgugugcuugcucugguugaaggacucgcacugcgcuccuacguggaaagacaagaccgccaucuccgagaaccuaaagagcuucagcgaggugggcgagauugaugcugaugaggagguuaaaaaggcccucaccgguauaaaacagaugaagauaaugauggagcgaaaagagaaagaacacaccaaccucaugagcacucugaagaagugccgcgaggaaaaacaggaggcccuuaagcugcugaacgaaguccaggaacaucuugaggaggaggaaagacugugccgggaaucccucgcggacucuuggggcgagugcaggucaugccuagaaaauaauugcaugcggauuuacaccaccugccaaccauccuggucauccgucaaaaacaagauugaaagauucuuucgcaagauuuaccaguuuuuguucccauuucacgaggacaaugagaaggauuuacccauaucagagaagcugaucgaagaagaugcccaguuaacucagauggaagacguguucucacaacugacugucgacgugaacagccuguucaauagaaguuuuaauguguuccgccagaugcagcaggaauucgaccagacauuucaaucucacuucauuucugacacagaucucacggaaccuuacuucuuucccgcguucuccaaggaaccgaugaccaaggcugaucucgaacaguguugggauauuccaaacuuuuuccagcuguuuuguaacuuuucagugaguauuuaugagucagucucagagacuauuacuaaaaugcuuaaggccauagaagaucugcccaaacaggacaaagccccggaccauggaggacucaucucaaagaugcuucccggacaggauagaggacugugcggugaacucgaucagaaccugucaagauguuuuaaguuucaugagaaaugccagaagugucaggcccaccucagcgaagauugccccgacguucccgcacuccacaccgagcucgaugaggcuauuagacugguuaacgucucaaaucagcaguacggacagauccugcagaugacaaggaagcaccuagaagauaccgcguaucucguagaaaagaugagagggcaguucgguugggucuccgaacuggcgaaccaggcccccgaaaccgagauuaucuuuaacuccauucaaguggugccacgcauccacgaagggaacaucucuaagcaagaugagaccaugaugacagaccugucuaucuugccaucaucuaacuucacucugaaaauaccucucgaagagucugccgaaagcagcaauuuuaucggcuacgugguugcuaaagcucuccaacacuuuaaggagcauuucaaaacaugguag

SEQ ID NO: 13328 - RNA, 1716 nt, Artificial Sequence
  Description of Artificial Sequence: Synthetic coding sequence
guugaaaugagaaaauggagcucagaaccuggcccggaacccgauacuguggaagccguuaucgaguauauguacacagggcggaucaggguuaguacggguaguguccacgagguccuggaauuggccgaucgauuucugcuuauaagacugaaagaauuuugcggagaauuucucaaaaaaaagcugcaucucagcaauuguguggcaauccacaguuuggcucacauguauacucugagucagcuugcccugaaggcagcggacaugaucaggcggaauuuccacaaagugauucaagaugaggaguucuacacucuuccuuuccauuugauacgggacuggcugagugaccuggaaaucacuguggacucugaagagguucucuuugaaacugugcugaagugggugcaacgaaacgccgaggaaagagaacgguacuucgaggaacuuuuuaagcugcugagguuaagucaaaugaagccuaccuaccugacacggcauguuaaaccggaacgguugguagcaaauaacgaagucugcgugaaauuaguagcugacgccguagaaaggcaugcacugagggccgaaaacauucagagcgguaccugucagcacccaaccagccauguuagcuuacugccuagguacggucagaacauggaugugauaaugguuauaggcggcguuucugaggggggggauuaccuuucugaaugcgugggguacuuugucgaugaggauaggugggugaaucuuccucacauacacaaccaucuggacgggcacgccguggcagugacggaaaguuacguuuaugucgccggaagcauggaaccaggauucgcaaagaccguugagagguacaaucccaaucugaauaccugggagcacguuuguucccugaugacgcggaagcauucuuuuggacugacagaggugaaaggaaagcuguauagcaucggcggccaugguaacuucucuccaggcuuuaaggauguuaccgucuauaaccccgaacuugacaaguggcacaaccuggagagcgcccccaagauccugcgugacgucaaagcacuagcaauugaagaccgcuucgucuacauugcugcccggacacccguagaccgugacacggaggacgguuugaaggccgugauuacaugcuacgacacugaaacgcgucaguggcaagauguugagucucuaccccucaucgacaauuacugcuucuuucagaugucagucgucaauagcaauuuuuaucaaacagcuagcugcuguccaaagucguacugccuagagaacgaagaggcggugagaaaaauagcaucccagguguccgaugagauccuugagagucugccuccggaggugcuuaguauugagggggcugccauuuguuacuauaaagaugauguuuuuauaauuggcggauggaagaacagugacgauauugacaagcaguauagaaaggaggcuuaccgcuacugugcugagcgcaaaagauggauguuguugccaccgaugccacaaccgagauguagggcuacagccugucacgugcgcauuccguauagguauuuacauggcacccagcgguacccuaugccccaaaaucugauguggcagaaggacagaaucagacagaugcaggaaauucaucgccacgcuuugaauaugcggagaguuccaagcucgcagaucgagugcuag

SEQ ID NO: 13329 - RNA, 729 nt, Artificial Sequence
  Description of Artificial Sequence: Synthetic coding sequence
auguugaaaaagauaucaguggggguggccggcgaucugaauacagucacuaugaaacuugguugugugcucauggcgugggcacuguaucugagcuuagggguucucuggguagcccagaugcuuuuagccgcaggcugucacgccgaacuuuuuccggcaccuauucugagagcaguaccuagcgcugagccacaggccggaagcccuaugacucucaguugccagacaaaacuaccccuacagagauccgccgcgagacugcuguuuucuuuuuauaaagacggccggauaguucaaucccgaggacugaguucugaguuccaaauccccaccgccuccgaggaucacucaggcucuuauuggugugaggccgccacggaagauaaucaaguguggaagcaaucuccccaguuggagauccggguccagggugcaucuuccagcgccgcgccucccacucucaauccagccccacagaaguccgccgcccccgguacagcucccgaggaagcgccaggcccgcugcccccaccuccgacacccuccucagaagaucccggauuuagcaguccgcucggaaugccagacccacaccucuaccaucagauggggcugcugcuuaaacacaugcaggacguucgcguucuucuaggucaccuguugauggaacucagagaacuuagcgggcaccgcaagccaggcacgaccaaggcuaccgcagaguag

SEQ ID NO: 13330 - RNA, 1392 nt, Artificial Sequence
  Description of Artificial Sequence: Synthetic coding sequence
auguacgugaguacucgcgagcgauacaaauggcugagguucucagaagacugccuuuaucuaaacguuuaugccccagcucgggcccccggcgacccucaacuacccguaauggucugguuucccggaggugccuucaucgugggcgcugcaucuuccuacgaaggaucagaccuggccgcccgggaaaaagugguucuggucuuucuucagcacagguuggguaucuucggauuccuguccacugaugauagucacgcucgcggcaacuggggccuucuggaccaaauggcugcccugagaugggugcaggagaacauugcagcguucggcggugauccugggaacgugacccuuuuuggccagagcgcuggagccaugucgauuuccggccuaaugaugucaccacuugccagcggccucuuucaccgagccaucucucaauccggcacagcucuguuucggcuguuuaucacaucaaacccacugaaaguggcgaagaaagucgcacaccuagcaggcuguaaucacaacuccacucaaauccugguaaacugccuacgagcuuugucagggacaaaagucaugagggucagcaauaagaugcgcuuccuccagcuuaauuuucaaagggacccagaggagaucaucuggucuaugagcccaguaguugacggcguugucaucccugacgacccccugguuuugcuuacacagggcaaggugucuucagugcccuaccuccucggagugaauaaucuggaguuuaauuggcugcugcccuacaucaugaaauucccucucaaccgccaggccaugagaaaagaaacaaucaccaagaugcuguggagcacuaggacccugcuuaauaucacaaaggaacaggugccacuuguugucgaagaguaccucgauaauguuaacgagcacgauuggaagaugcugagaaaccgaaugauggacauugugcaggaugcuaccuuuguauacgcgacacuacagacagcccacuaucacagggacgcagggcuuccggucuacuuguacgaauucgaacaucacgcccgggggaucaucgugaaaccucgaacugacggcgcagaucacggagaugagauguacuuccuauuuggaggaccuuucgcuaccggacucucuaugggaaaggaaaaggcgcugucucugcagaugaugaaguauugggccaacuucgcuagaacaggcaacccaaacgaugguaaucucccaugcuggccgcgguacaacaaggacgagaaguaccugcaauuggacuucacaacgagggugggaaugaagcugaaggagaaaaaaauggcuuucuggaugucucuuuaccagucccagagacccgagaagcaacgccaguucuag

SEQ ID NO: 13331 - RNA, 1215 nt, Artificial Sequence
  Description of Artificial Sequence: Synthetic coding sequence
auguucuaucacgccuacgauucauaucuggagaacgcguuucccuuugacgaacugagaccucugaccugcgacgggcacgacacuuggggcagcuucagccuuacucugauugacgcacuggacacccuucucauucucgguaacgugucagaauuccagagaguagucgagguguugcaagauagcguugacuucgauauugacguaaacgcaaguguuuuugaaaccaauauacguguggucgguggucuccucucagcccaucuacucagcaaaaaagcugguguugaaguugaagcaggcuggccauguuccgggccucugcuccgcauggcagaggaggcugcucgcaagcuacugccggcauuccagacaccuacagguaugcccuaugguacugucaauuugcuacauggcgugaacccuggugaaacacccgucaccugcaccgccgggauugggaccuuuaucguggaauucgcuaccuuaagcucucucacuggugacccuguguuugaagacguggcccgcguugcccugaugcguuugugggaaucucguagcgauaucggauugguaggcaaucauauugacgugcucacuggcaaauggguagcacaggacgcggggauuggcgcaggcgucgacaguuauuuugaauacuuagugaagggagcaaucuuacugcaggacaaaaaguugauggcuauguuccuggaguacaacaaggccauucgcaacuacacacgcuuugaugacugguacuuguggguacaaauguauaaaggcacagugagcaugcccguguuucagucccucgaagcguauuggccggggcugcagagucucaucggugauauugacaaugccaugaggaccuuucucaauuauuacacgguuuggaaacaauuuggcggccugccugaauuuuauaauaucccucaaggauauacaguggaaaaacgcgaaggcuacccucuccgcccggagcugauugaaagcgccauguaucuguaccgagcuacuggagacccgacauuacuugaauugggacgggaugcaguggagagcauagagaagauuagcaaagucgagugcggcuucgcaacuguguccguuugcauggcaccaagaaccggaaagagccucccgcugcugcugaaaucacuguuuaagggacgagcguuggggguccugacauaccagcacuag

SEQ ID NO: 13332 - RNA, 1281 nt, Artificial Sequence
  Description of Artificial Sequence: Synthetic coding sequence
auggguuggacagacaccuuagaaagugcugaggacaucuucuggaagcaagcugacuuuggcuacgcgcgggagcgacuggaggagaugcacguacuaugccaacccaaagaaacaucagacaguucacugguguguagccgguaccuucaguacugucgugcgaccaacuuauaucuugauuugaggaacauuaaaaggaaccacgaucgauucaaagaggauuuuuuucagucaggcgaaaucggcggccacuguaaacucgauauccggacccugacuagugaaggccagaggaagagcccucuccaaagcugguucgcugaguugcagagcuauacccaacugaacuucaggccaaucgaagacgcuaaaugcgacauugugauagagaaaccuaccuacuucaugaagcuagaugcaggggugaacauguaucaccacuuuugugacuuuauuaauuuauacauaacucaacacgucaacaacucuuuuucuacggacgucuacaucguuaugugggacacuagcagcuacggguauggugauuuguuuagugacacuuggaacgccuucacggacuaugacguuauucaucucaagaccuacgacuccaagcgggucuguuucaaggaagcaguuuuuucguuauuaccacggaugagauaugggcucuucuacaauacuccccuuaucuccggcugccagaauaccggucuguuccgugcuuucgcccaacauguccugcacaggcugaacauaacacaagaaggcccaaaggauggcaaaauaagggugaccauucuggcaaggagcacagaauacaggaaaauccucaaccagaacgaauuggugaacgcucugaaaaccgugucuaccuuugaggugcagaucguugauuauaaauaccgagaauuaggcuuccuugaccagcugcgcauaacacauaacacagacaucuucaucggcaugcauggugccgggcuuacgcaccugcucuuucugcccgacugggcagccguauucgagcuuuauaauugugaggacgaacgguguuaccuagaccuggccaggcuccgggggguucauuacauaacauggagaagacagaauaagguauucccacaagauaaggggcaucacccuacucugggcgagcauccaaaguuuacaaauuacagcuucgaugucgaggaguucauguacuuggugcugcaagcagcagaucacguacugcagcaucccaaauggcccuucaagaagaagcaugacgaacuuuag

SEQ ID NO: 13333 - RNA, 1098 nt, Artificial Sequence
  Description of Artificial Sequence: Synthetic coding sequence
augaagcugggaugugugcugauggccugggcauuauaccuuucgcucggugugcucuggguggcucaaauguuauuggucgcauccuccuucucugcugccuccuucgaaacccuccagugugaaggccccgucugcacugaagaaaguucgugccacacugaggacgacuugaccgacgcccgagaagcgggcuuccaggucaaagccuacaccuuuucugagcccuuccaucugauuguguccuaugacuggcucauucuccagggcccugcgaagccuguguucgagggugaucuccuaguucuccggugccaagcuuggcaggauuggccuuuaacacaaguaacauuuuaccgggacggcucggccuuggggcccccaggaccaaacagagaguucagcauuaccguaguccagaaggccgauucuggccauuaucauugcucggggauuuuucagagucccggaccugggauacccgaaaccgcaucagugguugccauuacaguccaggagcuguucccugcuccaauucuacgcgcuguccccagcgccgaaccccaagcaggaagcccgaugacacugucaugccaaacuaaacuuccacugcagagaagugcggcccgccugcuguuuuccuuuuacaaggacggccguaucgugcaaucacgagggcugagcucugaauuucagaucccgacagccucugaggaucacucgggcucauacuggugcgaagccgcaacagaagauaaccaaguguggaagcagucuccucaguuagaaauccgaguucagggcgcuagcucuagugcggcucccccuacucuuaauccugcaccacagaaguccgccgccccagggaccgccccggaggaagccccuggcccucuuccaccaccucccacacccaguagcgaggacccuggcuucaguucaccccuuggcaugccagauccccacuuauaccaucaaauggggcuucuacugaaacauaugcaggacgucaggguacugcuuggacaccuccugauggagcuuagagaauuaucaggucaccggaagccugguaccacaaaagcuaccgcggaauag

SEQ ID NO: 13334 - RNA, 1407 nt, Artificial Sequence
  Description of Artificial Sequence: Synthetic coding sequence
augcgcuggauucuaugcuggucuuuaacgcucugccugauggcgcagaccgcccuuggagcucuucacacaaaaagaccucagguggugacaaaguacggaacacuccaagggaagcaaaugcacgugggaaagacacccauccaaguguuucugggggugccauuuuccagaccuccacuggggauucugcgauucgcuccacccgagccgccagagccuuggaaaggcauccgggaugccacuacuuacccaccugguugucugcaggagucuuggggccaacucgcuucuauguacgugucgacccgcgaacgcuacaaauggcuccguuucagcgaagacugucuuuaccugaauguguaugccccagcucgcgcaccaggggacccccagcugccagucauggugugguuccccgguggugccuuuauugugggggcugcuucaagcuaugaggggucugaucuggcggcaagggaaaaagugguguuaguuuuucuucagcacagauugggaaucuucggcuuucucuccacagaugauucucaugcuagagguaauuggggcuugcuagaccagauggccgcucugcgcuggguccaagaaaacauagccgccuuugguggcgaucccgguaaugugacccucuuuggccagucugcuggggcaaugagcaucucuggccucaugaugucuccacucgcaagcggcuuguuccaucgcgcgauuucucagagcggcacugcccuauuucgucucuucaucacuucuaauccacugaaggucgccaaaaaggucgcccacuuggcugggugcaaucacaauucgacgcagauauuaguuaauugcuugagagcacucucugggaccaaagugaugagaguuucaaacaagaugcgguuccuucagcugaauuuucaacgcgacccagaggaaaucaucugguccaugaguccagucguggacggggugguaauuccugaugacccauugguccugcuaacccagggaaaagucucuucagucccuuaccugcucggcgucaauaaccuggaauucaauuggcuucucccuuacauuaugaaauucccccuuaacaggcaggcaaugaggaaagagaccaucaccaaaaugcucuggagcacucggacgcuacugaauaucaccaaggagcagguuccgcuuguagucgaggaguauuuggacaauguaaacgaacacgacuggaagaugcugaggaauaggaugauggacauagugcaggaugccacauucguguacgcuacauugcagaccgcucauuaccaccgagagacccccaugaugggcauaugccccgcuggacacgccacaacaaggaugaaaagcaccuguucuuggauuuuaccucaggagugggccuag

SEQ ID NO: 13335 - RNA, 756 nt, Artificial Sequence
  Description of Artificial Sequence: Synthetic coding sequence
auguccuccuauggauacggagaccucuucuccgacaccuggaacgcauuuacugacuaugauguuauccaucugaagacuuacgauagcaaaagaguauguuucaaagaggcaguguucucccuacuccccaggaugcgcuauggucuguuuuacaacaccccccucauuucuggaugucagaauacaggccucuuccgagcuuuugcccaacaugucuuacacaggcuuaacauaacccaggagggaccuaaggacggaaagauccggguaacuauucuggcgcgcucuacugaauaccguaagaucuugaaccaaaacgaacuggucaaugcacugaagacugugagcacguucgagguucaaaucguagauuauaaguacagagaacucgguuuccuugaccagcuuagaaucacucauaacaccgacauauuuaucgggaugcacggagccggccucacacaucugcuuuuucucccagauugggccgccgucuuugaacuguacaacugcgaggaugaacggugcuauuuggaccuggcucgccuaaggggaguccauuacauuaccuggcgccgacagaacaagguauucccucaggacaaaggacaucacccuacuuugggagaacauccgaaauuuaccaacuauucuuucgacgucgaagaguucauguauuuagucuugcaggccgcugaccacguacuccagcacccgaaauggccuuuuaaaaaaaaacaugacgagcuguag

SEQ ID NO: 13336 - RNA, 927 nt, Artificial Sequence
  Description of Artificial Sequence: Synthetic coding sequence
augaucccagucgaacugcugcuuugcuaccuccuccugcauccgguagaugccacaucuuacggaaagcagaccaaugugcugaugcacuucccccucucacuggagucucagaccccuaguuccgauccacucuccugccaauucuuacaccccaagucucugccaggguucagccacauggcgccucuacccaaauuccuugugucacuagcacugcggaacgcguuggaggaggcaggcugucaggccgaugucugggcuuugcaauuacagcuuuaucgccaaggcggagugaacgccacccaaguacugauccaacaucucagaggacugcaaaagggucgcucaacagaaagaaacguuuccgucgaggcuuuggccucggcucugcagcuucuggcacgugagcagcagucaacaggccggguuggaaggucgcugccgaccgaggacugugagaaugagaaagagcaggccguacacaaugucgugcagcuauugccaggggugggcacuuuuuacaaucuggguaccgccuuguauuacgccacacagaauuguuuggguaaggcacgggagcguggacgggacggugcaauugaucucggcuacgacuuacugaugacuauggccgguaugagcggaggucccaugggcuuagcuauauccgcagcauuaaagccagcucugcggucaggggugcaacagcuaauucaguacuaccaggaccagaaagacgccaacaucagucagccugaaaccaccaaggaagggcucagagccaucagcgacgucucggaucuggaagaaacaaccacccuagccucauuuauaagugaagucguguccuccgcccccuacugggguugggccaucauuaaauccuacgaccuggacccaggggccggcucacuggagauuuag

SEQ ID NO: 13337 - RNA, 2862 nt, Artificial Sequence
  Description of Artificial Sequence: Synthetic coding sequence
augagaguccucgccugucugcuggcggcacucgucggcauucaagcgguggagcggcugaggcuggcugaugggccccaugguugugcagggcgccuggaagucuggcacggcggacgaugggguacugugugugaugacgggugggaccuucgagacgcugcuguggcaugccggcagcugggcugugguggcgcucucgcagcccccggcggagccuucuucggugagggggcuggccccgucugguuguccgagcucgccugccgggggaaugaagggcagcuugggcugugucaccaccggggguggaaagcccacauauguagccacgaagaagaugcuggcguugucugugccggacaacggguggcuaauucucgcgacgauucaacuagcccccuagauggggccccauggccagguuugcucuuggaauuguccccuucgaccgaagaaccccuuguuacucaugcuccuagacccgcugguaauccacagaacgccagcaggaagaaaucuccgagaccaaagcaagcuaagucuacccgagccccacuucuuacgaccggggcaccgagacaagagcggcugagauuagugagcgggccccacagaugcgccggacgauuagaaguguggcauggaggcagauggggcacagucugcgaugaugggugggaucuucgugaugcagccguagccugccgcgagcucggaugcgggggcgcccuugcagcaccaggcggcgcacgcuucggcccaggggcaggcccugucuggauggacgaugucgguugcgggggcggagagcaggcccugagggacugcccacgcuccccauggggacgcuccaacugugaccauucugaagaugccgggcucgugugcacaggcccugcgccuagauuaaggcuagccgacgguccacaugggugcgcagggagacuggaaguguggcacgguggaagaugggggagcgugugcgacgacgccugggaccuaagagacgcggcaguggccugcagagaacucggaugcggcggcgcucucgccgcuccagggggggcuuuuuucggggagggcagugggccuaucauauuggacgaucugcgaugccgugggaacgagaccgcucuaagguuuuguccggcccgaccuuggggccagcaugacugccaccauagggaggaugcaggugcagucugcgauggaaugccgcuuggcuaugugccgccaacugccccaacagacucgaacaauuccacgccucgugaggccgcuagucguccccccucgacaaugacuucgcaagcgccuggaaccgccggggucuccccuccuccggccucccccacagugcucugggagcccgguccagaggccggauccccgcagcuccgucugguugcugguccaagcaaaugcagcgggaggcucgaaguuuggcaugaucaaagaugggguacugucugcgacgacucaugggauaugagggauagcgccguugucugucgcgagcugggauguggaggaccacaacagccugacccggcugcaggacgcuucggauggggugccgguccuauuuggcuggaugacgugggguguguggggacagaggcuucccuuagugacugcccggcagcuccuuggggaaagcacaauugcgcccacaaugaggauguuggggugaccugcacgggcccuccuggguuggacucaaucagugacccauucucguggucuuggauuccaggccuggggagagauagagacgcauggcugcccggagaacucgcaaccaagccaucagcgaguguuacugccucuguuuuggaaaagaccaccacaaaagccccugggaaaaugccuaaaagcacaaagaaguggguuacaaagaaugcaaagaggccaaccacgcagcccccagugaugccaaccacuaagcacucgcgcgcucagucuccaccugacuuaacaucccagacuacagcagcccugaccaccgaagcaucaagacgcccuacauccgaauucacuagaagaccuaccacagaggcaccacaacgcuggaccucccacacuacagcuacccugacgccacaggcaccgcgcgagcgcaccacuaaaaccauggccaugcugacaacucaggguccgcaagagaugacgagcgaaucuacgauaaagagcauuccucaagcuucuuuggaaccgucagccgaaauuccugaggguucuccagagagcccaaaagacccggcuccuuccccgaguguaucuacuaccggggagagcggauuguuuagggugagacuggcggacggcccuaauaggugugccggaaggcuugaggucuggcacgccggacgcugggguacggugugugacgacaacugggauuugcgcgaugccaccguugcaugcugggaacuggguuguggcaaagugcgcccccgagugggcaagacgcauuacggccccggcacuggccccaucugguuggacgauauggguugcaaaggaucugaggccucauugagcgacuguccaaguggcgcauggggcaagcacaauugcgaucaugaggaagacgugggguugacaugcaccggauacaccgauuacgaugacuauccccccuggaccugggauccuaccagccgagaggauuuggcaaagggaaccacuacagcaggugucccggggcauacacuacccuggcguaccacaagacgcccgggcagcuccucaccugccauccggcgacugccggauaccgaaccagaggcaggccugcgagaggucauguugcugguacagggcuugccaggcuugcagagauugcccaguccauag

SEQ ID NO: 13338 - RNA, 474 nt, Artificial Sequence
  Description of Artificial Sequence: Synthetic coding sequence
augcuuagaaccgaguccugucggcccagaucuccagcggggcaggucgcagcugccucaccauuacugcuacugcuguuacuccuggccuggugugcgggcgcauguagaggagcucccauccuaccucaaggccuucaacccgagcagcaacuucaacuguggaacgagaucgacgauacaugcuccucauuccucuccauugacagccaaccacaggccucaaacgcucuggaagaacuguguuucaugaucaugggcaugcugccaaaaccacaggagcaggaugagaaagacaacacgaagcguucuucugucguccacccacugcugcaacucguuccccaccuccaugagcguagaaugaaaagguuucguguagaugaggaguuccagagucccuucgcuucucagagccguggcuacuuccuguuucgcccaaggaacgguagacgaagcgccggguucauuuag

SEQ ID NO: 13339 - RNA, 1545 nt, Artificial Sequence
  Description of Artificial Sequence: Synthetic coding sequence
augccuucaacaguauugccuagcacugugcucccuuccuuacugccaacagcaggagcaggcugguccaugagguggauucugugcuggagccuaacgcuuugucugauggcccagaccgcccugggcgcccuucacaccaaaagaccgcaagugguuaccaaguauggcacccuucagggcaaacagaugcacguagggaagacacccauucagguuuuuuugggagugccguuuuccagaccuccauugggaauucuccgauuugccccaccagagccaccugaaccuuggaagggcauucgcgaugccaccacguauccaccaggaugccuucaagagucuugggggcagcucgccaguauguauguaucuacucgugagcguuauaaguggcugagauuuagcgaagacugccuuuaccugaauguuuaugccccggcacgggcuccuggugauccucaacugcccgugauggugugguucccuggcggagcuuucaucguuggcgccgcuucuagcuacgagggaucagaucucgcugcucgcgagaaggucgugcucguguucuuacagcacagguuagguauuuuuggcuuccugaguacugaugauucucacgcucgcgguaauuggggcuuauuagaucagauggccgcgcucaggugggugcaggaaaauauagccgcauuugggggagaucccgguaacguuacacuguuuggucaaagcgcuggggcgaugagcaucucuggccuaaugaugucaccacuggcaagcggguuguuucaucgagccauuucacagaguggcacagcccucuuccgacuuuuuauuacaucaaauccccucaaaguggcuaagaaaguugcacacuuagcugguuguaaucauaacucuacccaaaucuugguuaacugccuucgcgcacuuucuggaacuaaggucaugagagucucaaauaaaaugcgguuucuccagcugaacuuccagcgcgacccagaagagaucauuugguccaugagccccguuguagaugggguggugauuccugaugauccccuggugcucuugacacaaggcaagguguccucugugccauaccugcuggggguaaauaacuuagaguuuaacuggcuccugcccuacaacaucacuaaggaacaggucccacuggugguagaagaguaccuggacaacguuaacgagcaugauuggaagaugcugcgaaacaggaugauggauaucgugcaggacgcaaccuucguuuaugccacacugcagacagcacacuaccaucgcgggcucuccauggggaaagaaaaggcacugucccugcagaugaugaaauacugggcuaacuucgcaagaaccgguaacccgaacgacggcaacuugccaugcuggcccagauacaacaaagacgaaaaauaccugcagcuggauuuuaccacccgcguggggaugaaacuuaaagaaaagaaaauggcauuuuggaugucucuguaucagucccagcggcccgagaaacaaaggcaguuuuag

SEQ ID NO: 13340 - RNA, 1062 nt, Artificial Sequence
  Description of Artificial Sequence: Synthetic coding sequence
augaguaacccaacacagaccgacgccgauuccgacuuggugggugaugugugcgauacaaacgaagauuccgauggugauggccaucaagacacaaaggacaauuguccccaguugcccaauucuucacaguuagauucugacaacgauggccugggcgacgagugcgauggggaugaugacaaugacggaauuccugacuaugucccaccuggaccugauaacugccgacuggugccaaaccccaaucagaaagauucugacgggaauggcguuggcgaugucugcgaggaugacuucgauaaugaugcuguuguggaucccuuggacgucuguccagaaagcgccgaagugacgcugacagauuuccgugccuaccagaccgucguccucgaccccgaaggcgaugcacagauugacccuaacuggguuguauuaaaccaggggauggaaauagugcagacaaugaauagugaccccggccuggcugucggcuauacggcauucaacggagucgauuuugaaggcacauuucauguaaacacagucacagaugacgacuacgccggguuucuuuucucguaccaggauuccggccgcuucuauguggugauguggaaacagacggagcaaacguacuggcaggcuacacccuuccgcgcaguggcccaaccggguuuacagcuuaaagccgucacauccguuucggguccaggugagcaucugagaaacgcccucuggcauacaggccacacccccgaccaggugcgcuuacuuuggaccgauccacguaauguaggguggagagauaagaccagcuacagauggcagcugcugcauagaccucaggugggcuauauucggguuaaacuguaugaggggccacaacugguugccgacagcggagugauuaucgauacgaguaugcgcggaggucggcuggggguauucuguuucagucaggagaauauuaucuggucuaauuuacaguacaggugcaacgauacaguuccugaggauuuugagccauuccggagacaacucuugcagggaaggguauag

SEQ ID NO: 13341 - RNA, 1074 nt, Artificial Sequence
  Description of Artificial Sequence: Synthetic coding sequence
auggagauugagcauacccucgaucagaugaucucaaaaguggguaaccauaucgacguguuaacuggaaaguggguggcucaggacgcaggaaucggugccgguguagauuccuauuucgaauauuuggugaaaggagcuauacuucuccaggacaaaaagcucauggcuauguuucucgaauacaauaaagccauacggaauuauacacgcuucgacgacugguacuuauggguccagauguacaaagggaccguuagcaugccaguguuucagucacuugaggcauacuggccuggccugcagucgcuaaucggagauaucgacaaugcgaugcggaccuuuuugaacuacuacacagucuggaagcaguucggggggcucccagaguucuacaauauuccucagggguauacuguggaaaagagagaagguuacccccuuagaccugaacugaucgaaagugccauguaucucuaccgggccaccggagaccccacgcugcucgaacucggacgcgacgccguagagagcauugagaagauuucaaaaguggaguguggcuucgcuaccauuaaggaccuccgcgaccacaaacuagauaaucggauggaaagcuucuuucuggccgagaccguuaaauaucuauaucuucuguuugacccaaccaacuucauucauaauaacggcaguacauuugaugcagucauuaccccauauggcgaguguauucuaggcgcuggcggauacauuuuuaauacggaagcucaccccaucgaccccgcagcucuucauugcugucagcggcucaaagaggaacaaugggagguugaagaccuuaugagggaguucuacagucuaaaaagguccagaucgaaguuucagaagaacacuguuaguuccggaccuugggaaccaccugcaaggccagguacccucuuuagccccgaaaaccaugaucaggccagagagcggaaacccgcaaaacagaaggugcccuuauugucauguccuucccagcccuucacaucgaagcucgcacuucuaggccaaguuuuccuggauaguuccuag

SEQ ID NO: 13342 - RNA, 1341 nt, Artificial Sequence
  Description of Artificial Sequence: Synthetic coding sequence
augcugcacccagagaccagucccgggcggggucaucuccucgccgugcuacuugcucugcuuggcacggcaugggcugaaguguggccuccccagcuacaggaacaggcaccgauggcuggcgcucuaaaucgaaaagaaagcuuucuguuacugucccuucacaaccgccugcggucuuggguucagccacccgcugcagauaugaggcgauuagacuggagugacucccucgcccagcuggcucaggccagggcagcccucugcggcaucccuacuccaagccuggccaguggccucuggaggacccuccagguuggauggaauaugcaguuguugccugccggccuggcauccuuuguagaagucguaucgcugugguucgcagagggucagcgguacucucaugcugccggugagugugcacgcaaugcaaccuguacacacuauacccagcuugucugggcuaccucaucccaacuggggugcgguagacaccucuguuccgcuggacaagcagccaucgaagccuucgugugugcauauaguccucggggaaauugggaaguaaacggcaagacaauuguuccuuacaagaaaggcgcuuggugcucgcucuguaccgccagcguuaguggauguuuuaaagccugggaccacgcaggaggcuugugugaaguuccuaggaauccuuguaggaugaguugucaaaaucauggccgccugaacaucuccacgugucauugccacugcccuccuggcuauaccggucgcuacugccagguucgauguucccugcaaugugugcacggccgguuuagggaggaagaaugcucaugugugugcgacauuggcuauggcggugcgcaaugcgccaccaagguccacuucccuuuucacaccugugaccuaagaauugacggggauugcuucauggugucauccgaagcggacaccuauuacagggcucgcaugaagugccagagaaaggguggcguguuggcccagauuaaaagccagaaaguucaggacauccuagcauuuuaucugggcagacuugaaacuacgaaugaaguaaucgacucugauuucgaaacucggaauuuuuggauuggccugaccuacaaaacagcuaaagacuccuuccguugggcuacaggagaacaucaggcauucacuaguuuugcauuuggacagcccgauaaucauggauuuggaaacuguguugagcuucaagcaucagcagcauuuaauuggaauaaucagcgguguaaaacccgaaaccgcuauaucugucaguuugcucaggagcauauaucuagaugggggccagguaguuag

SEQ ID NO: 13343 - RNA, 900 nt, Artificial Sequence
  Description of Artificial Sequence: Synthetic coding sequence
augggagguccacgagcacugcuggcagcccugugggcccuggaggcggccgggacugccgcccuccgcauuggagcuuuuaauauccaaucauucggcgacucaaaaguuucagacccugccugcgguuccauuauagcgaaaauccuggcugguuacgaccuugcgcuuguacaggaaguacgugauccugaucugucugcuguaucggcgcugauggagcagaucaauuccgugagugaacacgaguacagcuucguuucaucccagccccucgggcgagaccaguauaaagaaauguaucuguucgucuacaggaaggacgcugugagcgugguggacaccuaccuguacccggaccccgaggacgucuucucuagagaaccauucgucgugaaguuuagcgccccaggaacaggagagagagcaccuccccugcccucccgacgggcccucacacccccaccauugcccgcggccgcacagaaccucgugcugauuccacuucaugcugccccccaccaagcggucgcagagaucgacgcacuguaugauguauauuuagaugucauugauaaaugggggacugaugauauguuguuccugggcgauuucaacgcugauuguucuuacgucagagcccaggauugggcugccaucagacugagaucuagugaaguuuuuaaguggcucauaccugacucggccgacacgaccgugggaaacucagauugugccuacgaccgcaucguugccugcggagcucgacuacggcgaagucugaaaccccagagcgcaacaguacaugauuuccaagaggaauucgggcuagaccaaacccaggcccuggcuaucagcgaucauuuucccgucgaggucacacugaaauuccaucgauag

SEQ ID NO: 13344 - RNA, 1458 nt, Artificial Sequence
  Description of Artificial Sequence: Synthetic coding sequence
auggacaauaacaagcauuguaagcaagauaauugucuguuaacccccaacucaggccaagaagacgccgauaaugacggcguuggggaccagugugaugacgaugcagauggagacggaauuaaaaauguggaggacaauugcaggcuguuuccaaauaaggaucagcagaauuccgacacagauucauuuggcgaugcgugcgauaacugcccuaacguaccaaacaacgaccagaaggauacggauggcaauggugaaggggaugcaugcgauaaugacgucgauggggacggcaucccuaacggacucgacaauugcccaaagguuccaaacccacuacagaccgauagagacgaagacggggucggcgaugccugcgauaguugcccugagaugagcaauccuacccaaacggaugcugacuccgaucuuguuggagaugucugugauacuaacgaggacuccgauggugacggucaccaggauaccaaggauaauugcccccagcugccaaauucuucccagcucgauagcgauaaugauggacucggcgacgaaugugacggcgacgacgacaacgacggcauaccggacuauguccccccugguccagauaauugcaggcuugucccaaacccuaaccagaaagauucagauggcaauggcgucggcgacgugugcgaagaugauuuugacaacgacgccgugguugauccuuuagacguuuguccggagagugccgagguuaccuuaacugauuucagagcauaccagaccgugguguuggacccugaaggcgacgcacagauugaucccaacugggucgugcugaaccagggcauggaaaucgugcagacaaugaauucagaucccggccuggccgugggcuacacggccuuuaauggaguugacuucgagggaacauuucacgugaacacagugaccgaugacgacuacgccgguuuccuguucuccuaccaggacucgggacgcuuuuauguggugauguggaaacagacagaacagacuuauuggcaggcaacgcccuuccgagcuguagcucaacccggacuacagcuuaaggcugugaccuccguguccggacccggggagcaccuucggaacgccuuauggcacacaggacauacacccgaccagguccgacucuuguggacagauccuaggaauguaggguggcgggacaagacauccuaccgauggcagcuguugcacagaccgcaggucggauacauccgaguuaaacuguaugaagggccacagcucguggcggauagcggugugaucaucgacacuagcaugcgcggcgggaggcugggaguauucugcuuuagccaggaaaacaucaucuggucuaaccuccaguaccguugcaacgauacagugccugaagacuucgaaccguuccgucgccaacuuuugcagggacggguauag

SEQ ID NO: 13345 - RNA, 2358 nt, Artificial Sequence
  Description of Artificial Sequence: Synthetic coding sequence
augaagcacacuuuggcucuacuggcuccacugcucggccuggggcugggcuuggcgcugucacagcucgcugcuggagcuaccgauugcaaauuucucggccccgcggagcaccuuacauuuacacccgccgcuagagcaagguggcucgcucccagggucagagcccccggacucuuggacagucuguacggaacaguccggagauuuuuaaguguaguucaauugaacccuuucccuagcgaacuuguuaaggcguugcucaacgaguuggccucuguuaagguuaacgaagucguaagauacgaagcuggguacguugucugugcggugauugcgggacuguaccuccugcucgugccgaccgcuggucuuugcuuuuguuguugccgcugccaccguaggugugguggacgggugaagacggaacauaaagccuuagcuugcgaacgcgccgccuugaugguguuccugcuacuuaccacccucuugcuacugauagguguugucugcgcuuuugugacaaaccagagaacacacgaacaaauggggccuucuaucgaagcuaugccagagacucugcuuagucuauggggauuaguguccgauguaccucaggaacuucaggcuguggcccaacaauucagucucccccaggagcaaguaucagaggagcuggauggaguuggugugucgauuggguccgccauccacacacaguugagaucuagcgucuacccccugcuggcagccguggggucccugggacagguucugcaagugucaguucaccaccugcagacauugaaugccacagucguggaacuacaagcgggccagcaagauuuagaaccugccauucgagagcaucgugacaggcuccuugaguugcuucaggaagcgcgaugccaaggagacugcgccggcgcacucaguugggcgaggacauuggagcugggcgcagacuucucacaagugccauccguggaccacguccugcaccagcucaaagguguacccgaagccaauuucaguaguaugguccaggaagaaaauagcacuuuuaacgccuuaccugcacuggcagccaugcagacaaguaguguggugcaggaacugaaaaaggcugucgcccagcagccugaagggguccgaacgcucgccgaagguuuuccuggccuggaggccgcgucccgaugggcucaggcguugcaggaaguugaggagaguucucgccccuauuuacaagaaguucagcgcuacgaaacauaccgcuggaucgucgguugugugcucugcaguguggugcucuuuguaguccugugcaaccugcugggucugaaucuaggaaucuggggauuaucagcuagagaugaccccucccacccugaagcaaagggcgaagcaggagcuagguuucugauggcuggcguggggcuguccuuccuuuuugcagcuccccuaauacucuuaguuuucgccaccuuucucguuggggggaaugugcagacacucgugugccagagcugggaaaacggcgagcucuuugaguucgcugacacuccaggaaaucucccccccucaaugaauuuaagccaacuauugggccuccgaaaaaacauuucuauacaccaggccuaucagcagugcaaggagggcgcagcacuauggaccguucuucagcugaacgacuccuaugaucuggaggagcacuuagauauuaaucagauccagcgcccgguggugaaaacaucaauggaacaauuggcacaggaauugcaaggccuggcccaggcccaggauaacucugugcuggggcagagacuccaggaggaggcacaaggucugcgaaauuuacaucaggaaaaaguagugccucagcagucccucguagcaaaguugaaucuuagugugagggcucuggaaucauccgcccccaaccuacaacuggagacgagcgacguucuggccaacguuacguaccucaaaggcgaacugccggcaugggcagcccguauuuuacgaaauguaagcgaauguuuucucgcacgcgagaugggcuacuucucacaguauguggccugggugcgugaggaggugacacaacgaaucgccacuugccagccucugagcggcgcgcuggauaacucccgcgugauccucugcgacaugauggcggaucccuggaaugcguucugguucuguuuggccugguguaccuuuuucuuaauuccaaguauuaucuucgccguuaagacauccaaguauuucaggcccauccgcaaacgacuuuccaguacauccucagaagagacucaacucuuucauauaccaagaguuacaagccugaagcuuuag

SEQ ID NO: 13346 - RNA, 792 nt, Artificial Sequence
  Description of Artificial Sequence: Synthetic coding sequence
augggacggguccuggaagaggcuagauuugccguugcauuuacagaguccaugaaagagauggcccaagcacaguggaaggcaaggcagauuucccuugcgguuacaagugcuguuccggugcagccccacgccaaggggaaaguguauguucagucacagggaaucgcaaccacacccaacgcagcauucaacuggaacacuuuucuccagcgaucugaaauuaaucagucugccgacaaucugcacauuuuucuguugauuugcggacugaggcagguuaaagaccccuuguaccugguggacgcguucagcgcguggcaucaagaggagccaaaugugcaccuuguaauagugggacccgaaguggacccagucuuuacacgggaagugaaggccaaggugaaaagggcugcaggcgugaggcuuaucggcgagaugccccaggaggaccugcacgcggugguuaagaauugcuuugcagugguuaauuccuccguuuccgagggcaugagcgcugcuauccuagaagccauggaucucgaaguucccgugcuggcacggaacauccccgggaacgcagccguggugaaacacgagguaacaggauugcucuuuucaaacccucaggaguuuguccacuuggcuaagagacuagucucugaucccgcucuugagaaggagaucguagugaaugguagagaguacguaagaauguaucauaguuggcaaguagagcgagauaccuaccagcagcugauccgaaaacuugaaggcaguacagaagauuag

SEQ ID NO: 13347 - RNA, 456 nt, Artificial Sequence
  Description of Artificial Sequence: Synthetic coding sequence
augaagacagccguaaugaaagaacucuauagcuuucugcaccaucaaaaccgguaugguagcgagcaggaguuuguggaugaccucaagaauaugugguuuggacuguacagccggggaaacgaagagggagacuccucgggcuuugaacacguguucuccggagaaguuaaaaagggcaaagugaccggguuccauaacuggauuagauucuaccucgaggagaaagaaggacuggucgacuauuacucccauauauaugauggcccuguacccguuaagccuggaagaauaucacuuuccugcccugacaucuaucugggccaaguccaccucugggaauggcaggaagugcaucgccacucacugcacagcguauuucaccucauugaacugagggcacggaaaggucacgaagguaguugcgaaacggagguucugucaaguuuggauuag

SEQ ID NO: 13348 - RNA, 363 nt, Artificial Sequence
  Description of Artificial Sequence: Synthetic coding sequence
augcucccucaguggcuguugcugcuguuccuccuuuucuuuuuccucuuccuuuuaacacgaggaucccugucgcccacuaaauacaacuuauuagagcuuaaagaauccuguauaagaaaccaagacugcgagaccggcugcugccagcgagcaccggacaacugcgagucucacugugccgaaaaaggauccgaggguagucuaugccaaacucaaguguuuuucggacaguaccgcgccugucccugcuuaaggaacuugaccuguauuuacucuaaaaaugagaaauggcucuccaucgccuauggcaggugccagaaaaucgguagacaaaagcuagccaaaaaaauguuuuuuuag

SEQ ID NO: 13349 - RNA, 951 nt, Artificial Sequence
  Description of Artificial Sequence: Synthetic coding sequence
auggccgaggcugcgcucgaggcaguccguagcgagcugagggaauuuccugcugcugcacgagagcugugcguuccacuggcugugccauaucucgauaagccuccaacuccauuacauuucuaucgcgacugggucuguccuaaucgaccaugcauuauccgcaacgccuugcagcacuggccagcucuucagaaguggucucuuccauacuuucgagccacuguaggcucuacagaaguguccgucgcagugacaccugacggcuacgcagacgcugugagaggcgauagguucaugaugccggcugaaaggaggcugccacugagcuucgugcuugauguacuugaaggucgcgcucagcacccagguguccuguauguccagaaacaguguucuaauuuaccguccgaguugccacaacuacuacccgaccuggagagucaugugccaugggccucugaggcacuugggaaaaugccugaugccgugaauuucuggcugggggaggccgcagcugugaccucacuucacaaggaccacuacgagaaccuauacugcgucgugagcggagagaaacacuuccuuuuucacccaccuagcgauagaccuuuuauucccuaugaacuguauacuccagccaccuaucagcugaccgaggagggaaccuuuaaagugguugacgaggaagcuauggagaaagucccauggauuccgcuggauccucucgcacccgaucuggccagauauccgucuuauucccaggcccaggcccuucgaugcaccgugagagcuggagagaugcucuaccuccccgcuuuaugguuccaucacguccagcagagccaaggaugcaucgcaguuaacuucugguacgauauggaguaugauuugaaauacucuuacuuccagcuucucgacucucugacaaaggcuucagguuuggacuag

SEQ ID NO: 13350 - RNA, 657 nt, Artificial Sequence
  Description of Artificial Sequence: Synthetic coding sequence
augggccguguuuuucuaacaggcgaaaaggcgaacucuauacugaaacgauacccgcgggcuaacggcuucuucgaagaaaucagacaaggcaacaucgagcgcgaaugcaaggaggaguuuugcaccuucgaagaagcccgcgaggccuuugagaauaaugagaaaacaaaagaguuuuggucuaccuacacaaaggcacaacaaggagaauccaaccggggaagcgauugguuccaauucuaucugacauucccucugaucuuuggcuuauuuaucauucuucugguaaucuuccuaauuuggcgcuguuuucugcggaauaagacaagaaggcagacugugacugaaggucacauuccuuucccgcaacaccugaacaucauaacaccgccaccucccccagaugaagucuuugacuccuccgggcugucuccagguuuucuaggguauguggugggacgaucagacucagugagcacaagacucaguaacugcgacccacccccuacuuaugaggaggccaccggccagguuaauuuacagcguagcgaaacugaaccucaccuugacccuccccccgaguacgaggauauugucaacucaaauagcgcaagugcuauccccauggugccgguggugaccaccaucaaauag

SEQ ID NO: 13351 - RNA, 909 nt, Artificial Sequence
  Description of Artificial Sequence: Synthetic coding sequence
auggccauguuucuggaguacaauaaagcaauucggaauuacacacgauucgacgacugguacuuguggguucagauguacaagggcacagugaguaugccagucuuucagucucuugaggcuuauuggcccgggcuacagucccugaucggugauaucgauaacgcgaugagaaccuuuuuaaacuauuacacaguauggaagcaguucgguggacugccagaauuuuauaacaucccccagggauauacaguggaaaaacgggaaggguauccucuucgcccugagcuuaucgagucugcaauguacuuauacagagcaaccggugaucccacacuuuuagagcuggguagggacgccguagaauccauugagaagauaaguaagguggagugcggcuucgcaacaauuaaagaucugagggaccacaaguuagacaaccguauggagagcuucuuucucgcggagaccgucaaauauuuguaucuccuguuugacccaacaaauuuuauacacaacaauggcuccacauucgaugcugucauuaccccuuacggugaaugcauuuugggagcuggaggauacaucuucaacacagaagcccauccaauagaucccgccgcacugcauuguugucagagauugaaggaagaacagugggaagucgaagaccuuaugagagaguucuauucguugaagcgaucucgcagcaaguuccagaagaacaccgucaguagugggcccugggagcccccggcucgaccggggacccucuucucuccagagaaccacgaccaagccagggagcgcaaaccagccaaacagaaagucccucuccuuucauguccaagccagccuuuuacaucuaagcucgcucugcuaggacaaguguuucuggauuccucuuag

SEQ ID NO: 13352 - RNA, 459 nt, Artificial Sequence
  Description of Artificial Sequence: Synthetic coding sequence
augcucguagauggacccucagaacggccugcccucugcuuccuguugcuugccgucgccaugagcuucuuugguuccgcucuauccauugacgagacucgggcccaccuacuccugaaagagaaaaugaugcgcuugggcggaagacugguuuuaaauaccaaagaggaacuggccaaugagcguuuaaugacccugaaaaucgccgaaaugaaagaagccaugaggacauugauuuuuccuccuuccaugcauuuuuuccaggcuaaacaucuaaucgagcgcucucaaguguucaauaucuuaaggaugaugccaaagggggcagcccugcaccugcaugacauugggauuguaacgauggauuggcugguuaggaacguaaccuaucgcccacacugccauaucugcuucacaccuaggggaauuaugcaguuucgcuucgcacauccuacauag

SEQ ID NO: 13353 - RNA, 3951 nt, Artificial Sequence
  Description of Artificial Sequence: Synthetic coding sequence
auggaaccucgccucuucugcuggacuacccuguucuugcuggccggguggugccucccgggguugccauguccaucccgcugccugugcuuuaagucaacugugaggugcaugcacuugauguuggaccauauaccgcaagucccccagcagaccacagugcuugaccugagauuuaaccgcauccgcgagauuccgggaagcgcauucaaaaaacucaagaaccugaauacauuacugcuaaacaauaaccacauacggaaaauuuccagaaacgcauuugaggggcucgagaaucugcuguaccuguauuuguacaagaacgagauccaugcccuggacaagcagacauuuaagggucucauuagucuggagcaccuuuacauucacuuuaaucaacuugaaaugcuccagccagaaacguuuggagaucugcugcgacuggagagacuguuccugcacaacaacaagcugaguaaaauuccugccggaagcuucucaaauuuagacucucuuaaacggcugcgacucgacucaaaugcucuggugugugauugcgaucugauguggcuuggagagcuguuacagggauuugcacagcauggucacacccaggccgcagcuacuugcgaguauccacggcggcuccacggcagagcuguagcuuccgugacagucgaagaguucaauugucagucaccuaggaucacguuugaaccucaggauguggagguuccaucuggcaacacuguguacuuuacgugccgcgcugagggcaauccuaaaccggaaauuauuuggauccauaacaaccauaguuuagauuuagaggacgauacacgacugaacguguuugacgauggaacucugaugauccgcaauaccagggaaagcgaucagggaguuuaccagugcauggcccggaacucagccggugaagcgaagacacaaucagcaauguuaagguacuccucauugccugccaaaccgucuuucguuauccaaccucaggacaccgaagugcugauaggcacaaguaccacacuagaaugcauggcaacaggccacccgcauccauuaaucacauggaccagagauaacggcuuggagcuggauggaucucgccacgucgcaacuucuucgggucucuaucuucagaacaucacacagcgagaccauggacgcuuuacuugccacgcaaacaacucucacggaacaguucaggcugcagcaaacaucauuguccaggcccccccgcaauuuaccguuacccccaaggaucaagucgugcuggaagaacaugcugucgaguggcugugcgaagcagacggaaacccucccccugugauagucuggaccaagacaggcggccaauuaccaguggaggggcagcauaccguccugagcuccggcaccuuacgcaucgauagagcugcccagcacgaccagggucaguacgagugccaagccgugucgucucucggcgugaaaaaaguaaguguacaguugaccguaaaaccuaaggcacuggcaguuuucacccagcugccacaagauacauccguagaagugggaaaaaacaucaauaucucaugccaugcucaaggcgaaccacaaccaauuaucacauggaacaaggaaggcguacaaauaacagaguccggcaaguuucaugucgaugaugaagguaccuuaacuauauaugaugcagguuucccagaucagggaagguaugagugcguugccagaaacaguuucggccuggcagugacaaauauguuuuugacggugaccgccauccagggcagacaagcaggagaugauuuuguggaaucuucaauccucgacgcuguacaacgcguugacagcgcuauuaauaguaccaggcgccaccucuuuucccagaagccacauacuuccagcgaccugcuagcccaguuccauuauccucgcgacccccugaucguagagauggccagggccggggagauauucgaacauacguugcaauuaauuagagaacgcgugaagcaagggcugacaguggaccuggagggaaaagaauuuagauacaacgaucucgucuccccccgaucccuaucucugauugccaaccucuccggcuguacagcacggcgaccucugccuaauugcucaaauagaugcuuccaugcaaaguauagagcacacgacggaacuugcaauaaccugcagcagccaaccuggggcgcagcucucacagcuuuugcacgccuccuccagccugcauacagggauggcauacgugcaccccgcggacucggcuugccugucggcucucgacagccacucccuccacccaggcugguagcuacagugugggcccgcgcggccgcugugacacccgaccauucguauacgcgcauguuaaugcacugggguugguuucuggagcacgaucuggaucacaccguccccgcccugucaacggccagguucagcgacgggcguccaugcucuucuguguguacaaacgaucccccuuguuuuccuaugaauacacggcaugccgauccgcguggcacacaugcaccuuguaugcuguuugcgcggaguucaccugccugcgcuaguggccgaccuagcgcuaccguggauuccgucuacgcacgggagcagaucaaccagcagacagccuacaucgacggcuccaauguauacgggagcagcgaaagggagucccaagcccugcgcgacccgaguguuccuagaggguugcugaagacgggcuuccccuggccaccuuccggcaagccgcuucugccuuucucaaccggacccccgacugagugugcucgucaggaacaagaaagcccguguuuucucgccggggaucaccgugccaaugaacaccucgcgcuggcugccaugcacacucugugguuucgggaacauaauaggauggcgacagagcucucugcauugaacccucacugggaagggaacaccguguaccaggaagcuaggaaaaucguuggugcagaguugcaacacaucacauauucucauuggcugcccaaaguccugggggacccaggcacccgaaugcucagagguuaccgaggguauaacccaaauguuaaugccggcauaaucaacuccuucgcaacagcugcauuccgcuuuggucauacucugauuaaccccauucuguaccgucucaacgcgaccuugggugaaaucuccgaaggccaccugccuuuccauaaagcuuuguucucacccaguagaaucauuaaagaaggagggaucgacccuguccugcgggggcucuuugguguggccgcuaaauggagggcuccuucuuacuugcuguccccugaacucacccagcggcuuuuuucagcagccuauucugccgcaguggacucagcggccaccauaauucaacgcggcagggaucauggaauuccacccuacguugauuuccgggucuucuguaacuuaaccagcguaaaaaauuucgaggaccuacagaaugaaauaaaagauuccgagauccgccagaaacuacggaaacuguacggcuccccgggcgauauugaccucuggccagcgcugaugguggaagaucugauacccgguacccgcgugggcccgacacugauguguuuauuugucacacaguuccagaggcuucgggauggggacagguucugguaugagaauccugguguuuuuacgccagcucagcuuacucagcugaaacaagccaguuuguccagagugcucugcgacaauggugacucgauucagcaaguccaggcagacguguuuguuaaagccgaguacccacaggauuaccugaauugcuccgagauuccaaaaguugacuuaaggguguggcaagacugcugugccgacaaacaggcagggggcacaccagaggccggccgggucuaccggugcuag

SEQ ID NO: 13354 - RNA, 891 nt, Artificial Sequence
  Description of Artificial Sequence: Synthetic coding sequence
auggaucccagcaaaaucgcacacacugaauacccuguaaauaccauaaucauccacgaagauuuugacaacaacuccauguccaauaacauugcucuacugaagaccgacacugcaaugcacuucggcaaucucgugcagucuaucugcuuuuuggggagaaugcuccacacuccgccaguucugcagaauugcuggguauccggguggaacccaacuagcgccacuggcaaccacaugacgaugagcguacugcgcaagaucuucguuaaagaucuagauaugugucccuuguacaaacuccagaaaacugaauguggcagucauacaaaggaggagacgaagaccgcaugccuaggcgauccggguucuccgaugaugugccaauugcaacaguucgaccugugggugcuccggggcgugcucaauuucgggggagaaacaugucccggccuuuuccuguauacuaaaguggaggauuacucuaaguggaucaccaguaaagcugagagagccggcccuccucuaucaagccuucaccauugggagaaacugaucagcuuuagucaccacggccccaaugcgaccaugacucagaagacauacuccgauucagaguugggccacgucggaucauaucuacaaggccaaaggcguaccauaacacacagucgucuagggaauaguuccagagacagccuagacgugagagaaaaagaugugaaagaaucuggaagaucuccggaggcaucuguacagccacuuuauuacgacuauuaugggggagaggucggagagggcagaauuuuugcaggccaaaaucggcuguaucagccagaagagaucauccucguguccuuugugcugguuuucuucuguagcucuauuuag

SEQ ID NO: 13355 - RNA, 2808 nt, Artificial Sequence
  Description of Artificial Sequence: Synthetic coding sequence
augaggaagccacgccgcaaaucucgccagaaugcugaaggccgccgcucacccagucccuauucucucaagugcucuccaacuagagaaacacugaccuaugcccaagcccagaggaucguugaaguggacauugacggccggcuacaccggaucaguauuuacgauccgcuuaagauaauuaccgaggacgaacugaccgcccaggauaucacugaguguaacaguaacaaagagaauagugaacagccacaauuuccgggaaagagcaagaagccauccuccaaagguaaaaagaaggaguccuguucaaaacacgccucagggaccucuuuucauuugccccagccuaguuuucgcauggucgauucugguauucagccagaggcaccaccccucccagccgcauacuauagauauaucgagaagccuccugaggaccuggacgccgaaguagaguacgacauggaugaagaggaccuggccuggcuagauauggucaaugagaagagacggguugacgggcauagcuugguguccgccgacacauucgaguuacuggucgaucgacuggaaaaagagucauaucuugaaucaagaucuucuggggcucagcagucuuuaaucgaugaagacgccuuuuguugcgucugccuggacgaugagugccacaauaguaaugugauccuguucugugauauuuguaacuuagcuguccaucaggagugcuaugguguucccuauaucccagaaggacaguggcuguguaggugcugccugcaguccccauccaggcccguggauuguauccucugucccaacaaaggcggagccuucaagcaaaccagugacggccacugggcacauguggugugcgccaucuggaucccagaaguguguuuugcaaacaccguguuuuuagagccaauugaagguaucgauaacauuccccccgcaagguggaagcuuacuugcuacauuugcaaacagaaaggccuuggagccgccauacagugccacaagguaaacuguuauacagccuuccaugugacaugugcccagagagccggauuguuuaugaaaauugaaccuaugagagaaaccucccuaaacggaacaaucuucacugugagaaagacggccuauugcgaggcacauagucccccaggcgcugcaaccgcccgcaggaaaggcgauaguccacgguccauauccgagacuggagaugaggaaggacuuaaagagggagacggcgaagaggaggaagaggaagagguugaggaagaagagcaggaggcccagggcggcguuucuggcagucugaagggcgugccuaaaaaaagcaagaugucgcugaaacaaaagaucaagaaagagccugaagaagccgggcaagauacuccaagcacccugccgaugcucgcugucccacagauaccaagcuaccgacuuaacaagauuuguagugggcuuagcuuccaacgcaaaaaccaguucaugcagcgacugcacaauuacuggcugcugaagagacaagcccgcaaugguguuccacugaucaggcgcuugcacucucacuugcagagccagcgaaaugcugagcagcgggaacaagaugagaaaacguccgcugucaaagaggagcugaaguauuggcagaagcuucgacaugaccuagagcgcgcccgccugcugauugaacucauccgcaaacgcgagaaacucaaaagggagcaggugaaggugcagcaggcugccauggaacuugaacugaugccauucaauguguuacuuaggacaacacuggacuuauuacaagagaaggacccagcccauauuuuugcagagccugucaaccugucugaggugccugauuacuuagaauuuauaucaaaacccauggacuucaguacaaugaggcguaaguuagagucgcaccuguaccggacacuggaagaguuugaagaggacuucaaccugaucgugaccaacugcaugaaguacaacgcaaaagauaccauuuuccaucgggcugcuguucgccugagggauuugggaggagccauacugagacacgccagacgccaggccgagaauauuggguaugaucccgagcgcggaacacacuugccugagucgcccaaacuggaggacuucuaccgcuucucuugggaggauggaaugacuaauggguuuggaaaacacaccgaaaguggcagcgacagugaguguucacucggacugucagggggacuugcauucgaggcuuguagcggguugacaccaccuaagcguagcagaggaaagccagcuuuaucacgagugccauuccuggaaggcgugaauggugacagcgauuacaauggcuccgggagaucccuucucuugccguuugaggaccggggcgaccuggaaccacucgaguugguaugggcuaaaugccgcggcuaccccucuuacccggcucugauuaucgauccaaagaugccaagggagggcuuguugcauaauggcguucccauuccgguacccccucuugacgugcuaaaacugggagaacagaagcaagcagaagcaggggaaaaacuuuuccugguguuguucuuugauaacaagaggaccuggcaguggcugccccgagacaagguacuuccacugggaguggaggauacaguggauaagcucaagaugcuggagggccgcaagacuucgauucgcaaaagcgugcagguggccuacgacagagccaugauucaccucucacgcguacgcgggccacacagcuuuguuacuucuucuuaucuguag

SEQ ID NO: 13356 - RNA, 270 nt, Artificial Sequence
  Description of Artificial Sequence: Synthetic coding sequence
augaagacuggccuguuuuuccugugccuccuggguacggcugccgccauucccacgaacgcucgacuucugucugaccauuccaagcccacugccgagaccguggcccccgauaauacugcaaucccgagucugagagccgaagccgaggagaaugagaaagaaacugccgucucaacagaagacgacucucaccacaaggcagagaaaucaucggugcucaaguccaaagaggaaagucacgaacaauccgcugagcaaggaaaguag

SEQ ID NO: 13357 - RNA, 657 nt, Artificial Sequence
  Description of Artificial Sequence: Synthetic coding sequence
auggggagaguguuucucacuggggagaaggcaaacuccauucugaaaagauauccgagagcgaauggguucuuugaagagauuagacagggcaacauugagcgggaauguaaagaagaauuuugcaccuuugaggaggccagggaagcauuugaaaauaacgagaagaccaaggaguuuuggagcaccuauacaaaggcucagcagggugaaucaaauagggggucagauugguuucaguucuacuuaaccuucccacucauuuuuggacuuuucaucauucugcuggugaucuuccuaauuuggcgcugcuucuuacggaacaagacccggaggcagaccgugacugaaggacauauucccuuuccacagcaccugaauauuaucacaccaccgcccccucccgacgaaguauucgacucauccggauugagcccugguuuucugggcuacguugugggacguucagauucaguaagcacucggcuuaguaauugcgauccaccacccacauacgaggaagcuacaggucaagugaaucuucagcgcucagaaaccgagccucaccucgacccucccccugaguaugaggacauuguaaauucuaauucugccagcgcuauaccaaugguccccgucgugaccacaaucaaguag

SEQ ID NO: 13358 - RNA, 540 nt, Artificial Sequence
  Description of Artificial Sequence: Synthetic coding sequence
auguccuugggaccugaaguauuucuuggcccuccagaggcccagucuuuccuuuccagucauaccagaaucccuagagcaaaccacugggaccucgaacuccugacgccuggcaaccuggagagagaaugcuuggaagaacgauguucuugggaagaggcuagagaguacuucgaagacaacacguugacugagagguuuugggaaagcuauaucuauaacggaaagggcggccgcgggcgcguugaugucgcuagccuggcaguugggcucacagggggcauccuucugaucgugcuggccggauuaggagccuucugguacuugcgguggcgccaacauaggggacaacagccaugcccccaggaagccggccugaucucuccccugucaccccugaauccucuaggucccccaacgccccuaccacccccaccuccaccuccgccuggauugcccacuuacgagcaggcccucgcagcuucaggggugcacgacgcccccccacccccauacaccucacugcgccggccccacuag

SEQ ID NO: 13359 - RNA, 765 nt, Artificial Sequence
  Description of Artificial Sequence: Synthetic coding sequence
augaccuuggaagacauagugcaacgcgagguuuggggcaccgucguagcccggggcgcccccgcuccuccagggccuguaccaacuaggggcgccgcaagccgcagacucucuguguccccugccuccacaucugaaacaucacuuuaucaggugcugcugggagccagacagcuggugcagcccggcccucaugcaauguacgcacgagugagacaaguugaaaguaauccacucuaucaggguaccgccucaagugccgacgucgcucugguggaacuggaagcgcccguaccauuuaccaauuauauccuuccagugugucuccccgacccauccguuauuuucgagacagggaugaauuguugggugacaggauggggcuccccaagugaagaggaucugcugcccgagcccaggauccuucaaaaacucgccguuccaauuauugacacgccaaagugcaaucuccucuauuccaaggacacugaguucggguaucagccgaagaccaucaagaaugauaugcugugugcaggcuuugaagaagguaagaaggacgcuuguaagggagauucuggcggccccuuggugugucuugucggccaguccuggcugcaggcuggggucauuucuuggggggaggggugcgcuaggcagaaucggccaggcguauauaucagggugaccgcacaucauaacuggauucaucguauuauccccaaacugcaguuucagccagcucgacuggggggccagaaauag

SEQ ID NO: 13360 - RNA, 1899 nt, Artificial Sequence
  Description of Artificial Sequence: Synthetic coding sequence
augacuccccccguuuuaacgacagcagaaacaucagugaagcccaguguauccgccuuuacccacucucccccugagaauacuaccggcaucagcuccaccauaagcuuucacucucgaacgcucaaccugaccgacgugauagaagagcucgcucaggccuccacgcagacucugaaauccacgaucgcuucagagaccacccuuucgaguaaaagucaucaaucaaccacuacucgaaaagcgauuauccgccauuccaccauccccccauuucuguccagcucggcuacccuaaugccagugcccauuuccccacccuucacccagagagccgucacagacaauguugccacuccgauuucuggacuuaugacaaauacuguggugaaacugcaugaguccucucggcauaaugccaaaccucaacagcuagucgccgaagucgcuaccaguccaaaagugcaccccaaugcuaaguuuacgaucggcacaacucacuuuaucuacaguaaucuccuucauagcacuccaaugccagcacucaccaccgugaagucucagaauucuaaacugacaccauccccuugggcagaaaaccaguucuggcauaagccuuauagugagaucgccgaaaaagguaaaaaacccgaagugucuaugcuggccaccaccggcuugucugaagcuacuacuuuagugucugacugggauggccaaaaaaauacgaagaagagugacuucgauaagaagccugugcaagaagccacgaccucuaaauugcucccuuucgacagcuugagcagauacauuuucgagaagccccgcauaguggggggcaaagccgccucuuucacgauuccugccaauagcgaugccuuucucccuugcgaggcagucggaaauccacuuccuacaauccacuggacacgcguaccauccgggcuugaucucucuaaacggaagcaaaacucucgcguacaggugcuccccaacggcacacuuagcauccagagaguggagauccaggauagaggacaauaccuguguucagcuuccaaccuauuuggcacugaccaccuucaugucacccucagcgucguauccuauccuccuagaauuuuggaacgcagaacaaaagagauaacagugcacuccggcuccacugucgagcugaaaugccgcgccgaggggcggccaucaccuaccgugacauggauucuggcaaaucagacagucgugucagagucaagccaggguagccgacaagcggugguuaccguggacggaacccuggugcugcauaaccuguccaucuacgaccgaggauucuauaagugcgucgccagcaaccccggaggacaggacucgcugcugguaaaaauccaaguuaucgcagccccuccugucauucuggaacaacggagacagguuaucgucggcaccuggggagaaucgcucaaacucccauguacugccaaaggcacuccacagcccagugucuacugggugcucucugaugguaccgaagugaagccacuccaguuuaccaacucuaagcuguuucucuucucuaauggaacauuguauaucaggaaccuagccagcucugacagaggaacauaugagugcaucgcuacaucuaguacuggcagugaaagacggguuguaaugcucaccauggaggagagaguaacuucuccccggaucgaagccgcaagccagaaacgaaccgaggugaacuuuggcgauaaguugcugcucaauugcuccgccacuggggagccuaagccccagauuauguggcgacugccuuccaaagccgugguugaucaacagcaccggguggcagcaggcucaacuucuacccugauggacccaugucuacucgaccaauag

SEQ ID NO: 13361 - RNA, 681 nt, Artificial Sequence
  Description of Artificial Sequence: Synthetic coding sequence
auggacaucauuguccuacuucccaaggggcacugcacuaagauccaagaauuacagaugaccaccgugcugaaacaaaauguccaugucuucggcguagaggggaauucugaugagcucgaugaaccuauuaaaacaguguuugcugaugucgccuuuguuaagaagcacaaccugaugucucucaauagcauuaauuggucuagaguccugguccagauggcccaccauuucuucgcauauuuccagugcacgccuucucucgauacucacccguuaccacuuguagaggugguagugccgacaggugccgccgggaauuuggcagccggcuauauugcacaaaaaauaggacuccccauccgccugguuguggccguaaaucgcaacgacaucauucacagaacuguccagcaaggcgacuuuucccucucagaggcagucaagaguacgcuggccuccgcaauggacauucaggugcccuacaacauggaacggguauuuugguugcucuccgguagcgacucccaagugacucgcgcccucauggagcaguuugagcgcacccaauccgucaacuuacccaaggaauugcacuccaaacacucaccaguucugcccaggccaugccugugcucccaggugccaggcucuugcccaggaugcuggccugaccccuag

SEQ ID NO: 13362 - RNA, 729 nt, Artificial Sequence
  Description of Artificial Sequence: Synthetic coding sequence
auguuccagacaggcggccugaucguauucuauggacuccuggcccagacucucccgcucaacguuaauccugcgcugcccuugucccccacgggauuagcagguucuuugacaaaugcccuaucgaacggacuguuaagcggaggucuccucggaauacuagagaaccugccccuucuugacauucuuaagccggguggagggacuagcggcggccuacugggcggcuugcugggcaaggucaccucugugauccccggucuaaauaacauuauugacauuaaggucacugacccucaacuacuggaacuuggccuugugcagucuccugacggacaucgguuguaugugacuaucccccucgggauuaagcuccaggucaacacaccacuuguuggcgcaagccuccuaagacuugccgugaaacuugauauuaccgcagaaauucucgccgucagagauaagcaggagcguauccaccucguuuugggcgacuguacacacucaccaggcagccuucaaaucucccugcucgacgguuugggcccccucccgauccagggcuugcuggauagucugacuggcaucuugaauaaagugcuccccgaacuaguucagggaaacguuugcccucuggucaacgaaguauuaagaggauuggauauuacucugguacacgauauugucaacaugcugauucaugggcuucaguucguaauaaagguguag

SEQ ID NO: 13363 - RNA, 1422 nt, Artificial Sequence
  Description of Artificial Sequence: Synthetic coding sequence
augucucuggaggcuucucuguguucacuggaggaaugugcugcuuuucagcccuccucuccuuccccucuucagccacaggggccagugaagucgaacaauaucguaacuguuacuggcaucucgcuuugucuuuucaucauaaucgcgacgguucugauuacucuauggcggagguuuggacggccugcuaagugcuccacgccagcccgucauaacuccauccauucuccuagcuucagaaagaacagcgacgaagagaauaucugugaacugagcgagcagcgggguaguuucucugacggcggugaugggccuaccggaucaccgggcgacaccggaaucccuuugaccuaccgcagguccggcccugugcccccugaggacgacgcgucuggguccgaaagcuuucaguccaaugcacagaagauaaucccuccccucuucucauaccggcuggcacaacagcaauugaaagaaaugaaaaagaaaggacugaccgaaacuacaaagguuuaccaugugagccaguccccccuuacagauaccgccaucgaugcagcuccgagcgccccacuagaucuggaaaguccggaagaagcugccgccaauaaauuuagaaucaaaagucccuuucccgaacagcccgcaguguccgcuggcgaacggccccccucccgucuggaucucaaugucacgcaagcauccugcgcuauuuccccaagucaaacgcuaauccguaaaucucaggcccgccauguuggaucccgggggggucccuccgaacguagucaugcucggaacgcccacuuucgccgaacagcauccuuccaugaagcuagacaggcccgcccauuuagagagagaagcaugagcacccuuacaccucgucaagcaccugcauauagcucccggacuagaacuugugagcaggcagaagaccgguuuaggccucagucucgcggcgcgcaccuguuuccugagaagcuggagcacuuucaagaggccaguggcacuagggggccccucaacccgcugccgaaguccuacaccuugggccagccacugcgaaagccggaccuuggagaucaucaagcggggcucguggcugggauugagaggaccgaaccccaccgcgcucgccgaggaccuucuccuucccauaagucaguaucaagaaagcaaaguagcccaauuucccccaaggacaauuaucagcgcgugagcucuuugaguccaucacagugucgcaaggacaagugucaaucguuucccacacauccggaauuugcguucuaugauaauacuuccuuuggccuaacggaagccgagcagcggaugcuggaucuuccuggcuauuuugggucuaacgaagaagaugagaccaccucgacucucucugucgaaaaauuggugaucuag

SEQ ID NO: 13364 - RNA, 2310 nt, Artificial Sequence
  Description of Artificial Sequence: Synthetic coding sequence
auguugaguaaaaagggaauuuucccguggauucugacuuguaucagugaagaaauggccuuucggacuaucuguguucugguggguguguuuaucugcuccauaugugugaaaggcucaagucaaccucaggcccgagucuaccugacauuugaugaacugcgcgaaacuaagaccucugaguauuuuucauugucucaucacccucuggacuaucggauccuccuaauggacgaggaucaggaccgaaucuaugugggguccaaggaucacauuuugucgcucaacauaaauaacaucucacaggaagcccuuuccguuuuuuggccugcaagcacaaucaaaguggaggaaugcaagauggccggcaaggacccaacucacggcugcggaaauuucgugcgaguuauucagaccuuuaauaggacccaccuguacgucuguggauccggcgccuucaguccaguguguaccuaucugaaucgaggccgucguagugaggaucagguguucaugauagacucuaagugugagucggguaaaggcagguguaguuucaaccccaacgugaacacgguuaguguuaugauuaacgaagaacucuucagcggaauguauauugauuuuauggguaccgaugcagcuaucuuucguucacugacaaagcguaacgcagugcgcacagaccagcauaauucuaaauggcugagugagccgauguucguggaugcccaugugauucccgauggcacagaccccaacgaugccaaaguuuacuucuuuuuuaaggaaaaauugacggacaacaaccgcaguacaaaacaaauucauagcaugaucgcccgcaucugcccuaacgacaccgguggacuucgcucccuuguaaacaaauggaccaccuuucugaaggcuagauugguguguucuguaacagaugaagacggccccgagacucacuucgaugaacuagaagacguguuccugcucgaaaccgauaacccucggaccacccuuguguacggcauauucaccacuucuucuucaguuuuuaagggcuccgcuguuugcguguaccaccucucggauauccaaaccgucuuuaaugguccauucgcccauaaagaagguccaaaccaucaacucauuaguuaccaaggacgaauuccauauccacgucccggcaccugcccaggaggagccuucacccccaacaugcgaacaacuaaggaauuuccugacgacguagucacguucauaaggaaccacccccuaauguacaacagcaucuauccaauccacaagaggccccuaaucgucaggaucggcacagacuacaaguauacaaagauugcaguugaccgggucaaugcggccgacggcagguaucacgugcucuuucugggcacagaccgcggcacuguccagaaagugguugucuuacccacaaacaacucagucagcggagaacugauccuggaagaacuggaggucuuuaaaaaucacgcacccauuaccaccaugaagauuucuucaaaaaaacagcagcucuacguauccucaaaugaaggcgugucccaagucucccuccaucgcugccacauuuacgggacugccugugccgauuguugccuggccagagacccguacugugccugggauggacacagcugcucuagauuuuacccuacaggcaagcgcaggucaagaagacaagacguuagacauggcaauccccuuacucaguguagaggauucaaucugaaggccuaccggaacgcagcugaaauugugcaauacggcguaaaaaauaacaccacauuccuggagugugcaccgaagucuccccaagcauccauuaaauggcuccugcagaaggauaaggauaggcgcaaggaggucaagcucaacgaacgaauuaucgcuaccucacaggggcuucugauucgcagcguucagggcucugaucagggccuguaucacugcauugcuaccgagaacaguuucaaacagaccauugcaaagauuaauuuuaaagugcuggacuccgagaugguugcaguggugacugauaaauggucuccauggacuugggccucuucaguccgggcucuaccuuuccacccgaaggauauaaugggagccuucucccauuccgagaugcagaugauaaaucaguacugcaaggauaccaggcagcaacaccagcagggugacgaaagucagaagaugcgaggcgacuacggaaagcuuaaagcucucaucaauucccgaaagucccgcaaucgacgcaaccaacucccugagucuuag

SEQ ID NO: 13365 - RNA, 942 nt, Artificial Sequence
  Description of Artificial Sequence: Synthetic coding sequence
augcccggauggcugaccuugccuacacucugucgguuccuuuuaugggcuuuuacaauauuccauaaggcacagggcgacccggcuucccacccugguacaacaccccccuccuauaaggugcgauggucgaaggucgagccaggggaacuuagagagacuuugaucuugauuaccaauggucuucacgcaagaggcuacgguccacugggcggaagggcacgcaugcgcaggggacaucgacuagaugcuucucuggugaucgcaggcgugaggcucgaggaugagggcagguacaggugugagcucauuaauggcauugaggaugagaguguggccuuaacacugucucucgagggagucguguucccauaccagccaagcagaggucgauaccaguucaauuacuacgaagccaagcaagccugcgaggagcaggauggacgacuugcuacauauagucagcuuuaccaagccuggacagaaggacuggacuggugcaaugcggguuggcuucuggagggaaguguucgauauccaguguuaaccgccagggcaccauguggcggucgcggaaggccuggcauccgauccuaugggccacgagaccggaugcgagauagauacgaugcuuuuugcuuuacauccgcccuggcugggcaaguguucuuuguacccggaagacuaacuuugucagaggcccacgcugcuugucggaggcgcggagcugugguggcaaaaguggggcaccucuaugcagcuuggaaguuuagcgggcuugaccagugcgacggaggauggcuugccgacggaagugugcgguuucccauuacuacuccacgcccucgauguggcggacuccccgacccgggagucagaucauucggguuuccucggccucagcaggcugcuuacggcacauacugcuacgcggaaaacuag

SEQ ID NO: 13366 - RNA, 1089 nt, Artificial Sequence
  Description of Artificial Sequence: Synthetic coding sequence
auggcuuggacguuugaaugcagucggacuacuagcccugaaccauuguccaccucuccauguagaacuaccucuaguagaaacucaccgaccauguccuguccugcgucugucgcuugcgagccaagcacaucgacuaccaccagcucccccccuaaggcaugucugacuaggccguccagcccuaguccaucauguaguacauccgcauggcauaacaaaaauaaucugauuaguaaagugccucgcggggcccuuagccgacagacccagcugcgggaguuauaucuucagcacaaccagcugacugacucuggucuagaugcuacuacuuucucuaaacuucacagucuggaauaccucgaucugucacauaaccaacucaccacuguaccugcuggccuuccuagaacccuugccaucuugcauuugggcaggaaccggauccgacaaguggaagcugcacgacugcacggggccaggggcuugagguauuuacuuuugcaacacaaccaguugggaaguucugggcugccagccggggcucugcgcccccuucgcggucuacauacuuuacauuuguauggcaacggcuuagaucgugucccaccagcucucccacggagacucagggcguugguccucccccacaaucacgucgcugcucuuggagcuagggauuugguggcuacuccaggacugacagaacugaaccucgcuuacaacagauuagcuagugcucgcgugcaccaucgcgcuuucagacgucuuagggcauuaaggucccuggaucucgcagggaaccaacucacccggcugccuaugggguugccuaccgggcugagaacacugcaacugcaacggaaucagcuccggauguuggaaccugaaccacuggccgggcucgaccagcucagggagcugucucuugcacacaacagacucagggugggggacaucggacccggcacguggcaugaacuacaagcuuugcaggugcgccaucgucuaguaucacacaccgugccaagggcccccccaucuccaugccucccuugucacguuccaaacauucuagugucuugguag

SEQ ID NO: 13367 - RNA, 900 nt, Artificial Sequence
  Description of Artificial Sequence: Synthetic coding sequence
augcuccacccagaaacaagucccggaagaggccacuuacucgcuguauugcuagccuugcuaggaaccgcuugggcagaagucuggccuccccagcuucaggagcaggcccccauggccggggcauuaaacagaaaagaguccuuccuccugcuuagucugcauaaccggcuccgcucgugggugcagccucccgccgcugacaugagaagacuggacuggucugauucacuggcucagcucgcccagggcucuccacuguggaauccuaaucccgaacccggugucagaccugucgcucaucccgccagcggacucgagcacgcugccgcuccccgagccugguguccucuuucuaaauggucccugugguucgccgaaggacaacgcuauucacacgcggcgggugaaugugcccgaaaugcuaccugcacccauuauacccagcucguaugggccacaucuagucaauugggauguggccggcacuuguguagcgcuggccaggccgcuauagaggcuuuuguuugugcauacagcccuagaggaaauugggaggucaacggaaagaccaucguacccuacaagaagggcgcguggugcagucucuguacggcuucugucaguggcugcuuuaaagcuugggaccaugccggcggcuugugcgaaguuccacgcaauccaugccggauguccugccagaaucacggacgacugaauauauccacgugucauugccacuguccacccggcuacaccggucgauacugucagguccgguguucucugcaguguguacaugguagauucagagaggaagaauguaguugcguaugugacaucggcuacgagcccucuguccccccaagguguauauuuccaucuacgcccguaacguag

SEQ ID NO: 13368 - RNA, 1047 nt, Artificial Sequence
  Description of Artificial Sequence: Synthetic coding sequence
augcuggacacaaaccuaauucugcugccacuuuuucaguucauuguuccgaaggaauggaauucaaaguaccggccugugugcauucaccuggcgggcacuggcgaccaccacuacuggagacgacgaacacugauggcccggcccaugauuaaagaggcccguauggcaagcuugcuucuagagaauccauauuacggcuguagaaaacccaaagaccaagugagaucuucuuugaaaaaugucuccgaccuguucguuauggggggagcucugguacuggaaagcgcagcucuucugcauuggcuagagcgggagggcuacggaccgcuuggcaugacuggaaucucuauggggggacacauggccucccuggccgucucgaacuggccaaagccuaugccuuugaucccaugucucaguuggaguacugccagcggaguuuucaccaccacagauucauucaaaaugggccaggaauucgugaagcauuuuaccagcagugccgacaagcuaacuaaucugaaccucguaucacggacccugaacuuagacaucucuaaucaggugguuagucagaaaccagcugacugccauaauagcagcaagacaagcgugagcgccacaagcgaggguuuacugcuccaggauacuagcaaaaugaaacgguuuaaucagacauugaguacuaauaaaagcgguuauaccagucguaacccacagagcuaucaccugcuauccaaggagcagagucgcaauagcuugcguaaggagagccucaucuuuaugaaaggugucauggaugaaugcacucauguugcuaauuuuagcguccccguggaccccucccuuauaauuguagugcaggccaaagaggaugcuuauauuccacgaaccggcgugcggucacugcaggaaauuuggcccgguugcgagauacgguaucuggagggugggcauaucagugcuuauuuauucaaacaaggguuauucagacaagcaauuuacgacgccuuugaucgauuuuuacauaaguaugcgaacuag

SEQ ID NO: 13369 - RNA, 1044 nt, Artificial Sequence
  Description of Artificial Sequence: Synthetic coding sequence
augcgcgccuguauuucucucguuuuagccgugcuguguggccuggcaugggccgaucuguauucagcucccacauccugucaagguagauguuaugaggcuuucgacaagcaucaccaaugucauuguaacgcccgcugucaggaauuuggaaauugcuguaaggauuuugaaucucuuugcucggaucaugagguuucacacucauccgacgcaauuacaaaagaggaaauccaauccaucagcgaaaagaucuaccgcgccgauaccaauaaggcucagaaggaagacaucguguuaaauagucagaauugcauaucuccaagugaaacuagaaaucagguggaccggugccccaaaccccuguucacguacgugaaugaaaaacucuucucgaaaccaacuuacgcagcauucauuaaccugcucaacaauuaucaaagagcuaccgggcacggagaacacuuuagugcucaggaacuggcugagcaggacgcauuccugcgcgagaucaugaagaccgcaguuaugaaagagcuguauagcuuuuugcaccaucaaaauagauacggaagcgaacaggaguucguggacgaccugaaaaauaugugguucggcuuauauucacgagggaaugaggaaggugauucuuccggcuucgagcauguuuucuccggcgaagugaagaagggaaaagucacuggauuucauaauuggauccgguucuaccuggaagagaaagaagggcugguggacuacuacucacacauuuaugacggcccuugggacucguacccggacgugcucgcgaugcaguucaacugggacggauauuacaaagaaguuggaagugccuucaucggauccucacccgaguucgaauuugcacucuauucccugugcuuuaucgccagacccgguaaggugugccaacugucucuugguggcuauccucucgcaguaaggacuuacacuugggacaaaagcacuuaugguaaugggaaaaaguacaucgcgaccgccuauauaguuucaucaacuuag

SEQ ID NO: 13370 - RNA, 864 nt, Artificial Sequence
  Description of Artificial Sequence: Synthetic coding sequence
augcucaagaagauaucagugggcguggcuggggaucugaauaccgucacuaugaaacucggcugcguucugauggcaugggcacuuuauuuaagucuggguguguuauggguggcacagauguugcuggcugcuucuuuugagaccuugcaaugugaaggacccgugugcaccgaagaaucuucaugccacacggaggacgaccugacugaugcccgggaagcgggauuccaggugaaagccuacacuuucuccgagccguuccaccucauugucuccuacgagcuauucccugccccaauauuacgagcuguuccaagugccgaaccacaggcaggaucaccuaugaccuuguccugucagaccaaacucccacugcagcgauccgcggcaagguugcuguuuuccuucuauaaagauggcagaaucguucaaucacgcggucucucaagugaauuccagaucccgacagcgagugaggaucacuccggcucuuacuggugugaagcagccaccgaagauaaccagguguggaaacagagcccgcagcuggagaucaggguccagggagcauccuccucugccgcacccccaacucugaacccugccccacagaaaucagcagccccuggaaccgcucccgaagaagcccccggaccacuacccccaccacccacccccucuucugaagacccaggauucucuucaccccuggguaugccagauccacaccuguaccaucagaugggacugcugcugaaacauaugcaggacguccgcguccuguugggacaccugcuuauggagcugagagaguugagcggccaccguaaaccgggaacuaccaaagccaccgcugaguag

SEQ ID NO: 13371 - RNA, 1815 nt, Artificial Sequence
  Description of Artificial Sequence: Synthetic coding sequence
augaugagagccguaugggaagcauuagcagcucuggccgccgucgccugccucguuggcgccgugcguggggggcccggucuuagcauguucgcaggccaagccgcacaaccugaucccuguuccgacgaaaauggacacccgcggcgauguauccccgacuuuguuaacgcggcguucggcaaggaugucagaguaaguaguacaugcgggaggccuccagcacgauacugcguggugagcgaaaggggggaggaacggcugagaagcugccaccugugcaacgcguccgacccuaagaaggcccacccuccugccuuucugacugaccugaauaauccucacaaucugacauguuggcaaagugaaaauuaucuucaauucccacacaacguuaccuugacgcuguccuuagguaagaaguucgaagugacguacguuagcuugcaguucuguagcccucgaccggaaaguauggccauuuacaaguccauggauuacggcagaaccugggucccguuucaguucuacuccacccaaugucggaaaauguacaaucggccgcauagagcaccaaucacuaagcagaacgagcaggaagcuguauguacugauucccacaccgacaugcgcccgcuuucugguggccucaucgccuuuagcacccuggacggcagacccuccgcacaugacuuugauaauucaccagugcuucaggauugggucacagccacugacaucaggguggcuuuuucucggcugcauacuuucggugaugagaacgaagacgacagcgagcucgcaagggauucuuauuuuuaugccguauccgauuugcaagugggcggcaggugcaaaugcaauggccacgcagccagauguguaagagacagagacgacagccuuguuugcgacugccgccacaauacagccggcccagaaugugaccgcuguaaaccauuccacuaugaccgucccuggcagcgugcaaccgcccgugaagcgaacgagugcguggcgugcaauugcaaccuucaugcacggcgcugccgcuucaacauggagcuauauaaacugucaggcaggaaaagcgggggggugugcuuaaacugccggcacaauaccgccggacggcacugccacuacuguaaagagggauauuaucgcgauauggggaagccaaucacucacagaaaagcuuguaaggcaugugauugucacccugugggagcggccgguaagacaugcaaucagacuacaggacagugucccugcaaggauggugucacuggaaucacauguaaccguugugcgaagggcuaccagcagagcagaucuccuauugccccuuguaucaagauccccguugccccaccuacaacugcagcuuccaguguugaggaaccugaggauugcgacucguacugcaaggcaucaaaaggcaaacucaaaauuaacaugaagaaguacugcaaaaaggauuacgcuguacaaauucauauucuuaaagccgauaaagcaggggacugguggaaguucaccgugaauauuaucucugucuacaagcagggcaccuccagaauucggcgcggcgaucaaucacuguggauaagaucgagagauauugcuuguaagugccccaaaaucaagccuuuaaaaaaauauuuacuucucggaaacgcggaagauucucccgaucagagugguaucguagcugacaaguccagucucgucauucaauggcgggauacuugggcccggagguuacggaaauuucaacagagagagaagaagggcaaaugcaaaaaggccuag

SEQ ID NO: 13372 - RNA, 1005 nt, Artificial Sequence
  Description of Artificial Sequence: Synthetic coding sequence
augagaucggccggggguagaggcgagauuaaaguuagacgugaacuccaaccaaguaaacagguuuccgguuuaacaaaucacgcuagaacaggccaggaaaagagaaaccugcagcgacuugugcuagaaacaccuagucagaacauuuuuuuuucucccgugagugugucuaccucacuugccaugcugaguuugggugcgcacuccgugacuaagacucagauuuuacagggacugggauuuaaucugacucauacaccggagagugcuauccaccaggguuuccaacacuuagugcacucacuaaccgugcccucgaaggaccuuaccuuaaaaauggguuccgcucucuucgugaagaaggagcuacaacugcaggcuaacuuccuggggaaugugaaaagacucuacgaagccgaaguguuuagcacagacuucagcaauccaucaaucgcucaagccaggauuaacucucacguaaaaaagaagacucagggaaaggugguugacauuauucagggucucgaucugcugacugcaaugguccuggugaaucacaucuuuuucaaagccaaaugggagaaaccauuccacccagaauacacuaggaaaaacuucccuuuccucguaggugaacagguaacuguacacgugccgaugaugcaccagaaggaacaguuugccuucgggguggacaccgaacugaauugcuuuguacuucaaauggacuacaagggagaugcugucgcuuucuucguccugcccaguaagggcaaaaugagacaacuggagcaggcucugagcgccagaacacugaggaaguggagucacucacuucagaaaagauggauugagguguuuauuccaagauuuucaauuuccgccucguauaaccuugagacuauauugccgaagaugggaauucagaauguguucgacaagaacgcugacuucuccggcauugccaagcgggacucucugcaggugucuaaagucuccuag

SEQ ID NO: 13373 - RNA, 1065 nt, Artificial Sequence
  Description of Artificial Sequence: Synthetic coding sequence
auggcaccggccagaaggccagcuggcgcucggcuguuauuaguguacgcuggacuccuggccgcugcugccgcugggcugggauccccagagcccggugcuccuagucguucccgggcccguagagaaccgccaccaggaaacgaguuaccacgaggcccaggcgagagcagagcgggacccgccgcuagaccaccagagcccaccgcugaacgggcacacuccguggacccgagagacgccuggaugcuguuuguccggcagagugauaaagggguaaacggaaagaagagaaguaggggaaaggcaaaaaagcugaaguucggucugccaggcccucccggcccaccggggccucaggggcccccuggucccauaauuccacccgaagccuuguugaaagaauuucaacuccugcugaaaggcgcaguaaggcaacgcgagagggcagagccagagccauguacaugcgggccagcugguccuguagccgccaguuuggcuccaguuucggcuacagcgggcgaggaugacgaugauguaguaggggacgugcuagcccuguuagcugcaccgcucgcaccaggaccgcgagcaccucggguggaggcugcuuucuugugcagguugagaagagacgcccuggucgagagacgcgcccugcaugagcugggugucuacuaucucccagaugcggagggcgccuuccgucgggggcccggguuaaauuugacuaguggacaauacagagcgccugucgccggcuucuaugcucuggcagccacucuacaugucgcucugggcgaaccaccccggcgcgggcccccccguccucgagaucaccugaggcuucugauuugcauccagucucggugccaaaggaacgcaagucuugaagcuauaaugggccuagagucuuccuccgagcuguuuacaauuucugucaacggagugcuguaccugcagauggggcaauggaccagcgucuuucuggauaacgcguccgguugcucacuuacagugcggaguggcagucacuuuagcgccgugcuccuugggguuuag

SEQ ID NO: 13374 - RNA, 2685 nt, Artificial Sequence
  Description of Artificial Sequence: Synthetic coding sequence
augucauugcccagauguugcccucauccacuuagacccgagggguccggagccauggggccagaagcccucaguagccucuugcuuuugcuccuuguggccucaggcgacgcugauaugaaaggccauuuugacccagcuaaaugucgcuacgcucugggaaugcaggaccggacgauaccagacuccgacaucucugcuucaucuucuuggagcgauuccacugcagcccgccacucacgccuggaaucaagugacggagauggggcuuggugcccggccgguagcguauucccaaaggaagaagaguaccuccagguggaccuccagaggcugcaucugguggcucuggucggcacccaaggacgacacgcuggaggauugggaaaggaguucuccaggagcuaccgcuuacgguacagucgggauggacgucgguggauggguuggaaggaccgcuggggacaggaaguaaucuccgggaaugaggaucccgagggcgucguguugaaagaucuggggccgcccauggucgcccgcuuaguccgguucuacccacgggcggaucgcguaauguccguaugccuuaggguugagcuguacggcugucuauggcgcgacggacucuuaaguuacaccgcgccugugggccagacuauguaucucagcgaggcuguguacuugaacgauucaacauacgacggacacaccgucggaggguugcaguauggggguuuaggccagcuggccgacggugucguaggacucgacgacuuccgcaagucacaggaguuacgcguguggcccggcuacgacuacgucggcuggucuaaccauuccuuuucaaguggguauguggagauggaguuugaauucgaucgguugagggcguuucaggcuaugcaagugcacugcaauaacaugcauacacugggggcucgguuaccagggggaguggagugcagguuccggcgcgguccagcaauggcuugggaaggcgagccuaugaggcacaaccucggagggaaucucggggauccucgggcucgggccgugucugugccuuugggggggcggguagcucguuuccugcagugcagguuucucuuugcuggcccguggcuccucuuuuccgaaauuagcuuuaucucagacguugugaacaauaguuccccugcacuggguggaacuuuccccccugcucccugguggccucccgguccgccucccaccaauuucucuucccuggagcuggagccccggggucaacagcccguggccaaagccgagggcucccccaccgcuauacucaucggcugccucgucgcaaucauucugcugcugcugcucaucaucgcccucauguuauggagauugcauuggagacggcuccugucgaaagcggagaggcggguccucgaagaagaacuuacggugcaccugagugugcccggggacacaauacuuauuaauaaccgaccaggcccaagagagccacccccauaccaggagccccguccgagaggaaacccuccgcauagcgccccaugcgugccaaacggaucggccuacagcggagacuacauggaaccugagaagccgggugcaccacugcugccaccaccaccucagaacagcguuccacauuaugcagaagcagauauuguaacauuacaagguguuaccgggggcaacaccuacgcagucccagcucuuccccccggcgccguuggagaugguccuccgagaguggauuucccucggucuagacugagguuuaaggagaagcucggagaagggcaguucggagaagugcaccugugugagguugauucuccccaggaucugguaucccucgacuuuccacuaaaugugagaaagggccacccucugcuuguugcaguuaagauccuaaggccagaugcuacaaaaaacgcaagaaaugauuuccuuaaagaagugaagauuauguccagguuaaaggaccccaauauuauccgacugcuaggcguguguguucaggacgacccccuguguaugaucaccgauuacauggaaaacggagaucucaaccaguuucuuagcgcacaucaacuggaagauaaggcugcagaaggggccccuggagacggacaggcggcccagggcccuacaaucucauacccaaugcuccuucacguggccgcccagaucgcuagugguaugcguuaccuggcaacacuaaacuucguucauagagaucuagccacccgaaacugucugguuggagaaaauuucacuauaaaaaucgccgauuuuggaaugagccguaaccuauaugcuggggauuauuaccgcgugcagggucgcgcuguucugccaauuagguggauggcgugggaauguauccugaugggcaaauuuacuacugcuagugaugucugggccuuuggagucacucuaugggaaguccuaaugcugugucgagcccagccuuucggacagcugacugaugaacaaguuauagaaaacgccggcgaauucuuucgagaucagggacggcagguguaucuguccaggccccccgccugcccacaggggcuguacgaauuaaugcugagguguuggucccgagagagugaacagcggccgcccuucagucaauuacaccgauuccuagccgaagaugcacugaacacaguauag

SEQ ID NO: 13375 - RNA, 2685 nt, Artificial Sequence
  Description of Artificial Sequence: Synthetic coding sequence
augucccucccuaggugcugcccccauccacuucgcccugagggaagcggcgccaugggcccagaagcucugucuagccuguugcuguugcuccugguggccuccggagacgccgacaugaaaggccacuucgacccugccaaaugucgcuacgcacucggcaugcaagacagaacuauccccgauagugauauuucagcuuccagcaguuggucugauucuacugcugccagacacucgagauuggaaagcagcgacggcgauggggcauggugcccugcagggagcgucuuccccaaagaggaggaauaccugcaggucgacuugcagcgccuccauuugguggcucuuguggggacccagggacggcacgccgggggccuugguaaagaauucucucgcuccuacagacugagauacucacgugauggacgccgauggaugggauggaaagacaggugggggcaggaagucauuagcggaaacgaagauccugaaggggucguauugaaagaucuagggcccccuaugguggcucggcuggugagguucuauccaagagccgauagagucaugagcgugugccugagaguugagcucuacggaugcuuguggcgagacggacuucugagcuacaccgcccccgucgggcaaacgauguaccucagcgaggcaguguacuuaaacgacagcaccuaugaugggcacacaguggguggacugcaguaugggggucugggccagcucgcggauggcguggugggcuuagaugacuuccggaaaagccaggaguuacggguuuggccaggguaugauuaugugggcuggucuaaucacaguuucucauccggauauguagagauggaguucgaguucgacagacugagggcuuuccaggccaugcaaguucauugcaauaacaugcacacuuugggagcacggcugcccgggggaguggaaugccgauuuaggcggggcccagcuauggcuugggagggagagccuaugaggcacaaucuggggggaaaucugggcgauccgcgggcuagagcuguguccgugccauugggaggacggguggcucguuuccugcagugucguuuccucuucgcugguccaugguugcuguuuucagaaauaucauuuauuuccgauguagugaauaacucaucccccgcacuuggaggaaccuuuccuccugcgccuugguggccgcccgguccucccccuacgaauuuuaguagucuggaguuggagccaaggggccagcaaccgguugcuaaagcugaaggcucuccaaccgccauccugauaggaugccuaguugcaauuauauuacuucuguuguugauaauugcccucaugcuguggagacugcacuggagacguuuacugagcaaagccgagcggagaguuuuagaggaagagcugaccgugcauuuaucagugccaggugacacaaucuuaaucaauaaucgcccuggcccccgcgaaccuccacccuaccaggaaccccgaccacgcggaaacccaccucauucagcaccaugugugccuaacggcagugccuacucaggggauuauauggagccagaaaaaccuggugcuccacuccugccuccacccccccaaaacucugucccccacuacgcagaggccgacaucgucacacuucagggcgugaccgggggaaacacauaugcgguucccgcucugccuccuggugcagugggagauggaccacccagaguugacuuuccacgcagucgccugcguuuuaaggagaaauugggagaaggccaauuuggugagguucacuuaugugaaguggauuccccacaggauuugguaagccuggauuucccucuaaacgucagaaagggucauccacuucuggucgcggucaaaauucuccgcccagacgccaccaaaaacgcaagaaaugauuuccucaaagaaguaaagauaauguccagacugaaagacccuaacaucauucgacuccugggcgugugugugcaggaugacccccugugcaugauuacugauuauauggaaaauggcgauuugaaucaauuccucucugcgcaucaacuugaggacaaggcagccgaaggcgcccccggagauggacaggccgcccaggggccuacuaucucuuaucccaugcugcuccaugucgcagcgcaaauagccucagggaugcgcuaccucgcaacucugaauuuugugcaccgagaucuggcuacgaggaacugucuggugggagagaacuucaccaucaaaauagcggauuucggcaugucuaggaacuuguaugcuggggacuacuaucgggugcaagggagggcuguucugccuauucgguggauggcaugggagugcauacucaugggaaaauuuacgaccgcuucugaugugugggcguucggggucacauuaugggaggucuuaauguugugccgagcccagccauucggccaacuuacagaugagcaggucauugagaaugccggcgaauuuuuucgggaucaggggcgucaaguguaucugucucggccccccgccugcccccaggggcucuacgaacugaugcucaggugcuggucacgggaguccgagcagcggccaccauucucacagcuucaucgcuucuuagcagaagacgcucugaauaccguguag

SEQ ID NO: 13376 - RNA, 2886 nt, Artificial Sequence
  Description of Artificial Sequence: Synthetic coding sequence
auguugcugcuccuccugcuggcuccgcuguuucuuagaccacccggggcaggcggggcccagaccccaaacgcgacauccgaagguugccagauaauucacccuccuugggaaggaggcauucgguacagaggacugacgagggaccaaguuaaggccaucaauuuucugcccguagacuaugagaucgaauacgugugccggggcgaacgcgaaguagugggaccaaaagugagaaaaugucuggcuaauggcuccuggacagacauggauacacccaguagaugcgugagaauuuguucaaagaguuaccucacucuggagaacggcaaaguguucuuaacaggcggggaucuucccgcauuggacggcgcccgaguugauuuccguugcgaccccgacuuccaccuuguggggucuucccgcucaauuuguagucagggccaguggucaacgccaaaaccucacugucagguaaaucgaacaccacacuccgaacggagagcugucuacaucggagcacucuucccaaugagugguggcuggccugggggacaggcaugucagcccgcaguagaaauggcgcucgaagacguuaacagcagaagagauauucucccggauuaugagcugaagcugauucaccaugauaguaagugugaucccgggcaagcuacgaaguaccucuaugagcuucuuuacaacgauccuauuaagauuauacucaugccaggcugcucuuccguaucuacgcucguagcagaggccgcacgcauguggaaccuaauuguucuguccuacggaucgucaucgccagcgcugagcaacaggcagcgauuucccacuuucuuccgcacccaccccucggccacacuacacaaucccacgagagucaaacucuucgagaaguggggguggaagaagauagcuaccauacagcagaccacugaaguauucacaucuacccucgacgaucuggaagaacgggugaaggaagcugguaucgagaucaccuuuaggcaaucuuuuuucagcgacccggcaguacccguaaagaaccuaaagagacaggacgcccggauuaucgugggauuguucuaugaaacugaagcuaggaaggucuucugcgagguuuacaaagagcgccucuuugguaagaaguaugucugguuccugauuggcugguacgccgacaacugguucaaaauuuaugauccaucuauuaauugcacagucgaugaaaugacagaagcaguugaggggcacaucaccacggagaucgugaugcucaaucccgccaacacaagaagcauuuccaauaugacgucccaagaguuuguagaaaaacuuacgaagagauugaagcgccaucccgaggagacgggugguuuucaggaggcuccccucgcauacgacgccaucugggcuuuggcgcuggcucugaacaagaccagugguggaggaggaagguccggcgucagacuagaagacuuuaacuacaauaaucagaccauaacagaccagaucuaccgggccaugaauagcagcaguuuugagggggugagcggucacgugguguuugacgccucaggcucacggauggcauggacacugauugagcagcugcagggcggcagcuauaaaaaaaucgguuauuaugacaguacuaaagaugaccucagcuggucaaaaacagacaaguggauaggcgguucacccccagccgaccagacacucgugaucaaaacauuccgguuccuaucacagaaacucuuuaucagcgucagcgugcugaguuccuuggggaucguccuggcggucgugugucugagcuuuaauaucuauaauucccacguccgcuauauccagaacagccagccuaaccugaauaaucuuaccgccguagggugcucccuggcuuuggcagcaguuuuuccuuuaggacucgacggguaccauauuggaagaaaucaguuucccuuugugugccaagcccguuugugguuacuaggacucggguuuucccugggauacgggucuauguucacuaagauuugguggguccacaccguauuuacuaaaaaggaggaaaagaaggaguggagaaagacuuuggagccauggaagcucuacgcuacugucgguuugcuagucgguauggauguacuaaccuuggccauuuggcagaucguggauccccuccauagaacaaucgaaacguucgcuaaagaagagccuaaggaagacauugacgugagcauauugccccaacuggagcauuguaguaguaggaaaaugaauacauggcugggcaucuuuuauggcuauaaggggcuguugcuccugcuuggcaucuucuuagcguacgagacgaagagcgugucuacugagaagauuaacgaccauagggccguagguauggccauuuacaauguggcugucuuaugccuuaucacagcuccagugacuaugauauuaucaucucagcaggaugcagccuucgcuuucgccucucuggccauaguguucucuucuuacauaacgcugguuguccuauucgugccuaaaaugaggcgguugaucaccagaggcgaauggcagagugaggcucaagauacuaugaaaaccgguucaucuacuaacaauaacgaagaagaaaaguccagauuguuggagaaggagaaccgggagcucgaaaagaucaucgccgagaaagaagaacgcgugucugagcugaggcaccagcuccagucgaggcagcagcuaaggucucgacggcacccaccaaccccccccgaaccuaguggcggccuuccacggggaccucccgagccuccugauagacuuagcugugaugggucuagagugcaucuucuguacaaauag

SEQ ID NO: 13377 - RNA, 2559 nt, Artificial Sequence
  Description of Artificial Sequence: Synthetic coding sequence
augcucccaaccgaggucccccaaucgcacccaggaccuuccgcucuucugcucuugcaauuguuacugccgccaacuagugccuuuuuuccaaauaucuggucccugcucgccgcuccaggaucgaucacucaccaggacuugaccgaggaggcugcccuuaacgugacacuccagcuguuccucgagcagccgccaccugguagaccaccucuacgucuggaagauuuucuaggccgcacccugcuggcugacgaccuguucgccgccuacuucgguccagguucaucccggagauuucgggcagcucugggagagguuucccgggccaacgcggcacaagacuuccugccuacgucucguaacgacccagaucugcauuuugaugcggaaagacucggacaagggcgagcccgucuugucggugcucugcgggagaccguuguugccgccagagcccuagaucauacucuugccagacaacgcuuaggagcagcucugcaugcccuccaagauuucuacagccacucuaacuggguugagcuaggggaacaacagccccacccccaucuccuguggccacgacaagagcugcagaaccucgcccaaguggccgaccccacguguagugacugcgaagaacuauccugcccucggaauuggcuuggcuucacucugcucacuuccggauacuucggcacccauccccccaagccaccagggaaaugcucccacggcggacacuuugaccgauccuccagccagccaccacggggcggcauaaauaaggauagcaccuccccgggcuucaguccacaucacaugcuucaucugcaggcugccaaacuugcucucuuggccucgauccaggccuuuucccuucugcggagcagacugggggauagggauuucucuagauugcuggauaucacuccugcaagcucacugucguucgugcuggauaccacaggcucuaugggugaggagaucaaugcggcaaaaauucaggcuagacacuuggucgagcaacgacgcgguucuccuauggaaccgguccacuaugugcugguuccuuuccacgacccgggcuucggaccaguguucacaacuucugacccugacuccuucuggcagcaacucaacgagauucaugccuugggagguggcgacgagccugagaugugccugucugcucuacaauuagcccuuuugcauacgccaccacugagcgacaucuuugucuuuacagaugcgaguccaaaagacgccuuccucacuaaucaagucgaaucccuaacucaggaacgccggugccgcguuaccuuccuggucaccgaagacaccaguagaguccaagggagggcccgacgggagauucugucgccacuuagguucgagcccuauaaagccguggcuuuggcauccggaggagaaguuaucuucaccaaagaccaacacauccgcgacguggcggcaauugugggagaaagcauggcugcccucguuacucucccguuggauccuccaguagucguaccaggucagccucucguuuucaguguggacgggcugcugcaaaaaaucacggugcgaauccauggagauaucagcagcuuuuggaucaaaaauccugcaggcgugucacaagggcaggaagaaggggguggaccucucggacauacacgccgguucgggcaauuuuggauggugacaauggacgaccccccccagacugggacaugggaaauucaggucacugcagaagauacacccggcguucgcguacaagcccaaacaucuuuggacuuccuguuccacuuuggcauaccaauggaggacggcccucaucccggccuguauccacugacccagccaguugccggucuucaaacacaguuguuaguggaggucacaggccuagguuccagggcaaaccccggcgauccacaaccucacuucucccacguuauucugaggggcguacccgagggggcugagcucgggcaagucccacuggaaccagucgguccucccgagcgcgggcuacuggcagcuuccuuaucgccuacucuuuugucaaccccacggccauucucucuggagcugauuggucaggacgccgccggucgcaggcugcaucgugccgccccccagccaucuacgguggucccugugcuccuugagcucuccggaccuucagguuuucuggcucccggaucaaaggucccucugucgcugagaauagcuucuuuuagcggcccacaggacuuggaucugcguaccuuugugaacccuagcuucucccuaacuucgaaucugucucgcgcccauuuggagcugaaugagagugccuggggaagacuguggcucgagguacccgauucagcugcccccgauucagucguuauggugacugucaccgcgggaggaagggaggcgaacccuguuccacccacucacgcuuuccuuaggcuccugguuucagccccggcuccccaggugagaaaucauuauuucccaagucaaggcccugcgcaucacccuuaucgauugaucuag

SEQ ID NO: 13378 - RNA, 756 nt, Artificial Sequence
  Description of Artificial Sequence: Synthetic coding sequence
augccacauuuagcaagucuauucacagcuucuucgagguguugcccucauccucucagaccggagggaucaggugcuaugggcccggaagcuuuaucuucuuugcuacuuuugcugcuuguugccucaggagacgccgauaugaaagggcauuuugauccagccaaguguagauacgccuuagggaugcaggaucguaccauccccgauucggauauaucugcuucgucaucuugguccgacagcaccgccgcccgccacuccagguuggaauccucugauggagauggcgcuuggugccccgccggcuccgucuuuccaaaggaagaggaguaucugcagguggauuugcagagacugcaccuggucgcacuggucggaacacaggggagacacgcugguggacuggguaaagaguucucaagaaguuaccgucuucgauauucccgagauggucgccgcuggaugggcuggaaagaucggugggggcaggaaguuaucagugggaaugaagauccugagggaguuguccugaaggaucugggacccccuaugguggcucgacuagugagguucuaucccagagcggaucgggucauguccguaugucuucgaguugagcuguacggauguuuguggcggggggaauggcuaagcuuccugggaaucugcuuucucagccgcgggcuggaaggaggagaauguggcgagugggcaagucggaucccaaguccugcaggcaagcuuucucucuag

SEQ ID NO: 13379 - RNA, 726 nt, Artificial Sequence
  Description of Artificial Sequence: Synthetic coding sequence
augaaauuuauacucuugugggcucuguuaaaucugacugucgcacucgcuuuuaauccugacuacacuguaucaucaacaccaccuuaccuuguauaucuuaagagcgauuaucugccaugcgccgggguccugauucacccccuguggguuauaaccgcugcucauuguaacuugccgaagcugcgagucauccugggcgugacuauuccagcugauucgaacgagaaacaucuucagguaaucggcuaugaaaagaugauucaccacccccacuucaguguuacuucaauugaccacgauaucaugcugauuaaacucaaaacggaagcugaacugaacgacuaugugaaacucgccaacuuaccuuaucagacgaucagugaaaacacuaugugcagcgugucaacuuggaguuacaauguaugcgacaucuacaaggaaccugauucccuccagacagucaauauauccguuaucaguaaaccacagugccgagaugccuauaagacuuacaacaucacagagaacaugcugugugucggcauuguuccugguagaagacagccuugcaaggaagucagcgccgcaccugcgauaugcaaugguauguuacaaggaauuuuaaguuuugcugacggaugugugcucagagcagacgucgguaucuaugccaaaaucuucuacuauauuccauggauugaaaacgucauacagaauaauuag

SEQ ID NO: 13380 - RNA, 1536 nt, Artificial Sequence
  Description of Artificial Sequence: Synthetic coding sequence
auggccaaaggucugagcgugcagaacgauaagcacccuggauaucaaccugcacugcuguugucuccuggcgcuccucuguuugcagauggcccagccuacgcgcuguuacauuuacugcuccacgaaggaaaggccgagauggcagaucaggcagcagccuggcugacucggcagggaucauuccaagggggcuuucggagcacacaggauacaguuaucgcacuggacgcccucucagcguauuggauugcuagucacacaacagaagagagaggacuuaauguuacguugucaucuacaggcagaaauggauuuaaaucccacgcauuacagcuuaacaaccggcagaucagggguuuggaagaagaacuucaguuuucacucggcuccaagauuaaugugaagguuggaggcaauaguaagggcaccuugaaggugcuccgcacauauaauguucuggacaugaagaacaccaccugucaagaccugcaaauugaggucaccgucaagggucaugucgaguacaccauggaggcuaacgaggauuacgaagacuaugaguaugacgaacugcccgccaaagaugauccagacgcuccacuccaacccguaaccccacugcaacucuucgagggacggcguaaccggagacggcgagaggcuccuaaaguaguugaagaacaagagucccgcguccauuacacagucugcaucuggcgcaauggcaaaguggggcuguccggaauggcuaucgccgacguaaccuuguuguccggcuuucaugcccuucgagcugaucucgagaaguuaacaagucugagcgauagauaugugagccacuucgagaccgaaggcccacacgugcuucuuuacuucgacucuguuccaacgucucgagaauguguuggauuugaagccgugcaggaggucccugugggguuagugcagcccgcguccgcuacuuuauacgacuacuauaaccccgagagaagauguucagucuucuauggggccccuuccaagucacggcuguuggcuacacuguguagugccgagguaugccagugcgcagagggcaaguguccucgccaacgacgcgcccuagagcggggccugcaggacgaagacggcuaccgcaugaaauuugccuguuacuacccucguguugaauacggcuuucaaguuaaagugcugagggaggacagccgcgcagcuuuuagacuguuugagaccaagauaacccagguacugcacuuuacuaaagaugucaaggcggcagccaaccagaugcgaaauuuucuggugcgcgccuccugucgguugagacuggaaccgggcaaagaguauuugauaaugggccuagauggugcuacuuacgauuuagagggucacccucaauaucuucuagauuccaacuccuggauagaggaaaugccaagcgagcgguugugcagaaguacccgacagagagcagcuugcgcccaguuaaacgauuuccugcaggaguacgggacacaaggcugccagguuuag

SEQ ID NO: 13381 - RNA, 2067 nt, Artificial Sequence
  Description of Artificial Sequence: Synthetic coding sequence
augcucccaacugaagugccccagucccauccugggccuucugccuuauugcuucuacagcucuuacuacccccuaccucugccuucuuucccaacaucuggagcuuacuggcagccccaggaagcauuacacaccaggaccuuaccgaggaggccgcccugaacguuacacugcagcuuuuucucgagcaacccccccccgggaggcccccacuucgcuuggaagauuuccuugguaggacacuucucgcagacgaccuguucgcagcguauuucggcccaggaaguucacgucgauuucgagccgcccugggcgaaguuucacgggcaaaugcagcucaggauuuccuaccaacuucaaggaacgauccggaucuccacuucgacgcugagagacucggacaaggcagagcccgguuggugggggcccuccgcgagaccgucguggccgcucgggcccuugaucauacacuugcccgacagcgccugggggccgcucuucaugcccuccaggauuucuauucccacucuaacuggguagagcucggugaacaacagccucacccucaucuacuguggccccgccaggagcuucagaaucucgcucagguggccgacccgaccugcagugacugcgaagaacugagcugucccagaaauuggcugggguucacccugcugaccucaggauauuucggcacccaccccccaaagccuccaggaaaaugcucucacggugggcacuucgaucgauccaguucucagccaccuagaggaggaauuaauaaggacucuacuaguccuggguucaguccucaccacaugcuccaucuucaggccgcuaaacuggcccucuuggccuccauccaagcauucucccugcugagaucgcggcugggggaccgcgacuucaguagacuacuggauauuacccccgcgucaagucuuaguuucguauuagacacaacuggcuccaugggcgaagaaaucaacgccgccaaaauccaggcuagacacuuaguagagcagaggcgugggucuccuauggaaccugugcacuaugucuuagucccauuccacgaccccggcuuugguccuguguucacaacaagcgacccagauuccuuuuggcagcagcuuaaugagauucacgcacucgguggaggcgaugagcccgagaugugcuuguccgccuugcaguuggcacuccuacacacacccccauugagugacaucuuuguguuuaccgacgccagcccaaaagacgcguucuuaaccaaccaggucgagucucugacccaggaacgaagaugcagaguuacauucuuagugaccgaagacaccucucgugugcagggaagagcgcggcgagagauacuguccccuuuacguuucgagccguauaaagcaguggcgcuagccagcggaggcgaagucauuuuuaccaaagaucagcacaucagagauguggcagccauuguaggcgaaagcauggcggcccucguaacauugccucuugacccacccgucguugucccuggacaaccgcugguguuuagcguugauggauuacugcagaagauuacugugcgaauucacggcgauaucuccaguuucuggaucaaaaauccugcuggagugagccaggggcaggaagaaggaggcgguccccugggccacacccgccgcuuuggacaauucuggaugguuaccauggaugacccaccccagacgggcaccugggaaauucaggucacugcugaggacaccccgggcguacggguccaagcucaaacgucccucgauuuuuuguuucacuucgggauccccauggaggacggcccacacccaggacuuuaccccuugacucagccaguagcuggacugcagacacagcugcugguggaaucucagucuugggggucgagcgcggccuuucugccuaggcauccuucucgcgguccgcgaggguguagaaccagaccgggagcgcuaggugcucgcgggacguccggcgcuaggaguccacgcucgcuugccgucgcacacgccgcggugcauccauag

SEQ ID NO: 13382 - RNA, 2559 nt, Artificial Sequence
  Description of Artificial Sequence: Synthetic coding sequence
augcugccuacagaagucccacagucacacccaggaccuucugcucuacuuuugcuucaguuacuccucccacccacauccgccuuuuuccccaauauuuggucccugcuagcagcccccggaucaaucacacaccaggaccucacugaggaggcagcccuuaauguuacacugcaauuguucuuagagcaaccaccgcccgggagaccgccuuuacggcucgaagacuuccugggccgcacgcuacuagcugaugaccuuuucgcugcauacuucggaccaggcaguucaagacgguuccgggcugccuuaggagaggucagccgagcuaacgccgcccaggacuucuuaccaaccuccagaaacgaccccgaccugcacuuugaugcagagagacuugggcaagggagggcgcggcuggugggcgcccuaagagagacaguggucgcggcccgggccuuggaucacacccucgcccgucaacgccugggagcagcauuacacgccuugcaggacuuuuacucccauuccaauuggguggaacugggggagcaacagccccauccgcauuuauuauggccacggcaagaguugcagaacuuggcacaggucgcagauccaaccugcagugauugugaggaacugagcuguccuagaaauuggcucgguuucacucuauugacaaguggcuacuucggcacccacccccccaaacccccuggcaagugcagccacgggggacacuuugauaggaguucuucccagcccccucguggcggcauaaacaaggacagcacaagcccaggcuucucgccccaucacauguugcaccuccaggccgcuaagcucgcacuucucgcuagcauccaggcguucagccuguuaaggucaagauuaggggacagggacuucucacgacuucuggauauuacucccgccaguucuuugaguuuuguguuggacacaacaggcucaaugggugaggaaauuaaugcugccaagauucaagcgcgacaucucguugagcagcgacgaggaucgccuauggagccaguccauuauguauuggucccguuccacgacccugguuuuggcccaguuuucacaaccuccgaucccgacucuuuuuggcagcagcuaaaugaaauccaugcccugggugggggcgaugagcccgagaugugccucucagcacugcaacuggcucuucugcauacucccccgcugagcgacaucuuugucuuuaccgaugcgagucccaaagacgccuuccucacuaaucagguggaaagccuaacccaggagcguaggugucgugugacauuucuggugacagaggacacaagccgugugcaaggccgcgccagacgcgaaauucucucuccacugcguuucgaaccuuauaaggccguggcccuggcaucagggggugaagugaucuuuacaaaagaccaacauauaagagauguagcagccauugucggugagucuauggcagcucugguuacacugccccucgaccccccaguuguggugcccggacaaccucuaguuuuuucagucgauggccugcuucagaagauuaccguacgcauccauggugauaucagcuccuucuggauaaaaaaccccgccgggguuagccagggccaggaagagggaggaggcccucucggacauacuagaagauuuggccaguucuggauggucacuauggaugaccccccacagaccggaaccugggagauccagguuacagcagaagacacacccggcguccgagugcaggcccaaaccucacuggauuuucuguuccacuucggcauaccaauggaggaugggccacauccaggccucuacccccuuacgcaacccgucgcgggccugcaaacacaacuguuaguggagguuacaggccugggaucucgggccaacccuggggacccccagccccauuuuucccacgucauucugcgcggggugccugagggggccgagcuaggccaagucccauuagaacccgugggacccccagaaagaggacuguuggcagccagucucuccccuacucuuuugucuaccccucggccguucucacuggagcucauuggacaagaugccgccggaagaagacugcaucgcgcggcuccucaacccuccacaguagugccaguucuguuagaacucucaggcccaucaggcuuucuagcccccgguuccaaagugccuuuaucauuacgcauugcauccuuuucaggaccucaggacuuagaccugagaaccuuugucaauccgucuuucucccucaccagcaacuugagccgugcacacuuggagcugaaugaaucagcauggggacggcuguggcuagaggugcccgauucugccgcccccgacuccguggucauggugacaguuacugcggguggacgagaagcaaauccgguacccccaacccacgccuuccuccggcugcuagucuccgccccagccccacagguucguaaccauuauuucccuagucagggcccagcccaccaucccuaucggcuuaucuag

SEQ ID NO: 13383 - RNA, 1737 nt, Artificial Sequence
  Description of Artificial Sequence: Synthetic coding sequence
augcuucuguugcuacuguuggccccccucuuucuucgcccacccggcgcagggggcgcgcagaccccuaaugcuacauccgaagggugccaaauuauccacccgcccugggaaggugggaucagauacagaggccuaacucgcgaucagguuaaagccauuaauuuccuuccaguagauuaugagaucgaguacguguguagaggcgagcgcgaagucguugguccuaaaguaaggaaaugucucgcaaacggcuccuggaccgauauggacacuccuaguaggugcguuagaauuugcagcaaaucuuaccugacacuugagaauggcaagguguuucucaccgguggugaccugcccgcauuagacggcgcuaggguggacuuccggugcgauccagauuuucauuuaguuggaagcagucggagcauuugcucucagggccaguggagcacucccaagccgcacugucaagugaauagaaccccucacucugaaaggcgggccgucuauauuggcgcccucuuccccauguccgggggcuggcccgggggucaagcaugucagccagccguggagauggcccuggaagauguuaacagccgccgcgauauccugccagauuacgaauuaaagcugauucaucaugauucuaagugugaucccggucaagcgacaaaauaccucuaugaguugcuauauaaugauccgauuaagauuauccucaugcccggcuguucuucaguaucaacacugguggccgaggcugccagaauguggaaccugaucguccuuuccuauggcaguucaucaccugcucucaguaaucgccaaagguucccgacauucuuccggacgcauccuucugcuaccuugcacaacccuacacgagugaaacuguucgaaaaguggggcuggaaaaaaaucgcaacgauccaacagaccacugaagucuuuacauccacucuugacgauuuggaagaacgggucaaagaggcgggcauagaaauuacguuucgacagucuuucuucucugauccugcaguucccgugaaaaaccucaaaagacaggaugcucguauuaucguuggacuuuucuaugaaaccgaagccagaaaaguuuuuugcgaaguguacaaagagagguuguuugguaaaaaauaugucugguuucugaucggaugguacgccgacaacugguuuaagauauacgacccaaguaucaauuguacaguggaugaaaugaccgaggccguugaggggcacauuaccacagagauugucauguuaaacccugcuaacaccagguccaucucuaacaugacaagucaggaauucguugagaaacucacaaagcguuugaagaggcacccugaggagacuggaggauuccaggaggcaccccuggccuacgacgcaaucugggcuuuggcccuggcgcucaauaagaccagcgggggcgguggccgaucaggcguccgacuagaggauuucaacuauaacaaccaaaccaucacagaucaaauauaucgcgccaugaacuccuccaguuucgaaggcgucucagggcacgugguuuucgaugcgucaggcucaaggauggccuggacccugauugaacaguugcagggugguucuuauaagaaaauuggguacuaugacaguacaaaggaugaucugagcuggagcaagacggacaaguggaucgugaucaguagaacccauucaccuacuuag

SEQ ID NO: 13384 - RNA, 1326 nt, Artificial Sequence
  Description of Artificial Sequence: Synthetic coding sequence
auggaguuugaauucgacagacuuagagcguuccaggcgaugcagguccauuguaauaauaugcauacacugggcgcacggcugccugggggcguggagugcagauucagaaggggacccgcgauggccugggaaggggaaccaaugaggcacaaccugggcggaaaccugggugauccaagggccagggcaguuucggugccucuaggaggacgaguggcacguuuccugcagugucgguuccuguucgcagggccuugguugcuguucuccgaaaucuccuuuaucucagaugugguuaacaacuccagccccgcccucggagggacuuuccccccagccccaugguggccaccggguccuccucccacaaacuucuccucacuggaacuggaaccacgcggucaacagcccguugcaaaagcugaagguucccccaccgccauccugauaggcugucugguagccaucauccugcuuuugcugcuaauuauagcgcugaugcuuuggcgacugcacuggcgccgucugcuuagcaagguacuagagucacauccgcgaacaagaucucccggcuuaguaggcauacgccccacccccuugcccgugaguccgauggcacuccgaugcuguagccccauucaacccaccgccuccuucuggccauuaaccccagucccgcuugaggcgcgcgcgccgccgcacccccccggacccaacccccccacaccgaggggugucacugggggaaauacauacgcugugccugcucugccccccggcgcuguuggagacggacccccaagaguggauuuuccaagaucaagacugcgauucaaggagaagcucggugaaggccaguuuggcgaaguacauuugugugaaguggauagcccucaagaucuggugucuuuggauuuuccccuuaauguaaggaaagggcacccucuacuuguggccgugaagauacuacgccccgacgcaacuaagaacgcucguaaugauuuucugaaggaagucaaaauuaugucucgauugaaggaccccaacauuaucaggcucuugggggugugugugcaagacgacccccugugcaugaucacagauuacauggagaacggagaccugaaucaguuuuugucugcgcaccagcuggaggacaaggccgccgagggcgcucccggagauggacaggccgcccaggguccaaccaucuccuaccccaugcuccugcacguugcggcgcagaucgcaucaggcaugcgcuaucucgcaacucucaauuucguccacuucuggggagaaagacaucgcuuccugcacuag

SEQ ID NO: 13385 - RNA, 2685 nt, Artificial Sequence
  Description of Artificial Sequence: Synthetic coding sequence
augucauugccacguugcuguccgcaccccuuaaggccagaagguaguggcgccaugggaccugaagcccucagcucucuacuccuacuguuguugguggcaagcggagaugcugauaugaaagggcacuuugauccugccaaaugccgguaugcucuuggaaugcaggaccguacuauaccugacagugacaucagugcuuccagcuccugguccgauuccacugccgcucgucauucacggcuggagaguucagauggugacggcgcauggugcccagccggauccgucuuuccgaaagaagaggaguauuuacaggucgaccuucagcgccugcaccucguugcgcuggucgguacgcaggguagacacgcugggggacuugguaaagaauuuagccgcucuuacagacuaagauauucacgggauggcaggcgguggaugggguggaaagaucgcuggggacaggaagugauuuccgguaacgaagauccugaaggcguugugcugaaagauuuagggccccccauggucgcgagacucguaagguucuauccccgcgcugaccggguuaugagcguuugccugcgaguggaguuguaugguugcuuguggcgugacggcuugcugaguuauacugcacccgugggacagacaauguacuuaagugaggcgguguacuugaacgacuccacauacgauggacacaccguuggcggcuugcaauacggcggccugggucaguuagccgauggugugguugggcuugaugauuuccggaaaagccaggagcucagaguuuggcccggcuacgauuauguugguugguccaaucauuccuuuuccuccggcuauguugagauggaguuugaguuugaccggcugagagcauuucaagccaugcagguacauuguaacaauaugcacacacugggugcccgcuugcccggugguguugagugccgguuccggaggggcccugccauggcuugggagggagaacccaugagacacaaucugggcgguaaccucggcgacccuagggcucgugccgucagugucccccucggcggaagggucgcccgguuuuugcagugcagauucuuauuugcugggcccuggcuccuguuuagcgaaauuucuuuuaucagcgacgucguuaauaacuccuccccagccuugggggggacuuucccaccugcuccgugguggcccccuggaccaccucccacgaacuuuagcucccuggaacuggaaccgagaggccaacaacccgucgcgaaggccgaagguuccccuacggccauucucauaggcugccuggucgcaaucauucuccuucugcugcuuauuaucgcucuuaugcucuggcgccuucauuggaggagguugcucagcaaggcugagagaagggugcucgaagaggaguugacuguccacuugucaguuccgggcgauaccaucuugauuaauaaccggccugggccaagggagccuccaccguaccaggagccacguccucggggcaauccaccacacucagcccccugugugcccaauggaagugcauacucaggcgauuacauggagccugaaaagccuggagcgccccugcugccuccccccccucaaaacagugugccgcacuaugcagaagcugauauugugacccugcagggggugaccgguggaaauacauaugcuguuccugcccugccuccaggcgccgucggggacgggccacccaggguugacuuuccaagaucccgguugcgguucaaagagaaacugggcgagggacaguucggagaagugcaucucugugaagucgacaguccccaggaccuuguaucucuggacuucccacuaaacguccgcaaggggcacccauuacugguggccgugaagauccugcgacccgacgcuaccaagaaugcacggaacgacuuccugaaagagguuaaaaucaugagcagacuuaaagacccaaauauuauucgccugcugggcgugugcguccaagacgacccucugugcaugauuacagacuauauggagaacggcgaucugaaucaguuccucucugcccaucagcuggaggauaaggcugcagagggggcccccggagacggacaggccgcacagggccccaccauuucauauccgauguugcuacauguggccgcucaaauugcuuccggcaugcgauacuuggcgacacuaaauuucgugcauagggauuuggccacccgaaauugccuaguuggcgaaaacuuuacaauuaagaucgccgauuucgguaugucccggaaccuguacgcaggcgauuacuaccgugugcagggccgugcagugcuccccauuagauggauggccugggaauguauccugaugggcaaguucacgaccgcaucugauguuugggcuuuugggguuaccuuaugggagguacugaugcugugcagagcucaaccguucggccaacugacagaugaacagguaaucgagaacgcaggggaguucuuuagagaucagggccgacaaguuuaccucuccaggccucccgcuugcccucagggacuuuaugaacucaugcugagguguuggucuagagagucugagcaacgcccgcccuuuagccagcugcaucgauuccuggcagaagacgcacucaauaccguuuag

SEQ ID NO: 13386 - RNA, 216 nt, Artificial Sequence
  Description of Artificial Sequence: Synthetic coding sequence
augccugccggcgugccuaugucaacuuaucucaaaauguuugccgcaagccuuuuagccaugugcgcgggcgcugaagugguccaccgguauuaccgccccgaccuaacgauccccgaaauccccccuaagagaggggaacucaaaaccgaacugcucggccucaaagagagaaagcacaagccacaggugucccaacaggaagagcucaaguag

SEQ ID NO: 13387 - RNA, 2760 nt, Artificial Sequence
  Description of Artificial Sequence: Synthetic coding sequence
augggccccgaggcucuaagcucuuugcuccugcugcuguugguggcuuccggugaugcugauaugaagggacauuucgacccugcaaagugcagguaugcucuggguaugcaggaccggacuaucccagauagcgacaucagugccucaagcuccugguccgacuccacagcggcacgccauucccgacuagaauccucugacggcgauggagcauggugcccagcugggaguguauuucccaaagaagaggaguaccuccagguggaucugcagcgacugcauuuaguagcucuugugggcacccaagggcggcaugcuggaggacuugggaaggaguuuucccgcaguuacagacucagauauucucgagauggaagacgcuggaugggauggaaagauagauggggacaagaaguuaucaguggcaaugaggaccccgagggggugguacucaaagaccuaggccccccaaugguggcccgccucgucagauucuacccaagggcagauagagugaugagcgugugucugagagucgaacuguacggaugccuguggcgugauggccugcuauccuacaccgccccuguagggcagacaauguacuugagcgaggcaguguacuugaacgacucuacuuaugauggucauacaguggguggccuccaguauggaggcuugggccagcuggccgacggaguggugggccuggaugacuuucggaagucucaggaguugagaguguggccaggauaugauuaugugggguggaguaaucacuccuuuucgaguggauacguggaaauggaauuugaauucgacaggcugcgcgcauuucaagcuaugcaggugcacuguaacaacaugcauacacucggagccagacugcccggagggguagaauguagguuucgcagaggaccugcgauggcuugggaaggcgagcccaugcggcauaaccugggagggaaccuaggagauccucgagcucgcgccgucucugugccacugggggggagaguggccagauucuugcagugucgcuucuuguucgccggaccuuggcugcuguucagcgagauaaguuucauuagcgacguaguuaacaauucauccccagcacuggggggaacauucccccccgccccaugguggccaccuggcccuccaccuacgaauuuuucgucucuggaacuggaacccagaggccagcaaccuguggccaaagcugaaggcuccccuacagcgauucuuauuggguguuugguugccauuauccugcuucuccuccugauaauagcccugaugcuguggaggcuccauuggagacggcuucuguccaaggcugagagacguguucuugaagaggaguugaccgugcaccuuagugugcccggcgauacuauacugaucaauaaucggccaggcccccgcgagccccccccuuaccaggaaccccgccccaggggcaaucccccgcacuccgccccuugcgucccuaacgguucugcucugcuucugucaaauccugcuuaccgucuguugcuugcuacauaugcgcgcccaccacgggguccaggccccccuaccccagccugggcaaagccaacuaauacccaagcguauucuggcgauuacauggaaccugagaaaccuggcgccccgcugcuccccccaccuccacagaauuccguaccccauuaugccgaagccgauauugugacccugcagggagugaccggcggcaauaccuacgccguacccgcccuuccuccuggagccguuggagacggucccccccgagucgacuuuccccgaucacggcuucgauucaaggagaaacugggcgagggccaauuuggugaaguucaucugugugaaguugauagcccccaggaucugguuucacucgauuucccacucaaugugagaaaaggccauccccucuuaguggccgucaagauccugaggccagaugcuaccaaaaacgccucauuuucacuguucucuaggaacgacuuccucaaagaaguuaaaauuaugucuaggcuaaaggauccuaauauaauacgccuacucggggugugugugcaggacgacccucuuugcaugauuaccgauuauauggagaauggcgaccugaaucaguuucuuagcgcccaucagcuggaagacaaagccgcagagggagcccccggggauggacaagcggcccaggguccaaccauuagcuauccgaugcuccuucauguggccgcucagauugccucggggaugagauaccuggcaacgcugaacuucgugcaccgagaucucgccaccagaaacugcuugguuggcgagaauuucacuaucaagaucgccgauuucgggaugucuaggaaucuguacgccggcgacuauuaccggguucagggcagagcugugcuuccaauccgguggauggcaugggaguguaucuugaugggcaaguuuaccaccgcaucagacgugugggccuucggggugacacuaugggagguauugauguuaugcagagcucagcccuuuggacagcugacugaugagcaaguuauagagaacgcuggggaguuuuucagggaucagggacgacagguguaucucuccaggccuccugcuugcccacaagggcucuaugaauuaauguuacguuguuggagccgcgaauccgagcagagaccccccuuuucacaacugcaccgcuuucuugcggaggacgcuuugaauacaguuuag

SEQ ID NO: 13388 - RNA, 447 nt, Artificial Sequence
  Description of Artificial Sequence: Synthetic coding sequence
augcaaacuuuucccguugccggagccuuggaccccgcgauccuggauacuuccuccccgcaggcccuauacacaguguuauugauuguccuugugaugaugucacuuguguuuggcaaguucgugccagugaauugggagcccccgcagccguugcccuuucccaaauaccugcgcugcuaucguugucuccuugaaacaaaagagcuuggaugccugcucggcagcgacauuuguuugaccccagccggcucauccugcauaacccugcacaagaagaauagcagugggucagacguuauggucucugauugccgcucuaaagaacagaugagcgauugcucgaauacccgaaccucucccgucucuggauuuuggaucuucucacaauacuguuuccucgauuuuugcaacgacccccagaauaggggccucuacacaccuuag

SEQ ID NO: 13389 - RNA, 5097 nt, Artificial Sequence
  Description of Artificial Sequence: Synthetic coding sequence
augcggcuacuuuggggacucaucugggccaguucuuucuucaccuuaagccugcagaaaccucggcuguugcuguucagcccaucagugguccaucucggcgugccacugagcguggguguacaauugcaagauguuccccguggacagguggugaaagggucgguguuccuccgcaauccuuccagaaacaauguaccauguucgcccaagguagauuuuacccucuccuccgagcgggacuucgcacuccugagucuucaggucccucuuaaggaugcgaaaagcuguggucuccaucagcuucugagagggccagaaguucagcugguugcacacucccccuggcugaaggacucacuuuccagaacaaccaauauucagggcaucaaucuucucuucaguuccagacgaggccacuuauuucuccagaccgaucagcccauauauaacccgggccagcgagugcguuauaggguguuugcauuagaccagaaaaugcgcccaaguaccgauacuaucacugugaugguggaaaacucccacgggcuuagaguccggaaaaaggaaguguauaugccaucuaguaucuuccaggacgacuuuguaauaccugacauuucagaacccgggacguggaaaauuagugcccgguuuagugacggccuggaauccaacucuuccacccaguuugaagugaaaaaguacguacugcccaauuucgaagucaaaaucacaccgggcaaaccuuauauucuuacugugccaggucaucuggaugaaaugcagcucgauauccaagccagguacauauacggaaagccugugcagggcguagccuacgucagauuuggacugcucgacgaggacggcaagaagacguucuuccgcggucuagaaucccagaccaagcuugugaauggccagucccacaucucauugagcaaggcagaauuccaagaugcucuggagaaacuaaauaugggaauaacugaucugcagggucuacgucuauauguggcagcggcuauuauugaguaucccgguggggagauggaagaagccgagcugaccagcugguauuucgugagcucacccuucucucuggaucucuccaagaccaagcgacaccuggugccaggagccccauuccuccugcaagcucugguucgcgaaaugagcggcucaccugccuccggaauuccugugaaggugagcgcaacagucagcagucccggaucuguucccgagguacaagacauucagcaaaacacagacggcucuggacaggucucuaucccaauuauuauuccucaaacuauuuccgaacugcaacugagugugucugcagggaguccucacccagcaaucgcgagacuuacaguugccgcuccaccaaguggaggcccaggguuccugaguauugaacgcccugacucccgcccuccucgggugggcgauacacugaaccuuaauuugagagcugugggcaguggggcuacuuuuucccauuauuauuacaugauucuaaguagaggccagauuguuuucaugaaccgcgagcccaagaggacauugaccucagugagcguguucguagaccaccaccuugcccccagcuucuacuuugucgcguuuuacuaucacggagaccaccccguugccaauagccuacgcgucgacgugcaggccggagcgugugaggggaagcuugaacuuuccguggacggagcaaagcaguaccggaacggggagucagugaagcuccacuuagaaacugauucacuugcucuuguggcccucggcgcgcuggauaccgcacuguacgccgccggguccaaaagccauaagccucuuaacaugggcaaggucuuugaggccaugaacaguuaugaucuggguugcgguccaggcgggggggauucggcgcugcaaguguuucaagcagccgggcuggcuuucucugacggagaccaguggacccuuucucguaagcggcucuccugccccaaggaaaaaacuacccgcaaaaagcgcaaugugaauuuccagaaggccauuaaugaaaaacucggccaauacgcuucccccacagcaaagcgcuguugucaagacggggugaccagacugcccaugaugcguaguugcgagcagcgugcugcucggguccagcaaccugauugccgggaaccauuucuaagcugcugucaguuugcggagucacuccgcaaaaaauccagagauaaaggacaagcgggauuacagcgcgcucuggaaauccugcaggaggaagacuuaauugacgaggaugauaucccgguccgaucuuucuuuccggagaacuggcuuuggcgcguagagacuguggacagguuccagauuuugacuuuguggcugcccgauagccugacaacaugggaaauccauggucucucgcuuucuaaaacaaaaggcuuguguguggcuaccccuguccagcugcgcguguuuagagaguuccaucugcaucuucgccuuccaaugagugugcggagauuugaacagcuagaacugaggccgguucucuacaacuacuuggauaaaaaccucacagugucaguucaugucucuccgguggaaggccugugucuggcagggggggguggacuggcacagcagguccuaguuccugcaggcucagcucgcccagucgcauuuaguguagugccaaccgcagcagcugccgucagucucaagguugucgccagggggagcuuugaauuuccggugggcgacgcagugucaaaaguucuccagaucgagaaggagggagcaauacaccgugaggaguuggucuacgaacucaacccccuggaucaucgcgggaggacccucgagauuccugggaauagcgacccaaauaugauuccggacggagacuuuaacuccuauguccgggugacugcuucugauccucuggacaccuugggcucugaaggcgcccugagucccggggggguggccucgcuacuccgacugccuaggggauguggugaacagaccaugaucuaucuggcuccaacucuggcugccuccagauaccuagauaagaccgagcaguggagcacuuugccuccagagacuaaggaccaugcaguagaccucauccaaaaaggauacaugcgaauccaacaguucaggaaggccgacgggagcuacgccgcuuggcugagcagaggaagcucuacguggcugacagcuuucguauuaaaaguguuaucccuugcccaagaacagguuggcggcucuccagagaaacugcaggagaccucgaacuggcugcuaucacagcagcaagccgacgggucuuuccaggaucucuccccugucauccaucgcuccaugcaggguggacuugugggaaaugacgaaacagucgcucugaccgccuucguaacaaucgcgcugcaccacggccuggccguauuccaggacgaaggggccgaaccacucaaacagcguguggaagccucgaucuccaaggcauccagcuuucugggagagaaggcuucagcgggacucuugggugcccacgccgcagcuauaaccgccuaugcccucacacucacuaaagcgccagcugaucugagaggagucgcacauaauaaccucauggccauggcccaagaaaccggcgacaaccucuauuggggcucugugacaggaucucaguccaacgcagucucgccuaccccagcuccacgaaauccaucagacccuaugccccaggcacccgccuuauggaucgagacaacagcauacgcucuccuucaccuccuccuucacgaggggaaagcugaaauggccgaccaggcggccgccuggcucacucggcagggaaguuuccaagguggcuuuagaaguacacaggacaccguuaucgcguuagaugcgcuaucugcauacuggaucgcuucucacaccacugaagagaggggacugaacgucacguugagcucgaccgggaggaauggguuuaagagccacgcucuucaguuaaauaauagacagaucaggggguuagaggaggagcuccaguuuucucugggcucuaagaucaaugugaagguaggagguaacagcaaaggaacccugaaagugcugagaacauauaaugugcucgauaugaaaaacaccaccugccaggaccugcaaaucgagguuacuguuaagggccacguggaguauacgauggaggccaaugaagauuacgaggauuaugaguaugacgagcuaccagcuaaagaugacccagacgcaccccuucaacccguuacaccccuccaacuguuugagggacggagaaaucggaggagacgcgaagcgcccaaacugacgucccugagugauagauaugucucccauuucgaaacagaaggcccacacgugcugcuguauuuugauaguguccccacgucucgggaaugugucggcuucgaggcugugcaggaagucccagugggcuugguccaaccagcauccgccacucucuaugauuacuacaacccagaacgccgauguagcgucuucuauggugcaccauccaaaucccgccuucuagcaacucugugcucagccgaaguuugccaaugugcagagggcaagugcccccgccagagaagagcccuggagcgcggacuccaagacgaggacggauaccggaugaaguuugcuuguuacuacccuagaguugaguacgguuuccagguaaagguacuaagagaggauagcagggcggcuuuucgccuguuugagaccaaaaucacucagguccuacacuuuacaaaggacgugaaggccgccgccaaucaaaugcgcaauuuucugguccgcgccucuugccguuugagguuggagccuggcaaagaauaccucaucaugggcuuggacggcgcuaccuacgaccuugaggggcauccccaguaucuucuggacucaaauaguuggauagaggagaugccgucugaaagacucugccgaagcacucgccagagagccgcgugcgcucagcucaacgauuuuuuacaggaguacgggacccaggggugucagguuuag

SEQ ID NO: 13390 - RNA, 1986 nt, Artificial Sequence
  Description of Artificial Sequence: Synthetic coding sequence
auggacuuaguucugaagaggugcuuguuacaccuggcaguuauuggggccuuacuggcugugggcgccaccaaagugccaaggaaucaggacuggcugggcguaucccgccaguugcguacuaaagcuuggaaucggcaacuauaccccgaguggacagaggcucagagauuagacuguuggcggggaggacaagugucccuuaagguauccaaugacggucccacccuaauaggagccaacgcauccuucucuauugcuuuaaacuucccagggucacagaaggugcugccagauggccaagugauuugggucaauaauacaaucauaaauggaagucaggugugggggggccaaccuguguauccccaggaaacugaugaugccuguauuuucccugacggaggaccaugcccgagcggaucuuggucucagaagcgcaguuuuguguacguauggaagaccuggggucaguauuggcaggugcugggaggccccgucucugggcuuagcaucggaacaggccgggcaaugcuuggaacucacacuauggagguuaccgucuaccacaggcgcggaucaaggucguacgugccacucgcucacucauccuccgccuucaccauuacugaucagguaccguuuagcguauccgucucccagcugagagcccuugacggggguaauaagcacuuccuaagaaaucagccacucaccuuugcguugcaguugcacgauccgucgggcuaccuugcggaagcagauuuauccuauacaugggacuucggggacuccagcgggacccucauuuccagagcccuggucgugacacauacauaccuggaaccuggcccaguuacagcccaaguggugcugcaggcagccauacccuugacuaguuguggcuccucuccgguacccgggacgacugacggacauagaccuacugcagaggcaccaaacacuaccgcagggcaggugcccacaaccgaggugguggggacaacucccggacaggcacccacagcugagcccucaggaacuacguccgugcaaguucccacaacagaggucauuucuaccgcccccgugcagaugcccacugccgaguccaccgggaugacuccggagaaggucccaguuuccgaagugaugggaacuacauuggcugagaugagcaccccagaggccaccgggaugacucccgcugaggucaguaucguggugcuuucugggacgacugcugcucagguaacgaccaccgaauggguggagaccacugcgcgugaacugccgauuccagagcccgaggggccugacgcuagcagcauuauguccacagagucuaucacaggaaguuugggcccacuuuuggacggcacagccacccuucggcucgucaaacgccagguaccucuugacugugugcuguaucgauacggaucuuucucuguaaccuuggauauuguccagggcauagaguccgcugaaauccuucaagcugucccauccggcgaaggcgaugccuucgaacugacuguauccugucagggcggacuucccaaagaggccugcauggagauuagcagcccggguugccagccuccugcccagagauugugccagccaguccugccgucacccgccugccaacucguucuucaucagaucuuaaaaggcgggucugggaccuacugucugaaugugucacucgccgacacuaacucccucgcuguggugucgacccagcugauuaugccaggacaggaagccggccucgggcagguaccacucaucguagggauccuccucgucuugauggcagugguccucgccagucuaauuuacagacggcggcugaugaaacaggauuuuucagugccccagcugccccauucuucaucucacuggcuccgccucccccguauuuucugcucuugcccuauuggagaaaauaguccccuacucagcggacagcaggucuag

SEQ ID NO: 13391 - RNA, 516 nt, Artificial Sequence
  Description of Artificial Sequence: Synthetic coding sequence
augagacauaaucuggggggaaaccugggcgacccgcgcgcccgcgccgucuccgugccauuagguggacgcguagcucgguuucugcagugucgcuuucucuuugcugggccauggcugcuuuuuagugagauaagcuuuauaagugacgugguuaauaauaguucucccgcccucggcggcacuuucccacccgccccaugguggcccccuggcccuccuccaacgaacuucagcucuuuggagcucgaaccacgcggccagcaaccuguugcuaaagccgaaggcaguccaaccgcuauucuaauuggaugccuuguggcuauuauacuccugcugcuguuaauaaucgcacugaugcuguggcgauugcacuggaggaggcuccucucuaagguccuagagucacacccccgaacaaggaguccuggacuggucgguauuagacccaccccucuuccugucucuccaauggcacucguccaccucugcgaagucgacucuccucaggauuag

SEQ ID NO: 13392 - RNA, 1986 nt, Artificial Sequence
  Description of Artificial Sequence: Synthetic coding sequence
auggaccucgugcuuaaacgcugucuucugcauuuagccguaaucggagcgcuucucgccgucggagccaccaaagucccccggaaccaggauuggcucggcgugucgcggcagcugcgcacgaaggcuuggaauagacagcuauauccggaauggacagaggcgcagcggcuagacuguuggaggggcggacaggucagccugaaagugaguaaugauggcccuacccuuaucggagcuaaugccucuuuuagcauugccuuaaauuuuccagguucgcagaaagugcuuccugauggacaggucaucugggugaacaauaccauaauuaauggaucccaggucugggggggccaaccaguguacccucaggagacagacgacgcuuguauauucccagacgguggcccguguccauccggcuccuggucacagaagaggucauuuguauauguuuggaagacuuggggacaguauuggcagguauuagggggcccugucucuggccugucaaucggaacgggccgggcgaugcuggguacucauacuauggaggugacaguuuaucaccggcggggcuccagaucuuacguuccucucgcucauagcagcagcgcuuucacaauuacugaucagguucccuucucgguuaguguuucacagcugagggcacuggacggcgguaacaagcauuuucuuagaaaccagccuuuaacuuuugcucugcaacugcacgaucccucuggcuaucucgccgaagcugaccuuucauauacaugggauuucggagauagcuccggaacacuuauuagucgggcgcuuguagugacucacacuuauuuggaaccuggaccgguuacugcccagguaguuuuacaggcagcuaucccccucacaagcugcggaagcagcccagugccuggaacuacggauggccaucgcccaacugcagaagccccuaacacuaccgcaggccaaguuccuacuacagaaguggucggcaccaccccuggucaggcaccuacagccgaaccgaguggaacgaccuccgugcaaguccccacaacugaggugaucucaacugcaccggugcaaaugccuaccgcagaaagcacagguaugacccccgaaaaagucccuguuuccgaagucaugggcacuaccuuagcagaaaugagcaccccagaggcaacagguaugacacccgcagagguuaguauugugguucucucugguaccacggcagcucaggugacuaccaccgaguggguagaaaccaccgcacgcgaacuaccuauuccugagccugagggcccugacgccucgagcauaaugagcaccgaguccaucacagggucauuggguccccuccucgacggcacagcaacacuaagacuggugaaacggcaggugccgcuggauugugugcuguaucgguauggcuccuucagcguaacccuugauaucguucaggguaucgaaucagccgaaauuuugcaggcuguaccaaguggagaaggcgacgcguuugaguugaccguuucaugccagggaggucugccuaaggaagcaugcauggagauuucuaguccuggcugccagccccccgcacagcgccuuugccaaccggugcugcccaguccggcuugccaacugguacuccaucagauucugaaaggcgggucaggaacauacugcuuaaacguaucauuggcagauacgaacucccucgcugucgucucuacccagcugaucaugcccggccaggaagcugggcuggggcagguaccccuuauagugggaauccuccugguccugauggcgguggugcuggcgucccucauuuaucgucggaggcuuaugaaacaagacuuuuccgugccccaguuaccccauucuucuucucauuggcucagacucccccggauuuucugcuccugccccaucggcgaaaauagcccucuccuguccgggcagcaggucuag

SEQ ID NO: 13393 - RNA, 1737 nt, Artificial Sequence
  Description of Artificial Sequence: Synthetic coding sequence
auguugcugcuuuuauuguuggccccccucuuucugagaccgcccggcgccggcggcgcccagacccccaaugccaccagcgagggaugucaaauuauccauccaccaugggaaggcggcauucgguaccggggccugacucgggaucagguuaaagccauaaacuuccugccagucgauuacgagaucgaauaugucuguaggggagaacgugagguggugggcccaaaagugaggaagugucucgccaacggguccuggacagacauggauacaccuucuagaugcgugcggauaugcuccaaauccuaccucacauuggagaauggaaaaguguuucuaacagggggggaucuacccgcuuuggauggggcacgugucgacuuccgcugugauccagacuuucaccucguugggagcagucgaucuauaugcagucagggucaaugguccacccccaaaccccauugccaagugaaucgcacaccccacuccgaaagaagagccguauacaucggugcucuguucccuaugagcggcggguggccaggcggccaggcgugccagccagcuguugagauggcccuugaggacgucaacucucgccgugacauucugccagacuacgaauuaaagcuuauacaccacgauagcaaaugugaccccggacaggccacaaaauacuuauaugaguuacuauauaaugacccuauaaagauuauucugaugccagguugcaguucuguuagcacccugguugcugaggcugcacguauguggaaccugaucguccucuccuauggcagcagcagccccgcuuuguccaaccgccagcgcuuuccaacauuuuuuaggacucauccuucagccacucuacauaacccaacgcgugucaaacucuucgaaaaguggggauggaagaagauugcaacuauucagcaaaccaccgagguuuucacguccacacuggaugaccuugaagaaagggugaaagaagcaggcauugagauuacguucagacaguccuucuucagcgauccagcagugcccgugaagaaucugaaaagacaggaugccaggauuauuguagggcucuucuaugaaacugaggcucgcaagguguucugcgaaguguacaaggagcgcuuguucggaaagaaguaugucugguuucugaucgguugguaugcugacaacugguucaagaucuaugacccuuccaucaacugcacgguagacgagaugacagaggcaguugagggacacauuacuaccgagauugugaugcucaacccugcaaacacuagauccauuuccaacaugacaucacaggaguucguggaaaaacugacuaagagauugaagcgucaucccgaagaaaccggcgguuuucaagaggcccccuuggccuacgacgcuauuugggcccucgcccuggcucugaauaagaccucaggagguggagggagaucuggagugagguuagaagacuuuaacuacaauaaccaaaccaucacagaucagaucuaucgcgcgaugaauucuucaucguuugaaggagucagcgggcacgucguguuugacgccagcggaucccgcauggcuuggaccuuaaucgaacaauugcagggggguuccuacaagaaaauaggauacuacgacagcaccaaagacgauuugucguggucuaaaacagauaaguggauugucauuaguagaacacauuccccuacguag

SEQ ID NO: 13394 - RNA, 1326 nt, Artificial Sequence
  Description of Artificial Sequence: Synthetic coding sequence
auggaauucgaguucgaccgcuuacgggcguuccaagccaugcaggugcacugcaauaacaugcacacucuuggggcaagauugccuggcggcguugagugcagauuucgccgggggccagcaauggccugggaaggcgagcccaugagacacaaccugggcggcaaucuuggagauccaagggccagggcgguaucugugccauuaggugggagaguggcuagauuuuuacaguguagguuuuuguucgccggaccguggcugcuauucucugagaucuccuuuaucuccgacguagugaacaauuccucuccagcuuuaggagggacauuuccacccgcccccugguggccaccggggccccccccaacuaauuucagcaguuuggaacuggaaccccgaggccaacagccaguagccaaggcagaaggaucucccacagccauacuuaucggcugucugguggcaauuauacugcugcuccuccugauaaucgcucucaugcuuuggcgacuucacuggcggaggcugcuuucuaaagugcuggaaucacauccgcggacgcgaucaccugguuuagugggcauucgccccaccccuuugcccguaagcccuauggcgcuacgauguuguagcccaauacagcccacugcuaguuucuggcccuuaacuccggugccccucgaggccagagcaccgccccauccuccuggcccgaauccuccuacaccccgcggcguuacaggcggaaauacuuaugcaguuccagcccugccuccuggagcagucggggaugggcccccuaggguggauuucccccgaucuaggcugcgguuuaaggaaaaguuaggagaagggcaguucggcgaaguucaccugugugaggucgauucaccccaggacuuaguuagucuggacuuuccacugaacgugcgaaaagggcauccguugcucgucgcugugaagauacugcgucccgaugccacaaagaacgcuagaaaugauuuccucaaggaggugaagauuaugagcagacucaaggaucccaacauuaucaggcuuuuaggcgucugcguccaggacgaccccuugugcaugauuacugacuacauggagaacggagauuugaaccaguuucuaagcgcccaccagcucgaagauaaagccgcugaaggcgccccgggugauggacaggcugcgcaggggccaacaaucagcuauccuaugcuuuugcacgucgcagcccagaucgcaucuggcaugagauaccuggcgacccugaauuucguucacuucuggggagaaagacaccgcuuccuucacuag

SEQ ID NO: 13395 - RNA, 447 nt, Artificial Sequence
  Description of Artificial Sequence: Synthetic coding sequence
augcagacauuuccuguagccggcgcccuggacccagccauccucgacaccuccagcccccaggccuuauauacaguauuacuaaucguucucgugaugaugagccuuguuuucggaaaguuugucccaguuaauugggagcccccccagccccuaccauuccccaaauaucugagguguuauaggugccucuuggagaccaaggaauugggaugccuacuuggaagcgacaucugucucacucccgcuggaagcucauguauuaccuugcacaaaaagaacucaucaggcucugacguaaugguguccgacugccguagcaaagagcagaugucagacuguagcaauacccgcacuuccccugucagcggcuuuuggauuuucucacaguacuguuuucucgacuucuguaacgacccucagaaccggggacuuuacacucccuag

SEQ ID NO: 13396 - RNA, 732 nt, Artificial Sequence
  Description of Artificial Sequence: Synthetic coding sequence
augggccccgaagcccucaguuccuuguugcugcuuuuauuaguugccucaggugacgccgauaugaaaggacacuucgaucccgcaaaaugccgguacgcccugggcaugcaagaccguacgauuccagacagugacaucagugcuucuaguucauggagcgauuccacagcugcccggcacucgcgucuugaaagcuccgauggcgacggcgcuuggugucccgccggaagcguuuuucccaaagaggaggaguaccuccaaguugaucugcagaggcuccaccucguggcgcucgucggcacgcaggggagacaugcagguggccuggguaaggaauucucgagaucauauagacucagauacucacgagacgguagaagauggaugggcuggaaagacagguggggccaggaggugaucagcgguaaugaagacccggaaggggucguccugaaagaccuggggcccccuaugguggcucgacuggugcgcuucuauccgcgagccgacagagugaugucagucugucucaggguagagcuguacggcugcuuauggagggacugcaguaugggugucugggccuccuggcagauggugugguggggauggaugacgcugggacgaguccggaguugcgggagcggacaggcuaugacuaugugggauggagccacaacagcaucaccaguugcuauguggagguggagcuuaagccucacaggguag

SEQ ID NO: 13397 - RNA, 732 nt, Artificial Sequence
  Description of Artificial Sequence: Synthetic coding sequence
auggguccagaggcuuuaagcaguuugcuacuauugcugcucgucgccuccggggacgcagauaugaaagggcacuuugaccccgccaaauguagguacgcucuaggaaugcaggauaggacaauaccagacucugauauuucugcgucaagcuccuggagugauuccacagcagcgcggcacucaagacucgagaguuccgacggggacggcgccugguguccagcaggcagcguuuucccuaaagaagaggaauaucuccagguggaucugcagcggcugcaucuggucgccuuagugggaacucagggacggcaugccggggggcuaggaaaggaguuuagucgcaguuauagacucagauacucacgggacggacggcguuggauggguuggaaagaucgguggggucaggagguuauaucuggcaacgaggacccagagggcgugguccugaaggacuuggguccacccaugguugcuagauuggugagguucuauccgagagccgauagagucaugucaguguguuuaagaguggaacuguacggcuguuuguggagagauugcuccaugggcgugugggccaguuggcagaugguaugguggggcuggaugacccugggcagagugagguccugcggguccgggcaggcuaugacaaugugggacggagcaaccacagcgucgcccgucgcaauguggagauggucuuugagcuugacuggcuag

SEQ ID NO: 13398 - RNA, 1224 nt, Artificial Sequence
  Description of Artificial Sequence: Synthetic coding sequence
augcgcuugcucgccuggcucauauuccucgcuaauugggguggugcccgcgccgaaccugggaaguucuggcauauagcagaccugcacuuggaccccgacuacaaaguguccaaagauccuuuccaggucugccccagcgcaggcucacagcccgugcccgacgcaggccccuggggagauuaucuaugcgacagccccugggcguuaaucaacucgucuaucuacgccaugaaggagauugaacccgaaccugacuucauucuguggacaggggacgauacaccccacguacccgaugaaaaacuuggcgaggcagcgguucuggagaucguugagcgucuuaccaaauugauccgggaaguguucccuggcgccuucuacugcgaaaagcuuccuggaccuucaggggcagggaggauuguuguucugaacacuaaccuguauuacacuaguaacgcccuaacagcugauauggcugaccccggccagcaguuccaguggcuggaagacgugcugacagacgcuaguaaagcuggagauaugguguacauuguuggacacgucccuccuggguuuuuugagaagacacaaaauaaggccugguuucgagaggguuuuaacgagaaguaccugaagguagugagaaaacaccaucgcgucauugcuggacaguucuuugggcaucaccacacagacucguuucggaugcuguaugacgacgcaggcgugccuauuuccgcuauguucaucacuccaggagugacccccuggaaaaccacccugcccggcguuguuaacggcgcuaacaacccagcgauaagaguuuucgaguaugaccgcgcgacacucucgcugaaagauaugguuacguacuucaugaacuuaucucaggcaaacgcacaaggcacuccaaggugggagcuggaguaccaacugacugaagccuacggcgugcccgaugcaagugcucacuccaugcauaccguccuggauagaauugcaggggaucaaucuacucugcaaagauauuacguguauaauagcguuucuuacucugccggagucugcgacgaggccugcucuaugcagcauguuugugccaugcggcagguggauaucgacgccuauacgaccugucuguacgcauccggaaccaccccugugccucagcucccacucuuacugauggcccuacugggucugugcacacuggucuuguag

SEQ ID NO: 13399 - RNA, 756 nt, Artificial Sequence
  Description of Artificial Sequence: Synthetic coding sequence
augccccauuuggcuagucucuuuaccgccucuagucggugcuguccucauccucucagaccagagggauccggggccaugggacccgaggcccuaucuagcuugcugcuucuacuacuggucgcgucuggggacgccgauaugaagggccacuuugauccagccaagugcagguacgcacuggguaugcaggaccguaccauaccugacucagauauaagugcaucgagcuccuggucggacagcacugcugcgcgacacucuagacuggaauccucugacggcgacggugccugguguccugcugguagcguguuuccuaaagaagaagaguacuugcagguggaucugcaacgacuccaucugguggcccugguugguacccaagggcgccaugccggcggacugggcaaggaguucucucggaguuauagacugcguuacaguagagacggacgacgauggaugggauggaaagaucgauggggacaggaggugaucucuggaaaugaggacccagaaggcguggucuugaaggauuugggcccucccaugguggccagauuaguaagauucuacccacgagcagaucgggugaugagcgugugucuuagaguggagcuauacggaugccucuggcgcggggaguggcuguccuuucuggggaucuguuucuuaucgaggggucucgaaggcggcgaaugcggggaaugggcaagccgcauuccuagucccgccggcaaacugucccuguag

SEQ ID NO: 13400 - RNA, 756 nt, Artificial Sequence
  Description of Artificial Sequence: Synthetic coding sequence
augccccaucuggccucccuguucaccgcauccucgagaugcuguccucacccccuuagaccagaaggcuccggcgcaauggggcccgaggcauuauccagccuauuacuguugcuacucguugccucuggcgaugcugacaugaagggucacuuugacccagcuaagugccgcuacgcucuggggaugcaggaccguacaauucccgacucagauauuuccgcuagcuccucauggagugacagcacagcugcccgucauucuaggcucgaguccucagacggcgauggggcguggugucccgccgggagcguguuucccaaagaagaagaauauuuacagguggaccuucagcgccuccaucugguggcccuaguuggaacccaaggccgccaugccgggggacucggaaaggaguuuucaagaagcuacagacuccgcuauagccgcgaugggagacgcuggaugggauggaaggaccgauggggacaggaagugaucucugggaacgaggacccugaaggagugguuuugaaagauuugggcccuccaaugguggcuagacuggugcgcuuuuacccccgcgccgaccgugugaugagcguaugcuugagaguggaauuguauggauguuuguggaggggcgaguggcuguccuucuuagggauuugcuuucugagccgcggucuggaggguggagaauguggcgaaugggcuagucgcaucccuucgccugcugggaaacucucacuuuag

SEQ ID NO: 13401 - RNA, 456 nt, Artificial Sequence
  Description of Artificial Sequence: Synthetic coding sequence
auggaucucguccucaagcgguguuugcuccaccucgcugugauaggcgcgcugcucgcggucggugccaccaaagugccucgaaaucaggacuggcugggcgucagucgccaguuacgcaccaaagcauggaauaggcaacuguaucccgaauggacagaagcccagagacuggauuguuggagaggcgggcaagugucacucaaaguuuccaacgauggcccuacauugauuggugcaaacgcgaguuucagcauugcauuaaacuuuccaggcucucagaaaguucuaccugacggccaggugauuuggguuaacaauacuaucauuaacggaucacagguaugggggggccagccuguguacccccaggagacagacgacgcguguaucuuccccgauggaggaccuuguccaaguggcagcuggucucagaaacgcucauucguguacuag

SEQ ID NO: 13402 - RNA, 216 nt, Artificial Sequence
  Description of Artificial Sequence: Synthetic coding sequence
augccugccggcguuccuaugucuacauaccugaaaauguucgcugccagcuuauuagcaaugugugccggagccgaaguugugcaucgcuauuaccgcccugacuuaacuauaccagagaucccaccgaagcgcggagagcuuaagaccgagcugcugggccugaaggagaggaagcauaaaccccagguaucgcagcaggaagaacucaaauag

SEQ ID NO: 13403 - RNA, 447 nt, Artificial Sequence
  Description of Artificial Sequence: Synthetic coding sequence
augcagacauuucccguggcaggagcacucgaccccgcaauccucgacacaagcaguccccaggcacuuuacaccguccuccugauuguacugguaaugaugagccucguauucgggaaauuuguuccuguuaacugggagccuccucagccucuuccuuuucccaaguaccuucgaugcuaccguugccugcuugaaaccaaggaacuggguugccuccuagguagugacaucugucucacaccggcgggcaguucuugcauuacacuucauaaaaagaacagcagcggcuccgaugucaugguauccgauugucggucuaaagagcagaugagcgacuguucaaauacccgcaccaguccuguuuccgguuucuggaucuucucgcaguacugcuuccuggauuuuugcaaugauccacagaacagaggacuguacacaccguag

SEQ ID NO: 13404 - RNA, 447 nt, Artificial Sequence
  Description of Artificial Sequence: Synthetic coding sequence
augcaaaccuuccccguggccggagcccucgacccagcaauucuggacacaucaagcccucaagcucucuacacuguucugcugaucguucuugucaugaugucccugguguucggaaaguuugugcccgugaauugggaaccaccacagccccuucccuuuccaaaguaucugcgcugcuaucgaugucuuuuagagacaaaagagcugggaugucuguuagggagugauauuugccugacacccgccgguucuaguugcaucacuuuacacaagaagaauuccagcggaagugacgugaugguaucugauuguaggucuaaagaacagaugagcgacuguucuaauacaagaaccagcccagucagcggauucuggauauuuucacaauacugcuuccucgacuucugcaacgauccccagaaccgcggucucuauaccccuuag

SEQ ID NO: 13405 - RNA, 1326 nt, Artificial Sequence
  Description of Artificial Sequence: Synthetic coding sequence
auggaguuugaauuugacagacugcgggcuuuccaggcgaugcaggugcauugcaauaauaugcacacguuaggggcccgacugccuggcgggguugagugccgguucagacgcggaccagcaauggcaugggagggcgagccuaugagacauaaucuugggggaaaccugggagacccaagggcccgugccgucagugugccgcugggaggccggguggcgagauuccugcaaugcagauuccucuuugccggcccauggcuucucuuuagugaaaucuccuucaucagugaugugguaaacaacaguagucccgcgcucggaggcacguucccaccugcuccaugguggcccccagguccacccccaacaaacuuuaguagucuagaacucgagccgaggggccaacaacccguugcgaaggccgagggcagcccaacugccauacucauuggaugccuaguagccaucauucugcugcuacugcugaucauugcauuaaugcuauggcggcuucauuggaggcggcugcuuagcaagguccuggaaucgcaccccagaacgagauccccugguuuggucggcauuagaccaacaccucugcccgugucccccauggcacucagaugcuguagcccuauccaaccuaccgcuucguuuuggccacucacaccggugccucuugaggcgcgugcucccccucauccacccggcccaaauccccccacaccccggggcguaacaggggguaacaccuaugcuguuccagcacucccuccgggcgcagugggcgauggcccaccaagggucgauuucccccgcaguaggcucagauuuaaagagaaacugggagaagggcaguuuggcgaaguacaccugugugaaguggacucuccacaggaccugguuucacuugacuuuccuuuaaacgugcguaagggccauccacuacucguggcaguaaaaauccugcggccugacgcaacuaaaaacgcuaggaacgauuuccugaaggaggugaagaucaugucaaggcuuaaggauccgaacauuauucguuugcugggcgugugcgugcaggacgacccucucugcaugauuacagacuauauggagaacggagaccugaaccaauuucuuucggcucaccaacuugaagacaaagcugcagaaggagcaccaggcgauggacaagcugcacaggggccuacuauuuccuaccccaugcuccugcauguggcugcccagauugccucgggaaugagguaccucgcaacccuuaauuuuguacacuuuuggggagagagacaucguuucuugcauuag

SEQ ID NO: 13406 - RNA, 2067 nt, Artificial Sequence
  Description of Artificial Sequence: Synthetic coding sequence
augcuccccaccgaaguuccacagucucaucccgggccuuccgcccucuugcugcuccagcuguuacugccaccuacauccgccuucuuuccuaacaucuggucucuucuugcagcaccuggaucuaucacacaucaggaccugacagaagaagcagcacugaauguuacacugcagcuguuuuuggaacagccgcccccgggccggccuccacuuaggcuggaagauuuucugggacgcacccugcuggcugaugaucuuuucgcagccuacuuugggcccggcagcagccgacgauuccgggcagcacugggcgaagugaguagagcuaacgcugcacaggacuuucuacccacgucgcguaacgaucccgaucuccauuucgaugcugagcgccugggacaggguagagcgcgcuuaguuggagcccugagagaaacaguaguggccgcccgcgcacuggaccauacguuggcccggcagaggcucggagccgcauugcacgcccuccaggacuucuacucucauaguaauugggucgagcuuggagagcagcagccucauccacacuugcuuuggccccggcaggagcugcagaaucuugcccaggucgccgauccaacauguuccgauugugaggaauuguccugcccuagaaauugguugggauucacgcugcugacuagcggauacuuuggcacacacccgcccaagccuccuggcaaauguagucacggcggucauuucgauagaagcuccucccaacccccaaggggcggaauuaacaaagacucaacaagcccaggauucagcccacaucacaugcugcaccuccaggccgcuaaacuagcccuacuagcauccauccaggcuuucucucuguuaagaucuagacuuggugauagggacuucucucgccuccuagacauuacgccagcgucaucgcuguccuuuguccucgacacuacaggguccaugggggaggagaucaacgcggcuaaaauccaggcgaggcaccuuguggaacagcgacguggaucaccuauggagccuguccauuaugugcucguacccuuucacgauccagguuucgguccugucuuuacaacaucugaucccgauucauucuggcagcagcucaacgaaauucacgcccugggaggaggcgacgagcccgagauguguuugagcgcccuccaacucgcauugcuucauacaccaccccucagugacauuuucguguucacagacgcuagcccaaaagacgcauuccugaccaaccagguugagucucugacgcaagagcggagauguagagugaccuuccucguaaccgaggauacuucccguguacagggucgcgcaagaagagagaucuuaucaccgcugcgauucgaacccuauaaggcgguugcccuggcuuccggcggcgaggucauuuucaccaaagaccagcacaucagagauguugcagcaauugugggagagagcauggcggcccuggucacacugccucuggauccuccaguuguuguccccggucagccccuggucuuuucgguugauggauugcuccagaagauuacuguuagaauacauggagacauuuccuccuucuggaucaagaauccagcaggcguaucucagggacaggaggaggguggcgggccuuugggucauacacguagguucggccaauucuggauggugaccauggaugacccuccucagaccgguacgugggaaauucaggucaccgcagaggacacuccugggguccgcguccaggcccagacaucccuagacuuucucuuucacuuugguauuccaauggaggacggcccacacccuggacuuuacccacuaacccagccaguggcagggcugcagacacagcugcucguagaaucucagagcugggggaguucugcugcauuucugccccgucacccaaguaggggcccuagggguugccggacccguccuggagcccugggugccaggggcaccucgggcgcacgcucgccucggagccuugcaguggcucacgccgcagugcauccguag

SEQ ID NO: 13407 - RNA, 1326 nt, Artificial Sequence
  Description of Artificial Sequence: Synthetic coding sequence
auggaguuugaauucgauagacugcgagcuuuucaggccaugcaggugcauugcaacaauaugcacacccuaggagcucgucuucccgguggagucgagugucgauuuagaagggggcccgcuauggccugggagggcgaacccaugcgccauaaucucggcgguaacuugggagacccuagggcacgcgccgucucaguucccuuggggggcagaguggcccgguuucugcaaugucgauuucuguucgcagggccuuggcucuuauuuagcgaaauuuccuuuauuagcgacguugugaacaacuccagcccagcucucggagggacguuucccccagcuccuugguggccccccggaccaccuccaacgaacuuuucuucucuggaauuagagccaagaggccagcagccaguggcgaaggcagaagguucgccaacggccauacugauuggaugucugguggcaauaauccugcuccuguugcucauuauugcccucauguuauggcgccugcacuggaggcgccugcucaguaaaguacuggagagucacccaagaacucgcagcccaggguuagucggcauccgacccacgcugcuacccgugucccccauggcucuuaggugcugcuccccgauacagcccaccgccucuuuuuggccguuaacaccuguuccccucgaggcacgagccccaccccacccacccggcccuaacccccccaccccgcgaggagugaccggcggaaacacauacgcagugcccgcccucccaccaggcgccgugggugaugguccuccucgcgucgacuucccaagaagcagacugcgguuuaaagaaaaacuuggcgagggccaguuuggagagguucaucugugugaaguagauucaccacaggaccuagucucucuggauuucccccugaacguuagaaaaggucauccccugcuggucgccgugaagauccugaggcccgacgccacaaaaaacgcccggaacgauuuccugaaggagguuaagauaaugagucgccugaaggauccaaacaucauccguuugcuuggcgucugcguucaggaugacccucugugcaugauuaccgacuauauggagaacggagacuuaaaucaguuccucagcgcucaccaguuagaggacaaggcugcugaaggcgccccuggugaugggcaagcagcccaaggaccuacuaucucauaucccaugcugcugcauguggcugcacaaaucgcaucuggaaugcgguacuuagcaacgcuaaauuucguccauuucuggggcgaaaggcacagguucuugcacuag

SEQ ID NO: 13408 - RNA, 2559 nt, Artificial Sequence
  Description of Artificial Sequence: Synthetic coding sequence
augcucccaacggaagugccacagucacacccuggcccaagugcuuuauugcuucuccagcuacuuuuaccucccaccucagcauuuuucccgaauauauggagucuauuagccgcaccaggauccauuacccaccaagaccucacugaggaagccgcccuaaacguuacacugcagcucuuucuagagcagccuccaccgggacguccaccgcuacgacuggaggacuuucuuggacgcacucuccucgcggacgaucuguucgcagcguauuucggccccgggagcaguagaagauucagagccgcccugggcgaagugagcagagccaaugccgcccaggacuuccugccaacuucuagaaacgauccagaccuccacuuugaugcagaaagauuaggccaagguagagcccggcugguaggagccuuaagagagaccguggucgcagccagggccuuggaccacacccuugcacgccagaggcuuggagcugcccuacaugcucugcaggauuuuuacucacauucaaacuggguugaacuuggggagcagcagccucacccccaucuuuuauggcccagacaagaacuccaaaaccuggcccaggucgcagauccaacauguagcgacugcgaagagcucucuugccccaggaauuggcugggcuucacccucuuaacaucugguuauuucggaacucacccuccuaagccuccagguaaaugcagccauggcggacacuucgacagauccagcucccaaccuccgaggggcggcauuaacaaagacuccacguccccaggcuucaguccccaucacaugcugcacuuacaggcugcaaaauuagcccuucuggccagcauccaggccuucucccuacugagaucaaggcuaggagaccgcgacuuuagcagguuacuugauauuaccccagccagcucucuuagcuucguccuggacaccaccggaagcaugggcgaggaaaucaacgccgcuaagauucaggccaggcaccucguagagcagagaagagguagcccuauggaacccguccacuauguccuugucccguuucaugaccccggauuugggccuguauucaccacaagcgacccagacucuuucuggcaacaauuaaaugaaauucacgccuugggcgguggagaugaaccugagaugugucuuuccgcucugcagcucgcccuucugcauacaccaccgcugucagauauuuuuguguuuacagaugccagucccaaggacgcguuucucacgaaucagguggagagccugacccaggaacgacggugucgcgugacauucuuaguaaccgaagacacgucccggguacagggcagggcuaggagagaaauuuuguccccauugagauucgagccuuauaaagccguggcgcuagccaguggaggagaaguaaucuuuaccaaagaucagcauauacgggauguugcugccaucgugggugagaguauggcugcacuggugacauugccauuagauccccccguggugguucccgggcagccuuugguuuucagcgucgacggacuccugcagaaaaucacagugcggauucacggcgauaucagcagcuucuggaucaaaaacccagcaggagugucccaaggucaagaagaagggggagggccccuaggacacaccaggcguuucggucaauucuggauggugaccauggacgaccccccccaaacaggaacgugggagauccaggucaccgcagaggacacccccggagugcgugugcaagcgcagacaucucuggacuuucuauuccacuucgguauccccauggaggacggcccucacccugggcuuuacccacuuacucagccaguggccggccugcagacgcagcuccucguagaggugacagggcucggaucaagagcaaacccaggggacccacaaccacacuuuucccaugugauccuacggggggugccagaaggagccgagcuagggcaggugccucucgaaccagugggaccucccgagaggggguuacuugccgcaucccucucucccacacuguuaagcacgccccgaccuuucucauuagagcuuauuggucaggacgcggccggacgccgacuacaucgggcggcuccacagccgaguacagugguaccagucuugcuggagcugagugggccuucgggauuucuggcucccggcaguaaagucccccuuagucucaggaucgccucuuucucaggaccacaggacuuagaucuucgaacguucguuaaccccaguuucagccuuacaagcaaucugagccgagcacaccuggagcugaacgaauccgccuggggucggcuguggcuggagguucccgauucggccgcuccugauuccguaguuauggugaccguaacagcaggcggacgcgaggcgaacccuguaccuccuacccaugcuuuuuuaagacuccucguguccgcuccugcgccccaagugagaaaucacuacuuuccaagccagggcccugcccaucacccauaccgauugauuuag

SEQ ID NO: 13409 - RNA, 732 nt, Artificial Sequence
  Description of Artificial Sequence: Synthetic coding sequence
augggaccugaggccuuaaguucauugcugcugcuucugcucgucgcuucaggagaugcggacaugaagggacacuuugacccugccaagugucgguacgcucugggaaugcaagaucggaccauuccagacuccgacauuuccgcuagcaguuccuggucggacagcacggccgcucggcauagcaggcucgagagcucugauggggauggagccuggugcccagccgguucagucuuuccaaaggaggaggaauaccugcagguggaucugcaacggcugcaucucgucgcucugguaggaacccaaggaagacacgcugggggacuugguaaggaauucagucgaucuuauagacugagauacucaagagacggccgcagguggauggguuggaaggauagaugggggcaggaaguuaucuccggcaacgaagaucccgagggcguuguacugaaagaucugggcccccccaugguugcacgacugguaagauuuuacccccgggcagacagggucaugagugugugucugcguguggagcuauacgggugccuguggagagacuguuccaugggugugugggcuucuuggcagauggugugguggggcuggaugacacucggaagggugcgcagcugcggauccgggcaagcuaugacgaugugggacggagccacuaccgccucucccgucgccauguggagauggucgcugagccucacaggcuag

SEQ ID NO: 13410 - RNA, 2760 nt, Artificial Sequence
  Description of Artificial Sequence: Synthetic coding sequence
augggccccgaggcacucaguucccugcuccuacugcuccucguugccaguggggaugccgacaugaaaggacauuucgacccggccaagugccgcuaugcccuggggaugcaggauagaacaauaccugauuccgacauuuccgccagcagcucauggagcgauaguaccgcugcccggcacuccaggcucgaauccucagauggugacggcgccugguguccagcugggucuguuuucccaaaagaggaggaauacuuacaggucgauuugcagagacugcaccuuguugcccucguaggcacucagggucggcacgccggaggucuggguaaagaguuuucccguucuuaccgacucagguacucccgggacggccgcagauggaugggauggaaggauagauggggccaggaggucaucucaggcaaugaggaccccgaaggaguaguguugaaagaccucgguccaccgaugguugcacgcuuggucagauucuauccaagagcugaucgagucaugagcgucugccugcgcgucgagcuguacgguugucucuggcgagauggucugcucucuuacacagcaccuguagggcaaacgauguacuuaucagaggcagucuauuugaaugacagcaccuaugaugggcacacugucgggggccuccaguauggaggacuuggacaauuagcagacggcguggucggccuagaugacuuccgcaagucucaggaacuacguguguggccugguuacgacuacgugggauggagcaaccacucuuucagcucaggcuauguugaaauggaauucgaguuugacagauugcgcgcauuccaggcgaugcaaguacacugcaauaacaugcacacgcucggagcucggcucccagggggaguggagugucgguuccgaaggggacccgccauggcaugggaaggggagccaaugaggcacaacuuaggggggaaucugggugaccccagagcucgagccgucuccgucccucugggcggaaggguggcccgauuucugcaauguagauuucuauuugcugggcccuggcuucucuuuagcgagauuucauuuaucucagauguggugaacaauuccucuccggcucugggagggacguucccccccgcucccugguggccuccugggccuccccccaccaauuucaguucuuuggagcucgagccaagaggucagcagcccguugcgaaggccgaagggucgccaacagccauuuuaaucggcugcuuaguagccauuauccuacuccuccuacugaucauugcccucauguuguggcgauugcauuggagaagacuccugaguaaggcggagcgccggguucuggaagaggaacuuacagugcaccucagugugccuggggauacuaucuugaucaacaaucgcccugggccuagagaacccccaccguaccaggagccucgcccuagggguaacccaccccauagcgccccauguguaccaaacggguccgcacuccuguugucaaauccugcuuaucgccuccuucucgccaccuaugcaagaccaccaagaggacccggaccgccaacccccgccugggcgaaaccuaccaauacacaggcauauagcggggauuauauggaaccugaaaagccgggggcuccuuugcugccccccccuccccagaacuccguuccacauuaugccgaagcugacauugugacucugcagggaguuacaggaggcaauacauaugccguuccagccuugccucccggcgcugucggggacggaccuccaagagucgauuucccacggagucggcugcguuuuaaagagaagcugggagaaggacaauucggagagguccaccucugugaaguugauucgccacaggaucucgugucccuagacuuuccucugaacguaaggaaaggucacccacuccugguugccgugaagauccuucgccccgaugccacuaaaaaugccucguuuucccuauucagcagaaaugauuuucugaaggaggugaaaaucaugagucgauugaaggaucccaacauuauccgacuguuggggguuugcgugcaagacgacccacugugcaugauuacagauuauauggagaauggcgaucuuaaccaguuucugucagcucaccaguuggaagacaaggccgcugagggggcucccggggauggacaggccgcucagggcccaaccauuucuuaccccauguuauugcacguggcagcccagaucgccuccggaaugcgcuacuuagcaacccucaacuucgugcaccgugauuuggcuacuagaaauugucuggugggagagaauuucaccauaaaaaucgcagacuuugguaugucucggaaucuguaugcuggcgauuauuauagggugcaggggagggcagugcugccaauuagauggauggccugggaguguauccugauggguaaguucacgacugccagugacgugugggcuuuuggugugacacugugggagguguugaugcucugucgggcacagccuuuuggucaauuaacugacgagcagguuaucgaaaaugcuggcgaguuuuucagggaccaagggcgucagguguauuuaagucgccccccagccuguccccagggccucuaugaauugauguuacgauguugguccagagaguccgaacagcggccaccuuucucacaacuccacagauuucuggcugaggaugccuuaaauacagucuag

SEQ ID NO: 13411 - RNA, 2700 nt, Artificial Sequence
  Description of Artificial Sequence: Synthetic coding sequence
augcugcuccuguuguuacuggcccccuuauucuuacgccccccuggggcaggaggcgcucagaccccuaaugcuaccagcgagggcugucagauuauacacccacccugggagggaggcauucgauaccgagggcugaccagggaccaggugaaggcuaucaauuuccugccaguugauuacgagauugaguacguaugccggggagaaagagaggucguugggccgaaagugagaaagugccucgccaaugggagcuggacugauauggauaccccuucgcggugugugaaccguaccccccacucugagcggcgggccguauacauuggagcccuguucccuaugagcgggggauggcccgggggccaggcuugucagccugccgucgagauggcucucgaggaugugaauucccggcgggauauccugcccgacuaugagcugaaacugauccaccacgacucgaaaugcgaucccgggcaggccacuaaauaccuguacgaacugcuguacaacgacccaauuaagaucauucugaugcccggcugcucaagcgucucgacucucguugccgaggccgcucgaauguggaaucugauugugcucucauauggaucaaguaguccugccuugucaaaccgucagcgcuuucccaccuucuuccgaacgcauccuucagccacucugcauaacccuacaagggugaaacuguucgagaaauggggguggaaaaaaaucgcuacuauacagcagacuaccgaaguauucacaaguacccucgacgaucuggaagaaaggguuaaggaagcaggcauugaaauuacuuucagacagucauuuuuuucagacccugccgucccagugaaaaaucugaaacgucaagacgcaaggaucauugucggccuguucuacgagacagaagccagaaagguuuucugcgagguguauaaagaacguuuguucggaaaaaaauaugugugguuccugaucggcugguaugcugacaacugguuuaaaauuuacgauccaaguaucaacugcaccgucgacgagaugaccgaggcaguggaaggacauauuaccacggagauuguaaugcugaacccugcaaacacccgaucaauaagcaauaugacaucacaagaguuuguggagaagcuuaccaagaggcucaagcgucaucccgaggagacuggcggcuuccaagaggcgcccuuggccuaugaugcuaucugggcuuuagcacuagcucuuaacaaaaccaguggagggggagggagaucaggugucagacucgaggacuucaacuacaauaaucaaaccauuaccgaccaaauuuauagagccaugaacuccucuagcuucgagggcgucuccggccacgugguuuuugacgcuucaggcagucggauggcuuggacgcucauugaacagcuucaggggggcuccuacaaaaagauaggauauuacgauucaacuaaagaugaucucucguggagcaagacugacaaauggaucggugguucuccuccugcugaccaaacacuggucaucaagaccuuccgguuccuuucccagaaacucuuuauuagugugucugugcugagcucccugggcauagugcuggcugucguuugccugucauucaauauuuauaauagccacguuagguauauccagaauagccaaccaaaccuaaacaaucuaacagcuguuggcuguucgcuggcacuagcagcgguguucccccucgggcuggacggguaccacauaggaagaaaccaguuucccuuugugugucaggcucggcuguggcuuuuaggucuuggguucagccuaggguacggcucuauguucaccaaaauuugguggguccacacagucuucacgaaaaaggaggagaaaaaggaguggagaaagacacuggaacccuggaaauuguacgccaccgugggucuccugguggguauggacguccugacacuggcaauauggcagaucguggauccucuucacagaaccauugaaaccuuugccaaggaagaaccuaaagaagacaucgauguaucuauccucccccagcuagagcauugcucuucacggaagaugaacacaugguuaggcauuuucuauggguacaagggucuccuacugcugcuggguaucuuucuugcguacgagacuaagagcguauccacagagaaaauuaacgaccauagggcagugggcauggcaauuuacaacgucgccguuuuaugccugauaacagcuccugugacaaugauccuuuccucucagcaggacgccgcuuuugcguucgccagucuggcaauaguuuucaguuccuauaucacgcuaguuguucuuuuuguucccaagaugaggagauugauaacccggggcgaauggcaaucagaggcccaagacacgaugaaaacuggcagcuccacaaacaacaacgaggaagaaaagucaaggcuucucgaaaaggagaaccgugagcuagaaaagauuaucgccgaaaaggaggaaagagucuccgagcucaggcaccagcuacagagccgucagcagcuucgcucgagacggcacccaccgacaccaccggagcccuccggaggucugcccagggggcccccagaaccccccgaccggcuguccugcgacgguucgagagugcaccugcuguauaaauag

SEQ ID NO: 13412 - RNA, 447 nt, Artificial Sequence
  Description of Artificial Sequence: Synthetic coding sequence
augcagacauucccaguugcaggggcacuggauccagccauacucgacaccucuuccccccaggccuuguacacuguguuacuaaucguccuggucaugaugucacuggucuucggcaaguucgugccaguaaacugggagccgccacaaccauuaccauucccgaaguaucuccgguguuaucggugucugcuggagacaaaggaacugggcuguuugcuuggaagcgacaucugccucacccccgcaggcucaaguugcaucacgcugcauaaaaagaacucaucaggaagcgaugugaugguaucugacugucgcaguaaggaacaaauguccgacuguucuaauacaagaaccucucccguaagcggcuucuggauuuuuucucaauacuguuuucucgauuucuguaacgauccacagaacagaggccuguacacccccuag

SEQ ID NO: 13413 - RNA, 516 nt, Artificial Sequence
  Description of Artificial Sequence: Synthetic coding sequence
augagacacaauuuaggagguaacuugggcgacccaagggcuagagcaguuuccgugccucugggcggacggguagccagauuucuccaaugucgcuuccuuuucgcaggccccuggcugcucuuuucugaaaucuccuuuauauccgaugucgugaauaacuccucacccgcacucggaggcacuuuuccacccgcaccuugguggccgcccgggccaccgccgacuaacuuuucaucucucgagcuggaaccacgaggccaacaaccugucgccaaggccgaaggcagcccuacagcgauccucauugguugcuuaguggcaaucauucugcugcuucuccugauuauugcucucaugcuuuggagacugcacuggcggcggcugcuaucaaaaguccuggaaucccauccccgaacuaggucuccugggcugguugggauuagaccgaccccccugcccgucaguccaauggcacucguccauuuaugcgagguugacaguccccaggacuag

SEQ ID NO: 13414 - RNA, 666 nt, Artificial Sequence
  Description of Artificial Sequence: Synthetic coding sequence
augaccacgcagcugagaguuguccaucucuugccgcugcugcucgccugcuuugugcagaccucuccuaagcaggaaaagaugaagauggacugccacaaggacgagaaaggcacaaucuacgacuaugaagcaauugcgcugaauaagaacgaguaugugagcuucaaacaauaugucgggaagcauauccuguucgucaacguggcgacuuauugcggccugaccgcacaauacccggaauugaaugccuugcaggaggagcugaagcccuacggacucgucguacuuggauuucccuguaaucaguucggcaagcaagaaccuggggauaacaaagagauccugccaggccucaaauauguucgcccaggggggggauuuguaccgucauuccaacucuuugaaaagggugauguaaauggugagaaagaacagaaaguguucaguuuucugaaacacucaugcccucacccaagcgagauccuugguacguuuaagaguaucucuugggauccagugaagguucaugacauacgguggaacuuugaaaaauuuuuaguaggacccgauggaaucccuguaaugcgcuggucucauagagcgaccgucaguagcguaaaaacugacauucuggccuacuuaaagcaauucaaaacaaaauag

SEQ ID NO: 13415 - RNA, 447 nt, Artificial Sequence
  Description of Artificial Sequence: Synthetic coding sequence
augcagacauucccagucgcuggggcccuugaccccgcuauacucgauaccucuucuccccaagcucuguacacggugcuccugaucguguugguaaugaugagccucgucuuugguaaguuugucccugucaacugggaacccccucaaccccuucccuucccaaaguaucuucgguguuaucgguguuuacuggaaacgaaggaauugggcugucuccuuggaagugacauuugucugacacccgccggguccagcuguaucacccugcauaagaagaacuccucugguucagaugucaugguuuccgacuguagauccaaagaacagaugucugauuguucuaauacucggacuucaccagugagcggcuucuggaucuuuagucaguauuguuuucuugacuuuugcaaugacccacagaaucguggcuuauauaccccuuag

SEQ ID NO: 13416 - RNA, 1737 nt, Artificial Sequence
  Description of Artificial Sequence: Synthetic coding sequence
augcuucugcuacuccugcuugccccauuguuucuucgaccaccuggcgccgguggggcccagaccccuaaugcaacuagugaaggcugccaaauuauucauccuccuugggagggcgggauucgguaccgagggcugacuagagaccaggugaaggcaauuaauuuccuaccaguggacuacgagaucgaauacgucugccggggugaaagggaaguuguaggcccuaagguccgcaaguguuuagccaaugguuccuggacggacauggacacaccuagccggugcgugcgcaucuguuccaagagcuauuugaccuuggagaacggcaagguguuucucacggguggcgaucuuccagcguuggauggcgcacggguugacuucagaugugacccugauuuccaccucgucggcaguucuagauccaucugcagucagggucaguggucaacaccuaaaccgcacugucagguaaaccgcacaccucauuccgagagacgggcuguguauauuggagcgcuguuccccaugagcggagguuggccuggcggccaggcuugccagccugcuguggagauggcccuggaggacgugaauucccguagagauauauugccugauuacgagcugaagcugauucaucacgauucuaagugcgaucccggucaagcgaccaaguaccuguacgagcuacuauauaaugacccaauuaagaucauucugaugcccggcugcuccagcgugucgacauuaguagccgaagcagcucggauguggaaccuuauuguacucuccuauggauccuccucacccgcucugaguaaucgucagcgauucccaaccuucuucagaacacaucccuccgcgacacugcacaaucccacuaggguuaaauuauuugaaaaguggggcuggaagaaaauagcuacuauucaacaaaccacagagguguucaccaguacucuggacgauuuggaggagcguguaaaagaagcuggcauugagaucaccuuccgucaguccuucuuuagcgaccccgcugucccaguaaagaaccuuaaacgacaagaugcuaggauuauugugggauuguucuacgagacagaggccaggaagguuuuuugcgaagucuacaaagagcgacucuucggcaaaaaguacgucugguuccucauuggaugguaugccgacaauugguucaagaucuaugacccuucuauuaauuguacuguggacgagaugaccgaagcugucgaggggcauauaacgacggagauaguaauguugaacccagccaacacaagaucaauaucuaauaugaccagucaagaguucguggagaagcuuacaaagagacugaagcggcaccccgaggaaacugguggcuuccaggaggccccucuggcguaugacgccauuugggcacuggcuuuagcacugaacaagacauccggagggggcggucgcucuggcguucgccuggaggacuuuaauuacaauaaccagaccauuaccgaccaaauauacagggcuaugaacaguagcucguuugaaggagugucaggccacguaguguucgaugcuuccggcagcaggauggcuuggacuuugaucgagcaguuacaaggagggaguuacaagaagaucggcuacuaugauucuacuaaagacgaccugucuuggagcaaaacagacaaguggaucgucaucucccggacucauagcccgaccuag

SEQ ID NO: 13417 - RNA, 1737 nt, Artificial Sequence
  Description of Artificial Sequence: Synthetic coding sequence
augcuccugcugcuccugcuagccccucucuuccuccgaccacccggggccgguggagcucagacacccaacgcaacuuccgagggcugccaaaucauucacccaccgugggagggaggcauccgcuaucgcggacucacacgcgaccaaguaaaagcaaucaacuuuuugcccgucgauuacgagauugaguacguaugccgcggagaaagagaagucguuggcccaaaggugcgcaaaugucucgccaacggcucguggaccgacauggacacucccagccgaugcguucggauauguuccaaauccuaccugacucuugagaaugguaagguuuuucugacuggcggugaucugcccgcccuugauggagcucgaguggacuuccguugugauccugauuuucaccucguggggucaaguaggucuauaugcagucagggacaguggaguaccccaaaaccucacugccaggugaacaggacuccccauagcgaacguagagcaguguacauuggggcucuauucccaaugagcggggguuggcccggcggacaggcaugucagcccgcuguggaaauggcacuugaggaugugaauucccgucgagacauacugccggacuacgaacugaaguugauacaccacgacucaaagugcgaucccggccaagcuacaaaguaccuauacgaguugcuguauaaugacccuaucaaaauuauucugaugcccggaugcaguaguguuuccacgcugguugcugaggccgcgagaauguggaauuuaauuguguugucuuauggcuccucuucaccagcacuuucgaaccgucaaagauucccuacauucuuccggacacacccuuccgccacgcugcacaacccaacccgugugaaguuauuugagaaaugggguuggaaaaagaucgcaacuauucaacagacgacggagguguuuacaagcacucuggacgauuuagaagaacgggugaaagaggccggaaucgagauuacguucagacagagcuucuucagcgacccggcaguccccgugaagaaucugaagcggcaggaugcuaggauuaucgucggacuguucuaugagacagaggcucguaagguauuuugcgagguguauaaagaacgacuguucggaaaaaaauacgucugguuccugauuggcugguaugcagauaacugguucaagauuuacgacccuagcaucaauuguacuguugaugaaaugacugaggccguugagggacauauuaccaccgagaucgugauguuaaaucccgcuaauacaagaaguaucaguaacaugaccagccaagaguucguggaaaagcuuacaaagcgcuugaagcgucacccagaagagaccggaggauuccaggaagcaccacuagccuacgaugcaauuugggcguuagcccucgcacuaaauaagaccaguggaggcggaggccggucgggcguuaggcuggaggauuucaacuacaacaaucagacgaucacggaucagaucuaucgggcgaugaacucauccuccuuugaaggagugucuggacaugucguguucgacgcaagcggcucgagaauggcuuggacucuuauugagcagcuccaagggggguccuauaaaaagaucggauacuacgauucuacaaaggacgaucuauccuggaguaaaacagauaaguggauugucauuaguagaacucacaguccuacauag

SEQ ID NO: 13418 - RNA, 756 nt, Artificial Sequence
  Description of Artificial Sequence: Synthetic coding sequence
augccccaccucgccucucuguucaccgccuccagucguuguugcccucacccgcugagaccagaaggcaguggugccaugggaccagaagcccucaguucccugcuucugcuccuacuuguugcuucaggcgaugccgacaugaaaggacacuuugaccccgccaagugccgauacgcacuaggcaugcaggaccgcacuauuccggacucugauauauccgcgucuagcucuuggagcgauucuacagcggcucgccauagucgacuggagaguagcgauggugacggggcuuggugcccugccggaagcguuuuuccuaaggaggaagaguacuuacagguugaccuucagcgccugcacuugguugcauugguaggaacucaaggacgucacgccggaggacucggcaaggaguucaguaggagcuaccgauugcgguacagccgcgacggacgccguuggaugggcuggaaggacagguggggccaggaagugaucucaggcaacgaagacccugaaggaguuguccucaaagacuuggggccuccaauggucgcgagacucguucgauucuauccccgagcggaccgugugauguccguguguuuaagaguggaacuguacggcugccuguggaggggcgaauggcuaagcuucuugggaauauguuuuuugucuagggggcuugaaggcggggaaugcggugagugggcuucucgcauaccaucuccggcugggaaguugaguuuguag

SEQ ID NO: 13419 - RNA, 1764 nt, Artificial Sequence
  Description of Artificial Sequence: Synthetic coding sequence
augagaccucggggucugccuccccuacucgucgugcuccugggcuguugggcgagcgucuccgcccagacggaugccacgcccgcgguaacuacugagggucugaacaguaccgaagccgcguuggccaccuucggcaccuucccgaguacuagaccuccaggcaccccuagagccccugggccuucaaguggaccucggccuacaccugucacugacguagcagugcugugugucugugaccuuagucccgcccagugugacaucaacugcugcugcgauccugauuguucauccguugauuuuagcguguuuucugccuguagcguacccguggugacgggugauagccaguucugcucccagaaagccgugauuuacucccugaacuuuaccgccaacccuccacaacgaguguuugagcuagucgaccagauuaacccuagcauauucuguauccauaucacgaauuacaagcccgcccuuucuuucaucaauccugaagucccagacgaaaauaauuucgacacucucaugaaaaccucagacggcuucacacugaacgcagaaagcuauguguccuuuaccacaaaauuggacauucccacugcugcuaaauacgaguauggggucccccuucagacgagcgacagcuuccucagauucccauccagccuaacuuccucccucuguaccgacaacaauccagcugcauuucuagucaaucaggcagucaaguguacccguaaaaucaaucuugagcaaugugaggagaucgaggcucugaguauggccuucuauagcucgcccgaaauucugagggugccggacagccggaagaagguucccaucaccguccagagcauagugauccaaagccuaaauaaaacccugacacggcgcgaagauacagacguccuacagccaacccuuguuaaugcuggucauuucucucugugcgucaauguggugcucgaggugaaauacucgcugacauauacagaugccggcgaagugacuaaggcggaucuguccuuuguuuugggaacugugucaucugugguggugccucugcagcagaaguucgaaauccauuuccuccaggaaaauacccaacccgugccccucucuggaaacccugguuacgucguaggccugccucuugccgccgguuuccaaccacacaaaggaucagggaucauccaaacaaccaaccguuaugggcagcuuaccauuuuacacagcacaacggaacaggacugccucgcacucgaggggguccguacgccaguccuguuuggauacaccaugcaauccgggugcaaacucagauuaacgggggcgcuccccugccagcucguggcccaaaaggugaaaagcuuauuauggggccagggcuucccugacuacguggcuccuuuuggcaacucccaagcacaagacaugcuggacuggguaccuauccacuuuauuacacaaaguuucaaucguaaggauuccugccaauuaccuggcgcucugguaaucgaggugaaguggacuaaauacgggucacuguugaacccccaggccaagauugucaacguuacugccaaucugaucaguagcucuuuuccggaagcaaauucagggaacgagaggacuauucugaucucgacggccgugaccuuuguggacgugagcgcgccagcagaagcaggcuucagggccccaccugcgauuaacgcacgucugccuuuuaauuuuuuuuucccauuuguguag

SEQ ID NO: 13420 - RNA, 2067 nt, Artificial Sequence
  Description of Artificial Sequence: Synthetic coding sequence
augcucccaacagaggugccccagagccauccuggucccagcgcgcuccugcugcugcagcuacuucugccuccgacauccgcuuucuucccaaacauauggagucugcuagccgcgccuggcagcauaacucaccaggacuugacagaggaagcagcucugaaugugacccugcaguuauuccuugaacagccacccccuggaaggccgccacucagacucgaggauuuucugggaagaacucuacuggcggacgaucuuuucgccgcauacuucgguccaggcucaucaagaagauuccgggcagccuugggcgaggucucaagggcuaacgcagcccaggacuuucugccaacuagccguaacgauccugacuugcacuucgacgccgaacgacugggccaaggacgagcccgccucgucggcgcgcuuagagagaccguuguagccgcacgugcucuggaccacacccuugccagacagcgguugggcgccgcccugcaugcacuucaagauuucuauagccauagcaacuggguggaacuuggagagcagcaaccacacccacaucuccuuuggccacgacaagagcuacagaaccucgcccagguagcagacccgaccuguucggacugcgaagaacugagcuguccucgaaauuggcugggauucacucugcuuacaaguggcuauuuuggcacucauccacccaaaccccccgggaaauguagccacggcgggcacuucgaucguucuagcagucagccaccaagagggggaauuaacaaggacuccacaucucccggauucaguccucaccauaugcuucaccugcaagcagcuaaguuagcucugcuggcuucuauccaggccuucucucuucugcgcuccaggcugggcgaucgggauuuuagccgacuccuggacaucacuccagcuuccucccugucuuuuguucuagacacgacagguucaaugggagaggaaaucaaugcugccaaaauccaagcaaggcaucuagucgagcagagacgggggucuccaauggaacccguccacuauguacucguaccauuccacgacccugguuucgguccaguguuuacuaccuccgacccugacagcuuuuggcagcaguugaacgagauucacgcucucggcggcggcgaugagcccgagaugugucuguccgcccugcaacucgcccugcugcacacgcccccgcuguccgauauuuuuguguucaccgaugccagcccuaaggaugcauuucuaacuaaucagguagagagccucacacaagagcgccgcugccgaguuacauuccugguuaccgaagauaccucuaggguucaagggcgcgcccgaagagagauucugucuccucugagauuugagccauacaaggccguggcucuggccucgggcggggaggucauuuuuacuaaagaucagcacauucgugauguggcggcuauaguuggcgaaucuauggcagcucugguaacuuugccccuggaucccccagucguagugccaggacagccccuuguguucagcguugacggacuucuucagaagauuacggucaggauccacggggauaucagcucuuucuggauaaaaaauccugcaggcgucucccaagggcaggaagagggcgggggcccauuaggccacaccaggcgguuuggucaguucuggaugguaacgauggacgaccccccccagacgggcacaugggaaauacaggucacagccgaggacaccccaggcgugcgcgugcaagcccagacgagccuugacuuccuuuuccauuucgguaucccaauggaagacgggccacaccccgggcucuaccccuugacucaaccaguagccggucuucaaacucaacugcucguggaaagccaguccuggggcaguagcgcugccuuucugcccaggcaccccagccguggcccccgggggugucggacacgcccuggggcacugggugcacgcggaacgaguggagcccguucuccaaggucccuugcuguggcacaugccgccgugcaccccuag

SEQ ID NO: 13421 - RNA, 303 nt, Artificial Sequence
  Description of Artificial Sequence: Synthetic coding sequence
augacaacccagcugcgcgucguucaccugcuaccgcugcuacuggcauguuuuguacagacgucucccaaacaggaaaagaugaagauggacugccacaaagaugagaaaggaacaauuuaugauuacgaggcuauagcccuuaacaaaaacgaauaugugucauucaaacaguauguggggaagcacauccuauuuguuaaugucgcuacauacugcggccugacagcccaguauccaggcaugagcguccagggggaagaccuuuaucucgugucuaguuuucugaggaaagggauguag

SEQ ID NO: 13422 - RNA, 705 nt, Artificial Sequence
  Description of Artificial Sequence: Synthetic coding sequence
augaagacgcuggccggccuugugcuaggccugguuauuuucgaugccgccgucacugcuccuacacucgaguccauuaacuacgauucagaaacauaugaugcaacauuggaagacuuggacaaucuguacaauuacgaaaacaucccggucgacaaaguugagauagagaucgccaccgugaugccuucaggaaauagagagcugcucacaccgccaccccagccagaaaaagcccaagaggaagaagaggaagaggaaucuacaccacgacuuaucgauggauccucaccccaagagccagaauucaccgggguucuagggccccauacuaacgaagauuuucccaccugucuucucuguacuugcauaucuacuaccguuuacugcgacgaccacgaacuggaugcuauuccgccgcugcccaagaauaccgcuuauuucuacagucgcuuuaaucggauaaagaagaucaacaaaaacgauuucgcuaguuuaagugaccugaagcguauugaccugacuaguaaccuuauuagcgagaucgacgaggacgccuuucggaagcuaccacagcuucgcgagcucgugcugcgagauaauaaaauccgccaacucccagaauugcccaccacucugaccuucauagacaucucuaauaaucgccuaggucgaaaaggcaucaagcaggaagccuucaaguag

SEQ ID NO: 13423 - RNA, 2559 nt, Artificial Sequence
  Description of Artificial Sequence: Synthetic coding sequence
augcugccaaccgagguuccccagucccacccgggacccagcgcucuuuuacuucugcaguugcuccucccuccuacuucagccuucuuccccaauauauggucgcuccuugccgcuccgggcuccauuacccaccaggaccucacagaggaggccgcgcucaacguaacgcugcagcuuuuccuggaacagcccccuccagggcgcccaccccuacgucuggaggacuuccucggacggacccuccuggccgaugaccuguucgcugcguacuuuggcccggggagcucgcggagguuucgagcugcccuuggcgaagugucuagggccaaugccgcacaggauuuccugccgaccucucgcaaugauccugaucuucacuucgaugcugaacgcuuaggccaaggaagagcacgccuggugggcgccuugcgggaaacggugguagccgcucgugcucucgaccacaccuuggcuaggcagagauugggagcagcccuucaugcacugcaagauuucuauucacacucuaacuggguggagcucggagagcagcagccacacccacaccuauuguggccacgccaggagcuccaaaaccucgcccagguggcggacccuaccugcuccgacugcgaagagcucuccuguccacgcaauuggcuuggcuucacgcugcucacaucuggguacuuugggacucacccgccaaagccaccaggcaaauguagccacggaggucauuucgaucggucuaguagucaacccccucgcgggggaauuaauaaagauucuacuaguccuggauucucaccccaccauauguuacaccuccaagcggcaaaacucgcccuacuggcaagcauccaagcauuuucucuccuucguucccgucugggggauagggacuuuucccgccuccucgacaucacuccugcguccucacuuucguuuguucucgauacaacggguucaaugggggaggagauaaaugccgcgaagauccaggcccgacaccuuguugagcagagaagagggucgccuauggagccaguccauuaugugcuggugccauuccacgaucccggauucggacccguguuuacuacuagugacccagauucuuuuuggcagcagcugaacgagauucacgcccuggggggaggcgacgagccugaaaugugucugucugcucuccaguuagccuuacugcacaccccuccgcucuccgacauauucgucuuuacugaugcaagcccgaaggacgcauuucucacaaaccagguagaaucuuugacucaggaaaggaggugccgagucacauuucuggugacugaagauacgucuagaguacagggucgggccaggagggaaauccuguccccucuuagauucgaaccauauaaagcugucgcccucgcuucuggaggugaaguaaucuuuacaaaggaucagcacaucagagacguggcggcuaucguuggcgagaguauggcugcccucguaacuuugccguuggauccaccagucgucguuccaggacaaccacucguuuucagcguugauggacuucugcagaaaaucaccgugcgcauccauggcgauauauccuccuuuuggaucaagaauccugcgggggugucccaagggcaagaggaaggaggugggccuuuggggcauacccgccgguucggucaguuuuggaugguaaccauggaugacccuccucagaccggcaccugggagauucaggucaccgcagaagauaccccaggugugaggguucaggcccaaacaucccuggacuuccuauuccauuuuggcauuccuauggaagauggaccucaccccggguuguauccacuuacacagccaguugccggccuccaaacacaauuacuaguagaagucacuggucucgguucacgcgcuaacccuggcgauccucagccucacuucucccauguuauccuccgaggggucccagaaggggccgaacuggggcaggucccacuggagccuguuggaccacccgaacggggucugcuggccgcgucgcugagccccacacugcuuucaacaccuagaccuuucucccucgaacuaauaggacaggacgcggcuggcaggcggcugcauagagccgcaccccaaccuaguaccguggugccgguacugcuagagcugucaggaccaucgggauucuuggcacccggaaguaaaguuccccuaucccugcgcauugccuccuuuagugggccucaagaccucgauuugcgcacauuugugaauccuagcuuuucuuuaacaucaaaucuaucccgcgcccaccuggagcugaaugaaucggcuuggggaagacuguggcucgaagucccagauagugcugcuccagacucugucguaauggugacugugacagccggaggccgggaagccaauccagugccaccuacacaugccuucuugagacuucucguaagcgcccccgccccacaaguacgcaaccacuacuuccccucacaggggcccgcucaccauccuuaccgguuaauuuag

SEQ ID NO: 13424 - RNA, 2760 nt, Artificial Sequence
  Description of Artificial Sequence: Synthetic coding sequence
augggcccugaggcacuguccucacuguuguuacugcuacucguggcaucgggcgacgccgauaugaagggccacuuugaucccgccaagugcagguacgcgcuggguaugcaggacaggacuaucccugacagcgauaucucugccucaucuucuuggucugacuccacugcggccaggcacagcagacuggagaguucugacggggauggcgcauggugccccgccggcagcguuuucccuaaagaagaagaauaucuucagguugaccuucagagauuacaucuuguggccuuaguagggacucaggggcgccacgccggcggccucggcaaggaauuuagucgcucauauaggcugcgguacagucgcgauggaaggagguggaugggguggaaggacagguggggccaagaggucauuagugguaaugaagaucccgagggcguugugcugaaagaccugggaccccccaugguagcuaggcugguccgguuuuacccacgagcugaccgaguaauguccguaugucuuaggguugagcucuacgggugucuauggcgagaugggcuguuaucuuacaccgcccccguuggccaaacuauguaucuuagcgaagcugucuaccugaaugacucuaccuacgauggucacacaguuggcggauugcaauacggaggccuuggucagcuugcggauggcgugguugggcuggaugacuuucgaaagucacaagaauuacggguguggccuggcuaugauuacgugggcuggucuaaucacaguuucagcucgggcuauguagagauggaguuugaguucgaccgucugcgugcuuuucaggcaaugcaggugcacuguaacaacaugcauacuuugggcgcacgacugccggggggcguugaguguagauucagacgagggccggcuauggccugggagggggaacccaugcggcacaaucugggaggcaaccugggggacccaagagcccgcgcuguguccgugccacucggaggccgcguagcucgauuuuuacagugcagauuccuguuugccgggcccuggcuacuguucucggagaucuccuuuauuagcgacguugugaauaauucuucuccagcccuuggaggcacguuuccgcccgcucccugguggcccccugggcccccaccaacuaacuucuccagccuugaacucgaaccucggggccagcagccaguugcuaaggcugaaggaucaccaaccgcaauacugauuggaugucuaguggcgauuauacugcuucuuuugcuuauuauugccuugaugcucuggcgauuacacuggcgacgccucuuaaguaaggccgaacgacgaguccuagaggaagaauuaaccgugcaccuaagcgucccgggcgacacuauccuaaucaauaaucgcccaggcccccgggagccccccccuuaccaagaaccuagaccucguggaaaccccccucauucagcaccaugcgugccaaauggcagcgcccuguugcugagcaacccagcuuaucgccugcuucucgcgaccuaugccaggccaccuaggggaccuggaccacccacucccgccugggcaaaaccuacuaauacucaagcuuauaguggagacuauauggagccugagaagcccggcgccccccugcugccaccuccuccccagaacucagugccccacuacgccgaagcugauauagugacacugcagggcguaacuggugguaauaccuaugccgugcccgcccugccgcccggcgcagugggggacggucccccacgggucgacuucccucgaucucgccugcguuuuaaagaaaagcugggagaaggccaguuuggagaggugcaucugugcgaaguggacuccccucaggaucucgucagccucgacuucccccucaacgucagaaaaggccaucccuuacuggucgcuguaaagauucugcgaccugaugcuaccaagaacgccuccuucucucuguuuucgagaaaugauuuucugaaagaagucaagauaaugucucgccugaaggauccaaauaucauccgcuuauuggguguuugcguccaggaugaccccuugugcaugauuaccgauuacauggaaaacggggauuugaaccaauuccuuuccgcccaccaguuggaagacaaggcagcagaaggcgcaccaggugacggucaggccgcgcaaggccccacuaucaguuacccgaugcuacugcauguggcagcucagaucgccucuggcaugcgcuaccuugccacacugaauuuuguucacagagaccucgccacacgaaauugucuugugggugagaauuuuacgauaaagauugccgacuucggcauguccagaaacuuguacgccggcgacuacuauaggguucagggccgcgcagugcuuccgauuagguggauggccugggaguguauccuuaugggaaaguucaccaccgccagugaugucugggcuuuuggggugacucuaugggaaguucugauguugugcagggcccaaccuuuuggucagcugacugacgagcagguuauugagaacgcuggcgaguuuuucagagaucagggucggcaagucuaccuuucaagaccgccagccuguccucaggguuuguaugagcucaugcugcguuguuggucacgagagucugagcagcgaccccccuuuucacaguugcauagguuucucgcggaagacgccuugaacaccguguag

SEQ ID NO: 13425 - RNA, 1737 nt, Artificial Sequence
  Description of Artificial Sequence: Synthetic coding sequence
augcuguugcuguugcugcuugcgccacuguuccuuagaccacccggagcugguggugcucagacgccaaaugccacuucagaggggugucaaauuauucacccuccaugggagggcgggaucagguacagaggucuuacucgggaccaggugaaggcgaucaacuucuugccaguggacuaugaaaucgaauaugugugccgcggagagcgugaagugguaggaccaaaaguuagaaaaugccucgccaacggaaguuggaccgauauggauaccccaucuagaugugugcgcaucuguuccaaaagcuacuuaacacucgagaaugggaagguauuccugacuggcggggaccugcccgcccucgacggcgcucguguugauuuucgcugugacccagacuuucaccuuguuggauccucuagaagcauuugcagucagggccaauggagcacaccuaagccgcauugucagguuaaccgcaccccucauagcgaacggagggcaguguauauuggcgcccuguucccaaugagcggaggguggccuggcggccaggccugucagcccgcuguagagauggcgcuggaagacgugaauagucggcgcgacauuuugccggauuacgaacuaaagcugauucaccaugauagcaagugugacccuggccaggccacuaaauaccucuaugaacuacuguauaaugauccuauaaaaauuauucugaugcccgguugcucuucuguuucuacccuaguagccgaggcggcaaggauguggaaucugaucguacucucuuauggcuccucuuccccagcccucucaaaucggcaacgcuucccuacuuucuuucggacucaucccucugcuacccuucauaacccgacgcgcguaaaacuuuucgaaaaguggggcuggaaaaagaucgcaaccauacagcaaacuaccgagguguuuacaucuacacuagacgaucucgaagaaagggucaaggaggcggggauugaaauuacuuuucgccagaguuuuuuuagcgaccccgccgucccugugaagaaucucaagagacaagacgcuagaaucauugugggauuauuuuacgagaccgaggcgcggaaaguguuuugcgagguuuacaaagaacgucuguucggaaaaaaguacgucugguuccugaucggaugguacgccgauaacugguucaagauauacgaccccagcauuaauuguaccguggacgagaugaccgaagcuguugaaggccacauaaccaccgagaucgucauguugaaccccgcuaacaccagaucuaucucaaacaugacgucccaggaguucguggaaaagcugaccaaacgcuugaaacggcauccagaagagaccggcggguuucaggaggcaccacucgccuacgacgcaauaugggcucuugcacucgccuugaauaagaccuccgggggcggaggccgauccggagugagauuggaggauuucaacuacaauaaccagaccaucacugaccagaucuacagggccaugaacucaucuagcuucgaaggggugaguggccacgugguauuugacgcaagcggcuccagaauggcauggacucucaucgaacaacugcagggcggcuccuacaaaaagauuggguauuacgacagcacaaaggaugaucucagcuggaguaagacugauaaguggauuguaaucucacguacccauagcccuacuuag

SEQ ID NO: 13426 - RNA, 516 nt, Artificial Sequence
  Description of Artificial Sequence: Synthetic coding sequence
augcgacauaaucuagguggcaaccucggagauccucgugcccgcgcaguaucugugccccugggagggcgagucgcucgcuuccuccagugucgcuuucuguuugccggaccauggcuucuguucagcgagaucucauuuauuuccgacgugguuaauaacagcucucccgcucuuggagguacuuuuccuccugcucccugguggcccccaggaccacccccuaccaacuucucaucgcucgaguuggaaccccggggccagcagcccguggcgaaagcugaaggcucuccaaccgccauauugauuggauguuuagucgcgauaauucuccuucuguugcugaucaucgcgcugaugcuuuggagacugcacuggcgacgccuccucucgaagguguuagaaucccaccccaggacccgaaguccaggauuagugggcauuagaccaacaccacuccccgugagccccauggcacucguucaccucugugaaguggacuccccccaggacuag

SEQ ID NO: 13427 - RNA, 2067 nt, Artificial Sequence
  Description of Artificial Sequence: Synthetic coding sequence
auguuaccuaccgaggugccucagucccacccaggacccucugcuuuauuacuucugcagcugcugcugccaccuacuucugcauucuuuccuaacauuuggucccugcuggcagcaccaggaucuauuacacaccaagaccucacugaagaggccgcccugaacgucacucuucaacucuuccuagaacagcccccacccggccgacccccucugcgcuuggaggacuuucucggucguaccuuguuggccgacgauuuguuugccgcuuacuucgggccuggcuccucucgaagauuccgcgcugcccugggagaggugucucgcgcaaacgccgcccaggacuucuugcccacuagcaggaaugacccagaccugcacuuugacgcugagagacucgggcaagggcgcgcccggcuagucggcgcccuacgggaaacagucguggccgcuagagcucuggaccacaccuuagcccggcagcgccuuggggcugccuugcacgcucuucaggauuuuuauagccacaguaauuggguugaguugggggaacaacagccucacccacaucuucuauggccuagacaggaacugcagaaccuugcccagguggccgaccccaccuguagugauugugaggaacugaguugcccgagaaauuggcugggauuuacccugcucaccucuggguauuuuggaacacacccacccaagccgccuggaaagugcucucaugggggacacuucgacaggagcucuagccaaccccccagagguggcauaaacaaggacucuaccuccccaggguucagcccacaccacauguuacacuugcaggccgcuaaguuggccuuacucgccucuauucaggccuucucucuucuucguucuagacuuggcgacagggauuuuucaagacuccucgacauuacucccgcuucaucucucuccuuugugcuagauaccacgggcagcaugggagaggagauuaacgccgccaaaauccaggccaggcaccucguggagcagcgcagagguucccccauggaacccgugcacuacguucucguuccauuucacgacccuggauuuggaccaguguucacuaccucugauccggacagcuucuggcagcaacucaacgaaauucacgcacuggguggaggggaugaaccagagaugugccugucggcccuccagcuggcguugcuucacaccccaccacucuccgacauuuucguguucacggaugccagcccuaaggacgccuuuuugacaaaucaaguugaauccuuaacacaggaacgacgaugcagagucacguucuuggugaccgaagauacaagccggguacaaggcagggccaggagggagauucugagcccauugcgcuucgaaccauacaaggcggucgcccuugccagcgggggcgaagugaucuuuacuaaggaccagcacauacgagacguagcagccauugucggggaaucaauggccgcucuggucacucugccacuagauccgcccgucgugguccccgggcaaccucugguguucuccguugauggccugcugcagaagauuacugugagaauucauggagacaucucauccuucuggaucaagaauccagccggcguaucccaggggcaggaggaaggaggcggcccgcucgggcauacucgccgguuuggccaguuuuggauggucaccauggaugaucccccacaaacugguaccugggaaauucaaguuaccgcugaagauacaccgggagucaggguacaggcacagacaucucucgauuuucuguuccauuuugguaucccuauggaagacggaccacauccuggauuguacccacugacucaaccuguggcaggucugcagacacagcugcugguagagagccagagcuggggcagcucagccgccuuucucccaagacacccuucucggggaccccgaggcugcagaacccgccccggugcacucggcgcccguggcaccuccggagcuaggucaccacggagcuuggcagucgcacacgccgccguccacccguag

SEQ ID NO: 13428 - RNA, 5097 nt, Artificial Sequence
  Description of Artificial Sequence: Synthetic coding sequence
augcgacuguuguggggacuuaucugggcaucuuccuuuuuuacacuuuccuugcagaaaccccgcuuacugcuguucaguccaucugugguucaccuaggcguuccacugucaguggggguccaguuacaggacguaccucgaggccaaguugugaagggaagcguguuucucagaaacccaucaaggaauaaugugccaugcagcccuaagguggauuuuacacuuuccucugagagggauuucgcacuccugucacugcaggugccccucaaggaugcaaagagcuguggguugcaccagcuccuucgcggcccagagguacaacuggucgcccauagucccuggcuaaaggacagcuuaagccggacuacgaauauucaggguaucaacuugcuauuuucuucgcggagggggcacuuauuccuccaaacugaucagccuauauacaauccaggucagcgcgugcguuaccgaguuuucgcuuuagaccagaaaaugaggcccaguaccgauacaaucaccgucaugguugagaauagucauggccugaggguacgcaagaaggaaguguacaugccuagcagcaucuuccaggacgacuuuguuaucccugacaucucagagccuggaacuuggaaaaucucugcgcgcuuuagugacggacuagagaguaauagcucuacccaguucgaagugaagaaauacgugcugcccaacuucgaagucaagauuacuccugggaaaccauauauacugacggucccaggccaccuggaugagaugcaauuagacauccaggccagguauauauauggcaagccaguucaagggguugcguacguucguuucggucugcuggacgaggaugggaaaaaaaccuuuuucagagggcuggaaucucagaccaaauuagugaacggccagagucauaucucucucuccaaagcagaguuccaggacgcacuggaaaaacugaauaugggcaucaccgacuugcagggccucaggcucuacguagccgccgccauaauugaauaccccgggggcgaaauggaagaagcugaguuaacaaguugguacuucgucucuagcccuuucagccucgaucucucuaagaccaaacggcaccuugugccgggggcccccuuuuuauugcaggcccuggugagagagaugaguggcucuccggcaucaggaaucccagugaaggugagcgcuacagucucguccccagggagcgugccugagguacaggacauucagcagaauacugauggaagcggucaggugucaaucccuaucauuauuccucagaccauuuccgagcuacaacucucuguuagcgccggauccccccauccagcaaucgcccgucugaccguggcagcuccuccaagcggggguccuggauuucuuaguauagaaaggccagauagccggcccccgagagugggugauacauugaacuuaaauuugcgcgcaguagguagcggagcaacuuucucacacuauuauuacaugauuuuaucacguggacagaucgucuuuaugaacagagaaccaaaacggaccuuaaccucuguauccguauucguugaccaccaccucgcaccuucuuuuuauuucguggccuucuauuaucacggcgaucaccccguggcgaauucucuccgcguggaugugcaggccggcgcaugcgagggcaaacucgagcugucgguggacggggccaaacaguauaggaacggcgaaucagucaaacugcaucuggagaccgauucacuggcccucguggcccugggugcacuugauaccgcacuguacgcugccggaucaaagucacacaaaccucuuaauauggggaaagucuucgaggccaugaacagcuacgaccuggggugugggccugggggcggcgacucagcgcugcaaguguuucaggcugccggccuugcguucuccgauggggaucaguggaccuugagccgaaagaggcugucuugucccaaggaaaaaacaacuaggaagaagcgcaauguuaauuuccaaaaggcuauaaacgaaaagcuaggacaguacgccucuccaacugccaaacgcugcugccaagacggcgugacuagacugccaaugaugagguccugugagcagagggcugcccgggugcagcagcccgacugucgcgaaccauuucugucaugcugucaguuugccgagucccugagaaaaaaaucucgcgacaaaggacaggccggacuucaaagggcucuugagauauugcaggaagaggaccugaucgaugaggacgacauccccguuaggucuuucuuccccgagaacuggcuuuggagaguugaaacuguagaucgguuccagauccugacccuguggcuuccagacucgcugacaacgugggaaauucauggacugucucucucuaagacaaaagggcucugcguagccaccccaguucagcuuagaguguuuagggaauuucaucugcaccuucgacugccaaugucggucagaagguucgagcagcuagagcugcgaccggugcuguauaauuaccucgacaagaaccuaacugucagugugcauguaucucccgucgagggccuuugccuugcagguggaggcggucuggcucagcagguccugguccccgccggaucugcucggcccguggccuucuccguggucccaacagccgcugcugcggugagcuuaaaaguggucgcucgcggcucauuugaauucccuguuggcgaugcagucuccaaaguccuucagaucgaaaaggagggcgcaauccaucgugaggagcugguguaugaacuuaacccucucgaucauaggggcagaacauuagaaauaccugguaacucagaucccaacaugaucccugauggagacuuuaacaguuacgugcgagucaccgccucagauccucuggauacucuggggucggagggcgcccugucaccaggggggguggccagucugcugcgucugccucgaggcugcggugagcagaccaugaucuaccuugcaccgacgcuggcggcaucacgcuaucuggacaagacagaacaauggagcacauugccaccugaaaccaaggaucaugccguggaccugauccagaagggcuacaugcggauacagcaguucagaaaagcagaugguuccuacgcagcuuggcucuccagaggcuccagcaccuggcugacagcauuugugcugaaggugcugagucuggcccaggaacaagugggagggucuccagagaagcuccaagagacuaguaacuggcuucucagccagcagcaggcagaugguagcuuucaggaucuaagcccuguuauucaccgaucuaugcagggcgguuugguggggaacgaugagaccguggcauugacagcuuuugugacaaucgcucuccaccacgggcucgccgucuuucaggacgaaggugcagagccucugaagcagcgcguggaggccagcaucaguaaagcaucuucauuccugggagagaaagccucggccggauuacugggggcgcaugcggcagcuaucacugcauacgccuuaacacugacuaaggccccugcagaucuucgcggcguugcacauaacaaccuaauggcaauggcacaggagacuggcgauaauuuguacugggguucugugacagggucccaaaguaacgccgucagucccacuccugcgccacgaaauccuagugacccuaugccccaagcucccgcucuguggaucgaaaccacagcuuacgccuuguuacaucuguuacugcacgaaggaaaggccgaaauggcggaucaggccgcagcguggcugacuagacaagguuccuuucagggagguuuccgcagcacacaggauacugugaucgcucuggacgcccugucagcauacuggauagccagucacacuacugaagaaagaggcuuaaacgugacccuuucuagcacaggccggaacggauucaaaucucacgcccuucaacugaacaauagacagauccgcggauuagaggaggaacuccaauuuagucugggcucuaagaucaaugucaaggugggagggaacucaaagggaacacuuaagguccugcgaacuuauaauguguuagauaugaagaauaccacaugccaagaccugcaaauugaggugacagucaaggggcacguagaauauaccauggaagcuaaugaggacuacgaagauuacgaauacgaugaacucccggcaaaagaugauccugacgcgccuuuacagccagugacuccguuacaacuguuugagggacggcggaaucgacgaaggcgagaggcaccaaaacuuacgagucugagugacagauaugugagccacuucgagaccgaaggaccacauguucugcucuauuucgacaguguuccgacuagccgagaaugcguaggauucgaagcaguacaagaagucccagucggacucgugcagccugcuucggcaacccuguaugauuauuauaacccagaaaggcguuguucaguguuuuauggugcgcccagcaagaguaggcuacuggccacccucuguuccgccgaggugugucagugugcagaggggaaauguccgcggcaaaggcgcgcccuggaaagaggucugcaggacgaagacggguaucggaugaaguucgcauguuacuauccccggguggaguauggcuuucaagugaaagugcugagagaggacucucgcgccgccuuuaggcuuuucgagaccaaaauuacccaagugcuccauuucaccaaggacguaaaggcggccgcaaaucagaugcgcaacuucuuaguccgggcaaguuguagacuucggcucgagccaggcaaggaauaccuaaucaugggauuagauggggcuacauaugaccuagaaggccauccacaguaccuccuugacaguaauucauggaucgaagagaugcccagcgagagacuuugucgguccacuagacagcgcgcugcuugcgcacaacugaacgauuuucuucaggaguauggaacacagggcugccagguguag

SEQ ID NO: 13429 - RNA, 726 nt, Artificial Sequence
  Description of Artificial Sequence: Synthetic coding sequence
augaaauucauucuucuuugggcucuuuugaauuuaacagucgcucuggccuuuaacccggauuauacaguuuccuccaccccuccuuaccuugucuaucuuaaaagcgauuaucugcccugcgccggcguccucauacaccccuuauggguaaucaccgcugcccacugcaaccucccaaagcuaagagugauuuuaggcgugacuaucccugccgacucuaacgagaaacauuuacaaguaaucggcuaugagaagaugauucaccacccgcacuucuccgucaccaguauugaccacgauaucaugcuuauuaagcucaaaacagaagcagaguugaacgauuaugugaagcuggcuaaucugccauaucagaccauauccgagaacacaaugugcucggucaguacauggucuuacaacguuugcgacaucuauaaagaacccgauucacuccagacugucaacauuagugugauuagcaaaccgcaaugcagagacgccuauaaaaccuauaauauuaccgagaacaugcugugcguaggaauugugcccggccgacgccagcccuguaaagaggugagcgcugcuccggcuauuuguaacggcaugcugcaaggcauuuugucuuucgccgacgguuguguguugcgggccgaugugggaauauaugcaaaaaucuucuauuauauuccuuggauugaaaacgugauucagaauaacuag

SEQ ID NO: 13430 - RNA, 732 nt, Artificial Sequence
  Description of Artificial Sequence: Synthetic coding sequence
augggaccugaggcuuugaguucacugcuguuacuacuccuuguugccucuggcgaugcugacaugaagggacacuuugauccagcaaaguguagguacgcccucggaaugcaggaccgcacaauaccggauagcgacauuucugcaagcuccuccuggagugauagcacagcugcuaggcauagccgacuggagagcagugauggcgauggugcguggugccccgcaggcuccgucuuuccuaaggaggaagaguaucuccaggucgaucuccagaggcugcaucucguugcacucguaggcacucaaggaagacaugcggggggacuggggaaagaguuuagccgguccuaccgguugcguuacaguagggacggacggagauggaugggauggaaagaucgcuggggacaggaagugauaagcggcaaugaggauccagaaggcguggugcugaaggaccucggacccccuaugguggcucggcucguucgauuuuacccacgagcugaucguguaaugucuguuugcuugcguguggagcuguauggaugucuguggcgugauuguucgaugggcgugugggcaucuuggcagauggucugguggggcuggaugacucuaggucguguacggucgugugggucuggccaggccaugaccaugugggauggcgccaccacugcaucccccguggcaauguggcgcuggagucucucccugaccgguuag

SEQ ID NO: 13431 - RNA, 1986 nt, Artificial Sequence
  Description of Artificial Sequence: Synthetic coding sequence
auggacuuagugcugaaacgcugucuccuccacuuagcagugauuggugcccuccucgcuguaggggcuacaaaagugccacggaaccaagacuggcuuggcguaagccgucagcugcgaacaaaagccuggaauaggcagcuuuaccccgaguggacagaggcacagcggcuggacugcuggcgcggcggucaagugucgcugaaaguuaguaaugacggucccacccuuauuggcgcaaaugcuuccuuuaguaucgcuuuaaacuuccccgggucccagaaagugcuaccagacggccagguuauaugggugaauaacacaaucaucaacggcucucagguguggggcgggcaaccuguguacccucaggagacagacgaugccugcauuuucccagacggaggaccaugucccuccggcaguuggucucagaaaagaagcuucguguacguguggaagaccuggggacaguacuggcaggugcugggaggccccgugagcggucuuagcaucggcaccgggagagcuaugcucggcacccauacaauggaggugaccguguaccaucgaagagguagcagaagcuacguaccguuagcucauaguagcucggccuucaccauuacagaccagguuccguucuccgucuccgugucccagcucagggcccuggacggaggaaacaaacauuuucugcggaaucagccacugaccuuugcccugcagcuccaugacccaagcgguuauuuggcugaggccgacuugagcuauacaugggauuucggggacuccucagguacucugauuucacgugcucugguuguuacucacacguaccuagagcccggaccugugacugcacagguggucuugcaggccgcaauuccccucaccagcuguggguccucuccagugccuggcaccacugacggccauagaccaacugcagaagcaccuaauacgaccgcaggccagguccccacuacagaagucgucggcacuacucccggccaggccccaaccgcggagccaucugguacaacuuccguccaggugcccacuaccgagguuauuaguacugccccgguacagaugccuaccgcagagaguacagggaugaccccagaaaaggugccugugagcgaggugauggguaccacacuugcagagaugucuacuccagaggcuacaggaaugacuccggcagaggugaguauaguuguucuuuccggaacuaccgcugcacagguaacuacaaccgagugggucgagacgaccgcucgcgaacuucccaucccugagccagagggaccugacgccuccagcaucaugagcacugaaagcaucacaggcucucugggcccccuguuggauggaaccgccacccuccgccuaguuaaacgccagguuccucuagauuguguguuguaucgauacggcuccuucuccgugacgcuggacaucguccaagggauugaaagugcugagauacugcaagcuguaccaagcggggagggugaugcguucgagcucaccguguccugccaggguggucugccaaaggaagccuguauggaaaucucaaguccaggaugccagccccccgcucagcgauugugccagccagugcuucccucacccgcaugccaacugguacuacaccagaucuugaagggcgggaguggaacuuauugccugaacgugucccuagcugauacaaacaguuuagcaguggucucuacucaacuaauaaugccgggccaggaagccggccuggggcaagucccucugauuguugguauauuguugguccucauggcuguggugcucgccuccuugaucuaccggcggcgucuuaugaagcaggacuucagcguuccccaguugccccacucaaguucacacuggcugcgacugcccagaauuuucugcucuugcccuauuggcgagaauucuccgcugcucagcggucaacaggucuag

SEQ ID NO: 13432 - RNA, 2760 nt, Artificial Sequence
  Description of Artificial Sequence: Synthetic coding sequence
augggcccugaagcccuuuccucccuucugcuccuuuuacugguugccagcggagacgccgauaugaagggccacuuugauccagccaaaugcagauacgcgcuggguaugcaggaccgcacuauucccgauucugacauaagugccucaucuucuuggucagauaguacagcagcccggcauagucgccuggaaaguagugacggcgauggagccuggugccccgcuggcucugucuuccccaaagaagaggaguaucugcaaguugaccugcagagacugcauuuaguggcuuuggucggcacucagggaaggcacgcaggcgguuuggguaaggaauucagccggaguuaccgcuugagguauagucgagacgggagacgguggaugggauggaaggaccgguggggccaagaagugaucucgggcaaugaagauccugagggcgucguuuuaaaggauuugggcccccccaugguggcccgcuuagugagguucuauccgcgcgccgauagggugaugucuguuugccugcgcguggagcuguacggaugccuguggagagauggucuccucucuuacacagccccugugggucagacaauguaccucuccgaagcgguauaucucaaugauagcacguaugacgggcauaccguggggggguuacaguacgguggacuagggcaauuggccgauggcguggucgggcuggacgauuuccgcaagucacaggaacugagaguguggccuggauacgauuacgugggcuggucaaaccauucguuuucaagcggauacguagagauggaguuugaguucgacaggcugagagccuuucaggcaaugcagguccacugcaauaauaugcacacuuugggggcaaggcugccagguggcgucgagugucguuuccggcggggccccgccauggccugggaaggagaacccaugcggcauaauuuggggggaaaccuuggggacccuagagcacgggccguaagcguuccacuuggaggccggguggccagguuucugcagugcagauuuuuauuugcagggcccugguugcuguucagugagauuucauuuauaucagacguuguaaacaauucaucaccggcacuggguggcaccuuuccuccugccccaugguggcccccggggccgccccccacaaacuucagcucucucgaacuggaaccacgaggucagcagccagucgcuaaagccgaagguucgccaaccgcuauuuugauaggcugccuagucgccauuauccugcuacuccucuugaucaucgccuuaaugcuuuggcguuugcacuggagaagauugcuguccaaagcugaaagacgugugcuggaggaggaacucacggugcaccucagugugccaggggauacaauccuuauuaauaaucgcccaggccccagggaaccgccucccuaccaggaacccaggccaagagguaauccuccgcacucagccccaugcguuccuaacgguagcgcauugcuguuaagcaacccagccuaccggcuguugcuggcuaccuaugcccggcccccccgaggaccaggaccacccaccccagcaugggcaaaacccaccaacacacaagccuauucuggugauuauauggagccagaaaaaccaggcgcuccucuguuaccuccuccaccccaaaauagcgucccgcauuacgccgaggcggauauugugacucuacagggcguaacugggggaaauaccuaugcuguuccagcacuccccccuggagcaguuggcgauggaccaccaagaguugacuuuccuaggagcaggcuucgcuuuaaggaaaagcucggggaggggcaguuuggagaagugcaucugugugaaguggauagcccccaagaucugguuagccuagauuuuccacugaacgucagaaagggacauccauugcugguagccguaaagauucugcgucccgacgccaccaagaaugcaucuuucucacuuuuuagccgcaacgacuuccugaaggaagugaaaauuaugagucgguuaaaggacccuaacauuaucagauuacuaggcguguguguucaagacgacccgcuuugcaugaucacggauuacauggagaauggugaucugaaccaguuucuuagcgcccaucaacucgaagacaaagcagccgagggggcacccggggaugggcaggccgcccaagggccuacuauuuccuacccaauguugcuacacguagccgcccagauugccuccgggaugagguauuuggccacucugaacuucguacauagggaccuggcgacuaggaauugccuggugggagagaauuuuaccauaaaaauagccgacuuugguauguccagaaaccuguacgcuggagacuauuauagagugcaaggaagggcggugcuccccauuagauggauggccugggaauguauucuuauggguaaauuuaccaccgcuucagacgucugggcguucggugucacgcuuugggaaguuuuaauguugugccgagcacaacccuuugggcaacucaccgacgagcaggugaucgaaaacgcgggugaauucuuccgcgaccaaggaagacaaguguaucugucccgaccucccgccugcccccaggggcucuacgaacugaugcugaggugcuggucucgggagucugaacagaggcccccauucucccaacuccacagguuccucgccgaagacgcgcugaacaccgucuag

SEQ ID NO: 13433 - RNA, 216 nt, Artificial Sequence
  Description of Artificial Sequence: Synthetic coding sequence
augcccgcuggagucccgaugucaacuuauuugaagauguuugcagcaagccuucuggcuaugugcgccggagccgaagucguccacagauacuauaggccggaucucaccaucccagaaaucccuccgaagcgaggcgagcucaaaacagaguuacugggccucaaggaaagaaagcauaaaccucaggugucacaacaagaagaacugaaguag

SEQ ID NO: 13434 - RNA, 2685 nt, Artificial Sequence
  Description of Artificial Sequence: Synthetic coding sequence
augucguugcccagguguugcccccauccauuacgaccugaggguuccggugcaaugggaccagaagcauugaguagucugcugcuuuuacugcugguggcaucuggggaugcggauaugaaaggccacuucgauccggccaaaugucgguaugcccuggggaugcaggaccguaccauuccagacagcgauaucagugcaucuagcagcuggucugacagcacugcagcgcggcauagucgacuggagagcucagacggagacggugcuuggugcccugccggcagcgucuucccaaaagaagaggaguaucuucagguagaccuucagcggcugcaccucguagcacucguggggacucagggccggcacgcuggcggccucggcaaagaguuuaguagaucuuaccgccugagguauagcagagauggccggagguggaugggcuggaaagaccgcugggggcaggaagugauuucugggaaugaagauccugagggaguugugcuuaaagaccuggguccacccaugguagccagacuugugagguuuuacccaagagcagaccgggugaugagcgucugccuacguguugagcuguaugggugccuguggagggacggucugcugaguuauacugcacccgugggccagacgauguacuuaucugaagccguuuaucuuaaugacaguacauacgauggucauaccgugggcggcuugcaguacggaggucugggacaacucgccgacggcgucgugggucucgaugacuuucgcaaaagucaagaguugaggguguggccuggguacgacuauguuggauggucuaaccacaguuuuucuagcgguuauguggagauggaauuugaguuugaccgcuuacgagccuuucaagcaaugcaggugcacuguaacaacaugcauacucucggggcccgacucccaggagggguggagugucguuuccgcagagggcccgcuauggccugggaaggggagcccaugcggcacaaucucggcggcaaccugggggauccuagggcccgggcuguguccgucccucuaggugggagagucgcaagguuccuucagugucgguuucuuuucgcaggaccuuggcuguuguucuccgagauaagcuucauuuccgauguggugaauaauucguccccugcccucggcggcacauuuccaccugccccaugguggccuccggguccacccccaaccaacuucagcagccuggagcucgaaccuaggggucagcagcccgucgccaaagcugagggcaguccuaccgcuauucugauagguugucucguugcuaucauuuugcugcuacugcugauaaucgcucucaugcucuggagacugcacuggaggaggcuucucucuaaggcugaaaggcgaguccuggaggaagaacugacgguccacuugucugugcccggggacacuauucugauuaauaauaggccuggaccaagagaacccccaccauaccaagaaccccguccuaggggcaaucccccucauucagcaccgugcgucccaaacggcucugccuauagcggugauuacauggaaccggagaagcccggcgccccccugcucccaccacccccccagaacagugucccgcauuaugcagaagcggauauaguuacucuucagggugugaccggugguaacacguaugcugugccagcacucccaccaggggccgugggugacggccccccucggguggacuuuccucggucccgucuacgcuucaaagaaaaguugggugaaggucaguuuggcgaaguccaccuuugugaagucgauucuccacaggaccuuguuagccucgauuucccccuaaacgugcgaaaaggccacccccuguuggucgccgugaaaauucuuaggcccgaugcgaccaagaacgcaaggaaugauuuccugaaagaaguuaagaucaugagccgguuaaaggaccccaauaucaucaggcuacuuggaguuugcgugcaggaugauccccuuuguaugaucaccgacuacauggaaaauggcgaccucaaccaguuucugucagcacaucagcucgaagauaaagcugcugaaggggcccccggggacggccaagccgcccagggacccacuauuucauauccuaugcuguuacacguagcagcucagauugcaucggggaugcgauaccuggcuacauugaauuucgugcacagggaucuugcaacccggaacugucuggugggugaaaauuucacuauaaagauugcugacuucgguaugucucggaaccuguaugccggcgacuauuaccgagugcagggucgugcugugcugccaauaagauggauggccugggagugcauucucaugggaaaguuuacaaccgcaucugaugugugggcauuuggcguaacacuuugggaagugcugaugcucuguagggcccagccguuugggcagcugaccgaugagcagguuaucgaaaacgcuggagaguucuuucgggaccagggcaggcagguguaucugucgcgucccccagcauguccccagggacucuaugaacucauguugaggugcuggagucgggagagcgagcagcgaccgccuuuuagccaacugcauagauuccuugccgaggacgcccugaauaccguguag

SEQ ID NO: 13435 - RNA, 273 nt, Artificial Sequence
  Description of Artificial Sequence: Synthetic coding sequence
augcagcuuuucuuacuccuaugucucgugcuguugagcccacagggagcgucucugcacagacaucauccccgagaaaugaagaagaggguugaagaucuccauguuggagcaacugucgccccaagcucaagacgagauuucaccuuugaucuauaucgcgcucucgcaucugcugcccccucccagucuauauuuuucucccccguauccaucucuaugucccuggccaugcucucccugggagccgggagcucuacaaagaugcaguag

SEQ ID NO: 13436 - RNA, 618 nt, Artificial Sequence
  Description of Artificial Sequence: Synthetic coding sequence
augaugcgaacucuaauuacaacccacccuuugccauuguugcugcugccccagcaauugcugcaauugguucaguuucaggagguggauaccgacuuugauuucccugaggaagacaaaaaagaggaauucgaggagugccuggaaaaguuuuucaguaccggucccgcgagacccccaacuaaggagaaagugaaaagaagagugcugauagaacccgggaugccccuaaaucacauugaauauuguaaucaugagauuaugggcaagaaugucuauuauaaacaucgcugggucgcagaacauuacuuccugcugaugcaauacgaugaacugcagaaaauuuguuacaauagauucgugccauguaagaacggcauucggaaauguaacagguccaagggacuugucgagggcguguauugcaaccuuaccgaagccuuugaaaucccggcuugcaaguacgaaagcuuguacaggaagggauacgugcuaauaacauguagcuggcagaaugagaugcaaaaaaggauaccccauaccaucaacgaucuuguggaacccccugaacaucggucuuuucucucugaagacgguguauuuguaauuucccccuag

SEQ ID NO: 13437 - RNA, 30 nt, Artificial Sequence
  Description of Artificial Sequence: Synthetic coding sequence
auguccuucuccgcaacuauucuguuuuag

SEQ ID NO: 13438 - RNA, 600 nt, Artificial Sequence
  Description of Artificial Sequence: Synthetic coding sequence
augucuuucagugcaacgauccuguuuuccccaccaucuggaucugaagcaaggugcuguugcugcgcguguaaaagcgagacaaacggugguaauaccggaucucagggagggaacccaccccccagcacgccuaucacagucaccggccacggacuggccgugcaaucaagcgaacaacuacuacacgucauauaccaaaggguugauaaggccgucgggcuggcagaagccgcucuuggacuugccagggcuaauaacgaacugcuuaaaagauuacaggaggaagugggcgaccuccggcaggggaagguuaguauaccagacgaagacggagaauccagggcucauagcagcccaccugaagagccagguccccuaaaagaaagcccuggggaggcguucaaagcacucagcgcgguggaggaagagugcgauucaguggguuccggcguacaaguggugaucgaggagcuucggcaacuuggcgcugccucagucggucccggaccccuuggguuuccugccacccaacgagauaugcgacugccaggauguacccuagccgcgucagaagccgccccauuacugaacccuuag

SEQ ID NO: 13439 - RNA, 633 nt, Artificial Sequence
  Description of Artificial Sequence: Synthetic coding sequence
augagcgcuggaaaaaugaugcgcacauugaucacuacccacccgcugccacugcuccuccugccccaacagcuguuacagcucguccaauuucaagagguggacaccgacuuugauuuuccggaggaagacaaaaaagaggaauuugaggagugccuugagaaguuuuucagcacggguccagcacgccccccaaccaaggaaaaggugaaacggagaguuuuaaucgaaccuggaaugccccucaaucauaucgaauacuguaaucacgagauaaugggcaaaaacguguauuacaaacaucggugggucgccgagcauuauuuucuucugaugcaauaugacgaacugcagaaaauaugcuacaaucgauuuguuccuugcaaaaauggaauucgcaagugcaaucgcuccaaaggccuaguugaaggaguuuacugcaaucuuaccgaagcuuuugagaucccugcaugcaaauaugagucucuauaccggaaaggguacgugcugauuacaugcucuuggcagaaugagaugcagaagcggauuccccauaccauuaaugaucugguagagccaccugagcauagaaguuuucuuuccgaggacgguguguucguuaucucccccuag

SEQ ID NO: 13440 - RNA, 1221 nt, Artificial Sequence
  Description of Artificial Sequence: Synthetic coding sequence
augcagcuguuucuguugcugugccuuguccuccuaaguccccaaggggcuucgcuccaucgacaucacccucgagaaaugaagaaacguguugaagaccuccaugugggcgcuacugucgcuccgaguuccaggagggacuucaccuucgaucucuaccgcgcgcucgcauccgcagcacccagucaaaguauuuucuucucucccgugucaaucucgaugucgcuagccauguugagccuuggcgccgguucgaguaccaagaugcagauacuggagggauugggccucaaucuucagaagucuuccgagaaggagcugcacagaggcuuccagcaacugcuucaggaauugaaucagcccagggauggcuuucagcucagucugggcaaugccuuauuuaccgaucuggucguggacuugcaggauacuuuugugagcgcgaugaagacacuauaccucgcagacacauucccgacaaacuucagagacuccgccggagccaugaaacaaaucaacgauuacgucgccaagcagacuaaaggaaagaucgucgaucugcugaagaaucuggacuccaacgcaguugugauuaugguuaacuauauuuucuucaaggcuaaaugggagaccucauuuaaccacaagggcacucaggaacaggauuuuuaugugaccuccgaaacugugguuaggguuccaaugauguccagggaggaucaguaccauuaccuccucgaucguaaucugagcuguaggguuguggguguuccguaucagggcaacgcgacugcccuuuucauucuuccaagcgaaggaaagaugcagcaaguugagaauggccugagcgaaaagacauuaagaaaguggcugaagauguucaagaagcgacaguuagaguuguaucuccccaaguuuuccaucgagggauccuaucagcucgagaaggugcucccuucccucggcauaagcaauguuuucacaucucacgcugaccucucggggauuucuaaccauagcaacauccaggugucugaaaugguacauaaggccguggucgagguugaugagagcgggacacgagcggccgccgcuaccgggacgauuuuuaccuucaggucagcuaggcugaacucacaaagacucguuuuuaacagacccuuucugauguucauaguagacaauaacaucuuauuccugggcaagguaaauagacccuag

SEQ ID NO: 13441 - RNA, 600 nt, Artificial Sequence
  Description of Artificial Sequence: Synthetic coding sequence
auggagaccuucccacuccuccuccugagccugggacugguucucgcggaggcguccgagagcacuaugaagaucaucaaagaagaguuuaccgacgaagaaaugcaguaugacauggccaagucaggacaagaaaagcaaaccauugagauacugaugaaccccauucucuuggugaagaacacaucccugagcauguccaaagacgacaugucaaguacccugcugacauuccgaagcuuacauuacaacgauccuaaagggaacucaaguggaaaugacaaagaguguuguaacgauaugacuguguggcgaaagguuucugaggcaaacggauccugcaaauggaguaauaauuucauucguuccagcaccgaagugaugcgaagagugcauagggccccgagcuguaaauucguucagaauccaggcauuagcuguugcgagucucuggaacuggagaacacagugugucaguuuacaacaggaaaacaguuccccagaugucaauaccacuccguaacaagccucgagaagauauuaacaguucuuacuggccacagucucaugagcugguuaguuuguggcuccaaacuauag

SEQ ID NO: 13442 - RNA, 411 nt, Artificial Sequence
  Description of Artificial Sequence: Synthetic coding sequence
auguccuucuccgccacaauucucuuuucuccuccuagcgguucagaggcaaggugcuguuguugugccugcaagucagagacaaauggcgguaacacaggcucccagggaggaaauccuccgccuuccacaccaaucaccguuacugggcacggguuggcggugcaauccucugaacaacuguugcacguuauuuaucagcggguggauaaggccgugggccucgcggaagccgcacuggggcuggcacgagcgaacaacgagcuccucaaaagacugcaagaagaagucggugaucucagacaggguaaggugucaauacccgaugaagacggcgaaagccgggcacauuccuccccuccugaagagccuggcccacucaaagaaaguccuggugaggcuuuuaaguag

SEQ ID NO: 13443 - RNA, 252 nt, Artificial Sequence
  Description of Artificial Sequence: Synthetic coding sequence
augucuuuuucagcuaccauucuguuuucccccccuuccggaucagaggcacgauguugcuguugcgcaugcaaaucagaaacaaauggcggaaacacugguucucaaggugguaauccuccuccuuccacccccauuacugugaccgggcacggccuggcugugcagucuucggaacagcucuugcaugugaucuaucagcguguagauaaagcugucggauuagcugaggcggcgcuuggccuggcauag

SEQ ID NO: 13444 - RNA, 30 nt, Artificial Sequence
  Description of Artificial Sequence: Synthetic coding sequence
augucguucuccgccaccauccuguuuuag

SEQ ID NO: 13445 - RNA, 519 nt, Artificial Sequence
  Description of Artificial Sequence: Synthetic coding sequence
augcagcuauuuuuacuacuuugccuuguacuucucucuccucagggugccagccuucaucgccaucaccccagggaaaugaagaagcgugucgaagaucuccaugucggggccacaguugcgcccaguucaaggagggacuuuaccuucgaccuguauagagcucuagccuccgcagcaccaucucaaucgauuuuuuuuucuccugugaguaucucuaugaguuuggcaaugcugagccugggggcuggcagcagcacuaagaugcagauucuggaaggguuagggcugaauuuacaaaagucaagugagaaagagcuucacaggggcuuucaacagcuucugcaagagcugaaucaaccccgcgaugguuuccagcugagccuuggaaaugcacuuuucacggaccuggugguugauuugcaagacacguucguuucugcgaugaaaacucucuaccucgccgacacguucccaacuaacuuucgggacagcgccggugcuaugaaacagaucuag

SEQ ID NO: 13446 - RNA, 615 nt, Artificial Sequence
  Description of Artificial Sequence: Synthetic coding sequence
augccuggcggaaagaaaguggcugguggugguucuucaggggccaccccuacuucggcugccgcaacugcgccaucaggcgugagacgccuugaaacuucugaggggacuucugcccagagagacgaagagcccgaggaggagggggaggaggaucuacgugaugguggugucccauuuuuuguaaaucgcggggggcuaccgguugaugaggccacaugggaaaggauguggaaacaugucgccaaaauccacccagacggagagaaaguugcccaacgcaucagaggcgcuacagaccuaccaaaaauucccauuccuuccgugccuacguuccagccgucaacaccgguaccagaaagacuugaggccguccagcgguacauucgugaacugcaguacaaucacacuggcacccaauucuucgagauuaaaaagagcagaccccucacgggacugauggaccuggcaaaggagaugaccaaggaagcccugccaauuaagugccuggaagcugucauccugggaauguaucccagcucuccagagggcgaaggauccggauuauuaugggcuucugcuagcugcagugaaagugagggcggggugggguag

SEQ ID NO: 13447 - RNA, 1221 nt, Artificial Sequence
  Description of Artificial Sequence: Synthetic coding sequence
augcagcucuuuuugcuucugugucuggugcuucucucaccccagggugcaucucuacaccgucaucauccgcgugagaugaagaaacgcgucgaggauuugcauguuggggcgacaguggccccuuccucgagaagggacuucacauucgaccuauacagggcgcuugccagcgcugccccgagucaauccauuuucuuuuccccagucuccaucuccaugagccucgcaaugcugucucuuggcgcaggaucuuccacaaagaugcaaauucuagaaggucuuggacuaaaccugcagaaaaguagcgaaaaagaacuacacaggggauuucaacaacugcugcaggaacugaaccagccacgggauggauuucagcucucauuaggaaaugcauuauucaccgaccuuguuguggaccugcaggacacauuugucagcgccaugaaaacuuuguaccuggcggauaccuuccccaccaacuucagggacagugccggagcaaugaaacagauuaaugacuaugucgccaaacaaacuaaggguaaaauuguagaucuacugaagaaucuagauuccaaugcuguuguuauuaugguuaauuauaucuucuucaaggcuaaaugggaaacgucauuuaaccacaaaggcacccaggagcaggauuucuacgucacuucagagacaguagugcgcguccccaugaugucccgagaggaccaguaccacuaucugcuggaccggaauuugucaugccgaguaguaggcgugccauaccagggcaaugcuacagcacuguucauucugcccagugagggaaagaugcagcagguggaaaaugggcucagcgagaagacauuacguaaguggcugaaaauguuuaagaagagacagcuggaacuauaccuuccgaaguucagcauugagggaagcuaccagcuagagaagguucucccuucgcuggggauuagcaacguuuuuaccagccacgcugaucuuucuggcauuaguaaccacuccaauauccagguauccgaaauggugcacaaagcugucguugaaguggaugagagugguacaagggcggccgcggccacaggaacuauuuuuacuuuccggucugcucguuugaauucccagagguuaguauucaaucggccauuccugauguuuaucgucgacaauaacauccuguuucuaggcaaggugaaccgccccuag

SEQ ID NO: 13448 - RNA, 3837 nt, Artificial Sequence
  Description of Artificial Sequence: Synthetic coding sequence
augcgccuguugcugcuggugccccugcucuuggcccccgcuccuggaaguagcgcacccaaggucagaagacaauccgauaccuggggcccguggucacaguggucaccauguagcagaacauguggcggggguguguccuuccgcgaaagaccgugcuauucccaaaggcgggauggugguucuucauguguugggccggcccggagccacaggucaugcagaaccgagucuugcccagauggcgcucgcgauuucagagccgaacaaugcgcugaguuugacggggcugaguuucagggacgacgcuacagguggcuaccguacuauucagcaccaaacaagugugaauuaaacuguauaccaaagggagaaaacuuuuacuacaaacaucgcgaagcugugguggacggcacaccuugcgagccagguaaacgagacgucuguguagacggaaguugcagaguuguuggaugugaccacgagcuugauaguucaaagcaggaggauaaaugcuuacggugcggcggggaugggacaaccugcuaccccguagccgggacuuuugacgcuaaugaucugucccggggcuauaaucagauuuugaucgugccuaugggugcuacauccauacugaucgacgaggcugccgccuccagaaacuuccuggccgucaagaacgugaggggcgaauauuaccuaaaugggcacuggacgauugaagccgcuagggcccucccagccgcuucaaccauccuccacuaugagcggggugccgagggcgaccucgcaccggaaaggcugcaugcacgaggcccgacgucugagccgcuggugaucgagcugaucucucaggagccuaauccuggagugcauuacgaauaccaccucccauuacgccgcccuaguccaggcuucucauggucucacggguccuggucagacugcuccgcugagugugggggcggccaccagagccggcuggucuucugcacuauagaccacgaagcuuacccugaccauaugugucagaggcaaccuagaccggccgaccgcaggucuuguaaccugcacccaugcccagagacaaaaagauggaaagcaggccccugggcaccaugcuccgccuccugcgguggcgggucccagagcagguccgucuauuguauuucuagugauggagcuggcauacaggaggcggucgaagaagccgaaugugcugguuuaccagggaagccaccggcaauucaggccuguaaucuccagagaugcgcugcauggucuccagaaccauggggugaguguagcgucaguugcggcgugggaguccgaaagcguucugugaccugcaggggugagagaggcucccuauuacacacugcugcguguagccuugaggauagaccucccuuaacagaaccauguguccaugaggacugcccccuccuuagugaccaggcauggcacguggguacauggggccuguguagcaagucauguagcucaggcacucgccggcggcaggugaucugugcaaucgguccuccuucccauugcgggaguuugcagcacucgaagcccguagacgucgaaccaugcaacacucagccaugccaccucccucaggaggugccauccaugcaggacgugcauacgccagccuccaaccccuggaugccccugggaccgcaggaaucuccggcgagugacucacguggucaauggugggcagcgcaagaacacccaucugcucgcggugaucacaggggcgaacgaggcgauccuaggggcgaucaagggacacauuuaagcgcccucggaccugcaccuucgcugcagcaaccccccuaccagcagcccuuaagaagcgggaguggaccccacgacuguagacacuccccacacggcugcugcccagacgggcacaccgcuucucuuggcccacaguggcaggguugccccggagcaccuugccagcaaucccgguacggauguugucccgaucggguaagcguggcggagggaccacaccaugccggauguacgaaaucauacgguggagacagcacugggggcaugccgaggucaagagcugucgccagcacugugcauaacacacaucagccacaggcacaacagaacgaaccuagcgaauguagaggcucgcaguuuggguguuguuaugacaaugucgccaccgccgcggggccacucggagagggcugugugggucagccgagccaugcauaucccguccguugucugcucccaucggcccauggcucuugugccgacugggcugcucgaugguauuuuguugccuccgugggacagugcaaccgguuuugguauggagguugucacggaaaugccaacaauuucgcgagcgagcaggaauguaugagcaguugccagggaagcuugcaugggccaagacgcccacagccuggagcuucaggucggucaacucauaccgaugguggcgguucuucucccgcgggcgagcaggagccuucacagcauagaacaggggcagccgugcagcggaagcccuggcccucugguggccuguggcgccaggaucagcagcccgguccaggugaagcuccucauacacaagccuucggagaauggcccuggggccaagaacugggcagccgcgcuccaggccuuggcggggacgcugguuccccugcacccccuuuccacuccucuagcuaccgcaucucucuugccggaguggaaccaucgcucgugcaagccgcccugggacagcuggugagauugucuuguucugaugauaccgcuccugagucucaggcugccuggcagaaggaugggcaacccauuaguucagaucgucacaggcuccaguuugaugggucccucauuauccauccgcuccaggccgaagaugcugggacguauucaugcggcucuacuagaccugguagggacagucagaagauccagcuucgaauuaucgguggugacauggcaguuuuaucggaagcagaguugagucgguucccgcagccaagggauccugcccaggauuucggccaggcuggcgccgcuggaccuuuaggagccauuccuagcucucauccgcagccugccaaucgcuuacgccuugaucagaaucagccgaggguuguggaugcauccccaggccaacggaucaggaugacuugucgcgcagaaggcuucccucccccugcaaucgaguggcagcgggauggacaacccgugucauccccucgccaucaguuacaaccggacggaucucucgugauuucaagaguugccguggaagauggcggauucuacacuugcguggcuuuuaacggacaggaccgugaucagagaugggugcagcugagagugcucggggagcugacuaucuccggauugccaccaaccgugacagugcccgaaggcgacaccgcuaggcugcuaugcguaguagcgggagaguccgucaauauacgguggagucgaaacggacugcccguucaggcggacgggcauagggugcaccagagucccgacggaacccuucuuaucuauaaucugcgagcucgcgacgaggggucauauacuugcagcgcauaucagggaucacaagcggugagucguuccaccgagguuaaaguggucucgccagccccuacggcgcagccuagagaucccggccgugacuguguggaucagccggagcuggcuaacugcgaccugauucuucaggcacaguugugcggaaaugaguacuacaguuccuucugcugcgcuucuugcuccagauuucagccccacgcccaaccuauuuggcaguag

SEQ ID NO: 13449 - RNA, 261 nt, Artificial Sequence
  Description of Artificial Sequence: Synthetic coding sequence
augcaacuguuccuccuacugugucucgugcuguugagcccacaaggugcaucuuugcacaggcaucauccccgcgaaaugaagaagcgcguggaagaucugcaugucggcgccaccguagcccccucaucuaggcgcgauuuuaccuucgaccuuuaccgagcucucgcuagcgccgcaccgagucagaguauuuucuuuaguccaguaucuauuuccaugagccucgcaaugcuuagucucggcgccgguagcucauag

SEQ ID NO: 13450 - RNA, 906 nt, Artificial Sequence
  Description of Artificial Sequence: Synthetic coding sequence
augcaacuguuccuccuguugugccuagugcugcucucaccgcagggggccucucuccacagacaccauccaagagagaugaagaagcgaguugaagaccugcaugucggagccacagucgccccaucaucuagaagagauuuuacauuugaccucuaccgcgcauuagcuagcgcugcgcccagccaauccaucuucuuuagcccugucucuauuagcaugagcuuggcgaugcucaguuugggcgccggguccuccaccaagaugcagauuuuagagggccuggguuuaaauuugcagaaaagcucugaaaaagaacugcaccgagguuuucaacagcuccuucaagagcucaaccagcccagggauggguuucaguugucuuuaggaaacgcacuauuuacggauuuggucguggaucuucaggauacauucgucagcgcgaugaaaacccucuaccucgccgacaccuucccaaccaacuucagagauuccgccggagcuaugaagcagauuaacgacuauguggcuaagcaaacaaagggcaagauuguggaucugcucaagaaccuugacuccaacgcggucgucaucauggucaacuacauauucuuuaaagccaagugggaaacuucuuucaaccauaaagguacucaggagcaggacuuuuacgugaccucagagacaguuguucggguuccuaugaugucuagagaagaucaguaccacuauuugcuggauagaaaucuaagcugcaggguggucgguguaccauaucaggguaaugccacagcccuuuuuauuuugccuucugaaggaaagaugcagcagguugaaaacgggcucuccgaaaaaacacucagaaaguggcuaaagauguucaaaaaacgguacuuccaaacuuag

SEQ ID NO: 13451 - RNA, 411 nt, Artificial Sequence
  Description of Artificial Sequence: Synthetic coding sequence
auggagaccuuuccauugcuucuucuaagccuggggcucguucuagcugaagcaagugaaagcaccaugaagauaauaaaagaggaguuuacagacgaggaaaugcaguacgauauggccaaaagcggacaggaaaaacagacuaucgaaauauuaaugaacccaaucuugcugguaaagaauacaucacugucuaugucuaaagaugauauguccucgacucuucugaccuuccggucucuucauuacaaugacccaaaaggaaacucuagcgguaaugacaaggagugcuguaaugacaugacggucuggcgcaaggugagcgaagcuaaugggucaugcaaauggucuaacaauuuuaucagaaguucuaccgagguuaugcggcgaguccaccgagccccuucauag

SEQ ID NO: 13452 - RNA, 1221 nt, Artificial Sequence
  Description of Artificial Sequence: Synthetic coding sequence
augcaacuauuccugcuguuauguuugguccucuugagcccccaaggcgccucccuccaucgacaccacccacgcgaaaugaagaaaagaguugaagauuugcacgugggcgccacagucgcucccucaucuaggagggauuucaccuuugaccuguaucgcgcgcuggcuagugccgccccuagccagucaaucuuuuuuagcccagugucgaucucgaugucucuugccaugcugucucuaggggcuggaucuucaacuaagaugcagauacuggagggccugggucucaaccuccagaagaguucugagaaggagcugcauaggggcuuucagcagcugcugcaagagcuuaaucagccaagagauggguuucagcucagucucgguaaugcacuguucaccgaccucgucguggaucuucaggauaccuucguguccgccaugaaaacucuguaccuggccgauacauuccccacuaacuuuagggacagugccggugcuaugaagcagaucaaugauuacguggcuaaacagacgaaagguaaaauugucgaccuguugaaaaaucuggauucuaacgccguugugauuauggugaacuauauauuuuucaaagccaagugggagaccuccuuuaaccacaagggaacccaggagcaagacuucuaugugacaucugaaaccguugugaggguaccgaugaugagccgggaagaccaguaucauuaucugcuugauagaaaucugagcugccgggugguuggcguccccuaucagggcaaugcaaccgccuuguucauacuccccagugaagguaagaugcaacagguagagaaugguuugucagaaaaaacacugcggaaauggcugaaaauguuuaaaaagagacagcuugaacucuaccucccuaaauucaguaucgaaggguccuaucaacuggagaaaguccucccgagcuuggggauuagcaauguauuuacaagucacgccgaccuguccgguaucucuaaccacagcaauauacaagugagcgaaaugguacauaaggccgucguggagguugaugaauccgggacacgggcugcugcagcaacuggcacaaucuuuacuuuucgaucggcucggcucaacucccaacggcuuguauucaaccggccuuuucugauguuuaucgucgauaacaacauccuguuucugggcaaagucaaccgcccuuag

SEQ ID NO: 13453 - RNA, 618 nt, Artificial Sequence
  Description of Artificial Sequence: Synthetic coding sequence
augaugcgcacccuuauuaccacccauccucuuccccucuuacuuuuaccacagcagcugcuacagcuagugcaauuccaagaggucgacacggacuucgauuuccccgaggaggacaagaaggaagaauuugaagagugcuuggagaaauuuuuuagcaccgggccugcacgccccccuacuaaagagaaaguuaagagaagaguucugaucgaacccgguaugcccuugaaucauauugaauacuguaaucacgagauuauggggaagaacguauacuauaagcacagauggguagcugaacauuauuuccuacuaaugcaguaugaugaguugcagaagauauguuacaacagguucguccccuguaagaacgguauccguaagugcaaccgcucaaaggggcucguggaaggagucuauugcaaucugacggaggcguuugagauucccgcuuguaaguaugagucucuauacaggaaaggauacguccugaucacuugcucguggcaaaacgaaaugcagaaacggaucccccacacuaucaaugaucugguugagccacccgagcaucgaaguuuucucucagaggacggaguuuuuguuauuucaccauag

SEQ ID NO: 13454 - RNA, 240 nt, Artificial Sequence
  Description of Artificial Sequence: Synthetic coding sequence
augucauuuagcgccacaauucuauuuuccccucccucuggaucugaagcuaggugcuguugcugcgcuugcaaguccgaaacuaacggcgggaacacaggcucccagggcggcaacccccccccuaguacccccauuacggugaccggccauggacucgcugugcagucuucugaacagcuacuacaugucaucuaucaacgcguggacaaggccgucggccucgcagaagccgcguag

SEQ ID NO: 13455 - RNA, 618 nt, Artificial Sequence
  Description of Artificial Sequence: Synthetic coding sequence
augaugcguaccuugauuacgacacauccccugccgcuacucuugcugccacaacagcuguugcaacugguucaguuucaggagguggauaccgauuucgauuuuccggaagaagacaaaaaagaagaauuugaggagugucuugagaaguucuucucaaccgggcccgcccggccacccacuaaggagaaaguaaagcgacgggugcucauugagccuggaaugccacucaaucacaucgaguacuguaaucaugaaauuaugggcaaaaauguguauuacaagcaucgauggguugccgaacacuauuucuuguugaugcaauaugaugaguuacaaaaaaucugcuauaauagguucguaccuuguaaaaacggcauaagaaaguguaacagauccaagggacugguagaagguguguauuguaaucuuacagaggccuuugagauuccagcuugcaaguaugagagucuguacagaaaagguuacgucuuaaucacgugcuccuggcagaaugagaugcagaagcgaauuccucauacaauuaaugaucuggucgaaccucccgagcauagaucuuuccuuucugaagaugguguuuuugucaucuccccuuag

SEQ ID NO: 13456 - RNA, 3789 nt, Artificial Sequence
  Description of Artificial Sequence: Synthetic coding sequence
augaggcugcuccuacucgucccccucuuguuagcacccgcaccugggucaagugccccgaagguccgacggcaaucagauacauggggacccuggucccaguggucuccuugcucgagaacguguggcggcggcguuucauuccgugaacggccuugcuacucccagagacgugacggcgguuccagcuguguuggcccugccaggagucaccgcuccuguaggaccgagaguugcccagacggcgccagggacuuccgagcugagcaaugugccgaauucgacggagcugaguuucagggacgccgcuaucgcuggcuucccuacuacucugcccccaacaagugugaauugaacuguaucccaaaaggugagaauuuuuacuauaagcaucgggaggccgucguugacgggacacccugugaacccgguaagagagaugucugcguggacgggucaugcagagugguaggaugcgaucacgaauuagacucaucaaagcaggaagauaagugccugaggugcgggggagacgggacuacaugcuacccuguggcgggcaccuuugaugccaacgaucugucuaggggguauaaucagaucuugauugugcccaugggggcaacuucaauccugauugacgaagccgccgcaucaagaaacuuucuggcuguuaaaaacgucaggggcgaauauuaucucaauggacauuggacuauugaagccgcaagagcuuuaccagcugccuccacaauucuccacuacgaacguggggcugaaggugaucuggcaccagagaggcugcacgcccggggucccaccucagaacccuuggugauagaacugauuucccaggagccaaaccccgggguucacuacgaguaccaccugccauuacguagaccuucucccgguuucagcuggucacacgggucuugguccgauugcuccgccgagugcggcggcggucaccagucuagauuagucuucugcaccauagaucacgaagccuauccugaccacaugugccagcggcagccucgccccgcugaucgaagaagcuguaaccugcaucccugccccgaaaccaagagguggaaggcaggcccaugggcacccugcagcgcguccuguggaggagggucacagucucgguccguguacuguaucuccucugauggcgccgggauucaggaagcagucgaagaagcugagugcgccggacugccaggaaagccgccggcuauacaggcuuguaaucuccagaggugugccgcauggagccccgagcccuggggggaauguagcgucucuuguggcgucggaguacgcaaacguucugugacaugucgcggugaacgcggaagucuccugcauaccgcugcgugcucucuagaggacaggcccccucugaccgagccuugcguacacgaggauugccccuuguugagcgaccaggcauggcacguggggaccuggggacuuugcagcaaauccugcagcucgggcaccaggcguaggcaaguuaucugcgcaauagggccuccgucccauugcggcucuuuacagcauaguaaacccguugacguggaaccauguaauacacagcccugccaccucccacaggaggucccaucaaugcaggacguacauaccccugcgucaaacccauggaugccacucggaccacaagaaagccccgcgagugacuccaggggccaauggugggcagcucaggaacauccaagcgcccgaggcgaucaucggggggagcgcggggacccaagaggggaccaaggaacccauuuguccgcacucggcccagccccgucacugcagcagccacccuaccagcagccccugaggaguggaagcggaccgcacgacugccgacacucuccacacggaugcugucccgacggacauaccgcaucuuuggggccccaguggcaaggcuguccaggagccccuugucagcagucuagguacgguugcuguccagaucgcgucaguguagcugagggcccucaucacgcugguuguacuaaguccuacgggggagauuccacaggcggcaugccucgcucucgggcuguggccuccacagugcauaauacacaccagccacaagcccagcaaaacgaaccauccgaaugucgcggaucucaguuuggcuguuguuacgauaauguagcuacagccgcuggcccauuaggagaaggaugcguuggccagccuucucaugacugggccgcccggugguacuucguagcaagcguggggcagugcaaucguuucugguacggaggaugucacggaaaugccaacaauuuugcuagcgaacaggaguguaugucaucaugccagggaucccuccacggaccgagaaggccacagcccggcgcaagcggccguaguacucauacagacggcggcggcagcagcccagcaggagagcaggagcccucacagcauaggacuggagcagcggugcaacgaaagccguggccguccggaggccuuuggcggcaagaucagcaaccagggcccggggaagcgccucacacucaggcauucggcgaauggccauggggacaggagcuugggucaagggcaccugguuuaggcggcgacgccggcucccccgcuccuccauuccauucuucuucuuacagaaucucucuggcuggaguagaaccaucgcucguucaagcugcgcuugggcagcugguucgccugucauguagugacgacaccgcaccugagagccaagcugcauggcaaaaggacggccagcccaucaguuccgaccgucaucgacugcaguucgacggcagcuuaauuauucacccccuacaggcugaagacgcugggacauauuccugcggcucgaccaggccuggccgagacucucagaagauacaguuaagaaucaucggcggggauauggccgugcucagugaagcagagcucucccgauucccucagccccgcgaccccgcgcaggacuucggacaggcuggugccgccgguccgcucggugccaucccuagcagccauccccagcccgccaacagacugaggcuugaucagaaccagccgagggucguugacgcuaguccaggacaaaggauucggaugaccugcagagcggagggcuucccuccuccagcuaucgaguggcagagggauggacaaccgguuucaagccccaggcaucagcuacaaccugauggcucacugguaauuagccgcguggccguugaggacgguggcuucuauacaugcguugccuucaauggucaggacagagaccaacgaugggugcagcugcggguguugggcgaguugacaauuucuggccugccuccuaccgucaccgugcccgagggcgacaccgcgaggcugcugugcguuguggccggggaaucugucaauauucgcuggagucggaauggacugcccguucaggcugacggacauagggugcaccaauccccugacgggacucuccugauuuacaacuugcgagccagagacgagggguccuacaccuguucugcauaccagggaucccaagccguguccagaucuacugaggugaaaguuguguccccagcaccaacugcacagccucgagaucccggcagagauugcgucgaccaaccagaguuggcgaacugugaccugauucuccaggcacaacugugugguaaugaguauuacucuucuuucuguugugccaguuguucgcgcuuccagccgcaugcgcagccuauauggcaauag

SEQ ID NO: 13457 - RNA, 321 nt, Artificial Sequence
  Description of Artificial Sequence: Synthetic coding sequence
augucauuuucagcaacuauucucuuuuccccucccuccgguucugaggcccgaugcugcuguugugcuugcaaaagcgaaaccaauggcgggaauaccggaagucaaggggggaauccucccccauccacacccaucacagugaccggccauggacuggcagugcaguccagcgaacaacuucuacacguuauuuaccagcgugucgauaaggcagugggccuggcugaagcggcauuaggauuagcaagggcaaauaaugaacuccucaagcggcugcaggaagaggugggugaucugcgucaagguaagguuagcuag

SEQ ID NO: 13458 - RNA, 444 nt, Artificial Sequence
  Description of Artificial Sequence: Synthetic coding sequence
auggcacuccaaagaacccacucacuguugcugcugcugcuguugacucugcucggcuuaggucuggugcaaccgagcuacggccaggauggcauguaccaacguuuucuucgccagcacguucacccugaagaaaccggagguucugacagauacuguaaccuaaugaugcagcguaggaaaaugacccucuaccauugcaagcguuuuaacacauucauacacgaagacauuuggaacauucgcuccaucugcucuacaacaaauauccaguguaagaacggaaaaaugaauugucaugaggggguugugaaggucaccgauuguagagauacgggcuccucucgggccccaaacugccgcuaccgcgcuauugcuucgacucgccggguggugauugcuugcgagggcaauccccaggugccuguucacuucgaugguuag

SEQ ID NO: 13459 - RNA, 435 nt, Artificial Sequence
  Description of Artificial Sequence: Synthetic coding sequence
augcagcuguuccugcucuuaugucugguacuucugaguccgcaaggcgccuccuuacacagacaucauccccgugagaugaagaagcggguagaagaucuucacgugggugcaacuguggcccccagcagcaggagggacuucaccuuugaccuguaccgugcauuggccuccgcagcccccucucagucaauuuucuuuucuccgguuagcaucucgaugagcuuggccaugcuuucucuuggagcagggucuuccacuaagaugcagauauuagaaggccuuggauuaaaccuacagaaaucauccgagaaggaauuacaccggggguuccagcagcuacuucaggaacugaaccagccucgcgaugguuuccagcuaagccuuggaaaugcauuauucacugaccuugucguagacuugcaggacacauag

SEQ ID NO: 13460 - RNA, 540 nt, Artificial Sequence
  Description of Artificial Sequence: Synthetic coding sequence
auggggucguccgggcuguuguccuuacugguacucuuuguucuguuggcuaauguccagggccccgggcugaccgacuggcuuuucccccgccguuguccuaagauucgugaagagugugaauuucaagaacgcgacguguguacuaaggaucgucagugccaagacaauaagaaguguugcguuuucuccuguggaaagaaauguuuggaccugaagcaagacguuugcgagaugcccaaggaaacaggacccugucuagccuauuuccuacacuggugguacgacaagaaagauaacaccuguuccauguuuguguaugggggcugucaaggcaacaacaacaacuuucagucaaaagccaacugccuuaauacaugcaagaacaaacaacccuguccuaaaauuaagguagagugugagguugaagagaucgaccagugcacaaaaccuagggauugucccgaaaacaugaaauguugcccauucagcaggggcaaaaaaugucuugauuucaggaaagcaucucugaguacuuag

SEQ ID NO: 13461 - RNA, 444 nt, Artificial Sequence
  Description of Artificial Sequence: Synthetic coding sequence
auggccuugcaaagaacucacucucuacugcuucugcugcuguuaacucuauugggucugggauuagugcagcccucauaugggcaggacgggauguaucaaagauuccugcggcagcauguacacccugaagagacuggcggcagcgauagguacuguaaucuuaugaugcaacggcggaaaaugacauuguaccacugcaaaagauuuaauacauucauccacgaagacaucuggaauaucaggaguauaugcaguacaacaaauauucagugcaagaacggcaaaaugaauugccaugagggaguugugaaagucacugauugucgcgacacaggaucaagcagagcgccaaacuguagguaccgggcgauugccaguacgcggagggucgugaucgcaugugagggcaauccacagguacccgugcacuuugacgguuag

SEQ ID NO: 13462 - RNA, 600 nt, Artificial Sequence
  Description of Artificial Sequence: Synthetic coding sequence
auggagaccuucccccuccugcuccuuagucucgggcugguucuggccgaagcgucggaaagcacaaugaaaauaaucaaagaggaauucaccgaugaggagaugcaguacgacauggcaaaaucuggucaggagaagcagaccaucgagauucucaugaauccaauacugcuaguaaaaaauaccucgcuuuccauguccaaagaugauaugaguagcacuuugcuuaccuuccgaagccugcacuauaaugacccuaaagguaacucuagugguaacgauaaagaauguugcaacgauaugaccguguggcgcaagguguccgaagcuaauggcucuuguaaguggucuaacaauuucaucagaagcaguacugaggucaugagaagagugcacagagccccaaguugcaaguucguccaaaacccgggcauaaguuguugcgaaagcuuagaacucgaaaauaccgugugccaguuuacgacaggcaagcaguucccucguugucaguaucacucagucaccaguuuagaaaagauccucaccguccuuacugggcacaguuugauguccuggcuagugugugguagcaaacuguag

SEQ ID NO: 13463 - RNA, 153 nt, Artificial Sequence
  Description of Artificial Sequence: Synthetic coding sequence
augaguuucucagccacaauucucuuuuccccgccuucaggauccgaggcgcguuguuguugcugugccugcaaaucugaaacaaacggcgggaauacugguucacaagguggcaaucccccuccaucaacaccuauuacagugacaggauag

SEQ ID NO: 13464 - RNA, 75 nt, Artificial Sequence
  Description of Artificial Sequence: Synthetic coding sequence
augcagcuguuccuuuuacuuugcuugguacugcucucuccacaaggcgccucacuacaccgccaccacccuuag

SEQ ID NO: 13465 - RNA, 633 nt, Artificial Sequence
  Description of Artificial Sequence: Synthetic coding sequence
augagugcaggcaaaaugaugcgcacacugauaacaacucacccacucccacugcuucucuugccccagcagcugcugcaacuagugcaauuccaggagguugauaccgauuuugacuuuccugaagaggacaaaaaggaggaauucgaggaaugccuggagaaauucuucagcacaggucccgcgcggccaccgaccaaggaaaaggugaaaagaagagugcuuaucgaacccggaaugccguuaaaucacauagaauauugcaaccacgagauaaugggcaagaacguauauuauaaacaccguuggguagcggagcacuacuuucuccugaugcaauacgacgaacuacagaaaauuuguuacaacagguucgugcccugcaaaaacgguauacgcaagugcaauaggucaaagggacugguggagggcgucuacugcaaccugacagaagccuucgagauaccggcuugcaaauaugagucguuauaccggaaaggauacguucuaaucaccuguaguuggcaaaacgagaugcaaaagcggauaccucauacuaucaaugaccucgucgaaccgcccgagcacaggaguuuucuaucugaagacggagucuucgugauuucucccuag

SEQ ID NO: 13466 - RNA, 36 nt, Artificial Sequence
  Description of Artificial Sequence: Synthetic coding sequence
augucauuuuccgccacaauuuuguucucgcccuag

SEQ ID NO: 13467 - RNA, 444 nt, Artificial Sequence
  Description of Artificial Sequence: Synthetic coding sequence
augauuaucaugguuaucaucuuccugguccugcucuucugggagaaugaaguaaacgaugaagccgugauguccacacucgagcaccugcauguggacuauccccaaaaugaugugcccgugccagcacgguacugcaaccacaugaucauccagagagugauuagagagccagaccauacuuguaaaaaggaacacguuuuuauacacgaacgcccaagaaagauuaacggcaucuguauaucccccaagaaagucgcuugucagaaucucuccgccaucuuuuguuuccaguccgaaaccaaguuuaagaugacugucugccagcuaauugaagguacuagauauccagccugucgauaucacuacagccccacagagggauuuguccucguuacaugugacgacuuacgacccgacagcuuuuuggguuaugugaaauag

SEQ ID NO: 13468 - RNA, 696 nt, Artificial Sequence
  Description of Artificial Sequence: Synthetic coding sequence
augcaguuguuuuuacucuuaugucucgugcuuuugucaccucagggcgcgucacugcacaggcaccacccaagagaaaugaagaagagggucgaagaucugcacgugggcgcuaccguugcuccuucaagucgccgugacuucacuuuugaccucuaccgcgccuuagcaucagccgcucccucucagagcauauuuuucuccccagugagcauuuccaugucacucgcaaugcucagccugggugcaggcucuucuaccaaaaugcagauucucgagggccucggccugaaucugcagaaauccuccgaaaaagaguuacaccgcggcuuucagcagcuacuucaggaacucaaccagccaagagacggcuuucaacugucccuggguaacgcacuguucacagaccuggucgucgauuugcaggauacuuuugugagugccaugaagacucuguaucucgcagauaccuuccccacaaauuucagagacagugcaggggcuaugaaacagauuaacgacuacgucgcaaaacagacaaaagggaagauuguggacuuacugaaaaaccuggauagcaacgcugugguaaucauggugaacuacauauucuuuaaggcgaaaugggaaacaagcuuuaaucacaaaggcacacaggaacaagauuuuuaugugacaagcgagaccgucguuuag

SEQ ID NO: 13469 - RNA, 1626 nt, Artificial Sequence
  Description of Artificial Sequence: Synthetic coding sequence
auggcuaaguuuggugugcauaggauccuguuacuggcuauauccuuaacuaagugucuggagucuacaaaauugcuggccgaucuaaaaaaauguggggaccuggagugcgaagcccugaucaauagagucucagccaugagggacuaucgugggccagacugcagauaucuaaacuucacuaaaggggaagagaucagcguguacguaaaguuggcaggagaaagggaggaucugugggcaggaaagggaaaggaauucggcuacuuuccccgugacgcuguucagaucgaggagguauucauauccgaagagauccagaugagcacuaaggagagcgacuuuuuaugccugcuuggagucuccuacacuuuugacaaugaggauucugagcugaacggagacuacggagaaaacaucuauccguacgaggaggacaaggacgagaaauccagcaucuacgaguccgauuuccaaauagaaccaggguuuuaugccaccuacgagucuacacuguucgaagaccaggucccugcccucgaagcuccagaggacaucgguagcacguccgagagcaaggauugggaagaaguggugguagagucaauggaacaggauaggaucccugaggugcacguacccccuucaucggcuguaagcggcguuaaagaaugguucggguuggggggagagcaggcagaggagaaggccuucgaaucagugaucgaacccgugcaggagucaucauucaggucacggaaaauugccguugaagacgagaacgaucucgaagagcugaacaacggagagccucagacagagcaucagcaagaaucugagucagagaucgauuccgugcccaagacccagucugaauuggcaucagaguccgaacauauaccaaaaccacagucuacaggcugguuuggaggcggcuucaccuccuaccucggauucggugacgaggacaccgggcuagaacuuaucgccgaagaaucaaaccccccacuucaagacuuccccaacuccauuagcagugacaaagaagcuacugugccuuguacugaaauccugaccgaaaaaaaagauaccaucacaaaugauucucucucauuaaaacccagcugguuugacuucggcuuugccauccugggcuucgccuaugccaaagaagacaaaaucaugcuugaugaccgcaagaacgaagaagaugggggcgccgaugaacacgaacacccacucaccuccgaauuagaccccgagaaagaacaagagaucgagacgauuaagauaauugaaaccgaagaccagaucgacaaaaaaccaguaucugaaaaaacggacgagagcgauacaauuccauaucucaagaaguuuuuguauaacuuugacaauccauggaacuuccagaauauucccaaggaaacugaguuaccguuuccaaagcagauucucgaucagaauaauguaauagagaacgaagagacaggcgaguucagcauugauaauuacccuacugacaauacuaaggugaugauuuuuaaaucuagcuacagucuaucuggcugguacgagaacaucuauauuaggauuuacuucauuuucaagcacaaucuguuucucuag

SEQ ID NO: 13470 - RNA, 1245 nt, Artificial Sequence
  Description of Artificial Sequence: Synthetic coding sequence
augaauccaacccucggccuggccauuuuucucgcuguccuacuuaccgugaagggacugcucaagccgucauucaguccacggaauuacaaagcacucucagagguacagggauggaaacaacggauggcagccaaggaacuggcuagacaaaauauggaccuuggguucaagcuucuuaagaaacuggccuuuuacaaucccgggcggaacaucuuucucucuccacucagcaucucaacagcauucucaauguugugucuuggggcccaggacucuaccuuagaugagauuaaacagggauucaauuuccgcaagaugccagagaaagacuuacaugagggauuccacuacaucauucaugagcuuacacagaaaacacaggaucugaagcuuagcaucggaaacacuuuauucauugaccagagauugcagccacaaaggaaauuucucgaagaugcuaagaacuuuuacuccgcugagacuauucugacaaacuuucagaaucuggaaauggcacagaagcagaucaaugauuucauuagccagaaaacucacggcaagauaaacaaucucaucgagaacauagauccaggaacugucaugcugcuggcaaacuacauauuuuuccgugccagguggaagcacgaauucgacccuaacguuacuaaagaagaagauuucuuccuggaaaaaaacagcuccgugaaggucccuaugauguuuagaagcgguauauaccagguugguuaugacgacaagcuauccuguacaauccucgagauccccuaucagaaaaauaucacagcuauuuucauccuaccagaugagggaaaacugaaacaccuggagaagggccugcaagucgauacauuuagccgauggaagacccugcucucgagacgcguuguagacguuucaguaccgagauuacacaugacuggcacauucgaucugaagaaaacccucucauauauaggcguaucuaagauuuuugaagaacacggugaucugacaaagauugccccccauaggucucugaaggucggugaggcaguucacaaggcggaguugaaaauggaugaacgaggcacugagggugcugccggaaccggagcccagacccuuccaauggagaccccccuggucguaaagauugauaaaccauaccuguuacugauuuacagcgagaaaauuccuuccguccuguuucugggcaaaaucguuaauccaaucggcaaguag

SEQ ID NO: 13471 - RNA, 618 nt, Artificial Sequence
  Description of Artificial Sequence: Synthetic coding sequence
augaugagaacacucauaacaacgcacccgcucccccuccucuuguuaccucaacagcuguugcaacuggugcaguuccaagaagucgacaccgauuucgacuucccugaagaggauaaaaaggaagaauuugaggagugccuagaaaaauucuuuucaacagguccugcccggccacccacaaaagaaaagguaaaaaggcgcguccugaucgaacccggaaugccucugaaucauauugaguauugcaaccacgagaucaugggaaagaauguauauuauaaacaucgcuggguagcugagcauuauuuccuccucaugcaguaugacgagcuucagaagauuugcuacaaccgcuucguaccuuguaaaaauggcauucguaaguguaaccgcuccaagggccuggucgagggcguuuauugcaaccuuacagaagcuuuugaaaucccggcuuguaaauaugaaagcuuauaccgcaaaggauaugugcucauuaccuguucauggcaaaaugagaugcaaaagagaaucccucauacaaucaaugacuugguggagcccccggaacaccgguccuucuugagugaagacgggguguucgucauuucuccauag

SEQ ID NO: 13472 - RNA, 516 nt, Artificial Sequence
  Description of Artificial Sequence: Synthetic coding sequence
auggaaacauucccccuccuacuacuuagucuuggccuggugcucgcagaggcuuccgagucaaccaugaagauaaucaaagaagaauucaccgaugaagagaugcaguacgacauggcaaaaaguggacaggagaagcagaccaucgagaucuuaaugaaucccaucuuacugguuaagaacaccucuuugagcaugaguaaggacgacaugucuucuacacugcuuaccuuuagaagccuccacuauaacgauccuaaaggcaacucuuccggaaacgauaaagaauguugcaacgauaugaccguuuggcgcaaagugagugaagcgaacggcuccugcaaauggucgaauaauuucauucgcucaucuacagaaguaaugcgacgggugcaucgcgccccgucuuguaaauuugugcagaacccuggaaucucuugcugugaaagccuggagcucgagaacacagucugucaguuuacaaccgggaagcaguuuccccgcugucaguacuag

SEQ ID NO: 13473 - RNA, 633 nt, Artificial Sequence
  Description of Artificial Sequence: Synthetic coding sequence
augagugcaggaaaaaugaugcggacacugauaaccacacaucccuuaccccugcugcugcugccccagcagcugcuccaauugguccaguuucaagaagucgauaccgacuuugacuuuccagaagaggacaagaaggaagaguuugaggaaugcuuggaaaaauucuuuucuaccgguccagcccggccaccaacuaaggaaaagguuaagcggagaguucugauagagccugguaugccguugaaccacauagaguacuguaaccaugaaauuaugggaaagaacguguacuacaagcaucgcuggguugcugaacauuacuuucuguuaaugcaauacgacgaguuacaaaagauuuguuauaaucgguucguuccauguaagaaugguaucaggaaguguaaucguuccaagggacuaguugaaggcgucuauuguaaucugacugaagcguucgagauuccagccuguaaguaugagagccuguaccguaaggguuaugugcuuaucaccuguuccuggcagaacgagaugcagaaacguauaccucacacaaucaacgauuuggucgagcccccugaacaucgcagcuuccugagugaagauggagucuuugugauuagcccauag

SEQ ID NO: 13474 - RNA, 537 nt, Artificial Sequence
  Description of Artificial Sequence: Synthetic coding sequence
auggaaaccuucccuuugcugcuguuaucacugggcuugguucucgcggaggcuucugagagcacaaugaagaucaucaaggaagaguuuacggacgaggaaaugcaguaugauauggcuaaaucuggccaagagaagcagacaaucgagaucuuaaugaaucccauccuacuggugaagaacacaagucugucuaugucgaaggaugauauguccaguacacuccugacauuuagauccuuacacuauaaugaucccaaagguaacucaucuggcaaugauaaagaaugcuguaaugacaugaccguguggagaaaaguuuccgaggcaaaugguucauguaaguggucuaauaauuuuauccguucaagcacugagguuaugcgacggguacauagggcgccuucuugcaaauucgugcagaauccagguauuagcugcugugaaucccucgagcucgaaaauacagugugucaauuuaccacuggcaaacaguuuccgaggugucaguaccauagugucaccucuuuagaguag

SEQ ID NO: 13475 - RNA, 474 nt, Artificial Sequence
  Description of Artificial Sequence: Synthetic coding sequence
augcagcuguuucuucucuugugcuuaguccuccuaucaccccaaggggccucccugcaccgccaccaucccagggagaugaagaaaagaguggaggaucuucauguuggagcgacuguggcuccgagcagcagacgagauuuuacuuuugaccuguauagggcccuugcauccgcugcucccucucagucgaucuucuuuucuccugugucaauaucuaugucccuggcgaugcucuccuuaggcgccggaucuucaacuaagaugcagauucuggaaggccuuggucugaaccugcaaaaguccuccgagaaagaguuacaucgaggcuuucagcaauuacugcaagaauugaaucagccgagagacggauuucagcuuucacuggguaaugcccuguuuaccgauuuaguuguagauuugcaggacacuuuugucuccgcaaugaaaacguuguaccuggccgacaccuag

SEQ ID NO: 13476 - RNA, 1035 nt, Artificial Sequence
  Description of Artificial Sequence: Synthetic coding sequence
augccuccucguaugcuggucgcuccccucccccugcacuuucuguuagccgcagugucuagugagaacagguccgguagaagacaguggcagcaggcuguggcugcaggauccgggcccggcagaaacucauccagagccauucauuggucuuuaccccgagcucuggucccggcaacuggcacaagagccuccggaucucagaaaaggcaacggccgccuaagggacaagaggcuuuauggucucggccacauucaagacauuccgccgagcgcgccggagggucccauagcgacccgggacgauuguccgcuccgcuuggacugggccucccuucaggccggggucggcuuaccgcaaugccaggucgagcaccucuaaggacuguucccggcgcacucggggcuuggcuguugggcggccugugggccuggacccuuuguggacucuguagccugggcgcugucggugcucccagacccugucaggcaccccagcaaugggagggccgucaagugauguaucaacagagcagcggucgaaauucuagggccuuauuaucuuacgacggguugaaucagagggugcgaguucucgaugagcgcaaagcccucaucccuuguaaaagacuuuucgaguacauucugcuguauaaagauggagucauguuccagaucgaucaagcgacaaaacagugcucaaagaugacacuuacccagccuugggaucccuuggacauuccgcaaaacagcaccuuugaggaccaguacucuauagguggaccccaggaacagaucaccguucaggaauggagcgacaggaaauccgcccgaucuuacgagacguggaucggaauuuacacagugaaagacuguuacccuguacaggagacauucacuauuaauuauagugugauucugaguacucgauucuuugauauccaguuagguauaaaggacccaucugucuucacaccaccuuccacaugccagauggcucaauuggagaagaugucugaggauuguagcugguag

SEQ ID NO: 13477 - RNA, 321 nt, Artificial Sequence
  Description of Artificial Sequence: Synthetic coding sequence
ggccagccuaaagccgcacccagcguuacucuguuccccccuuccucagaggaauuacaagccaacaaagccacauuaguuugccugguuucugacuuuuauccuggcgcagucaccguggcauggaaggcagacggaucccccgucaaggugggcgucgagacaacaaaacccuccaaacagagcaauaacaaauacgcagccagcucuuaccugagcuugacccccgagcaauggaaaucccaccggagcuauaguugccgcgucacacaugagggaagcaccguugaaaagacaguggccccggcagaaugcaguuag

SEQ ID NO: 13478 - RNA, 672 nt, Artificial Sequence
  Description of Artificial Sequence: Synthetic coding sequence
augcgacugcaaaggccccgacaagcacccgccggcggacgaagggcuccacgggguggcagggguucacccuauaggccggauccugguagaggugcgcgucgcuuacguagguuucagaaaggcggggaaggugcgccaagggccgaccccccaugggcuccacucggaacaauggcuuuguuagcccuucugcuggucguggcccugccacguguuuggacugacgcaaauuuaaccgcacggcagcgugaucccgaagauucccagcgaacagacgagggcgacaauaggguguggugucaugugugcgaacgagagaauacauucgaaugucagaauccaaggaggugcaaguggacagagccuuacugcgugaucgcugcagucaaaauuuuuccucgcuuuuuuaugguggccaagcagugcucugcuggcugugcggccauggagcguccgaaacccgaggaaaagagguuccugcuugaggagccuaugccauuuuucuaccucaaguguuguaaaauucguuacugcaacuuagaaggcccucccaucaacucaucaguguuuaaggaauacgccgguagcaugggggagaguugugggggcuuguggcuggcuauacuauugcuucucgcuaguauugcugcuggacucuccuuguccuag

SEQ ID NO: 13479 - RNA, 1542 nt, Artificial Sequence
  Description of Artificial Sequence: Synthetic coding sequence
auggcaccugcacgcacuauggcucgcgccagacuugcucccgccggaaucccagcgguggcucuguggcugcugugcacucugggcuugcaaggaacccaagccgguccaccucccgcuccaccagggcuuccagccggagcugacugccucaauucauucacggccggcguccccggcuucgugcucgacacaaacgcauccgugucgaauggugcgacuuuucuugaaaguccuacugugaggcggggcugggacugcguuagggccuguugcacgacccagaacugcaaccuggcucuuguugagcuccagccugaucgaggagaagacgcaauagcugcaugcuuucucaucaauugucuguacgaacagaacuuugugugcaaauucgcaccacgcgaggguuucauuaauuaccugaccagagaaguguaucguucguaucggcagcugcguacacaagguuucggcgggucugguaucccuaaagcaugggccggcauugacuugaaggugcagccucaggaaccucuugugcugaaagacguggagaacaccgauuggcgcuugcugcgcggggacaccgauguccguguagaacguaaagacccuaaccagguugagcuuuggggacuuaaagagggaacguaccuuuuccagcugacaguaacaucaucagaucacccugaggacaccgccaacgugaccguuacagugcuuucuaccaagcagacugaggacuacuguuuggcuucaaacaagguuggucgaugucguggaucauuucccagaugguauuaugauccuacagaacaaaucuguaagaguuuuguauacgguggcugucuugggaacaaaaauaacuaucugcgggaagaggaauguaucuuggcaugccggggaguccaaggccccaguauggaacggcggcaucccguauguagcggaacuugccagcccacccaguuucgguguucuaauggaugcugcauagauuccuuccuugaaugcgaugauacaccuaauugcccggaugcuagcgacgaggcugccugugaaaaauauacaaguggguucgacgagcuccagagaauucauuuucccucugacaaaggacacuguguggaccucccagauacaggcuuguguaaggagucuauuccccguugguacuacaauccauucagugaacacugugcaagguuuacuuacggagguugcuaugggaauaagaauaacuucgaggaagagcaacagugccuagagucaugccgugggauuuccaagaaggauguguuugggcuuaggcgggaaauccccauuccaucaacaggcucaguugaaauggcagucgcuguguuccucgugaucuguauagucguggugguugcuauucucggauacuguuuuuucaaaaaucagcguaaggauuuccauggucaccaccaccaucccccuccuacuccggcaucuucuacggugaguacaaccgaagauacagagcaucuggucuacaaccauacaacucggccacucuag

SEQ ID NO: 13480 - RNA, 1341 nt, Artificial Sequence
  Description of Artificial Sequence: Synthetic coding sequence
augcugcacccggagaccuccccuggucggggacaucugcuggcagugcuguuggccuugcugggcacugcuugggcagaggucuggcccccccaacuccaggagcaagcuccuauggccggggcauugaacagaaaagaguccuuccuguugcugucauugcacaacagacucaggagcuggguucagccucccgccgcggauaugcguagacucgauuggucggacuccuuagcucagcuugcucaggcuagagccgcucuguguggcauccccaccccaagccuugcaucuggucuguggcguacgcuccaagucggguggaauaugcagcugcuacccgcuggacucgcaucguucguagaaguugucagcuugugguucgccgagggacagcgguacucccacgccgcaggagaaugcgcccgcaaugcuacaugcacgcauuauacgcaacuggugugggccaccuccagccaacuaggguguggcaggcaucuguguucggccggccaggcugccauugaggccuucguuugugccuauucacccagaggcaauugggaagucaaugggaaaacaaucguuccauacaaaaagggggccugguguagcuuguguacagccuccgugucuggcugcuuuaaagcaugggaccaugccggcggucugugugaggugccgcguaauccaugcagaaugucaugucagaaccauggucggcuuaauaucucgacgugccacugccacugcccaccaggauacaccggccgcuauugucaagugcgaugcucccuucagugcguacauggacgauuccgggaggaagagugcuccugcgugugugacaucgguuaugggggugcacagugugcaaccaagguccauuucccauuucacaccugcgaucuacgaaucgauggggauugcuuuauggugagcuccgaggcggauaccuauuauagggcacgaaugaaaugucagaggaagggcggagucuuagcacaaauaaagagccagaaaguucaggacauuuuagcauucuaucugggacgguuggagaccacaaaugagguuauugauagcgacuucgagacucggaauuucuggauagggcugacauacaagacugcgaaggacuccuuucgcugggccacaggcgaacaccaggccuuuacaucauucgcuuucggacaaccagauaaucauggcuuugguaacugcguggagcugcaggcuucugcugcauuuaauuggaacaaucagcggugcaagacuagaaauagguacauuugccaguuugcacaggagcacaucucacguuggggccccggaucauag

SEQ ID NO: 13481 - RNA, 936 nt, Artificial Sequence
  Description of Artificial Sequence: Synthetic coding sequence
augggcgucauggccaugcugaugcucccccuccuucuccuggggaucucagguuuacuuuucauauaccaggaagugagccggcucuggucuaaguccgccgugcagaacaaaguugucguuaucacugaugcgaucucagggcugggcaaggagugugcucggguauuucacacuggcggggccaggcuugucuuaugcggcaagaacugggaaagauuagaaaaccucuacgaugccuugauuagcguagcugaccccagcaagacuuuuacucccaagcugguacuguuggaucugagcgauauuaguuguguucccgacguggcaaaggaagugcucgauugcuacggcugcgucgacauucuuaucaauaacgcuucaguuaaggugaaggggccagcgcauaaaaucagccuggaguuagacaagaaaaucauggacgccaacuacuuuggaccaauaacccucacaaaagcuuuacugccuaauaugaucucccgacggacuggucagauuguucuugugaauaauauccagggaaaguucgguauacccuuuagaaccaccuaugcggccagcaagcacgccgcccugggauucuucgauugucugagggcagaggucgaggaguaugauguuguuauuaguacagugucccccacauuuauucgaagcuaucacguauaucccgaacagggcaauugggaagcaucuauuuggaaauuuuucuuucgcaaacugacguacggagugcaccccguggagguggccgaggaggugaugagaaccgugaggcgcaaaaaacaggaaguauuuauggccaacccaauucccaaggccgccguauauguacgcaccuuuuuccccgaguuuuuuuuugcuguugucgccugcggcguuaaagagaaguugaauguacccgaggaggguuag

SEQ ID NO: 13482 - RNA, 594 nt, Artificial Sequence
  Description of Artificial Sequence: Synthetic coding sequence
auggcuaagaauggacuagucaucugcauccugguuauuaccuugcuccuggaccagaccacaucacacaccucaagacuaaaggcacgcaagcacucaaagcgacgcguacgugacaaggacggugaccugaaaacacaaauagagaagcuauggacugagguuaaugcucugaaggagauccaggcccuccaaaccgucugccugaggggaacaaaagugcacaagaagugcuaccucgcguccgaaggccugaagcacuuccacgaagccaacgaagacuguaucagcaaaggcggcauccuugucauuccaagaaauuccgaugaaaucaaugcucugcaagauuaugggaagcggagccugcccgggguuaaugauuuuugguuggguauuaacgacauggugacggaagggaaguucguugacguaaacgggauagcuauuucauuccucaauugggacagggcucaaccuaacggcgggaaaagagaaaauugugugcuuuucucacaaucugcgcagggaaaguggagcgacgaggcuugucggucaaguaaaagauacaucugcgaauucacuauuccccaguag

SEQ ID NO: 13483 - RNA, 705 nt, Artificial Sequence
  Description of Artificial Sequence: Synthetic coding sequence
augaaaguucugcucuuaacagguuugggugcccuguuuuuugcuuauuauugggaugacaauuucgauccgggaggacucgacuaucuuguacugaaccauauuggaggggcaccugccggcacuagagcacggaguccccaggccacucgauggcugaugcagguuaacuucguuagcuacgugcaacugacuucuagagcucuaccaaguuugacugacaguaagggcucccucgugguugucuccuccuuguugggccgggugccuaccucauucagcaccccauacuccgccgcuaaauucgcucuggauggcuucuuuggcaguuuaagacgggaacuggacguccaggacguaaacgucgccauaacuaugugugugcuugggcuccgcgaucgcgccagcgccgcagaggccgugcgaucauccacaaguagaccccgacagcccgagcaucggggagugccccuacaaucacagaccgcaauguuucuccccccuaccgugccaggcgcccggacacucacggaaacccccuugcgcggguggccacaacccaaaaugaaaaguucccgccagaagucaaaaaccgagaaaaacgauggucaucucgagccagucacggcaugggaaguccaaguuccccgugugcgccgucucugccgcggccuggcuagaccacaucuguucggccaugauuag

SEQ ID NO: 13484 - RNA, 228 nt, Artificial Sequence
  Description of Artificial Sequence: Synthetic coding sequence
augaaaguucuuuuacugacagggcucggggcccuauuuuuugcuuacuauugggacgacaauuuugauccagcaucucuccaaggagcaagggugcuauugaccggggcuaacgcagguguuggcgaggaacuugcuuaccauuaugcuagacugggaagucauuuaguucugacugcacacacagaagcccucuugcagaaggccggcuggacaacaucgugcuag

SEQ ID NO: 13485 - RNA, 225 nt, Artificial Sequence
  Description of Artificial Sequence: Synthetic coding sequence
augcaacccagcgaaauggucaugaauccuaaacaaguguuucuuucaguguugaucuuuggaguagcaggauuauugcuguucauguaccugcagguuuggaucgaagagcagcauacaggaagggucgagaaacgcagagagcagaaagucacauccgguuggggucccgugaaguaucuccgcccugucccgagaaucaagccccaggucucccacgccuag

SEQ ID NO: 13486 - RNA, 861 nt, Artificial Sequence
  Description of Artificial Sequence: Synthetic coding sequence
augaaagugcuguuacugaccggacugggagcgcuguuuuuugccuauuacugggaugacaauuuugaccccgcaucucugcaaggagcgcggguucugcuuacgggugcuaaugccggcgucggagaagagcuggccuaccacuacgcccgacugggcagccaccucguguuaaccgcccacaccgaagcacuucuucaaaaagucguggguaacugccggaaacuuggcgccccuaagguuuuuuacaucgcugcagacauggccucaccggaagccccagaguccguugugcaauuugcucuugauaaacuuggcggucuggauuacuuaguacuaaaccacaucggcggcgcucccgcaggaacgagagcucgaucuccacaagcuacccgcuggcugaugcagguuaauuucguaagcuaugugcaauuaacuagccgcgcucugccaucacuuacugacucaaaagggagcuuggucguggugucuagucugcuuggacgagugcccacuucauucucuacuccauacuccgccgcuaaguucgcucuagacgguuucuuuggaucuuugaggcgggagcucgacgugcaggacgucaacgucgcgauuaccaugugcgugcucggccugcgagauagggccucggccgcugaagcggugaggggagugacgcgcgugaaggcggcccccgguccuaaggccgccuuagcuguaaucaggggcggggcaacacgcgccgcaggcguguuuuacccuuggagguuccgcuuguugugccugcugcgccgauggcugccaagaccacgagcaugguuuauucggcaggagcuuaaugugaccgcagccgccgcuuag

SEQ ID NO: 13487 - RNA, 459 nt, Artificial Sequence
  Description of Artificial Sequence: Synthetic coding sequence
augcagguuaauuucguauccuauguccaguuaacgucuagagcccuuccaucacucaccgauucgaaaggcucccucgugguggucucaucacuccugggacgagugccaacgucauucuccaccccuuacucagcugccaaauucgcacucgacggguuuuuugguucccucagaagagaacuggaugugcaagaugucaauguggcgaucacuaugugcgugcucggauuacgugacagggcaucagccgccgaggcagugcguggagugaccagaguuaaggcagcuccgggaccuaaagcagcucuugcuguuauacguggcggcgccacccgagcggccgggguuuucuacccuuggagauucagacugcugugccugcugaggcguuggcugccacggccucgggcuugguucauccgccaggaacuuaacgucaccgccgccgcagccuag

SEQ ID NO: 13488 - RNA, 2856 nt, Artificial Sequence
  Description of Artificial Sequence: Synthetic coding sequence
augcgaguguuagcaugcuuauuagcugcgcuggucggaauucaagcugucgaaagguuaagguuagcugauggcccacauggaugcgcugguagguuggagguauggcacggcggccgguggggcaccgugugcgacgauggaugggaucugagagacgcagcaguugcaugucggcagcugggcuguggaggcgcccuggccgcaccagguggugccuucuucggugaaggcgccggaccaguauggcucucugagcuggccuguagggggaaugaagggcagcugggacucugccaucauagaggcuggaaagcccacauuugcagucacgaggaggaugcaggcgugguuugugcaggacagaggguagcaaauucuagggacgauuccacuagcccucuugacggugccccauggccaggccuucuccuggagcuuucacccucuacugaggagccguuggucacgcaugcucccagaccggcaggaaacccccaaaacgccucccgaaaaaagagccccaggcccaagcaggcaaagaguacccgggcuccuuugcugacaaccggggccccacggcaggaaaggcugagacuugugagugggccucaccggugugcuggccggcucgagguguggcacgggggacgcuggggaacaguuugugacgacgggugggacuugagggaugcagcaguugcaugucgagagcucgguugugguggggcucuggcagcuccugggggugcucgcuucgggcccggcgcaggccccgucuggauggacgauguuggcugugguggaggugagcaggcacucagggauugcccaaggucaccaugggggagaagcaauugcgaccacucugaggaugcugggcucguauguacagggccagcccccagauugagauuggcugauggcccacauggcugcgcaggucgucuggaaguguggcaugggggacgcugggguagcgugugcgacgaugcaugggacuuacgggacgccgccguggccugucgggaauuggguugcgguggggcacuggccgccccaggaggagcauuuuucggagaaggaucugguccaauaauccucgaugaccuacgcugcagaggcaaugagacagcccugcgguucugccccgcaagaccguggggacagcacgacugucaccaccgcgaagacgcuggggcaguaugugacggaaugccucucgguuacgugccgccgacugccccuaccgacucuaauaacucuacccccagggaggcagcuaguaggccccccaguaccaugacaagucaagcaccugggacggccggcgugaguccaccgccagcuucgccaacaguguuaugggagcccggaccagaggcagguucuccacagcugagacugguugccggacccaguaaaugcagcggccggcucgagguuuggcacgaccagcgcugggguaccgugugcgaugacaguugggacaugcgcgauuccgcuguggucugucgugaacucggguguggcggcccacaacaaccagacccugcugcugggagauuuggguggggcgccggcccuaucuggcuugacgacgucgguuguguggggacugaggcgucacucucggacuguccagcagccccuuggggcaaacauaacugcgcucacaaugaggacguaggugugacguguacuggaccucccgggcuggauuccaucagcgaccccuucaguuggagcuggauccccggacugggccgggauagagaugcauggcugccuggugaauuagccacgaagcccuccgccuccgugacugccuccgugcuugaaaagaccaccacuaaagcuccuggcaagaugccaaagucaacaaagaaauggguaaccaagaacgcaaaacgacccacuacccaaccuccaguuaugcccacgacgaagcacucccgggcacagagucccccagaucugacgucccagaccaccgccgcucugacuaccgaggccucacgccgacccacuucugaauucacccgaaggccuaccacagaggcaccucaacgcuggacaucucacacuacagcgacccucaccccucaagcaccacgggaaaggacaacuaagaccauggcaaugcugacaacccaaggcccacaggagaugaccagcgagagcacaauuaaaucuaucccucaagccucgcuggaacccagcgccgagaucccggaggguagcccugagucgccuaaggauccagcccccuccccuucggugagcaccacaggagaaucgggucuguuccgcguuagacuggcagaugggccuaaucgcugcgcagggcgguuagaggucuggcaugcuggacgcugggggacagugugcgaugacaacugggaucuacgggacgcgaccguugcuugcugggaacuaggcuguggcaaggugcgcccacggguaggaaagacucauuaugguccugguacaggcccgauuugguuggacgauaugggcugcaaaggauccgaagcaucccuuuccgauugccccucgggugcaugggguaagcacaauugugaucacgaggaggaugugggucucacguguacgggguauacagauuaugacgacuacccucccuggacuugggauccaacaucccgcgaagaccuagccaagggcacaacaacugcaggagugccaggccauacccugcccuggaggacuacaaggaggcccggcuccagcucgccugcaaucagaagauuacccgacacggagcccgaggccggagcccccagaggggacgcuccacgaagucgcacggcuagaguggccgcuccuccuuag

SEQ ID NO: 13489 - RNA, 8430 nt, Artificial Sequence
  Description of Artificial Sequence: Synthetic coding sequence
augacucuugaggggcucuaccuugcccguggaccacuggccaggcuucugcucgccuggagugcucugcugugcauggccggaggccagggucgcugggacggcgccuuggaggcagccggcccaggaagagugaggcgacgcggaaguccaggcauccuucaaggaccuaacgugugcggcucucgcuuccacgccuauugcugcccuggguggagaacauucccuggacguucccaguguguggugccuaucugucguagagcuugcggagagggauucugcagccagcccaaucucuguaccugugcggacggcacccuggcuccaucauguggugugucucgcggaagcggcugcuccguguccugcaugaacggugggaccugcaggggagccucuugccugugucagaaggguuacacuggcacagugugcggccagccuauuugugaccgaggcugucacaauggcgggaggugcaucggaccgaauagaugcgccugugucuauggauucauggguccucagugcgagagggauuaucgaacuggcccgugcuucggacaaguaggacccgaggguugccagcaccagcuaacaggccuggucugcacuaaagcccugugcugcgcaaccgugggcagagccuggggccuucccugugaacuguguccugcucaaccccauccuugucggagaggcuuuauuccaaacauccacaccggggcaugucaggacguggaugagugccaggcugugcccgggcugugccaagggggaucaugcguuaacaugguggguuccuuccacugcagaugccccgugggccaucgguugucagauucgagcgccgccugugaagauuaucgcgccggagcguguuuuuccgugcucuuuggcggccggugugccggcgaucuugccggacacuauacacgcaggcaguguugcugcgaucgcggucgcuguugggccgccgguccagucccugaacugugcccgccacgugggucuaacgaauuccagcagcucugcgcccagcgcuugccgcugcucccgggccauccaggccuuuucccuggucuccugggauuuggguccaaugggaugggacccccccuggggccugcucgguugaacccccauggcagcgaugcuaggggcauuccgagccucgguccagguaauuccaacauugggacugccaccuugaaucagaccauugacaucugucggcacuucacaaaucuguguuugaaugggcguugucuucccacaccaagcagcuaucggugcgaaugcaauguuggauauacucaggacguccgcggugagugcauugacguggacgagugcacgucaucccccugccaccacggagacugcgugaacauuccaggcaccuaucauugucggugcuaucccggauuccaagcgacuccuacaagacaggcgugcguggacguagaugaaugcauagucucugguggccugugccaucuaggaagaugugugaauacagagggaucauuccaaugugucugcaacgccggauucgaguuaucuccggacggcaagaauuguguggaccauaaugagugugcaacaagcaccaugugcguuaaugguguaugccugaaugaggacggcagcuucuccugucugugcaaaccuggguuccuccuggcacccggaggacacuacugcauggauauugaugaaugucagacaccaggaauuuguguuaacggccacuguaccaacaccgagggcuccuuucgaugucagugucucggcggacuugccguggggacggauggucggguuugcguggacacccacgugagaucuacaugcuacggugccaucgagaaaggcagcugugcacggccuuuucccggaacuguuaccaagucagaguguuguugcgcuaauccugaccauggauuuggagaaccuugccagcucuguccugcaaaagacucugcugaguuucaggcacucuguaguuccggcuuggggaucacuaccgauggacgugauaucaaugaaugcgcccuagaucccgaggugugugccaauggggugugugagaacuuaagagggucuuaucgaugcguaugcaacuugggcuacgaggccggagccuccggcaaggacuguaccgacguggacgagugcgcccugaacucccuccugugugacaauggguggugucagaacucaccugguagcuauucaugcagcugcccaccggguuuucauuuuuggcaggauacagagauuugcaaggauguugacgagugccuuagcuccccaugugugucuggggugugucgaaaucuugccgguucuuacacuugcaaauguggcccaggcucccgacucgacccuagcggcacauuuugcuuggauaguacaaagggcacuuguuggcugaagauccaggagagccgaugugaggucaaucugcagggcgcaucccugaggucagaauguugugcuacacuuggugcugccuggggauccccaugcgaacguugcgaaauugauccagcaugcgcccguggguucgccagaaugaccggaguuaccugugacgacgugaacgaaugugaauccuucccuggcgucuguccuaaugggcgauguguaaacaccgcaggcuccuucagaugcgaaugcccugagggacugauguuggaugccucugggcggcuuugugucgacguccgccucgagccuugcuuucugaggugggacgaggaugaauguggggugacccugccaggcaaauaccgaauggacgucuguuguugcagcauuggcgccgugugggggguggaaugcgaggccugucccgacccggagucccucgaguuugccucacuguguccaagaggacugggguuugcuagccgggauuuccugagcgggagacccuuuuauaaggacguuaacgaaugcaaggucuuucccggccuguguacucaugggaccuguaggaauacagucgggucauuucacugugccugcgccggcggcuucgcccuggacgcucaggagcggaauuguacagacaucgacgagugcaggauuagcccagaccuuugcgggcagggaaccugcgugaauacaccuggcucauucgagugcgaguguuuccccggguacgagagugguuucaugcugaugaagaacuguauggauguugacgagugcgcuagagaccccuuauuaugucgcggcgguacaugcacgaauacagacggcaguuauaagugccagugcccaccuggccacgagcuuaccgccaaaggcaccgcuugcgaagauaucgaugaguguucacugucggauggccugugcccacauggacaaugcguaaauguaaucggcgccuuccaguguagcugucacgcuggguuccagagcaccccagaucgacagggcuguguggacauaaacgaaugucggguccaaaaugggggaugugacguccacuguauaaacacagaagggucuuaccggugcucaugcggccaaggcuacucucucaugcccgauggaagagccugugcagacguggacgagugugaggaaaacccacgcgugugcgaccaggggcauugcaccaauaugccuggcgggcacagaugccuguguuacgacggcuuuauggcgacgccagacaugcgaacuuguguggacguggaugagugcgaucucaauccccacaucugccugcacggcgacugugagaacacaaagggauccuucguaugucauugccaauuaggcuauaugguccguaagggcgcaacagguugcucugacgucgacgagugugaaguggggggccauaauugugauucacacgccucauguuuaaauauucccggcucauucucgugcaggugcuuacccgggugggucggugaugguuucgagugucacgaccucgaugaauguguuagucaggagcauagauguucccccaggggagacugucugaacguaccggguagcuauaggugcacaugcaggcaggguuuugcuggcgacggcuucuuuugcgaagaucgagaugagugugccgaaaacguagaccugugcgacaacggacagugccugaaugcucccggaggcuaccggugcgaaugcgaaaugggcuucgaucccacagaggaccauagagcgugccaggauguagacgagugugcacaaggcaaucucugcgccuucggaucuugugagaaucuuccuggcauguuuagguguauaugcaaugggggguacgagcuugacagaggaggagggaacuguaccgacaucaaugagugcgcugacccugugaacuguauuaauggagugugcaucaauacuccugguaguuaucuauguucuugcccccaagacuuugaacugaacccaaguggcguggguuguguggauacacgagcuggcaauuguuuucuggagacccaugacaggggagacuccggcaucuccugcagugccgaaauaggcgucgggguaacuagggccagcuguugcuguucacugggaagagcauggggcaauccuugcgaacuaugcccuauggccaacaccaccgaauaucguacucugugcccagguggggagggcuuucagccaaaucgaaucaccguuauucuggaagauauugaugagugccaagagcugccaggucugugccagggcggugauuguguaaacaccuuuggguccuuccaaugugaauguccaccaggcuaucauuugucugagcauacacggauuugcgaggacaucgacgaguguuccacccacuccgguaucugcggcccuggaacuuguuacaauacucuugggaauuacaccugcgugugcccugcugaauaucuucaagucaacggagggaacaauugcauggacaugcgaaagaguguguguuuuaggcauuacaauggcacuugucagaacgaacuggcuuucaacgugacccgaaaaauguguuguugcucauacaacauugggcaggcuuggaaccgucccugugaagccugccccaccccuauaaguccugauuaucagauacucuguggaaaucaagccccugguuuccucaccgacauacacacaggcaagccauuggauauagacgaguguggggaaauuccagccauuugcgcaaauggcaucugcauuaaccagaucgggucuuuucggugugagugccccgcuggguucaauuacaauucaauucuacucgcgugcgaggacguugacgagugcggcuccagagaaucuccgugucaacagaacgccgauugcauuaauaucccuggcagcuaucggugcaaguguacuaggggcuacaagcucucaccaggcggcgcuugugugggccgcaaugaaugccgugaaauucccaacgugugcucucacggcgacuguauggacacugaagggagcuacaugugcuuaugucaccgcggauuccaggccagugcugaucagacccuuuguauggacauugaugagugugaccgacagccauguggcaauggaacauguaagaacauuaucggaagcuauaacugucugugcuucccuggcuuuguuguaacccacaacggggacugcguggacuuugaugaguguacuacacucguaggucaagugugccguuucggucacugccugaauaccgcugguucauuucacugucugugucaggauggauucgaacucaccgccgacgggaaaaacugcgucgacacaaaugagugccugagccucgccgggacaugucucccugggacuugucaaaaccuggaggguucauuuagguguauuugcccacccggguuccaggugcaauccgaucacugcauugauauagaugaauguucugaagagccuaauuugugucucuuuggcacgugcacaaacucucccggcuccuuccagugucugugcccuccgggguuugugcucucugacaauggccauagauguuucgauaccagacagucuuucuguuucacuagguucgaagccggcaaaugcucagugcccaaagcuuucaacacaaccaaaacaagauguuguugcuccaaacguccuggagagggcuggggcgaccccugugagcucuguccccaagaggguucugccgccuuucaggagcuauguccuuuugggcacggagccguccccggcccugacgauucucgagaagacguuaaugaaugugccgaaaacccaggugucuguacuaacgggguuugugugaauacagacggcucuuuccgaugugagugcccauucggcuacagcuuggauuucaccggcauuaauuguguggauacagacgagugcucgguggggcaucccugcggacaggggaccuguaccaacgucaucggaggauuugaaugugccugugccgacggguuugaaccuggucucaugaugaccugugaagacauagacgaaugcucccuaaauccauugcugugugcauuucguugccacaacacugagggcuccuaucugugcacaugcccugcuggcuacacccuucgcgaagacggagcuaugugucgggacguagaugagugcgccgacgggcagcaggacugccacgcgcggggaauggaguguaagaaccugauugggacuuucgccugugucugcccaccagggaugcggccccugccuggcucaggcgaagguugcacagacgauaaugaaugccacgcacaaccagaucucugcgugaaugggaggugcgugaacacugccggaagcuucaggugugauugcgaugaagguuuccagccauccccgacacucacugagugccacgauauucgucagggaccuuguuucgcggaaguucugcaaacaaugugcagaagucugucgaguaguagcgaagcuguaacccgcgccgagugcuguugcggaggcggaagaggcuggggaccaaggugugagcucugcccauugccugggacuuccgccuacagaaaauuaugcccacaugggucaggcuauacugcugagggucgugacguggacgaaugccgcaugcuggcacauuugugugcacauggggaguguaucaacagccugggcucguuucgcugucacugccaggccggcuauaccccagacgcaacugcaacaacauguuuggauauggacgaaugcagccaggugcccaagccgugcaccuuucuaugcaagaauacaaaaggcucauuuuuauguagcuguccgagagguuauuuguuagaagaagauggaagaacaugcaaagacuuggacgagugcacuagcaggcaacauaauugucaguuccuuugcgucaacacaguaggggcuuuuacuugcagaugcccccccggauucacccaacaucaucaggcuugcuuugauaaugacgaauguagugcucaaccugggcccuguggugcacacggccacugccauaacacaccggggucuuuccggugcgagugccaccagggcuucacauugguguccucuggacauggaugcgaagaugugaacgagugcgacggaccucaccgaugucagcauggcugucaaaaccaacuggguggguaccggugcagcuguccucagggcuuuacacagcauucucagugggcgcaguguguggaugagaacgagugcgcacugucuccuccuacauguggauccgcuaguuguagaaauacccuuggcgguuuccgcugcgugugccccagcggauucgauuucgaccaggcucugggugguugucaggaaguugacgagugugcaggccgucguggccccuguuccuauaguugcgcuaacaccccuggagguuuccuuuguggcugcccccagggcuauuuccgggcuggccaggggcauugugucuccggacuggguuucucaccuggaccacaagacacgcccgacaaagaagaacuccuguccucagaggccugcuacgagugcaaaaucaacggacuguccccgcgugacagaccgaggcgcagcgcucaccgagaccaccaggugaaucuggccacccucgacagugaagcucugcucacccucggguugaaccucagccaccuggggagagcagagagaauucucgagcuccguccugcacuggaaggucuggaggggagaauccgguacgugaucgugcgcggaaaugagcaaggguuuuuucgcaugcaccacuugaggggcguaagcagucuucagcucgggcgacgcaggccaggaccgggaacuuauagacucgagguugucagucacauggcuggcccaugggggguacagcccgagggacaacccggcccaugggggcaagcucugcgcuuaaaaguccagcugcagcuccuguag

SEQ ID NO: 13490 - RNA, 291 nt, Artificial Sequence
  Description of Artificial Sequence: Synthetic coding sequence
augcgcguuacaagcgccacaugcgcccuccuguuagcccugaucuguagcgugcaauugggugaugccugucuggauauugauaaacuccuugcuaauguaguuuuugaugugagccaggacuugcuuaaggaggagcuugcuagauacaaccccucgccucugaccgaagaauccuuuuugaauguucagcaauguuucgcaaacguaagcguuacugaaagguucgcccauaguguugucaucaagaaaauuuuacaaucgaacgauugcauugaggcugcuuuuuag

SEQ ID NO: 13491 - RNA, 1890 nt, Artificial Sequence
  Description of Artificial Sequence: Synthetic coding sequence
augcaacaggauggcuuaggagugggcacucgcaacgguucagguaagggacggucuguacaccccucuuggccguggugcgccccaaggccccugcguuauuuuggcagggacgcacgggcacgccgugcccagaccgccgccauggcccuacucgcuggaggccugagcagaggucuggguucccaccccgccgcagccgguagagacgcaguagucuucguaugguuacugcuguccaccuggugcaccgcacccgccagggcgauccaggucacaguaucaaacccauaucauguggugauacuguuccaaccaguaacacugccauguacuuaucagaugacuuccacgcccacgcagcccaucgugaucuggaaauauaagucauucugccgagaucgaauagccgaugccuuuuccccagccuccguggauaaccaacuuaacgcccaacucgcagcugggaauccaggguauaaucccuacgucgagugucaggauucaguucggacugugcgcgucguggccacuaagcaggggaaugccgugacgcugggagacuauuaccagggucgacgcauuacaaucacagguaaugccgacuuaacauucgaccagaccgcuuggggggacagcggagucuacuauuguucugucgugagugcacaggaucuacaggguaacaacgaggcauaugcggagcugauuguccuggacuggcuguuuguuguuguggugugucucgcugcauuucugauauuccuauugcuggguaucuguuggugccaguguugcccucauaccugcuguuguuacgugcgcugcccauguugccccgacaaguguugcugcccagaagcucucuacgcagcuggcaaagcugcgaccaguggcgugcccagcauuuaugccccuucaacuuacgcgcaucuaagucccgccaagaccccacccccccccgcaaugaucccuaugggccccgcuuauaacggcuauccaggcggauaucccggggacguggaucggucaagcagcgcugggggccaggguuccuauguaccguuacuuagagacacugacucuucugucgcgagcguccgcucugguuaucgcauacaagccagucaacaggaugauucuaugcgggugcucuauuauauggaaaaggaauuggccaauuucgacccaagccggccuggcccaccaagcggucgcguggagcgagcuaugucagaagugacuucccugcacgaggaugacuggcggagcagaccaucucggggaccggcccucacucccauccgggacgaagaguggggggggcacagcccgcgcucacccagaggaugggaucaggagcccgccagagagcaggcaggcggaggcuggcgcgcuagacgaccuagagcucgguccgucgacgccuuggaugaccugaccccuccuagcacagcagaaagcggaucaagaaguccuaccucaaacggcggccgaagcagagccuacaugcccccccgcagccggucaagggaugaccuguacgaccaagaugacucuagggacuucccucggucacgugauccccauuacgacgauuuuagauccagggagagaccacccgccgacccucggagccaucaccaccgcacccgcgauccaagagauaaugggagcaggagcggagaccugcccuacgacggacguuuacuggaagaagcugugcggaagaagggaagcgaggagcgaagaaggccacacaaggaggaagaagaagaggcauacuaccccccugcccccccccccuauucggagaccgauucccaagcaucccgugaacgccgauugaaaaaaaaccucgcuuuguccagggaaucucuaguggucuag

SEQ ID NO: 13492 - RNA, 591 nt, Artificial Sequence
  Description of Artificial Sequence: Synthetic coding sequence
augucccgcagaaguaugcuacucgcaugggcauugccuucucuacugagacuaggugcggcccaggagacagaggacccugccugcuguuccccaauugugccgcggaacgaauggaaagcucuggcaagcgaaugugcccagcaucuuucccugccgcuccguuacguuguugugucucacaccgccgguucaucaugcaacaccccagccuccugucagcaacaggccaggaaugugcaacacuaccacaugaaaacguugggauggugcgacgucgguuacaauuuucucaucggggaggauggccugguguacgaaggcagaggcuggaauuucacgggcgcucacagcggacacuuguggaacccgauguccaucgguaucagcuuuaugggaaauuacauggacagagugccuaccccacaagccauucgcgcugcacagggacugcuggccugcggagucgcacagggggcacuccgcuccaacuacgugcugaagggucacagggacgugcaacggacucucucgcccggaaaccaacuguaccaccuaauccagaauuggccccacuaccgcucccccuag

SEQ ID NO: 13493 - RNA, 1056 nt, Artificial Sequence
  Description of Artificial Sequence: Synthetic coding sequence
auggaagcuuucgcacugggacccgcaaggagaggacguaggagaacgcgagccgccgguucauuacucucaagggcugccaucuuauuauucauaagcgcuuuccuuguucgagucccuagcuccguggggcaucuaguuaggcuccccagagcauucagguugaccaaggauucggucaagauaguagggucuacuaguuucccugucaaagccuacgucaugcuucaccagaagaguccacacguccugugcgucacccaacaauuacguaacgccgaacuaauagaucccaguuuccagugguauggaccaaaaggcaagguaguuucuguugaaaaccggaccgcccagauaaccucaaccgggucccuuguuuuucaaaauuuugaggagucaaugagugguauuuacacauguuuucuggaauacaagcccaccguggaagagauagucaaacgccuccagcucaaguacgcaaucuaugccuacagagagccacauuacuacuaccaguuuacggcccgauaucacgccgcgccauguaacaguauuuacaauaucucauucgaaaagaaguuacuucagauccuguccaaacuucuguuagaucuuucuugugaaaucagcuugcugaaguccgagugccacagggugaagaugcaaagagccggguugcagaacgaacuguuuuuugccuuuagcgugaguucauuagauacugagaagggacccaagcguuguacugaccauaacugcgagccauacaagaggcuuuuuaaggccaaaaaccugauugagcgcuucuuuaaccaacaggucgaaauucucggaaggagagccgaacaacucccucagaucuauuacauugaaggaacucuucaaaugguguggaucaauagguguuuuccuggguauggaaugaacgugcagcagcauccuaaguguccugaguguugcgucauaugcuccccuggcuccuacaacccccgcgacggaauccacugccuccagugcaauucaucauuaguauacggcgcaaaaaccugccuuuag

SEQ ID NO: 13494 - RNA, 420 nt, Artificial Sequence
  Description of Artificial Sequence: Synthetic coding sequence
auggagaccaauguuuuccaccuuaugcugugcgucacuagcgcccgaacacacaagucaacaucccuuugcuucggccauuucaauucauauccaagccugccacuaauacacgaucuucuccuggaaauuucauuucagcucagugcaccacacgaggaugcucggcugacucccgaggaacuugaacgcgccucuuugcuccagauccuccccgagaugcugggcgcugaaaggggcgauauucuccguaaggcugacuccaguacaaacauuuuuaacccccgugguaaucugagaaaguuucaagauuuuucuggccaagauccuaacauucucuugagucaccuauuagccagaauuuggaagccuuacaagaaaagagaaacaccugauugcuuuuggaaauauugcguguag

SEQ ID NO: 13495 - RNA, 606 nt, Artificial Sequence
  Description of Artificial Sequence: Synthetic coding sequence
auggguucggggcgccgugcucuuuccgccgugcccgcaguccugcuggugcuuacucuucccggacuuccuguaugggcccagaacgacacugaaccgauagugcuggaaggcaagugccuaguuguaugugacuccaauccggcaaccgauucaaaggguagcuccucuuccccuuuaggcauaucaguccgggcugcuaacuccaagguagccuuuuccgccguuagauccaccaaccaugaaccuuccgaaauguccaauaaaaccagaaucaucuauuuugaccaaauccuggucaaugucggcaauuuuuucacacuggaauccguguuuguugcuccacgcaagggaaucuauuccuucucuuuccacgucauuaaggucuaucagucacagacaauccagguaaaucuaaugcuuaauggcaagcccgugaucucagccuucgcuggugacaaggauguuacaagagaagccgcuacuaacggagugcugcucuaucucgauaaggaagacaagguguauuugaagcuagagaaaggaaaccuggugggcggauggcaauauuccacauuuaguggcuuuuuagucuuuccgcuuuag

SEQ ID NO: 13496 - RNA, 264 nt, Artificial Sequence; identical to SEQ ID NO: 11857
  Description of Artificial Sequence: Synthetic coding sequence

SEQ ID NO: 13497 - RNA, 1098 nt, Artificial Sequence
  Description of Artificial Sequence: Synthetic coding sequence
augccaggcgguaagaaggucgcuggaggugggucaucaggagcuacacccaccagugccgcagcuacugcccccagcggagugcggcggcuugaaacaucagaaggaacgagugcccagcgcgaugaggaaccagaagaggagggugaagaagaucugcgcgauggaggcguuccuuucuucgugaaucguggcggucugccagucgaugaggcgaccugggagcgaauguggaagcacguggccaaaauccaucccgauggagagaaagucgcacagaggaucaggggagccacagaccugccaaagauacccauaccaucuguccccacauuucaaccaaguacacccguucccgaaaggcuugaggccguccagcguuacauuagagaacuccaauacaaucauacaggcacccaguucuucgagaucaaaaagucccgcccauuaacgggucucauggaccuggcuaaggagaugacuaaggaagcccugccuaucaaguguuuagaggcugucauucugggcauauaucugaccaauucuaugccuacucuggagagauucccgauauccuucaaaacuuacuuuucuggaaacuacuucagacauaucgugcucggagucaauuucgcaggacgguauggagcccugggaaugagccgaagagaagaucucauguauaaaccaccugcauuuaggacacugucugaacuugugcuggauuuugaagccgcuuaugggcgguguuggcacgugcuuaaaaaggugaagcuaggucagaguguuucccacgacccacauucaguggagcagaucgaguggaaacauagcguucuugaugucgaaaggcucggacgggaugacuuuaggaaggaacuggaacgccacgcccgcgauaugaggcugaaaauuggaaaggguacagguccaccaucaccuaccaaagauaggaagaaggacguaagcucaccccagcgcgcacaguccucaccccaucgacgaaauaguagaagcgaacggagaccaagcggugacaaaaaaacuagcgagcccaaagccaugccugaccugaauggauaccagauuagaguguag

SEQ ID NO: 13498 - RNA, 1377 nt, Artificial Sequence
  Description of Artificial Sequence: Synthetic coding sequence
auggcuugggccucucggcuuggccuccugcucgcccuccugcugccaguugugggagccaguacucccgguaccgucguuagacugaauaaggcugcccuguccuauguuucugagauugguaaggccccacuacaacgcgcccugcaagugacugugccucacuuucuggacuggaguggcgaagcccugcaaccuacacgcauccggauccuuaauguccacguaccacggcugcaucuuaaguuuaucgcaggauuuggaguacgauuacucgcugcagcuaacuuuaccuucaagguguuucgcgcuccagagccccuagaacuaacgcuacccguugagcugcucgccgauacgagagugacucaaucuuccauucgaaccccaguuguuucuauaagugccugcucccuguuuuccggucaugccaacgaguuugauggauccaacucaaccucucacgcuuuauuggugcuuguccagaaacacauuaaagcugugcucucaaacaaacucugucucucaauuuccaaccucgugcaaggcgugaacguucaucuugggacccugauaggucuaaauccugugggcccagaaucucagaucagguauucaaugguuucagucccuacaguuacuagcgauuacaucuccuuggaagugaaugcaguucuguuccugcuaggaaaaccuauuauccucccaaccgaugcgaccccuuucguacuucccagacacguuggaacagaaggguccauggcuaccgugggacugucucagcagcucuucgacuccgcccugcuucugcuccaaaaagccggggcccugaaccuggauaucaccggacagcuacgcagcgacgacaaucuccugaacaccagcgcccucggaagguugauucccgaggucgcccgccaguucccagagcccaugccagugguccugaaagucagacuaggcgcaacaccaguggcuaugcugcauacuaauaacgccacccucagacugcagccauuuguagagguccucgccaccgccucaaacuccgcuuuucaauccuuguuuucacucgacgucgugguaaacuuaagacugcagcuguccgucucuaaagucaaauugcaaggcacuacuuccguucucggcgauguccagcuuacuguggccucaaguaaugugggguucauagacacagaucaggucaggacccuaaugggcaccguuuucgaaaaaccucuacuugaucauuuaaaugcuuugcuggcuaugggaaucgcccuaccaggggucgucaaucugcacuauguggcuccagagauuuucguauaugagggauaugucgugauuagcucagggcucuuuuaucaguccuag

SEQ ID NO: 13499 - RNA, 1815 nt, Artificial Sequence
  Description of Artificial Sequence: Synthetic coding sequence
augaugagggccgugugggaagcauuggccgcguuagccgccgucgcuugccuggugggagcaguccgaggcggcccuggcuuauccauguuugccggacaggccgcccagcccgauccaugcuccgacgaaaauggacauccuaggagaugcauucccgacuuuguaaaugcggcuuucggcaaagaugugcggguuucuaguacauguggaagaccucccgccagauauugugucgugagugagagaggcgaggagcgacuccgcaguugucaucugugcaaugcauccgauccuaagaaagcgcacccccccgcauuucuuacagaccuaaacaauccucacaaccucaccugcuggcaaucagaaaacuaucugcaauucccccauaacguaacacugacacucucccuggguaaaaaauucgaaguuacauacguaucacugcaguuuugcucuccacgcccugagucaauggcuauuuacaaaagcauggacuauggacggacauggguaccuuuucaauuuuacucuacacagugcagaaaaauguacaaucgaccacauagggcaccaaucacuaagcagaaugagcaggaggccgugugcacugauucacacaccgacaugcggccucugucuggcggacugauagccuuuuccacucuggacggucgacccuccgcucacgacuucgacaauagccccgugcugcaggauuggguaaccgccaccgauauuagggucgcuuuuucuaggcugcauacguuuggcgaugagaaugaggacgauuccgaacuggccagggacaguuacuuuuacgcaguauccgacuugcaagugggagggagaugcaaauguaauggccaugcugcuagauguguaagggaccgcgaugauucuuugguuugugacugcaggcauaauaccgcuggaccagagugugauagauguaagccuuuucauuacgauagaccuuggcaaagagccacugcuagagaagcaaacgagugcguggcuuguaacuguaaccugcacgcucguaggugucgguuuaauauggagcucuacaagcugagugggcgaaaaaguggagguguaugucuaaacugcaggcauaauacugcuggccgccauugccauuacuguaaggagggguauuaccgugacauggggaagccuaucacccaccggaaggcaugcaaggcaugcgacugucauccagugggagccgcagguaagacaugcaaucagaccaccggccaaugucccuguaaggacggggugaccgguaucacauguaaccgaugcgcuaaaggauaucaacaaagcagguccccuauagccccgugcaucaaaaucccaguagcaccuccuacaaccgccgcaagcuccguggaagagccagaagauugugauucguauuguaaggccucaaaagggaaauugaaaauuaauaugaagaaauauugcaaaaaggauuaugccguacagauucacaucuugaaagcugauaaggccggagacugguggaaauucacugugaauaucauaagcgucuauaaacagggcacuucucgcauccgacggggggaucagucuuuguggauccgaucuagagacauagccuguaaauguccaaaaaucaagccccucaaaaaauaucuauuguuggggaaugcggaggacucuccggaccagucagggauuguagcggauaagucaagccuagugauacaguggcgugacacuugggcccggcgguuacgaaaguuccaacaaagagagaagaaaggaaaguguaaaaaagccuag

SEQ ID NO: 13500 - RNA, 675 nt, Artificial Sequence
  Description of Artificial Sequence: Synthetic coding sequence
augcccgggagggccccccuccgcacaguuccuggagcccucggugcuugguugcugggggggcugugggcauggacuuuguguggacuuuguucucugggugcugugggcgcaccuagacccugucaggcaccucagcagugggaaggcagacagguaauguaccagcaauccagcggcagaaauagcagagcccuacugucauacgauggcuugaaccagcgaguuagaguccuugacgagcggaaagcccugauaccguguaaacgguuguucgaauacauacuccuguauaaagacgggguaauguuccagaucgaucaggcuacuaaacagugcagcaagaugacccuuacucaaccaugggauccauuggacauaccucagaacaguacuuucgaagaucaguauucuauuggcgguccccaggaacagauuacaguccaggaaugguccgaucgcaagucugcucguagcuacgaaacguggauuggcauauauacuguaaaggauugcuacccuguacaagagacuuuuacaaucaacuauucaguaauucuuaguacccgcuuuuucgauauccagcugggaaucaaggacccuucaguguuuacccccccuucaaccugccaaauggcccagcucgaaaaaaugucugaagauugcucaugguag

SEQ ID NO: 13501 - RNA, 5106 nt, Artificial Sequence
  Description of Artificial Sequence: Synthetic coding sequence
augggcuuucuuccaaagcucuuacugcuggccuccuuuuuuccagccggccaggccaguuggggcguuagcuccccccaggacguucaaggcgugaaggguucuugucuccuaauucccuguaucuuuucauucccagcagacgucgaggugccugacgguauaacugccauaugguacuacgauuacagcggacagcgccaaguggugucucacagugcggacccaaaacucguggaagcucguuuucgcggaaggacugaguuuauggggaauccugagcaccgcgucuguaaccugcuccugaaagaucuccaaccugaggauagcgguagcuacaacuuccguuucgaaaucuccgaggugaaccgcuggucagaugugaaggguacccuugucacagugacagaagaaccccgagugcccacuauagcuagcccuguggaacuuuuggaagguacugagguugauuuuaauugcuccaccccauacgucugucuucaagagcaaguccgccuccaguggcagggccaggacccagcgcguucuguuacuuuuaauagucagaaguuugaacccacgggcgucggucaucuugagacccuacacauggcuaugucuuggcaggaccauggacgcauucugcgcugucaacuaaguguggcaaaccauagagcacaguccgaaauccaucuccaggugaaauacgcacccaaagguguuaaaauccugcugucccccucggggcgaaauauccugcccggagaauugguaacacuaaccugccaaguuaacagcucuuaucccgcuguaagcucaaucaaaugguugaaggauggaguucgccugcaaacaaagaccggaguccuacauuugccucaggcagccuggagcgaugccggaguuuacaccugccaagcugaaaacgguguagguucacuggugucucccccaaucucccugcauaucuuuauggccgaaguucaagucucccccgccggaccuauccucgagaaucagacagucacccucguauguaauaccccgaacgaggcaccuuccgaccuccguuacagcugguacaaaaaucacgugcuguuagaggacgcacauagucauacccuccggcugcaccucgccacccgcgccgauacaggguuuuauuuuugcgaaguccagaacguacacgggagugaaagaucugguccaguuagugucguaguuaaccauccgccacugacacccgugcugacagcauuuuuggagacgcaggccggccugguuggaauuuuacacuguagugugguaagugagccccuggcuacauuaguguuaucacacggagggcacauccuggcuagcacuucaggagacucugaccauucuccacgauuuucaggcacaucuggcccaaacucacuccgccuugaaaucagagaccucgaggagacugacagcggcgaguauaagugcagcgcaaccaacucuuuagggaaugcaacuuccacgcuugauuuccacgccaaugccgcccgacuguugauuucgccagccgccgaggucgucgaaggccaagccgucacacuuucuugcaggucaggacuuagccccaccccagacgcaagguucucaugguaccuaaacggugcccuccuccacgaaggcccugguucaucgcuacugcugccagccgccucaucaacggaugccggcuccuaccacuguagagcuagagacgggcacagugccucagguccaagcucccccgccguucugacugugcucuauccuccccgccagccuacuuuuacgaccagacuggaccucgaugcugccggugcaggagccggucgacgcggccuguugcugugcagagucgauagugauccaccugcccgguugcaacugcugcauaaggaucgggucguugcuacaagccugccguccgguggcggauguucuacuugugggggauguuccccgaggaugaagguaaccaaggccccaaaccuccugagagucgaaauccauaacccauugcuugaggaagagggauuguaucugugcgaagcuucuaaugcuuuggguaacgcuucaacuucugcuacauucaauggccaagcuacaguccucgcuauugccccaucucauacacugcaggagggcaccgaggccaaucuuacauguaaugucagccgggaggccgccggcucaccugcgaacuucucaugguuucguaacggagugcuuugggcucagggaccacucgagacugucacucugcugccuguugcuagaacugacgcagcccuguacgcuugcagaauccucacugaggcaggagcucagcuguccaccccaguucugcugaguguguuguacccaccagaucgaccgaagcuaucagcacugcuugauauggggcagggacauauggcucuuuuuauuugcaccguugacagcagaccccucgcucucuuagcucuuuuccauggugaacauuuacuggcuacaucucuuggaccgcaagucccuucccacggucgauuccaggcaaaggcugaagcuaauagccuuaaguuggaagugcgggaacuggggcugggagauuccggguccuaccggugcgaagcaacaaauguacugggaagcagcaacacaagucuuuucuuccagguccguggggccugggugcaggucucgcccagccccgaguuacaagaagggcaagccguugucuugagcugccagguccauacaggggucccagaaggcacuuccuacaggugguaucgggauggacagccccuucaagaauccaccucggcaaccuugagauuugccgccaucacgcugacccaggcgggagcuuaucauugucaggcccaagcaccaggcucugcaacuacaagccuugccgcuccuaucagccuccacguguccuaugcuccucgccacgugacccuaacaacuuugauggauacagguccuggaagauugggacugcuacucugccgcguggauagugacccucccgcacagcugcgauuguugcacggagauagguugguugcuuccacacuucaaggggucggagguccggagggguccagcccaagacuacauguggcugucgcuccuaauacuuuaaggcucgagauccacggcgccaugcuggaggacgagggcguguauauuugcgaagcuucuaacaccuuaggacaggcaucagccucagcugacuuugaugcacaggcugucaauguucaaguauggcccggcgcaacagugcgagaaggucagcuugugaacuuaacgugucuuguguggaccacacauccugcucagcucaccuauacuugguaccaagauggucaacagagauuggacgcccauucaauuccucuucccaacguaacuguccgagaugccacaagcuauagaugcggaguugggccgccagggcgggcccccaggcugagcagacccaucacccuagacguacuuuaugcuccccguaaccucaggcuaacuuaucuacuggagagccauggcggacagcuagcccugguccugugcacugucgacagccgcccucccgcccaguuggcccugucccacgccggccgccuucucgccaguucgaccgccgccucagucccuaacacacuucgguuggaacuacgcggaccccaacccagggaugagggguucuauuccugcucugcacguucaccucuuggucaagcuaacaccucgcuagagcuacgucuggaaggugucagggugauacucgcucccgaagcagcagucccugagggugcccccauuacagucacuugcgccgacccagccgcacaugcuccaacccuguauaccugguaccacaacggcagauggcugcaggaaggaccugcagcguccuuaucuuuuuuagucgcaacucgcgcacacgccggagcuuauucgugucaggcgcaagaugcccaggguacucguucaucuaggcccgccgcacuccaggugcuuuaugcuccacaagaugcuguucucaguucauuccgcgacucacgugccagauccauggcaguuauccaguguaccguggauucugaacccccagcugaacucgcacucucacaugacggaaagguccuagcaacuaguucugggguccacucccuugccucgggcacgggacaugugcaaguagcccggaaugcuuugcgccugcaaguucaggacgucccugcuggcgaugacacuuaugucugcacugcacaaaaccugcuugguuccauuucaacuauuggacgcuuacaggucgagggagcacgggugguugccgaaccuggccuggauguccccgagggcgccgcgcugaauuugagcugcaggcugcugggaggucccgguccagucggaaacucuacauuugccugguuuuggaacgacagacggcugcaugcugagcccgugcccacacuagcuuuuacccauguggcgcgggcacaggcuggaauguaccacuguuuggccgaacucccgacuggcgcagccgcuuccgcccccgugaugcugagagugcuauacccuccaaaaacuccaaccaugaugguguucguggaaccugaaggcggccucagggggauucuggacugccgcgucgacucagagcccuuggccucacuuacguugcaccuuggaagucgccuggucgccuccagccagccucaaggagcucccgcagagccacacauccauguccuagccuccccgaaugcacucagagucgacaucgaggccuuacgaccuagugaccagggcgaguacauuugcuccgcuagcaacgugcugggcagcgcuuccaccucaacauauuucggcguucgagcucuccaccguuugcaccaauuucaacagcuucucugggugcuaggguugcucguuggccugcugcuguugcuacuggggcucggagccuguuacaccuggagcagcuugauucugaugcaaccgcauguccgcccucaaccuguuccucacccaugggccgaucaauggugcugccugccaucugguggugaaucgggacagaaucuauag

SEQ ID NO: 13502 - RNA, 708 nt, Artificial Sequence
  Description of Artificial Sequence: Synthetic coding sequence
augaccgugcuggcgcccgccuggucacccaccacguacuuauugcuucucuugcuacuuucuaguggucugucaggcacacaagacugcaguuuucagcauaguccaaucagcucggauuucgcagugaaaaucagagaacucucagauuaccuauuacaagauuacccugugacgguggcaagcaaucugcaggacgaggagcuuuguggggggcuauggagacucguguuagcccaaagauggauggagagacucaaaacugucgcuggaagcaagaugcaaggacuuuuggagagagugaauacagagauccacuucgucaccaagugugccuuucagccuccaccuuccuguuugcgauuuguacagaccaacaucagccgacuccuacaagaaaccagugagcagcucguggcucugaagccauggaucacccgacagaauuucagcagaugccuugaacuucagugccaaccugacucgucaacccugccacccccaugguccccucggccucuugaggcgacagcccccacagccccucagccaccacuacuucuacuccuccuguuacccgugggcuuacuguuacucgccgccgccuggugccuucacuggcagagaacgcggcgacguacaccaagacccggcgaacaaguaccaccgguacccagcccucaggaccuccuucucguagaacacuag

SEQ ID NO: 13503 - RNA, 5472 nt, Artificial Sequence
  Description of Artificial Sequence: Synthetic coding sequence
auggcccuaagcagcgccuggcgcagcgugcugccacucuggcuccugugguccgccgccugcucuagggcagccuccggggaugacaacgccuucccauuugacauugagggcucaagcgcuguggggcgucaagaccccccugaaacuagugaaccucgcguggcauuaggucgccugcccccugcugccgaaaaguguaaugcugguuuuuuucauacucugaguggagagugugucccuugugauuguaauggcaacucaaacgaaugccuugacggauccggauacugcgugcacugccaacgaaacaccacaggugagcauugcgagaagugucuggacgguuauauuggagacucuauccgcggagcaccucaauucugucaacccugucccugcccuuuaccacacuuggcuaacuuugcugaaaguugcuauagaaaaaacggcgcugugaggugcauuuguaacgagaauuacgccggccccaacugugagcgcugcgccccgggauauuacggcaacccccuucugaucggcagcacuugcaagaaaugcgauuguuccgggaauagugauccaaaucugauuuuugaggacugcgacgaggugaccggccagugccgaaauugcuuaaggaauaccaccggauucaagugugaaaggugcgcucccggauauuacggggaugccaggauagccaagaauugugccguuugcaauuguggaggagguccgugcgacuccguuacaggcgaaugccuagaggaaggcuucgaaccaccuacaggaauggacugucccaccauuagcugugacaaaugcgucugggaucuaacugaugcuuugagauuggcugcgcuguccaucgaagaagggaagagcgguguacucagcgugucaagcggcgcugcugcccaucgacacgugaaugaaauuaacgccacgaucuaccugcugaaaaccaaacugagcgagagggagaaucaauacgcucucagaaaaauccaaaucaauaaugcggagaacaccaugaaaucccugcuuuccgacguggaggaacuaguggaaaaagaaaaucaagcuagucgcaaaggucaauuaguccagaaggagagcauggacacaauaaaccaugccagccagcuaguggaacaagcccacgacaugcgcgauaaaauccaagaaauuaauaacaagaugcucuacuauggagaagaacacgaauugucucccaaggaaaucagcgagaaacuagugcuggcccaaaaaaugcuggaggagauacguaguagacaacccuuuuucacucagagagagcucguugacgaagaagcagacgaagcauaugagcugcucagucaggcggagaguuggcagcgccuacauaacgagacccguacguuauuucccgugguacuagaacaguuagaugacuacaacgcaaaacuuagcgaccuucaggaagcccucgaccaggcacucaacuacguccgagacgccgaggacaugaaccgugcaacugccgcucgccaacgcgaucacgagaaacagcaagagaggguacgggagcagauggagguugugaauaugucccuuaguaccucggcagacucucuaacuacaccacggcuuaccuuaucugagcucgaugauauaauuaagaaugcuucuggaauuuaugcugaaaucgacggggcaaaaucagaacugcaggugaaauuaucaaaccuuagcaaccuuucccacgacuuggugcaggaggccaucgaccacgcucaggacuugcaacaggaggcaaacgagcuuagcaggaagcuucacaguagugacaugaacgggcuggugcaaaaagcccucgaugccucaaacguguacgagaacauagugaauuaugugagcgaagccaacgaaacugcggaauuugcccucaauaccacugacagaaucuaugacgccguaucaggaaucgauacacagauaaucuaucacaaagacgagagugaaaaucugcugaaccaggcaagagaacuccaggcaaaggcugaauccucaagcgacgaggcgguagcagacacgucccgaagagucggaggcgcacucgccaggaaauccgcucugaaaacccgacuauccgaugcggucaaacagcuacaggcggccgaacguggagacgcacagcagagacuuggacagagucgacucauuacagaggaagcuaacaggacaacgauggaaguucaacaggccacugcuccuauggcaaauaaucuaaccaacuggucucagaaucuacagcacuuugauagcagcgccuacaacaccgccgugaauucagcccgggacgccgugcgaaauuuaacagaagucgucccacagcuccuugaccagcugaggaccguggagcagaagaggccagcaucuaacgucucugccaguauccaacgaauacgggaacugaucgcucaaaccagaagcgucgcauccaaaauucaggugucuaugauguuugacggucaaagcgcugucgagguacauucaagaacuucuauggacgaucugaaggcguuuacuucccugucucuguacaugaaacccccagucaaaaggccagagcugaccgagacugcagaccaguuuauccuuuaccugggcucaaaaaacgcaaagaaagaguauaugggccuugccaucaagaacgauaaccuaguguacguuuauaaccugggcacgaaagacguggagauuccccucgacuccaagccugugucuaguuggccugcuuacuuuagcaucgugaaaaucgagagagucgggaaacauggcaaagucuuuuuaacagucccuagcuuaagcucuaccgccgaagaaaaguuuaucaaaaagggcgaauucucuggcgaugauucauuacuugaccuugaccccgaagacacagucuuuuacgugggcggagugccuucuaacuuuaaguuacccacgucacugaaucugccuggauuuguggguugucuagaacucgccacucuaaacaaugauguaauuagucuguauaauuucaagcacauuuacaauauggauccauccaccucgguuccaugcgccagagauaaacuugcauuuacgcaauccagagcugcuucauacuucuucgacgggaguggauaugcagucguccgcgauaucacgcguaggggcaaauuuggucaaguaaccagguuugacauagaagucaggacuccagcagauaaugggcugauucuccucauggucaauggcuccauguuuuuucgccuagaaaugagaaauggauaccugcacguguuuuaugacuuuggauuuagcggcggaccaguacaccucgaagacacacugaagaaggcucagauaaaugacgcgaaauaccaugaaauuucgauuauauaucacaaugacaagaaaaugauacuggugguggaucggaggcacguaaaaucuauggacaacgaaaaaaugaaaauuccauuuacagauauauauaucggaggcgcuccaccagaaauccugcagagucgugcccugcgggcucacuugccauuggacauaaacuuuagagguugcaugaaaggcuuccaauuucagaaaaaggacuuuaaccugcucgagcaaacggagacccuugggguuggcuacggaugucccgaggauuccuugauuucccggcgagcuuauuucaauggccagagcuuuauagccaguauucaaaagaucagcuucuucgauggauucgaagguggguucaauuuuaggacgcuccaaccaaacggccugcuauucuauuacgcaucagggagcgauguguucucaaucucccuggacaacggaaccgucauuauggaugugaaaggaauuaaagugcaaagcgucgacaaacaauauaaugauggccucucccauuuugucaucaguuccgucucaccuacuagauaugaauugaucguggauaaaucucgggucggguccaagaacccaacgaaaggcaaaauagaacaaacacaggcuagcgaaaagaaguuuuauuuuggugggagcccaauuucugcucaguaugcuaacuucacagguugcauuucgaacgcuuacuucacacgggucgaucgcgacgucgagguugaagacuuccagcgcuacaccgaaaaaguccauacauccuuguaugaaugcccuauagaaucuaguccucuguuccuccuccacaaaaaagguaaaaauuugucuaagcccaaagccagucagaauaaaaaggggggcaagucgaaggaugcccccuccugggaucccguagcccucaagcuccccgaaagaaauacgccccguaacucucauugucaccugucuaauucuccacgcgccaucgaacacgcauaucaguauggaggcacugcuaacucgcgccaagaguuugaacaucugaaaggagauuuuggcgcuaagucucaauuuuccauaagacuucggacgcggucuucacauggcaugauauuuuacguguccgaucaggaggaaaacgauuuuaugacacuguucuuggcacacgggaggcucguguauauguuuaacgucgggcauaaaaaguuaaagauaaggucucaggaaaaguacaacgacggucuuuggcaugacguuaucuuuauuagggaacggucaagcggcagacugguaauugacgggcugcgcguucuagaggaaagucugccacccacugaagcaacauggaaaauaaaagguccaauauauuugggaggaguggccccaggaaaggcagucaagaacgugcagaucaauuccaucuacuccuucuccgguugucuaaguaacuugcaacuaaauggggcuucgaucaccucagcuagccagacauuuagcgugacccccuguuucgaaggaccaauggagaccggcacauauuucucuacagaaggcggcuaugucguguuggaugaauccuucaauaucggccugaaauuugagaucgccuuugaaguccguccucgcucuucauccgguacacucguccacggccacucagucaauggagaguaccucaaugugcauaugaaaaacggacagguuauagugaaaguuaauaacggaauccgcgacuuuucuacgagugugacaccuaagcagucucugugugacggucgguggcauaggaucacaguuauucgggauuccaauguggugcaacuagauguggauuccgaaguuaaucacgucgucgggccgcugaaccccaaaccuaucgaccauagagagcccguuuuugucggaggagugcccgagagccugcugacaccucgccuugcccccucaaagccauucacgggcugcauacgccacuucguuaucgacggccaucccgucucguucaguaaggcugcacucgugucuggagcaguauccauaaauucuugccccgccgccuag

SEQ ID NO: 13504 - RNA, 1434 nt, Artificial Sequence
  Description of Artificial Sequence: Synthetic coding sequence
augacauccaaguuccuccuuguguccuucauacuggcugcucucucacuuagcaccaccuucucccuucagcccgaccagcagaagguccugcucgucucuuuugaugguuuuaggugggauuaccuuuacaagguuccaacuccucacuuccauuauaucaugaaauacggagugcacgucaaacaagugacuaacguauucauuaccaaaacuuauccuaaccauuauacacuugucaccggucuguuugcugagaaucacgguaucguggcaaaugauauguuugauccaauaaggaacaagucauuuagcuuagaucauaugaacauuuacgauucaaaguucugggaggaagcaacuccaaucuggauuaccaaccaacgcgccggucauacuucaggagcugccauguggcccggcacagaugugaaaauucacaagagguuuccgacccauuacaugccguacaacgaaucuguuaguuuugaagaccguguagcaaagauaauugagugguucacuuccaaagaacccauuaaccuuggucuacuguacugggaagauccagaugacauggggcaucacuugggacccgacaguccacugaugggacccguaauuucugacauugacaaaaagcugggcuaccugauucaaaugcuuaagaaagcgaagcucuggaacacauugaaccuaauaauuacauccgaccacgggaugacgcaauguagcgaggagcggcugauugaauuggaucaauacuuagauaaagaccacuacacacugauugaucaguccccgguagcggccauucugcccaaggaagggaaauucgacgaaguuuaugaagcccucacacacgcacacccaaaccucaccgucuacaaaaaagaagaugugccugagcgcuggcauuacaaguacaauucucgcauccagcccaucauagcuguugcagaugaaggguggcacauucuucagaacaaaagcgaugauuuucugcuggguaaucacggauacgacaaugcacucgccgacaugcacccaauuuuucuugcucacggucccgccuuuaggaaaaacuucagcaaggaggcuaugaacucaaccgaucucuauccgcuacucugucaccuucugaauaucaccgcuaugccucauaauggaagcuucuggaacguccaggaccuguugaauagcgcuaugccacgugucguucccuauacucaaucuaccaucuugcugccuggaucugucaaacccgcugaauacgaccaggaagggucuuauccauacuucauaggcguuucacucggcagcaucaucguuauuguguuuuucgucauauucaucaagcaucugauccauagccagauuccugcucuccaagacaugcacgccgaaaucgcccaaccauugcugcaggccuag

SEQ ID NO: 13505 - RNA, 1131 nt, Artificial Sequence
  Description of Artificial Sequence: Synthetic coding sequence
augcuaaaaaaaauuucuguugguguagcgggggaucuaaauacugucacuaugaaacucggcugugucuuaauggccugggcacuuuacuuaucucugggggugcuguggguggcucagaugcugcuggccgccucuuucgaaacacugcaaugcgagggaccagugugcaccgaagagagcagcugucauaccgaagacgauuugacagacgcacgcgaagcgggauuucaggucaaagcauacacuuucucugaaccuuuucaccugaucguuaguuaugauugguuaauucugcagggcccugccaaaccgguguucgaaggggaucuguuaguacuccggugccaggcguggcaggacuggccccugacccaagugacauucuauagagauggcagcgcccuugguccaccuggaccaaaccgggaauucaguauaacgguaguccagaaggcagacuccggucacuaccacugcucagggaucuuccaaucaccugguccaggcauccccgagacugccagugucguugcgauuaccguacaagaacuuuucccugcaccgauccuaagagcugugccaagugccgagccacaagcugggucaccaaugacucugagcugccagacaaaacuuccacuacaacgcucagccgcacggcugcuguucagcuucuacaaggacggacggauuguacaaagcagaggccugucuuccgaguuccagaucccuacagcuuccgaggaucacagcggaucauauuggugcgaggcugccacagaagacaaucagguuuggaagcaauccccccaguuagaaauucguguacagggcgcaucuuccuccgcugcuccuccaacacugaacccugccccccaaaaaagcgcugcaccugggacagcaccagaagaggcucccggcccacugcccccaccccccacacccagcucagaagauccaggauuuucgucuccacucggaaugccugauccacaccuuuaccaccaaaugggucugcuccucaagcacaugcaggacgugagaguauugcucggccaccuguugauggaacugagggagcugagcggccacaggaaaccuggaaccaccaaggccacagcagaguag

SEQ ID NO: 13506 - RNA, 1572 nt, Artificial Sequence
  Description of Artificial Sequence: Synthetic coding sequence
auggccagaaaagcucuuaaacuugcuaguuggacuagcauggcauuagccgcaucuggcauauacuucuacuccaauaaauaucucgaucccaacgauuucggcgccguacgcgugggaagggcuguggcgacgacggcugugauuucauacgauuauuugacaucgcucaagaguguccccuacggguccgaagaguaucuccaguuacguucgaaagugcaucugcgcagcgcccgacgccucugcgaacuuuguugcgcuaacaggggaaccuuuauuaaaguuggucagcaucugggggcucuggauuaucucuugcccgaagaauacacuuccacacucaaaguucugcauagccaggccccccagaguuccaugcaagaaaucagacaggugauucgcgaggaucucgggaaagaaauccacgaccuguuccaauccuucgacgacaccccccucggcaccgcuagucuggcucaggugcacaaagcaguacuacacgauggcaggacuguagccguaaaagugcagcacccaaaaguuagagcgcagucuucuaaagauauccuccuuauggaggugcuuguguuagccgucaagcaauuguuuccagaguuugaauuuauguggcuaguugacgaagcuaaaaaaaaccuuccccuggagcuugauuuucugaacgagggcagaaacgcggagaagguuucacagaugcugcgucauuucgacuuucugaaggugcccaggauucauugggaucucagcaccgagcgaguguuacuuauggaauuuguggacggcggacaggugaaugacagagauuauauggagagaaauaagaucgacgugaaugaaaucuccaggcauuuggggaaaauguacagcgagaugauauuugucaauggauuugugcacugugauccgcaccccgguaauguguuaguuaggaagcacccaggaaccggcaaagccgagauuguuuuacuggaccacggacuguaucagaugcugaccgaagaguucagguuaaacuacugucacuuauggcagucucuaaucuggacugacaugaagcggguaaaagaauauucucagaggcuaggagccggugaccuuuauccccucuucgcauguaugcuuaccgcccgaaguugggacucugugaauagaggaauuucccaggccccaguuaccgccacagaagaccucgaaauccgaaacaacgcugccaacuaccugccucagaucucacaccuccucaaucaugugccccgacagaugcuccucauccugaagaccaaugauuuguuacgcgggauugaggccgccuuagggacccgagccagcgccucuagcuuucugaauaugucgagauguuguauucgagccuuagcagaacacaagaaaaaaaauaccuguuccuucuuucgucggacucagaucucauucagcgaggcuuucaaccuguggcagaucaaucugcaugaacucaucuuacgcgucaagggacugaaacuugccgaccgaguucuugcacugaucugcuggcuguucccugccccacucuag

SEQ ID NO: 13507 - RNA, 1197 nt, Artificial Sequence
  Description of Artificial Sequence: Synthetic coding sequence
augugguugcuacuuaccauggccucccugauuuccgugcucggaacgacacaugggcuauucgggaagcuucacccuggcagcccugaaguuacaaugaauaucucgcagaugauuacauacuggggcuauccaaaugaagaauacgagguggugacugaagauggcuauauccuagaagugaaucgcauccccuaugggaaaaaaaacagcggaaauacaggccagagaccugugguguuuuugcagcacggacucuuagccucugcaacaaacuggauuucuaaucugccuaacaacagccucgcuuucauacuggcagaugccggcuaugauguuugguuggggaauucaagagguaacacaugggcucgacgcaaccuuuauuacucgccagacucgguagaauucugggccuuuagcuucgaugagauggccaaguacgaucugccagccaccauagacuuuauaguuaagaaaacuggacagaaacaauugcacuacgucggacauagucaggggaccacaauaggcuucauagcuuucaguaccaaccccucccucgcaaaaagaaucaagacguuuuaugcuuuggcucccguagccaccgugaaauauaccaaguccuugaucaacaaacuucguuucgucccacagucacucuucaaguuuauuuuuggggauaagaucuucuacccucacaauuucuucgaccaauucuuagccaccgaagugugcaguagggaaaugcucaaccuuuuaugcuccaacgcccuguuuaucauuugugguuuugacagcaagaacuuuaauacaucgagacuagacguuuaccugucucauaauccagcuggcacaucaguccagaacauguuucauuggacccaagccguuaagucggguaaauuucaagcauacgauuggggguccccuguacagaauaggaugcauuaugaccagucucagccaccuuauuacaaugugacugcuaugaacgucccuauugcuguuuggaacgguggcaaggacuuauuggcugauccgcaggaugugggacugcugcugccaaaacugccaaaucugauuuaccauaaagagauuccuuucuauaaccaucuugauuuuauuugggcuauggaugcaccgcaggagguuuauaacgauauagugucaaugauaagcgaagauaaaaaguag

SEQ ID NO: 13508 - RNA, 555 nt, Artificial Sequence
  Description of Artificial Sequence: Synthetic coding sequence
augagggggcagggcaggaaagagagucuaagugauuccagagaucuugauggauccuaugaucagcuuacggauaguguggacgacgaauucgaacuaaguaccguaugccauaggccagagggccuagaacaguugcaagagcagacaaaauucacgagaaaagaacuucaggugcuguaucgagguuucaagaacgaguguccauccgggauuguuaacgaggagaauuucaaacagauuuacucccaauuuuuuccucagggagauaguagcacuuacgcgaccuuucuguucaaugcuuucgauacuaaucaugacgguuccgugagcuucgaagaaauguuggauaucaugaagagcaucuacgacaugaugggcaaauauacguauccggcgcugcgggaagaagccccucgggagcacguggaaaguuuuuuucagaaaauggaucguaauaaagauggaguggucacaauagaggaguucaucgagaguugucagaagguacaacuacccgcccuuuacauuacguuaaccuggacacaagccuag

SEQ ID NO: 13509 - RNA, 3900 nt, Artificial Sequence
  Description of Artificial Sequence: Synthetic coding sequence
augagucuucaggaaauguuuagauucccaaugggccugcugcuuggcucaguucucuuaguugccucagcaccagcgacucuagaaccgcccggcugcaguaauaaagagcagcaagugacaguaucucacacauauaagauugaugugcccaaguccgcacucgugcaaguagaugcagauccacagccucugagcgacgauggugcaucucuguuggcacugggggaggcucgcgaagaacaaaacaucauauuuagacauaauauccgccugcagacgccccaaaaagacugugagcuggcagguucgguucaggauuuacucgcucgaguuaagaaauuagaggaggaaaugguggagaugaaggaacaaugcagcgcacaacgguguugucagggggucacagaccuuaguaggcacugcucaggacauggaaccuucagccuagagacgugcagcugucauugugaagagggaagagaaggcccugcgugcgaacgacuggcgugccccggggccuguaguggucauggccguugcgucgacgggagaugucugugucacgaaccuuauguaggcgcagauuguggauacccagccugcccagaaaauuguucuggacacggggaaugcguccgaggugucugucaaugucacgaagacuucaugagcgaagacuguuccgaaaaacgcuguccuggugacugcagcggucacggcuucugugauacuggugaauguuacugcgaggagggauucacagggcuggauugugcacaagucguuacaccucagggauugcagcugcucaaaaacacagaagacucccuucucguuuccugggaaccaagcucacaaguugaccauuacuuacuauccuacuacccacugggcaaagaacucagcgggaaacaaauccaggugccaaaggagcagcauaguuacgaaauucuuggccuccugccuggcacaaaguauauugugacccuuaggaacguuaaaaacgagguaucgucuucaccccaacaccuacuugccacuacagacuuagcaguccugggaacugcauggguuaccgacgagaccgagaacuccuuagacguggaaugggaaaaucccucuaccgaaguggacuacuauaaauuaagguauggccccaugacuggacaggagguugcugagguuacugugccuaaaucaagcgacccuaagucuagguacgauauuacuggauugcauccgggcacugaguacaagaucacaguagugcccaugcgcggagaacuagaaggcaagccaauucugcuaaacgggaggaccgaaauagacucaccuacaaauguaguaacagauagagugacggaggacacagccacagucucaugggacccaguacaggcagugaucgauaaguaugugguucgauauacgagugcugacggcgauacaaaggagauggcuguucacaaggaugaaagcucgacugugcuaaccggucuaaaaccgggagaagcauacaagguauacguuugggcugaacggggcaaucaggggucaaaaaaagccgacacaaacgcccucacagagauugacucucccgccaacuuaguuacggauagggugacagaaaauacagccaccaucuccugggacccaguacaggcaacaauugacaaguacguugugcgauauacaucugccgacgaucaagaaacucgggagguccucgucggaaaagaacaauccucaacuguguugacaggauugcgccccggagucgaguacacggugcaugugugggcucagaagggagauagagagucuaagaaagcugauacaaacgcccccacagauauagauucgccuaaaaauuuaguuacagaccgcguuacagaaaauauggcuaccgugucuugggaucccguucaggccgcuaucgauaaauaugugguucgguauaccagcgcagggggagagacaagggaggucccuguggguaaagaacagaguucaacaguucucacggguuugcgaccagggauggaguacaugguacacgugugggcucagaagggugaucaggaaucuaagaaagccgauaccaaggcccagaccgacaucgacagcccgcaaaaccucguuacagaccgugugaccgagaauauggcgaccgugagcugggaccccgugagagcgacaauugacagauauguuguccguuacaccuccgcuaaagauggggagacucgugaagugccaguaggcaaggaacaaucguccaccgugcugacgggccucagaccuggaguagaauauaccguucacguaugggcacaaaaaggcgcccaggagagcaagaaagccgacacaaaagcacaaacagauauagacucuccacagaaccuggugacagacugggucacagaaaauacugcuacuguuucaugggacccugugcaggcaaccaucgaucguuauguuguucacuauacuucagccaacggcgaaacuagagaagucccagugggaaaagaacaaucuucaaccguuuugacuggccuucgcccagggauggaauauacugugcacgugugggcacaaaaagggaaccaggaaucgaagaaggcagacaccaaagcccaaacugaaaucgacggaccgaagaaccuugugacagacuggguaaccgagaacauggccaccgugaguugggaucccguccaagcaacaauagacaaauacauggugagauacacuagugccgacggagaaacccgcgagguccccguagguaaagaacacucuagcacuguccugacagguuugcgucccggaauggaguacaugguacacgucugggcccagaagggcgcgcaggaaucaaagaaagcagacacgaaggcucaaacagaacucgauccuccaagaaaucugcgcccaucagcugugacccaaagcggagguauucugacuuggacgccgccgucugcucaaauccacggguacauccucaccuaucaauucccagaugguacagugaaagaaaugcaacugggcagagaggaucagagauuugcgcuucaaggucuagaacagggcgccacauaccccguaucccuuguugcauucaagggaggaaggagaagccggaaugugucgacgacacuuucuaccguaggagcaagauucccacacccuucugauugcucacaaguucagcagaauucuaacgcagccuccgguuuguacacaaucuaucuccauggcgacgcgagccggccacugcagguguauugcgauauggagaccgacgggggaggcuggauugucuuccagagacgcaacacaggacaacuggauuuuuuuaaaagguggcgaaguuauguugaaggauuuggagaccccaugaaggaauucuggcucggccuagauaaguuacauaaccuuacaacuggaacacccgcccgcuaugaagugcgaguggacuuacaaacagccaacgagagcgcuuacgccaucuacgacuuuuuccagguggccagcagcaaagaacgguacaagcuuaccgugggcaaauauagagggacugccggcgacgcccuuacauaccacaacggauggaaauuuacaaccuuugacagagacaacgauaucgcacugucuaauugugcucugacacaccaugggggguggugguacaaaaauugccaccucgcgaauccuaacggccgauacggcgagaccaaacauucagagggagucaauugggagccuuggaagggccacgaauucucuauuccauaugucgaauuaaaaauccgcccacaugguuacaguagagagccuguguuaggucgaaaaaagcguacucuuaggggacgccuccggacuuuuuag

SEQ ID NO: 13510 - RNA, 1662 nt, Artificial Sequence
  Description of Artificial Sequence: Synthetic coding sequence
augacaagaggcggucccggcggucgaccuggccugccucagccucccccccuacugcugcuucuucuucucuugccgcuuuuauuagugacagccgagccacccaagccagcaggcguguauuacgcuacugcuuacuggaugccagccgaaaagacagugcaggucaagaauguuauggauaagaacggagaugcauacggcuuuuauaacaauagcguuaaaacaacaggauggggaauccuggaaauccgugcgggguacggcucucaaacccuguccaacgagauuauaauguuuguggcuggguuucuagaaggcuaucuuacagcuccucacaugaacgaccacuauacaaauuuguauccacagcucaucacaaaaccgaguauuauggacaagguccaggacuuuauggaaaagcaggauaaguggacaagaaagaacaucaaagaauacaaaacugacuccuuuuggcggcacacuggauaugugauggcucaaauugacggccucuacgugggcgcuaagaaaagagcuauucuggaagggacuaagccuaugacacuguuucagauccaauuccucaauucugugggagaucuccuggaccugauuccaagccucucccccacuaagaacgguucacugaaaguauuuaaacgaugggauaugggacauugcucagcauuaaucaaagugcuccccggauucgagaacauccucuuugcccauucuaguugguacacauacgccgcuauguugagaauuuacaaacauugggacuucaacgugaucgacaaggacacguccaguucccggcugaguuucagcagcuauccuggauucuuggagucuuuggaugacuuuuauauacugucaaguggccucauccuauugcagacuacgaacaguguuuucaauaagacccuucugaagcaaguaauuccagagacauugcuauccuggcagcgcguucgaguggcaaauaugauggccgacuccggaaaacgaugggcagacauuuucucuaaauacaacagcgggaccuacaauaaucaauauauggugcuugaccugaaaaaaguaaaauugaaccauucacucgacaagggaacacuguacaucgucgaacagauuccuacguauguggaauauagcgagcagaccgacguucugcggaaaggguacuggccgaguuacaacguuccauuccacgagaagauuuacaauugguccgguuauccuuugcuagugcaaaagcucggccucgauuacuccuaugaccucgcaccccgugcgaagaucuuuaggcgggaccaaggaaaagugaccgacaccgcuucaaugaaguauaucaugagguauaacaauuauaaaaaagaccccuauagccgcggcgauccaugcaacaccaucugcugcagagaagaccugaauaguccgaacccuagcccuggcggauguuacgauacuaagguggcagauaucuaucuggccucccaauacaccagcuacgcuauaagcggaccgaccgugcagggaggauuaccaguauucagaugggaccgguucaauaaaacgcugcaccagggaaugccugagguuuauaacuucgauuucaucacaaugaagccuauucugaaacucgacauuaaguag

SEQ ID NO: 13511 - RNA, 2271 nt, Artificial Sequence
  Description of Artificial Sequence: Synthetic coding sequence
augaguagaccugguacugcuacacccgcccuggccuuggugcucuuggcagugacguuggcagguguaggcgcacagggugccgcccucgaagacccagauuacuaugggcaagagauuuggagccgggaaccuuauuacgcaagaccagagccagaacucgaaacauuuuccccaccacugccagcggguccuggcgaagagugggagcggcgaccacaagaaccgagaccucccaaaagagccaccaaaccuaaaaaggcccccaagcgagagaagagcgcccccgaaccacccccaccagguaaacauagcaacaagaagguaaugaggacaaagaguucagagaaggcggcgaaugacgaucacuccgugagaguagcaagagaagauguuagagaaucauguccuccuuugggcuuagaaaccuugaaaaucacagauuuccaacuucacgccucaacagugaaacgguauggccuaggcgcucaccgagggaggcugaacauccaagcugggaucaacgagaacgacuucuaugauggcgcuuggugcgcggggcgcaacgaccugcagcaguggauugagguggaugcccgacgccucacacgauuuacuggagugauuacacagggucggaauucccuguggcucucugauuggguuacaaguuacaaagucauggugucuaacgacucccacaccugggugacuguuaaaaaugguagcggugauaugauauucgaagggaauagugaaaaggagaucccaguacugaaugaauugccagucccgaugguggcacgcuauauuagaaucaacccacaauccugguuugacaacggcucuauaugcaugcgaauggagauucucggaugcccccugcccgaccccaacaacuauuaucaccgacggaaugaaaugacuacaacugacgacuuggacuucaagcaccauaacuauaaagagaugagacaacugaugaaagucgucaaugaaaugugcccaaauauaacccggauuuauaacaucggaaaaucucaccaaggacuaaaacuuuacgccguagaaaucucggaccauccaggggagcacgaggugggggagcccgaauuccauuauauugcuggcgcucaugguaaugaagugcucggucgugaacuucuccuacuccuagugcaguuugucugucaggaauaucucgcccgcaaugccagaauugugcaucugguugaggagacccggauccacguccugcccagccuaaacccggacggcuaugaaaaggcauaugaaggcgguucugaacuuggaggguggucacuggggcgauggacacaugaugguauagauaucaauaacaacuuuccggauuugaauacccugcuuugggaggcggaagauagacaaaacgucccacgcaaaguuccaaaucacuacauugccauuccugaaugguucuuauccgaaaaugccacgguugcugcugaaacacgagccguuauugcuuggauggagaagauucccuuuguucuggguggcaacuuacagggaggugagcuugugguggcguacccauaugaccuagugaggucuccuuggaagacucaagagcauacacccacucccgaugaccacguauuuagauggcuggcauacucuuacgcaucuacccaccgucuuaugacugacgcaagaaggagaguuugucauacagaagauuuucagaaggaggaaggaacagucaauggagcuagcuggcacacaguggccgguucucucaacgacuuuaguuaucuucacacaaacuguuucgaacuaucuauauaugucggcugcgauaaauauccccaugaaucucagcugcccgaggagugggagaacaauagagaaagucugaucgucuuuauggagcagguccaccgcggcauuaaaggucuaguccgagacucucauggcaaaggcauuccaaacgcuauuaucagcgucgagggaauuaaucaugacauucgcacagcuaacgauggugauuauuggagguuacucaaucccggggaguacguugugaccgccaaagcugaaggguuuacugcuagcacuaagaauuguauggucggcuacgacaugggugccacaaggugugauuuuacgcucucuaagaccaacauggcgagaauuagggaaauuauggagaaauucgguaaacaaccugucagccucccagccagaagauugaaacugcgaggccagaaaagacgacagaggggauag

SEQ ID NO: 13512 - RNA, 702 nt, Artificial Sequence
  Description of Artificial Sequence: Synthetic coding sequence
auggccacccccccguuucgucuaauacgcaagauguucuccuuuaaggugagucgguggaugggccuagcuugcuucagaagucucgccgccucaagcccaucaaucagacagaagaagcucaugcauaaacugcaggaggaaaaagcuuucagagaagagaugaagauuuuccgcgagaaaauagaggacuuuagagaagaaauguggacuuucaggggcaagauucaugcauuccgagggcaaauuuuaggauuuugggaggaggagaggccauucugggaggaagagaaaacguucuggaaagaggaaaagaguuucugggaaauggaaaaaaguuuuagggaggaagaaaaaaccuucuggaagaaguaucgcacauucuggaaggaagacaaggccuuuuggaaagaagauaacgcauuaugggagagagacaggaaucuguugcaagaagacaaagcucuuugggaggaagaaaaggcacucuggguggaagaaagggcccugcuugagggagaaaaggccuuaugggaggacaaaaccaguuugugggaggaggagaaugcccugugggaagaggaaagagcuuuuuggauggagaauaacggccauaucgcaggggaacagauguuggaggacgggccacacaaugcaaaucgaggacagcggcuuuuggccuuuaguagaggaagagccuag

SEQ ID NO: 13513 - RNA, 696 nt, Artificial Sequence
  Description of Artificial Sequence: Synthetic coding sequence
augaugcugaguugcuuauuucuguugaaggcccucuuagcacugggcucuuuagaaucauggaucacugcaggugagcaugcuaaggagggagaaugcccaccacauaagaacccauguaaggaacuaugccagggagaugaacuuugccccgcugaacaaaaaugcugcacuacaggcugcggacggaucugcagagauaucccuaaaggaaggaagcgggacugcccacgaguuaucaggaaacaaaguugccuuaagagaugcaucacggaugagaccugcccaggaguaaagaaguguuguacacucggguguaacaaguccugcgugguuccaauuucuaaacagaaacucgccgaguuugguggagaaugcccagccgauccucugcccugugaagaauugugcgauggggaugcgucaugcccccagggacauaaguguugcagcacaggaugugggcggacuugcuuaggggacauagaggguggaagaggaggagauuguccuaaggugcugguggggcucugcaucgugggcugugugauggacgagaauugucaggccggcgagaaauguuguaagucugguuguggccguuucugcguuccucccgugcugccuccuaaauugacuaugaacccuaacuggacugucagaucugauuccgagcucgagauaccuguccccuag

SEQ ID NO: 13514 - RNA, 1050 nt, Artificial Sequence
  Description of Artificial Sequence: Synthetic coding sequence
augggcccgauuagcgcaccauccugcagguggcguauaccuuggcaaggccugcugcucaccgccucccuuuuuaccuuuuggaauccaccaaccaccgcccagcugacuaucgaagcaguucccucaaaugccgccgaaggaaaagaagugcuccucuugguucacaaucuaccccaggauccuagaggauacaacugguauaagggcgaaacggucgaugcgaaucgcaggaucauaggauauguuaucuccaaucaacagaucacaccagggccagccuacagcaauagagagacaaucuacccuaacgccagccuucugaugcggaaugugacaagaaacgauacuggcagcuauacauuacaagugaucaagcuaaaccugaugagugaagaagugaccggucaguuuucuguccacccagagaccccaaaaccaaguaucuccuccaauaauucuaauccuguagaggauaaagacgccguggcauuuaccugcgaacccgaaacccagaacaccaccuaccuuuggugggugaacggccaaucacugccggugagcccaagacugcagcugaguaaugguaaccggacgcugacacuuuuaucuguuacucgcaaugauguuggcccuuacgaaugcgagauccagaaucccgccuccgccaauuuuuccgauccugucacacugaauguccuguacggcccggacgcccccacaaucucuccuagugauacuuauuaccaugccggugucaaccuaaaccuaucuugccaugcagccucuaacccccccucccaauacucaugguccgugaauggcacauuccaacaguacacucagaagcucuucauuccuaauauuaccacaaagaacagugguuccuaugcaugccacaccacgaacagugcaacaggacgaaauagaacaacugugagaaugauaacagucuccgaugcguuaguccaaggaucaucacccggacugucugcucgugccaccguuucgaucaugauugggguguuggcaagaguagcguugauuuag

SEQ ID NO: 13515 - RNA, 510 nt, Artificial Sequence
  Description of Artificial Sequence: Synthetic coding sequence
augaccgcaggaaggcgaauggagaugcucugcgccggaagggugcccgcauugcuucuuugccugggcuuccaccuucuccaagccguucuaaguaccacgguuauccccucauguaucccgggcgagucuuccgauaacuguacugcuuuggugcagaccgaagauaaucccagagucgcgcaggugucaaucacuaaauguagcuccgauaugaauggcuauuguuugcacggccaguguauuuaccuaguggacaugagucagaauuacuguagaugcgaagugggcuauaccgggguuaggugugagcacuuuuuccugaccguccaccaaccacugucuaaggaguaugucgcuuuaaccguuauucucauaauacuguuccucauaaccguggucggcucuacauauuauuuuugccggugguacagaaauaggaaguccaaagagccaaaaaaagaauacgaacgagucacaaguggugauccagagcugccccaaguguag

SEQ ID NO: 13516 - RNA, 273 nt, Artificial Sequence; identical to SEQ ID NO: 11877
  Description of Artificial Sequence: Synthetic coding sequence

SEQ ID NO: 13517 - RNA, 429 nt, Artificial Sequence
  Description of Artificial Sequence: Synthetic coding sequence
augccccgcuguagauggcucucccucauccugcucacaauuccccuggcuuuaguggcgagaaaggacccaaagaaaaacgagaccggcgugcucagaaaacugaaaccagugaaugcaucaaacgccaacgucaaacaaugccucugguucgccaugcaggaauauaauaaggaaagcgaagacaaguauguuuucuugguugugaagacuuuacaagcccagcuucaggugaccaauuuguuagaauacuugauagacguggagauagcuagaucagacuguagaaaaccucuuucuacaaacgaaauaugcgcuauucaggagaacuccaaguuaaagcggaaauuaucuuguucuuuccuugucggagcacuaccauggaacggagaguucacugugauggagaagaaaugugaggacgccuag

SEQ ID NO: 13518 - RNA, 438 nt, Artificial Sequence
  Description of Artificial Sequence: Synthetic coding sequence
auggguaucggcugcuggcgaaacccuuuguugcugcuuaucgcccucguccucucugcuaaguuaggccauuuucaacggugggagggcuuucaacaaaagcuaaugagcaagaaaaacaugaauaguacacucaauuuuuuuauucagagcuauaauaacgcauccaaugauacauaccuguaccgugugcagcgccuuauccgcagccagaugcaguuaacuacuggaguagaauauauuguaacggucaaaauuggauggacuaagugcaaacgaaaugauacuucuaauuccucauguccacugcaaucgaagaagcuuagaaagucccugaucugcgaaagccucaucuacaccaugccauggaucaauuauuuucaacucuggaauaacagcugcuuggaagccgaacauguugguagaaaucuccgguag

SEQ ID NO: 13519 - RNA, 552 nt, Artificial Sequence
  Description of Artificial Sequence: Synthetic coding sequence
augaagcugcuguuccccaucuucgcaagucuuaugcugcaauaucaagugaacacugaauuuaucggacugagacgaugccuuaugggucucggaaggugucgagaccacugcaaugucgacgaaaaggagauucagaaaugcaaaaugaagaaaugcuguguaggccccaaggucgugaagcucauuaaaaacuaucuccaguauggaacccccaauguauugaaugaagacgugcaagaaauguugaaaccugcaaagaacucaucugcugugauucaacguaaacacauuuuauccguguugccucagaucaaaucaacgaguuuuuuugcaaacaccaauuucgucaucauccccaacgccaccccaaugaauuccgccacgaucaguacuaugacacccggacagaucacuuauacggcuacuagcaccaaaagcaauacuaaggagagcagagacuccgcaaccgccaguccaccaccugccccgcccccaccuaacauucugcccacaccaucacuugagcuugaggaagccgaagagcaauag

SEQ ID NO: 13520 - RNA, 609 nt, Artificial Sequence
  Description of Artificial Sequence: Synthetic coding sequence
augagaggucacccaucuuugcugcuucuguauauggcgcucacaacuugcuuggauacuuccccuucagaggagaccgaucaggaggucuuuuugggacccccagaggcacagucauuccugucaucucacacacgcauaccucgcgcaaaccacugggaccucgaacugcugaccccggggaaccuggaacgagaaugcuuagaggaacgguguucuugggaagaggccagggaauacuucgaagacaacacgcucaccgaaagauuuugggaaucuuacauuuauaacgggaaaggagggagaggacgcguggauguggcaucuuuggcagucggccuuacaggcgguauccuucuuaucgugcuugccggccuuggggcauucugguaucuccguuggagacagcaucgcggacaacagccuugcccacaggaagcuggccuaaucucucccuugucuccccuuaacccacugggccccccgaccccucuuccaccuccaccacccccgccacccgggcuaccuacauaugagcaggcccuagcugcaucaggcgugcaugacgcuccaccgccccccuauacuagccugagaagaccacacuag

SEQ ID NO: 13521 - RNA, 558 nt, Artificial Sequence
  Description of Artificial Sequence: Synthetic coding sequence
augagacuuuugauacugaccugccucguugcaguugcacuggcucguccuaagcucccucuccgcuacccugaacggcuccagaauccauccgaaaguuccgaacccaucccacuggaaagcagggaggaauauaugaauggcaugaauagacagagaaacaucuugagggagaagcagacagacgagaucaaggauaccagaaaugaguccacccagaacugugugguggcugagccugagaaaauggaaagcagcauaagcucuucguccgaggaaaugagucuaagcaaaugcgcugaacaguucuguagacugaacgaguacaaucagcugcagcuccaggccgcacacgcccaagaacagaucaggcgcaugaaugagaacucacacguccaaguucccuuucagcaacucaaccaguuggcagcuuauccguacgcaguaugguauuauccacagaucaugcaauacguuccauuccccccauucagcgacauuaguaacccgacugcccacgaaaauuaugagaagaauaaugugaugcuucagugguag

SEQ ID NO: 13522 - RNA, 1410 nt, Artificial Sequence
  Description of Artificial Sequence: Synthetic coding sequence
augaucacugagggcgcacaggcuccccgucuuuuguuaccgccccucuugcuacugcugacacugccugccacuggcucagauccuguucucugcuucacccaguacgaagagagcagcggaaaauguaaagggcuccucggcgggggaguuaguguggaagauugcugccucaauacggcauuugcuuaucaaaagcguucagguggucuaugccagcccugccgcucuccucgcuggucgcuguggucuaccugggcuccuuguagcgugacguguucagaaggaagucaacuucgcuauagaagaugcgucggauggaacggacaguguucgggaaaggucgcaccggggacacucgaguggcagcugcaggcuugcgaggaccaacagugcugucccgagauggguggcuggucgggauggggaccaugggaaccaugcaguguuaccuguuccaaagggacccggacucgacggagggccugcaaccaccccgccccuaaguguggagggcauugccccggucaagcccaagagucagaagcuugcgacacccagcaagugugccccacccauggcgccugggcuacuuggggcccguggacacccuguagugcgagcugccacgguggcccucacgaaccuaaggaaaccaggagcaggaagugcagcgccccugagccaucccagaaaccgccuggcaaaccgugucccggcuuagcuuacgaacagcgaaggugcaccggucucccacccuguccuguggcuggaggguggggucccuggggaccagucucacccugcccuguaaccugcggucuaggacaaaccauggaacaaaggacgugcaaucacccgguaccccagcacggaggcccauucugcgccggcgaugcuacuaggacccauaucugcaacaccgcggugccuugccccguagauggcgagugggacucuuggggcgaguggucaccuugcauucggcgaaauaugaaaucuauuuccugucaggagauaccaggacagcagagcaggggaagaacaugcagaggaagaaaauucgauggccauagaugcgcuggccagcagcaggauaucagacacuguuauuccauccagcacuguccucuuaaagguaguuggagcgaauggagcacguggggacuauguaugcccccuuguggcccgaacccaacacgagcaagacagcggcuauguaccccccugcugcccaaguacccuccaacagucuccauggucgaaggacagggcgagaaaaacgugaccuuuuggggccggccacucccccggugcgaggaauuacaagggcagaaguuggucguggaggaaaagagaccaugucugcacgugcccgcuuguaaggacccagaagaggaagaauuauag

SEQ ID NO: 13523 - RNA, 453 nt, Artificial Sequence
  Description of Artificial Sequence: Synthetic coding sequence
augcuaaucgcuaccucuuucuuucucuucuucaguagugucgucgcagcaccuacucacucuagcuuuuggcaguuucaacgcagaguuaagcauaucaccgggagauccgcuuuuuuuucuuacuacggcuacggcugcuacugcggguugggagauaaggguauccccguggacgauacagacucccccagcucuccaucucccuacgaaaaacugaaggaauuuucaugccagcccguacucaauaguuaucaguuucacaucgucaacggagcugugguguguggcuguacacugggccccggcgccucaugucauugucguuugaaggccugcgagugcgacaaacagucugugcacuguuuuaaggagucccucccaacauacgagaagaauuucaaacaguucucuagccaaccccgaugcggacggcauaaacccugguguuag

SEQ ID NO: 13524 - RNA, 1347 nt, Artificial Sequence
  Description of Artificial Sequence: Synthetic coding sequence
augcgagaaugcauaucuguccacgucgggcaggccggugugcagauggggaacgcuugcugggaguuauacugucuggagcacgguauacaaccggauggucagaugccgucugacaagacaaucggagggggcgacgauaguuucacuacuuucuuuugcgagaccggagcgggaaaacauguaccgagggcgguguucguugaccucgaaccuaccguuauugacgagauuagaaauggaccauauagacaguuguuccauccagagcaguuaauuacagguaaagaagacgcugccaacaauuacgccagaggccauuacacaaucggcaaagagauuaucgacccuguguuggaccgcauccggaagcuuucagaccaguguacaggccuccagggauucuuggucuuccacagcuuuggcggcgggacuggcaguggcuucacaucacuucuaauggaaagacucuccgucgacuacgguaaaaaaagcaaguuagaauucucuauauauccagcaccccaggugagcaccgccguuguagagccauacaacagcauuuuaacuacacauacaacacuugagcauucagauugcgcuuuuaugguugauaaugaagcuauuuacgacauuuguaggcgaaaccuugacauagaaagaccaaccuauacaaaccucaaccgacucauuucucagaucguguccucaaucaccgccucccugcgcuuugacggcgcgcuaaacguggauuugacagaauuccaaacgaaccugguuccauacccucgcauccauuuuccgcuggccacuuaugcgccgguaauaucagcagaaaaggccuaccacgagcagcuguccguugcagagaucacaaacgccuguuuugaaccagcgaaucagauggugaaaugcgaucccagacauggaaaauacauggccuguugcuugcuuuacaggggugauguugucccaaaagacgugaacgcugcaauagccgcaauaaaaacuaaacggagcauucaguuuguugacuggugucccaccgguuucaagguaggcauuaacuaccagccaccaaccguugugcccggaggggaccuggcaaaaguccagagagccguauguaugcuuucgaacaccacagccaucgcugaagcgugggcaaggcuagaucacaaguuugaccugauguacgccaaaagggcauuugugcauugguaugugggagaagguauggaagagggcgaauuuagugaggccagggaagacauggcagcacucgagaaagauuacgaagaggugggcaucgacucguaugaagacgaagacgagggggaggaauag

SEQ ID NO: 13525 - RNA, 942 nt, Artificial Sequence
  Description of Artificial Sequence: Synthetic coding sequence
augagagucgugaccauugugauccugcuuuguuucuguaaagccgcggagcugcgcaaagcuaguccaggaucugugaggagccgggugaaucacggccgugcuggaggaggaaggagaggcuccaauccugucaaacgcuaugcucccgggcugccgugcgacgucuauacauaucuccacgaaaaauaucuugauugccaagagcggaaauugguuuacguucugccaggcuggccacaggacuuacugcacaugcugcuugcacgaaauaaaauacgaacauuaaaaaacaacauguuuucaaaguuuaagaagcucaaaucccuggaccuacaacagaacgagauuuccaaaauugagagugaagccuuuuuuggguuaaacaagcugacuacccuacugcugcagcacaaccaaauuaagguccucaccgaagagguguuuaucuauacucccuugcuaucauacuuaaggcucuaugacaaccccuggcauuguaccugugaaauagaaacacugauuucuaugcugcagaucccucgaaaccggaaucuggguaacuaugcgaaaugcgagucuccccaggaacaaaaaaacaagaaacuccgucagaucaaguccgagcagcuguguaacgaagaggagaaggagcagcuggaucccaagccucagguuagugggcggccccccguuauuaagccagaaguggauucaacauucugccauaauuauguauuucccauccaaacccuagauuguaaaagaaaagaacucaaaaaagucccgaacaacauuccaccagacaucguaaaacuggaccugaguuacaacaaaaucaaccaauugcggccgaaggaguucgaagauguucaugaacucaaaaagcugaaucucagcucgaauggaauugaauuuauagacccuggaucguugagauag

SEQ ID NO: 13526 - RNA, 972 nt, Artificial Sequence
  Description of Artificial Sequence: Synthetic coding sequence
augcaggcagcuugguuacuaggcgcgcuggugguaccucaacuccugggguucggccacggggcucggggagcugaaagggagugggagggaggaugggggggugcgcaggaggaggaacgggagagggaagcauugauguugaaacaccuccaggaggcccugggauuaccagccggccgcggagacgagaacccggcaggaacggucgagggaaaagaggauugggaaauggaggaagaccagggggaagaggaggaggaggaggcuacaccaacacccagcucaggaccaagucccucccccaccccugaggauauugugaccuacauucugggcagacuggcaggucuggaugccggccuccaucaguuacacguuagauuacacgcauuggauacgcgggugguugagcuaacccaggguuugcgccagcuucggaacgccgcuggggacacucgugaugcaguccaggcucuacaggaggcacagggcagggccgaacgggagcauggcagacuagagggcugucucaaaggacuucggcugggccacaaaugcuuccugcuuaguagagacuucgaagcccaagccgccgcucaggcgcgcuguacagcucgcggugggucacuggcgcagcccgccgaucggcagcagauggaggcuuugacccgcuacuuacgggcugcucucgccccauauaauuggccugucugguuaggcgugcaugauaggcgagccgagggauuguaccuuuuugagaauggacagcgugucucuuuuuuugcauggcauaggucccccaggccugagcucggagcucaaccuagcgcgucuccccauccccucagucccgaucaacccaacggggguacacucgaaaacuguguugcccaagcuagcgacgacgguucguggugggaucaugauugccaacgccgacuuuacuauguaugcgaauuuccauucuag

SEQ ID NO: 13527 - RNA, 1086 nt, Artificial Sequence
  Description of Artificial Sequence: Synthetic coding sequence
augaauggacugagccugagcgagcuguguugucucuuuugcuguccaccauguccaggaagaauugccgcgaagcuggcauuccugccaccagaggccaccuacagcuuggugccagaaccagagcccggaccgggcggagccggagcagccccccuuggaacuuugcgcgccucuucuggagccccaggaagguggaaauuacaccucacggagcgggccgauuuucaguauucucaacgggaguuggacacgauugaaguuuucccuaccaagucugcccgagguaaccguguaucuuguauguacguucgaugcgugccgggggcacgacagggucaccaggcucagggaggccacccacaacuggccugggugggcagacuuggcgauucaaacaauccggccccuggugguugucugcucgggaaaagcugggggacgggcgcugcacuagccugcggguauauccaucuucucgcuagauacacugugcuguucucucaugguaacgcuguagaucugggacagaugucuagcuucuauaucggacuuggcucaagacugcacuguaauaucuucagcuaugacuauaguggcuacggugcaucuagcggccgcccauccgagcgaaaucuuuacgcagauaucgacgcagccuggcaggcacugcgcacaagauaugggauuucccccgauucuauuauuuuauacggucagagcauuggcaccguuccaaccguggaccuggcgagcagauaugagugugccgcugugguacuucacuccccucucacaucugguaugagaguagcuuucccggacaccaagaaaaccuauuguuucgaugccuuuccuaauauagagaaagucucaaaaauuacaaguccagugcugauuauucacggcacagaagaugaggucauagacuuuucucauggucuagccuuguaugagagaugcccuaaggccgucgagccucuauggguggaaggugccggucauaaugacaucgaauuguauucucaauaucuugaacgucugcgcagguuuaucucccaggaacugccaucucagagggcauag

SEQ ID NO: 13528 - RNA, 1404 nt, Artificial Sequence
  Description of Artificial Sequence: Synthetic coding sequence
augaggaccgcuccaucucuuagacguugugugugucugcugcuggcugcuauccuugaccucgcccgggguuaccucacuguuaacauagagccucugccuccugugguggccggagacgcugugacauuaaaauguaauuuuaaaaccgacgggaggaugagggaaaucguuugguaucgagucaccgacgggggaacaaucaagcaaaagauauucaccuucgacgccauguucucuacaaacuacucacauauggaaaauuacaggaagcgagaagaccuuguguaucagucaaccgucagauugccugaagugcgaaucuccgacaaugggcccuaugaaugucaugucggaaucuacgauagagcgacccgcgaaaaagucgugcucgcuucagggaauauauuccuaaauguaauggcgcccccgacauccauugaagugguagccgcagacacccccgcaccauucuccagauaccaagcucaaaacuucacacuagucugcauugugucuggagguaagcccgcacccauggucuauuucaagcgugauggcgaacccaucgacgcugucccucucagcgagcccccugccgcaagcucuggaccgcuucaggauucccggccguuucgaucccuacugcaccgcgaucuugacgacacaaaaaugcagaagucacugagccuacuugaugcagaaaaccgugguggcagaccuuacacagagcguccaagcaggggacuuacucccgauccuaauauucuccuacagccaacaacagagaauauccccgaaacuguggugagccgcgaauuuccaaggugggugcauucggcagaaccaacuuauuuucuucgacacucccggacacccagcuccgacggcaccguugaggucagagcccuccugacauggacauuaaauccacaaauugacaaugaagcacuuuucucaugugagguuaaacacccugcacugagcaugccuaugcaagccgagguuacucuuguugcaccaaagggcccaaagauaguuaugacucccagucgcgcccggguuggggacacugugcggauucuaguccauggauuccagaacgaaguauucccugagccuauguuuacuuggacuagaguagggucucgccugcuggauggaagugccgaauuugauggaaaggagcucguacuggaaagagugccggcugaacucaauggcuccauguaucguugcaccgcccagaacccccuaggcaguacggacacccacacccguuugauagucuuugagaaccccaauauuccacgagguacagaagauucaaacggauccauaggcccaacgggagcaagacuuacccuggugcuggcauuaacuguuauccuugaauugaccuag

SEQ ID NO: 13529 - RNA, 783 nt, Artificial Sequence
  Description of Artificial Sequence: Synthetic coding sequence
auggcgagaccuggaauggaacgguggagagaccggcuggcccuugugacgggagcgagcgggggcauaggugccgccguggcccgcgcuuugguucaacagggccucaaagugguugguugugcucguacuguugggaauaucgaggagcuagcugcugaauguaaaucugccggauacccugguacacucauccccuacagaugugaccuuucuaacgaggaagacauacuaagcauguucucugcaauacgaucucaacauucuggaguugacauauguauuaauaacgcuggucucgcccggccugauacacugcucucuggaucuacuagcggauggaaagacauguucaacgugaacguccuggcucuuucaauuugcacacgggaagccuaccaguccaugaaagaacggaacguggacgacgggcauaucaucaauauuaacagcaugucuggacaucgggugcugccucuuagcgugacccauuuuuauagcgccacuaaguaugccgugacugcccucaccgaaggccugagacaggaacuccgcgaagcccaaacccacauccgcgcaacuugcauuagcccuggagugguagagacacaguucgcuuucaaacuucaugacaaggauccugaaaaagccgccgccacauacgaacaaaugaaaugccugaagcccgaagauguagcagaggcaguuauuuacgugcuuucgacccccgcucauauccagauuggggauauucagaugagaccuaccgagcagguuaccuag

SEQ ID NO: 13530 - RNA, 1218 nt, Artificial Sequence
  Description of Artificial Sequence: Synthetic coding sequence
augaguagccccgcauuaacagccggugcaucaggcaaggugauggauuucaauaaugguacuuaccuuguuuccuucacacucuuuugggaaggacaggugucacucagccuccugcucauccacccuucggagggagccagugccuuguggagggcccggaaccaaggguacgacaagaucauauucaaggguaaguucguuaacgguaccucacacguuuuuacugaaugcggccucacuuugaacaguaaugcagagcuuugcgaauaccuggaugauagagaucaagaagcuuuuuacuguaugaaaccccagcacaugccaugugaagcuuugacauauaugaccacacgcaacagagaaguuuccuaccuaacagauaaagagaacagccuguuucacagaucaaaaguugguguugaaaugaugaaagacagaaagcauauagauguaaccaauugcaacaaacgagagaagaucgaggaaacuugucaggucggaaugaaaccaccugugccaggagguuacacccugcaaggaaaauggaucaccaccuucugcaaucagguccagcucgacacaauaaagauaaauggcugucuaaaggggaaacuuaucuaccugcugggugacucaacacugcgacaauggaucuacuacuucccaaaagugguuaagacccucaaauucuucgaccuccacgagacgggcauuuuuaaaaagcauuugcuucuggacgcagaaaggcacacccagauccaauggaagaagcacagcuacccuuucguaacauuucaguuauacuccuugauagaucacgacuacauuccccgggaaaucgaucgccuaucuggagacaaaaacacugcgauugucauuacuuuuggccagcacuuuaggccuuucccuauugacauuuucauucgccgcgcuauuggggugcagaaagcaauugagcgguuauuccugaggucacccgcaacuaaaguaauuauuaaaacagagaacauucgagaaaugcacauagaaacugaaagguuuggggacuuccauggguacauucacuaucugaucaugaaggacaucuuuaaggauuuaaacgucgggauuauagacgccugggauaugacuaucgcuuaugguacggacaccauucauccucccgaccacguuauuggcaaccagauaaauauguuucugaauuacaucugcuag

SEQ ID NO: 13531 - RNA, 597 nt, Artificial Sequence
  Description of Artificial Sequence: Synthetic coding sequence
augcccguaccugccuuaugucuccugugggcacucgcuaugguuacucgcccagcaucagccgcgccgaugggcggcccagaauuggcccagcacgaggaacugacgcugcuuuuucacggaacacugcagcucggccaagcucuuaauggcguguaucggacuacagaaggcagacucacaaaggcacgaaauucucucggacucuacggcagaacuauugagcuacucggccaggaggugagcaggggacgagacgccgcccaagagcugcgcgcaagccuccuugaaacacagauggaggaggauauccugcagcuacaagcagaagccaccgccgaggucuuaggugaagucgcacaggcccaaaaggugcucagagauaguguccaacggcuagaggugcagcugcggagugccuggcugggcccagccuauagggaauucgaagucuuaaaggcucacgcugacaagcagucacauauauugugggcucugacaggccacgugcagagacagaggagggagaugguagcucaacagcaucgguugcgacagauucaggaacgacuucauacagcggcccuccccgcguag

SEQ ID NO: 13532 - RNA, 1455 nt, Artificial Sequence
  Description of Artificial Sequence: Synthetic coding sequence
auggccgguccauggacauuuacccugcugugcggucuguuagcagcuacccugauacaggcgacauuaucucccacagcuguauuaauucugggcccuaaggugauuaaggagaagcugacucaagagcugaaggaccauaacgcuacgucgauucuccagcagcuuccacuucuaagcgccaugcgagaaaaacccgccggaggcaucccugucuuaggaaguuuagucaacaccguguugaagcauaucaucuggcugaaagucauuaccgcaaauauccugcaguuacaggugaagcccagcgcgaacgaucaggagcuguuagucaaaauaccccuggacaugguggccggcuucaauacaccucucgugaagacaauuguggaguuucauaugaccacugaggcccaggcuacgauuaggauggauacaucugcuaguggacccacacggcucguacuguccgacugcgcaaccagccauggaagucugcgaauucaacuuuugcauaaacuguccuuucucgucaacgcucuggccaaacaagucaugaauuuacucgugcccagccuccccaaccucgucaagaaccagcucugccccgugauagaggcuucuuucaacgguauguacgcugaucugcuucaacuggucaagguccccauaucacuuucaauagacaggcuggaguuugacuuacuguaccccgcuauuaaaggcgacacuauucaacuuuaucuuggcgcuaaacuucuggauucccaagggaaggugacuaagugguucaacaacucugcagcaucucucaccaugccaacacucgauaauaucccuuuuucucucaucgugucucaagacgucguuaaagcagcagucgccgccguguugucacccgaagaauuuaugguacuguuagacucaguacuucccgagucagcucacaggcugaaaaguaguauuggcuugaucaaugaaaaggcugcagauaaguugggcucaacccagauaguaaaaaucuugacacaagacacaccagaauuuuucaucgaccagggucacgccaagguagcucaacugaucgugcucgaaguuuuuccuucuuccgaagcucugcguccucuuuuuacacuagggaucgaggcuucuucagaagcucaguuuuacacgaaaggcgaccagcugauccugaaucucaauaauauuucaucagauaggauacagcuuaugaauucugggauaggaugguuucaaccagauguucuuaaaaacauaauaaccgagauuauacauucaauccugcuccccaaucaaaacggcaagcuaaggucaggggugccaguuaguuuagucaaagcauugggauuugaggcagcagaaagcucucugaccaaagacgcccuggugcuaacaccugccagccuguggaagcccucgagcccaguaagucaguag

SEQ ID NO: 13533 - RNA, 750 nt, Artificial Sequence
  Description of Artificial Sequence: Synthetic coding sequence
augcuucaguuauggaaauuaguguuacucugcggaguccugaccggaaccuccgagagucuccucgauaaucuuggcaaugaucuuucgaacguggucgacaaacuugaaccagucuugcacgaaggccuggagaccguagauaauaccuugaagggaauucuggagaagcugaaaguagaucuaggaguucuccagaaauccagcgccuggcaauuagcgaagcaaaaagcucaggaagccgaaaagcugcucaacaacgugauuucaaagcuguugcccaccaauacagacaucuuuggccucaaaaucucuaacagccuaauucuggacgugaaagcagaaccuaucgaugacgguaaaggauugaaucucucauucccagucacagcgaacgucaccguagccggaccuauuauuggccagauuauuaaccuuaaagcgagcuuagauuugcugacagccguuacuauagagacggacccacagacucaucaaccaguagccguuuugggagaaugugccuccgacccuaccucaauuagucuaucgcucuuggacaaacauucucagaucaucaacaaguuugucaauuccgugaucaauacucuaaagagcacuguuaguagccuccuccagaaggaaaucuguccucuuauccggauuuuuauacauaguuuagacguuaacgugauacagcagguggucgacaacccucaacauaaaacacaacuccagacccucauauag

SEQ ID NO: 13534 - RNA, 1959 nt, Artificial Sequence
  Description of Artificial Sequence: Synthetic coding sequence
augcaaggcccucuucuucuuccuggacuguguuuccugcucucucuguuuggcgcgguaacccaaaaaacuaaaacaucaugugccaagugcccuccgaacgcuuccugcguaaauaauacacacuguacaugcaaccacgguuauacuagcgguagcggccagaaacuuuuuaccuucccacucgagacuuguaaugacauuaaugagugcaccccgccauauucggucuauugcgguuucaacgcugugugcuauaauguggaagguucuuuuuauugccagugugugccagguuaccgccuccacuccggaaaugagcaguucucuaacucaaacgaaaauaccugccaggacaccacaaguucuaagacaacugaggggcgcaaggaauugcagaagauugucgauaaauucgaaucacuacucaccaaucagacacuuuggcgaacagaggggcggcaagaaauaagcaguacagccacuacaauccugcgcgacgucgaaucaaagguccucgagacggcucucaaagacccugagcagaaggugcuuaaaauccaaaacgauagcguggcaauugagacccaggcaauaaccgacaauuguagcgaggaacguaagacuuuuaaccuuaaugugcaaaugaacucaauggauauucgguguucugauaucauacagggugacacccaaggaccauccgccaucgcauucauaagcuacuccucucuggggaauaucaucaaugcaacauucuucgaagagauggauaagaaagaccaaguuuaucucaauucccaggugguaagugcagcuauuggccccaaaaggaauguuucuuuaucuaaaucggugacacuuacauuucaacacgugaagaugacgccuagcaccaaaaagguguucugugucuauuggaaaaguaccggccaggggucccaauggucacgcgacggauguuuccugauccacguuaacaaaucccacacaauguguaacuguagccaccugucgagcuucgcaguccuuauggcacugaccucccaagaggaagaucccguucucacugucaucaccuauguugggcugagcgucucucugcugugccuccuguuggcggcucugacuuuuuugcugugcaaagcuauccgcaauacguccacaucccuccaucugcaacugucacucugccuuuuccuugcucaccuuuuauuucugguagggauugaccgcacugaaccuaaaguccuuugcagcaucauugcuggagcccugcacuauuuguauuuagcggcauucacuuggaugcuucucgaggggguacacuuauuucucaccgcccgcaaucugacuguugugaauuauucuuccaucaaucggcuuaugaaguggauaauguuuccagucgguuacggugugccugcuguaaccguagccauuucugccgcuaguuggccacaccucuacggaaccgcagacagauguuggcugcaccuggaucagggguucauguggucauuucugggaccugucugugcgaucuuuucugcuaaccuaguccuguuuauucugguuuucuggauccucaaaaggaaacuguccagccucaauuccgaggucaguacaauucaaaauacaagaaugcuugcauuuaaggcaaccgcacagcuguuuauuuuaggauguacuuggugccuuggauugcuucaagucggcccagcagcacaggugauggccuaccuguuuaccaucauuaacagccuucaagguuucuucauuuucuuaguuuauugucuccuuagccaacaggugcaaaagcaguaccagaagugguuccgagagauaguaaagagcaaaucagaauccgagacauauacgcucaguucuaagauggguccugauucaaaacccucagaaggugauguauuuccugggcaggucaaaagaaaauauuag

SEQ ID NO: 13535 - RNA, 1263 nt, Artificial Sequence
  Description of Artificial Sequence: Synthetic coding sequence
auguccccacccccacuucuccagccauuacugcuguuacuuccgcuccuuaauguggaacccagcggcgccacccugauucgaauuccacugcaccgcguucagcccggccgccgcauucuuaaccugcuaaggggcuggcgggaaccagcugagcucccaaaacuuggcgccccuucuccuggcgauaaaccgaucuucguuccauugagcaacuacagagacgugcaguauuucggcgaaauuggacucgggacgccgccccagaacuucaccguagccuucgauaccggaucguccaauuugugggucccuucuagacguugucauuucuucagugucccauguuggcuccaucacagauucgacccuaaggcgagcucaucauuccaggcaaauggaaccaaauuugcuauacaauacggcacaggcagaguggaugguaucuugucagaagauaaacuuacaauuggggguauaaagggcgccagugucauuuucggcgaagcucuaugggagccuaguuuaguguuugccuuugcucacuucgacgguauucucggcuuggguuuuccgauccugagcguggaaggcgugaggccccccauggauguucuuguggagcaaggguugcuggauaagcccguauuuuccuuuuaccucaaucgagauccugaggagccugacgggggcgagcuugugcugggaggaucugauccugcccauuauauucccccucuuacauucgugcccgugacaguccccgccuauuggcaaauccauauggagcgggucaaagucggaccagggcugacacuuugcgccaaggguugcgcugcuauacucgacacuggaaccucacucauuacuggacccaccgaagaaaucagagcccuacaugcagcuauugguggaauaccccuccuugccggagaauauauuauccuuugcucugaaaucccaaaguuacccgcagugucuuuccucuugggcggggugugguucaaccuuacugcacaugauuacgugauccagacaaccaggaauggcguaagauuaugccugagugguuuucaagcccuggauguaccucccccugccggaccauuuuggauucucggcgacguguuccuuggcaccuacguagcaguuuuugaccggggagauaugaaaaguucugcacgcguaggucuggcucgggcaaggacgagaggugcggaccuuggauggggugaaacagcacaagcucaauuuccaggauag

SEQ ID NO: 13536 - RNA, 1293 nt, Artificial Sequence
  Description of Artificial Sequence: Synthetic coding sequence
auggcauggaccuucgagugcucacgcaccacaucaccugagccuuuaagcacaucuccaugcagaaccacaucuagcaggaacucaccuacaaugucuuguccagcaucuguggcaugcgagccuagcacaucuacuaccaccucgagcccucccaaguuaucagucgcaccccaauuucucccucguucucugagagucgcugacuuagccgcaaaccaagugauggaaaucuuccccuuaaccuucggugaaaagcccgcccugaggucagucuacuugcauaauaaucagcuuuccaacgccggucuaccccccgacgccuucagaggcuccgaagcaauugccacuuugagucucucaaauaaccagcugagcuacuuaccaccuucacuacccccuucacuugaacggcuucaucugcagaauaaucugauuuccaaagugccccgcggugcacucucuagacagacacagcugagagaacuauaccugcagcacaaucagcugaccgacagcgggcuggaugcaacgacuuuuucuaaguuacacagccuugaguaccuggaucuuucucacaaucagcuaacaacggugcccgcagggcugccccgaacacuugcuauucuacacuugggacguaaucggauccggcaagucgaggccgccagacuccacggggcccgggggcugcgauaucucuuacuccaacacaaccaacuugguucaaguggccuucccgcuggcgcccugcguccucuucgcggacuccacacacugcaccuguacggcaacgggcucgaccgagucccccccgcgcugccccgucgacuaagagcauugguacugccacacaaccacguugcugcccuaggcgcucgggaccucguggccacccccggccucacagaauugaaucucgcuuacaaucgccuggcauccgcccgcguacaccaccgcgccuuucgacgucuaagagcccugcgaucccucgaucuugccggcaaccagcuuacccgauugcccaugggguuacccacaggauuacguacacuucagcuucaaagaaaccaauuaaggaugcuugagccagaaccuuuggcuggauuggaccagcucagagagcugagccuugcgcauaaucgccuucgcgugggggauauaggaccuggcacuuggcaugaguugcaggcccugcagguacgccaucgacuugucucccauacagucccuagggccccucccagccccugccugccaugccacguuccaaacauuuuagucuccugguag

SEQ ID NO: 13537 - RNA, 3162 nt, Artificial Sequence
  Description of Artificial Sequence: Synthetic coding sequence
auguggcagccccgcagaccuuggccgcgcguuccauggcggugggcucuggcccuccucgcacuggucggcgccggacugugucaugccgggccucagccaggcuauccugcgaggccuucagcacgaaacaaaaacuggugcgccuauaucgugaacaaaaacgugagcuguagcguccuugaagguucggagucauuuauccaagcucaauacaacugcgccuggaaccaaaugcccugucccucagcucuuguauacagagugaauuuucgccccagauaugugacuagguauaagacugugacccagcucgaauggagauguugucccggcuuccguggaggugauugucaggaaggaccaaaagauccugucaaaacgcuccggccaacccccgcacgcccucgcaauagucugaagaaagcaacagauaaugaaccgagccaguucucagaaccaaggaagaccuugucucccacuggaacagcucagccgucauggggaguugacccaaaggagggcccucaagaacugcaggaaaagaaaauucaagugcucgaagaaaagguuuuaaggcucacccgcacaguucuggaccuacaguccucccuugccggggucagugaaaaccucaaacacgccacccaggaugaugccagucgcacucgugcgccuggucucagcucucaacaucccaaaccagacacaacugugaguggcgacacagagacaggacaaagccccggaguguuuaauacuaaggaaucgggaaugaaggacauuaaaagcgaacuggccgaagugaaggauacccugaagaauaagagcgacaagcuugaagaauuagacggaaaggucaagggcuacgagggacaguuaagacagcuacaagaagccgcucagggaccgacugugaccaugaccacuaacgaacuauaucaggcauauguggacucuaaaauugacgcacuccgggaagaacuuauggaaggaauggauagaaagcuggccgaucuuaagaacucuugcgaguauaaguuaacaggucugcaacaacaaugcgaugacuacggauccagcuaucugggcguuauugaacuaaucggggagaaagaaaccagccugcgaaaagaaauuaauaaccugcgcgcccgacugcaagagccaagcgcccaggccaauuguugcgacagugaaaagaacggcgauauuggccagcagauaaagacucuagaccaaaagauagagaggguugcagaagccaccagaaugcucaauggaagguuagacaacgaauuugaccgccuaauaguacccgagccugacguggacuucgaugcaaaguggaaugagcuugaugcucgcauuaacgugaccgaaaaaaacgcagaggagcacugcuuuuauauagaggagacacucagaggugcaaucaauggagaggugggggaccugaaacagcuuguugaucagaaaauccagucccuggaggauagacucggcucaguucuucugcagaugacaaacaauacaggcgcagaguuguccccucccggugccgcagcgcugccggggguaaguggcuccggagaugaacgcguaaugauggagcuuaaucacuuaaaagauaaggugcaggugguugaagauaucugccuacuuaauauccagggcaaaccgcacggaauggaaggagcacugccaaacagagaggaccgugcggugcgggacuccuuacaccugcugaaaagccuuaaugauacgaugcacagaaaguuccaggaaacagaacagacuauccagaaauugcagcaagauuucucauuccucuauagucaguugaaccacaccgaaaaugacguuacccaccuccagaaggaaaugucaaacuguagggcaggcgaaaacgccggaaugggccgguuuaccaaggucggagagcaggagcgcacaguugauacucucccuuccccucagcauccuguggcccacuguugcucucaacuagaagagcguuggcagaggcuucagucccagguaaucagugagcucgacgcaugcaaggagugcacacagggaguacagcgggaggucuccaugguggaagggcgagucucgcacauggaaaaaaccugcucuaaguuagauagcaucucugguaaucuucagcgcauaaaggaaggacuaaauaagcacguguccagcuuguggaauugcgugcggcagaugaacggcaccuugcgaagccacucucgagauauuucagggcuuaagaauagcguucagcaguuuuacucucacgucuuccaaaucucaaccgaccuccaagaccucguuaaauuucaacccagugccaaagcucccucccccccacccccugcagaagcucccaaagaaccccugcagccugaacccgcaccucccagaccuaguggaccugcuacagcagaagaucccgggcgaagacccguacuuccccagcgcccuccggaagagaggcccccucagccacccggguccacaggaguuauagcagagaccggccaagcuggacccccagccggagcugguguuuccgggcggggcuugccgagaggaguggacggucaaacaggauccggcacagugccuggagccgaaggauuugcuggggcgccuggcuauccaaagagucccccagucgccagcccaggcgccccagucccaucuuuagugucuuuuuccgcgggccuuacacagaagcccuuuccaagcgauggggguguggugcuguuuaauaagguucuagucaacgacggcgauguguauaacccuucaaccggugucuuuaccgccccuuacgacggucgguaucugaucaccgcaacucugaccccugaacgcgacgccuacguagaagcugucuugagcgugagcaaugccuccguggcucaacugcacaccgccggauaccggagggaguuucuugaauaccaccgaccaccaggagcucugcacacuugcggaggaccgggggcauuucaccuuauuguucaucugaaagcuggcgaugcuguaaacguuguggucacugggggaaaacuggcacauaccgauuucgaugaaauguacucaacuuucaguggagucuucuuguaucccuuucuuagccauuuguag

SEQ ID NO: 13538 - RNA, 1548 nt, Artificial Sequence
  Description of Artificial Sequence: Synthetic coding sequence
auggcccagcuuuucuugccucuucuggcagcacuggugcuggcccaggcccccgccgcauuggccgauguucuggagggagauucaagugaggacagagccuuucgcgugaggauugcaggggacgcaccucuacagggcguccuuggaggagcacugaccauuccaugccacguucauuaccuacgacccccaccuagcaggagagcgguacuuggcagcccacgggugaaauggacuuuucugagccgugguagggaagccgagguuuuggucgcccgcggagucagagugaaggugaacgaagcauaucgauuuagggucgcuuugcccgcauaucccgccagccuuacagacgucucauuggcgcuuagcgaguuacggcccaacgauucaggcaucuacaggugcgaggugcagcacggcauugaugacucauccgaugcaguugaagacagccagcucuacccaauccagacaccucgcgaagccugcuacggagacauggacggauuuccuggcguacgcaauuacggcguggucgaucccgaugauuuguacgacguguacuguuaugcugaggacuugaauggugaguuguuccugggcgaccccccagagaagcucacacucgaggaagcaagagcuuauugccaggagcguggcgcugaaaucgccacuaccggacaacuguaugcugcuugggacgggggccuugaucauuguucccccgguugguuggccgacggaagugucagauacccaaucgucacaccgucacagcgaugcggcggcggucuacccggagucaagacuuuguuucuguucccaaaccagaccggguuccccaacaagcacucccgauucaacgucuacugcuuucgugguaguacaugccuguugcccagccugcgaccccccacccagcccccaacucaagacggacucgaggcaaucguuacagugaccgagaccuuggaggaguugcaauugccgcaggaggcuacagaauccgaaucucggggagcuaucuauucaauacccauuauggaggauggcggagggggaucaaguacaccagaggauccugccgaggccccgagaacgcugcuugaauuugagacgcaauccauggugcccccuacaggcuuuagugaagaggaagggaaggcucuggaggaggaggaaaaauacgaggacgaggaagaaaaagaggaagaagaagaagaggaggagguagaggaugaggcucugugggccuggccuucugaacugaguaguccggguccagaagcuucccuccccacugagccagcugcccaagaggagucucucucacaggcccccgcuagagcagugcuacaacccggcgcgucuccuuugccagauggagaaucugaggcuaguagaccaccgaggguucauggaccaccaaccgagacgcucccaacaccccgggaacgaaaccuagcuaguccuuccccaaguaccuugguugaagccagggagguuggggaggccaccggaggaccagaguugagcggauag

SEQ ID NO: 13539 - RNA, 1023 nt, Artificial Sequence
  Description of Artificial Sequence: Synthetic coding sequence
augccugguugguuaacgcuaccuacucuauguagauuucuucugugggcguucaccaucuuccacaaggcgcagggggauccagccucccauccaggcccccauuaccuuuugccuccaauccacgagguuauccacagccauagaggagccacugccacacugcccugcguguuggggacaaccccaccuagcuauaaggugcgauggucuaaggucgaacccggcgaacucagagagacccugauucugaucacgaacgggcugcacgcacggggauacggaccacucggaggacgcgcacguaugagacgaggacaucggcuagaugccagcuuggugauugccggaguuagacuggaagacgagggccgauaucgcugugaauugaucaauggcauugaggaugagucgguugcccugacacugucacuugagggagucguguuucccuaucagccuagcagaggccgcuaucaguuuaauuauuacgaggcuaagcaagcaugugaggagcaggacggccgccuugccacauauagccaacucuaucaggcauggaccgaaggucuagacuggugcaaugccggcuggcucuuagaaggcuccguuagauaucccguccugacggcucgggcaccaugcggaggacgggggcggcccggaauacgguccuacggacccagagauaggaugcgagaccgcuacgaugcauuuugcuucacaagcgcacuugcagggcaggucuuuuuuguaccaggcaggcuaacauugucagaagcucaugcugcgugccgaaggagaggcgcugucguggccaaaguuggccaucuuuaugcggccuggaaauuuagcggauuagaccaaugugacggaggaugguuggcugauggaucuguacguuucccaaucacuaccccaagaccccgcuguggaggacugccggauccaggcgugcgcucuuuuggauuuccccgaccccagcaggcugccuacggaacauacuguuaugccgaaaacuag

SEQ ID NO: 13540 - RNA, 690 nt, Artificial Sequence
  Description of Artificial Sequence: Synthetic coding sequence
auggaucugcugcaguuccuugcauuucuguucguucugcugcucucugguaugggcgcgacaggcacacugcggacgagucuggaccccagccuggaaauuuauaaaaaaauguuugagguuaaaagacgugagcagcuccuggcuuugaaaaacuuggcccagcugaacgauauccaccaacaguacaaaauuuuggacguuaugcugaagggccuauuuaaaguucuagaagauaguagaaccguccucaccgcagccgauguccucccugauggccccuucccacaagaugagaaauugaaggacgccuucucgcaugugguagagaacacagcguucuucggggacguagugcugcgcuuuccccgcauaguccacuauuauuuugaccacaacuccaauuggaaccugcuaauucgcuggggaaucaguuucuguaaccagacaggcguuuucaaucagggcccccauaguccuauccuuucucuuauggcccaagaacucggcaucucugagaaagauuccaauuuucagaacccguuuaaaaucgaccgcacagaauucauacccuccacagacccuuuucagaaagcucugagagaggaggagaaaagacgaaagaaggaggaaaaaagaaaggaaaucagaaaggggccaagaaucaguaggagccagagcgagcuguag

SEQ ID NO: 13541 - RNA, 465 nt, Artificial Sequence
  Description of Artificial Sequence: Synthetic coding sequence
augucagugggcacaagccuagagcaagcccagaugagcacuuuaaccugccccuuauuuauuccgaccgugggaagaaagaccgcccugcauaguggugaggacuuccagacccugcucuuugagaggguguucgucaauuuggauggcugcuuugauauggccacaggccaauucgccgccccauuacgaggaaucuacuuuuucucccucaauguucacuccuggaacuauaaagaaacguacguucacaucaugcauaaucagaaagaagcugugauccuguaugcccaacccuccgagagaucuauaaugcaaagccagucuguuaugcuugaccucgccuauggagauagagugugggugagauuguucaaaagacagcgcgagaacgcgauauauagcaaugacuuugacacuuacauuacauucaguggucaccucauaaaagccgaagacgauuag

SEQ ID NO: 13542 - RNA, 900 nt, Artificial Sequence
  Description of Artificial Sequence: Synthetic coding sequence
augagauccguuggcgaaggcgcucgggaguggauuagagagugccagcaccaauuccgccaccauagauggaauugcacuacuuuagaccgugaccauacaguauuuggaagaguuaugcugagaaguagcagagaggccgccuuuguguacgcaauaagcuccgcuggcguaguucaugcuauuacacgggcauguagccaaggggaauuaagcguuuguaguugugauccuuauacacgaggcaggcaccaugaucagagaggugacuuugauuggggaggcugcucugacaauauucacuauggggugagguucgccaaagcauucgucgaugcgaaggaaaaaagauugaaggaugcuagagcacuuaugaaccuacauaacaauagauguggaagaaccgcugugcgcagauuucuuaagcucgaguguaagugccacgggguguccgggagcuguacauugcggacuuguuggagggcccuguccgacuucagacgcacaggagauuauuugaggagaagguacgacggggcuguacaggugauggcaacccaggacggggcuaauuucacagccgcuagacagggcuacaggcgcgcaacacggacagaccuggucuauuucgacaacucucccgauuauugugugcuggacaaagcagccgggucacuaggcaccgccggaagaguuuguagcaaaacgucaaagggaaccgaugggugcgagaucaugugcugcgguagaggcuacgacacuacucggguaaccagggucacucagugugagugcaaguuccacuggugcugugccgucagguguaaagaauguaggaacacaguggacgugcauaccuguaaagcuccuaagaaggccgaauggcucgaccagaccuag

SEQ ID NO: 13543 - RNA, 1710 nt, Artificial Sequence
  Description of Artificial Sequence: Synthetic coding sequence
augcuacuucucuuuucugugaucuugauaagcuggguuucaaccguggggggugaagguacucucugcgauuuucccaagauccaucaugguuuccuguacgaugaggaagauuauaacccuuucagccaagugccgacuggagagguguucuauuacagcugcgaguacaacuuuguaagucccaguaaaucauuuuggacccggauaacuuguacagaggaagguuggagccccacgcccaaauguuugagaauguguucuuuuccuuucgucaagaacggacauucagaaucaucuggacuaauccaucuagagggagacacagugcagauaauauguaauacaggcuauucucuucagaauaaugaaaagaauauuagcugcguggaaagaggauggucuacacccccuauuuguagcuucacgaaaggcgagugccaugucccaauccuggaagcaaauguggaugcacaaccgaagaaggagaguuauaaaguuggagauguguuaaaguuuagcugccgcaagaaucugauucgagugggaagugacucugugcagugcuaucaguucggcuggaguccaaauuucccuacuugcaaaggccaaguucggaguugcggaccgccuccccaguugaguaacggcgaagucaaggagauuagaaaggaagaauauggacacaaugaagucguggaguacgacugcaaccccaacuuuauuauuaauggaccuaaaaaaauacagugcguugauggagaauggacgacacucccuacuugcguggagcaagucaagaccuguggguacauccccgaauuagaauacggauauguucagccaucagugccaccauaccaacauggcgugucagucgaagugaacuguagaaaugaauacgcaaugaucggcaauaacaugaucaccugcaucaacggaauauggaccgagcuaccuaugugcguagcuacccaucaacugaagagauguaagauugcuggcguaaacaucaagacccuacugaaacucucugguaaggaguuuaaccacaacucccgaauccgcuauagauguuccgauauuuuccgauaccgccacuccguuuguaucaacgggaaauggaacccagaaguagacugcaccgagaagcgggaacaguuuuguccaccaccuccacagauuccaaaugcacaaaacaugacuaccacagucaacuaccaggacggcgagaaaguggccgugcuuugcaaagagaauuaucuguugccagaagccaaagagaucgugugcaaagauggaagauggcaaagcuuaccacguugcgucgaauccaccgcauacugcgguccacccccuucuauaaauaacggagacacaaccuccuucccuuuaucuguguacccgccgggauccaccguuacauauagaugucagagcuuuuacaagcugcaggguucugugacugucacaugccgaaacaagcaguggagcgagcccccccgaugucuggauccauguguugugagcgaggagaauaugaacaaaaauaacauacaacugaaauggagaaaugaugguaaacuuuaugcuaagacaggugacgcugucgaauuccaguguaaauucccacauaaggcuaugauuaguucgcccccauuuagggcuauuugucaggagggcaaauucgaauaccccauuugugaguag

SEQ ID NO: 13544 - RNA, 351 nt, Artificial Sequence
  Description of Artificial Sequence: Synthetic coding sequence
augaaggguuuaaggucacuugccgcaacaacccuggcccuguuccuggucuucguguuccuaggaaauaguucaugugccccacagaggcuccuggagagacggaauuggaccccacaggcuaugcucuaccuaaagggagcucagggaagacgauuuaucuccgaccaguccaggagaaaagaccugagcgacaggccacuacccgaacguaggucaccgaauccccaauugcugacaauccccgaagccgccaccauucuucuggccucauugcaaaagucccccgaagaugaggaaaagaacuuugaucagacaagauuucuggaggacucucuuuuaaauugguag

SEQ ID NO: 13545 - RNA, 192 nt, Artificial Sequence; identical to SEQ ID NO: 11906
  Description of Artificial Sequence: Synthetic coding sequence

SEQ ID NO: 13546 - RNA, 567 nt, Artificial Sequence
  Description of Artificial Sequence: Synthetic coding sequence
augguuccaggagccgcaggcuggugcugucugguucucugguugcccgccugugucgcugcccacggauucagaauucaugauuaucucuauuuccaaguauuaagcccaggagauauccgcuacaucuucacagcgacucccgccaaagacuuuggagguaucuuccacacacgguaugaacagauucaccuagugcccgcugaaccucccgaagcuuguggcgaacugucuaauggguucuuuauucaagaucaaaucgcauuaguggaaagaggugggugcucauuucugucuaagacucgcgucguucaagagcacggaggcagagcugugauaaucucagauaacgccguggacaaugauaguuucuacguggagaugauucaagauucuacccaaaggaccgcagauauaccggcauuauuccugcucggucgagaugguuauaugauucgcaggagucuggagcagcauggucuccccugggccaucauuucuauuccuguuaacgucacuucgauucccacuuuugaacuucuccagcccccguggaccuucugguag

SEQ ID NO: 13547 - RNA, 2559 nt, Artificial Sequence
  Description of Artificial Sequence: Synthetic coding sequence
augaagccaaugcuuaaagacuucucuaaccucuugcugguuguccucugugacuacguucucggggaagcugaguauuuacuccugcgggaacccggacacguugcucuuucaaaugauacaguguaugucgacuuccaauacuucgauggagcgaacggaacguugaggaauguuagcguucuucugcuugaggcgaacaccaaccagacggucaccacuaaauaccugcugacaaaccaaagccagggaacacugaaguucgaauguuuuuacuuuaaggaagccggagacuauugguuuacaaugaccccugaagcaacagacaacucaacgcccuuuccauggugggagaagagugcuuuucucaaaguggaguggccuguuuuucacguagaucucaauagaagugcaaaagcagcugaagguacuuuucaggugggacucuuuaccucucagccauugugcccauucccuguagauaagcccaauauuguagucgaugugaucuuuacgaauagccuuccggaagccagacguaauucucgccagccauuggaaauuaggaccagcaagaggaccgaacucgcacagggccaauggguggaauucgguugugccccccugggaccagaagccuacgucaccgugguucuaaaacuccuaggccgggauucuguuauaacguccaccgguccaauugaucuugcucagaaauuugguuauaaacuggugauggugcccgaacuuacaugugagagcggaguugaagucaccgugcugccaccaccaugcacuuuuguucagggagugguaacaguguuuaaagaggcuccaagauauccagguaaaagaacuauccacuuagcugagaauucgcuaccacucggagagagaaggacuaucuuuaauugcacccuuuuugauauggguaagaacaaguauuguuuugauuuuggcauuucaagcaggagccauuuuagcgcaaaagaagaauguaugcugauccaacgaaauaccgaaaccuggggucuguggcagcccuggucucagugcuccgcaaccugcggugacgggguacgugagcggaggcgagugugucugaccaguuucccuuccuccccugucuguccaggaaugucucuggaagccucuuuauguucacuagaggaaugugccgccuuucagccauccucuccaagcccucugcaaccacaaggacccgugaagagcaacaacauagucaccgugaccggcaucucacuuugccuguucauuauuaucgccacuguucucaucacacuguggcgacguuucggccgccccgccaaauguagcacaccugcucgacacaauuccauccauuccccuucuuucagaaagaauagugaugaagaaaauauuugcgaacuguccgaacaacguggcuccuucagugacgggggugacggcccaacaggauccccaggcgacaccggaaucccacugaccuaucgcagaagcgguccuguuccacccgaagaugacgcaucugguuccgaaucuuuucagucaaaugcccagaagaucaucccaccacuguucuccuacagacuggcccagcagcaguugaaagagaugaagaagaaaggucuaacugagacgaccaagguuuaucacguaucccagucgccuuuaacagauaccgccauugacgcagcuccuagcgccccacucgaccuggagucacccgaggaagcugcagccaauaaguuuagaauaaaaucccccuuucccgagcagcccgcugucucugccggugaacgccccccuucaaggcucgaucuuaaugugacgcaggcaagcugcgcaaucucuccuucucaaacccucaucagaaagucucaagccagacaugucggaagccgcggcggaccauccgagaggagccacgccagaaacgcccacuuuagaagaacagcauccuuucaugaggcgagacaagcacgacccuucagagaaagaucaauguccacucuuaccccucggcaagcgcccgcuuacagcucucggacuaggacuugcgagcaggcugaggacagguuccguccacagucucgcggcgcucaccuuuucccugagaaacucgagcacuuccaagaagcuucaggcacccguggcccgcucaauccguugcccaaauccuacacccugggccaaccccugaggaagccugaucugggagaucaccaagccggccugguugccggaauugagcgcaccgagccucaccgcgcaagacguggccccucacccagucacaaguccguuucccggaagcaauccagcccaauuagcccuaaagacaauuaucaaagagucuccucccucucaccuagucaguguagaaaagacaaaugccagagcuuuccuacacaccccgaguuugccuuuuaugauaacaccaguuucggccugacugaagccgaacaaaggaugcuugaccugccuggcuauuuuggcuccaaugaagaagacgagacaacauccacacucucuguagagaaguuggugauuuag

SEQ ID NO: 13548 - RNA, 369 nt, Artificial Sequence
  Description of Artificial Sequence: Synthetic coding sequence
augggcuuucauuucuguauuuggauaaucuuccuucugcccccaccuuguaagaaaugccucuccccuccuacuaugaaucuucgacccccuaagagcuguggaaauguguuuuacugggugcugguacuaaauaguggucuccuguauaaguuuugucagacaauuaagugccgagcuaauuggcggccagcucgcgcuccaagaggauggaaugaagcuacagagcgacaccaggaacgacggacacagauggaaacagagauggggggcaucagcaccacauauuggcaccggcuaugcacuuguacagaucgaagggccgaaaaacugguaauggacgggaauaacugcugguuucacaaauag

SEQ ID NO: 13549 - RNA, 978 nt, Artificial Sequence
  Description of Artificial Sequence: Synthetic coding sequence
augcagggacgagucgcaggcagcugugcgccuuugggccugcuucugguaugucuucaccugcccggucuguucgcgaggucuauaggaguaguagaggagaaggucucgcagaaccuuggcacgaaucucccccagcugggacagcccucuaguaccggccccucuaacucagagcacccacagcccgcccuugacccacgcaguaacgaucuugccagaguaccccugaaacuuuccguuccagccagugacggguucccucccgcaggaggcucugcgguucagcguuggcccccuaguuggggccugccagcgauggacucuuggccgcccgaagaucccuggcaaaugauggccgccgcggcugaggauagacucggggaagcucugccggaggaguuaucguaucugagcucagccgccgcucuugccccaggaucuggcccccuccccggagaauccucaccugacgccaccggacugucuccaaaggcuagucuucuucaccaggauucugaaagcagacggcuuccucguucaaacagcuuaggugccggcgguaaaauucugucucagcgcccacccuggucccugauucaccgaguccuuccugaucaccccuggggcacucuaaauccaucaguuucuuggggcggcggcggaccuggaacaggguggggaacccgaccaaugccccauccugaaggaauuuggggcauaaacaaccagccucccggaacgagcugggggaacauuaaccgguacccuggaggcagcugggggaacauuaauagauauccugguggcuccuggggcaacauuaaucgguauccuggcgggucauggggcaacauucaucuuuaucccggcaucaacaacccuuucccuccuggggugcugcguccaccagggucuucuuggaauauuccugccggcuucccaaacccacccucaccuagauugcaguggggcuag

SEQ ID NO: 13550 - RNA, 2631 nt, Artificial Sequence
  Description of Artificial Sequence: Synthetic coding sequence
augggaccugaggcacugucgucccuucuccuucuauuacuggucgccucuggagaugcugauaugaagggucacuuugacccagcuaagugccgauaugcccugggcaugcaggaucggacuaucccugauucggacauaagcgcaucuucuagcugguccgacuccacagcugcuagacauucgagacuagagucuucugauggugauggcgccuggugucccgccgguagcguguucccaaaggaagaagaauaccuccaagucgacuugcaaagauuacaccuugucgcccuggucggaacccaaggaaggcaugcuggcggucucgguaaagaguuuucuagaucuuacagauuaagguacuccagagacggacgucgauggaugggauggaaagacagauggggacaggaaguuaucuccggcaaugaagacccagaaggcguuguucugaaagacuugggucccccaauggucgcucgguuaguacguuuuuacccccgggcggaucguguuaugagcguuugucuucggguggagcuauacgggugccuuuggcgcgauggcuuacuuucauauacagcgcccguggggcagacaauguaccuauccgaagcuguuuaccucaacgacucaacguacgacggacauacggucgggggccuccaguacggcggccuugggcaauuggccgauggcguggucggucucgacgacuuucgcaaaucccaagaacugcgcguuuggccaggauaugacuauguaggcuggucuaaccacuccuuuucaucagguuauguggagauggaguucgaguucgauagacugagagcauuucaagcaaugcaaguucauugcaacaauaugcacacucugggugcccgccuuccaggaggcguagaaugucgauucagacgggguccagcuauggccugggaaggagagccaaugcgacacaacuuaggcggcaauuugggggacccgagagcacgggccgugagugugccacucgguggaagaguugccagauuucugcaguguagguuuuuguucgcugguccauggcuccuguucuccgaaauaucuuucaucagugacgugguaaacaacuccucuccagcucuuggagguaccuuucccccugcuccuugguggcccccgggcccuccuccaacaaacuuuucaucacuggaauuggaaccgcgaggucagcaaccaguugcaaaagcugaaggaucacccaccgcuauccugauugggugcuuaguugccauuauucugcuccuguuacugaucauagcccugaugcuguggcgccuucacuggagaagacuccuuagcaaagccgagcggcgugugcucgaagaagaacucaccguucaucucucagucccgggugauaccauucuuauuaacaacagacccggcccuagagaaccaccuccauaccaagaaccacgaccucgggggaacccgccucauucagcgccauguguaccuaacgguagugcuuacagcggagauuauauggaacccgagaaaccaggggccccuuugcucccaccuccaccccagaacagcguuccucauuaugcagaggcagauauagugacacuucaaggugugacuggcggaaacacauaugccgugcccgccuuaccacccggcgcaguaggagacggcccuccaaggguggauuucccucgcuccagacucagguucaaggaaaaguugggugagggucaguucggcgaaguccaucuuugugaagucgacuccccucaggaccuugucuccuuggacuucccucugaaugugaggaaagggcacccacuccucguagcagucaaaauucucagacccgacgccacuaaaaaugcacggaaugacuuuuugaaagaagugaaaauuaugucaagacucaaagacccaaacaucauuagacuucugggagugugcguccaggaugacccccugugcaugaucacagauuacauggagaauggagacuugaaucaguuucuguccgcccaucagcuggaagacaaagccgcagaaggagcgcccggagauggacaggcagcgcagggcccaacgaucucuuaccccaugcuuuugcacguggcugcucagauugccagcggcaugcguuaucucgcaacccucaacuucgugcacagagaccuugcuacuaggaauugucuagugggggaaaauuuuacuaucaaaaucgcagacuuuggaaugucaaggaaccuguacgccggugauuacuaucgaguucaaggaagagccguucuuccaauuagguggauggcuugggaauguauccucaugggcaaguucacuaccgcuagugacgugugggcguucgggguuacucucugggagguucucauguugugucgggcccagccauuuggccaacuuacagacgaacaagugaucgagaacgcuggggaauucuuccgagaucagggcaggcagguuuacuuaucucggccccccgcauguccccagggauuguacgaacugaugcugagaugcuggucaagagaauccgaacagcgaccccccuuuucccagcuacauagguuucuggcagaggaugcauugaauaccguguag

SEQ ID NO: 13551 - RNA, 672 nt, Artificial Sequence
  Description of Artificial Sequence: Synthetic coding sequence
augaaguuuguacccugucuccuucuagucacucugagcugucuggguacacuggggcaggccccaagacaaaaacaggguaguacaggcgaggaauuucacuuucagacaggcggucgagacuccugcaccaugaggccuucuucccuggggcagggagcaggggaaguguggcugagaguugauugccggaacaccgaccagacauauuggugcgaguaccgcggccaacccagcaugugccaggccuucgcagcagacccaaagcccuauuggaaccaggcucuccaggaauuacguagauugcaccacgcaugucagggcgcccccgucuugaggccauccguuugcagagaagcuggcccucaggcacacaugcagcagguaacaagcucucuuaaggguucccccgaaccuaaccaacagccagaagcagguacucccucccuacgacccaaggccaccguuaaauugaccgaggcaacccaacuggggaaggacaguauggaagaacuuggaaaggccaagccaacaacacggcccaccgcuaaaccuacgcagcccggcccuaggccuggcggaaaugaggaggcuaagaagaaggccugggaacauugcuggaaaccauuucaggcccugugugcauuuuugauuucuuuuuuccguggguag

SEQ ID NO: 13552 - RNA, 585 nt, Artificial Sequence
  Description of Artificial Sequence: Synthetic coding sequence
augacuaugcgucacaacuggacucccgaucuuucacccuuguggguccugcugcugugugcucaugucgucacauuacuagugagagcaacucccguuucccagacuaccacagcugccacugcaagcguaaggaguacuaaagaccccugcccaucccaaccuccaguguuucccgcugcaaagcaauguccagcuuuggaagugacuuggcccgaggucgaggucccacuuaauggaacucucagccuaaguuguguggcauguucccgcuucccuaauuuuuccauuuuauauuggcuggguaacgggucuuuuaucgagcacuugccagggcgauugugggaaggcucuacgucucgcgagcggggcucuacugggacucaacuguguaaggcacuggucuuggagcagcuuacaccagcuuugcacucaacuaacuucuccuguguccuugucgaccccgaacagguaguacagcgacaugucguccuugcucaacugugggcagggcugcgggcuacucuucccccuacacaagaagcgcucccaagcucucauucaucuccucagcagcagggcuag

SEQ ID NO: 13553 - RNA, 777 nt, Artificial Sequence
  Description of Artificial Sequence: Synthetic coding sequence
augaucgcaauuuccgcaguguccuccgcccuucuauuuucacuccugugcgaagccucuacaguuguucuccuuaauuccaccgauagcuccccuccgaccaacaacuuuacagacaucgaagcggcauugaaagcacagcuggacuccgcagauauaccuaaagcccgacgcaagcgcuacauuagccagaacgauaugauugccauccucgacuaccauaaucagguacgcgggaagguuuuuccuccagcugcuaacauggaguacauggugugggacgagaaucucgcuaaaagcgcagaagcuugggcagcuaccuguauuugggaucacggaccuucauaccuucugcgcuuucuggggcaaaaccuuucugugcgaacaggccgguacagaucuauccuacagcuggugaagccuugguacgaugaggucaaagacuacgccuucccauauccccaggauuguaauccacggugcccaaugcguugcuuuggaccaaugugcacacauuacacccaaauggucugggcuacuucaaaucggauuggaugcgccauucacacgugccagaacaugaauguuugggggagcguauggcggcgggccguguaccuggucuguaauuaugcacccaaaggcaacuggaucggugaggcuccuuacaagguugggguaccgugcagcucuuguccacccaguuauggaggcaguugcacugauaauuuauguuuuccuggcguaacgagcaauuaucuguauugguuuaaauag

SEQ ID NO: 13554 - RNA, 906 nt, Artificial Sequence
  Description of Artificial Sequence: Synthetic coding sequence
augcugccuuuaaccaugacaguucucauccugcuguugcucccaacaggucaggcagcccccaaagacggcgugacccgccccgauucggagguucaacaccaacuccugccaaacccauuccagcccggccaggaacagcugggauuauuacaaucuuaccucaagggacucgggaggacugaaguacagcuggagcacuuaaguagagaacagguguuguuauauuuguuugcccuucacgacuacgaccaaucaggccagcucgauggacucgaauuauuaucuaugcuuacagccgcacucgcuccuggcgccgcgaauuccccuaccaccaacccugugauacugauuguugauaaaguauuggaaacacaagauuugaauggagacggccuuaugaccccugccgaauuaaucaauuuuccagguguggcuuuaagacacguggaaccgggcgaaccccuggcaccuuccccacaggaaccacaggccguaggccggcagucacuccuagcaaaguccccucugagacaggaaacucaggaagcgcccggcccccgugaggaagcaaaaggacagguggaggcaaggcgggaaagcuuggauccagugcaggagccaggaggacaggcagaagcagauggugacgugcccggaccacgaggagaagccgaaggccaggcugaggccaagggcgacgcacccggaccgaggggcgaggcgggaggccaggcagaggcagaaggugaugcuccgggucccaggggagaggcgggaggccaggcagaggcccgcgagaauggcgaagaggcaaaggagcugcccggugaaacacuggaaucuaaaaauacacagaacgacuucgaagugcacauaguucagguggagaaugacgagauuuag

SEQ ID NO: 13555 - RNA, 969 nt, Artificial Sequence
  Description of Artificial Sequence: Synthetic coding sequence
augaagacgcuggccggucuuguuuugggacuugugaucuucgaugcugccgucacugcacccacacucgagaguauuaacuacgacuccgaaaccuacgaugcgacccuggaagaucuggacaaucucuauaauuaugaaaauauccccgucgauaaggucgaaaucgaaaucgcaacgguaaugccauccggaaauagagaacugcucaccccaccaccacaacccgagaaagcacaggaggaagaggaggaggaggaaucuacuccuagacugauagauggaucaucaccacaggaaccugaguuuacagguguccugggaccucacacaaacgaggauuuucccaccugccugcucugcacaugcauuagcaccaccguguauugugacgaccaugaacucgacgccauucccccucuucccaaaaacacagccuauuuuuacucccgauuuaauagaauuaaaaagaucaauaagaacgauuucgcaucacuuuccgaucuuaagagaauugaccugacguccaaccuaauuucagaaaucgaugaagaugcauuccgcaaacugccacagcugagagaacuugugcuuagagauaauaagauuagacaacucccugaguuaccuacuacauugaccuuuaucgacauauccaauaaccgccuggguagaaaaggcauaaagcaggaggcuuucaaagacauguaugaccuucaucaccuuuaucucaccgacaauaauuuggaucauaucccucucccucuaccugagaaccuccgagccuuacaccuacagaacaacaacaucuuggagaugcaugaggauacuuuuugcaacguaaagaaucugaccuacauccguaaggcccuggaagacaucagacuggacggcaaccccauaaaccucuccaaaaccccucaagccuauaugugucucccucgccuucccguuggaucauuagucuag

SEQ ID NO: 13556 - RNA, 618 nt, Artificial Sequence
  Description of Artificial Sequence: Synthetic coding sequence
auggugaaucuggccgccauggucuggcggcgguuacuucgaaagcgguggguacuagcacuugucuuugggcugagccucguuuauuucuugaguuccacauuuaaacaggaagaaagagcugugagagacaggaauuugcugcagguccaugaucacaaucagccaaucccuuggaaagugcaguuuaaccucgggaauagcaguaggccaucuaaucagugcaggaauucuauccaaggaaaacaucuuaucaccgaugaacuaggauauguaugugaaagaaaagaucugcuagugaacggcuguuguaacguuaacguuccgucgaccaaacaauacugcugugacggcuguuggccaaauggaugcugcuccgccuacgaguacugugucaguuguugcuuacaaccuaacaagcagcuucuacuagaaagguuccugaacagagcagcugucgccuuucagaacuuguucauggccguggaggaccacuuugaacucugccuugcuaaaugucggacgucuagucaaucuguccagcaugagaauacuuacagagacccuaucgcaaaguacuguuacggugagucaccccccgaguuauucccagcauag

SEQ ID NO: 13557 - RNA, 3057 nt, Artificial Sequence
  Description of Artificial Sequence: Synthetic coding sequence
auggugagucacuuuaugggcagcuugucugugcuuugcuuucuucuacuguugggcuuucaauucguguguccccagccuucuacucagcauaggaagguuccacagcgcauggccgcugaaggcgccccagaggaugauggagggggcggugcacccggaguuuggggugcgugggggccauggucugcgugcagucggucaugcagcggggggguaauggagcaaacccguccaugcuugccuagaucuuaccgucuucgaggaggccaacguccuggagccccugcgagagcguuugccgaucacgucgugagcgcgguaagaacuucagugccccuccacagaaguagagacgagacuccugcccuggcuggcaccgaugcguccaggcagggccccacaguguugagagguucgcgucauccccagccucaaggacuugaagucacgggcgauaggaggagccggacuagagggacaauuggcccugguaaauaugguuauggcaaagcccccuacauccucccuuuacagacggacacggcucacaccccucaacgguuacgucgacagaaacuuucuucacgccacucuagaagccagggcgccuccucagcccggcacggcuauuccucgccagcacaucaagucccucaacacgguccacuguaccaaagcgacuccggcccacgguccggucuccaggccgccgaggcuccuaucuaccagcuaccacucacucacgaucaaggauauccagcggccuccucucuguuucacagcccggaaacaucuaauaaucacggcguugggacucauggcgcaacacaaucuuucagucagccagcucguucaacugcaaucagcuguaucggggccuacaggcaguauaaauuguguaauaccaauguguguccugaaucaucccgaagcaucagagaaguucagugcgcuucauauaacaacaaaccauuuaugggccgguuuuaugagugggaaccauuugcugagguuaaaggaaacagaaaaugugaauuaaacugccaggccaugggcuaccgguucuauguucggcaggcugaaaagguaauugacggaaccccaugcgaccagaacggaacggccauuugcgugucuggccaguguaaaagcaucggaugcgacgauuacuugggaagugacaaggugguagacaaauguggggugugcggcggugauaacacaggaugucagguggugagcggcguuuuuaaacacgcacugaccucauugggcuaucaucgaguaguugagauaccagagggggccacgaaaauuaauaucacagaaauguauaagagcaacaacuacuuggcgcugcggucgaggagcggcaggagcaucauuaacggcaauugggcuaucgacaggcccggaaaauacgaagggggcggcaccauguuuacauacaaacggccaaacgagauuucguccacugcaggggaaucauuccuggcugaaggaccaacuaacgaaauacucgacguguacaugauacaccaacaaccaaaccccggcgugcauuacgaauauguuauuaugggcacuaaugcgaucucaccacaagugccuccccaccggcggccaggagaaccauuuaacggacagaugguaacagagggacgaucucaagaggaaggcgagcaaaaagggaggaacgaagaaaaggaggaccuaagaggggaagcucccgagauguuuacaucagagagcgcucagaccuuucccguccgacacccugaccgcuucuccccucaccgucccgacaaccucgugccacccgccccucaaccuccacgacggagcagggaucacaacuggaaacaacuuggaaccaccgagugcuccacuaccugcgguaagggaucacaauauccaauuuuuagaugcguccaccggucuacucacgaagaagccccagaguccuacugugauaguucaaugaaaccuacaccugaagaagaaccuuguaauaucuuccccugcccagcauucugggauauaggcgaguggucagagugcagcaagacgugcggacugggcaugcagcacaggcagguguugugcagacaggucuacgcaaaccgaucccucaccguucagcccuaccgaugccaacaucuggaaaagcccgagaccacuucaacuugucagcuaaagaucugcucagaguggcagauucguacugacuggacgaguugcucaguaccaugcggcguuggucaacgcacccgggacgugaaauguguuucuaacaucggagacguggucgacgacgaagaauguaacaugaaacuacgaccuaacgacaucgagaacugcgacaugggcccuugcgcaaaauccugguuuuugacggaguggagugaaagauguucugccgaaugcggggcuggagugaggacacggucuguuguuugcaugacaaaccacgucucuucuuuaccccucgagggcugugggaauaaucgcccugcugaggcaacaccaugugacaauggaccgugcacaggcaagguggagugguuugcaggaucauggucucaguguagcauugagugcgggagcgggacacaacaaagggaggucauaugcgugcgcaaaaacgccgauacauucgaagugcuggaccccucugaguguagcuuuuuggagaaacccccaagucaacaguccugccacuuaaagcccugcggagcaaagugguuuucuaccgaguggaguauguguuccaaaucuugucaggguggauuucggguucgcgagguccgcugucugagugaugauaugacccucuccaacuuaugugacccccagcucaaacccgaagagcgcgaaucuuguaauccacaggauuguguaccugaggucgacgagaauuguaaagauaaguacuacaacuguaaugucguuguccaggcucgccuguguguuuauaacuacuacaagaccgcuugcugcgccucuugcacccgugucgccaaucgccaaacuggauuccuuggaucucgcuag

SEQ ID NO: 13558 - RNA, 1503 nt, Artificial Sequence
  Description of Artificial Sequence: Synthetic coding sequence
augaaguguacagcuagggaauggcuucgcguuacaacagugcuuuuuauggcccgcgccauacccgccaugguuguccccaacgccacccuccuggagaaacugcuggagaaauauauggaugaagacggugagugguggauugcuaagcagaggggaaaaagagcuaucaccgacaaugacaugcagaguauccuagaccuucacaacaaguugagaucacagguguauccaacagccagcaauauggaauauaugacgugggacgucgagcuagaacgcagcgcugaaucuugggcagaaucaugccucugggagcacgggccugccucacuguuaccuucuaucggccaaaaccuuggggcucauuggggccguuauagaccuccaaccuuucauguccaaagcugguaugaugaggugaaggauuucucuuacccauacgaacaugaaugcaacccuuacugcccuuuccgcugcuccgguccuguauguacccauuauacacaggucgucugggccaccucuaacagaauaggcugcgccaucaaccugugucacaacaugaauauuuggggccagaucuggccgaaggccguguacuuggucugcaacuauaguccuaaggggaauugguggggccaugccccuuauaagcacggaaggccuuguuccgcaugcccuccuuccuuuggaggcgguugucgugagaauuuguguuauaaagagggcagugacagauacuacccaccccgugaagaagaaaccaaugaaaucgagaggcagcagucacagguacacgacacacacgugaggacccguagugacgauagcucccgaaaugaagucauuucagcccagcaaaugucccagauugugucuugcgaaguacggcugcgggaccaguguaaagguacuaccuguaacagauacgaguguccggccggaugccuggacucaaaagcuaagguaaucggcucuguccacuacgagaugcagucuucuauaugucgcgccgcuauccacuacgggaucauugacaacgauggggguuggguugauauuacacgccagggcaggaaacauuauuuuauuaaaucaaaucgcaacggcauacaaaccauagguaaguaucagagcgccaauucauuuacuguuuccaaggucacagugcaagccguaacuugugaaacaaccguagagcaguuaugcccuuuucauaaaccggcuagucauugcccgagaguauacugcccccggaauuguaugcaggcaaauccccacuacgccagagugaucgguaccagaguauauucagaccucucauccauuugcagggcugccguccacgcggguguggucagaaaucacgguggguauguggauguaaugcccguagauaagcgcaagacuuacaucgccucuuuccagaacgguauuuuuuccgaaucccugcagaauccaccaggcggcaaggcauucagaguguuugccgugguauag

SEQ ID NO: 13559 - RNA, 2070 nt, Artificial Sequence
  Description of Artificial Sequence: Synthetic coding sequence
augaaauucggggcagucacacggauuggggggcccccacugggaaaucaaucacccaguaguugcagccuucuccaugaaaaggacccuccgacgacuagcggaccucagacagaccaaccaaagaagcaucucaccaacuucaagagcgccacucguagagucgcaagaacccaauggcugacagcagaucgacaaacaugggcaaguaucucuucaguuccuugggcucagacaauuagcgaaaagaaaccaggagguagcuuaugggaaaccagaagcuccccucccaccacugcgggcacggaagaagcuaugaacaccaccucauuguuggccccagcugcagagauaauggccacuccugggagucccucgcaagcaagcccuacccuuggcgcauuuacacacgggacacagacucccagucccaccaaagccacagccccuagguauccccaaaccggagauuuguccgcugaauggccuuucacggccggggaagaaccgguucuugugccacgcccucaucaagucagucgcguccgcuccaguuguuguuuaucaccaauucuguguagucccgcuaugaucgccuuccuccugaccuccgugcucaugaucccccacgccggcggccauccccuggacacuccccaccugccccaggaguuaccaccgggccucccuaauaauaucaauauaaccuucuucagcgguauguucaagaacgucgaauccgucgcugaaauauucgauugcuuaggcccucauuuuacuugguugcaagcaguauuuacaaacuuuccaguucugauucaguucguuaauggcaugaaguguguugccggucugugucccagagauuuugaagacuacggaugcacuugucgcuucgagauggaagguuugccaguggaugagagugacucuugcuguuuucaacaccguagaugcuacgaagaggccgcugaaauggauuguuuacaggauccugcaaaguuaaguaccgaaguuaauugcgucuccaagaagauuauaugugaauccaaagauaacugugagcaccuccuuuguacgugugacaaagccgcaauagagugucuggccaggagcucacucaauucgucauuaaauuuguuggacaccagcuucugccuugcccaaacaccugagacuacaauaaaagaggaucuaacaacacuguugccccguguuguaccaguugaaccuaccgacacaagucuaaccgcucucuccggcgagguugcugcugaaacggaagccgaccgcuugaucacccugagcaaaaaaaaggccggccaugaucaggaaggcguuggagcagcccgcgccacgagucccccggguuccgccgagaucguagcuacccgagucacagccaagauagugaccuuagucccagccggcauuaagagccucggacuggcugucagcuccguggagaacgauccagaagaaacuaccgagaaagccugcgacagauuuacuuuccuacaccuggguuccggagacaauaugcaaguuaugccucagcugggggaaaugcuauucuguuugaccagucgaugcccugaagaguuugagagcuaugguugcuauuguggacaagagggaagaggagagccccgcgacgaucucgacagaugcugcuuaucucaccacuguugccuugagcagguucgccgccugggaugucugcuggaaaggcugccauggagcccgguggucugcguggaucauacacccaagugcgggggccagucccucugcgagaagcuacuaugcgcaugcgaccagacagccgcugaauguaugaccucugccagcuucaaucagucucuuaaaucccccaguagacucggguguccaggccaacccgccgcgugcgaggacucgcugcauccugugcccgccgcaccuacacucgguagcaguucagaagaggacucggaggaagauccaccucaagaagaccugggucgcgccaagagauuucuccgcaagagccugggaccauugggcaucggcccguugcacggaagauag

SEQ ID NO: 13560 - RNA, 1359 nt, Artificial Sequence
  Description of Artificial Sequence: Synthetic coding sequence
auggaacucgcccuacggcgaucccccguucccagguggcugcuucugcucccauugcugcuggggcuuaacgccggcgcugugaucgacuggcccaccgaagaagggaaagaggugugggacuaugucacuguaagaaaagacgcauauauguucuggugguuguauuacgcuaccaauucuugcaaaaauuuuagugaguugccucucgugauguggcugcagggcgguccaggcgguucuagcacugguuucggaaacuuugaagagauagguccauuggauucagacuuaaaaccaagaaagacaaccuggcuacaggcugcaucucuguuguuuguggauaacccugugggcacagguuucagcuacgugaauggaagcggagcuuacgcaaaggaucucgcaaugguugccagcgacaugauggucuugcuaaagacauuuuucagcugucacaaagaauuccaaaccgugccuuuuuauauuuuuucugagucauaugguggaaaaauggccgccggaauaggccuggaguuguacaaggcaauucagcguggcacaauaaaauguaauuucgcugggguggcucugggggacaguuggauuaguccagucgacucaguccugucauggggcccauacuuguacucuaugucacuucuggaagauaaggggcuggcagaaguuagcaaaguggccgaacagguccucaaugcaguaaauaaagguuuguaccgggaggcuaccgaacucuggggcaaagcagagaugauuaucgaacagaacaccgacggaguuaauuuuuauaauauccucacaaaauccacuccuaccucuacaauggaaaguucucuggaguuuacacagucacaccuagugugucucugucagaggcacgugcggcaucuccagagggacgccuugagucagcugaugaacggcccgauacggaaaaagcucaaaauaaucccggaagaucaguccuggggaggacaagcuaccaaugucuucgugaauauggaagaagauuuuaugaaaccugugauuucaauuguggaugaauugcucgaggccggaauaaacguuacuguguauaacgggcagcuugaccugauaguggacacaauggggcaggaggcaugggugcgaaaacucaaguggcccgaacugccuaaauucucucagcuaaaguggaaagcccuuuauuccgauccuaagagccuugagacuagugccuuugugaagaguuacaagaaccucgccuucuauuggauuuuaaaagccggccauauggugccaagcgaucaaggugauauggcacugaaaaugaugagacuugugacucagcaagaguag

SEQ ID NO: 13561 - RNA, 1395 nt, Artificial Sequence
  Description of Artificial Sequence: Synthetic coding sequence
auggugaggcuggcugcugagcuccuccuccuccuaggccuccugcucuugacguuacacaucacuguccuuagggguuccggagccgcugacggcccugaugccgcugcaggaaacgcaagucaggcacagcugcagaacaaccucaacgucggauccgauacaacgagcgagacuucauuuucccucucaaaggaggcaccccgcgaacaucucgaccaucaggcugcucaucagccuuucccccggccccgcuucaggcaagagacuggccauccuucccuucaaagagacuuucccaggagcuuccuacuugauuugcccaacuuuccugaccugagcaaagcugauauaaacggacaaaaccccaacauucaagugacuaucgaggugguugacgggccagacucagaggcggacaaagaccaacacccagagaauaaaccuucauggaguguacccaguccagauuggcgugcaugguggcaaaggagccugagccuggcuagagcgaacuccggagaucaagauuacaaauaugacaguacaagcgacgauucaaauuuccucaacccacccaggggaugggaucauaccgccccgggacauagaacuuuugaaacuaaagaccaacccgaguacgauucuacagauggagagggcgauuggucauugugguccguguguagcgugacauguggcaauggaaaucagaagcggacucgauccugcggauacgccugcacagcgacugagagcagaaccugcgacagaccaaauugucccggaaucgaggauaccuuucgcaccgcagcuaccgaggucucucuucuggcaggcagcgaggaguucaacgccacaaaguuauuugaagucgauacagacucuugugagagauggauguccugcaagucggaguuuuugaaaaaguacaugcacaaaguuaugaaugaccuuccuucuuguccuugcagcuauccuaccgaaguggcuuauaguaccgccgauaucuuugauagaaucaaaagaaaagauuuuagauggaaagacgcuucugguccuaaagagaaacuagagaucuacaaaccaaccgcaagauacugcauacgaucgaugcuuucccuggagucaaccacacucgcugcucagcacuguuguuacggcgacaacaugcaacuaauaacaaggggaaagggcgccgggaccccgaauuuaauaucuacggaauucagugcugaacuacauuauaaaguggacgugcuaccauggauuaucuguaaaggcgauuggucaagguacaacgaagcaagaccuccgaacaauggucagaaaugcaccgaaucccccucugaugaagacuauauaaaacaguuucaggaagcaagggaguacuag

SEQ ID NO: 13562 - RNA, 1536 nt, Artificial Sequence
  Description of Artificial Sequence: Synthetic coding sequence
auguugguagacggcccuuccgaacgcccagcucugugcuuccugcuguuggccguugccauguccuucuuugguucagcacuauccauagaugagacuagagcacaucuucuucugaaggaaaagaugaugagguuaggagguagauugguucugaauacaaaagaagaguuggcaaaugagagacugaugacacugaaaauugcagaaaugaaagaggccaugcgaacacuuauauucccucccuccaugcacuucuuccaggcuaagcaccugaucgagagaucccaagucuucaauaucuugcgcaugaugcccaaaggagcagcucuucaucuccaugauaucggcaucguuacuauggacuggcucgugcggaacgucacauacaggccccauugccacauauguuuuacgccucguggaaucaugcaauuuagauucgcucacccaacuccgagacccucagagaaauguaguaaauggauucuauuggaggauuauaggaagagaguacaaaacguaacggaguuugaugacagccuucuccggaauuucacguuggucacgcagcaccccgaagugaucuacacaaaccagaacguuguuugguccaaauuugagacgauuuuuuucacuauuaguggccugauucauuacgccccuguguucagggacuacgucuuuagaagcaugcaggaauucuaugaagauaauguguuauauauggagauucgcgcaagacuccuuccuguuuacgagcucagcggcgagcaucacgacgaggaguggagcguuaaaacguaucaagagguugcucaaaaauuugucgaaacccaucccgaguuuauuggcauaaaaauaauuuauucagaccauaggaguaaggaugucgcgguuaucgcugaaagcauacgaauggcaaugggucugcgcauuaaauuccccacaguugucgcagguuucgaucucgugggccaugaggacaccggacacucucugcaugauuacaaggaagcccuaaugauaccugcuaaagauggcguaaaauugcccuauuucuuucaugcgggcgaaacagacuggcagggaaccucuaucgaccgaaacauuuuggacgcccugaugcuuaacacaaccaggauaggacaugguuucgcccugucuaaacaccccgcuguuagaacauauaguuggaaaaaagacauucccauugaaguuugcccaauaaguaaccagguccugaaacucgucucugaccuuagaaaucaccccguugccacauuaauggccacuggucaucccauggucaucaguuccgacgaucccgcuauguuuggcgcuaaagggcucagcuaugacuucuacgagguguuuaugggaaucggcgggaugaaagcugauuugaggaccuuaaagcagcuagcaaugaauagcaucaaguacagcacucuccucgagagcgaaaaaaauaccuuuauggagauauggaaaaagagaugggauaaguucauugccgaugucgcuacaaaguag

SEQ ID NO: 13563 - RNA, 777 nt, Artificial Sequence
  Description of Artificial Sequence: Synthetic coding sequence
augaagcagauacuucauccugcucucgagacuacagccaugacacuauucccaguauugcuguuucuaguggccggccucuugccgucuuuccccgccaaugaagauaaggaccccgcauucacagcccucuugacaacccaaacucaggugcaacgcgagaucguaaacaaacacaacgagcuucgcagagccguuuccccccccgcacgcaacauguugaagauggaguggaauaaggaagccgcugcuaaugcucagaaaugggcuaaccaaugcaauuaucgccacuccaacccuaaagaucgcaugacuucccugaagugcggcgaaaaccuguauaugucaagcgccuccucaagcuggagccaggccauucaaaguugguuugaugaguauaacgacuuugacuucggcguaggcccuaaaacuccgaaugccguugucggucauuauacccagguugugugguauuccucauaucucgugggcugcggcaacgcauacugcccaaaccaaaagguuuuaaaguauuacuaugucugccaauacugucccgcuggcaauugggccaaucgucuguauguaccuuacgagcaaggagcucccugugccuccugcccugauaacugcgacgauggccugugcacuaauggauguaaauacgaggaccucuauuccaacugcaaaucucucaaguuaacucucacuugcaaacaccaauugguacgcgauuccuguaaagcaagcuguaauugcucgaacaguaucuacuag

SEQ ID NO: 13564 - RNA, 714 nt, Artificial Sequence
  Description of Artificial Sequence: Synthetic coding sequence
augguuacgccucccccucccccuguguuuagccugcuaaaaaucagccagcgaauagucugccucguacuggauaagucugggaguauggguggaaaggauagacugaauaggaugaaccaggcugcuaagcacuuucugcuacagacuguagagaauggaucuugggucggaaugguacacuuugauagcaccgcuacuaucgugaauaaauuaauacaaauaaaguccucugacgagcgaaauacucuaauggccggacucccuacauacccccuaggcgguacuucuaucuguuccggaaucaaauacgcuuuucaagugauuggagaacuucauucccagcuggacggaucagaagugcuacuccugacagauggagaagacaauacagccagcucauguauagaugaagugaagcagucaggugcaaucgugcacuuuaucgcgcugggcagagcggccgacgaggcaguuauugaaaugucuaaaauuaccggagggagucauuuuuacgucagugaugaggcucagaacaacggccugaucgaugccuucggcgcuuuaaccucaggaaauacugaccuuagccagaaaucccuucagguccgcgugcucauucccugggucuuuauguucacauucgccacacguaagaaccaucugguggucauuucuuuugaauuccauaucuuccuuaaaguaaauuucuag

SEQ ID NO: 13565 - RNA, 459 nt, Artificial Sequence
  Description of Artificial Sequence: Synthetic coding sequence
auggauaacguucaacccaagauuaaacaccgcccauuuuguuuuucaguuaagggucacgugaagaugcuccgucucgcccuuacugugacauccaugacuuucuucauaaucgcgcaggcuccagagccauacaucgucauaaccggcuucgaagucaccgugaucuuauucuuuauucugcuguacguccucagauuggaccgccugaugaaguggcuguucuggccccuccucgauaucauuaacucccucgucaccacaguauucaugcuuaucguguccguccuugcccucauuccugaaacaacuacccuuacgguuggcggcggcguguucgcccuuguaacagcagucuguuguuuggcugauggggcccuuauuuaucggaaauuacuuuuuaauccaagcggaccuuaccagaagaaaccgguucacgagaagaaagaaguucucuag

SEQ ID NO: 13566 - RNA, 3744 nt, Artificial Sequence
  Description of Artificial Sequence: Synthetic coding sequence
augcucgcauccagcucacgaaucagagcugcauggacccgcgcucuacuucugcccuuacuccucgcaggccccgugggcugccucuccagacaggagcuguuccccuuuggcccgggacaaggcgaccuggagcuugaggauggugacgacuuugucagcccagccuuagaacucucaggcgcucugcgauuuuaugaucgcuccgauaucgaugcaguauaugugacaaccaacgggauuauagcuacuagcgaaccaccugccaaagaaucacauccgggccuguucccaccaacguucggugccguagcuccuuuuuuagccgaccucgacacuaccgacggccuggguaaaguguacuacagggaagacuuaucaccuuccaucacccagagggccgcugagugcguacauagaggcuuuccagagauaucuuuccagccuucgagcgccgugguugugaccugggagagcguugccccuuaucaggggccaucccgagaccccgaucaaaaaggcaaacgcaacacauuccaagccgugcuggcuuccucugauagcuccucuuacgcgauuuuccuuuauccggaggaugggcugcaguuccacaccacauuuaguaaaaaggagaacaaucaggugccugccgugguggcuuucucacaggguagcgugggcuucuuauggaaaucaaacggcgcauacaacauauuugccaacgaucgugaaucagucgagaaccuggcgaagucaaguaacucagggcaacagggcguuuggguguucgagaucggcucccccgcuacaaccaauggagugguuccugcagacguuauccuggggaccgaagauggcgccgaguacgacgaugaagacgaagauuaugaccuggccacgacaagauuaggauuggaggacguagguacaacaccguuuagcuacaaggcacuacgaaggggcggugcggacaccuacuccgucccaaguguuuugucccccaggagggcugccacugagaggccucugggucccccaacagagcguacaagaaguuuucagcuggcagucgaaacauuccaccaacaacauccgcaagugaucgauguagaugaggucgaggaaacuggcgucguauucucuuacaacaccgacucaagacagacaugcgcgaacaaccgacaucaguguagcguccacgccgaguguagggacuaugccaccggcuuuuguuguucuugugucgcaggguauacaggcaacggacggcaaugcguagcugagggaucuccucagaggguaaacgggaaggugaagggcagaaucuucgucgggucuagucagguuccaauuguuuucgagaauacggaucuccacucauauguugugaugaaucauggcaggaguuacaccgcgaucuccacgaucccagaaacagucggguauucacuguugccuuuggccccaguggggggaauaauaggcuggauguucgcugucgaacaggauggcuucaaaaacggguuuucuaucaccggcggcgaguuuacacggcaggcugaggugacauuugucggacaucccggaaaucugguuaucaagcagagauuuucuggcauagaugaacauggacaccuuacuauagacacagagcuagaaggcagagugccucagauccccuuuggcucaagcgugcauaucgaaccguauacugaauuguaucauuacucaacaucugugaucaccucauccagcacucgggaguauacagucacagagccagagcgcgacggggcaagcccaucaagaauuuacacauaccaguggcgacagaccauaaccuuccaggagugcgugcaugacgauucuagacccgccuuaccguccacacagcagcuguccguugauucaguuuucguuuuauacaaccaggaagagaaaauacuucgguacgcccuaucaaauuccaucgguccaguacgcgagggaucuccggacgcccuucaaaauccauguuauauugguacucacggcugcgauacaaacgcugccuguaggccuggucccaggacacaguuuacaugcgaauguucuauaggcuuucgaggggauggucgcacauguuaugauaucgacgagugcuccgaacaaccgaguguguguggaucccauacuaucugcaauaaccauccaggcacuuuucggugugaguguguagaaggauaucaauuuucugaugaagguaccugcguugccgugguggaucagcgccccauuaacuauugcgaaacuggcuuacauaacugugauaucccccaaagagcucagugcaucuauaccggaggaagcucuuacacuugcagcugcuuacccggguuuuccggcgacggccaggccugucaagauguggacgagugucagccuuccagaugucauccagacgcauuuugcuauaacacuccugggucuuucacaugucaguguaaaccagguuaccagggagacggguuucgcugcguuccuggcgaaguugaaaaaacaagaugccaacacgaacgagaacauauccugggggccgccggcgccaccgauccucagagaccgauaccccccgggcucuuugucccugaaugugacgcccauggucacuacgcucccacccaaugccacggcucgaccggguacugcugguguguggaccgcgacgggagagagguugagggaacgcgaacccgacccggaaugaccccucccugccuauccacuguagcaccaccuauacaucaagggcccgcuguacccaccgccguuaucccacugccccccggaacacacuugcuuuuugcccagacagggaagauugaacgacucccccucgagggaaauacuaugagaaagaccgaggccaaggccuuucuacacguccccgccaaggucauaaucggucuggccuucgauuguguagacaaaauggucuacuggacagacaucacagaaccaaguauugguagagccagucuacaugggggagagccuacaaccauuauacgacaagaucuggggaguccugaaggcaucgcuguagaccaccucggaaggaacaucuuuuggacagacaguaaccuggauagaaucgaagucgcuaagcuggacgguacccaacgccgugugcuguucgagacagaccuggucaauccuagagguauuguuaccgacuccgucagaggcaaccuguacuggacugacuggaaccgagauaauccaaaaaucgaaacauccuacauggacggaacgaauagaaggauccuuguacaagaugaucuuggcuugccuaacggacuuacuuuugacgccuucucuucacaguuguguugggucgaugcaggaaccaaccgugcugaaugcuuaaacccuagccagccaucccggagaaaagcgcuugagggccugcaguauccauucgcugucaccucauaugggaagaaucuguacuucacugauuggaagaugaacuccguggucgcucuggaucucgccauaucuaaagaaacagacgccuuccagccucacaaacagacccgacuauacgguaucacuacagcauugucucaauguccccaggggcacaauuauugcagcgugaacaacgggggaugcacccaucuuugccuugccacuccaggaucucggacgugcagaugcccagauaacacacucgguguggacuguauagaacaaaaguag

SEQ ID NO: 13567 - RNA, 525 nt, Artificial Sequence
  Description of Artificial Sequence: Synthetic coding sequence
augcuccgcaccgaauccugccggccccgaucaccugcuggccaaguugcagccgccaguccacugcuacugcugcuccuguuacucgcguggugugcuggugcuugucggggagcucccauccugccucagggauugcagcccgaacagcaacugcagcucuggaacgaaauugacgauacaugcucuagcuuccuuuccauugacucccagccacaggccucaaaugcccuugaagagcuaugcuucaugauuauggguauguugccaaagccccaggaacaagaugagaaagauaacacuaaacguuuccucuuucauuauucaaagacgcagaagcucggcaaauccaacguggucaguucuguagugcaccccuugcuccaacuggucccccacuuacaugaaagacguaugaaacgguuucgaguugaugaagaauuucaguccccuuucgcaagucagagccggggauauuucuuguuccggccaaggaaugggcgcagaagugcuggguucaucuag

SEQ ID NO: 13568 - RNA, 1218 nt, Artificial Sequence
  Description of Artificial Sequence: Synthetic coding sequence
auggacacgauuuuccucuggucacuccuacugcuguucuucggaucucaggcgucacggugcuccgcucagaaaaacaccgaauucgcugucgaucuauaccaagagguuucacucucucauaaagauaacaucaucuucuccccccuuggaauuacauuggugcucgaaauggugcaauugggcgccaaagggaaggcccagcaacagauacgucaaacccucaaacagcaagagaccuccgcuggcgaggaguucuucguccuuaaaucauuuuucuccgcgaucucugaaaaaaagcaagaauuuacauucaacuuagcaaacgcgcuguaccugcaagagggguucaccgucaaggagcaguaccuccauggcaauaaagaauuuuuccagagcgccaucaagcugguggauuuucaggacgcuaaggccugugccgagaugauuagcacuuggguggagagaaagaccgacggaaagaucaaagacauguucagcggcgaggaguucgguccccuuacucggcucguacucguaaacgccauauacuucaagggugauuggaagcaaaaauuccggaaagaagacacacaguugaucaauuucacaaaaaagaacggcaguacuguaaagauaccuaugaugaaggcccucuugaggacaaaauacggcuacuuuucagaaagcagcuuaaacuaucagguacucgagcuaagcuauaagggggaugaauucagcuuaauuauuauacucccugccgagggaauggacaucgaagaggucgagaagcuuaucaccgcucagcagauucugaaaugguuaagugagaugcaggaagaggaaguagaaaucucccuuccaagguucaaaguggagcaaaagguagacuucaaggauguguuguauagccuuaacauaaccgaaauuuuuagugggggaugugaccuuagugguauuaccgacagcucugaaguuuaugugagccaggugacccaaaaaguauucuuugaaauuaaugaagaugguuccgaggcugcuacaucuacuggaauccauauccccgugaucaugucccucgcgcagucacaguuuaucgcaaaucacccauuucuguucauaaugaagcacaauccgaccgagucuauccucuuuaugggacgagucaccaauccagauacucaggagaucaaaggacgcgaucucgacucucuauag

SEQ ID NO: 13569 - RNA, 3687 nt, Artificial Sequence
  Description of Artificial Sequence: Synthetic coding sequence
augaaaggugcccgauuguuuguuuuacuguccucauuauggaguggcggaauuggccuuaauaacucaaagcacagcuggacaauaccagaggauggcaauucccaaaagacaaugccuucagccucagucccccccaacaagauccaguccuugcagauucugccaaccacccgaguuaugagcgcugaaauugccacaacuccagaagcccgcaccagcgaagauuccuuacugaaaucuacacugccuccuucugagacauccgccccugcagaagguguacggaaccagacccugacgagcacggaaaaagcagaaggcguuguuaaacuacaaaauuugacucucccuaccaaugccucaauaaaauucaacccaggagccgagagcgugguccuguccaacuccacuuuaaaguuucuucaguccuuugcgcgaaagucaaaugagcaagcuaccucacucaacacagucgggggaacgggaggaauaggcggcgucggggggacaggggggguggggaaucgggcaccuagagaaacuuauuuaucacggggggauuccucauccagccagagaacugacuaucagaaauccaauuucgaaacuacaaggggaaaaaauuggugugcauacgugcacacacgguuaaguccuacggugauucuugacaaucagguuacguauguaccggguggcaaggggccuugcggguggacaggaggaucaugcccucagagaucucagaagauuagcaaccccgucuacagaaugcagcacaagauuguuacuucucucgauuggagauguugcccaggguacucaggaccuaaaugucagcuaagagcccaggaacagcagagccuuauucauaccaaccaggcagaaucucacacagccgugggacguggaguugccgagcagcaacagcagcaaggaugcggcgaccccgaagugaugcagaagaugacugaccaggugaacuaucaagcuaugaaacugacacugcugcagaagaagauugacaauaucagcuugacaguaaacgacguucggaauacauacuccagucuggagggaaagguuucagaagauaaaagcagagaguuccagagucuccugaagggccugaaaaguaagucaaucaacgugcugaucagagauaucguaagggagcaguucaagaucuuucaaaaugauaugcaggaaacaguugcccagcuguucaagacuguuagcucucucucugaggaucuugagucuacccgucaaaucauccaaaaggugaacgaaucuguuguuuccauugcugcacagcaaaaguuuguacugguacaggagaaccgaccaacucuuaccgauaucguagaacugcguaaccacauagugaacguccgccaagaaaugacccuaacgugugagaaaccaauaaaggagcuugaagugaaacagacacacuuagaaggagcacuggaacaggaacacucucgcaguaucuuguacuacgagagucugaacaaaacccuaagcaaacuaaaggaaguccacgaacaacuccugucgacugagcaagugagugaccagaagaacgccccagccgcugaaagcguaagcaacaaugugacagaguauaugagcacccuccacgagaauauuaaaaagcaaucccugaugauguugcagauguucgaagauuugcauauucaagaaucuaagaucaacaaccuuaccgugagccuggagauggagaaagaaagccugcgcggugaaugcgaggacaugcuguccaagugcagaaacgauuuuaaauuucagcugaaagauaccgaggagaaucuacacgugcugaaccaaacacucgccgaggugcucuucccuauggauaauaaaauggacaaaaugagugagcaacugaacgaucugaccuacgacauggagauauugcaaccuuuacucgagcagggcgcuucacugagacagaccaugacauaugagcaaccuaaggaagcaauagucauucggaagaaaauugagaaccucacauccgcugugaauucccugaacuucaucauuaaggaacucaccaaacgucacaaccuacuucguaaugagguacagggccgagaugacgcacucgaaagacgcauaaaugaguaugcacucgaaauggaggacggcuuaaauaaaacgaugaccaucauaaacaacgccaucgauuucauccaagacaacuaugcauugaaggaaaccuuaucaacaaucaaagacaauagcgagauccaccauaaauguacuagugauauggaaacaauucucaccuuuaucccccaguuccaccgucucaaugauucuauccagacacuuguaaaugauaaucagagauacaacuuugugcugcagguagccaagacauuagcaggaaucccucgugacgaaaagcuuaaccaaaguaacuuucaaaaaauguaucaaauguuuaacgaaaccaccucacaggucagaaaguaccaacagaauaugagccaccuggaggagaaguugcugcucaccacuaagaucagcaagaauuuugagaccagacugcaggacauugaaucuaaagugacucagacucuaauaccauacuauaucagugugaagaagggcaguguuguuaccaacgaacgcgaucaggcucuacaauuacaaguccugaauagucgguucaaggcccucgaagccaagucuauucaccuuucaauuaacuucuucucuuugaauaaaaccuuacacgaaguucuuacuaugugucacaaugccuccacuucuguuuccgaguugaaugccaccauuccuaaguggauuaagcacagccugccugauauccagcugcugcaaaaaggcuuaaccgaguuuguggagccuauuauccagauuaagacacaagccgcgcucucuaaccuuacauguuguauugauagaagucucccaggcucuuuagcgaacguggugaagagucagaagcaaguaaaaaguuuaccgaagaagauuaacgcgcucaaaaaaccaacggugaaccucacaaccguguuaaucggaaggacacagaggaacacagacaacaucauuuauccagaagaguacucaucuuguucacgccaccccugccaaaacggagguacuugcauuaacggucguaccagcuuuaccugugcuugucggcacccuuuuaccggagacaacugcaccauuaagcucgucgaagaaaacgcucuggcccccgacuucucuaaggggucuuaucgcuaugccccuaugguugcuuuuuucgcaucucacaccuacggcaugacaaucccaggccccauucuauuuaacaaccuagacguaaauuauggcgccucauacaccccucggacaggaaaauucagaauaccauauuuaggcguguaugucuucaaauauaccaucgaaucguucucugcgcacauauccggguuccuugugguggaugguaucgauaagcuggcauuugaauccgaaaacauaaacucugaaauccauugcgaccgcgugcugaccggcgacgcacugcucgaguuaaauuacggccaggagguguggcucaggcucgcuaaaggaacaaucccugccaaauuucccccuguuacaacauuuucuggcuaccuacucuauagaaccuag

SEQ ID NO: 13570 - RNA, 1365 nt, Artificial Sequence
  Description of Artificial Sequence: Synthetic coding sequence
auguggccacugacgguuccacccccacuccugcuucuguuguguucuggguuagccggccagacguuguuccagaacccugaggagggauggcaauuauacacauccgcgcaggcacccgacgguaaaugcauuuguaccgccgucauuccugcccagaguacauguucaagggaugggcgaagcagggagcugagacaauugauggagaaggugcagaaugugucccagucuauggaaguccuagagcuaagaacuuaccgagaccuucaguaugugcgaggaauggaaacucugaugcgauccuuggaugccaggcugcgagccgcggaugguucccucuccgcuaaaucuuuccaggaacugaaagaucguaugacugaacugcugccacugucaucugugcuggagcaauauaaagcagauacacgaaccauagugcgccugcgcgaagaaguacggaaucucucuggcagucuugccgcaauccaggaagagaugggcgccuacggauaugaagacuuacagcagagagucauggcacucgaggcuaggcugcaugcuugcgcacaaaaguuaggauguggaaagcugaccggcgucaguaauccuauuacagugcgagcuaugggaagucguuucggcucuuggaugaccgauacuauggcucccucugcagauaguaggguuugguauauggauggauacuacaaaggucggcgcguucuugaauucaggacuuugggagauuucaucaaaggucagaacuucauacagcaccuuuuaccccagccuugggcaggaacuggucauguggucuauaaugggaguuuauucuauaacaaauaccagucaaauguggucgucaaguaucauuuuagaagccgcuccguucuggugcagcggucucugccuggagcggguuacaacaacaccuuuccauacuccuggggcggcuuuuccgacauggacuucauggucgaugagucagggcucugggcggucuauacaacuaaucaaaaugcaggaaacauagucgucucuaggcuggacccucauaccuuagagguuaugagaucaugggacacugguuacccaaaaagaagugcuggggaagcauucaugauuugcggcgugcucuacgugaccaauucacaucuagcuggcgcuaagguauauuuugccuacuucacaaauacgagcagcuacgaauauacagacguucccuuccacaaccaauacucacauaucagcaugcuggacuauaacccacgcgaacgggcccuguacacauggaacaacggccaccaaguacuguacaauguuacccuguuucacgucauuagcaccagcggcgaucccuag

SEQ ID NO: 13571 - RNA, 909 nt, Artificial Sequence
  Description of Artificial Sequence: Synthetic coding sequence
augugugccgagcgccucggacaauucaugacacuggcuuuaguucuugccaccuucgacccugcccggggaacggacgcgacaaauccuccugaagggccacaggaucgaucuagucagcagaaagggcggcugagccugcaaaauaccgcagagauccagcacugcuuggugaacgcgggagauguggggugcggagucuuugaauguuucgaaaauaauucuugugagauacguggacugcauggcauuugcaugacauuucuacacaacgccggcaaguucgaugcccagggaaaauccuucauaaaagacgcccugaaaugcaaagcccacgccuugaggcaucgcuuuggcugcaucuccagaaagugccccgccauccgagaaaugguaagccaauuacagagagaguguuaccucaagcacgaucucugcgcagccgcccaggaaaauacuagagucauuguugaaaugauccacuucaaagaccuacuucuucaugagcccuacgucgacuuggugaaucuucuauuaaccugcggagaagaagucaaagaggccaucacccacucaguucagguucagugugaacagaacuggggcucuuugugcuccaucuuaucauucugcacguccgcgauucagaaacccccuaccgcacccccagaacgacaaccacagguugacaggacuaagcuaucgcgcgcgcaccauggagaagccggccaucaccuaccagagccaaguucucgcgaaaccggucgaggagcaaagggagagcgcgggucuaaaagucauccuaaugcccacgcuagaggccggguuggggggcugggggcccaaggaccuaguggcaguucugagugggaagacgagcagucagaauacagcgauauaaggcgauag

SEQ ID NO: 13572 - RNA, 2529 nt, Artificial Sequence
  Description of Artificial Sequence: Synthetic coding sequence
augaagccgggcgguuucuggcugcauuuaacccucuuaggggcuuccuuaccagcagcacucggauggauggaucccggaacaucuaggggucccgaugugggcgucggcgagucucaggccgaagagccuaggaguuucgaagugacaagaagggaggggcugucuucucauaaugaguugcuugcaagcuguggcaaaaaauucuguaguagaggaucccgaugcgugcucaguagaaaaaccggagaaccagagugccaaugucucgaagcaugccgccccucuuacguuccagugugcggaagcgacggaagauuuuacgagaaucacugcaaacugcacagggccgcuugucuacuaggaaagcggauuacaguaauacacagcaaagacugcuuccugaaaggggauacuugcacuauggccggguaugcuagacucaaaaauguucugcuugcuuugcagacuagacuucagccgcuucaagagggggauagccgucaggauccugcaagccagaaacgacuucucguggagagccuuuuuagggaccuggaugccgauggcaauggccaccuuaguagcagcgaacucgcucagcauguguuaaagaagcaggaucuagacgaagacuugcuaggcugcuccccaggcgaucuguuaagauuugacgacuacaauucagacagcucacugacucuccgcgaguucuauauggcuuuccagguaguacaacugucauuagcaccagaggacaggguaucugucacaaccgugacuguaggauugucuaccguuuugacaugugcugugcacggcgaccuuaggccucccauaaucuggaagaggaacggacuuacauuaaacuuccucgauuuagaagauauuaaugacuuuggcgaggacgauagccuguauauaaccaaagugaccacaauucauauggguaacuacacaugccaugccucgggacacgaacagcucuuucagacucacgugcuucagguuaacgucccuccagucaucagggucuaucccgaaucucaagcccaggaacccggaguugccgcaucacugaggugucaugcagaagggauaccgaugcccaggaucaccuggcuuaagaaugguguagacguauccacucagaugaguaaacaauugucccuucucgcaaauggaagugagcuccacauuucgucuguuagauacgaggacacaggcgccuacacuugcauugcaaaaaaugaagucggcguggacgaagauauaagcucacuguucauugaggacagcgcaagaaagacacuggcuaacauccuuuggcgcgaggaggggcucucuguagguaauauguucuauguguucuccgacgaugguaucaucgugauucaucccgucgacugcgaaauacagaggcaccuaaaaccaaccgaaaaaauauuuaugucuuacgaggagauuugcccccaacgagaaaagaaugccacccaaccuugccagugggugucagcugucaauguucggaaucgguacauuuauguggcccagccagcccucucccgggugcucgugguggacauucaggcccagaagguguugcaaucuaucggcgucgacccccugccugcaaaguugucuuacgauaaaucacacgaucagguaugggugcuuucuuggggagauguacacaaaagccgaccaagccuccaggucauuaccgaagccucaacuggacaaucucagcaucuaauaagaacccccuuugcggggguggacgauuucuuuauucccccaacuaaccuaauuauuaaccauauucgcuuuggcuuuauuuuuaacaaguccgacccugccgugcauaaggucgaucuggaaacuaugaugccacuuaagacuaucgggcuucaccaccacgggugcgugccccaggcaauggcccacacccaccugggaggauacuuuuucauccaaugccgccaggacucacccgccuccgcagccagacaauuguugguagacucagucaccgacuccguccucggaccaaauggcgaugucaccggcacuccccauacuucaccagacggcagauucaucguguccgcugcggccgauucgccauggcuucacguucaggaaauaacaguacggggugaaauccaaacauuauacgaucugcaaauuaauuccggcaucagcgaucucgcauuccagagaaguuucacagagagcaaucaguauaacauauacgccgcccugcacaccgagccagaccuccuuuuuuuggagcuaucaacaggaaaggucgggaugcugaaaaaccucaaagagccaccagccggaccagcccagccauggggaggcacucauaggauuaugcgggauucuggacuuuuuggccaguauuuacuaacaccagcucgcgaaucacuguuucucauaaauggaaggcaaaauacccugcggugcgaagugucuggaaucaaaggcggaaccacuguugugugggugggagagguuuag

SEQ ID NO: 13573 - RNA, 2256 nt, Artificial Sequence
  Description of Artificial Sequence: Synthetic coding sequence
auggcauuucgcacgauuugcguauuggugggcguguuuauaugcucaaucugugugaaaggcaguucacaaccacaggcaaggguguaucugaccuucgaugagcuaagggaaacgaaaaccucagaauacuuuagccucucccaccacccgcucgauuaccggauccuucucauggaugaagaccaggaccguauauaugucggauccaaagaccauauccugucucucaacauuaauaacauuagccaagaggcauuauccgucuuuuggccugcuucgacaaucaaaguagaagaaugcaagauggcuggaaaagacccuacacauggauguggcaauuucguacgggugauucaaacguuuaaccgcacucacuuauacgucuguggguccggcgcauuuuccccgguuuguacauaucucaaccgcggaagaagaucugaggaucaaguguucaugaucgacucgaaaugugaauccgggaagggacgcugcucguucaauccuaacgucaacacagucucaguaaugaucaacgaagagcuauucuccggcauguauaucgauuucaugggaacagacgccgcaaucuuuagaucucuaacuaaaagaaaugcuguucgaacugaccaacauaauucuaaauggcucucugagccaauguuuguugaugcccaugugauacccgacggaacugacccaaacgacgccaaaguuuacuucuuuuuuaaagagaaacugacugauaacaauagaucaaccaagcaaauacauucuaugaucgcccgcaucugccccaacgacacuggggguuuacgaagucuugugaacaaguggacaacuuuccuaaaagccaggcuggugugcucuguuacugacgaggacgggccugagacgcauuucgacgagcuggaagacguauuccuguuagagaccgauaauccaagaacuacccucguguauggcauuuucacuacgucuucaucuguguuuaagggaucagccgugugcguguaccaccugagcgacauccagacaguguuuaauggcccuuuugcccacaaggagggacccaaucaccagcugauuuccuaucagggccgcauuccauacccaagaccaggaacaugcccagguggagcuuucacgcccaauaugagaacgaccaaagaguucccugaugauguuguaacguuuaucagaaaucauccacugauguacaacagcauuuacccuauccacaagcgcccacucaucguacguauagguaccgacuacaaauauacaaagauagcgguugacagggucaacgcagccgacggcagauaccaugugcuguuucuggggaccgaccgcgguaccguucagaaaguuguagugcuaccaaccaacaacagcguaagcggggaauuaauccuggaggagcuggaaguguuuaaaaaucaugccccaaucaccacaaugaaaaucucuucuaaaaaacagcagcucuacgucucuaguaacgaaggugugucacaagugucccugcacagaugccauauuuacgguaccgccugcgcagauugcugucuggcccgcgaccccuacugcgcaugggaugggcacagcuguucaagauucuaccccacuggaaagcgaaggagcagaagacaagacguuaggcacggaaacccauuaacgcagugucgcgguuucaaccugaaggccuaccggaacgcugcugagauagugcaauacggcgugaaaaacaauaccacguuccucgaaugcgccccaaaaucuccucaggcuucaaucaaguggcugcuacagaaagacaaggaucgccgcaaagaggugaaauuaaaugagcgcaucauagccacaucacaggguuugcugauccggucagugcagggguccgaucaggggcuuuaucauuguauugccaccgaaaacucauuuaagcaaacuauugccaagaucaauuucaagguuuuagacagcgagaugguagccgugguaacagacaaauggucucccuggacaugggcaucgagugugcgggcccuuccuuuucauccuaaagacaucaugggagcauuuucucacucggaaaugcagaugauaaaccaguauugcaaagacacucgccagcagcaucaacagggcgaugaaucacagaagaugcgcggagauuacggaaaacugaaagcccugauaaacaguaggaagagcagaaacagaaggaaucagcuuccagagagcuag

SEQ ID NO: 13574 - RNA, 2316 nt, Artificial Sequence
  Description of Artificial Sequence: Synthetic coding sequence
augggcugguuaacaagaauagugugcuuguuuuggggagugcuucugaccgcaagagccaacuaucagaaugguaaaaauaaugugccgagacuaaaacugagcuacaaggagaugcuagaaucuaacaacgugaucacauuuaauggacuggcaaacucuucaagcuaccauacauuucuacuggaugaagagcgcaguaggcuguaugugggggccaaagaucauauuuuuucauucgaccucguuaauaucaaagacuuucagaaaauaguguggccugugaguuauacacgcagagacgagugcaaaugggccggcaaagauauuuuaaaagaaugugccaacuucauuaaaguccuaaaggcauauaaucagacgcaccuuuaugcaugcgggacuggggccuuccauccaaucugcacauacaucgagaucggacaccaccccgaagauaacauauuuaagcuggagaauucacacuucgagaacggaagagguaagagcccuuaugauccaaaacugcugacugcgucauuacugaucgacggugagcucuacucuggcacagccgcugacuuuauggguagggacuucgcaaucuuucgcacguuaggacaccaucauccaauacggacagagcagcacgauuccaggugguugaacgaccccaaauuuauuuccgcccaccuaaucagcgaaucagacaauccagaggacgacaaaguguacuucuucuuucgcgaaaaugcuaucgauggcgaacacucugggaaagcaacacacgcucgaauaggacagauuuguaaaaacgacuucgguggacaccgcucacuggucaacaaguggaccaccuuccucaaagcccggcugauauguuccgugccuggccccaaugggauugauacccacuuugacgaacuucaggacguguuuuugaugaacuucaaggacccgaaaaaccccgucguguauggaguauucaccaccaguucuaauaucuucaaagggucugcggucuguauguauuccaugucugacgugagacgaguguuucuggguccuuacgcucaccgagauggaccgaacuaucaaugggugcccuaccagggacguguaccauauccccggccuggaacuugcccuucuaaaacguucggaggcuucgacuccacgaaagaucugcccgaugauguuaucacuuuugcacgcucccacccagccauguauaaucccgucuucccaaugaacaauagaccuauagugauuaaaaccgacguuaauuaccaguuuacucagauaguuguggaucgagucgaugcugaagauggacaauacgacgucauguuuauuggcacugacgugggcaccguguuaaagguugucagcauccccaaagagacaugguacgaucuggaggaggugcugcucgaggagaugacagucuuucgcgaaccaacagcaauaucugccauggaacuaaguacaaaacagcagcagcuguauauaggcagcacggcaggaguggcucagcuccccuuacauagaugcgauauauauggaaaggcaugcgcagaauguuguuuagcgcgagacccguauugugccugggaugguuccgccugcucaagguacuucccgaccgcaaaaaggagaacacgucgucaagacauuaggaauggcgauccucugacccauuguagcgaucugcaucaugauaaccaccacgggcacuccccagaagaaaggaucaucuauggcguggaaaauucaaguaccuuucuggaauguucgccuaagucgcaaagggcccugguauacuggcaguuccaaagaagaaaugaggagagaaaagaggaaauccgcguugaugaucacauuauucggacugaucagggguuauuauuacguagccuccaacaaaaggacuccggaaauuaccucugccaugcuguagaacauggguucauucagacguuguuaaaggugacccucgaaguuauagacacagaacauuuagaggagcugcugcauaaagaugacgacggggaugggucuaagaccaaggaaaugaguaacucuaugacaccuagccagaaaguaugguaucgggacuuuaugcagcucauuaaccaucccaaucuuaacacuauggacgaauuuugcgagcaaguguggaagagagaccguaaacaacgccgccagcgcccaggccauacccccgggaauucaaacaaauggaagcaucuacaggaaaacaagaaaggcaggaacagaaggacucaugaguucgaacgagcaccgagaagcguauag

SEQ ID NO: 13575 - RNA, 4605 nt, Artificial Sequence
  Description of Artificial Sequence: Synthetic coding sequence
auggcccuaacuccaggauggggaucaagcgcgggccccgugcguccugaacucuggcuacugcugugggccgccgcguggcgguuaggcgcguccgcuuguccagcucuguguaccuguaccggcacuaccguggauugucacgggaccggucuacaggcaauuccuaaaaauauuccucggaacaccgagcgucuugaauugaacggaaacaacaucaccaggauccauaagaacgauuucgcuggucugaaacagcuccgagugcugcaacugauggaaaaucaaauuggcgcugucgaacgcggagcuuuugacgacaugaaggaacuugagagacuucggcuaaaccggaaucaacugcauaugcugcccgagcugcucuuccaaaauaaccaagcucugucccgucuggaccuuagcgaaaaugcaauccaggcaauaccucggaaggccuuuagaggcgcaaccgaccugaagaaucuccagcuggacaagaaccagaucucuugcauugaagaaggggcauuuagagcgcugcggggucuggaaguucugaccuuaaauaauaauaacauuaccacaauuccugucucuagcuucaaucauaugccuaaacuccguacuuucagauuacacuccaaucaucucuucugcgauugccauuuagccuggcugucacagugguuaagacagcgccccacuaucggccucuucacacaguguuccgguccugcuucacuuaggggacugaaugucgccgaagugcaaaagucugaauucagcugcuccgggcagggggaagccggucgcguucccacuugcacccucucuuccggaucaugcccugcaauguguaccugcagcaacgguauuguggacugccgggggaaaggccugacugccaucccagccaacuuaccagagacuaugacggaaauccgacuugagcugaauggaauuaaaucaaucccucccggggccuuuagcccuuacagaaaauuacgaagaauugaucuuagcaacaaccagauagcagaaaucgcccccgacgcuuuccagggccugcggucacuaaauagccugguucuguacgggaacaagaucacagacuugccaaggggugucuuuggcggcuuauacaccuuacaacuccucuuacuaaaugcuaacaagaucaacuguauaaggccagacgccuuucaggaucuacaaaaccuuagccuacuuagccucuaugauaacaaaauccagucucucgcuaaggggacuuuuaccagucuccgcgcuauucaaacauugcaccucgcccagaauccuuucaucugugacuguaaccuaaaauggcucgccgauuuucuacgcacaaauccuauugagacaaguggcgcacguugugcaagcccuagacgacuggcuaacaagcgcaucggccagaucaaaucuaagaaauuuagguguucagcaaaggagcaauauuuuauucccggaaccgaggacuaccaacucaacagcgaguguaauucugacgucguguguccccacaaaugcagaugcgaagcuaaugugguggaguguuccagucugaaacugaccaaaaucccagagagaauuccacaguccacagcagaacuccggcugaauaauaaugaaauaucaauccuagaagccaccgguauguuuaaaaaguuaacacauuugaaaaagaucaaccugucuaacaacaaagucucugaaauugaagacggagcguucgagggggccgcguccguuagcgaacugcaccugacggcaaaucaacuggaaagcauuagaagcgguauguuccggggauuggauggacugaggacccugaugcugcggaacaaucggaucucuuguauacauaacgauucuuucaccggccuaaggaacguuagguuacugagccuguacgauaaccagaucacaacaguaaguccaggagcauuugacacacugcagagcuuguccacccuuaaccuguuagcuaacccauuuaacuguaacugccaacuugcauggcugggcggauggcugagaaagagaaagauugucacggguaauccaagaugucaaaaccccgauuuucuccgccagaucccccugcaagauguggccuuucccgacuuucguugcgaggaaggacaggaggaaggggguugucuccccagaccacaaugcccacaggagugugccugccuagacaccguggugcggugcaguaacaaacaccuucgugccuugcccaaaggaauaccuaagaacguaacagagcucuaccuagaugggaaucaguuuaccuuagugcccggacaauugucaacguucaaguacuuacaauuaguugaccugucgaauaacaaaauuagcucacuauccaauucuuccuuuacaaauaugucccagcucacaacucugauuuuaaguuauaaugcacuucaguguauucccccucucgcguuucagggccuuaggucacuccgacucuuaagccugcacgggaaugacauaagcacacuucaggaaggcaucuucgcagacgugaccucccucucucaccuggcuaucggcgccaauccccuguacugcgacugucaucuacgguggcuauccagcuggguaaaaacaggauauaaggaacccgguauugcucggugcgcuggcccucaggauauggagggcaaacuguuauuaacuacgccugcuaagaaguuugaaugccaggggcccccaacacuugccgugcaggccaaaugcgaccucugucuauccucaccuugccaaaaccagggaacuugucacaaugacccacuggaagucuauagaugugccugcccaaguggcuauaaagggcgagauugcgaaguaucuuuagauagcugcaguagcggccccugugaaaacggcgggaccugucaugcgcaggagggcgaggaugcuccuuuuacuuguucaugccccacuggauuugagggcccuacuugcggaguaaacacagacgacugcgucgaucacgccugugccaacgguggcguaugugucgauggcgucggcaacuacacuugucaaugcccuuuacaauacgaaggcaaggccugugaacaguuggucgacuuaugcucgccugaucugaaccccugucagcaugaagcgcaguguguuggcaccccagacggcccccgaugugaaugcaugccuggauaugcgggggauaauuguucagaaaaccaagaugacugcagagaccacagaugucaaaauggagcccaauguauggacgaagugaauucauacucuugucugugcgccgaaggcuacuccggacagcuuugcgaaauccccccucaucugcccgccccaaaaucuccaugcgaagguacggaaugccaaaacggcgcgaacugcguugaccagggcaaucgcccagucugccagugcuugccuggauucggcgguccugagugugaaaaacugcuaucagucaauuuuguggacagagacaccuaucugcaauucacggaccugcagaacuggccccgggcgaacauaacccuucaggucuccacugccgaggauaauggaauccuguuauauaauggugauaacgaucauaucgcaguggaacuuuaccaaggucacgucagagugucauaugaucccggcuccuacccuucuagugcuauuuacucugcagagacaauaaacgacgggcaauuccauaccguugagcucguggcuuucgaucaaaugguuaaccuuuccauugacgggggguccccuaugaccauggacaauuuugggaagcauuacacucucaacagcgaggcaccacucuacgucgguggaaugccaguggacgugaacuccgccgccuuuagacuauggcaaauucugaacggcacuggauuucaugggugcauacgaaauuuauacauuaauaacgaacuacaagacuuuaccaaaacccagaugaagccaggaguggugcccgguugcgaaccgugccguaagcuauacuguuugcacgguauuugucaaccuaacgcuaccccaggcccaaugugccacugcgaagccggguggguuggccuccauugcgaucagccagcagauggcccaugucacggccauaaguguguccacggccagugugucccauuagacgcccugucauacuccugccagugucaagacggauacagcggggcucucuguaaccaagcuggcgcucuugccgaaccuuguagaggccuucagugccugcacggacacugccaggccagcggaacgaagggcgcccacugugugugcgauccaggcuucuccggagaacucugugagcaggagagcgagugucgcggagacccagugcgggacuuucaucaggugcaacggggcuacgcaauaugccagacaacaagaccauuaucauggguggaauguagggggucguguccagggcagggcuguugccagggauugcguuugaagcggagaaaguuuacguucgaguguuccgauggcaccucauucgccgaagagguagaaaaaccaaccaaguguggcugugcccuuugugcauag

SEQ ID NO: 13576 - RNA, 342 nt, Artificial Sequence
  Description of Artificial Sequence: Synthetic coding sequence
auggauuccagacaggccgcugcacuguuggugcuucuacugcugauugacggagggugcgcagaagguccagguggccagcaagaggaucaacucagcgccgaggaagauagugagccauuaccaccacaggaugcgcagaccucagguucucuacuccacuaccuucuucaggcuauggagcggccuggccgaucacaggcuuuuuuauuucagccucagcgcuuuggcagaaacacacaggggucuuggcgaaacgagugguugucuccccgagcuggagaggggcuuaacucacaguuuuggucacuggcugcaccucagagauucgguaagaaauag

SEQ ID NO: 13577 - RNA, 2568 nt, Artificial Sequence
  Description of Artificial Sequence: Synthetic coding sequence
auggccaggcaucugcuccugccucuagugaugcuugugaucucuccgauucccggugccuuucaggauucagccuugagcccaacucaagaagaacccgaggaccucgacuguggacgccccgagccaucagcacggauagucggagguagcaacgcgcagccugguacauggccuuggcaggucuccuugcaucaugggggcggccauaucugcgggggaaguuugaucgcaccuucauggguccuuucugccgcccacuguuuuaugacuaacgguacgcuugaaccugcugccgaguggagcguccugcuuggcgugcacucccaagauggcccgcuggacggagcccauacuagagcuguugcggcaauaguggugccugcaaacuauucacaggucgaacuuggagcugaccuugcacuccugagacuugcuucccccgcuucacugggcccagcugucuggccaguuugucugccucgugcaucacaucgauuugugcaugguacagcuugcugggcaacagguuggggagacgugcaggaagccgauccacucccacugccuugggugcugcaggaaguggaauugcgucuucucggagaagcaacuugucagugccuuuauucucagcccggccccuuuaacuugaccuugcaaauccugccuggaauguugugugccggauacccugagggaaggagagacaccugccagggagacuccggagguccauuggugugcgaggagggcgguagaugguuccaggccggaauuacuagcuuugguuuuggaugugggaggcggaauagaccagggguguuuacugcuguugccacauacgaagcauggauccgugagcagguuaugggaagcgaacccggccccgccuuccccacucaaccacagaagacccagucugacccacaggaaccucgagaagaaaacuguacgauagcacugccugagugcgggaaggccccuagacccggcgcguggcccugggaagcacaaguuaugguuccuggaucgcgccccugccacggggcauuggugagcgaaucuuggguccuugccccugcuuccuguuuuuuagacccaaacuccagcgauagcccuccuagagaccuggaugcuuggcguguccugcuacccucccgccccagagccgaacgaguugcgcggcuugugcagcaugaaaacgcaagcugggacaaugccucagaucucgcacuucuccagcucaggaccccugucaaucugucagcugccucucggccagucugucucccacauccagagcauuacuuucuaccuggcagcagaugccggcucgccagauggggccgcggcgaaccugcccucggaccgggugcccuccucgaagcagagcuacucggugguugguggugucauugccucuauggaagacagggugcagcggugccguuaccuggugacccaccucacgcacucuguccggcguaccaagaaaaagaagaagugggguccuguuggaaugauucgagaugguccuuacugugccaggaagagggcaccugguuccucgcuggaauccgcgauuuucccaguggauguuugcggccuagagcuuucuucccccugcagacacacggaccauggauuagucacgucacccgcggcgcauaucuggaagaccagcuggcaugggauuggggacccgacggugaagagacugagacucagacaugcccaccgcauacagagcacggugcuuguggacugagacuggaagcugccccugugggagugcuguggccuugguuagcugaaguccacguugccggggaccgagucugcacaggaauauugcuggcaccagggugggugcuugccgcaacccauuguguacucagacccggcucuaccacugugccuuauauagaaguguaccuaggucgcgccggcgcaagcucccuaccucaaggccaucaggugagccgguugguuauaaguauucggcuaccucagcauuugggcuugcgcccuccacucgcuuuguuagaacucuccaguaggguagaaccgagcccaagcgcccuuccaauaugccuucacccagcuggcauuccuccaggugcuucuuguuggguccucggauggaaggagccacaggacagggugccugucgcugccgccguaagcauauugacccagcgaauuugcgacuguuuguaucaaggaauucuccccccaggaacucugugcguccuauacgccgaaggacaagagaaucggugcgagaugaccuccgcccccccacuauuaugccaaaugacagaaggcuccuggauucucguuggaauggccguccaagggucuagggagcuguuugcagccaucgggccggaagaggccuggauuagccagaccgugggcgaggcgaauuuuuuaccuccgucagggagcccucauuggccaaccgguggcucuaaccucuguccuccugaacuugcaaaagcuagcggcagcccucacgccguguacuuccuccugcuucugacccugcuuauucaaagcuag

SEQ ID NO: 13578 - RNA, 912 nt, Artificial Sequence
  Description of Artificial Sequence: Synthetic coding sequence
augcuccauccugaaaccuccccagggcguggucaccucuuagcaguuuuacuggcucugcucggcacaaccugggcugaaguguggcccccacagcuccaggaacaagcacccauggcuggcgcccugaauaggaaggagaguuuuuuauuguugucucugcauaaccgccuccggucauggguccagccaccugcagcagauaugagacgcuuagauuggagcgauuccuuggcacagcuggcacaggcacgagcagcccucugcggcaucccaacaccaucccuggccaguggucuguggaggacacuacaggucggauggaacaugcaguugcugccagcuggacuggcuucuuucguggaggucguuucauugugguucgcugagggccagagauacagucaugcugcaggugagugugcccguaacgccacauguacccacuauacucaauuaguaugggcgacaucgucccagcugggcuguggccgucaucuuuguuccgcaggccagaccgcaaucgaggcauuuguaugugcuuauuccccaagagguaauugggaggugaauggcaagacaauuauaccguacaagaaaggugcauggugcucauuguguacagcuagcgugucuggcugcuuuaaggccugggaucacgccggaggacugugcgagguuccucgcaaucccugucguaugucgugucaaaaucacggaagguugaacauuucuacuugccacugucacugccccccuggguauacaggccgguauugucagguacgauguucucugcagugcguucauggacgguuuagagaggaagaguguagcugcgugugcgauaucgguuauggagaaccauccgugccaccuagauguauuuucccauccacacccgugacuuag

SEQ ID NO: 13579 - RNA, 1158 nt, Artificial Sequence
  Description of Artificial Sequence: Synthetic coding sequence
augaagaugcuuccaggcguaggcguguuuggaacuggcucaucggccaggguccugguaccacuacuaagggcugaaggguuuaccguggaagcucuguggggcaaaaccgaggaagaagccaaacaguuagcagaagagaugaauaucgcauuuuacacaucgagaaccgacgacauucuacuucaucaagauguagauuuggugugcauuuccauuccaccaccccugacccgccagauuuccguuaaagcccuagguaucgguaaaaaugucgugugcgagaaggcagccaccagcgucgacgccuucagaauggucacagccucuagauacuacccucaguugauguccuuaguuggcaacguucugagauucuugccagcguuuguuagaaugaagcaguuaauuagugaacacuacgucggugccguaaugaucugugaugcgagaaucuauagcggcagccuucuuagccccaguuauggcuggauuugugaugagcuuaugggaggugguggccugcacacaaugggcaccuacaucgucgaccugcuuacacaucuuacuggucggcgggccgaaaaagugcacggacuucuaaaaacauucgugagacaaaacgcggcuauccgaggcauucgccaugugacuuccgacgacuucugcuuuuuucagaugcuuauggggggaggcguguguucaacagugacacugaacuucaauaugccaggggccuucgugcacgaagugauggugguuggaagcgcgggucgguugguugcuagaggcgccgauuuguauggucagaaaaacagcgcuacccaggaagaauuacugcugcgggacucacuugcaguuggugccggccuccccgaacaagggccacaggacgucccgcugcuguaucugaagggaaugguguauaugguacaagcauugcggcaauccuuucaaggacaaggcgaucgaaggacuugggaccgcacuccagucagcauggcugccagcuuugaagacggccucuauaugcaaagcgugguagacgcaauuaaaagaagcagucggucuggugagugggaggccguggaagugcugaccgaggagcccgauacaaaucaaaaucucugcgaggcccuucaacguaacaaucuuuag

SEQ ID NO: 13580 - RNA, 1470 nt, Artificial Sequence
  Description of Artificial Sequence: Synthetic coding sequence
augccaguuacuuucgcguuacugcuccucuuagggcaggcaaccgcugacccuugcuacgauccacagggccggccccaauucugucucccaccagucacacaacuagcagccguugcugcaucauguccucaagcuugcgccuugucucccgguaaccauuugggagcuagagagacuuguaacgggucgcugacauuggcucuuggaggaccauuucugcugaccagugugucucuaagauuuugcaccccgggccccccugccuuaauccucuccgcagcuugggcaucaggcggcccauggcgauugcuuuggcacagaccggcuuggccuggcgcacugggaggcccugaacgggugaccuuccacucuaccccaggaccgaaggcaacaguugcagcuucgcauuugcgugucgaauuugguggucaggccggcuuggcugcugcaggacuccgaggaagaugucagugccauggccacgcagccagaugugcagcuagagcuagacccccacggugccacugccgucaucacaccacagggcccgguugugagaguugccgcccuagucaccgcgauuggccauggagacccgcuaccccgcgccauccacauccgugccuacccuguagcugcaaccagcaugcccgcagaugcagauucaacucugagcucuucaggcugagcggcggcagauccggagguguuugcgagcggugucgucaucauacugcagggagacauugccauuauugucagccuggauucuggcgcgaccccucucagccaauuuucuccagacgcgcauguagagcuugccaaugccacccuaucggugccacaggagggaccugcaaucaaacuuccggccaguguacuuguaaacucggcguuaccggccuuacauguaaccggugcggucccggauaccagcagucaagaucaccccguaugccuugucagagaauuccagaggcaacgacuacccucgcaaccacacccggcgccuacaguuccgauccacagugucaaaauuacugcaacauguccgacacucggguccacaugucccuucgucguuacugccaacaggaucacguacugcgggcacagguucucgcuuccgaagcagcagggccugccuggcagagauuggccguucgcguccucgccguguauaagcaaagagcacagcccgugaggagaggagaccaggacgcuuggguaccucgugccgauuugacaugugggugccuaaggcugcagccgggcacugauuaccugcucuuagguuccgcugugggagauccugacccaaccagacugauccuggauagacauggccuagcacugcccuggagaccaagaugggcuagaccccuaaaacgccuccagcaggaagaaagagcuggcggcugucgcggagugcgcgcccccacgccuucaccgaggccagaacauuag

SEQ ID NO: 13581 - RNA, 8430 nt, Artificial Sequence
  Description of Artificial Sequence: Synthetic coding sequence
augacgcuugaagggcuuuaccuggcaagaggcccucucgcuagacugcuccuggcuuggucugcauugcucuguauggccggcgggcagggacgaugggacggggcuuuggaggccgcugguccagguagggugcggcgccguggaucccccgguauuuuacagggacccaacguuugcgguucuagauuccacgccuauugcugcccaggcuggcgcacuuuccccggcagaagucaaugcgugguccccaucugucgcagagccuguggcgagggauuuugcucccagccaaaccugugcaccugcgcggauggaacuuuggcacccagcugcggcguuucuagaggcuccggguguucagugucuugcaugaacgggggaacuugucggggcgcaaguugccuaugucagaaaggauacacagggacaguguguggucagccuaucugcgauagagguugucacaauggcgggcgauguaucggcccuaauaggugugcaugcguuuacgguuucaugggaccacaaugcgagcgugauuacaggacuggucccugcuucggccaggucgggcccgaggggugucagcaucagcucacugguuuagugugcacaaaagcuuuguguugugcaacugucggacgcgcauggggacuccccugcgagcuuuguccagcucagccacacccaugccggagaggauucauccccaacauacauaccggugccugccaggacguggaugagugucaggccguuccugggcucugucagggcggauccugugucaauauggucgggucguuucacuguagaugucccguuggucauagguugucugauuccuccgcagccugugaggauuaccgugcuggagccuguuuuaguguuuuguuuggaggcagaugcgccggcgaccuugccggucacuauacuagacgccagugcugcugugauaggggccgcuguugggcagccggucccguccccgaacuguguccgccgcgcgggucaaaugaguuccaacagcucugugcacagcgguuaccucugcugccaggacaucccggacucuucccuggucugcugggcuuuggaaguaacgguaugggcccgcccuuaggcccugcccgguugaauccccacgggucggaugcucgcggaauuccuucacucggaccaggaaacucaaacaucgggacagcaaccuuaaaccaaaccaucgauaucugccggcacuuuaccaaccugugucucaauggaagaugucuuccuacuccuucuucguaucggugugagugcaaugucgguuacacccaagauguacguggcgaauguaucgacguggaugaaugcacaaguagcccuugccaccacggggauugcguuaacauacccggaaccuaucauugucgcuguuacccaggguuccaagccacuccaacaagacaagccugcguggauguugacgaauguaucgugucugggggacuaugucaccugggacgaugugugaauaccgagggaucauuucaaugcgucugcaaugcaggauucgagcuaagcccugacgggaagaauugugucgaucauaacgaaugugccacaucuaccaugugugucaacggcguaugcuugaaugaagaugggagcuucagcugccugugcaaaccaggcuuccuccuggcaccuggaggccacuacuguauggauaucgaugaaugccagacaccuggaauaugcguaaaugggcauuguaccaacaccgaaggaucuuuccgcugccagugucugggaggccuugcaguaggaacugaugggcgaguuugugucgauacccacgugcggucaacuugcuacggagcaauagaaaaggggucaugugcccgcccguucccagggacagugaccaagagcgagugcugcugcgccaauccugaucacgguuucggugagccaugccaacuguguccagccaaagacagugcagaauuucaggcucugugcagcucagguuugggaaucacgacugaugggcgggacaucaacgaaugcgcucuggacccggaagugugcgccaauggagucugugagaaccuccgaggcuccuaucggugugucuguaaccuggguuacgaagcuggcgccucuggaaaggacuguaccgacguggaugaaugugcccuaaauucgcuacucugcgauaauggguggugccagaauucccccggcucuuacucuuguaguugcccacccggauuucacuucuggcaagauacggagauuugcaaagaugucgaugaaugucucucuaguccuugcguaucuggggugugucggaaucuugcugggaguuauaccuguaaaugcggcccaggcucucgacuugauccuagugguacguuuugucuugacaguacaaaggguacaugcuggcuaaaaauucaggagucccgaugugaggugaaucugcaaggagccagucugagaagugaauguugcgccacccugggugccgcauggggcagcccgugugagaggugcgagaucgauccagccugcgcaaggggauucgcuagaaugacaggugugacaugcgaugaugucaaugagugcgagagcuuucccggugugugcccaaacggaagauguguuaauacagccgggaguuuccgaugcgaauguccggagggauugaugcuugaugccuccggccgucuuuguguggaugugagauuggaacccugcuuccugagaugggacgaggaugaaugcggaguaacauugccugguaaguauagaauggacguuuguuguuguaguaucggggcaguuugggguguugaaugugaggcgugucccgaccccgagagccuagaguucgccucacuguguccaaggggguuaggcuuugcguccagggauuuuuuguccggacgcccauuuuauaaggaugugaaugagugcaaaguguucccaggucugugcacccaugggacaugccguaauacaguggguucuuuucauugcgccugugcuggaggauuugcucuggacgcccaagaacgcaacuguacagacauugacgagugccgcauaucaccugaucuaugcggccaaggcaccugcgugaacaccccuggcaguuuugagugcgaaugcuuuccuggguacgaauccggguuuaugcuuaugaaaaauuguauggacguagacgagugcgcuagagacccccuucuuugucgcggcggcaccuguacaaauacagauggcucuuacaaaugucagugucccccuggacaugaacuuacagcuaaggguacagccugcgaagauauugacgaauguucuuuaagugauggucuuuguccccauggacagugcgugaaugugaucggugcauuucaaugcaguugccacgcuggauuccaaucaacgccugaucgccagggguguguggacauaaacgaguguagaguucaaaauggcgggugcgacguucauuguaucaauacagagggguccuacagaugcucuuguggacaggguuacagccucaugccggacggaagggccugugccgacguggacgagugugaagaaaaucccagagugugugaucaaggacacuguacgaacaugccuggaggacaccgcugcuuauguuaugauggauuuauggccacccccgauaugcggacuugugucgacguggacgagugugaucugaacccacauauuugcuuacauggcgacugugaaaauacaaaggguuccuuugucugccacugccagcucgguuacauggugaggaagggcgccacuggaugcuccgacgucgacgaaugcgaggugggcgggcacaauugugauucacacgccagcugccugaauauccccggcucuuuuagcuguagaugucugcccggcugggugggugauggcuucgaaugucaugaucuagacgaaugcgucagucaggagcacaggugcaguccaaggggugauuguuugaaugugccugguagcuaccgaugcacaugucggcaaggauuugcuggggauggcuucuuuugugaggaccgcgaugagugugcagagaacgucgaccucugugacaauggacagugucucaacgcacccggagguuacaggugcgagugugaaauggguuuugaccccaccgaggaucauagagccugccaagacgucgacgaaugcgcacaaggcaaucugugugcuuucggauccugcgaaaaucucccugggauguuccgauguauuugcaaugguggguacgaguuagacagagggggcggcaauuguaccgacauuaacgaaugugcagauccugugaauugcaucaauggaguuuguaucaauaccccuggaucauacuuauguucuugcccccaggacuuugaauugaaccccagcgguguggguugcguggacacgagagccgggaacugcuuucucgaaacacaugaucggggcgauuccgguauaucaugcucugccgaaauuggcgucggagucaccagggccucaugcugcuguucuuugggccgggcauggggaaaccccugcgaguuaugucccauggccaauaccaccgaguaccgcacccugugcccugggggggagggauuucagcccaaucgcaucacaguuauuuuggaggacauugaugagugucaggagcucccaggccuuugucagggcggagauugugucaauaccuuuggguccuuccagugcgaaugcccuccugguuaccaccucagugagcacacccggauaugugaagauaucgacgaguguuccacucacuccggcauuuguggacccggaacauguuauaauacccucggcaauuacacuugugucugcccggcugaauaucugcaggugaacggcggcaacaacuguauggauaugcgaaaaagugugugcuuuagacauuacaauggaacaugccagaacgaauuggcauuuaaugugacacgcaagauguguuguuguaguuauaacauuggacaggccuggaaucgccccugugaggcuugcccuaccccaauuuccccugauuaccagauucugugugguaaccaagcccccggguuccuuacugacauucauacaggcaaaccacuggauauugacgaauguggugaaauuccagccauuugcgcaaacggaaucuguauuaaucaaaucggcucauuuagaugugaauguccagccggcuuuaauuacaacagcauauuauuggcgugcgaagacgucgacgaguguggcagucgggaaagcccaugccagcagaaugcugacugcaucaacauccccggaucauauaggugcaaguguacgaggggauacaaguuaucccccgggggcgcuugcgugggucggaacgaaugccgagagauccccaacgucugcucucacggugauugcauggacaccgaaggauccuauaugugcuugugucaucggggauuccaggccagugccgaucagacucuguguauggacauugaugagugcgauaggcagccuugcgguaauggcaccugcaaaaacauuauaggcaguuauaauuguuuauguuucccuggauuugucgugacccauaacggggauugugucgauuuugaugaauguacuaccuuggugggucagguaugucgguuuggccacugucuuaacacugcaggcagcuuucacugucuuugccaggacggcuucgaacucacagcugacgggaaaaacugcguugacaccaaugagugccucagccuggccggaaccugucuacccggcacgugucagaaccucgaaggcucauuccgcugcauauguccaccaggcuuucaggugcaaagcgaccauugcaucgacaucgaugaguguucugaagagccaaaccuaugccuguucgguacguguacaaauaguccaggaucauuccagugucuguguccccccggcuuuguccugucugauaauggccaucguugcuucgauacccgccaaucuuucuguuuuacccgauucgaggcugguaaaugcucuguuccuaaagcuuucaauaccacuaagacgcgaugcuguugcucuaagcgaccuggagagggauggggcgauccaugugaguuauguccacaggaaggaucggcggcguuucaggagcugugcccuuucgggcauggggcaguuccaggucccgaugacucccgagaagaugucaaugagugcgcugagaaucccgggguguguacaaacggcgugugugucaauacagacggcuccuuccguugcgaaugucccuucggcuauuccuuggacuuuacagguauuaacugcguggauaccgacgaaugcagcguuggacacccuugcggacagggcaccugcaccaacgugauuggcggcuucgaaugcgcuugcgccgacggguuugaaccaggccugaugaugacuugugaggauaucgaugaauguagucuaaacccgcuccugugcgccuuccgcugucauaacacagaaggaagcuaccuguguacuugcccagccgguuacacccuuagagaagauggggcgaugugucgugauguggacgaaugcgcugauggacagcaggacugccacgcccgcggaauggaauguaagaacuugaucgggacauuugcaugcguaugcccuccgggaaugaggccgcugccaggaaguggggagggcuguacagacgauaaugagugucacgcucagcccgaccuuuguguaaaugggagauguguuaauacagcagggucguuccguugugacugcgaugaagguuuucaaccaucaccaacucuuaccgaaugucaugacaucaggcaagggcccugcuucgcugaggugcugcaaacaaugugucguuccuugaguucuaguagcgaggccguuacacgcgcugagugcuguugugggggggggcgcggauggggaccuaggugcgaauuguguccguuaccuggaacgagugcauaucgaaagcuuugcccacaugguucugguuacacggccgagggaagagacguggacgaaugucgaaugcuggcacaucugugcgcccauggcgaaugcauuaacucgcuuggcucguuccggugccauugucaggcugguuacacgcccgaugcuacugccacuacaugucuugacauggaugaguguucccaaguucccaaaccgugcacguuccuguguaaaaauaccaaagguucauuccucuguucgugcccucguggauaccuccuagaagaagacggacgcacaugcaaggaccucgaugaaugcaccucacggcagcacaacugccaauuccuuuguguaaauacaguuggugccuuuacuugucgauguccacccggcuuuacacagcaccaccaggcauguuuugacaacgaugaauguucugcgcagccagguccuugcggcgcccacggucacugccacaauaccccaggaagcuucagaugcgagugucaccagggguucacauuaguuucuuccggacacgguugugaggacgugaacgaaugcgacggaccucauagaugucagcacggcugccagaaucagcugggagguuaucgcuguagcuguccccaaggcuuuacccagcauucacagugggcccaauguguggacgagaaugaaugcgcccucuccccuccgaccuguggauccgcaucuuguagaaauacacuuggaggcuuucguugcgugugcccaucgggauucgacuuugaucaggcacuuggggguugucaggaggucgacgagugcgcaggaagacgcgggccuuguucauauucaugugccaacaccccagguggauuucuuugcgggugcccccaaggauacuuuagagcugggcagggccacugugugucuggccuaggauuuuccccuggcccgcaggacacaccggacaaggaagaauuacuauccagcgaggcuugcuacgagugcaaaaucaauggccugucuccacgcgacagacccagaagaagcgcccaccgcgaccaccaggucaacuuggccacuuuggacuccgaagcacugcucacguugggccuaaaucuaucacaccuggggagagcugagcgaauuuuggagcuucggccagcauuggaaggccuugagggacgaauucgauacgugaucguucgcggcaacgagcaaggauucuuuagaaugcaccaucuuaggggagucaguuccuugcagcuggggcguaggagaccuggaccggguacuuacagguuggaaguaguuucucauauggccggucccuggggugugcaacccgaaggccaaccggggccuuggggucaagcacucagacuaaaaguacaacugcaacuacuauag

SEQ ID NO: 13582 - RNA, 303 nt, Artificial Sequence; identical to SEQ ID NO: 11943
  Description of Artificial Sequence: Synthetic coding sequence

SEQ ID NO: 13583 - RNA, 1404 nt, Artificial Sequence
  Description of Artificial Sequence: Synthetic coding sequence
auguggcgcugcccccugggccugcuuuuauuguugccuuuggccggacaccuagcccucggcgcacagcagggacggggucgaagagaacuugcccccggacuccacuugcgcggaauccgagaugcagguggaagauauugccaggaacaagaucuaugcugucggggucgggcugaugacugcgcccugccguaccugggugccaucuguuacugugaccuuuuuugcaaccgcaccgugucugacuguugcccugacuuuugggacuucugccuugguguuccacccccguuucccccaauccaaggcuguaugcauggcgggagaaucuaccccgugcuaggcacauacugggauaacugcaauagaugcacaugucaggaaaaucgccaauggcaaugcgaucaagaacccugucugguggaucccgacaugauaaaggcgauaaaucaggggaauuauggguggcaggcugggaaccacuccgcauuuugggggaugacacuugaugaggguauucgguacaggcugggcacuauuagaccuuccucuuccgugaugaacaugcaugagauauacaccguccugaacccuggcgaagugcugccaacagcguucgaagccuccgagaaauggcccaauuuaauccacgaaccccucgaccaaggcaauugcgccgguuccugggcauucucuacagcugcuguagccucagaccgcgugaguauucauucucugggacacaugacgcccguccugucaccgcagaacuuacucucaugugauacucaucaacagcagggauguaggggcgggcgccucgacggagcauggugguuucugcguagaaggggagucgugucugaucauuguuacccauucaguggacgggagcgggacgaagcggggcccgcuccucccugcaugaugcacaguagagccauggguagagggaagcgccaggcaacagcacauugcccuaacucuuacgucaacaauaacgauaucuaccaggugacaccaguguacagacucgggagcaaugacaaggaaauuaugaaagaauugauggaaaaugguccaguucaggcucugauggagguucaugaagacuucuuccuauacaaaggcggaaucuauucccacacccccgucucccugggaaggcccgaaagguacagaagacacggcacccauagcgugaaaauuaccggauggggagaagaaacacugccggacggacgcacauugaaguauuggaccgcugcaaauagcuggggacccgcguggggagagaggggccacuucaggauugugaggggugugaaugagugcgauaucgagagcuuugugcugggcguguggggaagagugggcauggaggacauggggcaccauuag

SEQ ID NO: 13584 - RNA, 2205 nt, Artificial Sequence
  Description of Artificial Sequence: Synthetic coding sequence
auguucuacguguguucuucuugcguguuuuuaugcggauccaacuucccuaacuucccuuuccaagucgcaucggcaaaguccgcccccgagauuccuaccauugaccaggccuauucgaaacucaguaauucuauaacaguugaaugggcuaccguccccggugcaaccaguuaccuccugacugccgaagacggagauacugugauagaaacaacuguagccaacuccccaggaacgguuaccgggcugaaagccgcuacaugguacgaaaucacaaucaggucuauuucugcagccggacgaucacaagccagucccccgaaacaagcaaagaccguacucgccgcgccgauucuugaagucagcagcccuucuuccgauagcauucuaguccaaugggaagcaguguauauggccaucgcauucagcgucuccaucaugcgcgccaauggccucggcagcaucuggaaagagaauacuaccaauaccagcuugaccuucacuucccuugaagcugguacgcucuacacaauaaaggccuaugcauggaacgcaaaccgaauuccuggcgacgacaguacuuguaaucagcguacauccccacgagcaccggcaaacauacagguuuccuuugauaguggagcccugaaggccaguuucuccugggcccgggcugaaggcgcuuuuaacuauaccguaauggcccugagcgauuccucggaacugacaugcucaaccaccuuuagcucaugcaccauuagcucccuccaaugcggcaccgaguaucugauaagcguacuagcuaguaaugacgccggaucuaguaaauccaguucugcuaugacccucaagacaguggcuugugcaccugggcgcgugaccauucaggaagaucccccuggucaccucaguguggcuuggucuuccgucgaccugggcgacuacuacguaguguucgugaagucagaugacgggcucgaagugcauugcaauacuucucucacccaguguaacuuuuuaagcgaaugcggauucaccuacuuuaucucaguuuucguauacaauaaggcuggccaauccccucugggcgacaucuuuaacuauacaacagcaccauguugcccuuccgacaucaacccuguccuaguuucuagcgaccgcguggagauuguuuggucucccgugcgaggugccgaauuauaugagacaaaagcagucgauggcuacaacaugguggaguguaacgacacaaccccagccugcacgcucucagcucuagaaugugacaccaaguacaacauuaccguauacucauucaacgaaguccgagguuccaacaugaguuguacaccucaauucauuaccacggcucccuguucaccggaaauuaagaacguuucacgcgaugcauuuuccaugauuaacguccauuggcgcuccacaaacgaugacgcgacauacaccgugacugcucagggcgagaaaggauuauaucagugcuccucuacuggcgaguccuguaccaugagaggccugcccugcggaagcgucuuuaguguuacugccguggccgagacccaagcuggccgaucauugcccagcuacagcguaccccucgaaacaguuccauguugccccacgggacugacaguuacucaaauuacucaauccguuaucaacguauccuggacuaucgggcgcguugcccaaacucaugucgccgugcuggaaagccacaccggacaguccaagugucacacacaccaaaaucacugccugcugggcugcaucacauguggaaucaacuacaccgugacacugaaagccaucuccgccacuggucucacggccgauugcuccuaccagucuuacuuuuccggggcaugcugcccuuugggugucaaacucuacagacucggcccuaacggcauucgcaucuacuggcaagccucccgugggucagcaaacuacucuacugaucuuuaugguuccaagggcaucuucacaugcacuccguccgcuggccucuccuuuugugacgucaccgagaucccuugcggagacguauauaccgugauggucagccccgucgcaaagacgggucugaaacugacauuuugucccaaaaaaaucuauagcgugacauguucuggcuccacacuagguauggugauuuaucgcggcaaaagaaaugaggaguag

SEQ ID NO: 13585 - RNA, 1098 nt, Artificial Sequence
  Description of Artificial Sequence: Synthetic coding sequence
augcuggauggcagcccccucgcacgguggcuggccgcugccuuuggacugacacugcuucuggcugcuuuacgcccaagcgcugccuauuuuggucugaccggcucggaaccguugacaauuuugcccuuaacucucgagcccgaggcugcugcucaagcucauuacaaggcaugugacagacugaaacuggagagaaagcagagaagaauguguagacgggaucccggaguggcugaaacccuggucgaggccgugagcauguccgcccucgaaugccaguuucaauuuagguucgaacgguggaauuguacauuagaggggcgguaccgugcuucacuccugaaacgcggcuuuaaggaaacagcuuuucuguaugcaauuucuucggccgggcucacccaugcgcuggcuaaggccuguuccgcuggacggauggaaagaugcacaugugacgaggcaccagaccuagagaaucgagaggccuggcagugggggggaugcggugacaaucugaaguacagcagcaaauuuguuaaggaauuucuugggagacgaagcagcaaggaccuacgcgcuagaguugauuuucauaacaaucucguuggugugaaaguaaucaaagcugguguggaaacuacguguaagugucauggcgugucuggguccuguaccgucagaacauguuggcggcagcucgcuccauuccacgaaguaggaaagcaccugaaacauaaauacgaaaccgcccugaaagucgguuccaccaccaacgaggcagccggcgaggcaggcgccauuagucccccccgaggacgggccuccggugcuggaggcagcgacccauuaccuaggacaccugagcuugugcauuuagacgacagucccaguuuuugccucgcaggccgguuuagcccagggacggccgggcgacggugccaccgggagaaaaacugugaaaguauuuguugcggccggggacacaauacucaaucaagggucgugacucgcccaugucagugucaaguucggugguguuguuacguagagugucgccaguguacccagagggaggaagucuacacauguaaaggauag

SEQ ID NO: 13586 - RNA, 795 nt, Artificial Sequence
  Description of Artificial Sequence: Synthetic coding sequence
augagacuucgcccauugccacuugucguugugcccggacugcugcagcugcuauuuugugacuccaaagaaguuguucacgcuacagagggccuugauugggaggacaaggacgcacccggaacuuuggucggcaacguggugcauucccggaucauaucuccauuaagacuguucgugaaacaaagcccugucccgaagccugguccuauggccuaugcugauagcauggagaauuucugggacuggcuggcuaacauuaccgagauucaggagccccuagcacguaccaaacgccggccaauuguaaagacagggaaauucaaaaaaauguucggcuggggcgacuuucacuccaauauaaagacugugaagcuaaaucucuuaaucacagggaagaucgucgaucacggcaaugggacauuuucaguguauuuccggcacaauaguaccgguuugggcaacgugaguguaucacuaguaccgccaucaaaggucgucgaguuugaagucucuccucaguccacacuagaaacaaaagaauccaaaucuuucaacuguagaauugaauaugagaaaaccgaucgcgccaagaagacugcccugugcaacuuugauccaagcaagauauguuaucaagaacagacucagucucacgucagcuggcuaugcagcaaaccauuuaaagugaucuguauuuacaucgccuucuacucuguugacuacaaauugguacaaaaaguuugcccagauuacaauuaucacucugaaacaccauaucugucuagcggcuag

SEQ ID NO: 13587 - RNA, 1125 nt, Artificial Sequence
  Description of Artificial Sequence: Synthetic coding sequence
augaaaccccucuuagagacguuauaucugcucgguaugcuugucccaggcggacucggcuacgaucgcucauuagcucagcacaggcaagaaaucgucgauaaauccguaucgccuuggucucuugagacuuacagcuauaacaucuaucacccuaugggagaaauuuacgaauggaugcgagaaauuucagagaaguauaaagaagucguuacacagcacuuucucggggucacauaugaaacacaccccauguauuauuugaagauaucccagcccuccggaaacccaaagaaaauuauuuggauggacugcgggauacaugcccgggaguggauugcacccgcuuuuugucagugguucguuaaggaaauccugcaaaaccacaaggauaacucaucuauucggaagcuccuccguaaucuggauuucuauguuuugcccguauuaaauauugacgguuauauauauacguggaccacggaucgccucuggcgcaaaucuagaucuccucacaauaacgggaccuguuuugggacagaccucaaccguaauuuuaaugcuaguugguguucuaucggcgcuucccgaaacugccaagaccagacuuuuugugggaccggcccgguaucugagccugaaacuaaggccguugcaucauuuaucgaauccaaaaaagaugacauauuauguuuucugacaaugcacuccuacggacagcuuauacugacaccuuauggauacacgaaaaacaaguccucaaaucaccccgagaugauccaggucgggcaaaaggcagccaacgcauuaaaggccaaguacggaaccaacuacaggguuggaaguucagcagauauccuguaugcaagcagcgguuccagccgggauugggcuagagacaucgggauuccuuucuccuacacuuucgagcugcgcgauucuggcaccuauggauucguucugcccgaagcccagauacagcccacaugugaggagacuauggaagcuguauugucaguccucgaugacgucuaugcaaaacauuggcacuccgacuccgccggacgggugaccucagcuacuauguuacucggucucuugguuagcuguaugucgcuuuuauag

SEQ ID NO: 13588 - RNA, 1728 nt, Artificial Sequence
  Description of Artificial Sequence: Synthetic coding sequence
auggccucauggcuucgccgcaaacucagaggcaaacgcaggccugucauagccuucugccugcucaugauccucucugcuauggcugucacccgcuucccaccucagagaccuuccgccgggccagaucccggaccuauggagccacagggcgugaccggggcaccugcaacucauauuaggcaggcacuaaguuccagccgaaggcaaagggcacgaaauaugggcuucuggcgaucucgggcgcucccuagaaacagcaucuuagucugugccgaggagcaagggcauagagcacgaguugaucggagcagggaauccccuggaggcgacuuaagacaccccggaagagugagaagagauaucacacugucgggccacccaagacuguccacucagcacguagugcuucuacgggaagacgaggugggcgacccuggcacuaaagaucucggccauccacagcacggcagucccauucaggagacacaaagcgaagugguuacucuagucuccccauuacccggcucugauauggcggcguugcccgcauggagggccacauccggacugacucuguggccacauacugccgaggggcgagaccuccugggugcagagaacagggccuugaccggaggacagcaggcugaagauccgacauuggcuaguggcgcgcaucaguggccagguagcguggaaaaacugcagggguccguguggugugaugccgaaacucuucuuucuucuucccgaacuggaggucaggccccuccgugguuaacagaucaugauguacaaaugcucaggcuauuggcacagggugaggucguugacaaggcaagaguuccagcucauggacaagugcugcaagucggguucagcacugaggcggcucuucaggaucucuccaguccaagacugucacagcuuugcucacaggguuugugcggacucauuaagcgccccggugaucugccugaaguccucuccuuccacguggauagggugcuaggucuucgccguagucuuccugccguagcacggcgcuuucacuccccucugcuuccauacagauauacagacggcggagcucggccagugaucuggugggccccagauguucaacaccucucagauccagacgaagaccagaauagucuagcacugggaugguugcaguaucaggcacugcuggcacauuccugcaacuggccaggccaggcucccugccccggcauccaucacacagagugggcucgccuugcccuguucgacuuccuucuacagguucacgacagacuggacagguauugcuguggcuucgaaccugaaccuagcgacccaugcguggaggaacgccugagagaaaagugccagaacccugccgaguuacgucucguucacauucuugugcggagcagcgauccaucccacuuggucuacauugauaacgcuggcaauuuacaacaucccgaggauaagcucaauuuccgucugcucgagggcauagacggguuccccgaaagugcaguaaaaguguuagcuucugguuguuugcaaaauaugcuguugaaaagccugcaaauggacccuguguuuugggagagucagggcggcgcacaaggauuaaagcaaguucugcaaaccuuggaacaacgcggacagguucugcugggucacauccagaaacacaaccuuacacucuuccgggacgaagaccccuag

SEQ ID NO: 13589 - RNA, 1680 nt, Artificial Sequence
  Description of Artificial Sequence: Synthetic coding sequence
auguggaccaauuuuuuuaaacuccgccuguuuuguuguuuacuggccguccucaugguugucguccuggugauuaacgugacccaaguggaauaccuugaucaugagacagucagcgccacuuuuauugacaguuccggccaguuugugagcucacagguuacaggcaucucccggaaccccuauuguggauaugaucagcagacacuaucaucacaggaaagaauggaagaagacagucuucucgccgcccugcacagacaggugcccgaugucggaccaguacccuucguaaagaguacugacccuuccucauccuacuuugugauucugaauucugcugcauuuuucaaaguagguagccagcucgaagucuuaguccauguucaggacuuucaacguaaaccgaaaaaguaugggggcgacuaucugcaggcuagaauccacagucuaaagcugcaggccggagcaguuggcagggugguugacuaucaaaauggguuuuauaaggucuuuuucacacuucuauggccggguaaggugaaaguuucggugucacugguacacccaagugagggcauccgcgugcugcagagauuacaggaagauaaaccugaccguguuuacuucaaaucacuguuucgaucaggcagaaucagcgagacaaccgaaugcaaugucugccuuccuggcaaucugccccuauguaacuuuaccgaccuguauacaggcgagccaugguuuuguuuuaagcccaaaaaacuucccugcaguucccggaucacacauuuuaaaggcggauacuugaaaggguuauuaacagcugcugaguccgcauucuuucagucuggggugaauaucaagaugccagugaauucgagugggccugacugggugacagucauuccucgcaggauuaaagagaccaauuccuuagaacuaucccaggggaguggcaccuucccuucaggguacuauuacaaagaucaauggaggccaagaaaauucaagaugagacaguuuaacgacccagauaacauuaccgagugccuucagagaaaaguggugcaucucuuuggggacuccacgaucagacagugguucgaguaucugacaacauucgucccagaucucgucgaguuuaauuuaggaucacccaaaaacgucgggccguuucuugccgucgaccaaaagcacaacauucugcuuaaauaucggugucacgggccacccauacgauuuaccaccguuuuuagcaacgaauuacacuacgucgccaacgaacugaacgggauagucggcggcaagaauacagugguggcaauugccguguggagucacuuuucaacguucccacuggaaguauacauuagaagauugcggaacauucgacgcgcuguugugcggcugcuggaucgaucgccaaagaccgucguggugauacgcacagccaaugcccaggaacuuggucccgaaguaagccucuuuaauucugacugguacaacuuucaauuagauaccauucugcgcaggauguucuccggcguuggcguauaccuuguugaugcuugggaaaugacacuggcgcauuaccugccucacaaacuccaccccgaugaagugaucguuaaaaaucagcuggacauguuccucucuuucguaugcccauuggagaccuag

SEQ ID NO: 13590 - RNA, 3624 nt, Artificial Sequence
  Description of Artificial Sequence: Synthetic coding sequence
augcgguuaacccacauuugcuguuguugccugcuuuaccagcucggcuuucuuucaaauggcauuguguccgaacuccaauucgccccagauagagaagaaugggaaguagucuuuccagcacuuuggaggcgcgaaccuguagacccggccggggggagcgguggguccgcugauccggggugggugcgcggcguaggugggggaggcucagcccgugcucaggccgcagguuccagucgugagguccguucagucgcccccguuccacuggaggaacccgucgaaggccgcuccgaauccagacuacgcccuccccccccuagugaaggcgaagaagaugaagaguuagaaucacaggaacugccacgcgggagcucaggagccgccgcucuuuccccaggugcccccgccagcuggcagccccccccgccaccccagccgcccccgucaccuccacccgcgcaacaugcugagcccgacggugaugagguccugcucagaauuccagccuucucucgcgacuuguaccugcugcuucgacgcgacggccgguuucucgcccccagauucgcaguggagcagcgaccaaacccaggcccaggaccaacaggagccgcuucugcaccgcaaccacccgcuccacccgaugccgguugcuuuuauacgggagcuguguuacgccacccugggagucuggccuccuuuuccacuugcggcgggggacucaugggauucauccagcugaacgaggacuucauuuuuaucgaaccacugaaugacacaauggccaucacugggcauccacaccgcguguaccgccagaagaggucaauggaagaaaaagugaccgaaaaaucugccuuacauucccacuauuguggaauuauuucagacaaagguaggccgcgcucccguaaaaucgcagaaucaggucgcgguaagcgcuauuccuauaaauugccccaggaguacaauauugaaaccgugguuguugccgacccugcgaugguuuccuaucauggcgcugaugcagcccgacguuuuauuuuaacaauccugaacauggucuuuaaucuuuuccaacacaagucauugagugugcaggucaaccuacgcguaauuaagcugauccugcuucaugagaccccucccgaguuguauauuggacaccacggcgagaagaugcuugaaagcuucugcaaauggcagcacgaagaauucggcaagaagaaugauauacaccuggaaauguccacaaacuggggggaggauaugacuucaguagaugccgccauucuaauuacuagaaaagauuuuuguguacacaaggacgaaccaugcgauacaguggggauagcauacuuaagcgguaugugcucagagaagcgaaaauguaucaucgccgaagacaacggccuuaaccuggcuuuuaccauugcgcacgaaaugggacauaacauggggauaaaucacgauaaugaucacccaagcugugcugacggccuucacauuaugaguggugaauggauuaagggacagaaucucggugacgucaguuggucucgaugcucuaaagaagaccucgaacgauuucugcgcaguaaggccuccaacugccuccuccagacaaauccucaaagcguuaacucaguaauggucccuuccaaacugccaggcaugaccuacacagcugaugaacagugucagauacucuucggcccuuuagccagcuucugccaggagaugcagcacguuauuugcacaggacuguggugcaagguagagggggaaaaggaguguagaacaaaacuggaccccccuauggaugguaccgacugcgaucuuggcaaaugguguaaagcaggugagugcacgagcagaacgucggcuccugaacaccuggccggcgaguggucuuuauggucaccuuguagcaggacaugcuccgccggcauaucaucgagagagagaaagugcccaggguuggacuccgaagcucgcgauugcaacggacccaggaaacaguacaggauuugugaaaacccaccuugcccugcuggguuacccgguuucagagauuggcagugucaagcauacucuguccgcaccaguucucccaaacacaucuugcaguggcaggcaguguuagaugaggagaagcccugcgcccuguucuguucuccagugggcaaggaacaaccuauacugcuaucagagaaagugauggaugggaccaguugcggcuaccagggacuugauaucugugcaaacggacgcugucaaaaagugggaugugauggacuuuuagggucucuugccagggaagaccauugcggcguguguaacgguaacggaaagucuugcaagauuauuaagggcgauuuuaaccacacucgaggugcaggauacguggaaguucuggucaucccagccggcgcccgacguauuaaagucguugaagagaagccggcgcauagcuaccucgcccucagagacgcaggaaaacaaucuauuaauagcgacuggaaaauugaacacagcggugccuuuaaucucgcggguacuacaguccauuauguacgcagaggauuaugggaaaagauuuccgcaaaggggccaaccaccgcgccgcuucaccugcuuguacuccuguuccaggaccagaacuacggguugcauuacgaguacacgauucccagcgacccucucccugaaaaucagucaucuaaggccccagaaccgcucuucauguggacgcacacuagcugggaagacugcgacgccacuugugggggcggugagcgaaagaccacaguauccugcacuaagaucaugagcaaaaauauaucgauaguggacaaugaaaaaugcaaguaucugaccaagcccgagccucaaauuagaaagugcaaugaacagccgugucagacuagauggaugaugaccgaauggaccccuugcucucgaaccugcggaaaggggaugcaaaguaggcaaguggccugcacacagcaacucucaaauggaacacugaucagggcaagggaaagagacugcauuggucccaaaccggcaagugcccagcgaugugagggccaagauuguaugacagugugggaggcaggcguuugguccgaaugcucagugaagugcggcaaaggaaucagacaucggaccgugcgauguacgaacccacgaaaaaaguguguccugaguacaagacccagagaagccgaagauugcgaagacuauagcaaaugcuacgucuggagaaugggagacuggaguaaaugcagcauuacuuguggaaaaggaaugcaaucccgagucauccagugcaugcacaaaauuaccggaaggcacggcaacgaaugcuuuucaagcgagaagccugccgccuaucgaccgugucaccuucagccuugcaacgagaaaaucaaugugaacaccauaaccagccccagacucgcggcucuuacauuuaaaugcuugggcgaucaauggccuguuuacuguagagucauccgugagaaaaacuuaugucaagacaugcgaugguaccaacggugcugugagaccuguagagacuucuaugcccaaaagcuccaacagaaauccuag

SEQ ID NO: 13591 - RNA, 258 nt, Artificial Sequence; identical to SEQ ID NO: 11952
  Description of Artificial Sequence: Synthetic coding sequence

SEQ ID NO: 13592 - RNA, 2982 nt, Artificial Sequence
  Description of Artificial Sequence: Synthetic coding sequence
augggaucaggaagagugccaggucuuugucuucuggugcugcuagugcacgcuagggcugcccaauacucuaaagcugcucaggauguggaugaaugcguagaagggacagacaauugucauauagacgccaucugucagaauacaccacguaguuacaagugcaucugcaaguccggguauacuggagaugguaagcauugcaaagauguagacgagugugagagagaggacaacgccggcuguguacacgauugcguuaauauccccggaaacuacagguguaccuguuacgacggauuucaccuagcucacgaugggcacaacugccuagauguggacgaaugugccgaaggaaauggaggcugucaacaaucaugcgucaauaugaugggaucguaugaaugucacugcagagaaggcuuuuuuuuauccgacaaucagcauacaugcauccaaaggcccgaagaggguaugaacuguaugaauaaaaaccaugguugcgcccacauuuguagagagacuccaaagggaggcauagcuugcgagugccggcccggcuucgaauugaccaaaaaccagagagacugcaaacugacuuguaauuaugguaauggaggaugucagcauacaugcgacgauacugaacaagggccaagaugcggaugccauaucaaguuuguucugcacacagaugggaaaaccugcauagagacuugcgcuguuaauaaugguggaugugauuccaagugucacgacgcagccaccggcguucacuguacaugccccgugggcuucaugcuucagccagaccguaagacgugcaaggacauugaugagugucggcugaacaauggaggaugugaucacauuugucgcaacacagucggauccuuugaaugcaguuguaaaaaaggguacaagcuguuaaucaaugaaaggaacugccaagauaucgacgaguguaguuucgacaggaccugcgaccauaucugugugaauacaccggggucauuccaaugcuuaugucaccgcggcuacuuguuauaugggauuacucauuguggcgauguugacgagugcaguauuaaccgaggcggcugcagauuuggauguauaaacacuccuggcucauaccagugcacuugcccagcaggccaaggccgucugcauuggaacggaaaagauuguacagaaccacugaagugucagggcagccccggagcgagcaaggcuaugcugagcuguaaucggucaggcaaaaaggacacaugugcacugaccugcccuucccgagcccgguuccuuccugagagcgagaacggauucacagucucaugcggcacgccaagcccuagggccgcacccgcucgugcaggucacaauggcaauuccacgaacucuaaccacugucacgaagccgcgguacuuucaauuaagcagagagcuuccuucaagaucaaagaugcaaaguguagguugcaccuucgaaauaaagguaagaccgaggaagcuggcagaaucacaggaccaggaggagcgccuugcagugaaugucaagugacuuucauccauuugaagugcgacagcaguagaaaaggaaagggccgaagagcacggacacccccggguaaagaggucaccagacucacgcuggagcuggaggcugaggucagggcugaggagaccaccgccucuuguggucugcccugucuaagacagcggauggaacgacguuugaagggcucauugaaaaugcuaaggaaaucaaucaaucaagaccgguuucugcuacgacuugccggccuggacuacgagcuugcccauaaaccaggucucguggcaggggaaagggcagagcccauggaauccugccgcccuggacagcacagagcagguacaaagugcgucucuugcccgcaagguacauacuaccauggacagacugagcagugcgucccuuguccugcuggaacuuuccaagaaagagaaggccagcugucuugugaucuuugccccggcuccgaugcccaugguccacugggagccacuaacgucaccaccugcgccggucaguguccccccggucagcauucuguugauggcuucaaacccugccaaccgugcccccgaggcaccuaucagcccgaagccggccgaacacuuugcuuuccuugcgguggaggucugacaacaaaacacgaaggcgcuaucucuuuucaagauugugauacuaaggugcagugcagccccggacacuacuacaacaccagcauucacagauguauucgcugugcaaugggaaguuaucaacccgauuucaggcagaauuuuuguucccgcuguccugggaacaccucaacagacuucgauggaucuacuagcguugcccaguguaaaaauaggcagugugguggugagcugggcgaauucaccgguuauauagaaucaccuaacuauccuggaaacuauccugcuggcguggaaugcaucuggaacauaaacccacccccgaaaagaaagauucucauaguggugccugagaucuuuuuaccuuccgaggaugaauguggcgauguucuugucaugagaaagaacucuaguccuuccaguauuacaacuuaugaaacuugccagaccuaugagagaccgaucgcuuuuacggcuaggucccggaaguuauggaucaacuuuaaaacuucugaagcaaauucugcucgaggauuucagauaccguaugugaccuacgaugaggacuacgaacagcucguggaggacauaguuagggacggcaggcuguacgcaagcgagaaccaucaggaaauucucaaagacaagaaauuaaucaaagcauuuuuugaagucuuggcacauccucagaauuacuuuaaauauaccgaaaaacauaaagaaaugcugcccaaaucauucauuaaguugcuaagaagcaagguauccaguuuccuuagacccuauaaguag

SEQ ID NO: 13593 - RNA, 4773 nt, Artificial Sequence
  Description of Artificial Sequence: Synthetic coding sequence
augccuggcggcgcuugcguccuggugaucgcccucauguuucuggccuggggcgaagcacaagaauguucacccggaggacaucaguuuuuacggagcccauaucgaagcguccgguucgacuccuggcauuugcaacaguccgcaguccaggaccugauuugugaucacucacuuucacccggaugguaccgguuucuaauccuugaccgccccgcugaaaugcccacaaaaugcguugagaugaaccauuguggcacccaagcucccauauggcugagccugagagacagcgaaacuuugccuucacccggggagaucaaacagcucacagccugugcaaccuggcaguuccuguuuuccaccaccaaggacuguugucuuuuucaaauucccgugagcgugcgaaauuguggcaauuuuuccguuuaucugcugcagccaacacaaggaugcauggguuacugugccgaagcuaucagcgaugcgagauuacauccgugugguagugaugaaaccgagacaggcggggauugugugagacagcucgcugcgagccugccgccgccuccagccggccggccagaagugcuugucgaacugauugaaagccgacuguucugucgcugcaguuuugacgugccugcaacaaagaauucagucggguuccauauugcguggucucgccugucaucccaagaagugaaggaagaguugacccaagaaacaaccgugcaagccuuuucacuacuggaguuggacgguaucaaccugcgccugggcgauagaauuuucuguagugcuaguguuuucuuuuuggaaaacccacacguccaguccguugcuaucgaaagccaagaauucuuugcuggauuuaaacuacagccugagcugagcaccauaagcgaggacgggaaagaauacuauuugcgaauugaaucaaccgucccuauuauuuguuccgaauuuuccgaguuagaccaggaaugcaaaauuagcuuaaagcuuaagaccauagggcaggggcgcgaacaucugggccugaaucucgcacucucaucuugucauguggaccugcugcaaacauccagcugcgcaaauggcaccugcucucauacauuugucuacuacacugcugugaccgauuucagucgagacggggauaggguaagcaauauagugguccagccaauugugaacgaagauuuccuguggaauaacuacauucccgacaguauucagauuaagguuaaggacgucccuaccgcauauuguuauacauuuacugacccccacauuauuacuuucgacggccgaguauaugauaacuuuaagaccgggacauucgugcuguauaagagcaugucacgcgacuucgagguacacguccggcaaugggacugccgcucuuuacauuacccagucagcugcaauuguggauucguagcccaggaagggggagauaucguuaccuucgacauguguaauggucaguuaagagaaucccaaccuuaccucuucaucaaaucccaagacguuacccguaacauaaagaucucggagaguuaccuuggccgcaaaguuacaauuugguuuagcucgggcgccuucauccgggccgauuugggggaguggggcaugucccuaacuaucagggcucccuccguagacuauaggaacacucuuggauugugcggcaccuuugaugagaauccagagaaugauuuucacgauaagaauggaaugcagauagaucagaacuuuaauaauuacguggccuucaucaacgaauggcguauccuacccggaaagagcaugucugauacacuuccagucuccaugaccagccccgguaagcccaguuauuguaguugcucccuggauaccgcagccuaccccucaagcgaggaucucgacuccgucaguaggucugaaauagcccuggguugcaaggaucugaaucacgugucuuugucuagccuuauuccagaacuugacguuacaucagaauacauuaacagcgacacuuuaguucgagagaucaacaagcacacaagccccgaagaauacaaccuuaaucucuuccugcaggagaagaagcauauuaaccuuacaaaauuaggccuuaacgugcagaaacauccuggaaacgagaaggaggacaguuuacaguaccuugcgaauaaaaaguacacucagggcagaggaucucacagucaggagaugcgguacaacaggcagaauagauggaaaagacagaacuuccacgaauucccaccccuauuugcuuuucccagucugucacaaacggaucucgaagagcucacuuauuucuuuccagaggaccaugccgaagauguucagcaggaguucuuuccaaguuggcccacucccuccggccuuaccgaguauucuacacuuacccuuugucaggagacccuugcaaauaguuccauugggagacucugccuggcuuuccuuggcaaaagguuggacagcgucaucgaaauguguguaaaggauguguugcuuaaagacgacuugucgugggccgaggcuggcgucgcccugcucgagaacgagugcgaaaagagaauugucgaagaaggcaaauacaacacagaggaguauggaacauccauugaagauauccugucgguccugaagugccccaaucuguguucuggaaacggucaauguauggaaugggggugugcuuguuccccaucguucucuuccuaugauuguucugauucauacgacaaagcuccugagaucaccgaacucggcaacgcuggcuucugcgacguccagaaguacaacugcaugaugguacgcgucuucggaaagggauucaaggaauuaccuaguauuaaaugugaagugacuaagcuccaauauaacucaagugaauggaugccgggcgagcccauuuacacccagacaguguuccauaacucuagagcaguggauugucagcucccuaccgauguccagcaguucgauacaauggaucuugucggggggaagccaaccgggaaauggcaguuaaaggugaguaaugacggcuacaaauuuucuaauccaaagauaacagugaucuaugacggagcuugucagguuugcggauuguacaagaaugauaguuguaccauaaaggagaaugugugcauaauugauggguuaugcuaugucgagggcgacaagaacccaacuuccccgugccugaucugccggccaaaaauaagucgcuucacauggagcuuucuugagaauaaccaaccaccugugauacaggcuuuacaggacaaacuccagaccuuuuacggcgagaacuucgaguaucaauuuguugccuucgacccggagggauccgauauucauuucacacuagacaguggucccgaaggggccucagugagcucugcaggacuguuuauguggaagaccgaucuccucacaacacaacagaucacaguucgacuuaacgacgauugcgaugccgaaaccagaguuacgauugaggucacagugaaaucgugcgacugcuugaaugggggcucuugcguaucugaccggaauuuuagccccggauccggugucuaucuguguguuuguuugccaggauuucacggaucauugugcgaaguagacauuuccgguugccaauccaacccuugcggccucggcagcuauauuucaggauuucauucuuacuccugcgauugcccaccugaguuaaagguggaaacccaauucgugaaccaauuuacgacacagaccgugguguuaacuagaagcgacaagagcgugaacaaagaagaggacgauaagaaugcucagggaagaaagagacacgugaagccgacaucagggaacgccuucaccauuugcaaguaccccugugggaaaaguagagagugcguggcccccaauaucugcaagugcaaacccgguuauaucggcagcaacugucagaccgcccugugugacccagacuguaaaaaucacggaaaguguaucaagcccaacauuugucaguguuuaccaggacaugggggugcaacuugugaugaggaacauuguaauccucccugucagcauggcggaacaugccuagccggaaaucuuugcacaugccccuacggcuuugucggccccagaugcgaaacuaugguuuguaaucggcacugcgaaaaugggggacaaugcuuaacaccagauauuugccaauguaaaccggguugguacggccccacauguucaaccgcccugugugauccugugugucucaacggugggagcugcaauaaacccaauaccugucucugucccaacggauucuuuggcgaacacugccagaaugcuuucugccaccccccuugcaaaaacggaggacauugcaugaggaacaaugucuguguuugccgagaaggguauacaggcaggcgguuccaaaagaguaucugcgaucccacuuguaugaauggaggcaaaugcgugggccccucaaccugcaguuguccaagcgguugguccgguaaaagguguaacacgccaaucugccuccagaaauguaagaacggaggagaauguaucgccccuucaauuugccauugucccaguucaugggagggcgugagaugucagauccccauauguaaucccaaaugucuuuauggcggaagguguauuuucccgaacguaugcucuugcagaaccgaguauagcggagugaaaugcgagaagaagauccaaauucggagacacuag

SEQ ID NO: 13594 - RNA, 624 nt, Artificial Sequence
  Description of Artificial Sequence: Synthetic coding sequence
augaguaccaagcccgacaugauucagaaaugcuuguggcuagaaauacugaugggcaucuuuauugcugggacuuugagccucgauuguaaccuacugaacgugcaccugagaagggucacguggcagaacuugcgccacuuauccuccauguccaauuccuuuccugucgaaugucucagagagaauauugcguuugagcucccacaggaauuccuucaguauacccaaccuaugaaaagagauaucaaaaaagccuucuacgaaaugucacugcaagccuuuaauaucuuuucccagcacaccuucaaauauuggaaagaacgccaccugaagcaaauacagaucggacucgaucagcaagccgaguaucugaaccaaugccuggaagaagacaagaaugagaacgaggauaugaaggaaaugaaggagaacgagaugaagccuagcgaagccagagugccucaauuaagcagccuugaguuacggcguuauuuccauagaaucgacaacuuucucaaggaaaagaaguauagugacugugccugggaaaucguuagaguggaaauucggcggugcuuauacuauuucuauaaauuuacagcccucuuuagaagaaaauag

SEQ ID NO: 13595 - RNA, 939 nt, Artificial Sequence
  Description of Artificial Sequence: Synthetic coding sequence
auggagucagcuuuacccgcggcaggguuuuuauacuggguuggagcuggcacugucgcauaccucgcacugaggauuucauacagccuguuuacugcguugagaguguggggggucggcaaugaggcaggggugggucccggccuuggagaaugggccgucgugacuggaucaaccgacgggauuggcaaaucauacgcugaagagcuugccaaacaugguaugaagguaguccucauuuccagguccaaagacaagcuggaucaagucaguucagagauaaaggaaaaguuuaaaguugaaacaaggacaauugcugucgacuucgccagugaagacauuuaugauaagaucaagacaggccuggcuggguuggaaaucgguauccuggugaauaacguaggcaugucuuaugaauaccccgaguacuuucuagauguacccgaccuggauaacgugauuaagaagaugaucaauauuaauauacucagcgucugcaaaaugacacagcucguccugccuggcaugguagaacgcaguaaaggagcuauccugaacaucucaucugguaguggcauguugcccguuccccugcugacgaucuauucugccaccaaaacauuugucgauuucuuuucucaaugccuccacgaggaauacagaagcaagggcguguuugugcagagugugcugccuuauuucguugcuaccaaacuggccaaaauuaggaaacccacccuagacaaaccaagcccagaaacauucguuaagagugcuauuaagaccguaggccuucagucccgcaccaacggauaccugauucaugcucuuauggguagcaucaucagcaaucuuccauccuggauuuaucucaagaucgucaugaauaugaauaagagcacuagagcccauuacuugaagaaaaccaaaaagaacuag

SEQ ID NO: 13596 - RNA, 2214 nt, Artificial Sequence
  Description of Artificial Sequence: Synthetic coding sequence
auggaacucgguuguuggacucaacucgggcugaccuucuugcaauuacuguugauaagcucucugccucgagaauacaccguuaucaacgaggccugucccggggcugaguggaauauuaugugccgcgaguguugcgaguacgaucaaaucgaaugcguauguccagggaaacgcgaaguggugggcuauacaaucccaugcugucggaaugaagaaaacgagugugauuccugccuaauucauccaggcuguacaaucuuugagaacugcaagucaugucgcaaugggucguggggcggaacgcucgacgacuucuacgucaagggguucuauugugcagaaugccgcgcugggugguauggcggagauuguaugagauguggccaggugcugagggcccccaagggacagauucugcuugaaaguuacccucugaacgcucacugcgaguggaccauucaugcuaaaccaggcuucguuauucaacugcgauuugugaugcuaucuuuggaguuugacuacaugugucaauacgacuacguggaagugagagauggagacaaccgcgacggucagauuauuaaaagagucugugggaaugagaggccugcuccaauacagucaauugggucaucccuacacgugcuauuccauuccgacgguuccaagaauuucgacggcuuccaugcgauuuacgaggaaauuacagccugcuccuccagccccugcuuccacgacggaacuuguguuuuagauaaggccggaucauauaaaugugcuugccuugcugguuauaccggacagaggugcgagaaccuguuagaggcuggcaaaagcaagaucaaggcaucagaggauucccucucuguucuugaggaaagaaacugcagcgauccugggggcccagugaacggcuaccagaagaucaccggcggacccggacucaucaacgggagacacgcuaaaauuggaaccgucgucucuuucuucuguaacaacuccuauguguugagugguaaugaaaaaagaaccugccagcaaaauggugaauggagcggaaaacagccaauuuguauuaaggcaugcagggagccaaagauaagcgauuuaguccgucguagaguccuaccuaugcaaguacaguccagagagacuccucuucaccaguuauacucugccgcauucucgaaacagaaacugcagucagcaccaaccaaaaaacccgcauuaccauuuggcgaucucccuaugggauaccagcaccugcacacacagcuccaauacgaaugcaucagucccuuuuaccggcgacucggaucuucaaggaggacgugccugagaaccggaaaauggagcggucgcgcgcccaguugcauuccuaucuguggaaagaucgaaaacaucaccgcgccuaaaacacaaggacugagauggccuuggcaggccgcuaucuaccgccgcacaucgggggugcacgaugggucacuucauaagggugccugguucuuaguuugcuccggugcccucgucaaugaaagaacaguaguggucgcagcacacugugucacugaucuggggaagguuaccaugaucaaaacagccgaccucaaaguuguucugggcaaguucuaccgcgaugacgaccgagaugaaaagacuauccagucucugcaaauuucugccauuauacuucacccuaauuaugauccaauacuccuugacgccgauaucgcuauccuuaagcugcucgacaaagcuagaauauccacucgcguccagccuaucugccuggcagcaucacgcgaucuuucaacuagcuuucaggagucucacauuacuguugcagguuggaacgugcuagccgacguaagaagcccagguuucaaaaaugacacccuucgaaguggcguugucagugugguagacuccuugcugugugaagaacaacaugaagaccacgggaucccuguguccgucacagauaacauguucugcgcuuccugggagcccaccgcccccuccgacaucuguacagccgagaccgguggcaucgcagcuguguccuucccugggagagcuuccccagagcccagauggcaucuuaugggguuaguuuccuggagcuacgacaaaaccugcagccaucgucuuucuacugcuuucacuaaggugcuuccuuuuaaggacuggauagagcggaacaugaaguag

SEQ ID NO: 13597 - RNA, 1503 nt, Artificial Sequence
  Description of Artificial Sequence: Synthetic coding sequence
augggcaccgcuagaugguuggcccugggaucucuguuugcccuggcuggacuguuggaggggcgcuuaguaggagaggaagaggcaggauuuggggaaugcgauaaguuuuuuuacgcggggacaccgccagccggccuugcugccgacagccaugucaaaauuugccagagagcagagggggcugagagauuugcuacccuuuacucuacaagggacaggauccccgucuauagugcauuuagagccccucgaccggccccgggcggugcugaacaaagguggcugguggaaccucaaaucgaugaccccaauucuaaucuggaagaagccaucaacgaggcugaggcaaucacgucggugaacucccucggaaguaagcaagcucugaacaccgauuaucuggacagcgacuaccaaagaggccaguuguaccccuuuucucuuucaucugaugugcaagucgcaacauucacccugacaaauucugccccaaugacgcaaucauuucaggaacguugguacgucaaucuccacucucugauggaucgagcacugacaccccaaugcggcucaggcgaggauuuauauauacugacagggaccgucccuuccgacuaucgggugaaagacaagguggccgugcccgaauucgucuggcuugcugcaugcugugcuguacccgggggcggaugggccaugggauuuguaaaacacacacgggacagugauauaaucgaagauguuaugguuaaggaucuccagaaacucuugccuuucaacccucaacucuuccagaauaauuguggcgagacagagcaagacaccgaaaagaugaaaaagauucuagagguugucaaucaaauucaggaugaagaaagaaugguucaaucccagaaaagcucuucaccccugucauccacacgcucaaagaggucuacucucuugccacccgaagcuagcgagggaagcagcaguuuucuuggcaagcucaugggauucaucgcaacaccuuucauaaagcuguuucaacugauuuacuaucuuguuguggcaauucuuaagaauauuguuuauuuucucuggugcgugacaaaacagguaaucaaugguauugaaagcugucuguaucgucugggaagcgccacuaucucguauuucauggcaaucggagaagaacuugugucaauuccuuggaaaguucugaagguggucgccaaggucauccgggcccuucugagaauccuguguugucuuuugaaagcuauaugcaggguauuaaguaucccagugcguguucugguagacguugcaacuuuuccuguguauacgaugggagccauuccaaucguguguaaagauaucgcccugggacugggagguacagugucccuccuuuucgacaccgcauuugggacccugggaggccuguuucaagugguguucucuguauguaaaagaauuggguauaaaguuaccuuugauaauucuggugagcuguag

SEQ ID NO: 13598 - RNA, 300 nt, Artificial Sequence; identical to SEQ ID NO: 11959
  Description of Artificial Sequence: Synthetic coding sequence

SEQ ID NO: 13599 - RNA, 390 nt, Artificial Sequence
  Description of Artificial Sequence: Synthetic coding sequence
augccaauggcaucaccccagacgcuuguccuauaucuccuaguccuggccgugacagaggcauggggccaggaagcggugauccccgguugccaccuccauccguucaauguaaccguaagaagcgauagacagggcaccugucaagguucacauguagcgcaggccuguguuggacacugugaauccuccgcguuuccauccagauacuccgugcucguugcuucuggauaccggcacaauaucacuuccgugucacaauguuguacuauuucuggcuuaaagaagguaaaaguccagcugcagugcguggggaguagacgagaagagcuggagaucuuuacagccagggccugucagugcgacaugugcagauugucaagauacuag

SEQ ID NO: 13600 - RNA, 1965 nt, Artificial Sequence
  Description of Artificial Sequence: Synthetic coding sequence
auggcaaaauucggaguucaccgcaucuugcugcuggccauuucauuaaccaaaugucuggaauccacuaaacugcuggccgaccugaagaaaugcggcgaccucgagugugaggcgcugaucaaucgagucagugcuaugagagauuauagaggcccugauuguagauaccugaauuucacuaaaggagaggagauuagcguguacguaaaguuagccggagaacgugaagaucugugggcaggcucaaaagggaaagaauucggauacuucccuagggacgcgguccagauugaagaaguauuuauuagugaagagauccagaugagcacuaaagaaucugauuuccugugucuguuaggcgugaguuacacuuuugacaaugaagauagcgaauuaaacggagauuauggagagaauaucuacccauacgaggaggauaaggacgaaaagaguagcauauaugaaucagauuuccagauagagcccggcuuuuacgccaccuacgaaucuacgcuguucgaagaccaggucccugcuuuagaggccccagaagacauaggcuccacauccgaaucaaaggacugggaggaggugguuguagagucuauggagcaagaucgcauucccgaggugcacguacccccaucuagugcaguuucuggcgugaaagaaugguucggauuaggcggagaacaagccgaggaaaaagccuuugagagugucaucgaaccaguucaggaaucaagcuuuaggucacguaagauugccgucgaagacgaaaaugaccuugaagaguuaaacaauggagagccucagacagaacaucagcaggaaucagagucggagaucgacucagucccgaagacgcagagcgaacuugccagugaaagcgagcacauuccuaaaccacaguccaccggcugguuuggaggcggcuucacuagcuaccucggauuuggagaugaagauaccggacuagagcugaucgcagaagaauccaacccuccccuccaagacuucccuaacagcauuucaucagauaaggaagcaacgguccccugcaccgagauucuuaccgaaaagaaggauacaaucaccaacgacucccugucacugaagccaucuugguuugauuucggguuugcaauccugggcuuugccuacgccaaagaggauaaaaucaugcuugaugaccgaaagaacgaagaggacggcggcgcagaugaacacgaacacccacugacaucagaauuagaccccgagaaagagcaggaaaucgaaaccaucaagauaaucgagacugaggaucagauugacaaaaaacccguauccgagaagacagaugagagcgacaccauuccuuaccugaaaaaguuucuuuacaacuuugacaauccuuggaacuuccaaaacaucccaaaggaaaccgaacucccuuucccuaaacaaauucuggaccaaaacaacgugaucgagaacgaggaaacaggcgaauucucaauugauaauuaucccacagauaacacaaaggucaugauuuucaaaagcucuuauagccucuccgauaugguguccaacauugaacucccuacaaggauccaugaggaagucuauuuugaaccaucuuccagcaaagacucugaugagaauucuaagccaucgguagacacagaaggaccugcccuaguagaaauugaucgaucuguggaaaacacccugcuuaacagucaaauggucuccacagacaacucacugucaucacagaauuacauuagccaaaaagaagacgcuucagaauuccaaauccucaaguaccucuuccagaucgacguuuacgacuuuaugaauagugccuuuuccccuaucguuauccuuacugagcgcgucuccuuaccuuuuaaaccuuuugccaucauccuacccauucuucucaacauuagaguggcuacaaaauauguuuag

SEQ ID NO: 13601 - RNA, 1152 nt, Artificial Sequence
  Description of Artificial Sequence: Synthetic coding sequence
auggcuggcaucccuggucugcucuuuuugcuguuuuuccuuuuaugcgcagucggucaagugaguccuuauagcgcccccuggaagcccacauggcccgcauaucggcugcccgugguuuuaccacagucaaccuugaaccuggccaagccugacuuuggagcagaggccaagcuggaagugucaucuucgugcggaccccaaugccauaaaggaacaccccucccuacuuacgaggaggcaaaacaguaccugucuuacgaaacauuguaugccaacggcucuagaacugaaacccaggugggcaucuauauucucucuucaucuggugauggugcacagcacagagacucuggaaguuccgggaaaagucguagaaagagacaaauauacggguaugauucccgguuuuccaucuucgguaaagacuuuuuacucaauuaucccuuuucuaccuccguaaagcuuucuacuggguguaccgggacccugguggcugagaaacacgugcucaccgccgcucauuguauccaugacgggaagaccuauguuaaaggcacgcagaagcuuagaguuggauuccugaaaccaaaauucaaagacggaggacgcggcgcaaaugacucaacuucggcuaugccugaacaaaugaaauuccaguggauccgugugaagcgaacgcaugucccuaagggcuggauuaaggguaacgcaaaugauauuggaauggauuaugacuaugcccugcucgaacugaagaaaccucacaaacguaaguucaugaagaucggcgucuccccaccugcaaagcagcuuccaggcgguaggauucacuuuaguggauaugauaaugacagaccugggaaucucguguaucgcuucugugaugugaaggacgaaacuuaugaucucuuguaccagcagugcgaugcucaaccaggggccuccgggaguggaguguaugucagaauguggaaaagacagcagcagaaaugggagcgcaaaaucauuggaaucuucucaggccaccagugggucgacaugaacggaaguccacaggauuuuaacguggcugugcgaauuacaccacugaaauaugcucaaaucuguuauuggaucaaaggcaacuaucucgauugccgcgaagguuag

SEQ ID NO: 13602 - RNA, 1662 nt, Artificial Sequence
  Description of Artificial Sequence: Synthetic coding sequence
augaagugguguuggggcccugugcuguuaaucgcgggggccaccguguuaauggaggguuugcaggcugcacagagagcguguggccagagagguccugggccuccaaagccucaagaagguaauacuguuccuggggaauggcccuggcaagcuucugugaggagacagggugcacacauaugcagcggcagccugguagcugacacuugggugcuaaccgcggcccauuguuucgagaaggcugcagccacugaacucaauucuugguccguaguacugggaagccuccagagggaaggguuauccccgggagccgaagaaguugggguggcagcccugcaauugccccgagccuauaaucacuauagccaggguucagaccucgcccugcugcagcuagcacacccaaccacgcacaccccucuuugccuaccucaaccugcacaucgauuucccuuuggcgccucguguugggcuaccgggugggaccaggauacaagcgacgcgcccgguacacuuagaaaucugagacucaggcugauuucuagaccgacuugcaacugcaucuacaaucaacuucaccaacggcaucugucgaacccagcccggccuggaaugcugugcggaggcccccagcccggaguucagggcccuugucagggagacuccggcgguccaguacuuugccucgagccugacgggcacuggguucaagcaggaauaaucucuuuugccuccaguugcgcacaagaggacgcucccguacuucuuacuaauacugcggcccacucaucguggcuacaggcacgaguccaaggugcugcauuccuagcucaaucacccgaaacuccagagaugucugaugaagacuccugcguugcuugcggaagccucaggaccgccggaccgcaggcaggggcuccaucgccuuggccaugggaggcuagacugaugcaccaagggcaguuggcaugcggaggugcccugguauccgaagaagcuguacugacugcugcacauuguuucauaggacgucaggccccugaggaauggucuguugguuuaggaacaagacccgaggaguggggccugaaacaacugauauuacacggcgcuuauacacaccccgaaggcggguaugauauggcuuuacugcuguuagcccagccagucacucugggagcuucucugagaccgcugugucuccccuauccagaccaccaccugcccgauggcgagcgcggcuggguucuaggucgagcucgaccuggugcggguauuaguucacuacaaacuguaccagucacacugcugggcccaagggcauguaguagacuccaugcggcaccugggggcgacggaaguccgauucugccuggcaugguaugcacaucugcagucggcgaacuccccucaugcgaaggacugucaggagcuccacuggugcacgaagugaggggaacuugguuccuagccggucugcacuccuucggcgacgcaugccagggaccagcccgucccgccguauucacagcauuaccugcauacgaagauugggucucgagccuggacuggcaaguuuacuucgcagaggaacccgaacccgaggccgaaccgggaaguugucuugcaaacauuucucaaccaacuucauguuag

SEQ ID NO: 13603 - RNA, 936 nt, Artificial Sequence
  Description of Artificial Sequence: Synthetic coding sequence
augggaauuauacaauccauacucgccaccagccgcgacuguuauuccuuuaaaaagaagccuauccccaagaaaccuaccauguuggcccuugcaaagauccuccuuauuagcacauuauuuuacucguuguugucuggaucgcacggcaaagagaaucaggacauuaauacaacgcagaauauugcagaagucuuuaaaaccauggaaaacaaaccuauuucgcucgagagcgaggcaaaucuaaacucugacaaggaaaauaucaccacuagcaaccuuaaagccagucacuccccuccuuugaaccuccccaacaacucccaugggaucacugacuuuuccucuaacagcagcgcugaacauucacugggcagccuaaaacccacuuccacuaucagcacaaguccuccacuaauccacaguuucgugucuaaagugcccuggaacgcuccgaucgccgacgaagaccugcuacccauauccgcccauccuaacgcaaccccagccuuaagcagcgaaaacuucaccuggagucugguuaacgauacagugaaaaccccagacaauucuucaauuacaguuagcauccugagcagcgaaccuacuuccccaagugugacaccccucaucgucgagccaagugguugguugacaacaaacucugacucuuucacugguuucacacccuaccaagaaaaaacuacacuacagccuacgcugaaguuuacuaauaauucuaagcuuuucccgaauacguccgauccgcagaagguccuaagguuagacaacgcacccgagcccuaugacgucucuuuuggcaacagcuccuacuacaacccuacgcucaacgacagcgcaaugcccgagagcgaagagaacgcaagagauggcauccccauggacgauauccccccucugagaacaucuguguag

SEQ ID NO: 13604 - RNA, 3120 nt, Artificial Sequence
  Description of Artificial Sequence: Synthetic coding sequence
augcagaguagacugcuccugcugggugcuccagggggacacggcgguccugcuagccgccgcaugcgguugcuccucagacaggugguacaaaggcguccuggcggcgaucgccagcggccagaggugaggcuccuccaugcaggguccggcgccgacaccggagacacaguuaacauaggcgacgugucguauaaauuaaaaaucccaaaaaaccccgaauuaguaccacagaacuacauuuccgacucacucgcacaguccguuguucaacaucuucgcuggauuaugcagaaagaucuucugggacaagacgucuucuuaauaggacccccgggaccucuuagacgcaguaucgcuaugcaguaucuugaacuuacaaaacgcgagguggaguauaucgcacucuccagggacacuacugaaacagauuugaagcagaggcgggaaauccgugcggggacugcuuuuuauauugaccagugugcggugcgugccgccaccgagggcagaacccuaauauuagagggacuugaaaaggcggaacggaauguauugccaguuuugaauaauuuguuggaaaaccgcgaaaugcaauuggaagacggacgguuccuuaugucagccgagcguuacgacaaacuguugcgggaucacacgaagaaagagcuggacaguuggaaaauugugagaguguccgagaauuuuagagugaucgcccugggccucccaguuccccguuauaguggaaacccccuggacccaccccuccgcagccguuuucaggcccgagacauuuauuaucuccccuucaaagaucagcucaaacuguuguauucuauaggugcuaauguuuccgccgagaaaguuucccaguugcucuccuucgcaacaacccuuugcagucaggaaucuuccacacuuggccuccccgacuuuccacuagacucccucgccgcagcagugcagauccuggacucauucccuaugaugccuauuaagcaugcuauccaauggcuguacccuuauuccauucuccucggucacgaaggaaagauggccguagagggugucuuaaagagauuugaacuucaggacaguggaagcucacugcugccuaaagagauaguuaaaguagaaaagaugauggagaaccauguaucacaggcauccgugacuauccgcaucgcugacaaggaagugacuaucaaggugccugccgguacucgccuacugucucagcccugugccucugaucgauuuauccagacucugucccacaaacagcuacaggccgagaugaugcaaucccacauggugaaggauauaugcuugauagguggaaaaggcugcggaaagaccgugaucgccaaaaauuucgcugacacccucggcuauaauauagaacccaucaugcucuaccaggacaugacugcccgugaucuacugcagcagagguauaccuugccuaauggagauaccgcuuggagaucaaguccccucgucaaugcugcacuugaggguaaacugguucuacucgacggcauucaccgagucaacgccggcacucuggcugugcugcagcgcuuaauccacgaccgagaacuuucccuuuacgaugguagccgccuacugagggaggauagauacaugaggcuuaaagaagaacuacagcugucggaugagcaauuacaaaagagaucuaucuuuccaauccaucccucauuccgcaucaucgcccuagcagaaccacccgugauugggucuacagcucaccaguggcucggaccagaauucuuaacaauguuuuuuuuucauuauaugaaacccuuggucaaaucggaagaaauucaggugaucaaagagaaggugccaaaugugccccaggaagcacuggauaagcuguuaucuuuuacacauaagcuccgggagacccaggauccuaccgcucaaucccuagccgcgucucucucuacacgacaacuucuacgcaucagcaggaggcugucccaguauccaaaugaaaaucuacacucugcuguaacaaaggcaugucuuucuagauuucuucccucacucgcacgcucagcucucgaaaaaaauuuagcagacgccaccauugaaauuaacacagacgacaaccucgaaccugagcugaaagacuacaagugugagguuaccucagggacacuuaggauaggugcugugucugccccuauuuacaaugcccaugagaaaaugaaggugccugaugugcuuuuuuacgauaauauucaacaugugaucgugauggaagauaugcuaaaagacuuucugcucggggaacaucuccuguuggucggaaaccagggcguggguaaaaauaagaucguugaucgcuuccuccaucucuugaacagaccccgcgaguauauucaacuucauagagacaccacugugcaaacucugacccuccagccuucggugaaagacggacuuauaguguaugaggauucccccuuggugaaggccguuaaacucggacauauucuggugguggaugaggcagauaaagcacccacaaaugucacuugcauuuugaaaacacugguggagaacggagagaugauccucgccgaugguaggcgcauuguggcaaauagcgcuaaugugaaugggagagaaaaugugguaguaauucaucccgauuucagaaugauaguucuggcuaaucggcccggcuuccccuuucugggaaacgauuucuuuggaacauugggggauaucuuuucuugccaugcuguugacaacccaaagccucauucagaacuugaaaugcugcgccaauauggcccaaacguaccugaaccgauacuccagaagcuaguggccgcauuuggagagcugaggucccuagcugaucaaggaauuauuaacuauccauacuccacacgggaaguggucaacaucgucaaacaccuacagaaauucccaacugaaggccuuucaucgguggugaggaacguauucgacuucgauucuuauaauaaugacaugagagaaauucugauaaauacccugcacaaauauggaaucccgaucggcgcaaaaccaacaucuguccagcuagccaaagaauag

SEQ ID NO: 13605 - RNA, 801 nt, Artificial Sequence
  Description of Artificial Sequence: Synthetic coding sequence
augcgccuucuauuucuagccguccugcguccccacaccgguaacgccguuacagcucagcgggugcgagcccaucuggaggcggcuggacaugugugcgugcucaaagaugcuuuugacuucgaaucucgcuccgaaauagccaaccuuauacuugccgagaacugcgaggccgcacucgccuuacaccuguacagagggggaagacuucuucaagggcaucggauaccauucggggucauuuucggcgggacagacguuaacgaagaugccaaucaggcugagaagaacacagugaugggaaggguacuggaagaggcucgguuugcuguugccuuuacagagucaaugaaggagauggcccaggcucaauggguggaccccgucuucacucgcgagguuaaggccaaggugaaacgggcugccggaguccgauugaucggugaaaugccccaagaggaccuucaugcugucgugaaaaacuguuuugcuguggugaacucaucagucucugaaggaaugagugccgcuauccucgaggcaauggaccucgaaguuccuguucucgcucguaacaucccuggaaaugcagcaguggugaaacacgagguaacgggguuauuguucuccaacccucaagaguucguccaucuagcgaaacggcucguguccgacccugcacuggagaaggagauuguagugaacggcagagaguaugugcguauguaucauucguggcagguugaacgugacaccuaccaacaguugaucaggaaguuagagggaagcacagaagauuag

SEQ ID NO: 13606 - RNA, 2478 nt, Artificial Sequence
  Description of Artificial Sequence: Synthetic coding sequence
auguuuucaggguucaacguguucagggucggcaucagcuucgucaucaugugcaucuuuuauaugcccacagucaacagucuccccgaacucagcccucagaaauacuucaguaccuuacagccuggaaaagcuucucuggcauacuuuugucaagcugauucuccucgcaccuccgucuuucuggaagaacugaaugaagcaguccgcccccuccaagauuaugguauuucgguagcgaaaguaaacugcguuaaagaggaaauauccagauauugugguaaggagaaggacuuaaugaaagcuuaccucuucaaggggaacauucuucugcgugaguucccuaccgauacucuguucgacguaaacgccaucguagcucacguccuuuucgcgcuguuauuuagugaagugaaguacauuaccaaccuggaggacuuacagaauaucgagaacgcgcuuaaaggcaaggcuaacaucauuuuuuccuacguacgggccaucgguaucccagaacaucgagcugugauggaagccgcauucguguaugguacgaccuaucaguucguccuaaccaccgaaaucgcacugcuugaaagcaucggcucagaagauguugaguaugcccaccucuacuuuuuccauuguaagcucgugcucgaucugacgcagcagugccggaggaccuuaauggaacagccccugacaacccuuaauauccacuuauuuaucaaaaccaugaaggccccauuacuaacugaaguggccgaagauccucagcaggucucaacagugcacuugcagcuggguuugcccuuagucuuuauugucucacaacaggcuaccuaugaagcagaccgcaggacagccgaaugggucgccuggcggcuguuagguaaagccggaguccucuuauugcuucgggauagcuuagaagugaacauaccccaagacgcuaacguaguuuuuaagagagcugaggagggugugcccguggaguuccugguguuacaugaugucgauuugauuaucagccacguagaaaacaacaugcacaucgaagaaauacaggaagacgaagacaacgauauggaagggccugacaucgacgugcaagacgacgagguggcagagaccguguucagagaccggaagcgcaaacugccuuuggagcucacaguagaguugaccgaggagacuuuuaaugccacggucauggcuuccgauucaauaguauuguucuacgccggauggcaggcugucucuauggcuuuucuucaaucuuauaucgauguggccgugaaacuaaaaggaacuaguaccauguuacugacccgcaucaacugcgccgacuggagugacguuuguacaaaacagaaugucacugaauuuccaaucaucaaaauguacaaaaaaggagagaauccaguguccuacgccggaaugcuagggacagaggaucuucuaaaguuuauacagcucaaucguauuucauauccggugaauaucaccuccauucaagaagccgaagaguauuuguccggcgagcuauauaaggaucugauccuguacuccaguguguccgucuugggccucuucucuccuacaaugaagacugcgaaagaagacuuuuccgaagcagggaauuaccucaaaggcuacgugaucaccgggauuuauucagaggaagauguucuguugcugagcaccaaguaugccgccucucuucccgcccuacuccuggccagacauacagagggaaaaaucgaauccaucccauuggcaucuacccacgcucaagauaucguccaaauaaucaccgacgcacuccuugaaauguucccagaaaucaccguugagaacuuaccauccuacuuuagacugcagaagccucuuuugauccuguuuagcgacgguaccgucaauccccaguacaagaaagcgaucuugacccuagucaaacagaaguacuuggauucauucaccccuugcuggcugaacuugaaaaacacuccggugggccggggcauccugcgugcuuacuucgauccuuuaccaccacugcccuuacucguauuagucaaucugcauucagguggccaaguauucgcauuuccguccgaucaggccauuaucgaggagaaucucguacucuggcucaaaaagcuugaggccggacuagaaaaucauauuacuauucucccugcucaagaguggaagcccccuuugccagccuaugacuuucugucaaugaucgacgcugcaacgucucaaagagguacaagaaaggucccaaaguguaugaaagaaaccgauguccaggaaaaugacaaagaacagcacgaagauaaauccgccgugcgaaaggagccuaucgaaacacuucgcaucaaacauuggaacagaucuaauugguucaaggaagcagagaaauccuuuagacgugauaaagagcugggguguagcaagguaaacuag

SEQ ID NO: 13607 - RNA, 672 nt, Artificial Sequence
  Description of Artificial Sequence: Synthetic coding sequence
augacauggagacaccacguacgucuguuauucacagucucccucgcucuucagauuauuaaccugggcaauaguuaucagagagaaaagcacaacgggggaagagaagaagucaccaagguugccacccagaagcaccggcagucuccauuaaauuggaccucuagccacuuuggcgaggucacuggcucugccgaagguuggggaccugaagaaccacuacccuauucgugggccuucggagagggcgcgagugcuaggccccgguguuguagaaauggcgguacuugcguguuaggcagcuucugcguauguccagcucacuuuacaggcagauacugcgaacaugaccagagacgcucagaguguggugcgcuagagcauggcgcauggacccugcgcgccugccaucugugcagauguaucuucggagcccuucauugucugccacugcaaaccccggauagaugcgaccccaaagacuuucuagccucccaugcucauggccccagcgcaggcggcgcuccuucccuuuugcucuuguugccuugugcucuccuucacaggcuucuucgccccgacgcuccugcucauccacguucccuaguaccuucaguacuccagcgagaaagacggccaugcggucgcccaggccuuggacauagacuguag

SEQ ID NO: 13608 - RNA, 1320 nt, Artificial Sequence
  Description of Artificial Sequence: Synthetic coding sequence
augccagcuaucgcaguacuggccgccgccgccgccgccuggugcuuuuuacaaguggaaucucggcaucucgacgcucuagccgguggagccggcccuaaccacgggaauuuccuggauaaugaucaauggcucagcacugugucucaguaugaucgagauaaguacuggaaccgauuuagggacgaugacuauuuccgaaauuggaaccccaacaaaccuuucgaccaggcucuugauccaucuaaggauccuugccuaaaaguaaaguguucuccucauaagguaugcguuacgcaggauuaucaaacggcccuuugcguauccagaaagcacuuacuaccccgucagaagaaaggcaaugucgcucaaaagcauuggguuggcccauccaaccuagugaaguguaaaccauguccaguggcccaaucagcuauggugugcggauccgacgggcacucauacaccucuaaguguaagcucgaguuucaugcuuguucaaccggcaaaucccuggcaacguuaugcgacggcccaugcccaugucucccagaaccggagccuccuaagcacaaagcggaacgcuccgcauguaccgacaaggaacugcgaaaucuggcgucacggcugaaagacugguucggagcguugcaugaggacgccaacagaguuauuaaaccaacaucaucuaacacggcacagggaagauucgacaccaguauccugcccauuuguaaggacucucuaggcuggauguucaacaaguuagauaugaauuacgaucuacuacuugauccauccgagauuaaugcuauuuaucuggacaaguaugagccauguaucaaaccucuuuucaacagcugcgauucuuuuaaggacggaaaacuuucgaacaacgaguggugcuacugcuuccagaaaccuggugggcuucccugucagaaugagaugaacagaauccagaagcuaagcaaaggaaaaucgcuauugggcgcuuucauucccagguguaaugaagaggguuacuacaaagcaacacagugucaugguaguaccgggcaauguuggugugucgauaaguauggcaaugaacuggcugggagcagaaaacagggcgcugucagcugugaggaagagcaggaaacaaguggagacuucggaaguggaggcucgguggugcuuuuggaugaccuagaauaugaaagagagcuggggccaaaagauaaagaggguaaguugaggguucacacgagggcugucacugaagaugaugaagaugaggacgacgauaaagaggaugagguagguuacauaugguag

SEQ ID NO: 13609 - RNA, 7872 nt, Artificial Sequence
  Description of Artificial Sequence: Synthetic coding sequence
augaaagugaaaggucgggguauuacaugcuuacucgugagcuucgcaguuauuugccucguggcuacaccaggcgguaaagccuguccuagacgaugugccugcuauaugcccacugagguucauugcacuuuucgauacuuaacuucuauacccgacuccauuccaccaaacgucgaacguaucaauuugggguacaacucauugguccgucugauggagaccgacuucucagggcuaacuaaacuggagcuccuuaugcugcacuccaauggaauccauacaauuccagauaaaaccuuuucagaucuacaagcacuccaaguucucaaaaugagcuauaacaaagugagaaaacuacaaaaggacacuuuuuacggcuugcgaucucugacgcgacuucauauggaccauaacaacaucgaguucauaaauccugaagucuucuacgggcucaauuuccucagguuggugcaccuggagggcaaccagcucacaaaacugcaccccgacaccuuuguaucacugaguuacuugcaaauauuuaaaaucucauuuaucaaauuucuguaccuuagcgauaacuucuugaccucucuaccacaggagauggucuccuacaugcccgaccucgauuccuuauaccugcauggaaaccccuggacaugugacugucaucugaaauggcucagcgauuggauacaagagaagcccgaugucauuaaaugcaagaaggacagaagucccuccuccgcacagcagugcccccugugcaugaaccccagaaccuccaagggaaaaccacuagccauggugucagccgccgccuuucagugcgccaaacccacuauugacaguucccugaaaucuaagagccugacaauccuggaagauaguucuucagcuuucauuucuccccaaggcuucauggcaccuuucggaucguuaacucucaacaugaccgaccagucugggaacgaggccaauaugguguguucuauccaaaaaccuucucggaccucuccaauugcauucacagaagagaacgacuauauaguccucaauaccaguuuuucuaccuuccucguuugcaauauugauuacggacacauacagcccguuuggcagauacuggcacucuacagcgacuccccauugauccuggagcgaagucaucuuuugucagaaacuccccaacuguauuauaaguacaaacaagucgcuccaaagccagaggauaucuuuacaaacauagaagcagacuuaagggccgaucccagcugguugaugcaagaucaaaucucccuccagcucaacagaacugccaccacauuuagcacucuccagauccaguacucuucagacgcccagaucacuuuaccaagagccgaaaugcgcccugugaaacacaaauggacuaugaucucgagggauaauaacacgaagcuugagcauacagugcucgugggcggaacuguaggacugaacugcccuggccagggggaccccacuccucacguggauuggcuguuggcggauggaucuaagguuagagcuccuuacgugucggaggacggcagaauccuuauagauaaaucaggcaagcucgaacuacagauggcugauuccuuugauacugguguguaccacugcauuuccagcaacuacgaugacgcggacauucugacauacagaauaaccguaguugagccucuaguggaagcuuaccaagaaaacgggauucaccacacggucuucaucggagaaacucuugaccugccaugucauucaacugguauccccgacgccucaaucagcuggguuauucccggaaacaacguauuauaucagucuaguagagauaaaaagguccuaaauaacggaacucuccgaauccugcaaguaacaccuaaagaucagggauauuacagauguguugccgcaaacccuagcggaguggauuucuuaaucuuccaagugagcgugaagaugaaaggccagaggccucucgaacaugauggcgaaacagaagggucaggccuugaugaauccaaucccaucgcgcaccugaaagagcccccaggcgcucaacuccguacaucagccuuaauggaagccgaggugggcaagcacaccucuucaacuucgaaacgccauaacuaccgcgaacucacacugcaacgaagaggagauagcacccacaggcgcuuccgcgagaauagaaggcacuucccacccucagcacgucgaaucgauccacagcacugggcagcccugcuugaaaaggcuaagaagaaugccaugcccgauaaaagagagaauacuaccguuagccccccuccagucguaacacaacuccccaauauccccggagaagaagaugacaguuccggcauguuggccuuacacgaggaauuuauggugcccgccacuaaagcauugaaucuaccugcccgcacaguaaccgcugacagcagaacuauuuccgauuccccaaugacuaacaucaauuacggaacugaauuuucuccaguugugaacucucaaauucuccccccugaagagccuacggauuuuaaguuauccacagccauuaaaacaaccgcaaugagcaaaaacauaaauccuacaaugagcagucaaauucagggcacgacaaaucaacacaguucaacagucuuuccgcuccuccugggagccacugaguuucaagauucugaucaaaugggccguggacgggaacacuuccagagucgcccuccuaucaccguccggaccaugauaaaggaugugaacguaaagaugcuguccucaacuaccaauaaacuauuacuggaguccguuaauaccaccaacagucaccagaccagugugcgugaaguuucagaaccgcgccauaaccacuuuuauucccauacuacccaaauucucucuaccuccaccuuucccucugauccccauacggccgcccauucacaguuuccaauaccucgcaauagcacagucaauaucccacuguuccgccgguucgggaggcaacguaaaauugguggccgaggccgaauuauuucccccuauagaacccccgucuugcgacgccaccgcuauucaauuuuucgaucaacuaccagaggcucuucagagaaaagcaccaccgcuuucuccgcaaccgugcuuaacguuacaugccugagcugcuuaccccgugaacgccuaaccaccgcaacagcagcucuaaguuuucccagcgcugcccccauaacguucccuaaagccgacauagcuagagucccaucugaggaaagcacgacacugguccaaaauccccuguuacuccuggaaaacaaaccuagcguggaaaagacaacuccaacuauaaaauauuuccgaacagaaaucucacaggucaccccaaccggagccgugaugaccuaugccccuaccagcaucccuauggaaaaaacucacaagguuaacgcauccuacccccgggucaguagcacaaaugaggccaagagggacaguguuaucacaucuucuuuaucaggcgcaauuaccaagccaccgaugacaaucauagccaucacucgauucucccgcagaaagaucccuuggcagcagaacuucguaaacaaucauaacccaaaaggaagacugagaaaucagcacaaaguauccuugcaaaagucuaccgcugucauguuaccaaagaccucccccgccuugccucgcgacaaagugucuccuuuccauuuuaccacucugagcaccagcgucaugcagauucccucuaauaccuugaccacagcccaucauacaacaacgaagacccauaacccaggcucgcuucccaccaaaaaggaacuccccuucccaccucugaacccgauguugcccagcaucaucaguaaagacuccaguaccaagaguaucauuucaacccaaacagcuauccccgccacuacuccaaccuucccagcaucaguuaucaccuaugagacccaaaccgaacgguccagggcccagacaauucagcgcgaacaggaaccacagaaaaaaaaucgaacagacccuaauaucaguccggaccaaagcuccggcuuuacaacuccaacagcuaugaccccuccagucuuaacaaccgcugaaacauccgugaagcccucagugucugccuuuacccauucgccccccgagaauacgaccggaauaucuaguacaauuucauuucacucucgcacauuaaaccucaccgauguuaucgaagagcuggcccaagcaaguacccagacacugaagagcacuaucgcuagcgaaaccacucugaguucuaaaagucaucaguccaccacaacccggaaggcaaucauccgccacaguaccaucccucccuuccuguccaguagcgcuacccucaugcccgucccgaucuccccuccguuuacucagcgcgccgucacugacaauguggccacccccauuagcggguuaaugacaaauaccguggucaagcuccaugaaagcucuagacauaaugcgaagccccagcaauuagucgcugaagucgcgacguccccaaaagugcacccaaacgccaaguucaccauaggcacaacucauuucaucuacucuaaucuuuugcacucaacaccuaugccggccuugacaacagugaagucccagaauucuaaacugacaccauccccaugggcggaaaaccaguucuggcauaaacccuauucagaaauugccgaaaagggcaagaaacccgaggucucaaugcuagccacaacagguuuaucugaggcgacaacauugguauccgauugggauggccagaagaauaccaagaagucagauuucgacaaaaagccaguucaggaggcaacaaccagcaagcucuuaccauucgacucccuuucccguuacauauuugagaaaccuagaaucgucggcggaaaagccgcuucuuuuacuauccccgcaaauucagaugcauuucuuccuugcgaggcuguagguaauccucugccaacaauccauuggacgcgcgugccuucugggcucgaccuuagcaaaagaaagcagaacagccgagugcaggugcugccaaaugggacccugaguauccagaggguagagauccaagaccggggccaauaucuguguucagccucgaaccuauucgguacugaccacuuacauguaacgcuuagcgugguaucuuauccaccaagaaucuuagaaaggaggaccaaagagauaacuguacacuccggauccaccguggaguugaaaugccgggcagagggaagaccuagcccuacagugacguggauucucgcaaaucagacugugguguccgaauccucucagggcuccagacaggcuguugucacgguggacgggacucugguacugcauaaucucucaauuuacgaucggggauuuuauaagugcguggccucaaacccuggcgggcaggacucucuucucgucaaaauacaaguuauugcugcaccccccguaaucuuagagcaacgaaggcaaguaaucgucggaacuuggggggagucacuuaaacucccauguaccgcuaaaggcaccccacaaccuucugucuacuggguguugagcgauggaacugaggucaaaccccugcaguucaccaacuccaagcucuuccuguuuagcaauggaacgcucuauauuagaaaucuugccucuucugauaggggcacauaugaaugcaucgcuacuaguucaaccgggagcgagcgacgagucgugauguugacgauggaagaaaggguaacaucucccagaauugaggcugccagccaaaaacguacugaggugaauuucggagacaagcuacuucucaacuguagcgcaacaggcgagccuaaaccucaaauaauguggagacuccccagcaaagccgugguggaucaacagcacagaguaggaaguuggauucacguguauccaaauggauccuuguuuaucggcagugugacagaaaaagacuccggagucuacuuaugcguggcacggaacaagaugggugacgaccucauucuuaugcacguuagccuccgacuaaagcccgcuaaaaucgaccauaagcaguauuuucggaagcagguuuuacacgguaaggauuuucaaguggacuguaaagcuagcggaagcccuguaccagaaaucaguuggucucugccggacgggacgaugauuaacaacgcuaugcaggcugacgauucaggccauagaacucgcagauauacucuguucaacaaugguacacucuauuuuaauaaggucggaguggcugaggaaggggacuacacgugcuaugcccaaaauacccuggggaaagacgagaugaaaguacaucuuacuguuauuaccgcugcaccaagaauuagacaaagcaauaagacaaacaagaggaucaaggccggcgacacugcagugcuggauugugaagucacuggagacccgaaaccgaagaucuuuuggcuccucccgaguaaugauaugaucucauuuucuauugaucgguauaccuuucaugcaaaugggucccucacaaucaacaaagugaaacugcuggacuccggggaauauguaugcguggccagaaaccccucaggggacgacacuaaaauguauaaacuugaugugguguccaaaccaccccugaucaacggacuuuacaccaaucggacugucauuaaagcuacugccgugcgccacuccaaaaaacacuuugauugcagagccgaaggaacacccuccccagaagugauguggauuaugcccgacaacaucuuucuaaccgcccccuauuacgggucuaggaucaccguccauaaaaacggaaccuuagagauuaggaacgugcgacugagcgacucagccgauuucauuuguguggcgcggaaugaaggaggugaauccguccuaguugugcagcuggaagugcucgaaaugcugcggagaccaaccuuuagaaaccccuucaaugaaaagaucgucgcgcaguugggcaagucgaccgcauuaaauuguucuguugaugguaacccacccccggagauuauuuggauacuuccuaacgguacaagauuuuccaauggcccacagucauaccaauaucugauugcaaguaacggcucuuucaucauaucaaagacuacacgggaagaugcaggaaaauaccguugcgcagcucgcaauaaaguuggguacaucgaaaaauugguuauccucgagaucggccagaagcccgucauccucacuuacgccccugguacaguuaaagggauuuccggagagagccugucacugcacugugugucagacggcauccccaaacccaacaucaaguggaccaugccgagugguuauguagucgaucggccucagauuaauggaaaauauauacugcacgacaacgggacuuuaguuauaaaggaggccacggcguaugaucgcggaaauuauauuuguaaagcucagaacuccguuggccauacuuuaauaaccgucccggucaugaucgucgccuauccuccgcggaucacgaaccgccccccacgaucuauaguaacccgaaccggcgccgcuuuccaacugcauugcguggcgcuuggcguucccaaaccugaaauuacgugggagaugccagaucauucacuguugucgacugcauccaaagaaagaacccacgguuccgagcagcuacauuuacaaggcacauuggugauccaaaacccccagacgagugacuccggcauauauaagugcacagccaaaaacccacucggaucugacuacgccgcuacauacauacagguuauuuag

SEQ ID NO: 13610 - RNA, 1995 nt, Artificial Sequence
  Description of Artificial Sequence: Synthetic coding sequence
augaaaacgggcuuauuuuucuuauguuugcuagggaccgcugcugcaauccccaccaacgccagguugcuguccgaucacucuaaaccuaccgccgaaacuguagcuccagacaacaccgcgauccccagccugcgggcagaggcagaagaaaacgaaaaagaaaccgcagugaguacagaagaugacucucaucacaaggccgagaaguccuccgugcugaagucgaaggaggagucacaugaacaguccgccgagcagggaaaaucaucaucacaagagcuuggacucaaggaucaggaagacagcgauggccauuugucggucaacuuggaauaugcacccacagagggaacauuggauaucaaagaggauaugagugaaccccaagagaaaaaacucucagagaacacagacuuuuuagcgccaggcgugucaucauuuaccgauagcaaccagcaggaaucuauuacuaagcgcgaagaaaaccaggagcagccaagaaauuauagccaccaccaguugaacagaucuuccaagcacagucagggucugagagaucaggguaaucaggagcaggauccaaauaucucaaacggagaagaggaagaggaaaaagaaccaggugaaguaggaacccacaacgacaaucaggagagaaagaccgaacuuccacgggagcacgccaacucuaagcaagaagaagauaacacacagagcgacgacaucuuggaagagagugaucagcccacacaggugagcaaaaugcaggaagacgaauucgaccaagggaaucaggaacaggaggauaauaguaaugccgaaauggaggaagaaaaugcuaguaaugucaauaagcauauucaggaaacagaguggcagucccaggaagggaaaacaggacuugaagcaaucagcaaccauaaggagaccgaagaaaagacaguuagcgaagcguuguugauggagccuacagaugacggcaauacuacgccgcgcaaccacggugucgaugacgacggagaugaugacggggaugauggcggcacagacggacccaggcacucagcuucagaugacuauuucauucccucacaagcuuuccucgaagccgaacgggcccaaucuauugcguaccaucugaaaauugaggagcagagggagaaaguacaugagaaugagaauaucgggacuacagagcccggcgagcaucaggaagccaaaaaggcagagaauucgaguaacgaggaagagacuaguucugagggcaacaugagaguccaugcuguugacucuugcaugucauuccaguguaaaaggggccacaucuguaaagcagaccaacagggaaaaccacacuguguuugccaggacccugugacaugcccuccuacuaaaccacuggaccaaguaugcggaacugacaaccaaacauaugcauccagcugucaucuguucgcaaccaaaugcagacuagaggguacaaagaagggccaccagcuccaacuugauuauuucggcgcuugcaaaaguaucccaacuuguaccgacuuugagguuauccaauuuccccuuaggaugcgagacuggcugaagaacauccugaugcaauuguacgaggccaacagcgagcaugcaggguaccugaaugaaaaacaaaggaauaagguaaagaaaauauaccucgaugaaaagcgacuacucgccggcgaccauccuaucgaucugcuccucagggacuuuaaaaaaaauuaucauauguacgucuaucccguucacuggcaguucagugagcucgaccaacaucccauggaccgggucuugacacauucagaacuugccccacuuagagcuucgcuaguacccauggagcacugcauuacacgauuuuucgaagagugcgacccuaauaaggacaaacacaucacauugaaagaauggggacacuguuuuggcauaaaagaggaagauauugacgagaaccugcucuuuuag

SEQ ID NO: 13611 - RNA, 1254 nt, Artificial Sequence
  Description of Artificial Sequence: Synthetic coding sequence
augcuggcccucuuggugcuugugaccgucgcucuggccucagcccaccacggcggggaacauuucgaaggggaaaagguuuucagggugaauguugaagacgagaaccacauuaacauuauacgugaacuugccucuaccacucaaauugacuuuuggaagcccgacagcgucacucaaaucaagccucauuccacaguagauuucagagugaaagcggaagauaccgucacagucgagaacgucuuaaaacagaaugaacuccaguacaaaguucugaucaguaauuuaaggaacgugguggaggcccaguucgacucccgggucagagcuacuggucauucauacgaaaaguacaacaaaugggagaccaucgaagcuuggacgcagcagguggccacugagaaccccgcauuaaucuccagaagcgugaucggcacgaccuucgaaggcagagcaauuuaccuuuugaaaguugggaaagccgggcaaaacaaacccgcaauuuuuauggacugugguuuucaugccagagaauggauaucgcccgcauuuugccagugguuugugcgcgaagcaguuagaacauacgggcgggagauucaagugaccgagcugcuugacaaacuggauuucuacguucucccaguucuuaacauugaugguuauaucuauacuuggaccaaaagcagauucuggcgcaaaacacgguccacacacacuggaucauccuguaucggaacugauccaaaccggaauuuugacgcaggcuggugcgaaauuggcgcuucuagaaacccgugugaugaaacauacugugggccagcugcugagagugagaaggaaaccaaagcucucgcugacuuuauacgaaauaaacuaucaucaauuaaagccuaccugacgauacacaguuacucucagaugaugaucuacccauacuccuacgcguacaaacuaggagaaaauaaugccgaauugaaugcccuggccaaggcgaccguuaaggaacuagcgucccugcauggcacgaaguacacauauggacccggcgcaacuaccauauacccagcagcaggcgguagcgaugauugggcauaugaccaggggauuagguacagcuuuaccuucgaauugcgugauaccggcagauacggcuucuuauugcccgaaucccaaaucagggcaaccugcgaagagaccuuuuuagcuaucaaauaugucgccaguuacgugcuagagcaucuuuacuag

SEQ ID NO: 13612 - RNA, 588 nt, Artificial Sequence
  Description of Artificial Sequence: Synthetic coding sequence
auggccguaucucagggugacggcacccuguguuucguucuccugcucuguugcuggcaggaaacugaauuaagaccucgaacaguaauuccugguagucccaccgagauaccauuuagcuccaaacaagaggauaugagcgaacuguuggacgaaauauuaguacaggaaauccuggaccucaauaaaacaacacccuccgaaaugccuuccacagcaucuacacugagcaccccgcugcaugcuggcauagaugaaaacuaccaggccggugguuccgaaaacuaucaugaacuacucgaaaaucugcaguucucacccggaauugaagucaagaucagcaacgacgaggccaacgcuaacgcaaaucuacacggcgauccuagcgaaaauuacaggggaccccaagugucgcccgggucugagaaaucagugucuucaaaagaaaagaacucuaagaauacacaauacgagaaucucagcauuuuggaccaaauacuccagaacauugggagaucaagcggaaauaucuuucauaaggagcaacagaggacaagugcacaacguagaagccaggguagccaguag

SEQ ID NO: 13613 - RNA, 2334 nt, Artificial Sequence
  Description of Artificial Sequence: Synthetic coding sequence
augaaugcaaacaaagacgaacgacuuaaagcaaggucccaggacuuccacuuauucccagccuugaugaugcucuccaugaccauguuguuucugccuguuaccgguacgcugaagcaaaauauccccaggcuaaagcugaccuacaaagaccuuuuacucuccaauuccugcauacccuuccuagguucuuccgaggggcuugacuuccagacacugcugcuugacgaagaaaggggacgccugcugcugggcgcgaaagaccacauauucuuauuaucccuaguggaucugaacaagaauuuuaaaaaaaucuauuggcccgccgccaaagaaaggguagagcuuuguaaacucgccggaaaagacgcuaauacagaaugcgcaaacuucauccggguuuuacaacccuacaacaaaacccacaucuauguaugugguacuggagccuuucaucccauuugugguuacauugaucucgggguauauaaagaagacaucaucuuuaaacuggauacacacaaucuugaauccgggagacuuaaauguccguuugauccccaacaaccuuuugcauccgugaugaccgacgaguaccuguauuccgguacagcaucugacuuucuggggaaggauacagcauuuacacgcucacugggacccacucacgaccaccacuauauacgaaccgacauuucagaacauuauuggcugaacggcgccaaguuuauaggaaccuucuucauuccagauacuuacaauccggacgacgacaagaucuacuuuuucuuucgggaauccagccaagagggcagcaccagcgauaaaacuauccugagcagggucgggcgagucuguaagaaugauguaggaggacagagaagucucauuaauaaguggacuacauuucugaaagccagacuuaucuguucaaucccuggaagugacggagcagacacguauuucgacgaacuacaggauaucuaucuccuacccacccgcgacgaaagaaacccugucguuuaugguguuuucacaaccaccagcagcaucuucaaaggcuccgcagugugcguuuacucaauggccgacauccgggcugucuuuaaugggccuuaugcccauaaggaaucugccgaccaccguugggugcaguaugacggucgcaucccuuaccccagaccaggaaccugcccuucuaagacuuacgauccccugauuaagucgacucgagauuuccccgaugaugucaucucuuucauaaaacggcacucaguuauguauaaaucgguauauccuguggcuggcggcccaacauucaaacggauaaacguggacuaucgacugacucaaauugugguggaccaugugauugcggaggacggacaguacgacguuauguuccuggggaccgauaucggcacuguauuaaaagucguuagcauuucuaaggagaaauggaauauggaggaaguugugcuggaagagcuucagauuuucaaacacucuaguauaauccugaacauggagcucagucuaaagcagcagcagcuauauauuggcucucgugaugguuuaguucaguuaagcuugcaucgaugugacacuuauggcaaggccugugccgauuguugccuugcccgcgaccccuacugcgcuugggaugguaaugccuguaguagauacgcucccacaucuaaacgacgcgcaaggagacaggacgugaaauacggagauccgaucacccaaugcugggacauugaggauucaauuagucaugagacugcugacgagaaggucaucuucggcauugaguucaauucuacauuccuugaauguauaccgaaaagccaacaagccaccaucaaaugguacauccagagaaguggagaugaacauagagaagaacucaaaccagaugaaaggauaauuaaaaccgaauacggauuacugaucaggagccugcagaaaaaagauucugguauguauuacugcaaagcccaagaacacacauucauccauaccauuguuaaacugacucuuaacgucauagaaaacgaacagauggagaacacucagagagccgaacacgaggaaggaaaagugaaggacuuacuugccgagucacgccugcgguacaaagauuacauccagauucucagcucccccaacuuuagccuugaccaguacugugagcagauguggcaccgggaaaagaggcgccagagaaauaaaggagggcccaaguggaaacacaugcaagaaaugaagaagaaacgcaaucgccgucaccaucgugauuuagacgaacuaccccgagcagucgccaccuag

SEQ ID NO: 13614 - RNA, 1332 nt, Artificial Sequence
  Description of Artificial Sequence: Synthetic coding sequence
augcagccaucugaaaugguuaugaacccaaagcaggucuuucucagcguucuuaucuucggggucgccggccuacugcuuuucauguacuuacaggucuggaucgaagagcaacacacaggacgcguggagaagagacgcgaacagaaaguuaccucuggaugggguccgguuaaguacuugcgucccgucccuagaauaaugaguacagaaaagauccaggaacacaucacuaaccagaauccuaaauuccauaugccugaagacguccgggaaaaaaaagaaaaucugcuguugaauucagagagauccaccaggcuacucacaaaaacuucucacucacaggguggcgaccaggcauugagcaaaagcacaggaucaccuaccgagaaacugaucgaaaaaagacagggcgccaagacuguguuuaauaaguuuucaaauaugaauuggccaguugacauacauccucucaauaaguccuuagucaaagacaauaaauggaaaaaaaccgaggagacccaggaaaaacgaagaucauuucuucaggaauuuuguaagaaguaugggggaguaagccaucaucagagucauuuguuccacaccguuucacgcauauauguugaagacaagcacaaaauuuuauacugugaggucccuaaggcaggcugcaguaauuggaagagaauucuuaugguacucaauggucuggcaucuuccgcguacaacauuagccauaacgccguucauuacggaaaacaccugaagaaacucgauagcuuugacuuaaaaggcauuuauacccgcuuaaauacguacacaaaagccgucuucguacgcgaucccauggaaagauuaguuucagcauucagagacaaguucgaacauccuaauucauacuaucaucccguguucggcaaggcuauaauuaagaaguacagacccaacgcuugcgaagaagcccucaucaacggcucuggagugaaguucaaggaauucauacacuaccuauuagauucucaucguccggucggcauggauauccacugggagaagguaaguaaacuguguuaccccuguuugaucaauuaugacuucgucggcaaauucgagacccuggaggaagacgcuaacuauuuuuuacagaugauaggagcccccaaggagcugaaauuuccuaacuuuaaagaucgacauuccucugaugagcguaccaaugcccaaguuguacgacaauaccucaaggaucugacccgcaccgaacggcagcugauauaugacuuuuacuaccucgacuauuuaauguuuaauuauacaaccccauuccuauag

SEQ ID NO: 13615 - RNA, 3228 nt, Artificial Sequence
  Description of Artificial Sequence: Synthetic coding sequence
augaggggcggaaaguguaauaugcuuaguucccugggcugucucuuacuuugcggcucgaucacccuagcacuuggcaacgcgcagaaacucccuaaagguaagcgcccaaaccugaaaguccauauuaauaccaccucugauucaauucugcucaaguuccuacgacccagcccuaacguuaaacuagaaggacuucuccuggguuacggaucgaaugucaguccuaaucaauacuucccacuuccagcagaaggcaaauuuaccgaagccaucgucgacgcggaacccaaguacuugaucgugguuaggccggccccucccccuucgcagaagaaguccugcagcggcaaaacccgcucucguaaaccccugcaauuagucgucggcacacugacucccagcucuguuuuccucucauggggauuccugauuaacccccaucaugacuggacauuaccuucccauugcccaaacgaccgauucuacacgauuagauaccgcgaaaaagauaaagagaagaaguggauauuccagauuugcccugccacagagacgauugucgaaaacuugaaacccaauaccguguacgaguucggaguuaaagauaacgucgaaggcggcaucugguccaaaaucuucaaucacaagacagucguuggcaguaaaaaagugaauggaaaaauccagagcaccuaugaccaggaccacacagucccugccuaugucccccgcaaguuaauuccgaucaccauuauuaagcaggucauccagaaugugacccacaaagauagcgcaaaaaguccagagaaggcuccccugggaggcgucauccugguccaucuaaucauccccggcuugaacgaaaccacgguuaaacugccugccucucuuauguucgagaucucagaugcauugaaaacccagcuggcuaagaaugaaacucucgcacuacccgcagaauccaaaacccccgaggucgaaaaaauuagcgcuaggccgaccaccgugaccccagaaaccgugccuagauccaccaaacccaccacaaguagcgcgcuugauguguccgaaaccacacuugcuucaucagagaagccauggaucgugccuacagccaaaauuagugaggacucaaaaguccuacagccacagacugcaacuuacgacguuuucucuucuccaaccaccuccgaugaacccgagauuuccgauagcuacaccgcgacaagugacagaauccucgacaguauacccccuaaaacuucucgcacuuuagagcagccacgcgccacccuggcaccaucugagacacccuuugugccucaaaaacucgaaaucuuuaccaguccugagaugcagcccaccacccccgccccccaacagacaaccagcauuccauccacuccaaaacgacgaccacgacccaagccgccccgaaccaagccugagagaacaaccagcgcaggcacgauuacaccaaaaaucucgaaaucaccugaaccaacguggaccaccccugcgcccggcaaaacccaguuuaucagcuugaaaccaaagauuccacugagccccgaagucacucauaccaaaccagccccuaaacagaccccaagagcaccuccuaaacccaaaaccagccccagaccuagaauaccgcagacucaacccguaccaaaggucccacagagagucacagccaagccuaaaacuucucccagccccgaggugagcuauacgaccccagcaccuaaggacguacuauugccucauaagccguacccugaagucagucagucagaacccgccccccuugaaacacggggcauucccuucaucccuaugaucagcccaucacccagccaagaggaacugcaaacaaccuuagaagaaaccgaccaaucuacccaggagcccuucacaacuaaaaucccccggacaaccgagcuugcgaagacgacucaggcgccacaccgcuuuuauacaacaguuaggcccagaaccuccgauaagccccacaucaggcccgguguuaaacaggccccucgacccucuggagcggaccgcaacgugagcguggauucuacccauccaacaaagaaacccggaacucguagaccaccacugccccccagaccaacccacccacgcaggaagccccugccaccaaauaacguuacugggaagccuggaagcgccgguaucaucagcagcggaccgauuacaaccccuccauuacgaucaacuccucgcccuacugguaccccucuggaaagaauugagacugacauaaagcaacccacuguccccgcaucaggagaggaacuagaaaauauaaccgauuuuucuucgagcccuacacgcgaaacagaucccuuggguaagccucguuuuaaggggccccacgugagguauauacagaaacccgacaacuccccgugcuccauuacugacagcgugaagagguuucccaaggaagaggcaaccgagggaaacgccacuuccccgccccagaacccuccaacuaaucugaccguugugacugucgaaggaugcccgaguuucgugauuuuagacugggagaagccacugaaugauaccguaacagaauacgaaguaaucucgcgugaaaauggaucuuuuaguggaaaaaauaaaagcauacagaugaccaaccaaacguucucaaccguugaaaaucugaagcccaacacaaguuacgaauuucaagucaagccuaaaaauccccugggugaagggcccgucaguaauacugucgcuuucucaaccgaguccgccgacccucgcgugucugagccaguuuccgccgggagagaugcaaucuggaccgaaagaccauuuaacucugacaguuauucugagugcaagggaaagcaguauguaaagcgcacuugguauaaaaaauucguaggaguccaacuguguaacuccuugcgauauaaaauuuauuuguccgauucacucaccggcaaauucuacaacauaggagaccagcgggggcacggcgaggaccauugccaguucgucgacucuuuuuuagacgguagaaccggucagcagcuuaccagugaucagcugccaaucaaagagggauauuuuagagcugugaggcaggagcccguucaauucggcgaaaucgggggccauacucaaaucaauuaugugcaaugguaugaaugcggcacuacaauuccagggaaaugguag

SEQ ID NO: 13616 - RNA, 483 nt, Artificial Sequence
  Description of Artificial Sequence: Synthetic coding sequence
augcuccccuuucuauuuuucuccacucuuuucucaaguaucuucacugaagcgcaaaagcaguauugggugugcaacagcucugaugccaguauuuccuauacauauugugacaaaaugcaguaccccauuucaauaaacgugaaucccuguauugagcugaaaaggucaaaagggcuacuccauauauucuacaucccacguagagaccugaaacaacuauacuuuaaccuguacaucaccguuaauacaaugaaucugccaaaacguaaggaggugaucugucgcggcucugaugaugacuacaguuucuguagagcacucaaaggagagacuguuaauacaacaaucucuuucagcuucaagggaauuaaauucaguaaggguaaauauaagugcgucguugaagccauauccggaucucccgaagagaugcuuuucugccuugaguuugucauuuuacaccaacccaacuccaacuag

SEQ ID NO: 13617 - RNA, 780 nt, Artificial Sequence
  Description of Artificial Sequence: Synthetic coding sequence
auggcugcacugaugagaaguaaggauucuagcuguugucuucugcuguuagcggccguacucauggucgaaucaucccaaauuggaucuaguagggcaaaacugaacucuauuaagagcuccuuaggaggggagacuccaggacaggcagcgaaccggucagccgguauguaccaaggcuuggccuuuggagguagcaagaaaggcaaaaaccuggggcaggccuaccccugcaguuccgauaaagaaugugaagugggcagauacugucacaguccccaucaggguucuuccgcgugcauggucuguagacggaaaaagaaacggugucaccgcgacgguaugugcugcccuuccacgagguguaauaauggcauuuguauuccagucacugagagcauucuuacaccgcacaucccggcacuugaugggaccaggcauagagauaggaaucacggucacuacucaaaccaugaucugggcuggcagaacuugggacggccccacaccaaaaugagccacaucaaagggcacgaaggcgacccguguuuaaggucuagugacugcaucgaaggauuuugcugcgccagacauuucuggacaaaaaucuguaaaccaguccugcaccagggugaaguauguacgaaacagcgaaaaaaaggaucccacggacuugagauauuucagagaugcgauugugccaaagguuugucgugcaaaguguggaaggacgcaacauauucuuccaaggcaagauuacacgugugccagaagaucuag

SEQ ID NO: 13618 - RNA, 3030 nt, Artificial Sequence
  Description of Artificial Sequence: Synthetic coding sequence
augggccaguuaugcuggcucccucuguuggcuccgcugcuucuucuaagaccuccaggcguucagucggcuggcccaauuagagcuuucguggucccccacucgcauauggauguaggcuggguguauacuguucaagagucaaugagagcauaugcagcgaacguuuacacaucugucguggaggaguuagcaagagggcaacagagacgcuucauugccguggaacaagaauuuuuccgucuguggugggaugggguagcaagcgaccaacagaaguaucaggugaggcaauuguuggaagaaggacgacucgaauucguaaucggggggcaagugaugcaugacgaagcuguuacccaccuagacgaccaaauuuugcaacuuaccgagggucauggcuuccucuacgagacauuuggcauccguccacaguucaguuggcaugucgaccccuuuggcgcaucagcaaccacaccaacuuuauucgcucuggcuggcuuuaaugcccaccuggguucucggauugacuacgacuugaaagcugcaaugcaggaagcucggggccuccaauucgucuggagaggcaguccaagccucucagaacgucaggagauuuuuacccacaucauggaucaauacaguuauugcacaccuucacacauaccguucuccaaccgcucgggauucuacuggaauggugucgcugucuuuccaaaacccccacaggauggggucuauccuaauaugucugaaccaguuacgccagcaaauaucaaucucuaugccgaagcacugguggcuaacgugaagcaaagggccgcgugguuccggacgccccacguccuuuggcccugggguugcgauaaacaauuuuucaaugcuaguguucaguucgcgaacauggacccucuccuugaccacaucaacucccaugccgcugagcugggggugucuguccaauaugcaacacugggagacuacuuucgggcccuacaugcucucaacgucacauggcgcgucagagaccaucaugacuucuuaccuuacucgaccgaaccuuuucaggcuuggacuggauuuuacacguccagaaguucccuuaaaggccucgcuagacgagcuagugccuugcuguaugcgggugaaaguauguuuacacgguaucuauggccagcaccacgcggacaucuagaucccacuugggcccuucaacaacuacagcagcugcguugggcugucucugaaguccagcaccacgaugcaauuacaggaaccgaauccccuaaaguccgcgauauguacgcaacucaccuggcuucuggcaugcuugggaugaggaagcugauggcaucuaucguacucgacgagcugcaaccucaagcaccgauggcagcgucuucagaugcugguccugcuggacauuuugccucuguuuacaauccacucgccuggaccgugaccaccauaguuacucucaccgugggauuucccggcguuagggucacagacgaagcuggccaucccguucccagccaaauucaaaauaguacugaaacccccucugcauacgaucugcugauucugaccacaaucccuggacugucauaccggcacuacaauauaaggccaaccgcgggggcccaagagggaacccaggaacccgcugccaccgucgccucuacauugcaguuuggccggagauuacgccggagaacaucacacgccgguagauaccuggugcccguagcaaaugacuguuauauugucuuacuggaucaggacacuaacuuaaugcacaguauuugggagaggcagucaaaucggacgguuagagucacucaagaauuccuugaauaucaugucaauggcgacguuaagcagggaccaaucucugauaauuaccuguucaccccagggaaagcagccgugccugccugggaagcgguggagauggagauuguggcagggcagcuugugacagaaauaagacaauauuuuuauaggaacaugacagcucagaauuacacuuacgcuaucagaucaaggcuaacucacgucccccagggccacgauggcgagcugcuaugccauaggauugaacaggaauaccaggcagggccacucgagcugaauagggaggcaguucucaggaccucaaccaaccuuaauucccaacaggugauauacagcgauaauaacgguuaccagaugcaacgaagaccuuacguuucauaugugaacaauuccauugcuaggaacuacuacccuauggugcagucugcuuucauggaagacgguaagucccgauugguauuacuaagugaacgcgcccacgggauuuccagccaggggaacggccaaguggagguuaugcugcaccggagacuguggaauaacuucgacugggaccucggguacaaccucacccucaacgauacuucggucguccaucccguucucugguuguuacugggaagcuggucccugaccacugcacugcggcaaagaucugcccucgcccugcagcaucgcccgguuguccuguucggagaccuagcagguacugcuccaaaacugcccgguccacagcagcaagaagccguuacacuuccgccgaaucugcaccugcagauacuuucgaucccaggauggcgcuacagcagcaaucacacagagcacucacagaaucuuagaaaagggcaucguggcgaagcccaggcugaccugagaagaguacuucugcgacuguaccaccucuacgaggucggggaagauccgguccugagucaaccuguuacagugaaccuugaagcgguccugcaggcccucgggagcgucguggccguggaagagcguagcuuaacagguacaugggauuuaucuauguugcaucgauggaguuggaggacaggccccggcaggcaccgcggggacacuacaucccccagcagaccgcccggaggcccuauaaucacaguccaccccaaggagauacgaacuuucuuuauacauuuccaacagcaguag

SEQ ID NO: 13619 - RNA, 1443 nt, Artificial Sequence
  Description of Artificial Sequence: Synthetic coding sequence
auguuauuucggaacagguuucugcugcuccuggcauuggcugcacuuuuggcuuucguuucccuaagccuucaauuuuuccaccuaauccccgucagcacacccaagaacgguaugaguaguaaaagcagaaagcgcaucaugccugacccugucacggaaccucccguaacagauccugucuaugaagccuugcuguacugcaacauccccucuguggcagagagaucaauggagggccacgcaccgcaucauuuuaaauugguauccguccacgucuuuauuagacacggugaucgcuauccccuguacguuauuccaaaaacuaagcguccagagaucgauugcacacucguugccaacagaaagcccuaccauccuaagcuagaagccuucauaucccacauguccaaaggaagcggcgccucauuugaaaguccccugaacucacucccccuguauccaaaucacccccuuugugaaaugggagaacuaacacagaccggcgucgugcagcacuugcagaacggacaguuacugcgggauauuuaucuuaaaaaacacaaacugcuccccaacgauuggucugcagaucaauuauaccuugagacaacuggcaaaucaaggacccugcagagcggcuuagcacuacucuacggcuuccuuccagacuuugauuggaaaaaaauuuacuuccgacaccagcccucagcacuauucugcuccgggucaugcuauugccccguccgcaaccaguaucuagagaaggagcagcggcgacaauaccuccugagauuaaaaaacucacagcucgagaagaccuacggcgagauggcuaaaaucguugaugugcccacuaagcagcuuagggccgcgaacccaauugauuccaugcuuugccacuuuugccauaacguuaguuuucccuguacaaggaauggaugcguggauauggagcacuucaaaguuaucaagacacaccagauugaagaugaacgcgaaaggcgggaaaaaaaguuguacuuuggcuauucccugcucggcgcccauccaaucuuaaaucagaccauuggacgaaugcaacgggcuacagaggggcgaaaagaggaguuauucgcacuuuacuccgcacacgacguuaccuuauccccagugcuauccgcucugggccucucagaggcuagauuucccagauucgcugcucguuuaaucuuugaguuauggcaagauagggaaaaaccauccgaacauucaguuagaaucuuauacaacggcguagaugugaccuuucacacaagcuuuugccaggaccaccacaagcgaagucccaaacccauguguccccucgaaaaucuagugcgcuucgugaaaagagacauguucguggccuuaggcggaucaggaacuaacuauuaugacgcuugccaccgcgaaggguucuag

SEQ ID NO: 13620 - RNA, 1341 nt, Artificial Sequence
  Description of Artificial Sequence: Synthetic coding sequence
augcuucaucccgaaacguccccuggaagagggcaccuccuugccguucuccucgccuugcucggaacagcuugggcagaaguguggccgccacagcugcaggaacaggcuccuauggcgggagcacuaaauagaaaagaaucauuucuccuucucucccuucacaacagacugcggucuuggguccaaccacccgccgcugacaugcggagacuggauuggucggauucccucgcucagcuggcccaagcucgugcugcgcuuugugggacucccacaccgucacuugccucuggccuguggaggaccuuacagguuggauggaacaugcaacuguuacccgccggacugguuucuuuuguugaggucgugucacucugguucgccgaaggacagcgguacagccaugcugcuggcgagugcgcaagaaacgcaacuugcacucacuacacccagcugguuugggcgacaucuucccaauugggaugcggaaggcauuuaugcucagccgggcaagccgcuauagaagcauucgucugugcguauucuccacgcggaaauugggaggugaauggaaagacuauugugcccuauaaaaagggggcaugguguagucugugcacugccuccgugaguggcuguuucaaggccugggaucacgcuggaggcuugugugagguccccagaaauccuugucggaugagcugucagaaccacggucgguugaacauaucuacaugccacugccauuguccuccuggcuauaccgguagauacugucaaguaagaugcucucugcaguguguccacggaagguucagagaagaagaaugcaguugugugugcgacaucggcuacggaggggcgcagugugccaccaaggugcauuuuccauuccacacaugugaccucaggaucgacggggacugcuucaugguguccucugaagccgacacuuacuaucgcgcgagaaugaaaugucagcgaaaaggcggcguccuggcucaaauaaagucacagaagguucaggauauucuugcauucuaucugggcagacuggaaacuacaaaugaagucauagacagcgauuucgaaacacgcaauuuuuggaucggacucaccuacaaaacagccaaggacucauucagaugggccacaggggagcaucaagcauuuacuucuuuugccuucggucagcccgauaaucacggauucggcaauuguguggaacuccaagccagcgcagcuuucaauuggaacgaccaaaggugcaagacccgcaaucgcuacauuugucaguuugcccaggaacauauuucacguuggggcccagguucuuag

SEQ ID NO: 13621 - RNA, 2313 nt, Artificial Sequence
  Description of Artificial Sequence: Synthetic coding sequence
augguggagucggcugguagagccggacagaaaagaccugguuuucucgagggcggccuacuccugcuucuguuauuggugaccgcagcgcuaguggcccugggcguccucuacgcagacagacgcggaaagcaacucccccgacuggcuaguagacuaugcuuccugcaagaagagcgaacauuugucaagaggaagccccgcgggauuccagaagcucaggaaguuucggaagucuguacgaccccagggugugugaucgcugcagcuagaauucugcaaaauauggaucccacaaccgaacccugcgacgauuucuaucaauucgcuuguggaggguggcugagacgacauguuauuccagagacgaacucucguuacagcauuuucgacguacucagagacgaguuagaaguaauccugaaagccgugcuggaaaauucuacugcuaaagauaggccugcuguggagaaagcccgcacccuuuacagauccuguaugaaucaaagugucaucgagaagcgagggagccagccacuacuagauauccucgaagucgugggagguuggcccguugcaauggacagauggaaugaaaccguaggucuugaaugggagcuggaaagacagcuggcauugaugaauucucaauuuaacagacgcguccuuaucgaucucuucaucuggaacgaugaccagaauuccagcaggcacauuauuuauaucgaccaaccuacacucggcaugccuucccgggaguauuauuucaacgguggguccaacagaaaagucagggaagcauaucugcaauuuauggucucuguagcaacacuuuuaagggaagaugcgaauuugccacgcgauucaugucuuguccaagaggacauggugcaggugcuggaacuugaaacccagcucgcuaaggcgacagugccacaggaagaaaggcacgacgugauugcuuuauaucacaggauggggcuggaagaacugcaaucucaauucgggcugaagggauucaauuggacauuauuuauacagacuguucuuucuucugucaaaaucaagcuacugccagaugaagagguuguaguguacgguaucccuuaccugcagaaucuagagaauauuauugacacuuauucugcacgcaccauucagaacuaccuuguuuggagacuuguccuugaucgcauaggcucacuaagucaaagguuuaaggacacuagggugaauuaccgcaaagcccuuuuuggcaccaugguggaggaaguucgguggagggaaugugucggcuaugucaauagcaauauggaaaaugccgugggcuccuuguaugucagagaggccuucccaggggauaguaagucuaugguacgggaacugaucgauaaagugcgcaccguguucguugagacauuagacgagcuuggcuggauggaugaagaaucaaagaaaaaagcccaggaaaaggcgauguccauaagagagcagaucggccacccagauuauauucuugaagaaaugaaccgcagauuggacgaggaauacuccaaccuuaacuuuuccgaggacuuguauuuugaaaacagccugcagaaucuuaaaguuggagcacagagaagccugcgaaaguuaagggagaagguagauccgaaucucuggauaaucggggccgcuguuguuaaugcuuucuauucccccaacagaaaucagauuguuuucccugcuggcauacugcagccucccuucuuuagcaaggagcaaccacaggcccugaacuuugguggcauuggaauggugauuggccacgagauaacacacggauuugaugauaauggcagaaacuuugauaaaaacggcaacaugauggacugguggagcaauuuuagcacucaacacuuccgugagcagagcgaguguaugaucuaucaguauggaaacuauaguugggaccuggcugaugaacagaacguuaacggguucaacacauugggcgagaauauagcagacaacggcggcguuagacaggccuacaaagcuuaucuaaaguggauggccgaaggaggaaaagaccagcaacuuccagguuuagaccugacucacgaacaguuauuuuuuauuaacuaugcucaaguauggugcggguccuacagaccagaauuugccauccagucuauaaaaacagaugugcacuccccucugaaauaccgagugcugggcucucuacagaaccuggccgccuucgccgacacuuuccauugcgcuagaggcacacccaugcacccaaaggaacgaugccgcguuugguag

SEQ ID NO: 13622 - RNA, 1317 nt, Artificial Sequence
  Description of Artificial Sequence: Synthetic coding sequence
augagcaagcgugauaaagccggaaaagacacugcuagggguaaggguaaggacaucucaaaguacgguucaguacaaaagagcuuugcggaucggggccuuccuaaaccuccaaaggaaaagcucuuacaaguggaaaaauugagaaaagagucuggaaaaggauccuuucuccaaccuacugcaaaacccagggcccuggcucagcagcaggcaguuauucggggauuuacguacuacaaagccggcaaacaagaaguuacugaagccguggcggauaauacacuucaaggaacuucuugguuggagcaacugccucccaagguggaagggcguuccaacagcgcagaaccuaacucagccgaacaggaugaagcugaaccacgauccucagagcguguugaucuggcaucgggcacaccuaccaguauuccagcuacaacuacaacagcaaccaccacaccaaccccaacuaccucucuguugccaacugagcccccuucugguccugaggugagcagccagggcagagaagcuucaugugagggaacccugagagccguggacccuccuguccgccaucauaguuacggaagacaugaaggagcuuggaugaaggauccagccgcucgcgaugacagaauuuacgucaccaacuauuauuacggaaacucacuggucgaauuccggaacuuagagaauuucaagcaggggcggugguccaacauguauaagcugccuuauaauuggauuggcacuggacacgugguuuaucagggugccuuuuacuauaauagagccuucacuaaaaacauuauaaaauacgaucuucgccagagauuugucgcgucgugggcgcucuugccagacguaguguaugaggacacgaccccauggaaauggagaggacauucugauauugacuuugcuguggacgaaucggggcucugggugauuuauccagcuguugacgauagggacgaggcucagccugaagucauaguacugagucgucucgaccccggcgacuugucagugcacagggaaacuacguggaagacucgacugcgccggaauagcuacggaaauugcuuccucguguguggaauacuguacgcaguggacacguauaaucaacaggagggccaagucgcauaugccuuugacacgcacacgggaacugacgcgcgcccucagcuucccuuucuaaaugagcacgccuacacaacacagauagauuauaaccccaaggagcgagugcuauacgccugggacaauggacaucaacugacauauacccuacauuuuguggucuag

SEQ ID NO: 13623 - RNA, 3570 nt, Artificial Sequence
  Description of Artificial Sequence: Synthetic coding sequence
augccaggucuucucaacuggauaaccggagccgcccugccccuaacugccucggacguaacuucaugcguaucagguuacgcccucggccugaccgcaucauuaacuuauggcaaucuggaagcccaaccauuccaaggacucuucguuuauccucuagacgaguguacuaccgugauagguuucgaggcugucauugcugaccgcgucguuacuguccaaaucaaagauaaagcuaagcuggaauccggacacuuugacgccucacacgugagguccccgacuguuaccggcaacauuuugcaggauggagucucaauagccccucauuccuguacacccggcaaagucacccucgacgaggaucuagaacguauccuguuuguggccaauuugggcaccauagcccccauggaaaacguaaccaucuuuauuagcacuucuucugagcuuccuacacugccuucuggagccgugagagugcugcucccagccgugugcgcccccacuguaccacaguucuguaccaagaguacuggaaccucuaaccagcaagcacaaggcaaggacagacauuguuuuggcgcaugggccccgggcucuuggaauaaacuuugucuugcuaccuuguuaaauacugaaguuucaaacccaauggaguacgaauuuaacuuccagcuagagauccgggggccuugcuuauuggccggugucgaaucuccuacucaugaaauucgggcugacgcagcucccagcgcccgauccgcuaagucuaucauuauaacauuagcgaacaaacacaccuucgaucgaccgguagaaaucuugauccaccccagcgaaccccacaugccucacguacugaucgagaaaggcgacaugacauugggcgaguuugaucaacaccuaaagggacggacugacuuuaucaagggaaugaagaaaaaguccagggcugaaagaaaaaccgaaaucaucaggaagagacuacacaaggauaucccccaccacucagugauaaugcuuaacuuuuguccggaucuccagucagugcagccaugccuacggaaagcacacggugaauucaucuuuuuaaucgacagguccucuaguaugucaggcauuuccaugcauaggguuaaggacgcaaugcucguugcucugaagucuuugaugccagcgugucuuuucaauauaaucggguucgggucaaccuuuaagucauuguuccccucgucucaaacuuacuccgaggacucucuggccauggcgugugacgauauccagcgaaugaaggccgauaugggaggcacaaacauucucuccccccugaaguggguaauuagacagcccguucauaggggccauccuaggcuguuauucgugauuacugauggugccguaaacaacaccgguaaaguccucgagcucgugagaaaccacgccuucaguaccagauguuacucuuucggaaucggucccaacguuugucaccgucucgugaaaggauuggccagcgugucugagggcucagccgaacuguugauggagggggagagacugcagcccaagauggugaaaaguuuaaagaaagccauggccccgguccuuagcgacguuacaguugaauggauuuuucccgagacaacagagguucuggugucaccggugagugcuucuucuuuauucccuggcgaacgucuagugggcuacggcauugugugugacgcaucuuuacacaucagcaauccaagguccgacaagcggcgcagauacucaaugcuucacagucaggagagcggcagcucgguuuuuuaccacagccaggaugaugggcccgggcucgagggaggggacugugcuaaaaacuccggggcgccauuuauucuuggacaggccaaaaaugcacggcuugcaucuggcgacucaacgacuaaacacgauuuaaacuuaucccagcggagaagggccuauaguacgaaccagaucaccaaucacaagccguuaccacgcgccacaauggccucugacccaaugcccgccgccaagagauacccgcucagaaaggcuagacuucaggaccucacuaaccagacaagcuuggacguccagcguuggcagauagacuuacagccccuccucaacucugggcaggaucugaaucaaggcccuaaacuucgagguccuggagcacggcgcccaucccuucugccacaaggaugucagccguuuuugccauggggccaggaaacccaggccuggucucccguucgugagcgcacuagugacucaagauccccuggggaucuggagccuucccaccauccauccgcuuucgagacugaaacaaguucugacugggacccacccgccgaaucccaggaacgagcuucaccuagccggccugcaacaccagcaccaguccucggcaaagcacuuguaaaggguuugcaugauucgcagaggcuccaaugggagguuuccuucgagcuagguaccccaggcccagagaggggaggagcccaggaugcugauuuaugguccgaaacuuuccaucauuuggcagcacgagccaucauuagagacuucgaacaguuggccgaacgggagggugagauugagcaggggaguaaucguagguaucaaguuagugcacuucacacgaguaaggcuugcaacauaauaucuaaguacacagccuucgucccaguggaugugaguaaaagcagguaucuucccacaguggucgaauaccccaauuccgcugcccuucgcauguuaggcucuagggcccucgcucaacaauggcgggguacuuccagcggauucggccguccacaaaccauguugggggaggacuccgcucccggaaauggaccccagcgaagcuuggccacaaauacccugucuucaaugaaagcuucugaaaaccuguucggguccuggcuuaaccugaauaaaucucgcuuacugacccgggccgcaaaaggguuccugagcaaaccgcugaucaaggccguagaaagcaccaguggaaaucaauccuuugacuacaucccccuuguuucacugcagcuagcaaguggcgcuuuuuuauugaacgaagcuuucugugaggcuacucacauucccauggaaaaacugaaauggacauccccauucacgugccaccgugucucucugacaacucgcccguccgaaaguaagacaccuucuccucagcucugcaccucaucaccacccagacaccccucuugugauucauucucucuggaaccucuggcgaagggaaaacuuggcuuggaaccucgugcugugguugagcacaccggaaaauugugggcuaccgugguuggccuagccugguuagagcacuccucggcuucauacuuuacugagugggaacugguugccgcuaaagcaaauucauggcuggagcagcaggaggugccagaaggaagaacccagggcacauuaaaggcggccgcuaggcagcuguuuguuuuacuccgacacugggaugaaaaucuugaauucaauauguuguguuacaauccgaacuacguguag

SEQ ID NO: 13624 - RNA, 1344 nt, Artificial Sequence
  Description of Artificial Sequence: Synthetic coding sequence
augccucacguuuuaaucgaaaaaggagacaugacacugggcgaguucgaucagcaccuaaagggcagaacggauuuuauuaaggguaugaaaaaaaagagucgugcggaacguaaaacugaaaucauacggaaaagauugcauaaggauaucccucaucauucaguuauaaugcuaaacuucuguccugaccuccaauccgugcagcccugucugcgaaaggcacacggcgaauucauuuuccugauagaccgaucgaguucuaugagcggcauuuccaugcaucgggugaaagacgcuauguugguggccuuaaaaagucugaugccugcauguuuauucaauauuauaggguuuggcaguacauucaagagccuguuuccaaguagccagacuuauucagaagacucgcuggcaauggcaugugacgacauucagagaaugaaagcggauaugggagguacuaacaucuuguccccacucaaauggguuauaagacagccgguccaucgaggucaucccagauuauuguucgugauuacugacggcgccgugaacaauacgggcaagguccuggagcucguucggaaccacgcuuuuaguacccgauguuacuccuucgggauuggcccaaauguuugccaccgccuggucaagggacuugccucuguguccgaagguagcgccgaacugcugauggagggggagaggcugcagcccaaaaugguuaaaaguuugaaaaaggcaauggcccccguucugucugacguaacaguggaguggaucuuccccgagacgaccgaagugcugguauccccaguuucugcuuccucacucuuccccggugaacgacucguagguuacgguauugugugcgacgcuucccuccauauaaguaacccgcgguccgauaaacgacgacgcuauucaaugcuucacagccaggagucaggcucaucaguguucuaccauagccaggaugauggaccuggacuagaaggaggcgauugugccaagaauaguggagcuccauuuauucugggacaggcuaaaaacgcuaggcuggcuucaggcgauagcacaacaaaacacgacuugaaucucucacagagaagaagagccuacucuaccaaucagauuaccaaucacaaaccccugccaagagccaccauggcuuccgauccaaugcccgcagccaagagauauccccucagaaaagcgcgccugcaagaucuaacuaaccagacaucucuagacgugcagcgguggcaaaucgaccuucaggcuuuuaucugccucacuagcgaagauaccuuccaaauuagaacuccaacaggccaguag

SEQ ID NO: 13625 - RNA, 726 nt, Artificial Sequence
  Description of Artificial Sequence: Synthetic coding sequence
auguggaccgugcggacugaaggagggcacuucccucugcacagcccaacuuucuccuggaggaacgucgcauucuuacuucuacucaguuuggcacucgaauggacuucugccauguuaacgaagaaaaucaagcacaaaccugggcugugucccaaggaacgcuuaaccuguaccacagaacugccagacuccuguaauacggacuuugauugcaaagaauaucagaaauguugcuuuuucgccugccagaaaaaauguauggaccccuuccaagaaccuuguaugcucccagugagacauggcaauugcaaucaugaagcccagcgcuggcacuucgacuucaaaaacuauagaugcacaccuuuuaaauaucgcgggugcgaaggaaaugccaacaacuuucugaaugaagacgcuugccgaaccgccugcaugcuuauugucaaagacgggcaguguccccucuuccccuucaccgagcgcaaagaaugucccccuagcugccacucugauaucgacugcccucagaccgacaaaugcugugagaguagauguggauucgugugcgccagagccuggacagucaaaaaaggauuuugcccgcgcaaaccccugcucuguaccaaaauugacaagccgaaauguuuacaggacgaagaaugcccgcucguugagaaauguugcucccacugcggucugaagugcauggacccucgacgauag

SEQ ID NO: 13626 - RNA, 1074 nt, Artificial Sequence
  Description of Artificial Sequence: Synthetic coding sequence
augagaccucccccugcccuggcucuggcggguuuaugccuacuggcccugcccgcagcugcugccuccuauuucggacugacaggacgcgagguauugacccccuucccuggucucgguacugccgcugcaccagcccagggcggagcgcaucugaaacagugugaccuccuuaaacucagucggcgucagaaacaacucuguaggagggagccaggacuggccgaaacccugcgggaugcagcucaccucggccuacuugagugccaauuccaguucagacaugaacgguggaacugcagucuagaagggaggaugggacuccuaaaaagaggauucaaggagacagcuuuucuguaugccguaucaucagcugcgcuaacccacacccuugcucgggcuugcagcgcuggaaggauggaacgcugcacaugcgaugacucaccaggccuagagagcagacaggcguggcaauggggggugugcggggauaaccugaaguauuccacaaaauuucugagcaauuuccuggguucaaagcgggguaacaaagacuuacgcgcccgcgccgacgcccauaauacacauguggggauuaaggccguuaagucaggacugaggacgacaugcaaaugccacggcgugucaggcagcugugcggugcgcaccuguuggaagcagcuuucgccauucagggaaacaggacagguccucaaguuacguuacgacucggccgucaaagucucaagcgcuaccaaugaggccuuaggcagacuugaacucugggccccagcucgacagggcucguuaacgaaaggcuuggccccucgcaguggcgaccuaguguacauggaggacucacccagcuucuguagaccaaguaaauacucaccaggcacugcgggucgggucuguucuagagaagccaguuguucuucucuguguuguggacguggguaugauacacaaagucggcuggucgcuuuuucaugucacugccaagugcaguggugcuguuauguggaaugucaacaauguguacaagaggaauugguguacacaugcaagcauuag

SEQ ID NO: 13627 - RNA, 810 nt, Artificial Sequence
  Description of Artificial Sequence: Synthetic coding sequence
augguuaggugccuuggucccgccuuacugcuccugcuucuccucgggagcgcuucgagugugggaggcaauagauguguugacgcugcugaagccuguaccgccgacgcacgcugucagagguuacgaagugaguaugucgcccaaugccuggguagagcugcucaggguggaugucccagagcgagaugcagaagagcccugagacguuuuuuugcaagagguccuccagcccugacucacgcccuguuauucugccccugcgccgguccggcgugcgcagagagaagacgucagacguucgucccauccugugcauuuuccggccccggcccugcuccaccaagcugucuugaaccacucaauuuuugugaacgaucgcgggugugccggccucgguugcuggccuuucagguuaguugcaccccggcgccuagugccccggauggaugccugcuugaccagggagccagaugucuccgagcauacgcuggccuggugggaacagcuguuacucccaauuauguggauaauguaagcgccaggguggccccuuggugcgauugcggcgcaagcggaaaccggagagaagauugugaagccuuucgagggcuguuuaccaggaacaggugucucgacggagcuauucaggccuucgccuccggauggccuccaguguugcucgaucagcuuaauccccaaggcgacccagaacacucuuugcugcagguaaguucuacaggacgcgcccuggaaagacguucucugcucucuauccuaccaguucuggcccucccugccuuauuauag

SEQ ID NO: 13628 - RNA, 1728 nt, Artificial Sequence
  Description of Artificial Sequence: Synthetic coding sequence
augucugguaauuggguccauccuggacaaauccucauuugggcaaucuggguacuugccgcaccuacaaaagggcccucagcggagggcccccaaagaaauacaagacuagguuggauucaggggaaacagguuaccguucuuggaucaccuguacccguuaauguguuuuuaggcgugcccuucgcugccccuccucugggaagucuccgcuuuacuaacccacagcccgccucacccugggacaauuuacgcgaggcaacaaguuacccgaaucugugucuccaaaauucagaaugguuacuccucgaucaacauauguuaaagguacauuaccccaaguuuggugugucagaagauugucuuuaccuuaacauuuaugcaccugcucaugcagacacugggucuaaacuuccaguuuuagucugguucccuggaggugccuucaagaccgggucugccuccauauuugaugggucagcccuugccgcuuaugaggaugugcucgucguugugguccaguaccgauuagggaucuuugguuucuuuacaacuugggaccagcacgcuccaggcaauugggcuuuuaaagaccaagucgccgccuugucaugggugcagaaaaauaucgaguucuucggaggggaccccuccucaguuaccauuuuuggcgagagcgcgggagcuaucagcgugucuagucuaauuuuguccccaauggcaaagggccuauuccacaaggcaaucauggaauccggcguagccaucaucccauaccucgaggcacaugauuaugaaaaauccgaagaccugcagguuguggcacauuuuugcggaaauaacgcaucugacucugaagcacugcugcguugcuuacguacuaagcccucaaaagagcugcucacacugucucagaaaaccaagaguuuuacacgugucguagauggagccuucuucccaaacgaaccccucgaucugcuuucacagaaggccuuuaaagcaauccccaguauuauaggagucaacaaucacgaaugcggcuucuuguugccgaugaaagaagcucccgaaauccuuuccggaaguaauaaaagccuugcccuccaucugauucagaacauucuucacauaccaccacaguaccugcaccuuguagcuaacgaauacuuccacgacaaacacucucuuaccgaaaucagggauucacuccucgaccuguuaggcgacguguuuuuugucgugccagcucugauuaccgcuagauaucaucgagaugccggagcucccguguauuucuaugaguucagacaucgaccacaauguuucgaagacaccaagcccgcauucgugaaagccgaccacgccgaugaaguaagguuugucuucggcggcgcuuuccugaaaggugauauuguaauguucgagggggcuacugaagaggaaaaauugcugucuaggaaaaugaugaaauacugggcgacuuuugccagaacugguaacccgaacggaaacgaccugucccucuggccugccuacaaccucacugaacaguaucugcagcuugaccugaacaugucccugggacaaaggcugaaagaaccacggguugauuucuggaccucuacuaucccccuaauauuaucugcauccgacaugcuucacucaccucugucuucccucacuuuucuaagucuucuucagcccuuuuuuuuuuuuugugcucccuag

SEQ ID NO: 13629 - RNA, 1026 nt, Artificial Sequence
  Description of Artificial Sequence: Synthetic coding sequence
auggggacacuuccuugguuguuagcuuucuucauucuagggcuacaggcuugggacacuccaaccauagucagucggaaggaguggggcgcucgaccucuugcauguagagcgcugcugacacuuccagucgccuacauuauuacagaccagcuuccaggaaugcagugccaacagcagucaguuuguagucagauguugagaggguuacagucacauuccguguauacuauuggcuggugcgauguggcauauaacuuccuagucggugacgauggcaggguguaugaggggguagguuggaauauccagggacuucauacacagggcuauaauaacauuucucuggggaucgccuuuuuugggaacaaaaucgguagcucccccucacccgccgcccuguccgcagccgagggacugauaucuuacgcaauucaaaagggucaucuaagcccccguuauauccagccacuccuguugaaagaagagacaugccucgauccacagcauccaguuaugccacgaaaaguuuguccaaacaucauuaaaaggucugcaugggaagccagagaaacccacuguccaaaaaugaaucugccggcuaaguacgugauaauuauccauacggcuggaacuagcugcacggugucaaccgauugucaaacagucgugcguaauauucagucauuucauauggauacucggaacuucugugacauaggcuaccacuuccuagugggacaggauggaggcguguaugaaggagucggguggcacauccagggaucucauaccuacgguuuuaaugacaucgcuuuagguaucgccuucauuggguauuuuguggagaagccucccaaugccgcugcacucgaagcugcucaagaccuaauucaaugugccgucguugaaggauacuugaccccuaauuaccuccugaugggccauagcgaugucgucaauauucuaucuccuggccaagcccuuuacaauauaauuucuacauggccacauuuuaagcauuag

SEQ ID NO: 13630 - RNA, 897 nt, Artificial Sequence
  Description of Artificial Sequence: Synthetic coding sequence
auggguauugugugcgcucaguguuccuuuauccugcuccuuaguaucauucgagcccgcccuccgccauuucuguucuguccucugaguagccagcggaccgagagucccuacaagccugugcaccuuggacuaggaccaaccgacaagguagcugcuauagcgauggcucgcauuaucgaccuugugccuugggaugauggaucuacucauguauacgcuucucccgcaauccuccugcccauggaacgacagaggaaccagcucgccggagucaagcaacaacuguaucauccagcacuucccacacugaggcacauggauagagauacagucaaagcaugucugccagacgaacacugccagaguacuaccuacugucgaaaagaugaauucgauaacgcccacuucacucugcugggaguccccaacaaaccacuccagugccuggauauuacggcaacaggacagaaguuacggaaucgcuaccacgaaggaaagcuggcacccaucgcaccgggcauuaaccgcguagauuggcccugcuucacccgggcuaucgaggacuggagccacuucguuaguucugcuggugaauucaagcugccgugucugcgaaaaagggcagagggacuuaguggcuacgccguccguuaucugaagccagacgucacucaaacuuggcgccaggaagcuuuaugcggagcaugggcuggacggccuuguucgccagacucucccagaccuuauccauguuguccaccgcaauacugucucagccagaauccuagccuagaucguuacggccagaaaccucuccccuuugacagcuugaacaccuuucgguccuucgguuccuccuauucacgugucaauuaccugacuccuuggcacuag

SEQ ID NO: 13631 - RNA, 5799 nt, Artificial Sequence
  Description of Artificial Sequence: Synthetic coding sequence
auggcuccaggagccuugcgugggggcugcgaacagcgcgcuccuggugggggugccagaacagcggcacucggcccguggccauggccuuccccagggccagcuccuagccccggagccgccccuccccgcucuagaaagaugucuggggcccucuuauggcccuuacuuccauugcuuuugcugcuccugagcgcccgcgacggugucagggcugcccaaccacaagcacccggcuacuugaucgccgcacccucuguuuucagggccggaguugaagaagugaucucagucacgauuuucaauucacccagggaagucaccguucaagcucagcugguggcccagggagagcccgucgugcaaucacagggcgccauucuugauaaagguaccaucaagcuuaagguucccacuggacugcguggacaggcacugcucaaggugugggguagagguuggcaagccgaggagggcccccuuuuucauaaccaaacauccgugaccguggacgggagaggugccucggucuuuauucaaacagacaagccagucuauaggccacagcacagagugcucaucuccauuuuuaccguguccccuaaccuccgaccggucaaugagaaacucgaagccuacauacuggaucccagaggaagucggaugauugaauggcgacaccuaaaacccuuuugcuguggcauuaccaacaugagcuuccccuuaucugaccagccaguacugggcgagugguuuaucuucguugaaaugcaaggccaugcuuauaacaaaagcuucgaaguacagaaauacguucuaccuaaguuugaguuacugaucgauccaccacgauauauccaggaccucgaugccugcgaaacaggcaccgugcgcgccagauacacauuuggcaagccaguugcaggggcucuuaugauaaacaugacaguaaacggggucggcuauuacagucacgaagucggcaggccgguccugcguaccacaaagauacuaggcucuagggauuuugauauuugugugagagacaugaucccagccgaugugccagaacauuucagaggccgggucuccaucugggcgauggucaccucuguugauggcucacagcagguagcauucgacgacucaaccccagugcagcgccaauuggucgacaucagauacucuaaggauaccaggaagcaauucaaacccggccucgccuacguuggaaaagucgaguugagcuaccccgauggguccccugccgaaggcguaaccguucagaucaaagcagaacucaccccaaaggacaacaucuauaccuccgaaguugugucucaaagaggcuuagugggcuucgaaaucccaaguaucccuacuagcgcccagcacgugugguuagagacaaaaguuauggcgcucaaugguaagccugugggcgcccaauaccugccaucauaucugucuuugggaucaugguacagcccuagccaguguuaucuucagcuacagccaccuucccacccucugcagguaggugaggaggccuacuucagcguuaagucuacuugcccauguaauuucacccucuacuaugagguugcugcucgagguaauauuguacuaucuggccaacagcccgcccauacuacacaacaaaggucaaagcgcgccgcacccgcacuagagaagccaaucagacugacucaccugagcgaaacagagccuccuccagcaccagaggccgagguugaugugugugugacaucccugcacuuggccgugaccccuuccauggugccacuggguaggcugcucguguuuuacguccgcgaaaauggggagggaguugccgacagucugcaguuugcuguggagacuuucuuugagaaccaagugagugugaccuacucugccaacgaaacccagcccggggagguggucgaucuccgaauuagggcagcuagagggagcugcgugugcguggccgcugucgauaaaagugucuaucugcucagauccggauuuagacugacaccagcucaggucuuucaagaacuagaagauuaugacguuuccgacuccuuuggcguuagucgcgaggaugguccuuucuggugggccggauuaaccgcucagaggcgaagacgcucuagcguuuucccguggcccugggguauaacuaaagauaguggauuugccuuuacugagaccggccugguuguaaugaccgaucgcguaucccugaaucauagacaggacggugguuuauacaccgacgaagcugucccagccuuccagccucauaccgguagucugguugcaguggcacccagcagacacccgcccagaaccgaaaaaaggaaacguacuuucuucccggagacuuggaucuggcauugucuuaacauuuccgacccuucgggcgaggggacauuauccguuaaaguuccugauagcaucaccagcugggugggagaagcaguggcacuuucaaccucacaaggacugggaaucgcggagccgucucuucuuaagacauuuaaaccauuuuuuguggauuuuaugcuacccgcauugaucauccgcggagaacaaguuaaaaucccacuuucugucuacaacuacaugggcaccugugccgagguuuauaugaaguugaguguuccaaagggcauccaguucgucggucacccagggaaaaggcacguuaccaagaagauguguguggccccaggagaggcagaaccgaucugggucgucuuaucuuucucggaucucggucuaaauaauaucaccgccaaggcgcucgcuuauggagauaccaauugcugccgagacggucguuccuccaagcacccagaagagaaucacgccgacagacgugugccgauuggaguggaucacguacgacggucaguaaugguagaggcugagggggugcccagggcuuacaccuacagcgccuuuuuuugucccucagaacgugugcacaucagcacccccaauaaguacgaguuccaguaugugcagagaccccuucgguugacgcgguucgacgucgcaguaagagcccacaaugaugcuagggucgcccugagcucugggccucaggacacggcgggaaugaucgaaauaguacuaggcgggcaccaaaauacucgcucauggauuucuaccucaaaaaugggcgaaccugucgccucagcgcacaccgcgaaaauuuuaaguugggaugaauuccgaacuuucuggaucucuuggcgaggagggcugauccaggucggacacggaccagaaccaagcaaugagucugugauuguugcauggacacugccacggccuccugaaguccaguuuauuggguuuuccaccggauggggaagcaugggagaauuuagaauuuggagaaaaauggagguagacgaaucuuacuccgaagcuuucacccucggagugccacacggggcgauaccaggauccgaacgggccaccgcuuccauuaucggagacgucaugggucccacacugaaucauuugaauaacuugcugcgacugccuuuuggguguggugaacaaaauaugauacacuuugccccaaacguuuucguacuuaaguaucuccaaaaaacucagcaauugagcccagaaguggaacgcgagacgacugacuacuugguucaaggauaucagaggcaguuaacuuauaaaaggcaagacggcuccuacuccgcauucggcgagagggaugcuuccggcagcauguggcugacagcauucguccucaagucauuugcucaggcuagaucuuuuauuuucguggacccuagagaacuggcggccgcaaagucuuggauuauucagcagcaacaagcagaugguucuuuccuggcaguaggacgaguucugaacaaagauauucaggguggcauacacgguaccgucccacugaccgcauaugucgucguagcacugcucgaaacugggacugcgucagaagaagagcgcgggucaacugacaaagccagacauuuuuuagaaucugcugccccgcuggcaauggacccuuauucuugcgccuugaccacauaugcccuaacccuccuaagaagcccagcagcccccgaggcacugcgcaaacuucgaucgcucgccauuaugcgggacggagugacacauuggucucucucaaacagcugggacguggacaaaggcacauuucuaagcuucagugaccgcgugucucagaguguggucuccgcagaaguggaaaugacagccuacgccuuguugacauacacacugcugggagaugucgcagcagcucugcccgucguuaaguggcuuucccaacaacggaaugcauuaggcggguuuucuuccacucaggauacaugcguggcccuccaggcgcucgcugaguaugccauacugagcuacgcuggcgguauuaacuugacagucucacuagccucaaccaauuuggauuaucaggaaacauucgagcuucauaggacuaaucagaaagugcuacaaaccgccgccauuccaaguuuaccuacuggacuauucguuagugccaaaggagaugguuguugccuaaugcagauugaugucacuuacaaugugccagaucccguggccaaaccagccuuccagcuccuggugucuuugcaggaaccagaagcgcaggggagaccuccuccuaugccggccuccgccgccgaaggaucuagaggagauuggccccccgcugaugacgacgaccccgcagccgaccagcaucaucaagaguauaagguaaugcuggaaguuugcacacgcuggcuccacgcuggcagcucaaacauggccguccuggaaguccccuugcugagugguuuccgagcugacaucgagucacuagaacaguuacuguuggauaaacacaugggcaugaagagguacgagguugccggccgaaggguccuguuuuacuuugaugaaauaccaagccggugccugaccugugugagguucagggcacucagagaaugcguaguggggagaacgagcgcacugcccgucucaguguacgauuacuacgaacccgcguucgaggccacacgcuuuuacaacguuuccacccauucaccacuugcacgugaacuuugcgcagguccugcaugcaacgaaguagagcgagcgcccgcucgcgggcccgguugguuccccggcgaauccggaccugcuguugcacccgaggaaggagccgcaauagcucgcugcggcugcgaccaugacugcggcgcacaaggaaacccugugugugggagcgauggaguuguuuaugccuccgccuguaggcuacgggaagccgcgugccggcaagcagccccacuggagccugccccgcccuccuguugugcccuggagcagaggcuucccgcaaguuccagcaguacauacggugaugaccucgcaucgguagcaccuggcccgcugcagcaggauguaaagcugaauggagccggguuagaaguugaagacucugauccagagcccgaaggugaagcagaggacaggguuaccgcggguccacgccccccuguuucuuccgguaaccucgagucuagcacgcagucugccagucccuuccaucgauggggacagaccccugcaccucaacgccauaguggccgcgucgucggcgcucaucguccuggacuauuaagccccgucuucguuuauucacccgcuuuucaauccgggggggaggaaggacuuuggaugucuaacacaugcacccugcgauag

SEQ ID NO: 13632 - RNA, 1209 nt, Artificial Sequence
  Description of Artificial Sequence: Synthetic coding sequence
auggugugcgcucgggccgcucuuggccccggagcauuaugggcagcagcuugggguguccugcucuugacagcuccagcgggggcucagcgggggagaaaaaaaguggugcacgugcuggaaggcgaguccgggucuguuguagugcagacagccccuggccaggucgucucacauaggggagggaccaucguacugccuugucgauaucacuacgaagcggcugcacaugggcacgacggggugagauugaaauggaccaaggugguugacccccuggcauuuacggacguguucgucgcccuaggaccccagcaccgcgcauuuggcaguuacagggggcgggccgagcuucagggagauggaccaggcgacgccucccucgugcuucgaaaugugacucugcaggauuauggccgcuaugaaugcgaggugaccaaugagcucgaagacgacgcagggaugguuaaguuggaccucgaaggcgucguauucccuuaccacccuagaggagggcgauauaaguugacauucgcugaggcacagagagcaugugcagaacaggaugggauacuggcaagcgcagagcagcuccaugcugcguggagggaugggcuugacuggugcaacgcaggcugguuaagagauggcuccgugcaguauccuguuaaucgucccagagagcccuguggaggucugggagguacuggaagcgcuggugggggaggugacgcuaacggcggcuuacgcaacuauggcuauagacauaacgcggaggaacgcuaugaugcauucugcuuuacuucaaaccugcccgggaggguguuuuucuugaagccucugcgaccaguuccuuuuaguggggccgcucgcgcuugcgcugcucgcggugccgcuguagccaaagugggccagcuuuuugccgcauggaagcuacaauuacuggaccgcugcacagcaggauggcucgcggacgguagugcucgguauccgauagugaauccucgcgccagaugcgguggcagacgccccggcguccgaagucucggauucccugaugccacacgucggcuuuuugggguguauuguuauagggccccuggugcaccugauccugccccuggaggguggggauggggcugggcuggugguggcggaugggcugguggagcgcgugacccagccgcguggaccccucugcacguguag

SEQ ID NO: 13633 - RNA, 1740 nt, Artificial Sequence
  Description of Artificial Sequence: Synthetic coding sequence
augucagcauuaagaccgcuucuucuucuuuugcuuccacucuguccgggucccggccccgguccaggcagcgaagcuaaagugacacgcucgugcgccgagacaagacaggugcucggagcccggggauauucuuugaacuugauaccaccagcccugauaucgggcgagcaccugcgggucugcccccaagaguauaccuguuguuccucugagacugaacaaagacuuauacgagagacggaggcaacuuuucgcggccuuguugaggauucuggaaguuuccuuguacacacacuagcagcacggcauaggaaauucgacgaauuuuuucucgagaugcugucgguugcccaacacagucuuacacagcuauuuagucauucauacggccgucuuuacgcacagcacgcccuaauauucaacggguuauuuagcaggcuccgagacuucuacggcgagucaggcgagggucuggacgacacacuggcagacuucugggcccagcuguuggagcgcguuuuuccccuacuucacccacaauacucauucccaccggacuaucuucuuugccuaagccgccuggcauccaguacagaugguucacugcagcccuuuggcgacagcccaaggcgguuacgauugcagauuacccggacgcuggucgcugcccgagccuuuguacagggacuggaaaccggccggaacgucguuagcgaagcucugaagguucccgugagugagggauguagucaggcccuuaugcgcuuaauugguuguccgcugugcaggggaguuccuucacuuaugccaugccaaggcuuuugucuuaaugucguacggggaugcuugagcuccagaggucucgagccugauugggguaacuaccuggacggucugcuuauccuugcugacaaacuccaagguccguuuucuuucgaacugacggccgagucgauaggcguuaaaauuuccgagggccucauguaccugcaagaaaacuccgcuaaggucucagcccagguguuccaggaaugcgguccuccagaccccgugccagccagaaaucgcagggcccccccuccaagagaagaagcuggacgacucugguccauggugaccgaggaagaaagaccuacaacggccgcaggcacaaaucuccaucgucuugugugggaacucagagagcgccuggccagaaugcgcggguuuugggcacgccuuagcuuaaccgugugcggcgauagccgcauggcagcagacgcauccuuggaagccgcucccugcuggacaggggcgggccggggccgauaucugccucccgucguaggaggauccccugcagaacaaguaaacaauccugaauugaagguggacgcaucagggccagacguaccuacuaggcgaagaagacuccaguuacgcgccgcgaccgcucguaugaaaacagccgcacucggacacgaucuggacggacaggacgccgacgaggacgcuuccggcuccggagggggacagcaguacgccgacgacuggauggccggugcaguugcuccaccugcucgcccaccucguccccccuacccaccucgacgcgacggcagcggaggcaaaggcgggggaggaucugcuagauacaaccaaggccggucccgaucaggcggagcuuccauuggcuuccacacgcagaccauucugauauuaucacuuuccgcucuggcucugcuggguccaagguag

SEQ ID NO: 13634 - RNA, 498 nt, Artificial Sequence
  Description of Artificial Sequence: Synthetic coding sequence
auggcccuccuggcacugcugcuggugguggcuuugccucgcgucuggacugaugcaaauuugaccgcccgucagcgggacccugaagacagccaacggacggacgaaggggacaaucgcguguggugccauguuugugagcgggaaaauacguuugagugccaaaacccccguagauguaaauggacagaaccuuacugugugaucgcugcugugaaaauuuuuccgagauuuuuuaugguugcuaaacagugcucugcugggugugcugcuauggaacgcccuaagccugaagaaaagagauuccuccucgaagagcccaugccuuuuuuuuacuugaagugcugcaagaucagguacugcaaccuggagggccccccuauuaauucauccguguucaaagaguaugccgggaguaugggagagucaugcgguggauuauggcuugcuauuuugcugcuucucgccagcauugcagccggccuaucacucaguuag

SEQ ID NO: 13635 - RNA, 933 nt, Artificial Sequence
  Description of Artificial Sequence: Synthetic coding sequence
augaauggccugucccugagugagcuguguugucuguuuuguuguccacccugccccggccggaucgccgcuaaacuugcuuuucugccucccgaggcgaccuacucacuggugccagaacccgaacccgggcccgguggugcuggagccgcgccucucgguacauugagagccagcucaggagcacccggacgauggaagcugcacuuaacagagcgcgccgacuuccaauacucccaacgagagcuggacacaauagagguguuuccaaccaaaagcgcaagaggcaaucgggugucauguauguauguucgcuguguacccggcgcaagauauacgguucucuucucucacggcaacgcaguagaccucggccagaugucgucguuuuacaucggacuuggaucccggcuucauugcaacaucuuuuccuaugauuacagcgguuacggagcgucuuccggcagaccaagcgagcggaauuuguacgcagacauugaugccgcguggcaggcacugagaacccgguacggaauaucuccugauucuauaauacuuuacggucagucgauagguacugucccaaccgucgaccuggcuucccgauacgagugugcugcagucgugcuucauucuccccuaacaagcggcaugcgcguggcauuuccagacaccaagaagacauacugcuucgaugccuuccccaauaucgaaaaagugagcaagaucacaagccccgugcugauuauccauggcaccgaggacgaagugauugauuuuucucacggccuugcccuguacgagcgcuguccaaaagcaguagaaccacucuggguggagggagccggccauaaugauaucgaauuguacucacaguaccuggaaagauugaggcgcuucauuucccaagaacuccccucccagcgcgcauag

SEQ ID NO: 13636 - RNA, 1905 nt, Artificial Sequence
  Description of Artificial Sequence: Synthetic coding sequence
auggcucagggcgugcuguggauccuucugggucuguugcuuugguccgauccgggcaccgcgucccugccuuuguuaauggacuccguuauucaggccuuggccgaauuagaacagaagguucccgccgcuaaaaccagacacaccgcauccgcuugguugauguccgccccgaacucuggaccccauaaucguuuguaucacuuccuccugggugccuggagccuuaaugccacagaguuagauccuugcccccuauccccugaacugcuuggccucacaaaagagguggcuagacacgauguacgugagggcaaggaguauggagucgugcuggcaccugacggcucuaccguggccguugaaccuuuauuggcaggacuugaggccggccugcagggccgacgagucaucaaccucccccuggacagcauggcggcaccuugggagacuggagauacauuccccgacguaguugcaauugccccugaugugagagccacaaguuccccggggcuaagggauggaucaccggaugucaccacugccgacauaggcgcuaacacacccgaugcaaccaaaggcugcccagauguucaagcaucacuccccgacgcuaaagcgaaaucccccccaaccaugguggacagcuugcuggcugugacucuugccgggaaucucggccugacguuucugaggggcucccaaacucagagccaccccgaccuaggaacugaaggguguugggaccagcucuccgccccucggacuuucaccuuguuagaccccaaagcuucucuuuuaaccauggcguuccucaacggcgcguuagacggugugauuuugggcgacuaccucagccgaacccccgaacccaggcccucccucucucaucuccugagccaguacuacggagcuggaguggcucgagaucccggguuuagaaguaauuuuagaagacagaacggcgccgccuugacaagcgcauccauucuggcccagcaggucugggguacccuagugcuacuucaaagacuggaaccggugcaucuacagcuucaaugcaugucgcaggaacaacuagcucaaguggcagcaaaugcuaccaaagaguuuacagaggcguuucucggauguccugcuauacacccucgcugccguuggggcgcugccccauacagagggagacccaaacuucugcagcuuccguuaggauuucucuacguccaucacacguauguccccgcccccccuuguacugacuucacacggugugccgccaauaugagaucaaugcagagauaccaucaggauacacaggguuggggagacaucgguuacaguuucgugguaggaucagacggauauguauacgaaggcagaggguggcacugggugggggcacacacacucggacacaauaguagaggguuuggaguggccauaguggguaauuauacugcagcccugccuacagaagcugcucugagaacaguacgugacaccuugccuuccugcgccguuagagccggcuugcucagaccagauuacgcccugcucgggcaccgccaguuggugcgcaccgacugcccaggcgaugcacucuucgauuuacugcguaccuggccacauuucacagcuguuucucucaggucccuccauuacaccgcccgccgaccaaguguuuauacgucaaguacccggccccuuccaccugccuguaacaguugugccagaaccgccuccgcgagaccacccacgagccgccgacauguguacagcgggaaccugggcccugccuucgccggucacucugcaggaaacauacccgacccaguuacuucagccuacgccgccagcgcccagccccaaacacagccugccuguccauucccaucgaguuag

SEQ ID NO: 13637 - RNA, 777 nt, Artificial Sequence
  Description of Artificial Sequence: Synthetic coding sequence
auguuggugcuuuacggccacuccacgcaggaccugccugagacgaacgcgcgcgugguuggaggcaccgaagccggacgcaauuccuggccgucccagauuucccuccaauacagaaguggaggaucacgauaucauaccuguggcggaacauugauucgacagaacuggguaaugacagcugcccauugcguugauuaucagaaaacauuucgcgucguugcuggcgaucacaaccuaagccaaaaugacgguacagaacaguauguuagcguucagaagauugugguacacccuuacuggaauuccgacaacgucgccgcuggcuaugacauagcucuccuccggcucgcucaguccguuacccugaacaguuacguccagcucggagugcugccacaagaaggcgcuauacuugcaaacaacucuccaugcuauaucaccgggugggguaagaccaagaccaacggucaacuggcacagacucuccaacaggccuaucuucccagcgucgacuaugcuauuuguucuagcucgaguuauugggggucgacugucaaaaauacuaugguaugugcagggggugauggcguaagaaguggaugucaaggugauucuggggggccgcuacauugcuuagugaacggcaaauauagugugcacgguguuacuagcuucgugucuucuaggggcuguaacguuucaagaaaaccaacaguguucacgcaaguauccgcauauauuagcuggauuaauaacguaauagcuucuaauuag

SEQ ID NO: 13638 - RNA, 993 nt, Artificial Sequence
  Description of Artificial Sequence: Synthetic coding sequence
auggccgccaggcguucccagcgcaggagaggcagacgcggcgagccgggcacugcccugcuaguccccuuagcgcuuggccuuggucuugcucucgcguguuugggccuccugcuggcagugguaagccucgggucacgugccagcuugucagcucaggaaccugcccaagaggaacugguggcugaagaggaccaagacccaucagagcuuaacccucagacugaggagucucaggacccugcgcccuuuuugaauagacuugucagacccaggagaagugcacccaaaggacggaaaacucgcgcucggagagcaauagccgcccauuacgaaguccacccacgaccuggucaggauggugcucaagcaggagucgauggcaccgugagcgguugggaagaagcacgaauuaacucaagcagcccucuacgguacaauaggcagaucggugaauuuauugugaccagagcaggacuguauuaccuuuacugccagucuucagacgcucuagaggccugggaaaacggcgagcgaaguaggaaaagaagagccguccugacccagaagcagaagaagcagcauaguguucuucaccuuguccccauuaacgcuacgaguaaagacgauagugacgugaccgaagugauguggcagccagcauugcgacgugggagaggauuacaagcacagggguacggaguccggauacaggacgcuggcguauaccugcucuacucacaggucuuauuucaagacguaacauucacaaugggccagguagugucgagggagggacagggccggcaagagacccuguuucggugcauaagaucaaugcccucccacccagaccgcgccuauaauucuuguuauucugccgggguguuccaucuucaccagggcgauauuuuaagcgucaucaucccacgagcgcgggccaaacugaaucuuagcccucacggaacuuuucuaggcuuuguuaaacuguag

SEQ ID NO: 13639 - RNA, 2253 nt, Artificial Sequence
  Description of Artificial Sequence: Synthetic coding sequence
auggcaaagccccgccuguugguauuauauuucgcacuaaucgugguacccgcuugggugucaagcaucguucucaccggaaccucugaaccccccgaugcacagaccguagccccugccgaagaugaaacgcuccaaaacgaggcagauaaccaagaaaauguguuaagccagcuccucggugauuaugacaagguuaaggccaugagcgaagguagugauugccaauguaaaugcgugguacgaccacuaggucgcgacgcuugucagaggaucaaugccggugcgagccggaaggaagacuuuuacacaguggaaaccaucaccucaggcucgaguugcaaaugugcguguguggcaccgccauccgcccugaacccgugugagggcgacuuucgucugcaaaagcugagggaagccgauagccaggaucuuaaacugagcacgauuauugauaugcuagaaggggcuuucuacggacuagacuuguuaaaauugcacucagugacaaccaaguugguaggcagagucgauaagcuggaagaggaaguguccaaaaaccugacgaaagaaaaugaacagauuaaagaagauauggaggagaucagaacugaaaugaauaaaagaggcaaggaaaauugcagcgagaacauccuggauucaaugccagauauucguagcgcacuccagcgagacgccgccgcagccuaugcacauccugaauacgaagaaagauuuuugcaagaggagacagugucacaacaaauuaacucuauagagcuacuccagacacgcccucuugcgcugccggaaguugugaagucccagaggccauugcagaggcaggugcaccugagaggcagacccgcuagccagcccacaguuauaagagguauuacauacuacaaagccaaagugucagaggaagagaacgauauugaagaacaacaggacgaauucuuuagcggagacaacggaguugaucuucugauugaagaucaguugcucaggcauaacgggcugaugaccuccgugacgcgacgaccugccgcaacucgucaaggacauuccacagcugucacuuccgaucugaacgcuagaacugcgccuuggucuuccgcccugccacagccauccacuagcgacccuucaauugcaaaucacgcuucugugggcccaacccugcaaacuaccucagucucgccagauccaacccgcgagagcguucuucagccauccccccaagugccagccaccacuguggcccacaccgcgacccaacaacccgcugcaccagcuccccccgccgugucgccucgggaggcccugauggaagccaugcauaccgucccuguaccgcccacaacuguucgaaccgauucccugggcaaggacgcuccugcaggcuggggcacuaccccugcaagcccuaccuugagcccugaagaggaagacgauauucgcaaugugauuggaagauguaaggacacccuaucuacgauuaccgggccgaccacacaaaauacauauggccggaaugaaggagccuggaugaaagacccccuggcuaaggaugagcgaauauacgucacuaacuacuauuaugggaacacacucgucgaauuccgaaaucuggaaaauuuuaagcagggaagauggagcaauucuuauaaauuaccguacagcuggauugggacaggccaugugguauauaacggcgcauucuacuacaaucgcgcguuuacacgcaacaucaucaaguacgaucugaaacaacgcuauguagcagcuugggccaugcuccaugaugucgccuacgaggaggcuacaccauggcgguggcagggccauucugaugucgauuuugcgguagacgaaaacgggcuguggcugaucuacccagcccuggacgaugaggguuuuucucaagaggugaucgugcugucuaaauugaacgcugcagaccugucaacccagaaggagacaacuuggcgcacuggacuuaggcgaaauuuuuacggcaauugcuuuguuaucugcggagugcuuuaugcaguggauucauacaaucaacgaaaugccaauaucaguuaugcuuuugauacacacacaaacacccagaucgucccacgauuauuauucgagaacgaauauagcuauaccacccagaucgacuauaauccgaaagauagacuacucuaugcuugggauaacggccaccagguuaccuaccaugucauuuuugcauauuag

SEQ ID NO: 13640 - RNA, 678 nt, Artificial Sequence
  Description of Artificial Sequence: Synthetic coding sequence
augaaauuaggaugcguguuaauggcaugggcucucuacuugucccucggaguguuguggguugcucagaugcugcuugcggcagggugucacgcagaacuguucccagcaccgauucucagggccgugccaucagcagaaccacaagccggguccccaaugacguuaucuugccaaacuaaacugccucugcaacgcucagcagcaagacuccuguuuucuuuuuacaaggauggacgcauugugcagucuagaggcuugucaucugaauuccagaucccaacagccuccgaggaccauuccggaaguuacuggugcgaggccgccaccgaagacaaucagguguggaaacagaguccccagcuagagauccgagugcaaggugcaagcucaagcgccgcuccaccuacacugaauccugccccacagaagagugcagccccuggcaccgcucccgaagaggccccgggcccccugccgcccccgccuacuccuucauccgaagauccuggauucucuucuccacucgggaugcccgauccucaccuguaccaccaaaugggacuccuacugaaacauaugcaggaugugagagugcuguuagggcaccuguuaauggaacucagagaguuaagugggcauagaaagccuggaacuacaaaagcuaccgcagaguag

SEQ ID NO: 13641 - RNA, 891 nt, Artificial Sequence
  Description of Artificial Sequence: Synthetic coding sequence
augucccgccaggaacccaagauguuuguacuccuguauguaacauccuucgcaaucugcgcgagugggcagccacgggggaaccaacuuaaaggagagaacuacucaccucgguacauuuguuccauacccggacuaccuggaccaccagguccaccaggcgcaaauggaucacccggaccacauggacguauaggccugccugggcgcgacgguagagacggucggaagggcgagaaaggagagaaaggcaccgcaggacugcguggaaaaacuggcccucugggacuggcuggugagaaaggggaccagggcgaaacaggaaaaaagggacccauuggaccugaaggugaaaaaggcgaggugggacccauuggacccccgggaccaaagggcgaccgcggugaacaaggggauccuggacugcccggcguguguagaugcggcuccaucguucugaaauccgccuuuuccguaggcaucaccacgucguacccagaggaaagacuccccauaaucuucaauaaaguguuauucaaugagggagaacauuacaauccugcgaccggcaaauucauuugugcauuccccgguaucuauuauuuuucauaugauaucacccucgcaaauaaacaccuugccaucggauuaguucauaauggucaauauaggauaaagacauuugacgcaaacacugggaaccaugacgucgccagcggcucaacagugaucuacuuacagccggaagacgagguguggcucgagauauuuuuuacugaucaaaauggauuguucagcgacccagguugggcugacagucuuuuuucuggcuuccucuuguauguugauacagauuauuuggacucgaucagcgaggacgacgaacuguag

SEQ ID NO: 13642 - RNA, 1275 nt, Artificial Sequence
  Description of Artificial Sequence: Synthetic coding sequence
augggcagcuugguauuaacacuuugugcacucuucugccuugcugcauaccuggugucuggaagccccauuaugaaccuugaacaaucuccacucgaagaggauaugagccuuuucggcgauguuuuuagcgaacaagacgguguugauuuuaauacccuucugcagucaaugaaggaugaauuucugaaaacucucaaucuguccgauauucccacccaggacagcgcuaaggucgacccucccgaauacaugcucgaauuguauaauaaguucgcaacagauaggaccucaaugcccucugccaacaucauacguuccuucaaaaacgaagaucuuuuuucgcagccuguuuccuuuaacgggcucagaaaguacccacuccuauuuaaugucucaaucccacaucacgaagaagugauuauggcugagcuuagacuguauacguuagugcagcgcgaccgcaugauuuacgaugguguagaucggaaaauaaccauuuuugaggugcuggaaucaaaaggagauaacgagggcgagaggaauaugcuaguguuagucaguggugaaauuuaugggaccaacucagaaugggaaacauuugauguaaccgacgccauucggcgguggcagaagucuggcucuuccacacaccaauuggagguacauauugagucuaaacacgaugaggccgaagacgcaucauccggucgccucgaaauagauaccucugcccaaaauaaacacaacccccugcuuauaguguuuucugacgaccaaucuagcgauaaggagcggaaagaagagcugaacgagaugauuucacaugaacagcugccugaauuggauaaucugggccuagacucauuuagcaguggacccggagaagaagcucuucuccagaugagaaguaacauuaucuacgauaguacagcuagaauuagacgcaaugccaaggggaacuacugcaaaagaacaccccucuauauugacuucaaggagauuggcugggacucauggauuaucgcucccccuggguaugaagccuacgaaugccgcggaguguguaauuacccucuugcugagcacuuaacgcccaccaaacaugccaucauacaagcccuuguucacuuaaaaaacucacagaaagcuuccaaagccugcuguguaccaacuaagcuugagccuaucagcauucucuaccuugauaagggaguggugacuuacaaauuuaaauacgaaggcauggcgguaucagaauguggcuguagauag

SEQ ID NO: 13643 - RNA, 381 nt, Artificial Sequence
  Description of Artificial Sequence: Synthetic coding sequence
augcaccugagccagcuguuggccugcgcacugcuccuuacacugcuaagucugagacccagcgaagcaaagcccggagccccacccaaagugccccggacacccccagccgaggaauuagcugaaccacaagcagcaggcggaggucagaaaaaaggggauaaggccccgggaggagguggagccaaccuaaaaggagaucgcagcaggcuguuaagggaccugcggguggacacaaaaucacgggcagccugggcaagguuacugcaagagcauccuaacgcccggaaauauaaaggcgcgaauaaaaagggacuuaguaaagggugcuucggacuaaagcuagacagaauagggucuaugucaggauugggauguuag

SEQ ID NO: 13644 - RNA, 423 nt, Artificial Sequence
  Description of Artificial Sequence: Synthetic coding sequence
augcgcucuccccggaugcgcgugugcgccaaauccguguuguugagccacuggcucuuucuggccuauguguuaauggucugcugcaaacucaugucagcaucaucucagcacuugcgcgggcaugcgggacaucaucagauuaagcaggguacaugcgaaguggucgccgugcauagauguugcaacaagaaccgaauugaagaaagaagccagaccgucaaaugcagcuguuuuccgggacaagucgccggcaccacccgggcgcagcccaguuguguggaagcuucuauugugauacagaagugguggugccauaugaaccccugccuugagggggaagauuguaaaguucugcccgacuacucaggguggucuugcucuagcgguaauaaaguuaaaacaaccaagguuacuagauag

SEQ ID NO: 13645 - RNA, 1332 nt, Artificial Sequence
  Description of Artificial Sequence: Synthetic coding sequence
auguugauguuguuuguguucggcguccuccuacaugaggugucucuguccggacagaacgaagcaccaccaaacacccacucaauacccggcgaaccacuguacaacuaugcaagcauacgacuacccgaggaacacauaccuuucuuucugcacaacaauagacacauugcaaccgucugucgcaaagacucuuuaugcccuuauaagaagcacuuagagaagcugaaguauugcuggggguacgaaaagagcugcaagccugaguuucgguuuggcuacccuguuuguucuuauguagacaugggauggacagacacacucgagagcgcugaggauauuuuuuggaaacaggccgacuucggguacgccagagaacggcucgaagagaugcaugugcuaugucagccuaaagaaaccagugacucaucucugguaugcucacgauacuugcaauauugccgcgcaacaaaccuguaccuggaccuucggaauauuaaacguaaccaugaccgauuuaaagaggacuuuuuucaaagcggugagauuggcggucacugcaagcuggacauccgcacucuaacuucugaaggccaaagaaaguccccuuuacagucuugguuugccgaacugcaaagcuacacucagcucaacuuccgcccaauugaggacgccaagugugauaucgucauugagaaaccaaccuacuucaugaagcuggacgccggugucaauauguaccaucauuucugcgauuucaucaauuuguauauaacccagcacguuaacaauucuuuuucaaccgacgucuauaucguuaugugggacacagacggaaagauacgagugaccauccucgcaaggucuacggaguacaggaagauacugaaccagaacgaacuagugaaugcuuuaaagacagucucgacuuuugaagugcagauaguagauuacaaguaucgagagcugggguuccuggaucagcuucguaucacucacaacacagacauuuucaucgggaugcauggcgcugggcugacacaccuguuguuccuuccagacugggcugcagucuuugagcucuacaauugcgaagacgaaagguguuaucuugaucuugcuagacucagaggggugcacuauaucacuuggcggcggcaaaacaagguuuucccccaagacaaaggccaucauccaacuuuaggcgagcauccaaaauucacgaauuauaguuuugacguugaggaauucauguaccucguguuacaggcagccgaucauguacuucagcaucccaaauggcccuucaagaaaaagcacgacgaguuauag

SEQ ID NO: 13646 - RNA, 336 nt, Artificial Sequence
  Description of Artificial Sequence: Synthetic coding sequence
auggggccuucuucuugccugcugcuuauucugaucccacuccuacagcuaaucaauccuggcaguacucaguguuccuuggacucaguaauggacaagaaaauuaaagauguguugaacagccuggaguacucucccaguccaauuuccaaaaaguuguccugcgccuccgucaaaucccagggacgcccuucaucaugccccgccggaauggcugucacaggaugugccugcgguuaugggugugggucaugggacguccagcucgaaaccacaugucacugucaguguaguguaguggauuggacuaccgcgcguugcugccaccuaaccuag

SEQ ID NO: 13647 - RNA, 1965 nt, Artificial Sequence
  Description of Artificial Sequence: Synthetic coding sequence
auggccccuaagaaacugagcuguuugagaucucuuuuacuuccucucucucuuacccuacuacucccccaggccgauaccagaucuuuugucguagaccgcggucaugaccgcuuucuguuagacggggccccuuucagauacgucuccgguucacuucacuacuucagagucccucgcgugcucugggccgaccgguuacucaagaugcgcuggucuggucucaacgcaauucaguucuaugugcccuggaacuaucacgagccacagccggguguuuacaacuuuaauggaucuagagaucucauagcuuuucugaaugaggcagcacuugcaaaccuacucguuauacuccggccuggaccuuacauuugugcggagugggaaaugggcggacugccuagcuggcuauugaggaaaccagaaauccaucuuagaacaucagacccagauuuccuggccgcaguggacucaugguucaagguguuacucccaaaaauuuaccccuggcucuaucacaacggaggaaacaucaucagcauucaaguggagaaugaguacggaucauaccgcgccugcgauuuuucuuauaugaggcaccuggccggacuguuuagagcacugcuuggcgagaaaauucuguuauucaccaccgauggcccugaaggccugaagugcggcagcuuaaggggacuguauaccacagucgauuucggccccgcugacaacaugacaaagaucuucacccugcuccguaaauaugagccccauggcccucucguaaauucugaauacuauacgggcuggcuugacuauuggggacagaaccacucaacccgauccguuucugccgucacgaagggucuugaaaauauguugaaacugggagccagugugaacauguacauguuccacggcgggaccaacuuuggcuacuggaauggggccgauaagaaagggcgauuuuuaccgauaacgacuaguuacgacuaugaugcucccauaucugaagcuggagauccaacucccaaacuguucgcuuuaagagauguuaucucgaaauuccaggaagugccucuggguccucuaccuccgccaagccccaaaaugauguuaggucccguuacucuacauuuggugggccaucuauuagcauuuuuggaccuguugugcccccgcggcccuauucacuccauauugccaaugaccuucgaggcagugaaacaggaccauggcuucaugcuguauaggacuuacaugacucacacaaucuuugaaccaaccccuuucugggugccuaauaacggcguacacgauagggcuuaugugaugguagacggaguauuucagggagugguggagagaaauaugagggauaaacuguuccugacgggaaagcucggcaguaaauuagauauccuaguagagaauaugggccgucuuucuuucggcuccaacaguagugauuucaaaggacuucugaaaccucccauccuggggcaaaccauccugacucaauggaugauguucccucugaagaucgauaauuuggugaaguggugguucccgcugcaguugccuaaauggcccuauccccaagcacccucuggcccuacuuucuauaguaagaccuuuccuauacucgguagcgugggcgauacauucuuguaccuucccggauggacuaagggacaaguuuggaucaauggcuuuaaucuggguagguacuggacaaaacaaggcccucagcaaacucuguaugucccccgcuuucuguuguucccccgcggcgcuuuaaacaagauaacucugcuggaacuugaagauguucccuuacagccccaaguacaguucuuagacaaacccauccucaacucuacuuccacuuuacauagaacccauauuaacucccuuucugcugacacacugagcgcgucugaaccaauggagcucucgggucacuag

SEQ ID NO: 13648 - RNA, 2502 nt, Artificial Sequence
  Description of Artificial Sequence: Synthetic coding sequence
augaauauggagauuggacacccccacgaaggcaaggaugauuuaggcgauaagagggugauaaugggaaccaaguuucccauggaguugggcauucgcguagguuugggcaaagaagauagcaggugcggugaaucuccgguggucagcaacaagugugagggacgcauggcacccccagagaccaaauucccacugucuaaagggcuggagaugggacucgaacggcagaacauuucucgcaccgugaugcagcgggguucccucggcguggauagcgugucagcaagccagggaaccaagcccagccuguugccugguagaaugggucuggaaaacgaaucacugcuggccggguacacacacgaacgaauaauacagccaccucuuggccgcgugugcggaagcucccaggcugcugggagucgucgcgcuccccuggcaagugguccugaaggaguugaagaauuaguuggcaaacccgcuuuuguuauggagccuaggcaagaaauggagaaggagagcaccugcguuuugaugaaacccaacacagaaauaaaacuuccuguggagguggacaucgggcugacccaagcggaggguccggacgaaacgaaaaauacugagccccagaugggacuggugauugaaccaccucaaugccaauucgcucaacagcaugaacagaggaaagaggcaggaaacaucgaauccgggguagagccaccugacaggauccgcccgaucuauagcggcaaauucuucgaccgcaccccguguuggccgucugccggcaaagucauucccguagguuauagaguggcuaccugcuugaccgagaagcuaccaagauugauaacuccucccgaagcaaaaaaguacuucaauuuccgauaucccccugcaggggucgaacgcguguuuuacggcagagcuaacgacccgcaaauugcucccuacuugacucaugggauucguuccaaaauuuccguccuggcuaauacucucauuaauccccagccaauuaccaccuuccagcaaaagauaaaggauaagaaggaaaguaucuaucucuccaaccgccgugcaccacucggcaagucucacgaccaggcucccggacucccuaaaggcauggauacgaccaacaccaccuucggaaccgccgugauuaaagaauauucugccaaagauguaguaaacccaccaaagucguaugaagaaguguucaaagaaggcaaugaaggucacgaucuuuacguggugucgcauaaugacuauuaugcaggagaagcaaagaaucgcaaauauaaucccucaucauuccaccggugcagcguuuauggaguuccuaccccucauuucaacgacggccgagcaauggccaaaagccuauacuggcugcacgagcugcaaaugaagcggggcgccaaguucguaucaaaaagggccgaugacuucaaagagaaguuucaacacaaauugggcagggugcuggacccuauagcugaaaccaugaaugucccuccugacuguaccuuuggagcgugccuccgcccugaagaauacgggguaggagaucugauacauaacagacucccugacgaauaucuucgcggcaaggaccgccaacgagcacugauugcagcugugagacaucauuuaaaaaaggugaacuaucagaaguuugacacacuccuggcagcauuucggcauuacgauaagaagggagauggaaugauugacaaagacgagcugcaagaggccugcgaccaagcuaaccugucccuugaugacaagcuccuggaccagcuuuuugauuauugcgacguggacaacgauggauuuaucaacuaccuggaauuugcaaacuuucugaacuggaaggauaaaaugcugcucaaagaauacgaagaacgcguuauuauaaaaggaaggaagcccgacugcgugaauccaacagaagcuaaugucgaagagccagagcagacucuacucauaaagcccgaggacaucguacuuaaggaggcuggaagcacagagaaaacacugagaacacuccuccgcccuagugauaaggugaguaacuacuacaaaacaacuagcucagagaucaacgcuaucguuggggcuauaccaucaacgugcuauccaauuugcggcgucccaacgaucagaagcgacaucccagcuccaagaauacgaagaauaagcgacagaaccaauuauggagaggaaggguccgccuacagccuucuguauccaacuaucuuugccaggaaagguguguuugaacgggauuucuuuaagaccaggucaaaagaggagauugcugagauacugugcaauaucggcgugaaguuauccgaugaagaguucgaaaacgucuggaaccucgcauccaagaaacaucauagaggagaagucuguguagagaauauccgcaacgugcucgacgaacuaagacaugccgaucggauuaaauguaagacuuuaauguag

SEQ ID NO: 13649 - RNA, 2004 nt, Artificial Sequence
  Description of Artificial Sequence: Synthetic coding sequence
auggguucaucucgccuugccgcacuguugcugccacuucuccuuaucgucauugaucugucugacagugcagggauugguuuucgacaccucccucauuggaacacucgguguccccuagccucgcacacugacgauagcuucacaggcuccagcgcauacaucccaugucggacauggugggcauuguucaguacgaaaccauggugcguccggguauggcauuguucgaggugucuaugucagcacuuacucuccggcggauccggccugcagcguggucuguuccaucuacuuguccaaaagaguaaaaagucaagcacguuuaaguucuaucgaaggcacaaaaugcccgcuccagcacagaggaagcuauugccuagacgacaucuuucugagaaaucgcaucauauaucaauucccuccccugacauuucacauaaggggcuccggucuaaaagaacccagccaagcgacccagaaaccugggaaucccucccccgccucgauucgcagcggcacggcgguccugaauucuccuucgaccuccucccagaggcgcgggcaaucagaguaaccauaaguagcgggccugaagugaguguuagauuaugucaccagugggcccuggaaugcgaagaguugaguuccccuuaugacguucagaagauugugucugggggccauacuguggaacugccauacgaauuuuuacugccuugucuguguauugaggcuucuuaucugcaagaagacacagugaggcgcaagaaauguccuuuucaauccuggccugaagcuuaugguagugacuuuuggaaauccguucacuucacggacuacagucagcauacucaaaugguaauggcucucacacugcgcugcccauuaaagcuggaggcugcccugugccagcggcacgacuggcauaccuugugcaaagaucuccccaaugcuaccgcucgagaguccgauggcugguauguauuagagaaaguggaucuucacccucaauugugcuuuaaguucaguuuuggcaauuccucucacguugaaugcccccaucagaccggcagucucacuaguuggaacguuucaauggauacccaagcacagcaguugauucuucauuucuccuccaggaugcaugccacguuuagcgcugcuuggucucuaccuggcuuaggacaagacacacuugugccuccgguguacacaguuucacaggccaggggcuccuccccugugaguuuggaucuuauuaucccauuccugcguccuggcuguugcgugcuagucuggagaagugacguucaguucgcuuggaagcaccuccugugccccgaugucucguaucgccaucugggacugcugauacuagcacuuuuggcccugcucacccuucuaggcgugguacucgcccugacgugcagacgcccucaauccggaccaggccccgccagaccuguccuucuuuuacaugcugccgauucugaggcccagagaaggcucgucggggcccuggccgaacugcuccgagcugcuuugggcgggggacgagacgugauuguugacuugugggaggguagacaugucgcccgggucgguccacuccccuggcuuugggccgccagaacgcgaguggcccgugagcaggguacagugcugcuucucugguccggcgccgacuuacgucccguaucaggccccgauccaagggccgcgccuuuacuugcauuacuccacgcugcccccaggccucuucuacugcuugcuuauuucagccgguugugcgcuaagggcgauauccccccuccgcugcgggcucucccccgauaccgacuccugcgagaucucccucgccugcugagagcccuggacgcgcgcccuuucgcugaagcuaccucguggggcagauuaggcgcuaggcagagaagacagagucgccuugaauugugcagucgacuugaacgcgaagccgcucgguuagcagaucuuggguag

SEQ ID NO: 13650 - RNA, 609 nt, Artificial Sequence
  Description of Artificial Sequence: Synthetic coding sequence
auggaacuguggggagcuuaccugcuacuguguuuauucucacuacugacgcaggugacgacagaaccuccuacccagaagccaaagaagauugugaacgcaaaaaaagacgucguuaacacaaaaauguucgaggagcugaaaucgcgcuuagauacauuagcccaggagguugcauuacugaaggaacaacaggcuuuacagaccguguguuugaaggguacuaaaguucacaugaaaugcuuucuugcauucacacaaacuaaaaccuuccaugaagccagugaggacugcauuagucgagggggcacgcuugggaccccucagacugggagcgaaaacgaugcacucuacgaguaccuuagacagucagugggcaacgaagcagaaauauggcugggacuaaaugacauggccgccgaaggaacauggguugacaugacaggugccagaaucgcauauaagaacugggaaacugagauuaccgcccagcccgacggcggcaaaacugaaaacugcgccguacugaguggcgcugcuaauggaaagugguuugauaagagaugccgggaucaacuuccuuacauuugucaguuugggaucguguag

SEQ ID NO: 13651 - RNA, 1839 nt, Artificial Sequence
  Description of Artificial Sequence: Synthetic coding sequence
augcuugagggcuugggcuccccagcuaguccacgugccgcugccucugccucuguagccggcucuuccggccccgcugcuugcucaccaccaucuucaagugcaccacgcuccccagaaucgcccgccccaaggcguggaggagugcgcgccucugugccucagaaacuugcggaaaugcuguccagccaguauggacucauuguuuucgucgcuggacugcuccuucuucucgcgugggcagugcacgccgccgguguaucuaaaucggaucuacugugcuuucugaccgcucugauguuacuucaacugcuguggaugcugugguaugucgguaggucaagugcacauagaagacuguuucgacugaaagacacccaugcaggcgcaggcugguuacgcggcucaauuacauuguuugcgguaaucacugugauccucggcugccucaaaauuggguacuucauuggauucuccgagugucugucagcaacagaaggcguguuuccggucacucauaguguucacacgcuucuccagguguacuuccuuugggggcacgccaaggacaucauccaauccuuuaaaacguuagaaagguuuggcguaauucauucuguauuuaccaaccuccuccuuugggcuaauggagucuugaaugaaagcaaacaucaacuuaaugaacacaaagagagacuuaucacucugggauuuggaaacaucacuacaguucuugaugaucacacaccacaauguaacugcacaccccccacuuuguguaccgcaauaagccacggaauuuacuauuuauacccguuuaacauugaguaccagauucuagcuagcacaauguuguaugugcuguggaaaaacaucggccgcaaaguagacucccaccagcaccagaagaugcaauucaagagugauggagugauggugggugcuguccugggccuuacugugcucgcugccaccaucgccgugguggucguguaccuaauucauauagguaggucaaaaaccaagagugagucugcuuuaauuauguuuuauuuauacgcaauaacacuacuaaugcugaugggagcugccggacuagcugguaucaggauauaucgaaucgacgagaagagucuggaugagucaaaaaauccugcaagaaaauuggacagugaccugcuugucggaaccgcuuccggcucaugguuaauuucauggggauccauucucgccauucucugugcagagggccaccccagguauacuugguacaaccuaccuuauuccauccuugcuauaguugagaaguacauucagaaccuguuuaucuucgaaaguauccaucgcgaacccgaaaaguugagcgaggauauccagaccuuacgaguggugaccgucugcaauggcaacacaaugccccuugccagcuccugcccaaaaagcgguggagucgcccgcgauguggcaccccagggaaaagacaugcccccagccgccaacgggaacguuuguaugagagagucccacgacaaggaggaagagaagcaagaagagucaaguuggggaggcucuccaucaccugugcgacuaccccgcuuucuucaagguaaugcaaaaagaaaggugcugagaaacaucgccgccuuccuguuccuaugcaacauaucccuguggauuccucccgcguucgggugucgccccgaguaugacaacggccuagaagaaaucguguucgguuucgaaccguggauaauaguggugaaucucgccaugcccuucuccaucuucuaccgcaugcacgcugcugcuagccuuuucgaaguguauuguaagaucuag

SEQ ID NO: 13652 - RNA, 786 nt, Artificial Sequence
  Description of Artificial Sequence: Synthetic coding sequence
auggagcuucuccagguuaccauccuguuccuccuaccuucuauuugcuccucaaacagcacgggaguccucgaagccgcaaacaauucccugguggucacuaccacuaagccaagcauuacuacaccaaauacagaaucacuccagaagaaugucguaacccccaccaccgguacuacacccaagggcaccauuacaaaugaacuguuaaagaugagccucaugagcacugccaccuucuugacuuccaaagaugagggucucaaggcaacgacaacugacgugagaaagaacgauuccaucaucagcaacguaacggugaccagcgucacucuuccgaaugccgucucaacucuucaguccagcaagccuaaaacagaaacacagucaagcauaaagacuacugaaauuccaggaagugugcuccagccagaugcgucuccuaguaaaaccgguacacugacaucaaucccuguuacuauccccgaaaacaccucucagagucagguuauuggaaccgaagggggcaaaaaugccagcaccagcgcgacuagccgaucguacuccagcauuauacugcccgugguuauagcacuaauuguuaucacccugucuguguucgugcuggugggauuguauaggauguguuggaaagcugaccccggaacucccgagaauggaaaugaucagccucagucugacaaagaaucugugaagcuccugaccguaaaaacuauaagucaugaaucuggggaacacucagcccaaggcaaaaccaagaauuag

SEQ ID NO: 13653 - RNA, 6408 nt, Artificial Sequence
  Description of Artificial Sequence: Synthetic coding sequence
augccugcccugggaccagcacuccugcaagcacugugggccggcugggucuugacacuccaaccacugcccccuaccgcuuucaccccaaacggaaccuaccugcagcaccuugcacgcgaccccacaucaggcacucuuuaccugggcgcgaccaacuuccucuuucaacucucuccuggacugcaacuggaggccacagugagcaccggacccguacuugauagccgugacugucugcccccagugaugccggacgagugcccucaagcucagccaacaaacaacccaaaucagcuucuucuuguaucuccaggcgcccucgucgugugcggcuccguccaccaagggguaugugaacagcggcgacugggacagcuggaacagcuucuccugagacccgagaggccaggugacacacaguauguggcugccaaugaccccgccguuucaacagucggguuggucgcacagggccuugcuggcgagccauuacuauuuguggguaggggcuacacaucacggggagugggcggcgguaucccuccaauuacuacccgugcccucuggccacccgauccucaggcugccuuuuccuaugaagagaccgcgaaacuugcgguggggagacuuagugaauacucccaucauuuugugucagcauuugcgcggggugccucggcguacuuuuuauuccuucgaagggaucugcaggcacaaaguagagcuuucagagcuuacgugagucgcguaugucuuagggaccagcacuacuauucuuacguugagcuucccuuggcaugugaaggcggaagauacggauugauccaggccgcugcuguggcaacuagucgcgaagucgcccacggugaggugcuuuuugccgcuuuuagcucugccgccccgccaaccguuggccgcccacccagugccgcugcuggagcgucgggcgcaagugcccuaugugccuucccacuggaugagguggacagauuagcaaaucgcacucgggacgcaugcuacacccgcgaaggccgcgcagaggauggaacggaagucgcuuacaucgaguaugaugucaacucugauugugcacaacuucccguagauacauuagaugccuacccaugugggagcgaucacaccccuucaccaauggccuccagaguuccacuggaagcaacaccaauacucgaauggcccggaauccagcuuaccgccguugcaguaaccauggaggauggccacacaaucgcuuuucucggagauucgcagggacaauuacacagaguguaccugggaccagggucagauggacacccuuauucgacacaaucaauucagcagggcucggcugugucuagggaccuaacuuuugacggaacauuugaacacuuauacguuaugacacaaucaacucugcucaaaguaccuguagccagcugugcucagcaucuggacugcgccucaugccuggcucacagggacccauauugcggcugguguguuuuacugggcagguguucccggcggucagagugcagccgaggccagggacccgaacaguggcuaugguccuuccaaccagaauugggcuguuuacagguggcagcuaugagccccgcaaacaucucgcgggaagagacaagagaaguuuuccuuucaguuccugaucuuccccccuuguggccuggugaaucuuauucuugccacuucggggagcaccagucucccgcuuuguugaccgguuccgguguuaugugucccagucccgacccuucugaggccccgguacucccccgcggcgccgauuauguguccguuaguguugagcuaagauuuggggcuguuguuauagcaaagacuagucuguccuucuaugacuguguugcuguaaccgaacuucgaccaucagcccagugccaagccugcgugucuuccagaugggguugcaauugguguguguggcagcaccugugcacucacaaagcgucaugugacgccggccccauggucgcaagucaccagaguccccucgugagcccagacccgccagcuagggguggcccuucccccucuccccccacagcuccuaaggcccucgcaacucccgcaccagacacucugccagucgaaccgggcgcaccgagcaccgcaaccgcaucugacaucucuccuggggcuucuccuucacuucuaucuccauggggcccaugggcuggaucagggagcauuucuucuccagguagcacugguaguccucugcacgaagaaccgucuccgcccagcccgcagaacggaccaggaaccgcaguucccgcaccuacagauuucaggccuucugccacccccgaggaucucuuagccagcccacucuccccguccgaaguggccgccgucccuccagcugaucccgggcccgaggccuuacacccuaccgucccauuagaccugcccccugccacggugccagccacuacuuuucccggggcaauggggucugugaaaccugcucucgacuggcuuaccagggaaggaggcgaacugcccgaagccgacgaauggaccggcggcgaugcuccagcuuucucaaccaguacccugcucagcggcgacggcgacucugcggaauuagagggcccgcccgccccccugauucucccaaguucacuugacuaucaguacgacacaccggggcugugggagcuggaagaagcuacacuuggagccagcuccuguccuugcguugaaucuguacagggaucuacacugaugccaguucauguugagagggaaauccggcuuuuggguagaaaucugcaccuuuuccaagacgguccuggagauaacgaaugcgugauggaauuggagggacuggaagugguagucgaagcccgcgucgagugugaaccuccacccgauacucaaugucacgugacaugccagcagcaucaacuuaguuaugaagcccuacagccugaacuccgggugggauuguucuuacggagagcuggccgucugcgaguggacucugcugaaggacugcacguugugcuuuacgauugcagcgugggucacggagauuguucacgcugucaaaccgcgaugccccaguacggcugugucuggugcgagggugaaagaccaagaugugucaccagggaagcauguggcgaagcagaagccguggcuacacaaugccccgcgccccugauucauuccgucgagccccuuacaggcccgguagauggagggaccagagugacgauaagaggaucaaaucugggacagcauguucaggacguguuagguauggucacuguggccggcgugccgugugcagucgaugcccaagaauaugagguuaguucgagccuggugugcaucacaggggccaguggugaggagguggccggagcaaccgccguugaagugcccgguaggggaaggggcguguccgagcacgauuucgcuuaccaagacccaaaaguacacucgaucuucccugcuagaggaccacgcgcggguggcacuagacucacccugaacggauccaaauuauuaacggggcgccuagaggacauaagggugguggugggagaccagccaugucaucugcuacccgagcagcaguccgagcaauugagaugugaaacguccccacggccaacaccagcaaccuuaccuguggccguaugguuuggcgccacagaacgaaggcuccagcgaggccaauucaaauauacacuggacccaaauauuaccucugcagggccaacaaaaagcuuccucagcggcgggcgggagauaugcgugagaggacagaacuuagauguugugcagaccccucgcauucgcgugacuguagucucuagaaugcuucagcccagccaggggcugggcaggcgcaggcgaguugugccagaaaccgccuguucccucggcccauccuguuccucacagcaguuugaggaaccgugccaugucaauaguagccaacucauuaccugccgcacacccgcucucccaggccucccugaagauccauggguccgagucgaauucauccuugacaaccuagucuuugacuucgccaccuuaaacccaacucccuucuccuacgaagcugaccccacacuccagccacugaauccugaagauccaaccaugcccuuccggcacaaaccuggcuccguauuuucuguggaaggugagaacuuggaucuggccaugagcaaggaagaaguaguagcuaugauuggugacggcccuugugucgugaaaacucucaccaggcaccaucuauacugcgaaccacccguggaacagccccucccuagacaccacgcacuacgcgaggcacccgacucuuuaccugaguuuaccgugcaaaugggaaaucuucgauuuucguuagggcauguacaauaugauggcgaaucuccaggcgcauuccccguggcagcacagguuggccuggggguagggacuucucuccuggcacugggcguaaucaucaucgugcugauguaccgccguaaaagcaagcaggcucugagagacuauaaaaaaguacagauucaacuggaaaaucuagaaucauccgugagagaucgaugcaagaaggaguuuacagaccuaaugacagaaaugacagacuugacuucugacuugcuagguuccggcaucccuuuucuggacuacaagguguacgcggaacgaaucuuuuuuccuggccaccgugaaucuccucugcacagggaccuuggaguaccagagucgcgccgaccaacuguagagcagggccuaggccaacugucaaaucuucugaauucuaaacuauuccucaccaaguucauacacacucucgaaucccagcgcacuuucucagcucgcgauagggcuuauguggccagccuccucaccgucgcccugcauggaaaacuggaguacuuuacagacauccuaagaacacugcucagcgaccugguggcgcaauacgucgcgaaaaacccaaaauuaaugcucagaagaaccgagaccgucgucgaaaaguuacuuacuaauuggaugucaauuugcuuauauacuuuugucagagauucuguaggcgaaccuuuguacaugcucuuccgcggcaucaagcaccagguggauaagggacccgucgacucagugacuggcaaagcuaaauacacacucaacgauaauagauuacuuagggaagaugucgaauaccgcccccugacccuuaacgcucuucuggcuguugguccaggcgcaggggaggcccagggugugccuguuaaaguacucgauugugacacuaucucucaggcuaaggagaaaauguuagaucagcucuacaaaggcgucccucuuacccaacguccggacccacggacccuugauguagaauggcgcaguggagucgcgggacaucugauucugagugacgaagacguuacgucugaaguucagggcuuguggcggcgacucaacacccuccagcauuacaaagucccugauggugcaaccguugcccuuguccccugcuuaaccaaacaugugcugagagagaaccaggauuaugugccaggcgagcguaccccuauguuagaggacguagaugagggcgguauuaggccuuggcaucuuguuaagcccucagaugagcccgagccaccuaggccucgccgagggucccugcgggggggagaaagagaaagagccaaagcaauaccagaaauuuaccugacuagacugcugucuaugaagggaacccuccagaaguuugucgacgauuuauuccagguuauucugucaacaucccgucccguccccuuggccgucaaauacuuuuuugaccuucuugacgaacaggcccagcagcacgguaucuccgaucaggacaccauucacauuuggaagacuaauuccuuaccauuaagauuuuggauuaauaucaucaaaaauccccaguuuguguucgacguccagaccuccgauaauauggacgcagugcugcuggugaucgcacaaaccuucauggaugccuguacccuugccgaucauaagcugggccgggauucccccauuaacaaacugcuguacgcaagagacaucccucgcuauaagcggauggucgaaagauacuacgcugacauccgccaaaccgucccagcuagcgaucaagaaaugaauagugucuuggcugaacuuuccuggaacuacuccggugaccuuggcgcuagaguugcccuccacgaacuguacaaguacauaaacaaauacuacgaucaaaucaucacugcccuggaagaagaugguaccgcucagaagaugcaguuggguuaucgccuucaacagauugccgcugcuguggagaacaaagucaccgaccuauag

SEQ ID NO: 13654 - RNA, 297 nt, Artificial Sequence; identical to SEQ ID NO: 12015
  Description of Artificial Sequence: Synthetic coding sequence

SEQ ID NO: 13655 - RNA, 1443 nt, Artificial Sequence
  Description of Artificial Sequence: Synthetic coding sequence
augaaacgaagcguagcaguguggcugcuaguuggauuaucgcuaggggucccacaguucgguaaaggagauaucugugauccgaaucccugugagaacggcggaauuuguuugccaggguuggccgauggaaguuuuaguugcgagugucccgacgguuucacugacccuaacuguuccagcgugguugaaguggcaagugaugaggaggaaccgacgagugccgggcccugcacaccuaauccaugccauaacggugggacuugugaaaucucugaagcuuacagaggagauaccuucaucgguuacgucugcaaaugucccaggggauuuaacggcauacacugccagcacaacaucaaugaaugcgagguggaaccaugcaagaauggagggauauguacagaucugguggcgaacuauuccugcgaaugcccaggagaauucauggggagaaauugucaguacaaguguagcggaccucugggaauugaaggcgguauaauuuccaaucaacaaauaacggccagcucaacacauagggcucuuuuuggauuacagaaaugguaucccuauuacgcgcgucuuaacaagaaaggauugaucaacgccuggacagccgcagagaacgaucgauggcccuggauacaaauuaaucuccaacggaaaaugcgcgucaccggugucauaacacaaggagcuaagagaauaggaucucccgaguauaucaaaaguuauaaaaucgcuuauucuaacgauggaaaaacgugggccauguacaaagucaaaggcacuaacgaggauaugguauuccgaggcaauaucgacaauaacacacccuacgcgaacucuuucacacccccaaucaaggcccaauacgugcgucucuacccucaggugugccgccggcauuguaccuugcguauggaacugcucgggugcgagcugucugguugcucagagccccuuggcaugaaguccgggcacauucaggacuaucaaauuacugcuucuucgauauuccggacacucaauauggacauguuuacuugggaacccagaaaggccagacuggacaagcaaggcaaggucaacgccuggacuucuggacauaaugaccagucccaauggcugcagguugaccuccuugugccgacuaaaguuacaggaauuaucacacagggcgcgaaagauuucggacaugugcaauucgugggaagcuauaaacuggccuauucuaaugacggcgaacacuggacuguguaccaagacgagaaacagagaaaagacaaaguuuuucagggcaacuuugacaaugacacgcaccggaagaacguuaucgauccuccuauauaugcuagacauauccgaauacuuccuuggucaugguauggcaggaucacgcuuagauccgaauuguuagguuguacagaggaggaguag

SEQ ID NO: 13656 - RNA, 1323 nt, Artificial Sequence
  Description of Artificial Sequence: Synthetic coding sequence
auggcugucaaacugggaacuuuacugcuggcacuggccuuagggcuugcucaaccagcgucugcucggcgcaaacuauuaguguuccugcuugacggguucagaagcgacuacauaucugacgaagcccuggaaucauuaccuggguuuaaggaaaucgucagccgaggcgucaagguagacuaccugacaccugauuucccuaguuuauccuauccuaauuacuauacacugaugacugguagacacugugaagugcaccaaaugaucgggaacuauaugugggaucccaccacaaauaaauccuucgauaucggcgugaacaaggauagucugaugccauuaugguggaaugguagugaaccucugugggugacgcuaaccaaggcuaaaagaaaaguguacauguauuauuggccaggaugugaaguggagauuuuaggcgugcgucccacauauugucuugaguauaagaacguucccaccgauaucaauuuugcaaaugcaguguccgaugcacuggauuccuucaaauccggucgggccgaccuggcggcaaucuaucaugaacggauugacgucgaaggccaucacuauggccccgcuucuccccagcgaaaagaugccuugaaagcaguggacacaguauugaaauacaugaccaaauggauccaggaaagaggccuccaggaccgacugaaugucauaaucuuuucugaccacggcaugacugacauuuucuggauggauaaaguaauugaacugaacaaguauauuucucugaacgaccuacagcaggugaaggauagagguccugugguuucccuauggccugccccugggaaacauuccgagaucuauaauaagcugucuacaguugagcauaugaccguguacgaaaaagaggcgauuccaucacgguucuacuacaagaaggguaaguuugugucgccauuaacacucguggcggacgaggggugguuuauuacggagaauagggaaauguuaccauucuggaugaauucuacugggagacgcgaaggguggcagaggggauggcacggguacgacaacgaacuaauggacaugcgcgguauuuuccucgcguucggaccagauuucaagucuaacuuucgagccgcaccgauucguucgguggaugucuacaacgugaugugcaauguggucgguauuacaccccuuccuaauaacgguucauggucccgcguuauguguaugcuuaaaggucgcgccuccacagcccccccggucuggccuucacauugcgcccucgcuuugauccuacucuuucuccucgccuag

SEQ ID NO: 13657 - RNA, 351 nt, Artificial Sequence
  Description of Artificial Sequence: Synthetic coding sequence
auggaaucuucuagagugagacuucucccccugcugggcgcugcccuguuacuuauguuaccucugcuagguacgcgggcacaggaagaugccgagcugcaaccacgcgcccuggauauuuauucugcggucgaugacgccagucacgagaaagaacucauugaggcuuugcaagagguucugaagaaacuaaagucuaaacggguuccuauuuacgaaaaaaaguacggacaagugccaaugugcgacgccggcgagcaaugugccgugcgaaagggcgcaagaaucggaaaauuaugugacugcccccgcggaaccuccugcaauucauuucuccuaaaauguuuauag

SEQ ID NO: 13658 - RNA, 1365 nt, Artificial Sequence
  Description of Artificial Sequence: Synthetic coding sequence
auggcucgaccuaacaaguuccugcucugguucuguuguuucgccuggcuguguuucccaauuagucucggcucccaggcuucugggggcgaagcccagauugcagcuuccgccgaauuagaauccggcgcuaugccuuggucucugcuucagcacaucgaugaacgagaccgagcagggcuucuucccgcacuguuuaaaguucucuccgugggucgcggugguaguccucgacuucagcccgacuccagggcacugcauuauaugaaaaaguuauacaagaccuaugcaaccaaagagggcauaccaaaaagcaauagaucccaucucuacaacaccguccgauuauuuacaccuuguaccagacacaaacaagcaccaggcgaccaagucacaggcauucugcccagcguggaguugcuauuuaaccuagauaggaucacaaccgucgagcaucuccucaaaucaguccugcuguacaacaucaacaauuccguaucguuuagcagcgcagugaagugcguguguaacuuaaugaucaaggagccaaaaucuucaucaaggacucuugggagggcaccuuacucuuucacuuuuaauucccaauucgaauuugggaaaaagcacaaguggauucagaucgacguuaccagcuugcuucagccucucguggcuucuaacaaaagaucuauccauaugagcauuaauuuuacuuguaugaaagaccagcuagaacacccaagcgcccagaacggccuguucaauaugacacuugugagcccaagccugauccucuaucucaaugacacuuccgcacaagccuaucacaguugguacucccuccacuacaaaaggcguccuucccagggucccgaccaagagagaucgcuaagcgccuaucccguaggagaggaagcugcggaggacgguagaagcucgcaccauagacaccggcgcgggcaagaaacagucuccucagagcucaagaaaccccuaggcccugcgaguuuuaaucucucagaguauuucagacaauuucuacuuccucagaaugaaugugaacuucacgauuucagauuaaguuuuucccaacuuaagugggacaauuggaucguggcuccacacagguauaacccucgauauuguaaaggagauuguccuagggcugugggccaccguuacgguuccccaguccacacaaugguccagaauaucauauacgaaaaauuggacucgucagugccccgcccguccugcguucccgcuaaguacucuccgcucuccguauugaccauugagcccgacgggagcaucgcuuauaaagaauacgaagacaugauagcuacaaaauguacaugccgauag

SEQ ID NO: 13659 - RNA, 234 nt, Artificial Sequence; identical to SEQ ID NO: 12020
  Description of Artificial Sequence: Synthetic coding sequence

SEQ ID NO: 13660 - RNA, 912 nt, Artificial Sequence
  Description of Artificial Sequence: Synthetic coding sequence
augagugaaccacagccagaucucgagccaccccaacacggccuguauaugcuuuuuuugcucgugcugguguucuuccuaaugggccuagugggauucaugaucugccacguguugaaaaagaaaggauaccgcuguagaacauccagaggaagugagcccgaugacgcccagcugcaacccccugaggacgaugauaugaacgaagacacuguugagcgaaucguuagguguaucauacagaacgaagccaacgcagaagcucugaaagagaugcuaggagauucagagggugaaggcacugugcaauugucaagcguggacgcuacuuccucucugcaggacggcgcaccuucacaccaccauaccguacaccuuggaagugcugccccaugucugcauuguucacggagcaagaggcccccccuggugcgccaagguagaucaaaggaaggaaaaucucggccccguacaggcgagacaacagucuuuagcguuggacgguuccgcguuacccauauugagaagagauacgggcugcaugaacaucgcgaugguucaccuacugaccggaguuggggaagcggaggcggucaggaccccggugggggccaggguaguggaggaggacaaccaaaggccgggaugcccgccauggaacgacugccacccgaaagaccucagccccagguacuggcuaguccgcccgugcagaacgggggccuccgcgauaguagccuuacuccucgggcccuggaaggaaauccccgcgcuucugccgaaccaacccuuagagcgggcgguaggggacccucuccuggccuccccacucaagaagccaauggacagccuagcaaaccagauacuagcgaucaccaagugucccucccgcaaggagccggcucaauguag

SEQ ID NO: 13661 - RNA, 795 nt, Artificial Sequence
  Description of Artificial Sequence: Synthetic coding sequence
augcggacacuguggauggcacucugcgcacuuucucgacuauggccaggcgcccaagcgggaugugccgaagccgggaggugcugucccggacgagacccugcuugcuuugcuaggggauggcggcuugacagaguguaugggacauguuucugcgaucaggccugcagguuuaccggcgacugcuguuucgacuaugauagagcauguccugcaagaccaugcuuuguuggggaaugguccccuugguccgggugugcugaucagugcaaaccgacaacacgcgugcggcgaaggaguguucagcaggaaccacagaaugguggagccccaugcccuccuuuagaagagcgcgcuggaugucucgaauauucuacgccacagggacaggacugcggccauaccuauguuccagccuucaucacuaccuccgcuuuuaauaaagagcggacuagacaagcuacuucaccccauuggagcacacacaccgaggacgccggcuacugcauggaauuuaaaaccgaaagucuuaccccacauugugcccuggagaauuggccgcugacgagauggaugcaauaucugagagaaggcuacacagucugcguagauugucagccucccgcuaugaauucuguaucuuugcgaugcucgggggaugggcucgacucagacggcaaucagacacuacacuggcaagcaauuggaaauccucgaugucaagggacauggaagaaggugagacgggucgaucaaugcuccuguccagccguacacucuuuuaucuuuaucuag

SEQ ID NO: 13662 - RNA, 312 nt, Artificial Sequence
  Description of Artificial Sequence: Synthetic coding sequence
augagacaaaggcuacuaccaucaguuacuucacuccugcugguagcacuccucuucccuggaucuucacaagcacggcacgugaaccacagcgcaacagaagcucuuggcgaacuucgagagagagcaccaggccaggguacaaauggcuuucaauugcugcgacacgcugucaagcgcgaccuacugcccccacgaaccccaccauaucaaguucauaucucccaucgggaagcucgggggccauccuuccgaauuuguguagacuuccuuggaccucgaugggcaagaggcuguuccacugguaacuag

SEQ ID NO: 13663 - RNA, 3867 nt, Artificial Sequence
  Description of Artificial Sequence: Synthetic coding sequence
auggcgucaguggcuugggccguucuaaaagucuuacugcuucuuccuacccaaacauggucgccugugggagcagggaauccccccgacugugacgcaccguuggcuagugcauuaccacgcucuucuuucuccucaagcagcgaauuaucgucuagucacggaccuggauucagccggcucaaccgccgagauggggccggaggauggacaccccuagugaguaauaaguaucaguggcuacagauugaucucggcgagcggauggaggucacagccguugcaacucaggguggcuacggaucaucugacugggucacgagcuaccuacuuauguucagugacgggggcaggaauuggaagcaauauagaagagaagaauccauaugggguuucccagggaauaccaacgccgacagcguugugcauuacaggcugcaacccccauuugaagccagguucuugcgauucuugccacuagccuggaacccacggggccguaucggcaugcgaauugagguauauggaugugcauauaagagcgaagugguguacuuugacgggcagucagcucugcuguaccgacuagacaagaagccuuuaaagccaauccgagacguuaucagucuaaaguuuaaagcaaugcagagcaacggcaucuuacuucacagggagggccaacacggaaaccacaucaccuuagaguugauuaaaggcaaacugguguuuuuccuaaacucugguaaugcaaaacugccaucuaccaucgccccagugacucuaacccugggcucccuccucgacgaucagcauuggcauagcgugcucauugagcuucuggauacccaagugaacuucacaguugacaagcacacucaucauuuucaggccaagggggacuccucuuaccuggaccucaacuucgaaaucaguuuugggggcauuccaacaccuggcagaucgagagcuuuccgccgcaagaguuuccacgggugcuuagagaaucuuuacuacaaugggguagaugugaccgaacuagcgaaaaaacauaagccucagaucuugaugaugggaaacgucaguuucuccugcccucagccucagacaguuccuguaaccuuccuuucuucccgcuccuaucucgcacuaccagguaauucaggcgaagauaaggucucggugacuuuccaguuccgcacuuggaaucgggcuggucaucuccuauuuggugaacucagacgugguagcgguucuuucguuuuauuuuuaaaggauggcaaacuuaagcuaagccuguuucaaccuggccagucaccuagaaauguaacagcgggggcgggccugaacgacggacaguggcacuccguuagcuucagcgccaaauggucacauaugaacguggucgucgacgacgacacagccguacagccucugguugcuguccugauugacucgggugauaccuauuacuucggagggugccuagacaacucgagcgggucaggcugcaaaucuccacugggaggauuucagggcugccucagauuaaucacaauaggcgauaaagcagucgaccccauccugguucaacagggggcccugggcucuuuccgggacuuacagauagauagcugcggcaucacagauagaugucuuccaagcuauugcgagcacggcggcgaauguagucaaucaugggacaccuucuccugcgacugucugggcacaggguacaccggagaaacaugccauagcucucuguacgagcaaucaugcgaggcucacaagcacagaggaaaucccuccggucuguauuacaucgacgcagauggcuccgguccucucggcccauuccugguuuacugcaauaugacagcugacgcugccuggacuguggugcaacauggaggucccgacgcugucacacuccgaggagcaccuucaggucauccccggagugcggucucuuucgcuuacgccgcgggcgcagggcagcuuagaagcgccgugaaccuggccgagcggugugaacagcgacuagcccugagauguggaaccgcuagaaggcccgauucgagagauggaacaccacugagcugguggguaggcaggacaaacgaaacucacaccucuuggggcgguagccugccggaugcucagaaauguacuugcggacuggaggguaauuguauagacagccaauauuacugcaauugugacgccgguagaaacgaauggaccucggacacaaucguauugagccagaaagaacaucuuccagugacacaaauaguuaugacugacgcagggcguccucauucggaagccgccuacacauuagggccacugcucugcagaggcgaccaaaguuucuggaacucagcuucuuucaacacggagacaaguuaucuucacuucccugccuuucacggagagcugaccgccgacguuugcuucuuuuucaagaccacaguuucaucuggaguguucauggagaaccugggaauuacagacuuuauuaggaucgaguuacgggccccaacugagguaaccuuuuccuuugacgugggaaacggacccugcgaagugaccguacaguccccgacacccuucaacgacaaccaguggcaucauguacgggccgaacgcaauguuaagggagcuucauuacagguggaccagcugccacaaaagaugcagccugccccagccgacggucauguucgccuucagcuuaauucccaguuguucaucggggguacugcaacaaggcagcgaggcuuucuggguuguaucaggucccugcaguuaaacggugucgcucuggaucuggaggaacgcgccaccgucacaccuggcguugagccagguugcgcuggucacugcucaaccuacggacacuugugcaggaauggagggaggugucgcgaaaagagaagggguguaacuugcgacugugcauuuagugcguacgacggcccauuuugcagcaaugaaauuuccgccuacuuugccaccggcagcagcaugacauaccauuuccaggagcacuacacacuauccgagaacuccucgucccuggucuccagccugcaccgugaugucacccuuacaagagaaaugaucacuuugagcuucagaacaacccguacaccaucccuccuucuuuacguguccucuuuuuacgaggaauaccugucagugauuuuggccaauaacggcucguuacagauucgauauaagcuggaucgccaccaaaacccagacgccuuuacauucgacuucaagaacauggcagauggucagcuccaucaagugaaaaucaauagggaagaggccguuguuaugguggagguuaaucagaguacuaaaaaacaagugauuuuaucaucugggacugaauucaacgcggugaaaucccugauacucggcaaagugcuagaggccgccggcgccgauccugacacuaggcgugcagcuacuagcggauucacggguugccucagugccguccgguucgggagagccgcgccacugaaagcugcccuuagacccuccggcccuucuagagucacaguacgcggacauguugcaccuauggcacggugugcggccggggcugccuccgggucaccagcuagagaacuggcacccagacuugccggcggugcagggcggucaggccccgcggaugaaggcgagccauuagugaaugcugauagaagagacagugccgucauagggggaguaaucgcgguggucaucuuuauccugcugugcaucacugcaaucgccauacgaauuuaccagcagcggaaacugaggaaagagaacgaguccaaggugucaaagaaggaagaguguuag

SEQ ID NO: 13664 - RNA, 369 nt, Artificial Sequence
  Description of Artificial Sequence: Synthetic coding sequence
auggucccgggcccuccagaaucuguggugagauuuuuuuuaugguuuuguuuccucuugccucccacacguaaagcauccugcgaccccagagacuuaaaaagcugcaauaggccaugugugugguccaggcugcucaagccgaacucaagccugucaaaucuagagacggcuuacuuuccucagauccuccguuuucuucggccaugguacuuuucccgcagccaccugaauuaucaccagaaggccccagcaagaugggagugguuguacucuauuuaccguaaagguacaaaagcccaaagacguaauguuuuaaggucuccuugcgcaccuccccagccuuccuggcccuguuccgugauauag

SEQ ID NO: 13665 - RNA, 1887 nt, Artificial Sequence
  Description of Artificial Sequence: Synthetic coding sequence
auggccccuuccgcagacccugggaugucgcgcaugcugccauuccuacuccuccuaugguuccucccaaucacugagggcagucagcgagcugagcccauguuuacggcagugacgaauaguguuuugccaccugauuaugauuccaaucccacacagcuuaauuauggaguggcagugacagauguggaccacgauggagauuucgaaaucgucguugccggcuacaacggcccgaaucugguacugaaguacgaccgagcacagaaaagauuaguuaacaucgccguggacgaaaggaguuccccuuauuaugcucugagggaucgccagggaaaugccaucggcgugaccgcaugugacaucgacggcgauggccgcgaggaaauuuacuuccuaaacacgaauaaugcuuucucaggagucgccacuuacacagauaagcuauucaaauuccggaauaacagaugggaagacauccuuagugaugaagucaauguagcgagagggguagcuagucucuuugcaggaaggagcguugcuugcguugaucgcaagggaaguggacgcuauucuaucuacauagccaacuacgcguacggaaacguaggacccgaugcccuaaucgaaauggacccugaagcaucagaccuguccagagggauacuugcccugcgcgauguugcagcugaagccggggugucaaaguacaccggaggccgcggcgugucagugggaccaauucucuccaguagugccuccgauaucuucugugacaacgagaauggcccuaacuuccuuuuccacaaccgcggagacgguacuuuuguggaugcugccgccucagcaggcguggacgauccgcaucagcacggaagaggcguggcccuagccgacuucaaucgcgaugggaagguagacauuguuuacggcaacuggaacggcccgcauagacuuuaucugcagaugaguacacacggaaaggucagguucagggauaucgcuagcccuaaguuuuccaugccaagcccagugagaaccgugaucacagcagauuuugauaaugaucaagaguuagagauuuuuuuuaauaauauugccuaccgcucuucaucugcaaauagacuguuucgagugauuaggcgggaacauggcgauccucugauugaagagcugaauccuggagacgcccucgaaccugaagggcgggggaccggcgguguggugacagauuuugacggcgacggcaugcucgauuuaauccuuagccacggcgaaucaauggcacagccccuuaguguuuuucgcgggaaccagggauucaauaacaacuggcuaagaguuguccccagaacccgauucggcgcguucgccagaggcgccaaagugguucucuauacuaaaaagaguggagcgcauuuaagaauuaucgauggaggcucaggauaucugugcgaaauggaaccaguggcacauuuugggcuuggcaaggacgaggccucuucaguagaagugaccuggccugacggaaaaaugguaagcaggaacguggccuccggcgagaugaacagugugcuggaaauacuguacccccgcgaugaagacacccugcaagacccagccccccucgagacaccuaugaacgcuucaagcucccauuccugcgcucuggagacuucaccguacguguccacccccauggaagcaacuggcgcuggucccacaagaucugccgugggcgcgacuagucccacccguauggcacagccagccuggggccucuccgcuagucauagagcucccgcucccccuccuccuccccuccugcucccacugccccuccucuugccacuauuagaauuaccucuccugcaccggucaaguuag

SEQ ID NO: 13666 - RNA, 1008 nt, Artificial Sequence
  Description of Artificial Sequence: Synthetic coding sequence
augcaaggacaggggcgccgccgagguacaugcaaagauaucuucugcucuaaaauggccagcuacuuguacggcguuuuauucgcggugggacucugugcaccaauuuauuguguuucaccagccaaugcccccuccgccuacccucgcccuuccagcaccaaaucaacccccgcaucacaagucuauucuuuaaacacagacuucgcuuucaggcucuaucggaggcucgucuuggagacccccagucagaacaucuucuuuucuccugccaggaucaacucucacgugaaaaaaaaaacccaggguaaagucguggauauaauccaaggcuuggaucuucugacugcuaugguccuugugaaucauaucuucuucaaagcgaaaugggaaaaaccuuuccacccugaauacacucguaagaauuucccuuuccuagugggcgagcaaguuacagugcacgugccaaugaugcaucaaaaggagcaguuugcuuuugguguggauacugaacucaacugcuuuguguuacagauggacuauaaaggagacgccgucgcauuuuuuguguuaccaucuaaggguaaaaugcgacaacuggaacaggcccucuccgcgagaacacugcgaaaauggucccauaguuugcagaaaagauggauagaaguuuuuauuccccgguuuagcaucucugcauccuacaacuuagagaccauacugccaaaaauggggauucagaauguguuugacaaaaacgcugauuuuagcggcauugcgaaaagggacucauuacagguuuccaaagccacacacaaagccguguuagaugucagugaagaagggacagaagcgacagccgcgacaaccacaaaguuuaucgugcgcaguaaagacgguccaagcuauuucacagucaguuucaauagaacuuuuuuaaugaugauuaccaacaaagcuacugacggcauccuuuuuuugggcaaagucgagaauccaacgaaaucauag

SEQ ID NO: 13667 - RNA, 768 nt, Artificial Sequence
  Description of Artificial Sequence: Synthetic coding sequence
augguucucuuguuggucauacucauacccguucuugucuccagugcaggaacuagcgcccauuaugagaugcuggguacuugccgaauggugugcgauccguacgguggaaccaaagcuccuucuacugccgccacacccgaucgggggcugaugcaaagccugcccaccuuuauucaggggcccaaaggagaagccggccgccccggaaaagcuggcccccgcggcccacccggcgagcccggaccgcccggccccaugggaccgccaggcgagaaaggcgagccaggacggcagggacugccugggccgcccggugccccuggccucaacgcugcuggcgcaaucuccgccgccacguacucgacuguccccaaaaucgcuuuuuaugcaggccuaaagcgucaacacgagggcuacgaaguucuuaaauuugacgauguagucaccaaccugggaaaucauuaugacccaaccacugggaaauuuacgugcucaauuccaggcauuuacuuuuuuacuuaucauguucugaugcggggaggagauggaaccuccaugugggcugaucuuuguaagaacaaccaagugcgugccucagcuauugcucaggacgccgaccagaacuaugacuaugcaucuaacucugugguccuucaccuggaaccaggcgaugagguguacauuaagcuugacggaggcaaggcccauggagggaauaacaauaaguacagcacguuuucaggauucaucaucuacgccgacuag

SEQ ID NO: 13668 - RNA, 1617 nt, Artificial Sequence
  Description of Artificial Sequence: Synthetic coding sequence
augucuuucucugcgaccauauuauucucuccucccagcggcucagaagcaaggugcugcugcugcgcuugcaaauccgagaccaauggcgggaauacuggcucacaggggggaaauccuccuccaucaaccccaauaacgguuacaggucacggucucgcagugcaauccucugagcaguuacuucaugugaucuaucaacgaguagauaaggcagugggcuuagccgaagccgcucugggacucgcuagggccaauaacgaacucuuaaagcgucugcaggaggaaguuggcgauuugcggcaaggcaagguaucaauccccgacgaggauggugaguccagagcccauaguagcccuccugaggaaccuggcccuuugaaagagagucccggagaagccuucaaagcauuaagcgcaguggaagaagaaugugauuccgucggcuccggcguccagguugugaucgaagaacuccgccagcucggugccgcuucuguaggcccaggaccucuuggcuuucccgccacccagcgagauaugcgacugcccggcugcacucucgcugcuagcgaagcagccccccuccucaauccucuuguggacgauuacguggccagcgagggugccguccagcgugugcuagugccagcuuacgcgaaacaguuaagcccugccacacagcuagccauucagagagccacccccgagaccggaccugaaaacggaaccaagcuaccuccucccaggccugaggacaugcuuaacgcagccgccgcuuuagacagugcccucgaagagucugguccgggaaguacaggagaacuacgacacagccuaggguuaaccgucucuccauguagaacaaggggaagcgggcaaaaaaauuccagacgcaaacgagaccucgucuuaagcaagcugguucauaaugugcauaaucauauuaccaaugacaaaagauucaauggcagcgagagcauuaagagcucauggaauauuaguguagugaaauuccuccucgagaaacugaaacaagagcuggucacuuccccgcacaauuauacagauaaggaacuaaaaggugcuugugucgcauauuuccugacaaaaagacgugaauacagaaacagccuaaauccauucaaagggcugaaagaaaaagaggagaaaaagcugaggucuagacguuaccggcuguuugcaaaucgauccagcauuaugcgucauuuuggcccagaagaccagcgguuauggaaugaugugacugaagaacucaugagcgaugaagaagauuccuugaaugagcccggaguguggguagcccguccgccccguuuccgagcccagcgccucaccgagcugugcuaccaccuggacgcgaauaguaaacacggaacuaaggcaaaucgcguguauggccccccuucugaucgccuuccaucagcugaagcucaguugcugcccccugagcuguacaaucccaauuuccaggaggaggaagacgaaggcggagacgagaaugcccccgggagcccuucuuucgaccagccccauaagacauguugcccggauuuaaauaguuuuaucgagauuaaaguggaaaaggaugaguag

SEQ ID NO: 13669 - RNA, 2853 nt, Artificial Sequence
  Description of Artificial Sequence: Synthetic coding sequence
augcugcuccuuggaauacugacucuagcguucgcuggacggacggcuggaggauccgagcccgagcgugaaguuguugucccaauucggcucgauccggauauuaacggcagacgcuacuacuggagagguccagaagauucuggggaccaagggcuaaucuuucagauaaccgcuuuccaggaggacuucuaccuccaccucaccccagacgcacaguuucuugcuccugcuuuuagcaccgaacauuuggggguaccacugcaaggauugacggguggcaguuccgauuugagaagguguuuuuauucuggugacgugaacgcagagccugacucauucgccgccgucucccuuugcgguggucucagaggggccuuuggguaccgcggugcugaguauguuaucagcccucugccaaaugccucggcccccgccgcccagcgcaacucccagggugcccaucuccuacagcgacgagguguuccaggcgggccaucaggcgauccaacuagccgcuguggcgucgcauccggguggaaccccgcaauuuuaagagcccuagauccauacaaaccccggcgcgccggcuucggagagaguaggagccgcaggcguucgggacgagccaaaagguuugugucuaucccccgcuacguagaaacacuggugguagcggacgaauccaugguaaaguuucacggcgcagaccucgaacacuaccuuuuaaccuuacuggccacugcagccagacuguaccgccacccgucaauccucaaccccauuaauaucguggucgucaaagugcuccuguuaagggaccgggacucuggaccaaagguaacuggcaaugcagcacugacucugcgaaacuucugugccuggcagaaaaaacugaacaaagugagugacaagcacccugaguacugggacacagcgauccuguuuacgagacaagacuuguguggagccacaacaugcgacacucuuggcauggcagacgucggaaccaugugcgauccaaaacgcucuuguucaguaauugaagaugauggacuccccagugcguucacaaccgcucaugaacuuggucacguguucaacaugccccacgauaacguuaaaguuugcgaggagguguuuggaaaacuccgugcuaaccauaugaugucuccuacucucauucagauugaucgugccaauccuuggucagcaugcagugcagcaaucauuacugauuuucucgauagcgggcacggagauugucugcuugaccaaccuagcaagccgauaucccucccugaagaucugcccggagccagcuauaccuugucccagcagugcgaguuagcuuucggaguuggaucaaaaccuugcccuuacaugcaauacuguacaaaacuguggugcacgggaaaggcaaaaggccaaaugguuugucagaccagacauuuccccugggccgaugguacuaguuguggcgaagggaaguuaugcuugaagggugcuugugucgaacggcauaaccuuaauaaacaccgcguggacggaucuugggcuaaaugggaucccuacggcccguguagcagaacuugcggggggggcgugcaauuggccagaagacaaugcaccaauccaacucccgcaaaugggggcaaguauugugaggguguacguguuaaauaucgaaguuguaaucuggagcccugcccuagcucugcaucagggaaaaguuuccgcgaagaacaaugcgaagccuuuaauggauauaaccacucaacuaaccgacuuacucuggcaguggcauggguaccuaaauacucaggagucagcccgcgggacaaaugcaaacugaucuguagagcaaaugggacaggcuauuuuuacguucuggcuccgaaagucguggauggaacccuguguucccccgacucuacuagugugugcguucaggggaagugcaucaaggccggcugcgacgguaaucucggcucuaaaaaaagauucgauaaaugcggcgucugcggaggggauaacaagucauguaaaaaggugaccgggcuguucaccaaaccaaugcauggguauaacuuuguuguggcuaucccugcgggagcgucgucaauugauaucagacagaggggauacaagggacucauuggcgaugacaacuauuuggcucugaaaaauagccaagggaaguaccugcugaacggccacuuugucguuuccgccguugaaagagacuuaguaguuaagggaucauugcugcgguauucugguacaggcaccgcugucgaaucucuucaggcuucaagaccuaucuuagaaccucucacuguugaaguccucucagugggcaaaaugaccccuccacgcgugcgauauucauucuaccuuccgaaagagccccgugaggauaaaucuucccacccaaaagacccgagaggucccagcgucuuacauaacuccguguuaucauuauccaaucaaguagagcagccagacgacaggcccccugcccguuggguggccgggagcuggggacccuguagcgccucauguggcuccggucuccagaaacgagcaguggacuguaggggaagugcaggccaacgcaccgucccugcuugcgacgccgcgcaucgucccguugaaacacaagcuuguggugaaccuuguccuacuugggaauuaucagcauggucacccuguaguaaaucuuguggacggggcuuucagcggagaucccucaagugcgucggacacggaggcagacuccucgccagagaccaaugcaaucuacaccguaagccucaggaacucgacuuuugugugcuacgcccuuguuag

SEQ ID NO: 13670 - RNA, 1521 nt, Artificial Sequence
  Description of Artificial Sequence: Synthetic coding sequence
augacaagcaagccucauagcgacuggaucccauacucaguccuggacgaugaggggcgcaaucuccgucagcaaaaauuggauagacagagagcacucuuagaacagaaacaaaaaaaaaagcgccaagaaccccugauggugcaggcuaaugccgacggaaggccucguucacgaagggcaaggcagagcgaagaacaagcaccucugguggagucauauuuaagcagcucagggagcacgucauaccaagugcaggaagccgacagucucgcaucaguccagcuuggugcaaccagaccuacugcaccagcuucugcgaaacguacuaaggcagccgccaccgccgguggacaaggaggggcugcaaggaaagaaaagaaaggcaagcacaagggcacaagugguccugcagcccuggcggaggauaagucugaggcccagggaccagugcagauucucacagucggacagucugaucaugcccaggaugcaggcgaaacagcugcgggcgggggagagagaccaucuggucaggauuuacgcgcuacuaugcagcggaagggaauuucuucuagcaugaguuuugaugaagacgaggaagaugaagaggagaauuccaguuccagcagucaguuaaacucuaacacaaggccaucaucagccacaucucgcaagagugucagagaagccgccagugcgccuagcccuaccgccccugagcagccugucgauguggaagugcaggaccucgaggaguucgcacuuagacccgccccucaaggaauuacuaucaaaugcaggaucacuagagauaaaaagggaauggaucggggcauguaucccacauauuuucugcacuuggacagggaagauggaaaaaaaguauucuugcuggccgguaggaagaggaaaaaaucaaagacaagcaauuacuugaucagcguugaucccaccgauuugucuagaggcggugauaguuauauugggaaacucaggucaaaccuuaugggcacaaaguuuacagucuacgauaauggagugaacccgcagaaggcuagcuccuccacccuagaauccggcacacuuaggcaagaacuggcugccgucuguuacgaaacuaauguauuaggguucaaagguccaaggaagauguccgucauugucccggguaugaauaugguacaugagcgcgugagcauccguccacguaacgaacaugagacguuauuagccagguggcagaacaaaaacacagaguccauuauagaacugcaaaauaaaacucccguuuggaacgacgacacacagucguaugugcuaaauuuucacgguagagugacgcaggcauccguuaaaaauuuucagaucauccaugggaacgauccugauuauaucgugaugcaauuuggccggguugcagaggacgucuuuacuauggauuauaacuaucccuugugcgcacugcaagcuuucgccauugcccuuagcucuuuugacucuaagcuggcaugugaauag

SEQ ID NO: 13671 - RNA, 594 nt, Artificial Sequence
  Description of Artificial Sequence: Synthetic coding sequence
auggcuaagaaugggcucgugaucugcauccucguuauuacauuacuguuagaccaaacuaccucucacacaucacggcuaaaagcuagaaaacacagcaagcgucggguaagggacaaagauggugaccugaaaacgcagauugaaaaguuauggaccgaggugaaugcgcugaaagagauccaagcucuccagacaguaugccuccggggcacaaagguacacaagaaaugcuaccuagccagugaagggcuaaaacacuuccacgaagcuaaugaagacuguaucagcaaaggugggauccuggugaucccccgcaauucugacgagauuaacgccuuacaagauuacgguaagagaucacuccccggcgucaacgacuuuuggcuaggcauuaaugacaugguaaccgagggcaaguucguggaugucaacgggauugcuauaaguuuccugaauugggaucgggcccagccuaauggcggaaagagagaaaauugcgugcucuucucccaaagugcacaggguaaauggucugacgaagcuugucgaaguucuaaacguuacaucugcgaguucacgauuccucaguag

SEQ ID NO: 13672 - RNA, 2424 nt, Artificial Sequence
  Description of Artificial Sequence: Synthetic coding sequence
aaaaaaaagcggaaaaucucccugcuaccuaaaccaccuaaacacgacgccccacuuacaauugaauucccaaaccucgacaagacaucagccgaguggcucaaagugaauggacugaaagcaaaaaaacugaguuuauaccaaguucucgcacccaaugcguucagcccuguggaagaauuugugcccauuuugcagaaaaccgucaguucuaccauucacgagaaggcaaugauccaguuugaguggcaugauggcaccguuaaaaacauacauguugauccaccuuuccuauauaaauaccagcagcagcugucacgggcaaugaggauguacgagagaagaauugaguggcugucccuugcuucaagaaggaucugggggaccgugugugagaagagagucgugguccugcuggacaucuccgcaacaaauucuauguauaucauccauauccagcauagucuaagacuccuccuagaagaacagcugucaaauaaggauugcuucaaccuuauugcuuuuggaagcacaaucgaaucauggcgccccgagauggucccugugagccacaauaaucuacaguccgccuggagaugggcucugaaucuccgaugucgaggcaguaggaauguuuuguccgcauugagaaaggcugucgaaguagacuucaaagauaaagacaagcaucagagccaaggaauuuaucuguucaccgguggaaucccagaccaggauaugcccacccucagcgcuuauauggcagaagccugugggggaugugaucuccagcucaacgucugccuguuuuaugugggggaaccgaagauggacaccaccccacccgcccgcuacgcuucacacacagauacugcagccgcguauaaggaaguaacacgugcugcgggaggucgguuccauugguucggugacacgggcauuuacgaaucugacgacaucaauagcauuaugagcgagauggagaaggcucucaauuauagccagaagugugcuuucuugauggcuucgcuuaagaaccacaguggcaaaguccucggguccucagcccugcccaaggagaaaccuaaaacgcugcaacugcgaucucagccaaagaagcucugccccccacgccccacagucccccugggagcccgaaugucuauuaaagaugacccggauagagagaaaagcccacccuugaagucccuaaaguggcgaccuuuauccagccgagucggcauaucucccgcagccgcacagccuacuaaggaaggcaugauggaacugcgccgaaaaacuaaauccagagaagcugaaacgagucuucuguuguuuuauacagagaaagguaacgauguugguaguguguacaagaaauacccacagggaagggggcuaaggcgcacauccagcucaauagaucucccacgcaaggauaccguuuguucuucgcaggagugggucgcuaaauauggguuaaagaagcucaaacuagaaauauccagguguaugggaccaaauuguacccaucagaaauccgggcagagguccgcuagcgcuaaacacuguaguauuuuuccuucaguggaaauccaugguguggugaggcauauccaguggacuccucgcgagauggaaguguauaucaggcaccuugaaaaggucuugcgccguuauguacaacguuugcagugguuauuaagcgguaguaggaggcucuuuggaacugucuuagaguccaagguguguauccuccucgauaccucggguaguaugggccccuaucugcagcaaguaaaaacugaauuggugcugcugaucugggaacagcugagaaaguguugugauucguucaaccuccuaucuuucgcugaguccuuccaaaguuggcaggacacacuugucgagacaacggaugccgccugucaugaggcuaugcaaugggugacucaccuccaagcacagggcucgacguccaucuugcaagcccugcugaaagccuucucuuuucaugaucuagaagggcucuauuuguuaacagaugguaaacccgacacaucaugcucgcugguguugaacgagguccaaaaauuaagggagaaacgagacgucaaagugcauaccauaagucucaauuguagugauagggcugcugucgaguuucugcgcaagcuggcgucauuuacuggaggacgguaucauugucccguuggcgaagacacacuaagcaagauucauucuuuauugacaaaagguuucaucaaugagaaagaccccacacugccucccuuugagggcgaugauuuacgaauccuggcccaggagauaacuaaggcacggaguuucuuauggcaagcccagagcuuucgaucccaguugcagaaaaagaaugaugcagaacccaaagucacuuuaucauag

SEQ ID NO: 13673 - RNA, 639 nt, Artificial Sequence
  Description of Artificial Sequence: Synthetic coding sequence
auggugagucggaugguuucuaccaugcugaguggauuacucuucuggcuggcuucaggguggacccccgccuuugcuuacaguccccggacuccagaccgcgucucagaagccgauauccagcguuuacuacacggaguuauggagcaacugggcauugcuagaccuaggguugaguaucccgcccaccaggccaugaaucugguuggcccgcagagcauugaaggcggagcccacgaaggccugcagcaucuuggaccauuuggaaacauuccuaauauaguggccgaacuuacaggugauaauauucccaaggauuucagcgaagaucagggguauccugacccuccaaacccguguccugugggcaagacugcagacgacggcugcuuagagaauacacccgauaccgcagaauuuucucgcgaguuccagcuucaccagcaccuauucgaccccgaacaugauuacccuggccucggcaaguggaauaagaaacuacucuaugaaaaaaugaagggaggcgaaagaagaaaaagaagaagcgugaauccuuaccuccagggccagcgucucgauaaugugguugccaagaaguccgugccccauuucucagaugaagacaaagaucccgaguag

SEQ ID NO: 13674 - RNA, 1524 nt, Artificial Sequence
  Description of Artificial Sequence: Synthetic coding sequence
auguguaccaagacaauuccuguccugugggguugcuuucuccuguggaaccucuacgucuccuccucccagacuaucuauccuggcaucaaagcuagaauuacccagagagcacuugauuacggaguccaggcugguaugaaaaugauugaacagaugcugaaagaaaaaaaacugccagaccuuuccgguagcgaguccuuagaauuucuaaaggucgauuacguaaauuacaauuuuagcaacauaaagauaucggcuuucaguuucccaaauacuucccuggcuuuuguuccuggcgugggaauuaaggccuuaacuaaucacggaacagcuaauauuaguacugauugggguuuugaaaguccacuguuucaagacaccgguggcgcagaccucuuccugagcggaguauacuuuacuggcauuaucauccuuacacgaaacgauuuuggacacccgacacugaagcuucaggauugcuaugcccagcucucucacgcacaugucagcuuuucaggcgaacucucuguguuauacaauuccuucgcugagccaauggagaagccgauucuuaaaaacuugaaugaaaugcuaugccccauaaucgccuccgaagucaaggcccugaacgcuaaucugucuacacucgagguacugacaaaaauugauaauuauacacugcucgacuacagccugauuagcagcccagagauaaccgagaauuauuuggaccuuaaccugaaaggcgucuuuuauccgcuggaaaaccucacugauccccccuuuucccccgugcccuuugugcucccagaacggucgaauucuaugcucuauaucgguauugcggaauacuucuucaaaucugcaagcuucgcacauuuuacugcuggaguuuuuaaugugacccugaguacugaagagauuucaaaccauuuuguccagaacagccaaggccuaggaaacgucuuaucucguaucgccgagauauacauacuaucacagccuuucaugguucgcaucauggcuacagaaccaccuaucauaaaccuccagccaggcaacuucacacuagacauuccagccuccauuaugaugcucacucagccaaaaaacucuaccgucgagacuaucgucagcauggauuuugucgcaucuacaaguguuggccucguaauccuaggacagagauugguaugcucccucucccugaaucgcuuucgccuugcacucccggagucaaauaggagcaacaucgagguucugcgauuugagaauauuuugucaaguauccuacauuucggcguguuaccucucgcaaaugccaaacugcagcaagguuuuccccucucuaauccccauaaguuccuguucgugaauucugacauagaagugcuugagggcuuucugcuaauuagcaccgacuugaaguacgaaacaagcuccaaacagcagcccucuuuucauguuugggaaggacucaaccugaucucccggcaauggcgagggaagagugcuccauag

SEQ ID NO: 13675 - RNA, 474 nt, Artificial Sequence
  Description of Artificial Sequence: Synthetic coding sequence
augcaucccuggcuggggucugcccuuggcuuuccuaaguguagggggauacaccugugcgcaugcgguaacgguuggacaccuggugaaacacuuucucagaauaagacggaaauaacaaagaauaaggucacauguuggagaccccauggcugugagccuaacacgggccucggcuaucaaggaucccacacuucuaaguauacccugcugccuuggaaccugcucaagacaaagccacugccccccagccacggcaaggaaggcggcaaagaggcuaaaguaccuaguggugauaacucuggacgcggagagguccccagagcacaggaagggcaggccgcauguggaagagcugccucuggcgauucucaagaagguaugcggagaggauaugaggagcgggccacggcacagcguccagcagugagaucugccgaaaccacugcccacggaacauggauuuacccuuag

SEQ ID NO: 13676 - RNA, 213 nt, Artificial Sequence; identical to SEQ ID NO: 12037
  Description of Artificial Sequence: Synthetic coding sequence

SEQ ID NO: 13677 - RNA, 645 nt, Artificial Sequence
  Description of Artificial Sequence: Synthetic coding sequence
auggcccugcugcuaugucuuguuuguuugacugcugcacucgcucacggaugucuacauugccacucaaauuucaguaaaaaguuuucauuuuaucgccaucacgugaauuuuaagagcuggugggucggcgacaucccuguaucaggcgcucugcugacugauugguccgacgacaccaugaaggaacuccaccucgcuaucccagcgaagauuacccgagagaagcuggaccagguggcuacugcaguguaucaaaugauggaccagcuuuaucagggaaaaauguacuuccccggguacuuucccaaugaacucagaaauauuuuccgcgagcaaguccauuuaauccagaaugccaucaucgagagcaggaucgauugccaacaccguugcgggauauuucaauaugagacaauaagcuguaauaacugcaccgacucccauguggcuugcuuuggauacaauugcgaaagcuccgcgcaauggaaaucugccgugcagggucuacuuaauuauauuaauaacuggcauaagcaggacaccagcaugagccuugucagucccgcccugcgcugccuugagcccccacaccucgcuaacuugacuuuagaggaugcggcagaauguuugaaacagcacuag

SEQ ID NO: 13678 - RNA, 459 nt, Artificial Sequence
  Description of Artificial Sequence: Synthetic coding sequence
augagcccacaccugaccgcucucuuggggcucguuuugugccuggcgcagaccauccacacccaggaaggcgcacugccccggccuucaauaucagcagaacccggcaccguuauuucccccgguucccacguuacuuucaugugcaggggcccugugggcgugcaaaccuuucgccuagagcgagaagauagagcgaaguacaaggauagcuauaacguguuccggcuuggaccuucagaaucugaggcccgcuuccacauugauuccgucagcgagggcaacgcuggacuguacagaugucuguauuacaaacccccaggauggucagaacacucagauuuucuggaacugcucgucaaagaaagcuccggaggaccagauucucccgacacugagccaggcucaucugcugggacuguaccgggcacagaggcuaguggauucgaugcgcccuag

SEQ ID NO: 13679 - RNA, 900 nt, Artificial Sequence
  Description of Artificial Sequence: Synthetic coding sequence
auggcaccauggucccacccaucagcccagcuucaaccaguagggggcgaugcugucucuccagcucuuauggugcuacugugucucggccuuucacucggaccaaggacccacguccaggcaggcaaucugagcaaagcaacucugugggccgaaccaggaucagugauuaguaggggcaacagcgucacuauccguugccaggguacacucgaggcucaggaguauagacuagugaaggaaggaagccccgaaccuugggacacucagaauccccuagagcccaaaaacaaggcgcgcuucuccaucccgucaaugacugaacaccacgcaggcagguauagaugcuacuauuauucaccagcagguugguccgagccuucggauccauuagaauugguugucaccggcuuuuauaauaaacccaccuugagugcccuccccagcccaguugugaccaguggagaaaaugugacccugcagugcgguagucgccuucgauucgaccgcuucauccuuaccgaggagggagaccauaaguugagcuggacacucgacucacaguuaacaccuucaggucaauuucaagcacuuuuccccguuggcccaguaacacccucucauagauggauguugaggugcuacggcuccaggcgacacauucugcaaguguggagcgaacccucagaccuccuggaaauuccuguuucuggcgcagccgacaaccugucaccgagccaaaacaagucagacagcggcacagcuucacauuuacaggauuacgccguagagaaucuuauucggaugggcauggcaggauuaauucuuguaguucucggaauucucaucuuccaagauuggcacucccagcgaagcccacaggcugcugccggacgcuag

SEQ ID NO: 13680 - RNA, 618 nt, Artificial Sequence
  Description of Artificial Sequence: Synthetic coding sequence
augaaggugcugcugcuaacaggucucggagcucuuuuuuuugccuauuacugggacgacaauuuugaucccggaggacuagacuaucuugugcugaaucacaucggcggggccccugcaggcacccgagcaaggucaccacaagcaacucgauggcuuaugcaggugaacuucgugucuuacgugcaguugacuucaagggcacugccuaguuugacugacucaaagggcucgcucgucgucguaucuucccuucuaggucgaguccccaccucauuuagcaccccauacucugccgccaaauucgcucucgauggcuucuucggcucccuaaggagagagcuugauguacaggacgugaacgucgcgauaaccaugugcgugcucggguuacgggauagggccagcgcagcugaagccguucgaggagugacaaggguaaaggcggcgccaggaccuaaggccgcacuggccgucauuagaggaggugcgaccagggcagcaggcguguucuacccguggagauuucggcuccuguguuuacuuagaagguggcucccccggccgagagcaugguucaucagacaggaauugaaugugacugccgccgccgcuuag

SEQ ID NO: 13681 - RNA, 795 nt, Artificial Sequence
  Description of Artificial Sequence: Synthetic coding sequence
augcugcgcugcggcggccggggccuauugcuuggacuugcuguggcugccgcugcuguaauggccgcucgucuuaugggguggugggggccacgcgcaggcuuuagauuauucauucccgaggagcuuaguagauaucgcggcgggccuggagauccuggacuguaccuggcauuacucgguagaguguacgaugugaguucugggagacgacauuaugaaccuggcagucauuauuccggauucgccggucgagacgccagcagagcauuugugaccggugauuguucagaggcaggcuugguagaugacgugucagaccucucagcggcagaaauguuaacccuucacaauuggcuguccuucuacgaaaaaaacuacgucugugucgggcgggucacaggaagguuuuauggagaggaugggcuacccacacccgcacucacacagguugaggcugccauaacucgaggccuggaagcaaacaaguuacaauuacaagagaagcagacauuuccuccauguaaugcggaguggagcagcgcaaggggauccagauuguggugcucccagaaauccggaggggugucgagggauuggaucgggguaccuaggaagcuuuacaagccaggagcaaaagagccccgcugcguaugcguacguacuacaggaccuccuucuggucaaaugccugacaauccaccacacagaaaccgaggggaucuugaccaucccaaucuggccgaguauacaggcugcccaccucuagccaucacauguucauucccacuuuag

SEQ ID NO: 13682 - RNA, 468 nt, Artificial Sequence
  Description of Artificial Sequence: Synthetic coding sequence
augucuaaacgauuacugcugcugcugcugcuguccaugggagggacaugggccagcaaagaaccacuccgcccucgcugucguccaaucaacgcaacccucgcuguagaaaaggagggaugccccguguguauuaccgugaacacaacaauuugugccgguuacuguccuacaaugacaagaguucuucaggggguacuccccgcccugccccagguugucuguaauuauagggacgugcgguuugaaucuauacgucucccaggauguccuagaggggugaaucccguugugaguuaugccguugcccucagcugccaaugugcccucugccgccguucuaccacugacuguggcggaccaaaagaucauccucugacaugcgacgaucccagauuccaagacuccuccucuucaaaggccccgccaccaucucugccuucacccucacgccuuccagguccuuag

SEQ ID NO: 13683 - RNA, 498 nt, Artificial Sequence
  Description of Artificial Sequence: Synthetic coding sequence
auggaaauguuccagggacugcuauuacugcugcugcucuccaugggaggaacaugggcgucaaaggaaccucuccgaccucgcugccggccgaucaaugcaacacuugccgucgagaaagaggguugcccggucugcaucaccgucaacacuacaaucugcgccggcuacuguccgaccaugacacggguccugcaagguguccugcccgcccuuccacaggucgugugcaacuaccgcgacgugcgauucgaaucuaucaggcuuccgggaugcccaagaggcguuaauccaguuguguccuacgccguggcucuuucuugucagugugcccugugccggagaagcacaaccgauugcggaggccccaaggaccacccucugaccugcgaugauccacgauuccaggacucuagcucuucuaaagccccgccaccaagccugccauccccaucaaggcugccaggaccauccgauacucccaucuuaccacaauag

SEQ ID NO: 13684 - RNA, 990 nt, Artificial Sequence
  Description of Artificial Sequence: Synthetic coding sequence
augcugccucuucugcucggacuguuaggaccugcugcuugcugggcuuugggcccaacccccggcccuggaucaucagaacugagaucagcuuucagcgcugccagaacaacaccccuggaggguacuucugaaauggcuguuacguuugacaagguauauguaaacaucggcggggacuucgacguugccacgggccaguuucgcuguagagugcccggugcauacuuuuuuucuuuuacugcugggaaagccccacauaagagucugucaguaauguuggugaggaaccgcgaugaagugcaggcccucgcauuugaugaacagagaaggccgggugcccgccgagccgcgucccaguccgcaaugcuccaacuugauuauggugauacuguuuggcugaggcugcauggcgccccucaguaugcguuaggagcacccggcgcaacguucaguggguaccucgucuaugcagaugcagacgccgaugcccccgcgcgcggaccuccugcgccgccagagccacggagugcuuucuccgcagcccguacaagaucgcucguuggauccgacgcagggccaggccccagacaucagccucucgcuuucgacacagaguuugugaacauuggaggagauuuugacgcugcggcaggaguguucaggugucgacucccaggcgcuuauuucuucagcuuuacacuugggaaauuaccucguaaaacccuguccgugaaacuuaugaaaaaucgggaugagguccaagccaugaucuaugacgacggagcaagucggcgucgagaaaugcagagccagucugugaugcucgcccuaagacgaggagacgcggucuggcugcugucccaugaccaugacggauacggagcguacucgaaucauggcaaguauauuacuuuuucuggcuuccucguuuaccccgaccuggccccugccgcuccacccggccuuggcgcuucagaacuucuguag

SEQ ID NO: 13685 - RNA, 873 nt, Artificial Sequence
  Description of Artificial Sequence: Synthetic coding sequence
augcguaggccagccgccgugccccuccuacuccuguuauguuuuggaucacaacgcgcuaaagcggcaaccgcuugugggcgcccccggaugcucaacaggaugguaggcggccaagauacccaggaaggugaguggccauggcaaguaagcauucaaaggaauggcucacacuucuguggaggcagucucauugccgagcaguggguccugacagcugcacacugcuuccggaauacaucagaaaccucucuuuaucagguguugcuuggcgcucgucaacuaguucagccgggcccccaugcgauguaugccagaguuagacagguggaaagcaauccacuguaccaggguaccgcuucaucagcagacguggcccuugucgaguuagaggcucccguuccauucacaaauuacauccugcccgugugucuaccugauccuuccgugauuuucgaaaccgguaugaauuguugggugacaggaugggguagccccucugaagaagacuugcugccagaaccccggaucuuacagaagcuggcugugcccauaauugacacccccaagugcaaccuucuguacucuaaggauaccgaguuuggcuaucagccuaagacgauuaaaaacgauaugcuuugugcagguuuugaggagggaaaaaaggaugcuugcaaaggugacucgggaggaccauuagugugcuuaguuggacaaaguuggcuccaggcaggagugauaaguuggggagagggcugcgccaggcagaacagaccgggagucuacauucgcguaacagcccaucacaacuggauccaucgcaucaucccgaagcuccaguuccaaccagccagauuagggggacaaaaauag

SEQ ID NO: 13686 - RNA, 792 nt, Artificial Sequence
  Description of Artificial Sequence: Synthetic coding sequence
auggcauucuuauggcuucuguccuguugggcucugcuggguacaacauucggcugcggagugccugccauccauccaguacucuccggcuugucccguaucgugaacggagaagacgcugugccaggaucuuggccauggcagguuagccuccaggacaaaacaggguuucacuucugcggcgggucacuaaucagcgaggauuggguggugacagcagcacauugcggaguuagaacuagcgauguggucgucgccggcgaguucgaccaggguuccgaugaagaaaauauacagguguuaaaaauugcaaaggucuuuaagaaucccaaauucuccauauuaacuguuaacaaugacauuaccuuauugaaguuagccacgcccgcaagauuuucucaaacaguuucugccgugugccucccaagcgcagacgaugacuuuccugcaggcacacugugcgccacuaccggaugggggaaaacaaaauacaaugccaauaagacacccgacaaguuacagcaagccgcucugccuuuguugaguaacgccgagugcaagaaaucauggggcagacgaauaacagaugugaugaucugcgccggcgcaucuggugugucuucuuguaugggcgauucaggugguccacuggugugucagaaagacggcgcuuggacacuuguuggcaucgugucauggggcaguagaacaugcaguaccacuacuccagcuguguacgcccgggucgccaaauugauuccaugggugcaaaaaauauuggcagcuaauuag

SEQ ID NO: 13687 - RNA, 228 nt, Artificial Sequence; identical to SEQ ID NO: 12048
  Description of Artificial Sequence: Synthetic coding sequence

SEQ ID NO: 13688 - RNA, 762 nt, Artificial Sequence
  Description of Artificial Sequence: Synthetic coding sequence
auggccagaucguuguugcugccuuugcaaauacuguugcugucccuugcccuagaaacagcuggagaagaggcacaaggggauaagauuauugauggggcgcccugugcucgaggcucucaccccuggcagguugcacuccucagcggaaaccagcuucauuguggcggcgugcuggucaacgagagaugggugcuuacugccgcucacuguaagaugaaugaguauacuguccaucucgguuccgauacucugggggacagaagagcgcaacgcaucaaggcuuccaagaguuucaggcaucccggauacaguacccagacucacgucaacgauuuaaugcucgucaaacuuaacucgcaggcccgacugaguucuauggugaaaaaaguccgacucccuagccgcugcgaaccucccgguaccaccugcacugucuccgggugggguacaacuacauccccggacguuacuuuuccgucugaccugauguguguagaugucaagcuaauaaguccucaggacugcacuaaaguguacaaggaccucuuggaaaacucaaugcuuugugcuggaauucccgauucaaaaaaaaacgccugcaauggggacaguggcggccccuuggucugucggggaacucuucagggucuggucaguugggggacuuuuccaugcgggcagcccaacgauccuggcgucuacacccaaguguguaaguucacuaaauggauuaaugauacaaugaagaaacaucgguag

SEQ ID NO: 13689 - RNA, 480 nt, Artificial Sequence
  Description of Artificial Sequence: Synthetic coding sequence
augaaggcuugggggacagucguggugacgcuggcuacacuaauggugguuacaguugaugccaaaauuuacgaaagaugugagcuggccgcgcgauuagagagagcugggcucaauggguauaagggauacggcguuggagauugguugugcauggcccacuaugaaucgggguucgacacugccuuuguggaccacaacccagacggaagcagugaauaugggauuuuccagcugaauuccgccugguggugcgauaauggaauaacaccuacaaagaaccugugccauauggauugccacgacuugcuaaaccgccacauucucgacgauauccgcugcgcuaaacagauuguuaguagucagaacggccucucugccuggaccaguuggcgacuccacuguagcggucacgauuuguccgaauggcuuaaggguugugacaugcacguuaagaucgacccaaagauucacccauag

SEQ ID NO: 13690 - RNA, 501 nt, Artificial Sequence
  Description of Artificial Sequence: Synthetic coding sequence
auggcccagaccaacagcuucuuuauguugauaucaagcuugauguuccuaagccucucccaaggccaagagucucaaacagagcugccaaacccacgaauuagcuguccagagggcacaaaugccuacagaucguauuguuacuauuuuaaugaggauccugagacuuggguggacgccgaccuguacugucagaacaugaauagcggaaauuuagucucaguacuuacucaagccgagggcgcauucgucgccucccuuauuaaagaaucuagcaccgaugauucuaauguguggaucggcuuacacgauccuaagaagaauagaagauggcauuggagcagcgggucucuggucuccuauaagagcugggauacaggcucaccaucaagugcuaacgcaggauacugcgccucccuaacuaguugcagcgguuuuaaaaaguggaaagacgaguccugugagaaaaaguuuagcuuugucuguaaauuuaagaauuag

SEQ ID NO: 13691 - RNA, 528 nt, Artificial Sequence
  Description of Artificial Sequence: Synthetic coding sequence
augcuuccuccgauggcgcuaccaagugugucguggauguuacucuccugucuuaugcuauugucccaagugcaaggcgaggaaccucagcgagaacugcccucagcucgcauccgcuguccaaaagguagcaaagcuuauggaucucauuguuaugcacucuucuugagcccuaaauccuggacugacgccgaucucgcaugccagaagcggccauccgggaacuuggucagcguguugaguggugccgaagggucauucguauccucacugguaaagaguauagguaacagcuacucauacgucuggaucggccugcacgauccaacccagggcacagaaccaaacggcgaagggugggagugguccuccuccgaugucaugaacuauuuugccugggaaaggaacccaucuacgauuagcucucccggucacugcgcgucucucucaagguccaccgcuuuccucagguggaaggauuauaacuguaacguccgcuugccauacguauguaaauuuaccgacuag

SEQ ID NO: 13692 - RNA, 1686 nt, Artificial Sequence
  Description of Artificial Sequence: Synthetic coding sequence
augggggcaaggacuccacuaccauccuuuugggugagcuuuuuugcagaaacagggauucuuuucccagguggaacgccauggcccaugggcucccaacacagcaagcaacauagaaaaccugguccacugaaaaggggccaucggagagaccguaggacaacccggcgcaaauacuggaaggagggacgugaaauugcccgcguacuggacgacgaagggcggaauuugagacagcagaaacuagaucggcagagggcccuuuuggagcagaagcagaagaagaagagacaagagccguugauggugcaggcuaaugcagacgggcggccucgaagucgaagagcuaggcagucagaagaacaggcaccucugguggagaguuacuuguccucuagugggagcacgucuuaucagguacaggaagccgacaguuuagccagcguccagcucggugcuacucguccuacagcucccgccucggccaaacggaccaaagcugccgcaacagcaggaggccagggcggcgccgcacggaaagaaaagaaagggaaacauaaaggaaccucaggcccagccgcccucgcagaagacaaaagugaagcccagggccccguccaaauccugacugucggacaauccgaccaugcgcaggacgcaggugagaccgccgcaggugguggcgaacgaccuucuggccaggaucugagagcaacaaugcagcgaaaagggaucaguuccagcauguccuuugaugaggaugaggaggaugaagaagagaauagcucuaguucuagucaacugaauucgaauacccgcccaagcuccgcaacaucccgaaaaucugucagggaggccgcuucugcaccuucuccaaccgccccagaacagcccguggacguugagguucaagaccuggaggaguucgcguuaaggccugcuccacaggggaucacaauuaaaugcagaauuacaagggauaaaaaaggaauggaccgcggcauguacccuacguauuuccuccacuuggaccgcgaagacggaaaaaaaguauuucuccuggccggcagaaaacguaaaaaaagcaagaccucuaacuaccugauaucuguugacccuaccgaccugucaagaggcggagauucuuacaucggcaaacuacgauccaaccuuaugggcacuaaguucaccgucuaugauaacggugugaacccccaaaaagccucuucaucgacuuuagagagcggaacgcugagacaggaauuggcagcugucuguuaugaaacuaauguacucggcuucaaaggcccacggaaaaugagcgugaucguccccggcaugaauaugguccacgagcggguaucuaucaggccucgcaaugagcacgagacgcucuuggcacguuggcaaaacaagaacacugagaguauuauagaacuucaaaauaagacaccaguauggaacgacgauacacagucuuacgugcugaauuuccauggcagagugacucaagcauccguuaagaacuuccagauuauucacgguaaugaucccgacuacauugugaugcaauuuggccgcguugcggaagauguguuuacuauggauuacaacuacccuuuaugcgcuuuacaagcguuugcuauugcauuaagcuccuucgauucuaagcuggcuugcgaguag

SEQ ID NO: 13693 - RNA, 1272 nt, Artificial Sequence
  Description of Artificial Sequence: Synthetic coding sequence
augauguaucgcccggaugucguuagggcacgaaaacggguauguugggagcccugggugauuggacugguuauuuucauuucuuugauuguucuggccguuugcauugggcuuacugugcauuacgugagguauaaucagaaaaagacauauaacuacuacaguacuuuaucauuuacuacagacaagcuguaugccgaauuuggcagagaggcaaguaauaauuuuacagagaugagccaacgauuggaaucaauggucaagaacgcauucuacaagucgccacucagagaagaauuugugaagucacaggucaucaaauucucucaacaaaaacacggaguccuggcacacaugcugcugaucugcagguuucacuccaccgaggaccccgaaaccguugauaagaucguccagcuagucuugcaugagaaacuucaggacgcgguagggccccccaaggucgacccacacucuguaaaaauaaaaaagauuaauaagacugaaacugacucauaccugaaucacugcugugguacacgccggucaaaaacucuaggucagucacuaagaauugucggggggacggagguagaggaaggagaauggcccuggcaggcaucauugcagugggacggaagucacagaugcggcgcaacacuaauaaacgcaacuuggcuugugucagcagcgcacuguuuuaccaccuacaagaacccugcacguuggacugcuucauucggaguaacaauuaaaccaaguaagaugaagagaggccugcgccggaucauuguccaugagaaguauaaacacccaucccaugacuaugauaucucacuagccgaacucuccuccccagugccguacaccaaugccgugcaccgugugugucuuccagacgcuagcuacgaguuucagcccggagacguuauguuugugacuggguucggcgcucuuaagaacgauggguauucucagaaucaccuccgacaggcacaggucacacugaucgacgcuaccaccuguaaugagccucaggccuauaacgacgcuauuacaccaagaaugcuuugcgcuggcucgcucgagggaaagacugaugccugccagggggauagugguggcccgcuagucagcagcgacgcccgggacauuugguaucuggccgguauugugagcuggggagaugagugcgcuaaaccaaauaaaccaggcguauauacacgagugaccgcccuccgcgauuggauuacaaguaagaccggcaucuag

SEQ ID NO: 13694 - RNA, 282 nt, Artificial Sequence; identical to SEQ ID NO: 12055
  Description of Artificial Sequence: Synthetic coding sequence

SEQ ID NO: 13695 - RNA, 1530 nt, Artificial Sequence
  Description of Artificial Sequence: Synthetic coding sequence
auggauuuccuccucgcccuuguucuuguuucaucucuguaucuucaagcugccgccgaauuugaugggagguggccucgccagaucguuagcagcaucggcuuguguagguauggcggucggaucgauugcuguuggggcugggcccgucagaguuggggucagugccaacccguuugucagccuagauguaaacacggggaauguauugggccaaacaaaugcaaaugccauccagguuacgccgguaaaaccugcaaucaagaccucaacgaauguggacucaaaccaaggccuuguaaacaccgaugcaugaacacguauggaucuuauaaaugcuacugucugaaugguuauauguuaaugcccgacggcaguuguagcagcgcacucacuuguucaauggccaauugucaguacggcugcgacguaguaaaagggcagauacgaugucaauguccaucaccaggccugcaauuggcgccugacggaagaaccugugucgauguggaugagugcgcuacagguagagcuagcugcccuagauuccggcagugugucaacacauucgguaguuacaucugcaaaugucacaagggauuugaccugauguacauuggagggaaauaccaaugucacgauauagacgaaugcucacucggccaguaccaaugcucaucuuuugcuagguguuauaacauucgcggcucauauaagugcaaauguaaggaaggauaccaaggcgauggcuuaaccuguguguauauuccuaaaguaaugaucgagccauccggcccaauccaugugcccaagggaaacggcacuauucuuaaaggggauacagggaacaauaauuggauaccagacgugggcucaacuugguggccccccaagaccccuuacauuccuccuaucaucacuaaucgccccacuucgaaacccaccacucgccccacuccaaagccuacaccuauuccuacacccccacccccaccuccgcugcccaccgaauugcgcaccccacuuccccccacaacgccagaacggccaacuacuggacugaccacaauugcacccgcugcaucaaccccccccggcggcaucacaguagauaacagagugcaaaccgauccccaaaaaccccgaggagacguguucaguguguugguccacagcugcaacuucgaucacggacuaugcggguggauuagagagaaggauaacgauuuacacugggagccaauuagagacccggccggcggacaauauuugacuguaucugcugcaaaagccccuggaggcaaagccgcucggcuaguauugccauugggccgucucaugcacagcggggaccugugucucucauuccggcacaaggucacaggccuccauaguggaacccuccagguguuugugaggaaacacggagcacauggagccgccuuguggggacguaauggcgggcacggauggcgucagacucagaucacauugcgaggugccgacauaaaaagcgaaucccaacgauag

SEQ ID NO: 13696 - RNA, 381 nt, Artificial Sequence
  Description of Artificial Sequence: Synthetic coding sequence
auggauaagagcuuacugcucgaauugccaauacucuuguguuguuuuagggccuuguccgguagccugucaaugcgcaacgaugccgugaaugaaauuguagcugugaaaaauaauuucccagugauugagauagugcaguguaggaugugucacuuacaauucccuggcgaaaaguguaguaggggacgaggaaucuguaccgccaccacagaggaggcauguaugguuggcaggauguucaagagagacgggaacccuugguugaccuuuaugggaugccuaaaaaauugugccgauguaaaaggaauccgguggucaguauaucucgucaauuucaggugcugucgcucucaugaccucugcaacgaagaccuguag

SEQ ID NO: 13697 - RNA, 537 nt, Artificial Sequence
  Description of Artificial Sequence: Synthetic coding sequence
auggagcugcugcaggugaccauuuuguuccuacugccuucuaucuguuccuccaacagcaccggagugcucgaggccgccaauaacucacucguugugaccacaacuaaacccaguaucacuacgccuaauacagagucccuccagaaaaauguuguuacccccaccaccggaaccacaccuaaagguaccauaacgaacgagcugcugaagaugucccuuaugucuacugccaccuuucucacguccaaagacgagggcuuaaaggccaccaccaccgaugugcgcaaaaacgauagcauuauaagcaauguuaccguaaccagcgugaccuuaccaaaugccguaucaaccuugcaaagcuccaagccuaaaacugagacucagucuuccaucaagacaacugagaucccuggaaccccugaaaacggcaaugaucagccacaguccgauaaagaaagcgugaagcuacugaccguuaagacaaucucucacgaaagcggcgaacauagcgcacaagguaagacuaaaaauuag

SEQ ID NO: 13698 - RNA, 2544 nt, Artificial Sequence
  Description of Artificial Sequence: Synthetic coding sequence
auguucaaguguuggagcguuguccugguguuggguuuuaucuuucucgagucagagggaagaccgaccaaggagggugguuacgggcugaagaguuaccaaccuuugaugaggcugagacacaaacaggagaagaaccaagagagcucccgcguaaaaggcuucaugauccaagacggcccauuugggaguugcgaaaacaaauauugcggacuaggaaggcacugugucaccucaagagagacugggcaggccgagugcgcaugcauggaccugugcaaacgccauuacaagccaguuugcgguuccgauggcgaauucuacgagaaccauugugaagugcacagggcggcaugcuuaaagaaacagaagauuaccauugugcauaacgaagacugcuuuuuuaagggagauaaaugcaagacuaccgaguacagcaaaaugaagaacauguuauuagaucuccagaaccagaaauauauuaugcaggagaacgaaaaccccaauggcgacgacauuucuaggaagaaacucuuaguggaccagauguucaaauacuuugacgcugauucaaacggcuuaguggacauuaacgagcugacacaggugauuaaacaggaagaacugggcaaagaccuauucgauuguacccucuacguacuacuuaaauacgacgauuuuaaugcugauaaacaccucgcgcucgaggaguuuuaccgagcuuuccaagucauucagcuuagucucccggaggaucagaagcugagcauuacagcugcgacuguggggcaaagcgccguucugucuugcgccauucagggaacgcugcgcccacccauuaucuggaaacgcaacaacauuauccugaauaaccucgaucucgaagacauaaacgacuuuggugacgauggaagucuuuauauaacuaaggucaccacaacucauguuggaaacuacacauguuacgcugacggcuaugaacagguuuaccagacacacauuuuccaaguuaacgucccucccguuauacggguauacccagagucgcaggccagagaaccaggcgugacugcaucccuuagaugucacgcagaggguauuccaaagccgcaacugggcuggcuuaagaauggaaucgauaucacgcccaaacucaguaagcaguuaacccuccaagcaaacggcucagagguucacaucucaaaugugagauaugaggacaccggagcuuauacguguaucgccaaaaaugaagcggguguugaugaggacaucucaagcuuauucgucgaagacagugccagaaaaacccucgccaauauccuguggcgcgaagagggacuggggauugggaauauguucuauguguucuacgaagacggcaucaaaguuauucaaccgauugagugugaauuccaaagacauauaaaaccaucagaaaaacuuuuggguuuucaagaugagguguguccuaaagcugaaggcgaugagguccagagaugcgugugggccucggccgugaacguuaaggauaaauucaucuacguugcgcagccaacauuggaccgagucuugaucguggacguacagagccaaaaaguuguucaggccgucuccaccgacccaguaccuguuaagcuacacuaugacaagucucacgaccaagugugggugcucagcuggggaacuuuagaaaagaccaguccuacacugcagguuauuacccucgcgucuggcaacgucccccaucauacaauucacacucaacccguaggaaagcaguucgaccggguagacgauuucuucaucccuacaaccacccugaucauuacucauaugcgauucggauucauacuucacaaggacgaagccgcccuccaaaagaucgaccucgagaccaugagcuauaucaagacaauuaaucucaaagauuacaaaugcguuccccagucccuggcuuacacacaccuuggcggauauuacuucaucggaugcaaaccagauaguaccggagccgugagcccccagguuaugguugacggcguaacggacucagugauugguuuuaacucugacguaacaggaacgccuuacguuucaccggauggucacuacuuggucucuaucaacgaugugaaaggacuuguacgagugcaguacauaacuauccguggggaaauucaagaggcauucgauauuuauacaaaccugcacaucucggaucuggccuuccagccgucguuuacugaagcacaccaauacaacauauauggguccuccuccacccagaccgacguacuuuucguggagcugucuucuggcaagguaaagaugaucaaaagucucaaagaaccacuuaaagccgaggaauggccguggaacagaaagaauagacagauucaggauuccggacuguuuggccaguaucuuaugacacccucuaaggacucucucuuuauccuggacggaagacuuaauaaauuaaauugcgagauuaccgaaguggagaaggguaauacaguaaucugggugggcgacgcguag

SEQ ID NO: 13699 - RNA, 273 nt, Artificial Sequence; identical to SEQ ID NO: 12060
  Description of Artificial Sequence: Synthetic coding sequence

SEQ ID NO: 13700 - RNA, 1044 nt, Artificial Sequence
  Description of Artificial Sequence: Synthetic coding sequence
augagcagcuggucuagacagagacccaaauccccuggagguauucaaccacaugugagucggacccuauuccugcuccugcugcuugcugccagugccugggguguuacucucucaccuaaggauugccaagucuuccgcucagaucacggaagcucuauuucaugccagccaccugcagaaauccccggauacuuaccagccgacaccguucaucucgccguagaguuuuucaacuugacacacuuaccagcgaaucuccugcagggugcuaguaaguuacaggaacuccaccucucuagcaauggacucgagucucuaucgcccgaguuccugcggccagugccacaauugcggguauuagaucuaacaagaaacgcauugacaggucucccccccgguuuguuucaggcaagugcgacacucgauacucuuguuuugaaggaaaaccagcuggaggugcuggaggugaguuggcugcacggacugaaagcacugggacaccuggauuuguccggaaauagauuaagaaagcucccacccggccuccuagcuaauuucacauugcugagaacccucgaucucggagaaaaucaguuagaaacgcucccaccugaccugcugagaggaccacugcaauuggagcgucuacaccucgagggcaauaaguugcaggugcuaggaaaagaccuguuacuuccucagccggaucuccguuaucuguuucucaacgguaauaaguuagcacggguugccgcaggugcuuuucagggucucagacaacuagacaugcuggaccugucaaacaacuccuuagcuucuguuccugaaggauuaugggccucccuugggcagcccaauugggauaugcgcgacggcuucgauauuagcggaaacccuuggaucugugaccagaacuugagcgacuuauauagauggcugcaggcacagaaagacaagauguucucacaaaaugacacgaggugcgcgggaccggaggccguuaaggggcagacacuacucgcuguagccaagucucaguag

SEQ ID NO: 13701 - RNA, 1407 nt, Artificial Sequence
  Description of Artificial Sequence: Synthetic coding sequence
augccacccuggggcgcagcauuagcgcuuauccuggcuguuuuggcccuccugggauuauuagggccucgcuuacgcggacccuggggaagagcuguaggagaaagaaccuugcccggagcacaggacagagaugauggcgaagaagcggacggcgguggaccugcugaccaguucagcgaugggcgcgaaccauuaccugggggcugcucucuggugugcaaaccuucagcacucgcacagugccugcugcgcgcacugaggagaucagaggccuuggaagcugggccucggucuugguuuagcggaccccacuuacagacacugugucauuucguccuucccguugcccccggcccagaacucgcccgggaauaucuccagcuugcggacgacgggcugguggcccuggacuggguuguaggacccuguguaagaggucgaagaaucaccucagcagguggucuucccgcagucuuauuagugaucccuaacgcauggggucgccucacccgaaauguacugggucugugccuucuggcuuuggagagagguuauuacccugugauauuccaccgcagaggacaccauggcugcccgcucguaaguccccggcuccagccuuuuggagacccauccgaucuaaaggaggcugucacauacaucagguuccggcauccugcagcaccauuguuugcugugucugagggcucuggauccgcucugcugcugucuuaccuaggcgaguguggcucaaguuccuaugucacaggggccgccuguauuucuccaguuuugcgcuguagagagugguuugaagcuggucuccccuggccuuacgaaagaggguuucuccuccaccagaaaauugcacugagcagauacgccacagcauuagaagauacuguggauacuucccgucuauuucguucacgcucccuucgcgaauuugaggaagcccucuucugccauacaaagucuuucccaauuucuugggacacuuauugggaccgaaacgauccacugagagauguagacgaagccgccgugccaguguuguguaucugcagcgcagacgaccccguguguggaccuccagaccacacccugaccacugagcucuuucauucaaaucccuauuucuuucugcuacuuucucgacacgggggccauugugguuuucuucggcaggagccucuuccggcguggucucaugaggucauucuggagaguuuucgagcuuuaacugaauuuuuucgcacagaggaacgcaucaaaggccuuucaagacaccgggccagcuuucugggcggcaggagaagaggcggagcacuccaaagaagagaaguaagcagcagcuccaaccuugaggagauuuucaauuggaagcguucuuauacccgcuag

SEQ ID NO: 13702 - RNA, 423 nt, Artificial Sequence
  Description of Artificial Sequence: Synthetic coding sequence
auguuuuuuacgauuucaagaaagaacaugucucagaaacugagccuguuauugcuaguuuucggacucaucuggggucugaugcugcuacauuauacuuuccagcaaccuagacaucaaucauccgugaaacugcgggagcaaauucuggaucucucaaaaagauacgugaaggcacuugcggaggagaauaagaauaccguggacguggaaaauggagcaucuauggcaggauacgccgaucuaaagagaaccauugcugugcuguuggaugauaucuuacagcgucuggugaagcucgagaacaaggucgacuacauuguugugaacggcucagcagcgaauacuacuaauggaacaucugggaaucucguacccguuaccaccaacaagagaacgaacguguccggcucaaucagauag

SEQ ID NO: 13703 - RNA, 993 nt, Artificial Sequence
  Description of Artificial Sequence: Synthetic coding sequence
cgcggcgcucuggugggggccccacguagcgcucgugccaguugccuaagaggccggagaccagggcggaggcagccaugcgggaggugccccgauccuccacgguccgguccagggcaagcagggagagcaagaugcgcccgggacguggcagcacagaccgccuuagcgccucgggcucuggcccuuggggccggcgccgcgggcccagguuggcgcggggccguacccagacgcccagcugcaaggguaaguagagccgcucagcgucaggaacaagaguuagucagauugcaccgggagcaggagugugagcugcaacccgaaccugcccccccaagaccgagcggaccugccacagcugaggauccaggacggagaccagugcuaccccagcgucccccugaagagcgacccccacagccucccggcucgaccgggguuaucgccgaaaccggacaggcaggacccccagccggggcaggagugucuggauacccgaagucuccccccguggcguccccaggagcgccuguucccucucuggugaguuucucagccggccucacgcaaaagcccuuccccucagacggaggugucgugcuguuuaacaaggugcugguaaaugauggcgacguguacaacccuucuaccggcgucuuuacggccccuuaugacggucguuacuugauuacugcgacuuuaaccccugagagagaugcauauguugaagccguucugaguguguccaaugcaagcguggcucagcuccacacagcuggguacaggcgugaauuucuggaguaucaccggccccccggcgcccugcauaccugugggggccccggcgcuuuccaucuaaucguacaucuuaaagcuggcgaugccguuaacguggucgucaccggcgguaaacuagcucauacagauuucgacgaaauguauagcaccuucucaggcgucuuccuuuauccuuucuugucccaccuguag

SEQ ID NO: 13704 - RNA, 585 nt, Artificial Sequence
  Description of Artificial Sequence: Synthetic coding sequence
auguccgcccuguggcuccuucuaggauugcucgccuuaauggaucuuagcgagucaagcaauuggggaugcuauggaaauauccagucccucgacacccccggcgcaucguguggaauuggucgacggcacgggcugaauuacugcgggguucgcgcauccgagcgguuagccgagaucgacaugcccuaccuauugaaguaccagccgaugaugcagacaaucggacagaaauacugcauggaucccgccguuauagccggagugcuaagccggaagucacccggagauaagauccugguuaauaugggcgacagaacuucuauggugcaagauccaggcagucaagcucccaccaguuggauuucagaaucucaggucucacagacaacggagguguugacaacccgaaucaaggagauacagcgcagauuccccacuuggacuccugaucaguacuuaagaggcggacugugugccuacuccggcggcgcaggcuacguucggucuagccaggaucucuccugcgacuuuugcaaugacguucucgcacgcgcaaaauaccuuaaaaggcauggcuuuuag

SEQ ID NO: 13705 - RNA, 273 nt, Artificial Sequence; identical to SEQ ID NO: 12066
  Description of Artificial Sequence: Synthetic coding sequence

SEQ ID NO: 13706 - RNA, 1914 nt, Artificial Sequence
  Description of Artificial Sequence: Synthetic coding sequence
augucaagaaugcuuccauuccuccugcugcucugguuucuccccaucaccgaaggcucucagcgcgcugaaccuauguuuacagcggugacaaacagcguucuaccacccgauuacgacaguaauccaacacagcugaauuacggcgucgcagugaccgaugucgaucaugacggagauuucgaaauugucguugccggcuauaacggccccaacuuaguucugaaauaugauagagcccagaaaagguuggugaauaucgcaguugacgagcgguccucuccuuacuacgcccugagggacagacaagguaaugccaucggaguuacagccugugacauugauggagauggaagggaggaaauuuacuuuuuaaauacuaauaacgcuuucucagggguggcuacauacacagauaaacucuucaaauuucgcaauaaccggugggaagauaucuuguccgaugaaguuaacgucgcccgugguguagccucacucuuugcuggucggucuguggcauguguagauagaaaggguucaggucguuauaguaucuauaucgccaacuacgcuuacgguaacgucggucccgacgcacucauugaaauggacccagaagcauccgacuugucccgugggaucuuggcccuucgagacguggcugcagaggcuggggugucaaaguacacuggaggucgcggggugaguguugggcccauauugagcuccucugcaagcgacauauucugugauaacgaaaacggcccuaacuuucucuuucauaauagaggcgaugggacauucgucgacgcugccgccagcgcugguguugacgauccacaccaacauggacgagggguugccuuggcagacuuuaaucgggacggaaaaguggacauuguguacgguaauuggaauggaccacaucggcucuaccuucagaugaguacucauggcaaggugcgauuucgagacauagcuucccccaaguucaguaugccuaguccgguacguacugucauuacagccgacuucgacaaugaucaggagcucgaaaucuucuuuaauaauauugcuuacaggucuucaagcgccaauagauuauuuagggugauucgucgcgaacauggugacccuuuaaucgaggaacugaacccgggcgaugcucuugaaccagagggucggggcaccggaggaguggugacggauuucgauggcgauggaaugcucgaucugaucuuaagucacggcgaaucaauggcccagccccucucaguguuuagggggaaccaaggauuuaacaauaacuggcucagaguagugccaagaacacgauuuggcgcauuugcccguggagcaaagguaguauuguacacaaagaaaucgggagcacaccuacgcaucaucgacggaggaaguggcuaucucugcgagauggaaccugucgcucacuucggccuggggaaagacgaagccagcucggucgaagugaccuggccagaugggaagauggucucaagaaauguggcaaguggagaaaugaauagcgugcucgagauccucuacccccgugacgaagauacucugcaagaccccgccccucuugaauguggccaaggauucagucagcaggaaaacggacauuguauggacacuaacgaauguauccaauuccccuuugucugcccaagagauaagccaguuugugucaacaccuaugggucuuaccgaugccgcaccaauaagaaauguucgcguggcuaugaaccaaacgaagacggaacagcaugcguggcucagguugccuuucucggagguuacuccagcgcugcaucuaggauaucugaaccccucagccgugccaguuaucuuucucuuggcuuaggccugugcuuacagcuguacgcccuguag

SEQ ID NO: 13707 - RNA, 600 nt, Artificial Sequence
  Description of Artificial Sequence: Synthetic coding sequence
auggcccucaacggcgcagaaguggaugauuuuucaugggagccaccuacagaggcugaaacaaagguacugcaggcccgcagagaacgacaggaucggauuucccgccucaugggcgauuauuugcucaggggauaucgaaugcugggugaaaccugugcggacugcggcacaauacuccugcaggacaaacagagaaaaauuuauugcgucgccugccaagaacuugacucugacguggacaaagauaauccugcccucaaugcccaagcugcccuuucccaggcccgagaacaucagcuggcaagcgccagcgaacugccacucggcagucgacccgccccacagccccccgucccuaggcccgagcauugugaaggagcagcggcuggccugaaagcagcucaaggacccccagcucccgccgugccacccaauacggaugucauggcuuguacucaaacugcccuauugcaaaaguugacaugggcgucugccgaacucggaagcucuaccucucucgaaaccuccauacagcuuuguggccugauaagggccugcgccgaagccuugcgcucccuccagcagcugcaacacuag

SEQ ID NO: 13708 - RNA, 813 nt, Artificial Sequence
  Description of Artificial Sequence: Synthetic coding sequence
augaaacugggauguguacucauggcaugggcccuguaccugagucucggaguuuuauggguggcgcagaugcugcucgccgcuaguuuugagacccuccagugugagggaccgguguguaccgaggaaagcuccugucacacggaagaugauuuaaccgacgcccgagaggcuggcuuccaaguuaaggcguacacuuuuagugaacccuuccaccugauuguaagcuacgaacucuuccccgcaccuauccuuagagccgugcccucugcggaaccacaagcuggaagccccaugacccucucaugccagaccaaguuaccacugcagagaagugccgcacgccuccuuuucagcuucuacaaagauggccguauuguccagucuagaggauugagcucugaguuucagauaccaacagcuucggaggaccauucaggcucauauuggugugaggccgcuacugaagacaaccaaguuuggaaacagucaccacagcucgagauaagaguccagggggccucaagcuccgcggccccuccaacccugaaucccgcaccacagaaaucagcagcuccggggacagccccagaggaagcucccggcccacuuccacccccaccuaccccgucauccgaagacccuggauucuccuccccccucggcaugccagauccacacuuauaccaucaaauggguuuguuauuaaagcacaugcaagacguccgugugcugcucgggcaccuccucauggaauugagggagcuuaguggccacaggaagccuggaaccaccaaagcuacugcugaguag

SEQ ID NO: 13709 - RNA, 2421 nt, Artificial Sequence
  Description of Artificial Sequence: Synthetic coding sequence
augaggcuuagucccgcgccacucaaguuauccagaacucccgcacugcuggcacuggcccucccgcuagccgccgcgcucgccuuuucugacgaaacacuugauaaaguuccuaaauccgagggguacugcucgagaauccugcgagcccaggguacuagacgcgaaggauacacugaauucucguugcggguggaaggugauccagacuuuuacaagcccggcaccucauaucguguaacucuuucugccgcuccuccaucauauuuccgggguuuuacgcugauugcccucagagaaaacagagagggggauaaggaagaggaucaugcaggcacauuccagauaauugacgaagaagaaacucaauucaugagcaacugucccguugcgguuaccgagaguacccccaggcgucgaaccagaauucagguuuuuuggaucgcucccccagcagggacuggaugcguuauuuuaaaggcuagcauuguacagaaacggauuauuuauuuucaggacgagggguccuugacuaaaaaguugugugagcaagacaguacauuugauggcgugacagacaagccaauuuuggacugcuguugcggaacggccaaguaucgacuaacuuuuuaugggaacuggucugagaaaacccaccccaaagauuauccccgcagagccaaccauugguccgccaucauuggcgguucccacucuaagaacuaugugcucugggaguauggcggauaugcaagugaaggagugaaacaggucgccgaauuggggagcccaguuaaaauggaagaagaaauccggcaacaaagcgacgaaguucucaccgugaucaaggccaaggcucaguggccggcauggcaaccacuaaacguuagggcagcaccgagcgcugaguucuccguagacagaacuagacaccucaugagcuuccucacgaugaugggucccagcccagacuggaaugucggacucucugcagaagaccuaugcacgaaagagugcgguuggguccaaaaagugguacaagaccuuauacccugggaugcaggcacagacagcggcgugacuuacgaaagcccuaacaaaccaaccaucccacaggaaaaaaucagaccccugacuucuuuagaccauccgcaaagccccuucuaugacccggaggguggauccaucacacaaguggcccgcguggugauugaacggauugcucgaaagggcgaacaaugcaacauugugccugauaacguugaugauaucguagcagauuuagcaccugaggaaaaggaugaggaugacacacccgagacuuguaucuacuccaacuggagcccaugguccgcauguucaaguaguaccugugauaagggcaaaaggaugagacaaaggauguuaaaggcccagcuagaccucucagucccaugcccagacacacaagacuuccagccauguauggguccuggauguuccgaugaggauggcucuaccugcacaaugagugaguggaucaccuggucucccugcagcaucuccuguggcaugggaaugcgcucaagggaaagauaugugaaacaguuccccgaggauggauccgugugcacauuacccaccgaagagacugaaaagugcacuguuaacgaggagugcucgccaagcucuugcuuaaugacugaauggggagaaugggacgaauguagcgcaacuugcgguauggggaugaagaaaagacauagaaugauaaagaugaacccagcugaugguagcaugugcaaagcugaaacaagucaggcagagaaguguaugaugccagaaugccacacaauucccugccuccuaagcccuuggucagaauggucggauugcucagucaccuguggcaagggaaugcgcacacgccagagaauguugaaaucccuggcugaacugggggacuguaacgaggaucuggaacagguagaaaagugcaugcuacccgagugucccauugauugugaguuaaccgaguggucucaauggucugagugcaauaaaucaugcgggaaaggucacgugauuaggacuagaaugauucaaauggagccacaguucggaggagcaccuugcccagagacagugcagaggaaaaagugcaggauccgaaaauguuuaaggaacccaaguauccagaagcugcgauggcgcgaggcaagagagagccgcagauccgaacaacugaaagaggaaagugaaggggagcaauucccagggugcagaaugaggccuuggacggcauggucugaauguacuaagcuguguggaggaggaauccaggaacgguacaugacugugaagaagcgauuuaaauccagccaguucaccaguugcaaagacaaaaaagaaauucgugcauguaauguucacccgugcuag

SEQ ID NO: 13710 - RNA, 4242 nt, Artificial Sequence
  Description of Artificial Sequence: Synthetic coding sequence
augcgccacggggucgccugggcccuucugguggccgccgcauugggcuugggggcgagagggguucgaggagcugucgcacuagccgacuucuauccuuuuggggcugagagaggcgacgcagugacacccaaacaagacgacggcggcagcggucuccggccacuaucuguacccuucccauucuuuggagcggagcacaguggacuguaugugaauaacaaugggauuauuaguuuucucaaggaaguuagucaguuuaccccuguagcguuuccuaucgcuaaagacagauguguaguggccgccuucugggcggauguggacaaccgaagggcgggcgacgucuacuacagggaagcgacagauccugcaaugcugcgcagagccacggaggauguacggcacuacuuuccagaauuacuagauuuuaaugccacauggguauucguugcuacuugguaucgcgucaccuucuuuggcgggucaucaucaucacccgugaacacauuucaaacagugcuuauuacagaugggaaacugagcuucacaauuuuuaacuacgaaucaaucguguggacuacagguacucaugcuagcuccgggggaaacgcaacuggccugggggggaucgcagcccaagcugguuuuaaugcaggggacggccagcgauacuucucuaucccugguagucggaccgcugacauggccgagguggaaaccacaaccaacgugggggugccuggcaggugggcauuucguaucgaugacgcacaggugcgaguggggggaugcgggcauacuaccucagucugccuggcuuuacguccuugcuuaaacggagggaaguguauagaugacuguguuaccggaaaccccucuuauacgugcagcugcuuaagcgguuucacuggacguagaugucacuuggacgugaacgagugcgccucccagccaugccaaaacgguggcacguguacccacgggaucaauuccuuucguugucagugcccggcaggauuuggaggaccaacgugcgagaccgcccaaaguccaugugauacuaaggaaugccagcacggaggucagugccagguggaaaacggaagcgcuguaugcgucugccaggccggauacacaggagcagccugcgagauggauguagaugacuguucucccgauccuugccuuaacggugguucguguguggaccuuguagggaauuauacauguuugugcgccgagccuuucaaagggcugagaugugagacaggagaucaccccgugccugaugcgugccuuagcgcucccugccauaauggggguacguguguggaugccgaccagggguacguuugcgaaugucccgaagguuucauggguuuggacugcagagagagggugccugaugauugugaaugucggaauggaggccgcugccugggagcgaauacuacccugugccaauguccccugggcuuuuucggguuacugugugaguucgaaaucacagccaugccaugcaacaugaacacccaaugcccagacgggggauacugcauggaacacggggggaguuauuugugcguaugccauaccgaucauaaugccagucauucccucccuucuccuugcgacagcgaccccugcuucaacggcggaaguugcgaugcacacgacgacucauauaccugcgagugcccuagaggauuccacggaaagcauugcgaaaaagcucgcccccaccuguguucuucugguccaugcagaaacggcggaacaugcaaagaagccgggggagaauaucauugcucuuguccuuaccgcuuuacuggaaggcauugcgaaauagguaagccagacaguugugccagcggucccugucauaacggcgguaccugcuuccacuauaucggcaaguauaaaugcgauugcccuccaggguucucuggccggcacugcgaaaucgcgccaucaccguguuucagauccccuugugugaauggaggcacuugugaagaccgagauacugauuuuuucugccacugucaagccggauauauggggcgaagaugccaggcugaaguugauugcggaccaccagaggagguaaagcaugcaacgcuacguuuuaacgguacccgacugggagcaguggcgcuguaugccugugaucgagguuacucccuuagugcacccucaaggaucaggguuugccagccacacggcguguggucagaacccccccaaugcuuagaaaucgacgaauguagaagccaaccaugccuucauggcggcagcugucaggauagaguggccggcuauuugugccuauguucuaccgguuacgaaggagcccacugcgagcucgaacgagacgaauguagagcccaucccuguagaaauggcggaucaugucgcaaucuaccaggagcuuaugugugccgcugcccugcuggguuugucgggguucauugcgagaccgagguugacgcgugugacucgagcccuugccaacaugggggacguugugaaaguggugggggugccuaccugugugugugccccgaaagcuuuuuuggcuaccacugugagaccguaucggacccauguuucucuaguccuugcggcggucgcgguuacugucuggccucuaacggaucccauucuuguacauguaaaguggguuacacuggggaagacugugcuaaagaacucuucccaccaacagcauuaaagauggaacgggucgaggaaucuggggucucuauuucuuggaacccaccuaaugggccagcagcucggcagaugcucgauggcuaugcugugacuuacguuuccagcgauggauccuaccgccgaaccgacuucguagaccgcacacguuccucacaucagcugcaggccuuggcagccggacgcgccuauaauauaaguguuuucuccguaaaaagaaauuccaauaacaagaaugacaucaguagacccgccguucugcucgcccguacccggccacggcccguagaaggguucgaggucacaaacgugacggcuuccacuauuucagugcaaugggcacugcauagaauucggcaugcgacuguuaguggugugagagugaguauuaggcaucccgaggcccuuagggaccaagcaacagauguggacagaucuguggacagguucaccuuucgcgcccuccuccccggcaaaagauauacgauucaacugaccacacuuagcggccuucgcggugaagagcauccuaccgagucacuagccacagcccccacccauguguggacaaggccccuucccccugcgaacuuaacagccgcacgggugaccgcgaccuccgcucauguggucugggacgcucccacaccaggaagcuuauuagaagccuauguuaucaaugucacuaccagccagucaacuaaaucucguuacgucccaaacggaaaacuggcauccuauacaguuagagaccuccugccgggccgacgguaccaacucucuguuaucgccguacagagcacagaacugggcccucagcacucggaacccgcacaucuuuacauuauuacuuccccaagagauggagccgauagaagauggcaucaaggcggucaccaucccagagugcucaagaaucgcccccccccugcacgucugcccgaacugagauugcuuaaugaucacuccgcccccgagacccccacacagccaccaagguuuuccgaacuaguagacgggcgcggaagagucuccgcuagauuuggaggcucuccuagcaaggcagcuaccgucaggucccaaccaaccgcauccgcccaacucgagaacauggaagaggccccaaaacgcgugaguuuggcucugcagcuaccagagcacgggucaaaggacauagggaaugugcccggcaauuguagcgaaaauccuugucagaauggaggaacaugcguccccggagccgacgcccauucaugugacuguggaccaggauuuaaaggacgcaggugcgaacuugcaugcauuaaaguauccagacccugcacacgacuguucagcgagaccaaggcuuucccagugugggaagggggagucugucaccauguauauaaaagaguuuacagaguccaccaggacaucugcuucaaggaauccugcgagucaacgagccugaaaaaaacaccuaacagaaagcagaguaaaagccagacccuugaaaaauccuag

SEQ ID NO: 13711 - RNA, 1008 nt, Artificial Sequence
  Description of Artificial Sequence: Synthetic coding sequence
auguuuuuagcaacucugagcuuuuuacuaccauuugcacaccccuucggaaccgucucaugugaauauaugcugggaagcccucuaaguagccuagcccaagucaauuuguccccauuuucucauccuaagguccauauggauccaaacuauugucaucccuccaccucacuacaccuaugcucgcuggcuugguccuuuaccagacugcuacauccuccccucuccccaggaaucucacagguagugaaagaucacgucaccaagccaacagcuauggcccaagggcgcgucgcccaccugaucgaguggaaaggguggaguaaaccgucagacucacccgcugcucuagagucugccuuuaguaguuauucagauuugucagaaggagagcaggaggcccgcuucgcagcuggaguggccgagcaguucgcaauugccgaggcaaaauuacgggccuggucaagcguagacggagaggauagcacugacgacuccuaugaugaagacuucgcaggugggauggacacagacauggcugggcaguuaccacucggcccacaccuacaagaccuauuuacuggacaccgguuuucucgacccgugcgccaggggaguguagagcccgagucagacuguucccagaccgucuccccagauacacuuugcucuucccucuguagucuugaagauggacuguuaggcuccccugccaggcucgcaucacaacuuuugggugacgaacugcuucuugccaaacuaccacccagccgggaaucugcuuuucgcagccuugguccuuuggaagcccaggacaguuuguacaacuccccuuugacggaaucuugccugagccccgcugaggaagaaccagcaccaugcaaagauugucagccauugugcccaccguuaacagggaguugggaaagacaaagacaagcgagugacuuggcgagcagcggaguggugucccucgaugaagaugaagcagaaccagaagagcaguag

SEQ ID NO: 13712 - RNA, 828 nt, Artificial Sequence
  Description of Artificial Sequence: Synthetic coding sequence
augcagccuccuggcccacgugauccacuuauucggcucugcuuuuuccgagaagaggggacaaaugucguccagaaaaucuguuucagcacacaaaucauuaggcacuucgaaucaaaacuaagcgacacuauugaaguauaucaggagaggauccaguggcuaaccgaaaauuccaagaaggccuuuggccugauaaaaggcgcccggguguccaucuugaucgaugucagugcaaucagcagcggcccucagaaggaggaguuccagaaggauuuaaugucucugauugaugaacagcugucccauaaagagaaguuguucgugcugucuuucggcacaaaugccggaucccuuuggcccgaucccauggaagucucagccucaacauuacaggaguugaagcucugggugaagacacuccaacccgaugguggcucuaaucugcugcaggcucugaaaaagaucuuuacacuaaaaggacuggacucucucguggccauaaugaggaguugccccgaccaaccaucugaaauuuuaagcgacuauauucagcagucaacaauggggagggaccuuaucauacacuuuauaacuuaucgaugugacgaucagaugccacccgccgugcuuaaaaauuuggccgaagcaguacgcggcuacuaucauuguuauagccccaagauggagcauuacacuucgagagacauggaugaacuccuggccgaaauacagaaggcccagucacugcuaucucauguucaagcacuccagcacucaagcccuugcgaggcacucaccuguaccauggaagaaccccggaauuag

SEQ ID NO: 13713 - RNA, 438 nt, Artificial Sequence
  Description of Artificial Sequence: Synthetic coding sequence
augcuuaccagacuuguccucagugcucauuuaagcuccacaaccagcccgccauggacucacgcugccauuucuugggagcuugauaaugugcuuaugcccucuccacgcaucuggccccagguaacaccgaccggacggagcgcuucaguaagauccgaaggcaauacguccucucuuuggaauuucucagccggucaggacguucaugcaauaguaacccguacaugcgaguccgugcuuucgagugccguuuauacccaugguugcggcugugugcgguccgcuaccaauauaacgugucaguccuccggacagcaacgccaggcugcaagacaggaagaagaaaacucuauuuguaaggcacacgacucaagagaaggacgucuuggcuauccacucagcgcccaccagccggguagcggcggccccaauuag

SEQ ID NO: 13714 - RNA, 777 nt, Artificial Sequence
  Description of Artificial Sequence: Synthetic coding sequence
augaccccaccgaaacuacgcgccagucucucuccuucccuccuucugcuuuuaucuggaugucugcuugcggcugcaagaagggagaaaggcgccgcaucuaauguagccgaacccguaccagggcccacugguggaaguucugguagauuccuuucucccgaacagcacgccugcuccuggcagcugcuguugcccgcgcccgaggccgcggccggaucugaacucgccuuacgcugccagucccccgauggagcccggcaccaaugugccuaucgcgggcaccccgaaagaugugcagcauacgccgcacgucgagcacacuucuggaagcagguucugggcggacucagaaaaaaaaggagaccaugccacgaccccgcuccccuccaagcucgcuugugcgcaggaaagaagggacacggagccgagcugcgacuggucccccgagcuagcccccccgccaggccuaccgucgcgggcuucgccggagagucgaaaccacgggcaagaaacagagggagaaccagagaacgcgcuuccgguccugccgcugggacuccaccgccacagagcgcacccccuaaggaaaacccuucagaaagaaagacaaacgaaggcaagcgcaaagcggcacuugugccaaacgaagaacgccccaugggaacaggcccugacccagacggacuggacggaaacgcagaacuuaccgagaccuauugugcagaaaaguggcacucccuguguaacuuuuucgugaauuuuuggaaugguuag

SEQ ID NO: 13715 - RNA, 393 nt, Artificial Sequence
  Description of Artificial Sequence: Synthetic coding sequence
auggcuagacgccacuguuuuucauacuggcuccuaguaugcuggcucgucguuacaguggccgagggccaggaagaagucuuuacuccacccggagauucacagaauaaugccgacgccaccgacugucagauuuucacauugacuccaccucccgcccccagaucccccguuacacgcgcccagccaaucacuaaaacaccacguugccccuuucauuucuucccgcguagaccucggauucacuucagguucccgaauagacccuucguacccucuaggugcaaccauagguuuccuuuccagcccuuuuacuggccgcaccgcuaccugacguaccguuauuucccaagacgaagacugcaacgcgggucuagcucugaagaauccuag

SEQ ID NO: 13716 - RNA, 600 nt, Artificial Sequence
  Description of Artificial Sequence: Synthetic coding sequence
auguaccccgccaccgcaguuccacaaaucaauaucaccauacugaagggagaaaaaggggacagaggcgaccguggacuucaaggcaaguauggcaaaacaggcagcgcaggugcccgcggucacaccggccccaagggacagaagggaagcaugggcgccccaggagaacgaugcaagagucacuacgccgccuucagcgugggccggaagaaaccaaugcacagcaaucacuauuaccagacagucauuuucgauaccgaauucguuaaucuuuaugaucauuucaauauguuuacagggaaauuuuacuguuauguccccggacuguacuuuuuuucacuuaauguacacacauggaaucagaaagagacuuacuugcauaucaugaaaaacgaggaagagguagugaucuuguuugcccagguaggggaucgaucgaucaugcaaagccagagccuuaugcuagaauugagagagcaagaccaaguauggguccggcuguacaagggggagagggagaaugcaaucuuuagcgaagagcuugacaccuacauuacauuuucaggguaccugguaaagcacgcuacugagccguag

SEQ ID NO: 13717 - RNA, 702 nt, Artificial Sequence
  Description of Artificial Sequence: Synthetic coding sequence
auggcauugaaaaacaaguucucaugcuuguggauucuaggauuaugucugguagcuacaacgucuucuaaaauuccuagcauuacagacccucauuuuauugacaauuguauugaagcgcacaaugaguggagaggaaaggugaacccuccugcugcggacaugaaguacaugauuugggacaagggacuagcuaagauggccaaagccugggcuaaccaguguaaguucgaacauaaugacugccuugauaaaagcuauaaauguuaugcagcauuugaguauguaggcgaaaauauauggcuuggcggcauuaaguccuucacuccaaggcacgccauuacagccugguauaacgagacccaguuuuacgacuuugauucccuguccuguuccagaguuuguggccauuacacccaacugguuugggcuaacuccuucuaugugggcugugccguggcaauguguccgaaccugggcggagcuuccacugccaucuucgucuguaacuacggccccgccgguaauuuugcuaauaugccaccguaugugcggggugagucguguuccuuguguucuaaagaagagaaaugugugaaaaaucucugcaaaaauccuuuccuuaaaccuaccggacgagccccucaacagaccgcguuuaacccuuuuagccucggauuucuacuucuuagaauauuuuag

SEQ ID NO: 13718 - RNA, 669 nt, Artificial Sequence
  Description of Artificial Sequence: Synthetic coding sequence
auggcccuccacauccaugaagcauguaucuugcuccuugugauucccggauuggugaccucagcagcuauaagccacgaagauuauccagcagaugagggcgaucagauuucauccaaugacaaucucauuuucgacgacuaucgcggcaaaggcugcgucgacgauuccggcuucguuuauaaacucggcgaacgcuucuuucccggacacuccaacuguccaugcgugugugcccucgauggaccagugugugaccagcccgaauguccaaagauucacccgaaauguaccaagguggaacacaacggcugcugccccgaguguaaggaagugaaaaacuuuugugaguaccauggcaaaaauuauaaaauucuugaggaauuuaagcccucgccaugcgaauggugucgcugcgagccuaguaaugaaguacauugugugguugcugacugugccguucccgagugcguuaauccgguguaugaaccugaacagugcuguccaguuugcaagaauggcccaaauugcuucgcggguacuaccauaauaccugcagggaucgagguuaaggucgaugaaugcaacauuugccauugucacaauggagauugguggaaaccagcgcaaugcagcaagagagaaugccagggaaaacagacaguauag

SEQ ID NO: 13719 - RNA, 957 nt, Artificial Sequence
  Description of Artificial Sequence: Synthetic coding sequence
augcucccgcugacuaugaccgucuugauucuccuuuugcugcccacgggacaagcagccccaaaggacggcgucacacgaccugauagcgaaguacagcaccaguuauuacccaaccccuuccagccuggucaggaacaacugggguuauugcaaucauacuuaaaagggcuugguaggacagaagugcaacucgaacaccugagccgugaacagguccuucuauaucucuucgcacugcacgacuacgaucagucuggccaacuggaugggcuggagcuccugaguaugcugacagcugcucucgccccuggagcggccaacucacccacuacuaauccaguaauacugauaguugauaaaguguuggagacacaagaucugaacggugacggguugaugacccccgcagagcucauaaauuucccaggugucgcauuacgccacguugaaccaggcgaaccacucgccccuucaccucaggaaccucaagccgugggucgacagagccugcuggccaaaagucccuuacgccaggagacacaagaagcgcccgguccccgggaagaggcaaaagggcagguggaagcccgcagggagucccuggaccccguccaggaaccgggaggucaggcagaggcugacggggaugugccggggcccagaggggaggccgagggccaggcugaggcgaaaggcgaugcuccuggcccacgcggggaggcaggagggcaggccgaagcugagggggaugcuccuggcccccgaggagaagccggaggucaggccgaagccgagggggaugcaccuggcccuaggggagaagccggcggacaagcagaagcacgagaaaauggagaagaagcuaaggaacugccaggagagacauuggaguccaaaaacacccagaacgacuuugaaguucacauuguacaaguagaaaacgacgagauuuag

SEQ ID NO: 13720 - RNA, 393 nt, Artificial Sequence
  Description of Artificial Sequence: Synthetic coding sequence
auguuggcaccccuauuucucuguugccuucguaaucuuuuccggaaacugauuucauuucaaccuccucaacugggaaggacuaacaugcacuauagcaagcugccaagaacugccaucgaaaccgaguucaagcaaaauguuggaccgccaccaaaagacuugaccgcagagguguacuucccuuccauaaaguccagaagucaucugccugcaguguucuacaaccaguauuucaaacaucccaaaugcgucggagaguaugguccuaagaauggcgcggagaggcaaaucgaggagagaaaggugcugcccacaacaaugauguuuucaaugcuggccgauuguguguugaaguccacucccaucccaauuuuaggagucgcuauguag

SEQ ID NO: 13721 - RNA, 4362 nt, Artificial Sequence
  Description of Artificial Sequence: Synthetic coding sequence
augaugcuuccccagaacuccuggcacaucgacuuugggagauguuguugccaucaaaauuuauuuagugcaguggucacuuguauauugcuucugaacucaugcuuucuuaucaguagcuuuaacggaacugaccucgaguugagacuggugaacggggaugggccuuguuccggcaccguugaggugaaauuccaggggcaguggggcaccgugugugaugaugguuggaacaccacagcaucuacuguagugugcaagcagcuaggauguccuuucucuuucgcgauguuucgauuuggccaggccguuacucggcacgguaagaucuggcucgacgaugugaguugcuaugggaacgaauccgcccugugggagugucagcaccgcgagugggguagucacaacuguuaccacggagaagacguuggcgugaauuguuauggagaggcgaacuugggacuuaggcugguugauggcaauaauagcugcagcgggagaguagagguaaaguuucaggagcgguggggcacgauuugcgaugacgguuggaauuuaaacaccgcagcgguagugugcaggcagcuugggugcccuuccuccuuuaucuccagcggggugguaaauagcccugcuguccuuagaccgauaugguuagacgacauucugugucagggaaaugagcuggcauuauggaacugcagacacagagguuggggcaaucacgauugcucucauaaugaagauguuacauugacaugcuaugauucauccgaucuagagcucagacuuguggggggcaccaacagaugcaugggacgaguggaacucaaaauccaagggagauggggaacggugugccaucauaaguggaacaaugccgcagcggacgugguuuguaagcagcugggaugugguacugcgcugcauuucgccgggcuaccccaccuucagagcggcagcgaugugguuugguuggacggugugucuuguuccgguaaugaauccuuccugugggauugccgccauuccggcaccgucaauuucgauugucuccaucaaaacgacgugucagucaucugcuccgacggcgccgaccuagagcucagacuagcagaugguucaaauaauuguuccggucgaguugagguacggauccacgagcagugguggacuauuugugaucagaacuggaaaaaugagcaggcuuuagugguaugcaagcaguugggauguccauucaguguguuuggaaguagaagagcuaagcccuccaacgaagcaagggauauuuggaucaauaguaucagcuguaccgguaaugaaagcgcgcucugggacuguaccuacgacggcaaagcaaagcggaccuguuuccgcagaucagacgccggagugauauguagcgacaaagccgaccuggaucucaggcugguaggcgcgcauucaccuuguuaugggcggcuugaggugaaauaucagggcgaguggggcacugugugccaugauaggugguccacaagaaaugccgcggugguuugcaagcagcucggauguggaaagccucugcauguguuuggcaugaccuauuucaaagaagccucuggcccaaucuggcuugaugacgugucuuguaucggaaaugaaagcaauaucugggacugcgaacauagcggcuggggaaaacauaauugugugcaccgcgaagacgugauaguaacaugcucaggcgaugcaaccuggggacucagacugguggggggcaguaaccguugcagcgggagacucgaaguguacuuccagggucgauggggaacugucugugaugacggcuggaacaguaaagcagccgccguaguaugcagccagcuugacugcccgagcagcaucauuggaaugggauugggcaacgccucuacaggguaugggaaaauuuggcuggaugacgugucuugugauggugacgagucagaucugugguccugcaggaacagcggaugggggaacaacgauugcucacacucggaggaugugggcgugauaugcagugaugccagugauauggagcugcgacuuguggguggaaguagccgaugcgcugggaaggucgaagugaaugugcagggugcgguugguauauuaugcgcgaauggcugggggaugaauaucgcugagguaguguguaggcaauuggaauguggcuccgccauaagggucucucgcgaaccacacuucaccgagagaacacuacauauucuaaugagcaauagcggcuguaccgggggagaggcaucgcucugggauuguauuagaugggaauggaaacagacugcuugucaccugaauauggaggcaucccugauuugcucugcacaccggcaaccucggcuggucggcgccgacaugccuuguagugguagaguugaggugaagcaugcagauaccuggcgcucagucugcgauucugacuucucauuacacgcugccaacguucugugcagagagcuuaacuguggcgaugcaaucucccuuagcgugggugaccauuuuggaaaagguaacggucugaccugggcugagaaauuucagugcgaagguucagagacacaccucgcccugugcccaaucguccagcauccagaggacacauguauucauagucgagagguuggagugguuugcaguagguacacugaugugaggcuaguaaaugguaaaucccaaugcgauggacaaguagagaucaacguacugggacacuggggaagccugugugacacccauugggaucccgaggaugcacggguuuugugcagacaacugagcugugggacagcgcugucgaccacgggagguaaauacauuggugaacgaucugugcggguuuggggacaccgguuccacugcuuggguaacgagucuuugcuagauaacugccagaugacgguucuuggagcgccuccauguauccacggcaacacuguuucugugauuuguacgggcagccuaacacagccucucuuucccugucuggcaaacguaucagacccuuaucucucggcagucccugaaggcucagcguugauuugucuugaggauaaaagacuccgccucgucgauggcgauagucggugugccggccggguugaaauuuaucaugauggguucugggggacaaucugugaugacggcugggaucuguccgaugcccauguaguaugccagaagcuggguuguggagucgcauuuaaugccacagucagugcccacuuuggagaagggagcggcccuauuugguuagaugauuugaauuguacgggaauggaaagucaucuguggcaguguccuaguagaggcuggggacagcaugauugccgacauaaggaggaugcaggcguuauuuguagcgaguucacagccuuacggcuguacagcgagacugagaccgaaucaugugcugggcguuuagaagucuuuuacaauggcacauggggguccgugggaagacggaauauuacaacugccauagccgggaucguguguagacaauuagggugcggagagaauggaguggucucucuggcaccgcuguccaagaccggguccggcuucaugugggucgaugacauucagugcccaaaaacacacauuucaauauggcagugucucucagcgccgugggaacgccgcauuucaucuccugccgaagagacguggauuacuugugaagacagaauuagagugcgggggggggauacagagugcucaggcagggucgagaucuggcacgcuggcucaugggggacugucugugacgauucaugggaucuggcugaggcugagguggugugccaacagcuaggauguggcuccgcccuagccgcccuuagggacgccucuuucggucagggaacugguacuaucuggcucgaugauaugcgcuguaaggguaacgagucauuuuuaugggauugccacgccaaacccuggggccagucugauuguggacauaaggaagaugcaggcgugcgaugcagcgggcaaucguuaaagucuuuaaaugcaagcagcggacaucuggcucuuauuuugucuagcauuuuuggacugcugcugcugguccucuuuauucucuuccugacaugguguagagugcagaagcagaagcaccugccccuacgggugagcacacgaagacggggcuccuuagaggagaaccuuuuccacgagauggagaccugcuugaagagagaagacccccacggaacuaggacaucggacgauacgcccaaucauggcugugaagacgcuucugacacgucacugcugggagugcugccugcaagugaagcgacaaaguag

SEQ ID NO: 13722 - RNA, 759 nt, Artificial Sequence
  Description of Artificial Sequence: Synthetic coding sequence
augcugccucccccucgccccgccgcugcacucgcucuucccguucugcuucugcuguuaguggucuugacuccaccgcccacgggugccagaccaucaccaggcccagauuacuuaaggcgagguuggaugcgccucuuagccgagggagaagggugugcuccaugucguccagaggaaugcgccgcuccgcgcggaugccuggcuggccggguuagagaugcuuguggauguugcugggagugugcgaaccucgaaggacagcuuugugaucuugacccgucagcccacuucuauggucauugcggagaacagcucgaaugcagauuggauaccggaggagaccugucacgcggcgaaguucccgagccucugugcgcuugccgaucccaauccccccuaugugggucugacggucacacuuacucccagaucugccgacugcaggaggcugccagagcccgcccggacgcuaauuugacuguugcacacccaggaccuugugaaucaggaccucagauagugucccacccuuacgacaccuggagaggcccccgccuccaaacacuaggcacggaagauacgcugaccaccuuggugggagccgguggaauggcucgagcaguggccuguggagaagccccuggugagcaucuagcucugcagguucugugccuuagcggaaaacgucgacacuuguggcaggucggaucaacugguucaucugaaggcgugcccagcggaggauccuucugguag

SEQ ID NO: 13723 - RNA, 1323 nt, Artificial Sequence
  Description of Artificial Sequence: Synthetic coding sequence
augaaacuugcacuccuccuaccuugggcuugcugcugucuuugugggucugcauuagcuacaggauuccucuaucccuuuucugccgccgcccugcagcagcauggcuaucccgaaccgggcgccgggagccccggcucuggcuaugcaagcagacgucacuggugccaccacaccguaaccagaacggugaguugucagguccaaaacggcuccgaaacaguaguccaacgcguguaucagagcugccgauggcccggaccgugugcuaacuuggugucuuacagaacccuuauccgacccacuuaccgagugucuuaccgcaccguaacaguucuugaauggcguugcugccccggauucacagggucuaauugugaugaggaauguaugaacugcaccaggcugucugacaugucagagcgacuaacgaccuuggaggcuaaggugcucuuacucgaagcagccgaacgucccucuagcccagauaaugacuuaccggcaccagaaucgacucccccuacuuggaacgaggacuuccuuccagacgccaucccacuggcacacccugucccacgccagaggagaccaacaggcccagcuggaccuccggggcagacagguccucccggacccgccgggccgccuggaucaaagggcgaucgcggucagacuggagagaaaggacccgccgggcccccuggacugcugggacccccuggaccccgcgggcucccaggagagaugggucggccuggucccccaggaccgccgggacccgccgggaaucccggaccuaguccuaauucaccacaaggggcccucuacagccugcaacccccuacagacaaagauaacggugacaguagacucgcauccgccaucguugacaccguacuugcuggcguaccaggaccaagaggaccuccaggaccacccggcccccccggcccacgcgguccaccgggcccacccggcacaccugguucgcaggguuuagcuggugaaagaggaacuguggggcccuccggcgagccuggugucaaaggcgaggaaggggagaaagcagcuacugcugaaggggaggggguucaacagcugcgcgaagcacucaaaaucuuagccgaaagggugcuuauccucgaacacaugauuggaauccacgacccuuuggcuagccccgagggcuccggucaagacgcggcuuuacgggcaaaccuaaaaaugaaacgcgggggggcgcagccagacgggguccucgccgcuuugcucggcccagaucccggccagaaaagcguugaccaggcuucuaguagaaaguag

SEQ ID NO: 13724 - RNA, 1341 nt, Artificial Sequence
  Description of Artificial Sequence: Synthetic coding sequence
augcuucauccugaaacaucuccuggacgcgggcaccuacuggcagucuuauuggcccuccugggcacagcaugggcugagguguggccaccucaauugcaggaacaagccccgauggcuggggcauuaaauagaaaagaguccuuuuugcucuugucacuccauaacagauugagaucguggguccagcccccagcugcugauaugagaagguuggauuggucagauucucucgcacaacucgcccaggcccgagcugcccugugcggaauuccuacaccuucccucgcaucgggccuguggagaacucuucagguaggguggaauaugcagcugcuaccagcgggcuuagcuaguuuugucgaagucgugucucucugguucgcugaagggcaacgauacucucacgcagcuggagagugcgccagaaaugccacaugcacucauuauacgcagcucgugugggccacaucaucccaacucggguguggacgccacuugugcagcgcaggacaagcugcuauugaagccuucgucugugccuacucuccucggggcaacugggaagugaacgguaaaacgaucgugccuuauaagaagggggcauggugcucacugugcacugcuuccguuuccggcuguuuuaaagccugggaucacgccggcggacuuugugaaguuccucguaauccaugcaggaugucuugccagaaccacggccgauugaauaucuccacuugccacugccacugucccccuggauauacgggccgcuacugccaggugaggugcucccuccaaugcgugcacggcagauuucgggaagaagaaugcucuugugucugugauauuggauacggcggagcucaaugcgccacuaagguucacuuuccuuuccauaccugugacuuaaggauugacggggacugcuucaugguuucuucagaagccgauacauauuauagagcccgaaugaaaugccagagaaaaggagggguauuagcacagauuaaaagccagaaggugcaggauauccuggccuucuacuuaggcagauuggagacuacaaaugaagugauugauagcgauuucgaaaccagaaauuucuggaucggccuuacauauaaaacagccaaggacagcuucagaugggcgaccggcgaacaccaggccuucacgagcuucgcauuuggucagccagacaaucauggguuuggaaauuguguggagcuacaagcaagcgccgcguuuaauuggaacaaucagagguguaagacccgaaaucgcuacauaugucaguuugcucaggaacauaucucaagauggggaccaggaagcuag

SEQ ID NO: 13725 - RNA, 219 nt, Artificial Sequence; identical to SEQ ID NO: 12086
  Description of Artificial Sequence: Synthetic coding sequence

SEQ ID NO: 13726 - RNA, 2349 nt, Artificial Sequence
  Description of Artificial Sequence: Synthetic coding sequence
cuuuggcuacuccugugggcugccgccuggagguugggugcuagcgcaugcccagcguugugcacaugcacugggaccacggucgauugccacgguacugguuuacaggcuauccccaaaaauaucccaaggaacaccgagagacuugaauuaaauggaaacaauaucaccaggauccauaaaaaugauuuugcuggcuugaagcaguugagggugcugcaacuuauggaaaaucagauuggcgccgucgagaggggagcuuuugaugacaugaaagagcucgagagauugcgauugaaccgaaaucaacuucacaugcucccagaauuacuauuccagaauaaccaagccuugagccgccuagaucuuucugaaaacgccauucaggcgauuccucgcaaggccuuucguggcgcuacagauuuaaagaaccuucagcuugauaaaaaccaaaucuccuguauugaagaaggugcguucagggcccuacgaggguuggagguacucacccuuaauaacaacaauaucacgacuaucccgguuucuagcuucaaucacaugcccaagcugcgcacguuucgccuucauagcaaccacuuguucugcgauugccaucuggcuugguugucacagugguugaggcaacgcccuacaauuggguuguucacucaaugcagcggcccagcuucacuucgaggucuaaauguggcagaagugcagaaaucggaauucaguuguaguggacagggcgaagcaggaagagugccaacaugcacgcugagcucuggcucaugccccgcuauguguacuuguuccaacggaaucguugauugcagaggaaaaggcuugaccgccauucccgcaaaucuucccgagacaaugacagagaucaggcuugaacucaacggcauaaaaucuaucccucccggagcauucagucccuacaggaaacuucgaaggauuugcccccugaguuucugcucgccuugucgugaucucuccaacaaccaaaucgcagaaauugcacccgacgccuuccagggcuuacgcucuuugaauucccugguuuuguauggcaauaagaucaccgaucuuccccgcggagucuucggcggccuauacacacugcaacuccuucugcucaacgcaaauaagauuaacugcauucgaccagaugcuuuucaagaccugcagaaucuuucuuuacugucacuguaugauaacaaaauucaaucccuugcuaagggcacauuuaccagcuuacgcgcaauucaaacccugcaccucgcacagaauccauucauuugugacugcaaucucaagugguuggcugacuuccugcguacgaauccuauugaaacuaguggugcucgcugcgccuccccucggcgacucgccaauaaaagaauaggccagauuaagaguaaaaaguuccgcugcucagcaaaagaacaguacuuuauuccgggaaccgaagacuaccagcugaauagcgagugcaauagugaugucguaugcccgcauaagugucggugcgaagccaaugugguggagugcucuucuuuaaagcucaccaagauuccagaacgcauaccccaguccacagccgagcucagacucaauaacaacgaaaucuccauuuuggaggccaccggaauguuuaagaaauugacgcaccugaagaaaaucaauuugucuaacaacaaaguaucggagauugaagauggagcauucgaaggagccgcuucagucagcgaauuacaccucaccgccaaccaacuggagucgauuagaagcggaauguuucgcggucuggauggccucagaacuuuaaugcuuagaaauaaccgaaucucauguauucacaacgauagcuuuaccggucugagaaacgugagguuauuaucacucuaugacaaucagauaacaacuguuagccccggcgcauucgauacgcugcaaucccucucuacccucaacuugcuggccaauccauucaauugcaauugccaauuagcauggcucggcggaugguuaagaaaacggaagauuguaacagggaacccgaggugucagaauccggacuuucucaggcaaaucccccugcaggacgucgcuuuuccagacuuuagaugugaggagggccaggaagagggugguugcuuaccuaggccacaauguccacaggaaugugcaugucuggacaccguugugcgcugcucuaacaagcaucuuagggcccuuccaaaaggcauaccaaagaacguaacugaguuguauuuagacggcaaucaguucacucugguccccggccagcuuucaacuuucaaauaccuacaacugguguag

SEQ ID NO: 13727 - RNA, 411 nt, Artificial Sequence
  Description of Artificial Sequence: Synthetic coding sequence
augagcaaugucccacacaaaagcucuuugccugaaggcauaagaccaggaaccguccuuaggauuagaggucucgugccgccuaaugcaucccgauuccaugugaaccugcuguguggcgaagagcaagggagugacgccgcccugcacuucaauccccgccucgacaccucugaaguuguuuuuaauucuaaagaacagggaucauggggccgagaggagcgcggcccuggaguaccguuccagcgaggacagccuuuugaagucuugauuaucgcuucggacgaugguuucaaggccguugugggagaugcucaguaucaccacuucagacacagguuacccuuagcucgagugaggcugguagaagucggcggcgacguacaauuggauucgguccggaucuuuuag

SEQ ID NO: 13728 - RNA, 1926 nt, Artificial Sequence
  Description of Artificial Sequence: Synthetic coding sequence
augccuccuccucugccacuccugcuguuaacugugcuggucguagccgcugcucgucccggcugcgaauucgaacgcaacccugcagcaacauguguggacuuacaacuacggacguguuccgacgcugcuuacaaucauacaacuuuuccuaaucugcuucagcauagguccugggagguaguugaagcuagcucugaguauauccuuuugucuguauugcaucaacuuuuggaaggccagugcaacccugaucuacgacugcucggaugugcaguacuggcuccucggugugaggguggcugggugcguaggccuuguagacauaucugcgaggggcucagggagguuugccagccugccuuugacgcaauugacauggcuuggccguauuuccuggacugucaucgcuacuuuacucgugaagaugaagguuguuacgauccuuuagaaaaacugcgcgggggucuugaagcggacgaagcacugcccaguggacugccuccuacauuuauacgauuuucucaccauaguuacgcacagaugguccguguccugcgcagaacagccucaaggugcgcccauguggcccgaaccuauuccaucgggagauccuuugauggacgcgaacuguuagugaucgaauuuucaucccggccuggacaacaugaacugauggaaccagaaguuaaauugaucgguaauauccaugggaacgaagucgccgggcgggagaugcugauauaucuggcacaguauuuaugcuccgaauaccugcucggcaaccccagaauccagcgucugcucaauaccacaagaauccaccuauuacccagcaugaauccagacggguacgaaguugcagcggcagagggggccggauauaaugguuggacaagcggucgacagaacgcccagaaccuggaccugaacagaaacuuucccgaucugacaucugaguauuaucgacuggcagagacccguggagccagaagugaccauaucccaauuccucaacauuacugguggggcaaaguggccccugagaccaaagcaaucaugaaauggaugcagaccauaccuuuuguccuaagcgcuagccuccacggcggugaucuaguagugagcuauccauucgauuucucuaagcauccccaagaagagaaaauguucagccccaccccagacgaaaagauguucaagcugcugucccgagcuuacgcugaugugcauccgaugaugauggaucgaucugaaaauagauguggaggcaacuuccucaagcgcggcaguaucauaaacggagcggauugguauucauucacuggcggaauguccgauuucaacuaccuccauacuaauuguuucgagauaacagucgagcugggcugcgugaaauucccccccgaagaggcacucuauauccuuuggcagcacaacaaagagucacugcugaauuucguugagacagugcauagaggcaucaaaggaguugugacugacaaguuuggaaaaccugugaagaacgcccguaucucaguuaaaggaaucaggcacgacauaacaacagcaccugauggcgauuauuggcgguuguugccaccaggcauacauaucgugaucgcgcaagcuccgggcuaugccaaagucauaaaaaaggucauuaucccagcaaggaugaagagagcuggucgcgucgauuuuauucuccaaccacugggcauggggccuaaaaauuuuauucauggacugcgaagaaccggcccccacgacccacuugggggagcaucaucucugggugaagcgaccgagccugauccccuacgagcccgucgacaaccgagcgcggauggcucaaagcccuggugguggucauacuucacuucuuuauccacccacagaccucguuggcuguugaaauacuag

SEQ ID NO: 13729 - RNA, 1305 nt, Artificial Sequence
  Description of Artificial Sequence: Synthetic coding sequence
auggcgucacucgggcuuuugcugcuguugcugcuuacugcccugccaccuuuauggucgucaucccuacccggacuggauaccgcugaaucgaaagcaaccaucgcagacuugauucugagcgcucuggagcgcgccacagucuuucuggaacagcgacugccugaaaucaaccucgacggaaugguaggaguacgcgugcuggaagagcagcugaaaucugugcgcgagaagugggcucaagaaccacuacuucaaccccuaucucugcgcguugguauguugggagagaaacuagaggccgccauucaacgcagccuccauuaccugaagcuauccgaucccaaguaccuccgcgaauuccagcucacucuucaaccuggauucuggaaauuaccccacgccuggauucauaccgacgcuucguuaguguaccccacuuucggcccucaggacucauuuuccgaagagcgcucggacguuugccuggugcaguuacucggaaccggcacggacucaagugaacccugcggguuguccgaucucugucguagucugaugacuaagcccggcuguuccggcuauugucucucucaccaguuacuuuucuuccuuugggcuagaaugaggggaugcacccagggcccucuccagcagucccaagacuauaucaacuuauucugcgccaauaugauggacuugaacaggagagccgaggcuauuggcuacgcauaccccacccgggauauuuuuauggagaauaauguaacaggccaccccguguuuuacuugccucugugcgacuccuuccuccccccuaaagcagcaccuguuacagaacuguauaccgaugguccuguuauguucugcggaaugggcggcuucuccgacuuuuauaagcugaggugguuagaagcaauccucuccuggcagaaacaacaggagggguguuuuggggaaccagacgcagaagacgaagagcucucuaaagccauacaguaucagcaacauuuuuccagaagaguuaagcgaagggaaaagcaguuuccugacuccaggucagucgcccaagccggagugcaguggcggaacuugggaucucuccagcccuuaccaccugguuucaagcaauucagcuguuuaaucuugcccucaagcugggacuaccgguccgugccacccuaccuagcaaacuuuuauauuuuucuaguugaaaccggguuccaucacguugcgcacgccggacucgaauuacugauuucacgcgacccucccaccucuggaagccagucugucggacuuuag

SEQ ID NO: 13730 - RNA, 555 nt, Artificial Sequence
  Description of Artificial Sequence: Synthetic coding sequence
augaugucauucuuguugggcgcgauccugacucuucuuugggcccccacugcucaagcggagguccuccuacagccagauuuuaaugcagagaaauucuccggguuaugguacguggugagcauggcuucugauuguaggguguuccuggguaaaaaagaucaccuguccaugucaacacgggcuauuagaccgacugaagaagguggccugcaugugcauauggaguuuccaggggccgaugguugcaaucaaguggacgcggaguauuuaaaggugggcagcgaaggccauuuucguguacccgcacuaggcuaccuagacguaaggauuguagauaccgacuacaguagcuucgccguccuguacaucuauaaagagcuggagggcgcccucagcacaaugguccagcuguacucacgcacccaggacguuuccccucaggcccugaaauccuuccaggacuuuuacccuaccuuggggcuaccaaaagauaugauggucaugcugccacagagcgacgccuguaauccagaaucaaaggaagccccuuag

SEQ ID NO: 13731 - RNA, 219 nt, Artificial Sequence; identical to SEQ ID NO: 12092
  Description of Artificial Sequence: Synthetic coding sequence

SEQ ID NO: 13732 - RNA, 2247 nt, Artificial Sequence
  Description of Artificial Sequence: Synthetic coding sequence
augggccgcgccggagccgccgccguuauccccgggcucgccuugcucugggcagucggccuuggaucagcugccccuccuccccggcugagacugaguuuucaggagcuccaggcguggcaugggcugcaaaccuucucuuuggagcggaccuguugcuaucaagcuuuacuuguugaugaagaacgcgggcgccuguucguuggagcggaaaaucacguugccucccugaaccuugauaauauauccaaaagggcaaagaaacucgcuuggcccgcuccaguagaguggcgagaggagugcaacugggcuggaaaggauauugggacugaauguaugaacuucgugaagcugcuccacgcauacaauaggacccaccugcuugccuguggcacgggggcuuuucacccaacaugcgcuuuuguggaaguggggcauagagcugaggaaccagugcugcgacuagauccagggagaauugaggacggaaaaggaaaaucaccguacgacccuagacauagagccgccuccguucuggucggagaggaacuguauagugggguagcugccgaccuuaugggacgagauuucacuauauuuaggaguuuggggcagaggccaagcuuacgcacugagccccaugacagccgcuggcugaacgaaccuaaauuuguaaaaguguuuuggaucccugaaagugagaaccccgacgacgauaagauuuauuuuuuuuucagagaaacagccguggaggcggcucccgcacucgggcgacuaucagugucccgcgucggucaaauaugcagaaacgaugucggcgggcagaggucucuagucaauaaguggacaacauucuugaaagcucgcuuaguuuguuccguuccagggguggagggcgacacacauuuugaucaacugcaggacguguuucuguuaagcagccgagaccacaggacucccuuguuguacgcaguguuuuccacuuccagcucaaucuuccaaggauccgcagucugcguguauuccaugaacgacguuagaagagccuuccugggcccuuucgcacauaaggaaggucccaugcaccaaugggugucuuaccagggccgggucccguacccacggcccggaaugugcccaucaaagacauuuggaaccuuuaguucaaccaaagauuuucccgacgacgucauucaguuugcccggaaucacccccuaauguauaauucugugcugccaacagguggacgaccccuguuucuccaagugggagccaauuacaccuucacucaaaucgcugcagauaggguggccgcugcggacgggcacuacgaugugcuauuuauaggcacagaugugggaacaguccuuaaaguuauuuccguacccaagggaucucggccuucugcagaaggguugcuguuagaagagcuccauguuuucgaagauagcgcggcgguaaccucgaugcagauauccucaaaacgacaucaacuguaugucgcaaguaggucagcuguagcucagaucgcccugcaucgcugcgcagcucacggacgggugugcacggagugcugucuugcacgagaccccuacugugcuugggacggcguggcaugcaccagauuucagcccucugccaagaggcgcuucagaagacaggacguucggaauggcgauccaucgacucuuugcucuggcgacaguucacgccccgcccuguuagaacacaagguguucggcguugagggaucgucagcuuucuuggaaugcgaacccagaucucugcaggcaagaguugaguggacauuucaacgcgcuggcgucacugcccacacacagguacuggcugaggaacggacggaacgcaccgccaggggccuccuguuacgaagacugcgccggagagacucuggaguguaccuuugcgccgccguggagcagggcuucacacaaccccuuaggcgccucagccugcacgugcuuagcgccacccaagccgagagauuggcccgggcugaagaggccgcccccgcugccccuccuggucccaagcugugguauagggauuuucuucaacuagucgagccuggcgggggagguucugcaaacagcuugagaaugugccgaccccaaccagccuugcagucuuuacccuuggagucccgcagaaaggggaggaauagacggacccacgcuccugaaccaagagccgaaagggggccaagaucagcuacacauugguag

SEQ ID NO: 13733 - RNA, 369 nt, Artificial Sequence
  Description of Artificial Sequence: Synthetic coding sequence
auggucuuacugugccuguucuuggccaguuuggcagcaacaccuagagcugguguaacgggagccuggccaacaagcggucuuaguauccucgcacaguugcaaccuuccugcgagcuucgauggacacaacucucucggucuuccuggcgcgaucuggugaugacaacaucccuguggucccuggcuuacuuucagcacuuuucacaagaaaccacuacacaggaacagcuagaugaaauggaagaaauuccccgcgaaagccaguguggccgccaagauuuccacgcacuuaguuguccaaccgcuuccccacgagaucgaguucuguuauguuguccuggcuggagggcaaugguuccuucauag

SEQ ID NO: 13734 - RNA, 570 nt, Artificial Sequence
  Description of Artificial Sequence: Synthetic coding sequence
auguugcugggacaacuuuccacuuuacuguguuuacuauccggagcucuaccgacaggcaguggccgaccggaaccccagucgccacggccccaaagcugggccgccgcuaaucagaccugggcacucggaccuggcgcccucccaccacugguaccggccuccgcccuugggagcuggaaggcuuuccugggccugcaaaaagcuagacaacugggaaugggcagacuccagagagggcaggaugaagucgcggccgugacacuaccccucaacccgcaagaggugauucagggaaugugcaaggccguccccuucguccaggucuuuucccgcccagguuguucagccauacgguugcgaaaucaucugugcuucgggcauuguaguucccucuacauuccaggauccgauccuaccccauugguguuaugcaauaguugcaugccggcucggaagcggugggcccccguugugcuguggugucucacagguucuuccgcgaguagacgaagaguuaagauuuccaccaugcuuauugagggaugucauuguagucccaaagcuuag

SEQ ID NO: 13735 - RNA, 2505 nt, Artificial Sequence
  Description of Artificial Sequence: Synthetic coding sequence
augaagcacacacuggcccugcuggcaccucuccugggucugggacuuggucucgcacugucacagcuugccgccggcgcaaccgauugcaaauuucucgggcccgccgagcauuuaacuuuuaccccagcugcucgcgcuagauggcuggcuccacgagugcgcgcccccggauugcucgauagcuuguaugggacagucaggcgguuucuaucgguuguucaacuuaacccauuccccucagagcuuguuaaagcuuugcugaaugaacucgccuccguuaaggucaaugagguugugagauacgaggccgguuaugucgugugugccgugauagcgggccuauaucuccuccucgugccaacugcuggacucugcuucugcugcugucgcugucaucgccguuguggugggagggucaagacggagcacaaagcccuggccugcgagcgugccgcacuuaugguuuuucucuugcucacgacgcugcuucuacugauugguguggucugugcauuugugacuaaccaaaggacgcacgaacagauggguccguccaucgaagcuaugccugaaacguuguuaagucucuggggucuggucagcgacguuccacaagaauugcaggcuguagcacagcaguuuagucuaccucaagagcaagugucagaagaacuggauggcgucggagucucuauuggcagugccauacacacacaauugcgaucaagcgucuacccucuucuugcugccgugggcucucuaggccagguucuccagguuucuguacaccaucuccaaaccuugaaugcaacaguggucgaacuccaggccggacagcaggaucucgagcccgcgauuagggagcauagggaucgauuacuggagcugcugcaggaggcacgaugucaaggagacugcgcaggagcccugagcugggcaaggacccuggagcugggugcagauuucucccagguccccagugucgaucacgugcuccaucagcugaagggcguaccagaggcuaauuucuccagcaugguacaagaggagaauaguaccuuuaaugcccuaccagcccuugcggcaaugcagacaaguaguguuguucaggaacucaaaaaggcaguugcacagcagccugaaggcgugcggacucucgccgaaggcuuccccggccucgaagcagcuucacgcugggcucaagcauugcaggaaguggaggaaaguagucggccauaccuccaagaaguacagagguacgaaacuuacagguggaucgugggauguguuuugugcuccgucguauuguuuguuguccuaugcaaucuccugggucuaaaucuggggaucuggggccucagcgcucgcgaugauccaucucacccagaggccaaaggugaagccggggcucgauuuuugauggcaggggucggauuaucauuccuuuucgccgcaccauuaauacuguuagucuucgcuacguuccugguuggaggcaaugugcaaacccucgugugucaguccugggaaaauggugagcuuuucgaauuugcagauacaccaggaaaccugccccccucuaugaaucugagccaacuguugggccugcggaagaacaucuccauccaccaggcauaucagcaaugcaaggaaggugcugcacuuuggacugugcuacagcugaaugauucauaugauuuggaggagcaucuugacauuaaccaguauaccaacaagcucagacaggagcuucaaucauugaaaguagacacccagucuuuggaucuguuguccagcgcagcuagacgggacuuagaagcauugcaauccagcggucugcagcggauccauuauccagacuuucucgugcagauucagcggcccguggucaagacuucuauggaacaacucgcccaggaacuccagggccuagcccaggcucaggauaacucagugcucggucagcggcuucaagaggaggcccagggacugagaaauuugcaccaagaaaaggucguaccucagcagagucuggucgccaaguugaacuuaucugugagagcauuagaguccagugccccuaauuugcagcucgaaaccucagacgucuuagccaacguuaccuaccugaagggcgagcugccagcuugggcugcccgaauccuucguaauguguccgagugcuuucuggcucgggaaauggguuauuucucucaguaugucgccugggugcgggaagaagugacacaacggauugcgacuugccaaccucugaguggggcucucgacaauaguagaguuauacuaugugacaugauggcggacccguggaacgccuuuugguuuugccuggcuugguguacuuucuucuugauucccucuaucaucuuugcugugaaaaccucaaaauacuuuagaccuaucagaaagcgccugaguuccacauccagugaagaaacgcaguuguuccauaucccucgagucaccucucucaaacuauag

SEQ ID NO: 13736 - RNA, 2505 nt, Artificial Sequence
  Description of Artificial Sequence: Synthetic coding sequence
augaaacauacgcuggcccugcuagcacccuugcugggccugggacuaggucucgcuuugucacaacucgccgcaggcgccacagacuguaaauuucucgguccugcugagcaucucacauuuaccccagccgcccgugccagauggcuggccccucgcgucagagcgcccgggcuucuggacucccucuauggaaccguccgucguuuucuaagcguuguucaacugaauccauuuccuucggaguuggugaaagcccugcugaacgaacuggccucugugaaaguuaaugaggucgucagauacgaggcaggcuacguggugugcgccgucauugccggauuauacuuauuguuaguaccgacugccgggcucuguuuuugcugcugcaggugccauagaagguguggugggcgaguuaagaccgagcacaaagcccuugcuugcgagcgcgcagcccugaugguguuucugcugcugacaacccuccugcuucucauuggcgugguaugcgcuuucguuacaaaucagagaacacaugagcagaugggcccuaguauagaagcuaugccagagacucuucuuucccucuggggacuggucagcgaugugccucaggaacuccaggccguggcccagcaguucucauuaccccaggaacagguauccgaagagcucgauggggucggggugagcaucgguucagcaauucacacacaacucagguccuccgucuauccuuuacucgccgcagucgggucccuaggacagguccugcaggugagcguccaccaccuccagacccugaaugcuaccgucguugaguugcaggccggccagcaggaucuugagccagcaauccgugaacacagagaucgccugcuagaguuguuacaggaggcucguugucagggagacugugcuggugcgcuguccugggcacggacguuggaguuaggggccgacuuuagccagguaccaaguguugaccacguccuccaucagcugaaaggcguuccugaagccaauuucucauccaugguccaagaagagaacagcacauucaacgcccuaccugcucuagcagcuaugcagacaaguucugugguacaggagcucaaaaaggccgucgcccaacagccagagggugugcgaacacuggcggaaggauuccccggacuggaggcugcaucucgcugggcccaggcgcuacaggagguggaagaauccucuagaccuuacuugcaggagguccaacgcuaugaaaccuaucguuggauagucgggugcguucugugcaguguuguacucuucguggugcuaugcaauuugcuggguuugaauuugggaaucuggggacucucggcucgcgacgacccaucacacccugaggcuaaaggcgaggcgggggcgagauuucugauggcaggugucggcuugucguuccuguucgcagccccacugauauugcugguguucgcaacauuucugguugguggcaauguucaaacccuugucugucagucuugggaaaauggcgaguuauucgaguucgcugacacuccaggaaaucuuccaccgagcaugaaucugucucagcuucucggccuucgcaagaauauuaguauccaucaggccuaccaacaauguaaggaaggcgccgccuuauggaccguccugcagcucaacgauuccuacgaucuggaggagcaucucgauaucaaccaauauaccaacaaacuuagacaggagcuucaaucucugaagguugauacccagucucuggaccugcuuuccucugcggcgaggagggaucucgaagcuuugcaguccucaggauuacaaagaauccauuauccugacuuucugguacagauccagagaccaguaguuaagaccaguauggagcaauuagcgcaagagcugcagggucucgcucaggcucaggacaauucagucuugggacagaggcuucaagaagaagcucaaggucugcguaaccuccaucaggaaaaaguaguaccacaacaaucccuaguagccaaacuuaaccuaucaguacgggcucuggaaagcucagcaccuaaucugcaacuggaaaccuccgauguccuggccaaugugacauaucugaaaggagaacucccagcaugggcggcuaggauccugcgcaacguuucugagugcuuucuugcacgcgaaaugggauauuucagucaauacguagccuggguccgcgaagaagucacccagagaauugcuaccugccagccucuguccggugcucuagacaauagcagaguuauccuuugcgauaugauggcugauccguggaaugcuuucugguucugccuggccugguguacuuuuuuuuuaaucccauccaucauauucgcaguuaaaacgagcaaauacuuccgcccaauuagaaaacgucucuccagcaccucuagcgaggaaacccaauuguuucauauaccaagggucacaagcuuaaaacucuag

SEQ ID NO: 13737 - RNA, 216 nt, Artificial Sequence; identical to SEQ ID NO: 12098
  Description of Artificial Sequence: Synthetic coding sequence

SEQ ID NO: 13738 - RNA, 1377 nt, Artificial Sequence
  Description of Artificial Sequence: Synthetic coding sequence
auggaggcaacgggaacagacgagguggacaaacugaaaacuaaguuuauuagcgcauggaacaauaugaaauacucgugggugcucaaaacaaaaacuuauuuuagcagaaauucucccguacuuuuguugggaaaguguuaccacuucaaguaugaggacgaagauaagacucugccggcagaaucuggaugcaccaucgaagaucacgucauugcagguaacguugaagaguuucgcaaggacuuuauaagccgaaucuggcugacauacagagaggaguuuccccagaucgagggcucugcucugacaacggauugcggguggggauguacauugcgaacuggccagaugcuguuagcucaaggucuuauccuccauuucuugggucgugcuuggacuuggccagacgccuugaacauugagaauagcgauagcgagucauggacaucacacacagucaaaaaguuuacugccucauuugaagccucucuuaguggcgaacgugaauuuaaaaccccuaccauaucccugaaggagacaauuggaaaauauucugacgaccacgagaugagaaaugaggucuaccaccgcaagauaauaucaugguucggagauaguccauuagcuuuguucggacugcaccaacucauugaguaugguaaaaaaagcgguaagaaagcgggagacugguauggacccgcugugguagcucauauacucagaaaggcaguggaagaggcacgucaccccgaccugcagggaauuacuaucuacguugcucaggauuguacaguguauaauagugauguuaucgauaaacagagugcaagcaugacaagugacaacgccgacgauaaagccguuaucauacucgucccggugcgccuugggggagagaggacaaacaccgauuaccuggaauuuguaaaagggauucugagcuuagaauacugugugggaaucaucggcggcaaaccuaaacagucauauuauuuugccggcuuccaagacgauagccuuauuuacauggacccccauuauugccaauccuuuguggacgucucaaucaaagacuuuccccuggagacuuuccacugucccuccccuaagaaaaugagcuuucggaaaauggauccguccugcacaauuggcuucuacugucggaacgugcaagauuuuaaacgcgcaucugaagagaucaccaaaaugcucaaguucucaucuaaggagaaauacccccucuucacauuuguaaaugggcauagccgagacuacgauuucaccucgacuacuacuaacgaagaggaccuguucagcgaggacgaaaagaaacaacucaaacgguuuagcacagaggaguucguguuauuauag

SEQ ID NO: 13739 - RNA, 342 nt, Artificial Sequence
  Description of Artificial Sequence: Synthetic coding sequence
augcgucaacgacuccucccuaguguuacaucucugcuacugguggcguugcuguuuccaggaucuucacaggcgagacacgucaaucauucugcgacugaagcuuugggagagcugcgggagagggcaccuggccagggaaccaacggcuuccagcugcugaggcacgccgugaagcgcgaucugcugccaccacgaacaccgccuuaucaggaacccgcauccgaucugaaaguaguagacugucgccggucugaaggauucugccaagaguacugcaacuacauggaaacucaggucgguuauugcuccaagaaaaaagaugcauguugucuacacuag

SEQ ID NO: 13740 - RNA, 258 nt, Artificial Sequence; identical to SEQ ID NO: 12101
  Description of Artificial Sequence: Synthetic coding sequence

SEQ ID NO: 13741 - RNA, 264 nt, Artificial Sequence; identical to SEQ ID NO: 12102
  Description of Artificial Sequence: Synthetic coding sequence

SEQ ID NO: 13742 - RNA, 945 nt, Artificial Sequence
  Description of Artificial Sequence: Synthetic coding sequence
auguccuccgaagccgagacacagcaaccuccagccgccccaccugccgccccugccuugucagcagccgauaccaagccggguacaacaggcgcucaaggggcuguggccagggcacacauaggaggagcagggggagacaagaagguaaucgcuacaaagguccugggcacaguuaagugguuuaacgugcguaaugguuacggcuucauaaauagaaaugauacaaaagaggacguuuucguucaccaaacagcaauuaaaaagaauaauccgagaaaauaccuuagaucagugggugauggcgagacaguagaguucgacgugguugaaggcgagaagggcgccgaagcugccaacgugacaggaccgggaggcguccccgugcaaggaucuaaauaugcagccgaccggaaucauuacagacgcuacccaaggagacgaggaccaccaagaaacuaucagcaaaacuaccaaaacucagaguccggcgagaaaaacgaggguagugagucugcuccagaacggccaaauaacgccgggccccaagccaaagugccaacccuccuccaugcggaguaugggcgacgcccucaguacucgaacccacccgugcagggagaggucauggaaggagccgauaaccaaggugcuggcgaacaggguaggccagucaggcaauguauaggugacaucgaucaugacucugcaggggcauugcuugcccgacaaccaagagaagauggaaaugaagaagacaaagagaaucagggugacgaaacacagggccagcaaccaccccaacggagguacaggcgaaauuucaauuaucgcagacgcaggccagaaaauccaaagccgcaagacggaaaggagaccaaggcagcugauccacccgccgagaauuccagugcccccgaagcagaacaaggcggagccgaguag

SEQ ID NO: 13743 - RNA, 636 nt, Artificial Sequence
  Description of Artificial Sequence: Synthetic coding sequence
augguauuccucaaguuuuuuugcaugucuuuuuucugucacuugugucagggcuauuucgacggaccccucuauccagaaaugaguaacgggacauuacaucacuauuuugugccugacggcgacuacgaagagaaugaugauccggagaaaugucagcuucuuuuucguguuucugaccaucggcgcuguucucagggcgagggcagucaaguggggagucuuuugagucugacuuugcgagaggaguuuacuguuuugggucgccagguagaggaugcuggaaggguguuggaaggaauaagcaaaucaauuagcuacgaccucgacggggaggaguccuacggaaaguacuuaaggagagagagucaucagauuggugaugcuuacucuaacucugauaaaagccuuacugaacuggagucgaaguuuaaacaggggcaggaacaggauucacgccaggaaagcagacugaacgaagauuuucugggaaugcuaguccauacacggucauuacuuaaggagacccuagacaucagcguuggccugcgggauaaguaugagcuucuggcccucacuauuaggucccacggcacuagguuggggaggcugaaaaaugacuaucugaaaguguag

SEQ ID NO: 13744 - RNA, 1566 nt, Artificial Sequence
  Description of Artificial Sequence: Synthetic coding sequence
auguugugcgcacugcuccuccuucccuccuuacucggcgcuacccgcgcaagcccaacauccggaccccaagagugugcaaaagguucuacaguuuggugucaggaucuacaaaccgccgcucgcugcggugccgucggauacugccagggagcgguauggaauaaaccuaccgcaaagucacuuccaugcgaugugugucaggacauugcagccgcugcugguaacgguuuaaaccccgacgcaacugaaagcgacauccuggcauugguaaugaagacaugugaauggcugcccucccaggaaagcagcgcuggcugcaaauggaugguugacgcccacucuagcgcuauccucuccaugcucagaggcgcaccagauucagccccugcccaaguuugcacagcacugucccucugcgaaccccuccagagacaucucgccacccuacgcccccugucaaaagaagacacguucgaagccguagccccuuuuauggccaacggaccauugaccuuccauccucggcaagcuccagagggcgcccugugccaagacugugugcggcaggugagcagauugcaggaagcaguccgaucuaaucugacccuggccgaccucaauauccaggaacagugcgaaucccuaggacccggucucgcaguccucuguaaaaauuacuuauuccaguucuuuguacccgcugaccaggcucuaagacuacugccuccgcaggaauuauguaggaaaggggguuucugcgaggaacucggagcuccggcucggcucacacaaguuguagcuauggacgggguuccgucacuggaacuaggccuuccgcgaaaacagucagagaugcagaugaaagccggagugacuugugaaguguguaugaaugugguacaaaagcucgaucacuggcucaugucuaauaguucugaacucaugauuacacacgcucuggaacgagugugcuccguaaugccagcuuccauaaccaaagaguguauaauccugguagauacuuauagcccaucccugguucaacucguugcaaagaucacacccgagaaggucugcaaauucaucagauuaugcggcaacaggaggagggcuagggcagugcacgaugccuaugcaauugugccaucaccagagugggacgccgagaaucagggcuccuucugcaauggguguaaaagacugcugaccgucuccucgcacaauuuggaaucgaagucuacaaaaagagauauacucguugccuucaagggagguugcagcauucuaccccucccauacaugauccagugcaaacacuuugugacacaguaugagcccguacuuauagaaucccuuaaggauaugauggaccccgucgcgguguguaaaaaagugggcgccugucacgggccaagaacaccucuccucgguaccgaccagugcgcacucggcccaucauucuggugccgcucucaggaagccgccaaacucuguaacgccguccagcacugccaaaaacauguuuggaaggaaaugcaccuucaugccggggaacacgcuuag

SEQ ID NO: 13745 - RNA, 2127 nt, Artificial Sequence
  Description of Artificial Sequence: Synthetic coding sequence
auggcugcugcugcagucgccgcugccgccgcagcagcagccgcugccucgcuucaaguacuugaaauggagucaauggagacagccgccgcgggcucugcgggacuggcagcugaagugagaggaaguggaacaguugauuucgggccagguccaggcaucuccgccauggaggcuagcgguggcgaccccggaccugaagcugaagauuuugaaugcucaucucacuguagcgaacugucauggagacaaaaugaacagagacggcagggccuguucugcgauauuacacugugcuuuggcggugcaggaggucgagaguuccgcgcucauagauccguucucgcagccgcaaccgaauacuucacuccgcuccucagcggacaguucagugagucuagaucaggcaggguggaaaugagaaaauggagcucugagccuggccccgagcccgacacagucgaagccgucauugaauauauguauacagggcgcauuagggucagcacagguucuguucaugaggugcuugaguuagccgaucgguuucuccucauccguuugaaagaguuuuguggcgaguuccugaaaaaaaaacugcaucugucuaacugcguagccauacauagccucgcacacauguauacccugucucagcuugcauugaaggccgccgacaugauccgacgcaacuuccacaagguaauccaagacgaggaguuuuacacacucccauuucaucuaauccgugacugguuauccgauuuggagauuaccguugauagugaggaaguccuauuugaaacagugcuaaagugggugcagagaaacgcagaggagagggaacgguauuucgaggaacucuuuaagcugcuccgcuugucccaaaugaagcccaccuaccugacccgacauguuaagccagaaagacuaguggcuaauaacgagguaugcgugaagcugguggcagacgcaguugagcgucacgccuuaagagcugaaaacauccagagcggcaccugccagcaccccacuucacaugucucacugcucccucgauacggacagaauauggacgugauuaugguaauuggugguguuuccgagggcggggauuaucucuccgaaugcguagguuauuuuguagacgaagauaggugggugaaucugccacacauccauaaucaccuggacggacaugccguagcugugaccgagagcuaugucuacguggcagggucaauggaaccuggcuuugcgaaaacagucgaaagauauaacccaaaccuaaauaccugggaacauguguguucacugaugacucggaaacauuccuuugggcucacagaagucaaaggaaaacuguacucuauuggcggccacgguaauuucucuccuggcuuuaaggacgugacuguauauaauccugaacuugacaaauggcacaacuuggaaagcgcaccuaaaauccuucgcgaugugaaagcucuagcaaucgaagacagguucgucuauauugcagcuaggaccccagucgauagggauaccgaggauggacugaaagcagucauuacuuguuaugauacagaaacucgccaauggcaggacguggaaucacugccccucaucgacaacuacuguuuuuuucagaugucaguugucaacucuaacuuuuaucaaacagcaucauguugcccgaaguccuauugccuagagaaugaagaggccgugcguaaaauugcuucgcaaguguccgacgagauauuggagagccucccuccagaaguguuaaguauagagggggcagcgauuugcuacuacaaagaugauguauucauuauaggugguuggaagaacucugacgauaucgacaaacaguauaggaaggaagcuuauagguacugcgcagagcggaaaagauggaugcuccucccucccaugccccagccgcgcugcagagccacagccugccacgugagaauuccauaucguuaccugcacggaacccagcguuauccaaugccucaaaacuugauguggcagaaagaccggauucgacagaugcaagaaauucaccggcaugcuuuaaacaugagacgugugcccucaucucaaaucgaauguuag

SEQ ID NO: 13746 - RNA, 1578 nt, Artificial Sequence
  Description of Artificial Sequence: Synthetic coding sequence
augaguggaaacuggguucacccggggcagauccucaucugggccauuuggguacuggcagccccaacaaagggcccuucagcugaaggaccccaacguaauacgaggcugggguggauucaaggcaagcagguaaccguccugggcaguccuguaccugucaauguuuuucuaggggucccguuugcagcccccccccugggauccuugcgcuucaccaacccacagccggccucuccuugggacaaucuccgagaagcuaccucauauccaaaucuauguuuacagaauuccgaguggcugcuccuggaccaacacaugcugaaaguucacuauccuaaauucggagucucggaggacugccuguaucuuaauaucuaugcaccagcgcacgcugauacgggguccaagcugcccguucucgucugguucccuggcggagccuucaaaacaggaucagcaucaauuuucgauggcuccgcccucgcagcuuacgaagaugugcucguugucgugguucaauacagacuugguauuuucggguuuuuuaccaccugggaucagcacgcacccggcaauugggcuuuuaaagaccagguugcggcauuaaguugggugcaaaagaacauagaauuuuucgguggcgacccuaguucugugacuauuuuuggggaauccgccggagcuauuucugucuccucacuaaucuuaucccccauggcgaagggauuguuccauaaagcuaucauggagaguggcguggccauaauuccuuauuuagaagcucacgauuacgaaaaauccgaagaucugcaagugguggcccacuuuugcgguaauaaugcuagugauuccgaagcuuuacugaggugccugaggaccaagccaucuaaagagcuguugacacuuucccaaaagacaaaguccuuuacacgggucguugauggagcauucuuccccaacgaaccacucgaccugcuaagccaaaaagcguuuaaagcaauaccuagcaucaucggugugaacaaucaugagugcggauucuugcuacccaugaaagaagcuccagagaucuugaguggcucuaacaaaucccuugcucugcaucugauucaaaacauacugcacauacccccucaguaucuccaccugguugccaacgaauauuuccacgauaaacauagucugaccgagaucagagacucauugcuggacuuacuaggcgacguguucuuuguugugccagcccucauaaccgccagauaucacagagaaggagcgaccgaggaggagaaguugcugucccggaaaaugaugaaauauugggcuacuuuugcgaggaccggcaacccaaacgguaacgauuuaagucuuuggccagccuauaaccuuaccgaacaguacuuacagcucgaccucaauaugucauuaggucagaggcuuaaggaaccacgcguggauuuuuggacuucgaccauucccuugaucuugagugcaagugauaugcuacacuccccacuuaguucucucaccuuccucucucuucugcaaccuuucuucuucuucugcgcuccauag

SEQ ID NO: 13747 - RNA, 900 nt, Artificial Sequence
  Description of Artificial Sequence: Synthetic coding sequence
augguuaggugccugggccccgcucuccuuuuacugcuucuccuuggaucagccucuuccgucggaggcaacagaugcguggaugcggccgaggcuuguaccgccgacgcccgcugucaaagacucagaucagaguacgucgcccagugucugggccgugcagcccaggggggaugcccuagagcucguugcagacgagccuugagacgauucuuugccagaggcccgccagcucugacccaugcccuguuguuuugucccugcgcuggcccagccugugccgaaagacgccggcagaccuuugucccuucaugugccuuuucaggaccagggccggcuccaccuuccugccuugaaccccugaauuucugcgaacgaucgaggguauguagaugugcucgcgcagcugcuggacccuggcgaggguggggcaggggacuuaguccugcucaccgcccccccgccgcacaagcgaguccuccagggcuuuccggacugguccauccgucagcucaacgcccaagacgccuuccggcaggacccgggagaccccuuccugcacgacugcgugggccacgaggcguacccgcaggaaccgccgucacacccaacuauguggauaaugugucugcgagggucgcccccuggugcgauugcggugcgucaggcaaccggagagaagauugcgaagccuuccgcggcuuauuuaccaggaacagauguuuagauggcgcaauacaagcuuucgcuucgggauggcccccaguguuacucgaucagcuaaacccucagggggaccccgaacacucacuucugcaggugucuagcaccggccgcgcccuugagaggcggagccuucuuuccauccuuccuguacuugcacuuccugcccuucuuuag

SEQ ID NO: 13748 - RNA, 270 nt, Artificial Sequence; identical to SEQ ID NO: 12109
  Description of Artificial Sequence: Synthetic coding sequence

SEQ ID NO: 13749 - RNA, 663 nt, Artificial Sequence
  Description of Artificial Sequence: Synthetic coding sequence
auggcaucugaacggcugccuaaccgaccggcuugucuccugguagcauccggcgccgccgaaggcguuagcgcacaaucuuuccuacacugcuucaccauggccagcacagccuuuaaccuucagguugcuaccccuggcgggaaagcuauggaguucguggaugucacagaauccaacgcuagaugggugcaggauuuucgacucaaggccuacgccaguccggcuaaacuugaaucaauugacggagcccgauaccacgcauugcucauucccucuuguccuggugcccuaaccgauuuagcaucuucuggcucacucgcacguauauugcagcauuuccauucggagucaaaaccgauuugcgcaguuggccauggagucgcugccuuguguugugcgaccaaugaggauaggucauggguguucgacuccuacucuuuaacuggcccuucugugugugagcucgugcgggcccccgguuuugcccgacucccccugguuguggaggacuucgugaaggauagcggugccuguuuuagcgccagugaacccgacgcagugcaugugguucuagaucggcauuuggugaccggucagaaugccuccuccaccgugccagccguucaaaaccuccuuuuucucuguggaaguagaaaauag

SEQ ID NO: 13750 - RNA, 1158 nt, Artificial Sequence
  Description of Artificial Sequence: Synthetic coding sequence
auguggggguuccgcuuacugagauccccuccucuccuacuacuguugccucaguuaggaauuggcaaugcauccuccugcagccaggcgcguacaaugaauccaggcggaaguggaggagcucgguguucgcuuuccgcugaaguacggcgcagacagugccugcagcuaucgaccgugcccggcgcagacccacagcgaucaaaugaacugcuccugcuagcugcugcuggcgaagggcuagaaaggcaagaucuuccuggugauccugcaaaggaagagccccaaccuccuccucagcaucaugugcucuauuuccccggggauguccagaauuaccacgaaaucaugacacgccacccagaaaacuaccagugggaaaacugguccuuagaaaaugucgcaaccauccucgcucaucgguucccaaauuccuauauaugggucaucaagugcucccgaaugcaucuacacaaauucuccuguuaugauaacuuugugaaguccaacauguuuggagcaccugaacacaacacugauuuuggcgcuuucaagcaccucuacaugcugcucguuaacgcauucaaccuuucccaaaacucucugagcaaaaagagccucaacguguggaauaaagauucgauagcauccaacugucgcaguucaccuucucacaccaccaacggcugucagggagaaaaagugagaacaugcgaaaaaucugacgaaucagccaugucauuuuaccccccaagucuaaaugaugcuucauucacccucaucggauucaguaaggguugugucguccugaaccagcuccuguucgaguuaaaagaagcuaagaaagacaagaacauagacgccuucaucaaaucuauccguaccauguacuggcuggacgguggucauucaggugguagcaauacaugggugacauaccccgagguacugaaggaguucgcccaaaccggcaucaucguccacacucaugucacucccuaccagguaagagacccuaugcgaucuuggauugggaaagaacauaagaaguucgugcaaauuuugggcgaucucggcaugcagguaacaucucagauccacuuuaccaaagaggcuccaaguauagagaaccauuuucgcguccaugaaguauucuag

SEQ ID NO: 13751 - RNA, 936 nt, Artificial Sequence
  Description of Artificial Sequence: Synthetic coding sequence
augcgaggcgccgcucgcgccgcuuggggcagagcaggacaaccuuggcccaggcccccagcuccaggaccccccccgccaccucugccccuccugcugcugcugcuugccgguuugcuggggggagccggugcacaguacucuagcgaucguuguaguuggaagggaaguggccugacucacgaggcccacaggaaggaaguugagcagguauacuugcguugcgccgcaggcgcuguugaguggauguaucccaccggagcguugauugugaaccugcgaccgaauacuuuuuccccugcuagacaccugaccgugugcauuagaagcuucaccgacagcagcggagcaaauauuuaccuugaaaagacuggcgaacuuagacugcugguccccgauggugaugggcgcccaggccgagugcaauguuuugggcuggagcaaggugguuuguucguggaggccacaccgcaacaagauauuggucgcagaaccaccggguuucaguacgaacugguuagaagacauagagccucugauuuacacgagcucuccgcuccaugcagacccugcucagauacagaaguuuuacuugccguuugcacuagcgacuucgcuguccggggcucaauucagcaagucacccacgaaccagaacgacaggauuccgcaauucaccucagagugucuagacuauaccgccaaaaaucucgcguguuugaaccaguccccgaaggcgacgggcacuggcaaggccgugugaggacacugcuagaguguggggucaggcccggccauggagauuuucuuuuuaccgggcauaugcauuuuggggaagcuagacuuggcugcgccccucgcuucaaggauuuucagcgcauguauagagaugcccaggagagaggauugaacccgugugaaguuggaacagauuag

SEQ ID NO: 13752 - RNA, 1221 nt, Artificial Sequence
  Description of Artificial Sequence: Synthetic coding sequence
augggaccuagcacaccacuccugaucuuauuccuccugaguuggucuggaccauugcagggccagcaacaucaucugguggaguacauggagaggaggcucgcggcacuagaggaaaggcuugcucaaugucaggaucaauccaguagacaugcagccgaguuaagagauuuuaagaacaagaugcuuccacuucuugaggucgcugagaaagaaagggaggcccuacgaaccgaggcggauaccauaagugggcggguggaccgacuggagcgagagguggauuaccuugagacacagaauccugcccugccuugcguugaguucgaugagaaagugacaggagguccagggacaaagggaaaagggcgccgaaacgaaaaauaugacaugguaacugauugcgguuacacuaucucccaaguccgcucaaugaagauccugaaacgauucggggggcccgccggacuauggaccaaagauccgcugggacagacggagaagauauauguuuuagauggcacacaaaacgauaccgcuuuuguuuuccccagacuccgcgacuucacccuggcgauggcugcacggaaagcuuccaggguccggguccccuuuccguggguggguacaggacaacuuguguacgggggauuucuguauuucgcuaggcggccaccaggaagaccaggaggcgggggagagauggaaaauacucugcaacuuauaaaguuccacuuggccaaucggacagugguggacucaucgguauuucccgcagagggccugaucccaccauacggccugaccgccgauacauacauagaucuggcagccgaugaagaaggauuaugggcuguauacgcaacuagagaagacgacagacaucuaugucucgcgaaacuggacccacagacacuggauacugagcagcagugggacacuccauguccgagagaaaaugcugaggcugcauucgugauauguggcacguuauacguuguguauaauacucgcccugccagucgcgcuagaauucagugcucauuugacgccagcggaacccucaccccugaacgcgcugcccugccauacuucccaaggagauauggcgcucacgccucacuccgauauaauccucgcgagcgccaacucuaugccugggaugacggcuaucagaucguauauaaacucgaaaugcgcaagaaagaggaagagguuuag

SEQ ID NO: 13753 - RNA, 900 nt, Artificial Sequence
  Description of Artificial Sequence: Synthetic coding sequence
augggaggcccacgagcucugcuggcagcucuuugggcucuggaggcagcgggcacggcagcccucaggauaggcgccuucaacauucaguccuucggggacagcaaaguuagcgacccugcguguggcagcaucaucgcaaagaucuuggcaggauaugaucuagcucuagugcaggaagugagagacccugaccucagcgcuguuuccgcccuuauggaacaaauuaauucaguuagugaacaugaguacucguucgucagcagccagccuuuaggacgugaucaauauaaggagauguauuuauuuguguacaggaaagacgccgucagugugguugauacguaccuguaccccgaucccgaagauguauuuucccgagagccauucgugguaaaguuuucagccccuggaacuggagagagagcuccaccucugccgucacgucgcgcccuaacacccccaccccuuccugccgcugcucagaaccuugugcuuauaccucugcacgccgcgccacaccaggcgguagccgaaaucgacgcacuguaugacguguacuuagauguaauagacaaauggggaaccgaugauaugcucuuucucggagacuuuaaugccgauugcucuuacgugcgugcucaagauugggcugccauacgucugcgaaguucggaaguguuuaaguggcugaucccugauagcgcggacacuacaguugggaacucugauugcgccuaugauagaauuguggccugcggagcaaggcugagacggagccugaagccucaguccgccacaguccacgacuuccaagaggaguucggccucgaucaaacccaggcccuggcaaucucugaccacuuccccguagaagugacccugaaauuucacagauag

SEQ ID NO: 13754 - RNA, 1617 nt, Artificial Sequence
  Description of Artificial Sequence: Synthetic coding sequence
augggcugucuauggggccuugcacucccgcucuuuuuuuucugcugggagguuggcgugagcgguaguagugccgggccaucaacccguagagcugauacagccaugacaacugaugacacagaagugccagccaugacucuugccccagggcacgcagcacucgagacccaaacccugucagccgagacaaguucccgagccuccacgccugcuggcccuauaccugaagccgagacucgaggagcaaagcgcauuucgccugccagagaaacuaggucauucacuaaaaccucgccaaacuucauggugcucaucgcuacaucaguagagacaagugccgcuucugguucccccgaaggggcaggcaugacgaccguucaaacuauuaccgggucugacccaagggaagccauuuucgauacucugugcaccgacgauuccagcgaggaagcuaagaccuuaacaauggacauacucacucuugcccauacuucuacugaggcuaagggccugucuucugaaagcucagccagcuccgacucaccucaucccguaauaacgcccagcagagcuucugaauccucagcuucaucagaugguccacauccgguuauaacuccaaguagagccucugaaucuucagccagcucugacgggccacauccugucauuacacccaguuggagcccuggcuccgauguuacccuccucgcugaagcucucguuaccguuaccaacauugaagugauuaauugcagcauaacugagaucgaaacuacaacuucuucaauaccaggcgcaucugacaccgacuugauccccaccgagggaguuaaggcuaguucgacuagugauccuccagccuugcccgacagcacagaagcuaagccccauauuacagaagugacugcuuccgccgagacucucaguaccgccgggacuacagaaucagccgcuccagacgccaccgugggaacaccccucccaacaaacuccgcuaccgaaagagagguuacagcuccuggagccaccacccuuucuggagcacuaguaacagucucuagaaauccucuugaggagaccagugccuuaagugucgaaaccccaaguuacguuaaaguguccggggccgcaccagugucaauugaagcaggaucagccgucgguaagacaacaucauucgccggguccagugccuccucuuacucacccuccgaagcagcccugaaaaacuuuacaccuuccgaaacaccuacaauggacaucgcuacgaaaggucccuuuccaacaucacgggauccccuaccuucuguaccccccacgacaacgaacucuucucgggguaccaauucaacucuggccaagauuacuacuuccgccaagacaaccaugaaaccccccaccgcuacccccaccaccgccagaacacgcccuaccacugaugugucugccggagaaaauggaggauuucugcugcuccgcuuguccgucgcaucgcccgaagaccuaaccgauccaaggguggcagaacguuuaaugcagcaauuacaccgagaacuucacgcacacgccccucacuuucaagugagcuugcuucguguacgccgcgguuag

SEQ ID NO: 13755 - RNA, 975 nt, Artificial Sequence
  Description of Artificial Sequence: Synthetic coding sequence
augucuagcgaggccgagacucaacagccacccgccgcuccacccgccgcucccgcacuguccgcugcagacacaaagccagggacgaccggauccggagcugguucuggggggccaggaggauuaaccucagccgcaccagcuggaggcgacaagaaagugaucgccacaaaagugcucggaacugugaagugguucaacguacggaacggguauggguuuauaaaccggaacgauacaaaagaagacguguucgugcaccaaacugcaaucaagaaaaauaacccaaggaaauaccuccgaucagugggugacggagaaacaguugaguucgaugucguggaaggcgaaaagggggcagaagcagccaauguuaccgggccugguggagugccaguucagggcaguaaauaugcggcugaucggaaccacuacagacgguauccucgacgcagagggccgccacggaacuaucagcagaauuaccagaacucagaaagcggagagaaaaacgaggggagcgaaucagccccagaaggacaagcccagcaacgcagacccuacagacggcggcgcuuuccaccuuauuauaugcggagaccuuauggacggagaccacaauauucgaauccuccuguccagggcgaggugauggaaggcgcggauaaucagggugcuggugaacaaggaagaccugugagacaaaauauguauagaggcuauagaccacguuuucgcagaggcccucccaggcagcgccagcccagggaggaugggaaugaggaagacaaagaaaaucagggggaugaaacucaaggccagcagccaccccagagacgcuaucgccgcaauuucaacuacagacggagacgcccagagaaucccaaaccccaggauggcaaagaaacaaaagcggccgaucccccagcagagaacucuagugcgccagaggcagagcaaggaggagcugaauag

SEQ ID NO: 13756 - RNA, 210 nt, Artificial Sequence; identical to SEQ ID NO: 12117
  Description of Artificial Sequence: Synthetic coding sequence

SEQ ID NO: 13757 - RNA, 342 nt, Artificial Sequence
  Description of Artificial Sequence: Synthetic coding sequence
augaaguugcuaacaacaauauguagacugaaacuugagaagauguacucuaagacaaacacuagcucaacgaucuuugaaaaggcacggcauggaaccgaaaaaauuagcacagcuagaagcgagggacaccauauuaccuuuucgcgguggaaauccuguacugcaauuggaggccgcuguaaaaaccaaugcgaugauucugaauuccgcauuagcuauugcgcccggccuacaacucauugcuguguaacggagugugauccaaccgacccuaacaacuggauccccaaagacaguguaggaacacaggaaugguaucccaaagauucaaggcacuag

SEQ ID NO: 13758 - RNA, 3030 nt, Artificial Sequence
  Description of Artificial Sequence: Synthetic coding sequence
auggaucugauuaggggaguguuacugagacugcugcuucuagcaaguucccuggguccaggggcugucucucuuagagcugcgauucguaaaccggguaaaguuggacccccacucgacauaaaacuuggugcucugaacuguaccgccuuuagcauucaguggaaaaugcccagacacccaggcucccccauccucggauacacuguguuuuauagcgaagucggcgcugacaaauccuuacaggagcaacuccacagcguucccuuaagucgcgacauccccacgacggaggaggugaucggggaucucaaaccaggaaccgaauauagaguaucaaucgccgcauacucccaggcaggcaagggucggcugucuucuccacgucaugugaccacucuaucccaggauuccugucuuccaccugcagccccacagcaaccacaugucauuguggugucugacagcgaaguugcacuguccuggaagccaggggcaucugaaggauccgcacccauucaguauuauucaguggaguucauccguccugauuucgacaaaaaauggacuucaauacacgaacgcauccaaauggauaguauggugauuaaagggcuggauccagauaccaauuaccaguucgcaguccgagcaaugaauucucauggcccuuccccacggagcuggcccagugauauaauccgaacgcuuuguccagaagaggcuggcaguggaagguacggaccuagauauaucaccgacaugggagcaggggaagacgacgaaggauuugaagaugaccucgauuuagacauuucauucgaagaagugaaaccacuacccgccacgaaagggggaaauaaaaaguuuuugguggaguccaagaagaugaguauaagcaacccaaaaaccauaagccggcuuauuccuccgaccuccgcaucuuuaccuguaacuaccguggccccucaaccaauccccauccaacguaagggcaaaaauggcguggcaauaaugucucgccuuuucgauaugccaugugacgaaacucuuugcuccgccgauagcuuuugcguuaaugauuauacguggggcggaucucgcugucagugcacacuggggaaagggggugaaucauguucagaggacaucgugauacaguauccacaguuuuucggacacuccuacgucaccuucgaaccucuaaagaauucuuaccaggcauuucaaaucacucucgaguuucgggccgaagccgaggacgggcugcugcuguauugcggggaaaaugagcauggccggggcgauuucaugucucuagccaucauacggcggaguuuacaauucagauucaacugugguacgggugucgccaucauugucagcgagacaaaaaucaaguugggugguuggcauacugucaugcuuuacagggauggacuuaauggucuuuuacaacucaauaauggaaccccagugacgggccagucccagggacaguauucgaagauaacauuccgaaccccucuguacuugggaggggcuccgucagcuuacuggcuagugagagcgacagguaccaacaggggguuucaaggcugcguucaguccuuggcagugaauggccggaggauagacaugaggccauggccucucggaaaggcgcugaguggagccgaugugggagaauguucaucaggaauuugugacgaggcuucuuguauccacggcggaacauguacggcaauaaaggcugacagcuacauaugucuauguccacugggcuucaagggcaggcauugcgaagaugcuuucacccucacuauuccucaguuucgugaaucacugcgcagcuaugcugccacucccuggccuuuggaaccacaacacuaccugucuuucauggaauucgaaaucaccuuucggccugauuccggugacggcgugcuauuauacucauaugauaccggaucuaaagacuucuugaguaucaaucuugcuggaggacaugucgaauuccgcuucgauugcggcucaggcacugggguguuaaggagcgaagacccucugacacugggcaacuggcaugagcuacgcgugucucggaccgcaaaaaacgguauccugcaagucgacaagcagaaaaucguugaaggcauggcggagggaggcuucacacaaaucaagugcaauacagauauauuuauaggcggagugcccaauuacgacgaugucaagaaaaacaguggcguccugaaaccauucucagggucaauccaaaagaucaucuuaaacgaccguaccauacaugugaaacacgauuuuacuucaggagugaauguugaaaaugccgcucauccaugcgugcgugcgcccugugcccaugggggaucuugucggccucgcaaggaaggauaugacugcgauugcccucugggauucgagggccugcacugccagaaggcgaucauagaagcuauugagauuccccaguuuauuggucguucuuaucuuacauaugauaaucccgacauccugaaacgcguuuccgggucuagaucuaacguguuuaugagguuuaaaaccacugcaaaggauggucuauuacuguggagaggggauucaccuaugagaccaaauagugauuuuauuucucugggacuccgugacggcgcuuuaguuuuuagcuauaaucucgguucgggcguugcaucuaucauggugaacggauccuuuaaugacggcagguggcacagagugaaggcugugcgcgauggacaguccggcaagauuaccgucgaugacuauggagccagaacgggaaaaucaccuggaaugaugaggcagcucaauaucaauggcgcauuguacguaggcggaaugaaggaaauugcacuccauacuaaucgccaguauaugcggggacugguggguugcaucucccacuuuacucuuucaacagauuaccauauaucgcuuguggaggacgcgguggacggcaaaaacaucaauacuugcggcgcuaaauag

SEQ ID NO: 13759 - RNA, 1272 nt, Artificial Sequence
  Description of Artificial Sequence: Synthetic coding sequence
augagcgugagaggcauccugagacugggaacucaagaauacccuagcccccuggaucccgaaguaggaccauacugcgacacaccaacaaugcggacccucuuuaaccugcucuggcuugcccucgccugcucgccggugcacacuacacuuagcaagagcgacgcaaaaaaagccgcuuccaaaacccugcuggaaaaaagucaauuuucagacaaaccugugcaggaucgcgggcuggucgucacugaccucaaagccgaaagcguaguccuugaacacagaucauauuguuccgcaaaggcacgggaucggcacuucgcaggcgauguccuggguuacgugacuccauggaauucccacgguuacgacguuacaaaaguuuuuggcuccaaauucacccaaauuagcccgguaugguugcagcucaaaaggcgcgguagggagauguuugaagugacaggcuuacaugaugucgaccagggcuggaugagagcuguaaggaagcacgcgaaagggcuacacauugucccgagacugcucuuugaggacuggacuuacgacgacuuucgaaacguguuggacagugaggaugaaaucgaagagcucucgaagacggucgugcaggucgcaaaaaaucaacauuucgacggcuucguaguggagguguggaaucagcugcugagccagaagagagugggacugauacauaugcuuacacaccucgccgaagccuugcaccaggcccgauugcuggcccugcucgugauacccccagcuauaacaccaggcacagaccaacucggaauguuuacacauaaagaguucgaacagcuagcaccuguucucgaugguuuuucacuaaugaccuaugacuacagcacugcacaucagccggguccuaacgccccucuuucauggguacgagcuugcguacagguacuagacccuaagagcaaauggagauccaaaauuuuacugggauuaaauuuuuacggcauggacuacgcuacaagcaaagacgcgcgggaacccguggugggcgcccgauacauucagacacucaaggaucaucgaccgcggauggucugggauucccaggcaucggaacacuucuucgaguacaaaaaaagcagaucugggagacacgugguguucuaccccacacucaaaagucugcaagucagauuagaauuggcucgcgaguuggguguuggugugagcauuugggaauuaggacagggguuggacuacuuuuacgaucuucucuag

SEQ ID NO: 13760 - RNA, 1182 nt, Artificial Sequence
  Description of Artificial Sequence: Synthetic coding sequence
augcgaacucucuuuaaucugcuuuggcuagcccuugcuuguagucccgugcacacaacgcuguccaaaucugaugcgaagaaagcggcaucuaagacccucuuagaaaagagccaguucucugacaaaccagugcaagauagaggacuaguggugaccgaccuuaaggcugaaucuguuguccuggagcaccggucauacuguagugcuaaggcacgagauagacacuuugcuggugacguucucggcuaugugacccccuggaacucacacgguuacgaugugaccaaaguuuucgggagcaaguuuacucagauuucuccgguuugguugcagcugaaacggcggggcagggaaauguuugaggugacaggacuccaugauguagaccaaggguggaugagggcgguucgcaaacaugcgaagggccugcauauugucccaagacuccuguucgaagacuggaccuacgaugauuuucggaaugugcucgauagugaagaugaaauugaagaacucucuaaaacaguggugcagguggcuaagaaccagcauuuugauggguucguuguggagguguggaaccaauuauugucucagaagagagugggguuaauccacaugcucacccaucucgcugaggcacuccaccaagcccgcuugcuugcuuugcuaguuauaccccccgcaaucaccccuggaaccgaccagcucggcauguucacccacaaagaauucgagcagcuggcaccuguccuggauggcuucucucugaugacuuacgacuacuccaccgcccaucagcccggucccaacgcaccccuguccuggguaagagcguguguccaggugcuggaucccaaaucaaaauggagaucaaaaaucuuguuaggguuaaacuuuuaugguauggauuacgccacaucuaaggacgccagagaacccguuguuggcgcacgauauauacagaccuugaaagaccaucgcccacgcauggucugggauagucaggcuagugaacauuucuucgaguacaaaaagucuaggagcgguagacaugugguuuucuaucccacucuuaaaaguuuacagguucgacuugaauuagcuagggaacugggagugggaguauccauuugggaguuaggacagggacucgacuauuuuuacgaccuucuauag

SEQ ID NO: 13761 - RNA, 1959 nt, Artificial Sequence
  Description of Artificial Sequence: Synthetic coding sequence
auggcaagcguggcaugggccguccugaaaguccucuuacugcuuccgacccagacauggucacccgugggagccggcaauccucccgacugugacgcaccccucgcuucagcccuaccacgcagcucguuuaguaguucaucugaacucuccaguagccacggcccgggauucucacgacucaauagacgggacggcgccgggggcuggacaccccuuguuaguaacaaauaccaguggcuccagaucgaucuuggcgagcguauggaggugaccgccguugccacccagggcggguacgguucaucagauugggugacuucuuaccuccuaauguucagcgauggcggucggaauuggaagcaguauagacgcgaggagucuauauggggauuuccaggaaauacuaacgccgauucugugguucauuaccgucugcagccccccuuugaggcccgcuuucuuagauuccuuccacuugcauggaauccacgaggucggaucggaaugcgaaucgaaguguacggaugcgcguacaagagugaagucguguauuuugacggccaaagugcccuguuguacagacuugauaaaaagccccugaaacccauaagagauguuaucagccucaaauucaaagcuaugcaaaguaacgguauccugcugcaucgcgaaggacagcauggaaaucacauaacacucgaacuaauuaaggguaaacuggucuucuuucuuaauaguggaaacgcaaaacuaccguccacuauugcccccgugacccuaacucucggaucccugcucgaugaccagcacuggcacucuguucucaucgagcuacucgacacucaggugaacuucacuguugauaaacacacucaucauuuucaggccaagggagauuccaguuaucucgaccuuaacuuugagaucucuuuuggcggaauaccuacuccggggcgcucuagagcauuucgcagaaaguccuuucauggcugccucgagaaucuguacuauaacggcgucgaugugacagaacuugccaagaaacauaaaccucagauauugaugauggggaacguuuccuuuucaugcccccagccccaaaccgugccaguaaccuuuuugucuucgagaagcuaucucgcccucccagggaacaguggugaggacaaaguuagugugaccuuucaguucaggaccuggaauagagcgggucaucugcuguucggcgagcugaggcgcggaagcgggagcuucguguuguuucugaaggacgguaagcucaagcugagucuuuuccaaccuggacaauccccucgcaauguuaccgcuggagccggcuugaaugacgggcaguggcacuccgugucuuuuucagcuaaauggagccacaugaacgugguuguugaugacgauaccgccguccagccacuagucgcggucuuaaucgauucaggcgauaccuacuauuuuggugcccucuacgaacaaucaugugaagcacauaaacaucgagggaacccgucagggcuguauuauaucgacgcagacgggagcggcccccucggcccguuccugguuuauuguaacaugacagaugccgcguggacuguugugcagcacggaggcccggacgcagugacauugaggggagcuccuaguggucauccuaggucggccgugaguuuugcauacgcagccggugcugggcaauugcggucagccguuaaucuugcugagaggugugagcagagacucgcccugagaugcggaacugcaagacggccagauuccagggacggcacuccgcugaguuggugggugggcagaacaaacgaaacgcauacaagcuggggugggagcuugccugacgcacagaaguguacuuguggacuggaggggaauuguauagacagucaguauuauuguaauugcgaugccggaagaaaugagugguag

SEQ ID NO: 13762 - RNA, 1455 nt, Artificial Sequence
  Description of Artificial Sequence: Synthetic coding sequence
augugguaugucuccaccagagguguagcaccucgagugaauuuugagggcgcuuuauuuucaggcuacgcucccgacggagggcuguucaugcccgaggaauuaccgcagcuggacagaggaaccuugugucaguggagcacucuuaguuauccgggccuagugaaagaacugugugcccuguucaucgguuccgagcugcuaccaaaagacgagcugaacgauuugauugaucgcgcuuucucccgcuuccgccaccgcgaaguagugcaccuuagucgacugcgcaauggacucaacgugcuggagcucuggcacggaguuaccuaugccuuuaaagaucucucccugucauguacaacccaguuucugcaauacuuuuuagaaaagcgagagaaacauguuaccguagucgugggaaccagcggggauaccggaucagcagccaucgagucagugcaaggagcaaagaauauggauauuaucguccugcugccuaagggccacuguacuaaaauucaggaacuccagaugacaaccguccuuaaacagaacguccaugucuuuggggucgagggaaauuccgaugaacuagacgagcccaucaagaccguguuugccgaugucgcauuuguuaaaaaacacaaccucauguccuuaaauucuaucaacuggagccggguuuuggugcaaauggcacaccauuuuuucgcuuauuuucaguguacgccuucucucgauacacacccccucccccucguugaagucguggugccaaccggagccgccgggaaccuugcugcgggauauauugcucagaagaucggacuccccauccguuuggucguugccguuaaccguaaugacaucauacauagaacagugcagcagggcgauuuuucccugucugaagcugucaagucuacacuagcauccgccauggacauucaaguccccuacaacauggaacggguguuuuggcuuuuguccgggagcgauucccaagucacccgcgcucuuauggaacaguucgagcguacccagucaguuaauuugcccaaggagcuccauucuaagcuaucugaggccguaaccuccgugucuguauccgacgaggccauaacccaaaccaugggucgcugcugggaugagaaccaguacuugcuauguccacauucugccguggccgugaacuaccauuaucaacagaucgacagacaacagcccuccaccccccgauguugccuggccccagccuccgccgcaaaauuccccgaagcaguacuggccgccggccugacccccgaaacgcccgcagaaauaguggcucuggaacacaaagaaacucgauguacgcugaugaggaggggcgauaauuggaugcuaaugcuccgagacacgauugaggaccugagccgucaguggaggucacaugcuuugaauaccagccaguag

SEQ ID NO: 13763 - RNA, 264 nt, Artificial Sequence; identical to SEQ ID NO: 12124
  Description of Artificial Sequence: Synthetic coding sequence

SEQ ID NO: 13764 - RNA, 453 nt, Artificial Sequence
  Description of Artificial Sequence: Synthetic coding sequence
augagauucauggccggccccgcugguucacagucuuugggaccacuuugcuuccacucaucaccucaagcccuguacaccguccuguugauuguucucguuaugaugucccugguguuuggaaaauuuguacccgucaacugggagcccccucagccacuuccuuuccccaaguaccucagaugcuacagaugucuccuugagaccaaggagcucgggugccuucucgggagcgacaucugccugaccccagccggcucuucauguauuacccuucacaagaaaaauaguagcgguagugauguaauggugucugauuguaggaguaaagaacagaugucagacugcucaaacacacgcacaucuccaguaucuggauuuuggauuuuuucacaguacuguuuucucgacuuuuguaacgacccucagaauagaggacuauacaccccauag

SEQ ID NO: 13765 - RNA, 873 nt, Artificial Sequence
  Description of Artificial Sequence: Synthetic coding sequence
augucugugaggcgcggaagacggccugcgaggccaggaacucgcuugucuuggcugcugugcugcuccgcacuacugagcccugcugcuggcuacgugaucgugucuucaguaucaugggccguuaccaaugaaguggaugaagagcucgacagcgccucuacggaagaagcaaugccugcucuauuagaggauuccggaaguauauggcaacaaucuuuuccugcuuccgcucauaaggaagaugcccaccugcguccaagagccggagcugcuagagcaagaccacccccugcaccccccggcauguuuagcuaucggagagaagguggacagacugcaagugcucccccgggaccuagacugcgcgccgcaaccgcccgcucacuugcucaugcaucgguguggggcugccucgccacaguaagcacccauaaaaagauacagggccugcccuucggcaacugccuuccagucucugacggcccuuucaauaauuccacagguaucccauuuuuuuauaugaccgcaaaagacccggugguggcugaucuaaugaagaacccaauggcuucucucaugcugccagaaucagagggcgaguucugccgcaagaauaucgucgacccagaggacccccgcugcgugcaguugacgcugacaggccagaugauagcugugucacccgaagaaguggaauuugccaagcaagccauguuuuccaggcacccaggaaugagaaaguggcccagacaauacgagugguuuuuuaugaagaugaggaucgaacauauauggcugcagaagugguaugggggagccuccucaaucucucgcgaggaguauuucaaagcagugccccgaaaagcauag

SEQ ID NO: 13766 - RNA, 2742 nt, Artificial Sequence
  Description of Artificial Sequence: Synthetic coding sequence
augggucccgaagcauugagcucccugcucuuacucuugcuuguggcaucuggagacgccgauaugaagggccauuucgaucccgccaagugucgcuaugcccuaggaaugcaagaucgaacaauccccgauucagauaucuccgccucgucauccugguccgauuccaccgcugccagacacucccggcucgagucaagugacggcgauggcgcauggugcccugcgggcucaguuuucccuaaggaggaagaauacuugcaaguggaccuacaaagacuacaucugguugcucucgugggaacucagggacggcaugcugggggucugggaaaggaauucucacgcucuuacaggcugagguacaguagagauggcagacgauggaugggcuggaaagacagguggggacaagaaguaaucucugggaaugaagauccugaaggugugguguuaaaggaccuggggccaccaaugguugcucgacuugugagauuuuauccccgggcugaccggguaaugagcguuugucucagaguggaacuuuauggaugccucuggcgcgacggccuucugucuuacacugcccccgugggccagaccauguaucuuagugaggccguuuaccugaaugauucaacuuacgacggacacaccguugggggacuccaguaugggggacugggccagcuggcagauggugucgucggauuagacgacuucaggaagagucaggaacuucgaguuuggcccggauaugacuacguuggauggucaaaccacaguuucucaagugguuacguggaaauggaauuugaguucgauagacugcgcgccuuucaagccaugcaaguccacugcaacaauaugcacacacugggugcucgccugcccggaggagucgaaugccgauuucgcaggggaccagccauggcuugggaaggcgagccaaugagacauaacuuagggggaaaucugggagacccucgggcccgcgccgugagugugccccuuggcggaagaguagcucguuuccuacaguguagauuucuguucgcuggcccgugguugcuuuuuagcgaaauuucuuucaucucggauguggugaacaacaguagccccgcacuuggugguacauuccccccugcuccgugguggccuccaggaccuccaccuacuaauuuuaguucacuagagcuugaaccacggggacaacaaccaguagccaaggcugagggcuccccaacagccauucugauagggugucuggucgcaauaauacugcuccugcuuuugauaaucgccuugaugcuguggcggcugcacuggcggcgccuccugagcaaagcagaaagacgcguccucgaggaggaacuuaccgugcaccuuaguguuccaggagacacgauucugauuaacaauagaccaggcccucgugagccuccuccauaucaagaaccuaggcccaggggcaauccaccucacuccgcgccaugugugcccaacgggagugcuuugcuauugucuaaccccgccuaccgccuuuugcuggccaccuacgcacgacccccacgagggccugggccuccaaccccggcuugggcuaaaccaacaaacacccaggcuuacuccggcgacuacauggaacccgagaaacccggcgccccccuacuccccccaccuccucagaauucugugccucauuaugcugaagccgauauugucacacugcaaggcguaacaggaggcaacaccuacgcagugcccgcacugccacccggcgcaguaggcgaugggccuccccggguugacuuuccucggucaaggcuaagauucaaagagaaacucggcgagggccaauuuggggaagugcaucucugcgaagucgacucaccacaggaccucguuucccucgacuuucccuugaauguuagaaagggacacccauugcugguugcagucaagauccuacggcccgacgcgacaaagaaugcccguaacgauuuuuugaaggagguuaaaauuaugucaagauuaaaggauccuaacauuaucaggcuacugggugugugcguucaggacgauccccuaugcaugaucacagauuauauggaaaauggugaccugaaucaguuuuuguccgcccaccagcuugaggauaaagcagcagagggcgccccaggagacggccaggccgcccagggcccaacgauuucauacccuaugcuccugcacgucgcagcccagaucgcuucagggaugagauaccuggcuacucucaacuucguacaccgcgaccucgccacuagaaauugucuuguuggugaaaacuuuacaauaaaaauugcugacuuugggaugaguagaaaccuguaugccggcgauuauuaccgcguucaagguagagcugugcugccgaucagauggauggccugggagugcauuuugaugggaaaguuuacaaccgcuucagacguuugggccuucgggguuacacugugggaggucuuaauguugugucgcgcucaaccuuucggacaguugacagacgagcaagucaucgagaacgcuggugaauuuuucagagaccagggccgucaggucuacuuaucccgacccccagcuuguccacaaggccuguaugagcucaugcugcgaugcuggucacgcgaauccgagcagcgcccccccuucagucaguugcaccgauuucucgcagaggacgcacuaaacacaguauag

SEQ ID NO: 13767 - RNA, 243 nt, Artificial Sequence; identical to SEQ ID NO: 12128
  Description of Artificial Sequence: Synthetic coding sequence

SEQ ID NO: 13768 - RNA, 270 nt, Artificial Sequence; identical to SEQ ID NO: 12129
  Description of Artificial Sequence: Synthetic coding sequence

SEQ ID NO: 13769 - RNA, 264 nt, Artificial Sequence; identical to SEQ ID NO: 12130
  Description of Artificial Sequence: Synthetic coding sequence

SEQ ID NO: 13770 - RNA, 285 nt, Artificial Sequence; identical to SEQ ID NO: 12131
  Description of Artificial Sequence: Synthetic coding sequence

SEQ ID NO: 13771 - RNA, 327 nt, Artificial Sequence
  Description of Artificial Sequence: Synthetic coding sequence
augagacagcgacuucugcccucagugaccucucugcuccucguggcucugcuguuccccggaagcagucaggcacgucaugugaaccacagugcuacagaagccuuaggagaacugcgugagcgcgcacccggccaaggcacuaacggguuucagcuucucagacacgccguaaaaagagaccucuugccuccccgaacaccccccuaucaaggagaugugcccuugggcauucggaacacaauuugucggaugcagcaggguauuuguaggcuuuucuuuugccacaguggcacaggccagcaacauagacagcgaugcggauag

SEQ ID NO: 13772 - RNA, 807 nt, Artificial Sequence
  Description of Artificial Sequence: Synthetic coding sequence
augcugcugcucgcugcugcauuucugguggccuucguacucuuacucuauauggucucuccacugaucuccccuaagccccucgcacugcccggcgcccacgucguugugacuggaggcaguuccgggaucgggaaguguauagcuaucgaauguuauaaacagggagcuuuuaucacacuaguggcuaggaacgaagacaaauuacugcaggccaagaaagaaaucgagaugcacucuaucaacgauaagcagguggugcucuguaucuccguugaugucucccaggauuauaaccagguggagaauguuauaaaacaggcccaggaaaaguuaggacccguugauaugcucguaaauugugcaggcauggcuguaucaggaaaauuugaagaccuagaggucagcaccuucgaagugaagcccuauaacguauacauuacuguggcguacccccccgauaccgacacuccuggauucgcugaggaaaauaggacgaaaccccucgaaacuagauugauaagcgaaaccaccucaguguguaaacccgaacagguggcuaaacaaauugugaaggaugccauccagggaaauuucaauucuucgcugggcuccgauggauauauguuaagcgcccucaccugcggaauggccccuguuacuuccaucacagaggggcuacaacagguagugacaaugggcuuguuuaggacuaucgcccucuucuauuuagguagcuucgauuccauuguuagacgaugcaugaugcaacgagagaaauccgagaacgcagacaaaaccgcuuag

SEQ ID NO: 13773 - RNA, 1686 nt, Artificial Sequence
  Description of Artificial Sequence: Synthetic coding sequence
augagauggauccugugcugguccuuaacccuuuguuuaauggcccagacggcacuuggcgcccuccauaccaagaggccucaaguaguuacaaaguaugguacccugcaggggaaacagaugcacgugggcaaaaccccuauccaaguauuccucggcguucccuucucucgacccccacucggcauucucagauucgcucccccagaaccaccagagccuuggaaaggaauuagggacgcuacuaccuacccaccuggaugcuugcaggagagcuggggccaacuugcuagcauguacgugucaacaagagaaagauauaaguggcuucgguuuucugaagauugucuguacuuaaacgucuacgcuccggccagagcuccuggggacccgcaacuccccgucaugguaugguucccuggaggcgcuuuuaucgucggggcagcaucauccuaugagggguccgacuuggccgcacgcgagaaagugguccugguguucuuacaacacagacugggcauuuuugguuuucuauccacagaugauagucacgcacgcggaaacugggguuugcuggaccaaauggcugcucucagguggguccaggaaaauaucgcagcuuuuggcggcgacccggguaacgugacacuguuugggcagagcgccggggccaugucuaucuccggacuuaugauguccccucucgcgucuggucuuuuccacagggcuaucucccagucggguacagcauuguuucgacucuuuaucacauccaauccgcugaaggucgcuaaaaagguugcucauuuagccggaugcaaccacaauagcacacaaauucugguaaacugccuacgugcauugucuggcaccaaagucaugcgcgucucaaacaagaugcgcuuccugcagcucaacuuucaaagagauccugaagaaaucauuuggucaauguccccuguuguggaugggguugugauccccgacgauccacugguacugcuuacccaggggaaaguaucauccgucccauaccuucucggaguaaauaaccuggaauucaacuggcuccuacccuacauaaugaaguuuccucugaaucgucaggcaaugcguaaggaaaccaucacaaagauguuguggucuacaagaacguuacugaacauuaccaaggaacaagugccccuggucguggaagaguaucuggacaauguaaacgaacaugauuggaagaugcugcggaaccggaugauggauauugugcaggaugccaccuuuguguaugccacucuccagaccgcccacuaucacagagacgcaggguugcccguuuaccuauaugaguucgagcaccaugcaaggggaauaauugugaagccacggaccgauggggcagaccacggugaugagauguacuuccucuuuggcggacccuuugccacaggccuuucaauggggaaagaaaaagcccuaucacugcagaugaugaaguacugggcuaacuucgcucggaccggaaaucccaaugauggcaacuuaccuugcuggccgcgauauaauaaagacgagaaguaccuccagcucgacuucacgacgcgaguaggcaugaaauugaaagaaaaaaagauggcauuuuggaugucacucuaucagucacagcgaccagaaaaacagaggcaguuuuag

SEQ ID NO: 13774 - RNA, 444 nt, Artificial Sequence
  Description of Artificial Sequence: Synthetic coding sequence
auggcaucaucucuaaagaucugggguacacuacucgcucuguugugcauccucugcacucuucugguucaaucuaaggaggucagcuggagggaguuuaugaagcaacacuacuuaagccccagccgcgaauuucgcgaauauaagugcgaugucuuaaugcgagagaacgaggcacuuaaagauaaaucuucucacauguucauauauaucaguugguacaaaaucgagcacauuugcacaagugacaauuggauggaucgcuuucggaacgccuauguguggguucaaaauccucuuaaagugcucaaaugccaccaagaaaacucaaagaauagcuacaccgaaucucggucguucaauuauauagaauuucacugcucaauggacggcuauguagacuccaucgaagaucuuaaaaugguagaaccuaucggaaacuag

SEQ ID NO: 13775 - RNA, 444 nt, Artificial Sequence
  Description of Artificial Sequence: Synthetic coding sequence
augacuaguucuuugaagaucugggguauacugcucgcccuccugugcauuuugugccggcugugugucuauuccaacaacauuuauuggcgggaauuuauaaaauugcauuaccugucaccaucaagggaguuuaaagaguacaaaugugauguccugaugagagagaaggaggcgcucaaagggaagaguuuucauauguucauuuauucacugugguucaagauucagagagcauguauuaacgaaaagggcagcgacagguaucgaaacgcguacguuugggccccaggggcucucaaagugcucgagugucacugggaaaaauauaacaaccgauacaccgagucucguaguuuuaguuauaucgaguuucauugcggcgucgauggguacguggacaacauagaagauuugcgcauuauugaaccuauuuccaauuag

SEQ ID NO: 13776 - RNA, 1248 nt, Artificial Sequence
  Description of Artificial Sequence: Synthetic coding sequence
augucccccuuccucuaccuggugcuucuuguccugggucugcacgcaaccauacacugcgccagccccgaaggaaaagugacggcgugucacuccagucagccaaacgcaaccuuguacaaaaugucuucuauuaaugcagacuuugccuucaaucuauaucgccgauuuacggucgaaacacccgacaagaauaucuucuuuucccccgucuccauuucugccgcccuugugaugcucuccuuuggcgccuguugcucaacccagaccgaaaucgucgaaacccuaggguucaaucugacugacacuccaaugguugaaauucagcacggauuccaacaucuuaucuguagccucaauuuucccaagaaagagcuggagcuucagaucgggaacgcucucuuuaucgguaagcacuugaaaccacuugccaaguuccucaaugaugucaaaacguuguaugaaacagaaguuuucagcacugauuucucaaauaucucagcggccaaacaggaaauuaacagccacguagaaaugcaaaccaagggaaagguggucggccuuauucaggaccugaaacccaacacaaucaugguacuagugaauuacauucacuucaaagcucaaugggcuaauccuuucgacccauccaaaaccgaagauucuagcucauuccuuauagauaaaaccacuaccgugcaagucccuaugaugcaucagauggaacaauauuaccaccuuguggacauggaacugaacugcacagugcuucagauggauuauucuaaaaacgcccuagcacuguuuguacuucccaaggagggacaaauggaaucgguggaagcagccaugagcaguaagacauugaaaaaauggaaucgucugcuucagaaaggauggguggaccuauucgucccuaaauucucgauuagcgcaacuuaugaccuuggcgcaacgcugcugaaaauggggauccagcacgcauacuccgaaaaugccgauuucucugggcugaccgaggauaacggcuuaaaacuauccaaugcagcccacaaagccgucuuacauauuggggagaagggaaccgaagccgccgcagugcccgagguggaacucagugaccagccugaaaauaccuuccuacauccuauaauucagauagaucggaguuucauguuguuaauucuggaacgcucgacucgaaguaucuuauuucuuggaaaaguggucaauccuacagaagcauag

SEQ ID NO: 13777 - RNA, 285 nt, Artificial Sequence; identical to SEQ ID NO: 12138
  Description of Artificial Sequence: Synthetic coding sequence

SEQ ID NO: 13778 - RNA, 1062 nt, Artificial Sequence
  Description of Artificial Sequence: Synthetic coding sequence
augagguuaccccgcagggcagcacugggccugcuuccauuacugcuuuuauugccccccgcuccugaagcagcaaaaaaaccuacaccgugccaccgaugcagagggcuaguagauaaauuuaaccaggggauggucgauaccgcgaagaaaaauuucgguggagguaacacggcgugggaagaaaaaacgcuuucuaaauaugaaaguuccgagauccgccuguuggaaauacucgaaggucucugugagucuagugacuucgaaugcaaccaaaugcuugaggcucaagaggagcaucuugaggcaugguggcuccagcugaaguccgaguacccugaccuguuugagugguuuuguguuaaaacccugaaggugugcuguuccccuggcaccuacggaccggacugcuuagcaugucagggagggucccagagaccauguucuggaaacggccauuguagcggcgacggaucgaggcagggugacgguagcuguagaugucauauggguuaccagggcccccugugcaccgauugcauggaugguuauuuuuccagucuccggaacgaaacacacucuauaugcacagccugcgaugaaucuuguaagacuugcucuggcuuaacgaaucgagauugcggagaaugcgagguagguuggguauuagaugagggugccugugucgaugucgaugagugugcggcagaaccaccaccaugcagcgcagcccaguucugcaaaaacgccaaugguagcuacaccugugaggagugcgacuccucuugcgucgguuguaccggcgaagggccugggaacuguaaagaauguaucagcggauaugcccgagagcacggacagugugcggacguugacgaaugcucacucgcagagaaaacaugcguacggaaaaacgaaaacuguuauaauacgccuggcuccuauguguguguaugucccgacggguuugaggagacggaagaugcuugugugccaccggccgaagcugaagcuaccgaaggagaguccccaacccaacugccuucacgcgaggaccuguag

SEQ ID NO: 13779 - RNA, 651 nt, Artificial Sequence
  Description of Artificial Sequence: Synthetic coding sequence
augaaacugaauuuaguucagauauuuuuuaugcuucucaugcugcuguuggggcugggaaugggcuuggggcucggacugcacauggcaaccgcugugcuggaagagucagaucagccguugaacgaauuuuggucaucggauagucaagauaaggccgaagccacugaggaaggggacgggacacagacaacagaaacauuagugcuuagcaacaaggagguggugcagcccggauggccugaagaucccauccucggagaggaugaggugggagggaacaaaaugcuuagagccagugcuuuguuccagucuaacaaagacuaccugcgauuagaucagaccgauagagaauguaaugauaugauggcgcauaaaaugaaagaaccuucacaauccugcaucgcccaguacgcauuuauacaugaagaccuuaacacugugaaagccgugugcaauaguccuguaaucgcaugugagcucaagggcgggaaaugucauaaaaguagcagaccuuucgaccucacucugugugaacucagucagccugaucagguuacccccaacuguaauuaucugacaagcgugauuaaaaaacauaucauuauuaccuguaacgacaugaagcgacaacugcccaccggacaauag

SEQ ID NO: 13780 - RNA, 222 nt, Artificial Sequence; identical to SEQ ID NO: 12141
  Description of Artificial Sequence: Synthetic coding sequence

SEQ ID NO: 13781 - RNA, 609 nt, Artificial Sequence
  Description of Artificial Sequence: Synthetic coding sequence
auggagcgaggcgccggcgcuaaacucuugccccuccugcuacugcuucgggccaccggauuuacuugcgcccagacagauggucggaauggguacaccgccgugauugagguaacaucaggggguccauggggggauugggcguggccugaaauguguccggaugguuucuuugcuucaggcuuuuccuuaaaaguggagccaccccagggaauucccggcgaugacaccgcgcucaaugguaucagauuacauugcgcaagggggaacguccuuggaaacacccacguggucgaaucgcaaagugggaguuggggagagugguccgagccccuuuggugccgcgguggcgcuuaccuggucgcauucucacuuaggguagaagcaccaaccaccuuaggagacaauaccgccgccaauaacguaagguuuagaugcuccgauggggaggaguugcaagguccaggucucagcuggggagauuuuggcgauuggagugaccauuguccuaaaggagcauguggauuacagacaaagauacaaggcccgcgaggacucggagacgacacggcuuuaaaugaugcgcggcuguuuuguugccggucuuag

SEQ ID NO: 13782 - RNA, 759 nt, Artificial Sequence
  Description of Artificial Sequence: Synthetic coding sequence
augcaguuaacucguugcuguuucgucuuucuggugcagggaucucuauaccuagugaucugcggacaggacgaugggccacccggcucagaggacccagagcgcgacgaucaugaaggccagcccagaccccguguaccccguaaacgaggccauaucuccccaaaaaguaggcccauggcgaauuccacucugcuggguuuacuugcaccucccggggaggccuggggaauucucggucaaccaccuaacagaccuaaccacaguccaccccccucagcaaaagucaagaagauuuucggcuggggcgauuuuuauucaaauauuaaaacgguugcacugaaccugcucgucacuggaaaaaucguugaccaugguaacggcacauucucuguacacuuucagcacaacgccacugggcagggcaacaucagcauauccuuggucccaccuagcaaagccguggaguuccaccaggagcaacagauuuucaucgaggcaaaagcgucaaagaucuuuaauuguaggauggaaugggagaaaguugaaaggggaagaagaaccagucuguguacucacgaucccgcaaagauuugcagucgugaccaugcccaaagcuccgcuaccugguccuguagccagccuuuuaaagugguuugcgucuacaucgccuuuuauuccaccgauuaucgacucguacagaagguuugccccgauuacaacuaucacucugacacuccuuacuacccaagcggauag

SEQ ID NO: 13783 - RNA, 555 nt, Artificial Sequence
  Description of Artificial Sequence: Synthetic coding sequence
augaagauucucguggccuuucuuguggugcuaacuaucuuuggaauucaaucacauggguaugagguguucaacauuauuagcccgucgaauaacggaggaaauguucaggagacugucacuaucgacaacgagaaaaacaccgccauuauuaauauucacgcuggcucuugcagcucgacaacaauuuucgauuacaagcacggguauauugccuccagaguucuaagucgccgagcuugcuuuauccuuaaaauggaucaucaaaauauucccccucugaacaaucugcagugguacauuuacgagaagcaggcucuggacaacauguuuucuagcaaguacacuugggugaaauacaauccucuggaaagccuuauuaaagacgucgauugguuuuugcuggguucuccuauugagaaacuguguaagcacauaccacuguacaaaggggaaguugucgagaauacacacaauguaggagccggaggaugcgccaaagcuggauuacugggaauucuuggcauaucuaucugcgccgauauacacguauag

SEQ ID NO: 13784 - RNA, 651 nt, Artificial Sequence
  Description of Artificial Sequence: Synthetic coding sequence
augggggcugucauggggacuuuuuccagucuacagacaaaacagcgucgcccaucaaaggacaagauagaggacgaacuugaaaugacaaugguaugucacagaccagagggauuggaacagcuagaagcccagacgaacuuuacuaaacgugagcuucagguguuguauagaggguuuaaaaacgaaugcccuaguggaguggucaacgaagauacauuuaagcaaauauacgcucaguuuuuuccccacggagacgcuucaaccuacgcacauuaccuguuuaacgcuuucgauacaacucaaaccggauccgugaaguucgaagauuuugugacagcacucucuauucugcugagaggaaccgugcacgagaaacugagauggaccuucaaucuguaugauauuaacaaggacggauauauuaauaaagaggagaugauggacaucguaaaggcgaucuaugacaugaugggcaaguacacauacccgguccugaaagaagacacgcccagacaacacguggauguauuuuuucaaaagauggauaagaauaaagauggcaucgugacacucgacgaauuccucgaaucuugccaagaggacgauaacauuaugcgaucacuucagcuguuucagaaugucauguag

SEQ ID NO: 13785 - RNA, 2736 nt, Artificial Sequence
  Description of Artificial Sequence: Synthetic coding sequence
auggcucaacucuuccugccgcugcuggcagcccugguacuggcacaagccccugcagcgcuugcggacguauuagagggagauucuucugaggacagagccuuucgcguacgaauugccggcgaugccccccuucaagguguguuggguggcgcucucaccauuccaugccacguucacuaccuccggccaccuccaagcagacgggcaguacuuggcagcccuagggugaaguggaccuuucugucccgaggcagagaagcugagguacugguggcgcgcggcguacggguaaagguaaacgaggcuuaccgauuucgaguggcccucccugcauauccagccucauuaacagacgugagccuggcauuauccgagcuacgccccaaugacagugguauauaucguugcgaagugcagcauggaauugacgacucaucugaugcuguagaggugaaagucaaggguguuguauuuuuauaucgugagggcucugcccgguacgcuuucuccuuuaguggugcccaggaagcaugcgcuaggaucggggcucauauagccacaccagaacagcucuacgccgccuaccucggaggauacgaacagugcgaugccggaugguuaagcgaucagaccgugagguacccgauucagacuccccgagaggcgugcuauggggauauggauggauucccugguguucguaacuacggcguaguggacccggacgaucuguacgacguuuauugcuaugcagaggaccugaacggagaauuguuccugggagacccuccugagaaguugacguuggaagaggcuagggcuuacugucaagagagaggcgcagagauugcuacgacugggcagcuauacgccgcaugggauggcggccuugaucacuguucaccuggcuggcuggccgauggcaguguacguuaucccauuguuacaccuagccagcgaugcggcggcgggcuuccuggugucaaaacccuuuuccuguuucccaaucaaaccggauucccaaacaagcauagucgguuuaauguguacugcuuucgcgacuccgcccaacccagcgcuauaccagaggcaucuaacccagcuucgaacccagcauccgauggccuggaagccauugucacugugacagagacauuagaagaacuucagcucccacaggaggcuacagaaucugagucucggggagccaucuacucaaucccaaucauggaagacggaggcggaggaucuagcacuccugaggacccugccgaagcaccccgaacccuccuggaauuugagacccaaucuaugguccccccuacagguuuuucagaggaagaaggcaaggcacuugaggaggaggagaaguaugaggacgaagaggagaaggaagaggaagaggaagaggaagagguggaggacgaagcgcucugggcguggccaucugaacucagcuccccuggacccgaagcgucauuaccuaccgagccagcggcacaagaagagaguuugucgcaggcacccgcccgcgccguacugcagcccggggcaaguccucugccugacggagagucugaggccucucgccccccucgcguccacggaccaccaaccgaaacacugccuaccccacgggagagaaaccuagccagccccaguccuaguacacugguggaagccagagagguuggagaggccacuggcggaccagaacugagcggagucccuaggggcgagucagaagaaaccggcaguuccgagggcgcacccaguuugcucccagccacucgagccccagaggggacaagagaacuggaagcacccuccgaggacaacuccggacgaacugcaccagccgggacaucugugcaagcgcagccugugcugcccaccgacucagcuucaagggggggaguggcugucguaccugccuccggagacugugugcccagucccugccauaaugggggaaccugucucgaagaagaagaaggaguucgcugccugugccugccuggcuacggcggagaccugugcgacgugggacugagauucugcaacccagggugggacgcuuuucagggagcaugcuacaaacacuuuaguacuagaagaaguugggaagaggccgaaacacagugcagaauguauggagcccauuuagcuuccaucuccaccccagaggagcaggauuucauuaacaaucgauauagagaauaucaguggauaggauugaacgaucgcacaaucgagggggauuucuuguggucugacgguguacccuugcuauacgagaacuggaauccuggucagcccgacagcuauuuccuaagcggggaaaacuguguagucaugguguggcaugaucaagggcaguggucagacgugccgugcaacuaucauuuaaguuacacuugcaaaaugggacucguuuccugugggccacccccagaacuuccgcuugcucaggucuucgguaggccccgcuugcgcuacgaagucgauacagugcugcgguaucgguguagagagggacuagcucagagaaaccugcccuugauucgaugccaggagaauggaaggugggaggccccgcaaaucagcugcguaccccgucggccagcgagagcgcuccauccugaggaagauccagaagggagacaggguagacucuugggccgcuggaaggcacucuugauccccccaucaucuccaaugccaggccccuag

SEQ ID NO: 13786 - RNA, 852 nt, Artificial Sequence
  Description of Artificial Sequence: Synthetic coding sequence
augggucucggacugagggggugggggcgcccccugcugacuguggcaaccgcccuuaugcugcccgugaagccaccugccggcucuuggggagcucaaauuauugggggacacgaggugacuccacauucucgcccuuauauggcgucaguucgguucggaggucagcaccacugcgggggcuuuuuguugcgugcacgauggguugugucugcugcccacugcuucagccaucgugaucugagaaccggccucguugugcuuggagcucauguucuaucgacugcagaaccaacucagcaggucuuuggaauugacgcccucaccacucacccugacuaucaccccaugacacaugcuaacgauaucugucuacugcgauugaauggaucugccgugcugggaccggcagugggucugcucaggccgcccggacgaagagcucgaccacccacagcaggaacucgcugucgcguagccggauggggauucguuagugacuuugaagaacugccccccgggcugauggaagcuaagguaaggguccuggauccggauguguguaauuccagcuggaagggucaccuaacuuugacaaugcugugcacaagaaguggggacucgcaccgaagaggcuucuguuccgcagauucagguggcccacuaguauguagaaauagggcccacggacuggugagcuuuuccggguuguggugcggagauccgaagacgccagauguuuauacacaggucagugcauucguagcuuggaucugggaugucgugcgccgcucaagcccucagccuggcccccuucccgggacuacacggccuccaggggaagccgcuuag

SEQ ID NO: 13787 - RNA, 1209 nt, Artificial Sequence
  Description of Artificial Sequence: Synthetic coding sequence
augaugguugcccuacgcggggccuccgcccuucucguucuguuccuugcagcauuccugccaccuccgcagugcacacaggauccggccaugguccauuauaucuaccaaagauuucggguacucgaacaaggucuggaaaaaugcacccaggcaacgcgcgccuauauucaggaauuucaagaguuuuccaaaaacauuuccgugaugcuggggcgaugucagacauacaccagcgaauauaaguccgccguggguaauuuagcacuucgugucgaacgggcccagcgugagauugacuauauucaguaucuacgcgaggcagaugaauguauugaaucagaagacaaaacuuuagccgagaugcugcuucaggaggcugaggaggaaaagaagauaaggacccugcucaaugcaaguugugauaauaugcugaugggaauaaaaucguuaaaaaucguuaaaaagaugauggauacucacggcucauggaugaaagaugcaguuuacaauucaccaaaggucuaucuguuaaucggaagcagaaacaauacugugugggaauucgcaaacauucgugcauuuauggaggauaauaccaaacccgcaccacgcaaacaaaucuugacauuaucguggcaggggaccggacagguuauauauaagggguucuuauucuuccacaaucaagccacuuccaacgagauaauaaaauacaaccugcagaaaagaacaguugaggacagaaugcuucucccugggggcgucgggagggcacugguguaucagcacucucccuccacuuacauugaccucgcuguugaugaacacggccugugggcaauucauagcgggccuggaacucauucccaccugguucuuacaaagauagaacccgggaccuuagguguagagcauuccugggauacaccuugccgcagccaggacgcugaagccucauuucuguugugcggcguguuguauguugucuacuccacagggggccagggaccacauagaauuacuuguaucuaugacccacuuggaacaauuucugaagaagaucucccuaaccuguucuuucccaaaagaccuagaagccacagcaugauucauuauaauccccgggacaagcaauuguaugccuggaacgagggcaaucagauuaucuauaaguuacagacaaaaagaaaacugccucucaaguag

SEQ ID NO: 13788 - RNA, 1221 nt, Artificial Sequence
  Description of Artificial Sequence: Synthetic coding sequence
augcaacuguuucuccuccugugccuggugcuccugaguccacagggagcuagucuccacagacaccauccuagagaaaugaagaaacgcguggaagaccugcacguaggcgcuacugucgcaccgucuagcaggagagauuucaccuucgauuuguaccgcgcccuugcaucugccgcaccaagucaguccauuuucuuuagccccgugucuaucagcaugagccuugccauguuaucuuugggagccgguucgucaacaaaaaugcaaauccucgaaggccucggacucaaccugcaaaaguccucugagaaggaacugcacagaggcuuccagcaacuccuccaagagcugaaucaaccaagagauggauuccaacuuagcuuaggcaaugcucuguuuacagauuuaguuguggaucuccaagauaccuucgugagugcuaugaaaacacuuuaccuagcagauacauuuccaacuaacuuucgggauagcgcaggcgcaaugaaacagaucaaugauuacguggcuaagcagacgaagggaaagaucguugaccuccucaagaaucucgacucaaaugcggucgugaucauggucaacuauauauucuuuaaggcuaagugggagaccucauucaaccacaaaggaacccaggaacaagauuuuuauguaacuuccgagacaguagugaggguaccaaugaugagcagagaagaccaguaccauuauuugcucgaccgaaaccuauccuguagaguggugggagugccauaucaagggaaugccacagcccuguuuauacuuccaagcgagggcaaaaugcagcagguugagaauggacucagugaaaagacucugaggaaauggcugaagauguucaagaagcgacagcucgagcuguauuuaccuaaguucucuauugagggguccuaccagcuggaaaagguccugcccucccuaggaauuucaaaugucuucacuucccaugccgaccugucuggcauuaguaaucauucuaacauccaagucucagagaugguucauaaagcaguuguggagguugaugagagcggaacacgcgcugcugcugccaccgggacuauuuucacuuucagaucagcucgccugaauagccaacgucucguuuuuaacaggcccuuuuugauguucaucgucgauaauaauauucuauuucuuggaaaaguaaacagaccauag

SEQ ID NO: 13789 - RNA, 1626 nt, Artificial Sequence
  Description of Artificial Sequence: Synthetic coding sequence
augcgucuaagucccuuucaucuucagcuggaguuucacaugaaagaaaaacgcgaggaucugcagauuagcugguccuucauuagugucccugaaauggcagugaauauacaaccaaaggcucuuggggaagaucaagucgccgagacaagcgcaaugucugacgugcuaaaggauauucucaagcauuuggccggauccgccagcccuucuguggugcugauuaccaaaccaacaaccguuaaagaagcucagaaccuucagugugccgcauccacagcucaggaaucaugcccgccaaagcccccccgagcgcaugaacucaaacuguuagugagaaauauccacguucuguuacugucagaaccaggagccuccggucacauaaacgccguuugcguagugcaacucaaugauccuguacagagauucucuagcacccuuacgaagaacacaccggaucuuaugugggaagaagaguuuacauuugagcugaacgcgaaaaguaaagagcuucaccugcagauuucagaagcagggcgguccuccgagggacugcucgcuaccgccaccguaccacucgaucuauuuaaaaaacaacccucagggccacagagcuuuacacugacaucugguuccgccugcgggucaucagugcucgguucaguuacugcugaauucaguuacauggaacccggagaacuuaaauccuggccaaucccgccgccugugccagcugcgaagaucgaaaaagaccgaaccgucaugccauguggaacagugguaacaaccgugaccgccgugaaaaccaagccgagaguggacguuggucgcgcuucaccuuuguccuccgauuccccagugaagacaccgauuaaagucaaggugauugagaaagacaucagugugcaagcaauagccuguagguccgcgccgguuuccaaaacacuguccucuagcgacacugaguugcucgugcuuaacggaucugaccccguggcagaaguagcuauacgccaguuaucagaauccaguaaauugaaacugaagaguccaaggaagaaaaguacaauuaucaucucagggauuuccaaaacaucucucagucaagaucaugaugccgcacugaugcagggauacaccgccucuguggacucaacacaccaggaagacgcuccuucucauccugaaagagccgcagccuccgcuccacccgaagaagcagagagugcccaggccagucuagccccaaaaccccaggaggacgagcuugacaguugggaucuggaaaaagagccucaggcugcggcauggucuucucagguucuuuuagacccagacggcgaugaacuuucugaaucuucuauguccguucuggagcccggcacugcgaagaaacauaagggcggcauacucagaaaaggugccaaacuguuuuuuaggcggcgacaucaacagaaagaucccggaaugagccaaucacauaacgauuuaguuuuccucgaacaaccugaaggaucuagaaggaaaggcauaacacuaacacguaucuuaaacaagaagcugcuaucgcgccacagaaacaagaauacuaugaacggagcaccaguggagccauguacguag

SEQ ID NO: 13790 - RNA, 993 nt, Artificial Sequence
  Description of Artificial Sequence: Synthetic coding sequence
auggcuuuccuucccucuugggucugcguguugguugguuccuuuucugcgucgcucgcugggacuucuaaucugagugaaaccgagcccccuuuguggaaagagagucccggacagcuuuccgauuaucgagucgaaaauuccauguauaucaucaauccuugggucuaccucgaacgcaugggcauguacaaaauuauuuuaaaccaaacugccagguacuucgcuaaguucgcccccgauaacgagcagaauauucugugggggcugccucugcaauacggauggcaguauagaacuggccgguuagccgaucccaccaggcguaccaacuguggauaugaaucuggggaucacaugugcauaagugucgauagcuggugggcggaccugaauuacuuucuuaguucacugccuuuucuugcagccguggacaguggcguaaugggcaucucgagugaccaggucagacugcugccccccccaaagaaugaaaggaaauucuguuacgacgugagcuccugcagaucuagcuuuccugaaacaaugaauaaauggaauacauuuuaccaauaucuucaaucacccuuuucaaaguuugaugauuuauugaaauaucuuugggccgcucacacauccacccuggcagauaacauuaaaaguuuugaagaccgcuaugacuacuacucaaaagcugaagcucacuuugagaggagcuggguguuagcagucgaucaucuugccgccgugcuguuccccacaacacugauccggagcuacaaauuucagaaaggcaugcccccccgaauccugcucaacacugacguugccccuuuuaucuccgauuuuaccgcguuccaaaauguuguucugguguuauuaaacauguuagacaauguugacaagucuauuggcuaccuuugcacagaaaaguccaacgucuauagagaucauagugaaucaagcucccgcucauacggcaacaauucauag

SEQ ID NO: 13791 - RNA, 813 nt, Artificial Sequence
  Description of Artificial Sequence: Synthetic coding sequence
auggauucuuuagaauggaacugggccuuaguguacgagcugagcggagagcaccacgacgaggaguggucuguaaagacuuaccaggaaguugcccagaaguucgucgagacccaucccgaauucauuggcaucaaaauuauuuauucagaccaccgaaguaaagauguugcaguuauagcugagucuauccguauggccaugggccugaggaucaaguuuccuacagucguugcaggguucgaccucgugggacaugaggauacgggacacagccuucaugauuacaaagaagcacucaugauuccagcaaaggacggcgugaaguuaccauauuuuuuccacgcuggagagacggacuggcagggaacgagcauugaccgcaauaucuuggacgcccugaugcugaauacgacccggauaggacacggauucgcacucuccaagcaccccgccguaaggacauacagcuggaaaaaagacaucccuauugaaguuugcccaaucucaaaucagguacuaaaacuggugagugaccugcguaaccacccugucgcuacacuuauggcaaccggacacccaaugguuauauccuccgaugauccggcaauguucggggcaaagggccuuucguacgauuuuuacgagguguucauggguauuggagguaugaaagccgaucuuagaacucugaagcagcuggcuaugaacaguaucaaguauagcaccuuacucgagucugaaaaaaauaccuuuauggagauauggaaaaaacgaugggacaaauucaucgccgauguugcaacaaaauag

SEQ ID NO: 13792 - RNA, 939 nt, Artificial Sequence
  Description of Artificial Sequence: Synthetic coding sequence
augggcguuauggcaaugcucaugcuccccuuacuccuacuuggcauaagcggccuccuguucaucuaucaggaagugucccggcugugguccaagagcgccguccaaaauaagguugucgucauaaccgacgcuaucuccggucuagguaaggagugugccagaguguuccauaccggcggagcgagacugguguuguguggaaaaaacugggaacggcuggaaaaccucuacgacgcccuuauuaguguugccgacccuucuaagcaaacauucaccccuaaacuugugcuucuagaccuuucugauaucucguguguucccgacgucgcaaaggaggugcuugauugcuaugguugugucgacauucugaucaauaacgccuccgugaaaguuaaggggccugcacauaagaucucucucgaacuggauaagaagauaauggacgcuaacuauuuuggaccaauaacauugacaaaggccuugcuuccuaacaugauuucccgacgcacuggccaaaucgugcuugugaauaacauucagggaaaauuuggcauucccuuucgaaccacauacgccgccagcaagcacgccgcacugggcuuuuucgacugccuuagggccgaggucgaagaguacgaugucguuaucaguacugucaguccuacuuucauacgcuccuaccacguuuaucccgaacaaggaaauugggaagccucaaucuggaaauuuuucuuccgcaagcucacguauggcguccacccuguugaaguggccgaggaagugaugagaacagugagacggaagaaacaagaggucuucauggccaauccaauucccaaagcugccguuuauguccggacuuuuuuccccgaauuuuucuuugcuguuguagcuuguggggugaaagagaaguugaauguuccagaggagggcuag

SEQ ID NO: 13793 - RNA, 909 nt, Artificial Sequence
  Description of Artificial Sequence: Synthetic coding sequence
augagaagaugggcuugggcagcggugguggugcugcucggcccccagcuggucuugcucgggggagugggugcuagacgugaggcacagaggacacaacagccuggucaaagggcagaucccccuaacgcaacugcaucagcuucauccagagaagggcugccggaagccccuaagccuagccaagccagcggaccagaguuuucugaugcucauaugaccuggcugaacuucgugaggagaccagaugauggagcccugagaaaacgguguggauccagagacaagaaacccagagaccucuuuggcccaccuggaccgccuggggcagaagugacugccgagacauuauugcaugaguuccaggaacuauugaaggaggcuacugaaagacguuuuaguggauuauuggauccgcugcuaccucagggagccggcuugcgccuggugggggaggccuuucacuguagacuucagggaccacggagaguggauaaacgcacuuugguggaacugcacggauuucaggccccugcugcccaaggagcuuuccugcguggguccggacugucuuuggcuagcggaagguucacagccccaguauccgggauauuccaauucagcgccucucugcacguugaucacagcgagcuccaaggaaaagccagacugcgcgcccgagaugucgugugugucuuaaucuguaucgagagccuuugucagcggcacacaugccucgaagccgugagcgggcuagagucaaacagcagagucuucacauuacagguucagggacugcuccagcuucaggccggacaguacgcaucuguguucguggauaaugguucgggugcagugcuaacuauacaagccggaucuaguuucucuggacucuugcuagguacuuag

SEQ ID NO: 13794 - RNA, 1416 nt, Artificial Sequence
  Description of Artificial Sequence: Synthetic coding sequence
auggacucagccccccuuuucccacggccccaucuuuuucaaaaucuguuauuauuucugugggcgcucuuaaauuguggccucggagugagcgcccaaggacccggagaguggaccccaugggugucuuggacacgguguagcucgucaugcgggcgcggaguaucaguccguagcaggaggugccugaggcuaccaggugaggagccaugcuggggugauucacacgaauacagacuuugccaacugcccgacugcccgccuggcgccgugcccuuucgcgauuugcaaugugcgcucuacaauggucggcccguacuggguacacagaagacuuaccaguggguuccuuuucacggugcuccaaaucaaugugaccucaacugcuuggccgaaggccaugccuucuaccauuccuuuggacgcguccucgauggcaccgcuugcucuccuggugcucagggcguguguguugcuggcagaugucugagugccggaugcgauggacugcuuggcaguggcgcucuagaagaccggugcgggagaugcgguggugccaaugauaguugucucuuuguccaacgcguauuucgugaugcaggugcuuuugccggguauuggaauguaacccucaucccagaaggugcacgacauauuagagucgaacacagaucaaggaaucaccuagcccuaauggguggcgacggcagguacgugcuaaacggacacugggucguuucuccuccgggaaccuacgaggccgcggggacucaugugguuuauacccgggauaccgggccacaggaaacacuacaggcagccggaccaacuucccacgaccuucugcuacagguucuacugcaggaaccaaauccaggcauagaguuugaauuuugguuaccgagagaacgcuauuccccuuuccaagcucggguccaggcacugggauggccacuccggcagccccagccacgcgggguggaaccgcagccucccgccgcccccgccgucaccccugcccagacacccacgcucgcaccagacccuugucccccuugucccgacaccagaggccgugcacaucgacuccuccacuacugcgguuccgauuucgucuuucaggcccgagugcugggccaccaccaccaagcccaggagacaagauacgaaguccgcauucagcuuguuuauaagaacaggucaccauugagagcgagagaguauguuugggcccccggucacugcccaugccccauguuagcuccccaccgcgauuaccugauggcuguccaaagacuugucuccccagauggaacacaagaccaguugcuucucccucaugcuggauacgccaggcccuggucccccgcggaggauucacguauucgguuaacugcccgacgaugcccgggauag

SEQ ID NO: 13795 - RNA, 222 nt, Artificial Sequence; identical to SEQ ID NO: 12156
  Description of Artificial Sequence: Synthetic coding sequence

SEQ ID NO: 13796 - RNA, 2349 nt, Artificial Sequence
  Description of Artificial Sequence: Synthetic coding sequence
auggcccgcgcgagagcuggcgcuuuacucgcacuauggguuuuaggggcggcagcucacccccagugucuggauuuccguccuccuuuucgacccacccaaccgcucagacucugcgcccaguacagugacuucgguuguugcgaugagggccgcgaugccgagcuaacaagacgguucugggcccuugcgagccgaguggaugcagccgaaugggccgccugcgcaggcuacgcccgugaccugcucugccaggaauguagcccauaugccgcucaccucuaugacgccgaagauccauuuacacccuuacguacaguucccggauuaugucaagauuauugcuuggacauguggcacaaaugccgcgggcucuuuaggcacuuauccacugaccaagaguuaugggcccuggaagggaacuuggcccgguucuguagauaucugagccuggacgacacugauuauuguuuccccuaccuuuuagugaacaagaaucugaauuccaaccuaggacacguaguugcagacgcaaagggauguuugcaguuaugcuuggaagaagucgcuaacggguugcguaacccuguggccauggugcacgcacgcgacggaacccaucgguucuuuguggcagaacaagucgggcuagucugggcauaucuccccgaucgcagcagacucggcaaaccuuuucugaauaucagccggguggugcugaccucacccugggagggcgacgagcgcggguuuuugggaauugccuuccauccguccuuucaacauaaccgcagacuuuacguguacuacagcgucggaauuagauccucagaguggauccggaucagugaauuuagagugagcgaagacgaugagaaugccgucgaccauucuagcgaaaggaucauauuggaagugaaagaaccugcuagcaaccacaauggcggucaacuguuguuuggagaugauggguaucuguauaucuuuaccggggacggugguauggccggcgaucccuuugguacguucgguaacgcucagaauaaauccgcucuguuaggaaaagugcucaggauugacguggauagaaaagagcgcgggcucccuuauggcaucccaccugacaacccuuucgucggagaccccgcggcccaaccagaggucuaugcauuaggagugagaaauauguggagguguaguuuugaucgcggugacccuucuagcggaacgggaaggggacgucuguucugcggagacgugggccaaaauaaauuugaggaaguugacgugguugagcgaggcgggaauuaugguuggcgagcacgugaaggauuugagugcuaugaccgcucacugugugccaauacaucccugaacgaccuguuaccuaucuucgccuauccgcauacggugggaaaauccgucacuggaggcuauguauauagaggaugugaauacccaaauuugaacgggcuuuauauuuuuggagauuucaugucuggccgucuaaugagucugcaggaaaaccccgguacugggcaauggcaauauucagaaaucuguaugggacacgggcaaaccugcgaauuucccggccuaauaaacaacuauuauccauauauuauaucauuuggagaagaugaagccggagaauuguacuuuaugagcacgggggaacccagcgcaacugcaccaagaggcguggucuauaagauaaucgaugcaucuagacgggccccacccgguaagugccaaauccaacccgcccaaguuaaaaucaggucuagacucauuccauucgucccuaaagaaaaauucauacccaagaccaggaguaccccucgccccacugcucgagcaccgacccgcgcaccuaggagagggagacccacugcagccccgcccgccccuaccccacgcccugccaggccaacacagcagccuggcucacgucgcggagguggccgucgucgaggucggcugaacucugcaucaagggccuuucgcgauggagaggugcgccucguccgcccagccggccuuucaucuggaucagguagagucgaaguguuuguuggcggucgguggggaacaguuugugaugauucauggaauauuuccggggccgcagugguuuguaggcaacuggguuucgccuaugcaguccgagcagucaaacgcgccgaguuuggacagggugggagccugccgauccuacuugaugauguccgcugcgcaggaugggaaaggaaucuccuggagugucagcauaacggcguggguacccauaauugugagcacgaugaggaugcaggagugguauguagccaucagaaccccgaccuuuag

SEQ ID NO: 13797 - RNA, 1317 nt, Artificial Sequence
  Description of Artificial Sequence: Synthetic coding sequence
augcauccacugcccgguuacugguccuguuacugucugcuccugcuguucucgcucggcguacaggguucacucggcgcaccuuccgcggccccugagcaaguucaccugaguuaccccggggaacccgguaguaugacagugacauggacaacuugggucccaacccgcagcgagguucaauucggucugcaacccucaggcccccugccccugcgggcacagggaacauucgugcccuuuguugacggcggcauccugagaagaaaacucuacauccaucgaguuacccuccgaaaacuccuuccaggcguccaauauguguauagaugcggcucggcacagggauggagcagaagauucagauuccgugcucuuaaaaacggcgcacacugguccccgcgccuugccgucuucggagaucugggggccgauaacccaaaagccgugccacggcuucgccgcgacacucagcagggcauguacgacgcuguauuacacguuggagacuuugcauacaaucuagaucaggacaacgcccgugugggagaucgcuucaugcgucugaucgaaccaguugccgccucgcugccauauaugaccugcccagguaaucacgaagaacguuauaauuucucuaacuacaaagcccgguuuagcaugcccggggacaaugagggacucugguacucaugggauuuaggaccugcccacaucaucuccuucuccacugagguguauuuuuuccugcacuacggaagacaucuugugcaacgacaguucagguggcuggagagugauuuacagaaagcaaacaaaaaccgagccgcccgaccuuggauuaucaccaugggccaccgucccauguacuguucgaacgccgaccuagaugacuguacuagacacgaaaguaaggugcgcaaaggacuucaaggaaaacuauauggauuagaagaucuguucuacaaguaugggguggauuugcagcugugggcacaugagcacucuuacgaaagacucuggcccaucuauaauuaccaggucuuuaacggaucacgcgagaugccauauacaaacccaagaggccccgugcacaucaucacuggaucugcaggcugcgaagagagacugacacccuuugccgucuucccucgacccuggucagcugucagagugaaggaauacgguuauaccaggcuccacaucuugaauggcacccauauucauauucaacagguaucugacgaccaggacggcaagauuguggacgauguauggguggugagaccucuuuucggacggcgaauguaccuguag

SEQ ID NO: 13798 - RNA, 411 nt, Artificial Sequence
  Description of Artificial Sequence: Synthetic coding sequence
auggcucggacaaaacaaacagcgcguaagucaacaggcggaaaagcuccuagaaagcaguuggcuacaaaagcugcccgaaagagcgcuccagcaacggggggugugaagaaaccacauagauauagaccgggaacaguggcccugcgcgagauuagacgguaucagaaaaguaccgagcuauugauaagaaaguugccauuucagagacuugugcgagagauugcucaagauuucaaaaccgaccugcgguuccaaucuagcgcggugauggcccuccaggaagccagugaagcauaucugguaggacuauucgaagacacuaaccugugcgcuauccacgcuaaaagggugacaauuaugccaaaggacauucaacuugccaggcgaauuagaggugaaagagcuuag

SEQ ID NO: 13799 - RNA, 1209 nt, Artificial Sequence
  Description of Artificial Sequence: Synthetic coding sequence
auggcugcccgcccugggccacuauggcuccugggacuuacccucugugcuuuggguggaggcggacccggccugaggccuccuccagggugcccccagaggcgcuuaggugcacgggagagacgggaugugcaacgcgaaauccuggccgugcuuggucugccuggcagaccuagaccacgggcuccuccagcugcaucacgauugcccgccagugcaccauuguucaugcucgaucuuuaccaugcgauggccggagaugacgaugaggacggggccccggcagaacaaagacuagggagggcugaccucguuaugucauuugugaauaugguagagagggacagagccuugggccaccaagaaccacauuggaaagaguuccgguuugauuugacccagauucccgccggagaggcugucaccgcugccgaguuuagaaucuacaaagugccuaguauacaccuacuuaauaggacccuacauguuucaauguuccaagucguucaagaacagucuaacagagagagugaucuuuucuuucuugaccuccagacguugcgcgccggcgaugaggggugguuagugcuggacgugacugccgccuccgacuguuggcugcugaagcggcacaaagauuuggguuugcguuuguauguugaaacggaggauggccauucaguggacccaggcuuggcaggucuccuugggcagcgcgcuccucguucucagcagccuuucgugguaacguuuuuuagggccucucccagccccauucggaccccuagagccguucgcccucucagaagaagacaaccaaagaaaucaaacgaacuuccucaggccaacagauuacccgguauuuuugaugaugugagaggaagccacggccgccaagugugucggaggcaugagcuauacgugucuuuucaggauuugggauggcucgacuggguuauugccccacaaggauacucugcauacuacugugagggcgaauguucuuucccguuagacucuuguaugaaugccacuaaucaugccauuuugcaaucucucgugcacuuaaugaaacccaacgcggugccuaaagccugcugcgccccaacaaaacuuuccgcgacaucaguucuguacuacgacucuuccaacaacguaauucuuagaaaacaucgaaacauggugguaaaggcuugcggcugccauuag

SEQ ID NO: 13800 - RNA, 957 nt, Artificial Sequence
  Description of Artificial Sequence: Synthetic coding sequence
auggccgcugcugcccugccgccuagaccucuucuccugcugccacucgugcuccuacucagcggaagaccgacacgcgccgauucuaaggucuuuggcgaucucgaucaggugagaaugacauccgaaggcuccgauugccgcuguaaguguauuaugaggccacuuaguaaagaugccuguucuagggugagaucagggcgagccagaguugaagacuuuuauaccguagagacagucucauccgguacugauugcaggugcucuugcacagccccaccaucaagccuaaacccuugugagaaugaguggaagauggagaagcuuaaaaaacaggcuccagaacucuuaaagaguauaaaagcaaaucuuucaagggagaaugaggugguaaaggacucuguaaggcaccucucagagcaauuacgccacuaugaaaaccauucagccauuauguuggguaucaagaaagagcugucgagacucggacugcaacuguuacaaaaggaugcugccgccgcccccgcuacccccgccaccggaacaggcucuaaagcccaggauaccgcuagagggaaggggaaggauaucagcaaauauggaagcgugcaaaaaucauucgccgaccgcggacugccuaagccacccaaagagaaacuguuacaaguggagaagcugagaaaggagaguggaaaagguucuuuucugcagccaacggccaaaccaagagcccucgcucagcagcaggcaguuauccggggauuuaccuacuauaaggcuggaaaacaggaggucacugaagccgucgccgacaauacucugcaaggaacuucguggcuggagcagcugccaccaaaagucgagggacguuccaacagcgcggagccgaacagcgccgaacaggaugaggcagaaccuagaaguuccgagcguguagaucuggcaaguggcacauag

SEQ ID NO: 13801 - RNA, 402 nt, Artificial Sequence
  Description of Artificial Sequence: Synthetic coding sequence
auggcacugggggugcccaucucugucuaucuccuuuuuaacgcaaugacggcucuaaccgaagaagcugcuguuaccgucacccccccuauuacggcucagcaggccgauaacauagaagguccaaucgccuuaaaguuuucucaucugugucucgaggaucacaauucauauugcauuaacggcgccugugcauuucaccaugagcuggaaaaggcgauaugccgcuguuuuacugguuacacaggagaaagaugcgaacaccucaccuugacaucuuaugcagucgauuccuacgagaaauauaucgcgauuggaaucggcgugggauuacuauuaaguggguuucuugucaucuucuauuguuauaucaggaaaagauacgaaaaggauaagaucuag

SEQ ID NO: 13802 - RNA, 651 nt, Artificial Sequence
  Description of Artificial Sequence: Synthetic coding sequence
augaguuccgaggcagaaacccagcagccuccugccgccccacccgcugcccccgccuuaucagccgcagacacaaaaccuggcaccaccggaagcggcgccggcagcggcggccccggaggauugacaagcgcugcccccgcaggaggugacaaaaaggucauugccacuaagguguuggggacugucaaaugguuuaauguaagaaacggauacggcuuuauuaaccggaaugacaccaaggaagaugucuuuguucaucagggagcugaagcugcuaacgucacaggaccgggaggcgugccagugcaaggcagcaaauacgcagcggacagaaaucauuaccggagauauccacgucguagagguccuccuagaaauuaucagcagaacuaucagaauuccgaguccggggaaaagaacgaaggaucugaaucugcaccugagggacaggcucagcaaagaaggcccuauagaagaagacgguuuccucccuauuacaugaggcgaccauacggaagaagaccucaauacagcaacccacccguucaaggugaggugauggaaggagccgauaaucagggcgcgggagaacaggggcgcccaguccgccaaaacauguaccgaggauaucguccccgcuuucgcuag

SEQ ID NO: 13803 - RNA, 756 nt, Artificial Sequence
  Description of Artificial Sequence: Synthetic coding sequence
aacgacuggagcgccgaccagcuguacuuagaaaccaccggaaagucccgaacuuugcagagcgguuuagcacuccuguacggauuucuuccugacuuugauuggaagaagauuuacuuucgacaucagccgagugcccucuuuugcucugggucgugcuauugccccguuagaaaucaguacuuagaaaaggagcagagacgacaguauuugcuaagauuaaagaauucccagcuugaaaaaacuuacggcgagauggcaaagaucguagacguucccacaaaacagcucagggcugcuaacccuaucgacuccaugcugugucauuucugucauaaugugucuuucccuugcacccggaacggcugcguugacauggaacacuucaagguaauaaagacgcaccaaauagaagacgaacgggaaagaagggagaagaaacuguacuuugguuacucccuacucggagcacaccccauccuuaaccagacgauaggcagaaugcagagggcaacagagggaagaaaagaggaacuguuugccuuguacuccgcgcaugacgucacuuugagccccgugcugucagcccuaggacugagugaggcccgcuuuccucgcuuugccgcaagaguaaauauaccauccggcuuuuucaccauggcuagcaugucgcacucuaccccucuaucagcuaaaacaacuacaaguguuuugccuucucccugcgccagacuuaagacuuggucagcauuauag

SEQ ID NO: 13804 - RNA, 576 nt, Artificial Sequence
  Description of Artificial Sequence: Synthetic coding sequence
auggccgcccccagaggaagagcggcaccauggaccacugcccuacuuuugcuguuagcuagccagguccuaucucccggaagcugcgccgaugaagaagaaguuccagaagaguggguucugcugcacguagugcagggacagaucggcgcaggcaacuauaguuaucucaggcugaaccacgaagggaagaucgugcuccguaugcguucgcugaaaggcgaugcagaucuuuaugucuccgccagcucccuacacccuaguuucgacgauuacgagcuucaguccgcgaccugcgggccagacgccguaucuauuccugcgcauuuucgccgaccaguuggcaucggaguauacggacauccuagccaucuugaauccgaguuugaaaugaaaguuuauuacgacggcaccguagaacaacacccauucggcgaggcagccuauccagccgacggcgccgaugcaggacaaaagcacgccggcgcuccagaagacgcaucccaggaggaagagucugugcuguggacgauccuuaucaguauccugaaacuggugcuggaaauccucuuuuag

SEQ ID NO: 13805 - RNA, 2301 nt, Artificial Sequence
  Description of Artificial Sequence: Synthetic coding sequence
augggcaggagacgguuguuaguaugguugugcgccguagccgcccuccuuagcggcgcccaagccaggggaacaccguuacuggcuagaccugccccccccggcgccuccagauacagccucuacacaaccggcuggagaccuaggcucagaccaggcccucauaaggcccuaugcgcuuauguggugcaucggaaugugacauguauucuccaggagggagccgagucauaugucaaagcagaguacagacaauguagauggggcccgaagugcccuggaacagugacuuacaggaccgugcuacggcccaaguauaaggucggcuacaagacgguaacugaccucgccuggcgguguuguccagguuucacaggaaaaagaugccccgaacaucuaacugaccacggugcagcuucuccucagcuugaaccagagccacagaucccuagcggccagcuggaccccggaccucggccacccucuuacucccgugccgcacccuccccucacggcagaaaaggcccuggauuguuuggcgagcgguuagagcgucuggagggcgacgugcaaagacuggcccagacauacggaacgcugucaggccuagucgcgucccaugaggauccaaacaggaugacgggcggaccuagggcuccugccguuccagugggauucggcguuaucccagaaggcuuggucgggccaggagacagagccagaggaccccucacuccccccuuagacgaaauuuugaguaagguaaccgaagucagcaacacacugcagaccaagguccaauuauuggacaaaguccauggccuagcccugggccacgaagcucaccuucagagacugcgagaggcuccaccgucaccucuaaccucacuugcucugcuugaggaguacguagaucgacggcugcauagacuauggggaucccuguuagacggauuugaacagaagcuucaaggcgugcagagcgagugcgaccugagaguccaggagguacggaggcaaugcgaggagggacaagccgccaguaggcgucuccaccaaucucuggacggccgugaauuagcccuucggcaggaacuaucacaacuggggagucagcuacaggggcucagcgugucuggaagaggaucuuguuguggccagcucgcacugaucaaugcacgcauggacggguuggaaagggcucuucaggcuguaacugagacacaaagaggccccggggcgccagcgggcgacgagcuaacucgccucucugcagcgaugcuggagggggggguggacggacuuuuagaaggauuggagacacucaacggaacggaagguggcgcgcguggcuguugcuugaggcucgauauggggggaugggggguugggggauuugguaccaugcuggaggaacggguucaaucucucgaagaacggcucgcuacacuugccggcgaguugagccaugauucagcuagcccagguaggucagcccgcccccucguccagaccgagcuagccgugcucgagcagcguuuagugucucucgaaacgucauguacgccgucuaccaccagcgcuauccuggacucccucgucgccgaagucaaagcauggcaaucuaggucugaagcauuauuacggcaggucgcuucucaugccgcccuccugcagcagcuaaacgguacuguugcagaaguacagggucaacucgcagaagggaccggguccagucugcaaggcgagaucacucugcuaaagguaaaucugaauucugucucaaagucacucacgggcuugagugauuccgucucacaguauagcgaugccuuuuuagcggccaacacuagucuggacgagcgggaaaggaaggucgaggcggaagugcaggccauccaggaacaggucuccucacaaggaagcagauuacaggcuggacaucggcagguccugaaccugcgaggcgaacucgaacagcucaaggcuggcguagcaaagguagcuagcggucuuucucgcugccaggacaccgcacagaagcuccaacacacuguagggcacuucgaucaaaggguugcgcagguagagggcgcaugccggagacugggucuguuagccgccggccuugauucacuaccaacagagccacugagaccacgagaagggcuuuggagucacgucgaccaacugaaccgcacguuggcucaacacacucaagacauagcacgcuugcgagaugaccugcuggacugccaggcccaguuagcugagcaagugcgcccgggucaggccaacuag

SEQ ID NO: 13806 - RNA, 1251 nt, Artificial Sequence
  Description of Artificial Sequence: Synthetic coding sequence
auguaucgacauggaauaagcagucaacguaguuggccucucuggaccacuauuuucauuuuucugggggucgcugcgauccuaggaguuacgaucggucugcuggugcacuuccucgcgguagaaaagacauacuauuaucagggcgauuuucacaucagcggcgugaccuauaacgacaauugugagaaugcagcuagucaggcuuccacaaaccucuccaaagacaucgaaacaaaaaugcucaaugccuuucagaauaguuccauuuacaaagaguaugugaaaucagaagugauuaaguugcuuccaaacgccaauggcuccaacguacagcuccagcucaaauuuaaauuuccuccugcagaaggugugagcaugagaacuaagauuaaagccaaacugcaucaaaugcuuaagaauaauauggcuucauggaaugcggugccugcgucaauuaaacugauggaaauuucgaaagccgccuccgagaugcuuaccaacaauuguugugggagacaaguggccaauagcauaauaacuggcaauaagauuguaaacggaaaauccucccuggagggugcauggcccuggcaagcuagcaugcaauggaaaggccgacauuacuguggagccagccuuaucuccagcagguggcugcuauccgcugcucacuguuucgcuaagaagaacaacucuaaagacuggaccguuaauuuugggaucguggugaauaaaccuuacaugaccagaaaagugcaaaauauaauauuucacgaaaauuauuccucucccggauugcacgaugauauagcauugguccagcuggccgaggaagugaguuuuaccgaguacaucaggaaaaucuguuuacccgaagcuaagaugaagcucucagaaaaugauaacgugguggugacgggauggggaacacuguauaugaacggaagcuuuccagugauacugcaggaggauuuucugaaaauaaucgauaacaaaauauguaacgcuucauacgcguauuccggcuucguaacggauaccaugcuaugcgcagguuucaugucuggggaagcugacgcaugucagaacgacucuggaggaccacuugccuacccagauucaagaaacaucuggcaccugguggguauuguuagcuggggggacggaugcgguaagaagaauaaaccuggagucuacacacgcguaaccucauaucgaaacuggaucacaucuaaaaccggacuguag

SEQ ID NO: 13807 - RNA, 639 nt, Artificial Sequence
  Description of Artificial Sequence: Synthetic coding sequence
auguuguccagugugguauuuuggggccugaucgcccucaucgguacaucucgaggauccuacccauucagccauuccaugaaaccacaucugcacccacgacucuaucacggauguuauggagauauuaugacgaugaagacauccggcgcaaccugugaugccaauucgguuaugaacugcgguauucgcggaagcgaaauguuugcggaaauggaccuuagagcaauuaaaccauaucaaacauugauaaaggaggugggacagcgccacuguguugacccggcggugaucgcugcgaucaucaguagagagucccacggcgguagcguacuacaagacgguugggaucaccgcggcuuaaaguuuggacuuaugcaguuggauaagcagaccuaccacccugucggcgccugggauaguaaagagcaucuaucacaggcaacaggcauuuugacugaaagaauuaaggccauccagaagaaguucccuacauggagcguggcucagcaucugaagggaggguuaagcgcauucaaguccgggauugaggcaauugcuacgccauccgacauugacaacgacuucguaaacgacaucauagcucgcgccaaguucuacaaaagacagucauucuag

SEQ ID NO: 13808 - RNA, 378 nt, Artificial Sequence; identical to SEQ ID NO: 12169
  Description of Artificial Sequence: Synthetic coding sequence

SEQ ID NO: 13809 - RNA, 867 nt, Artificial Sequence
  Description of Artificial Sequence: Synthetic coding sequence
augaauaaucugucauuuagugaacuuugcugccuguuuuguugucccccuugcccuggcaaaaucgcuagcaagcucgccuuuuuacccccggauccaaccuauacccugaugugugaugagucugguaguagauggacccuccaccuuucugaaagagcggacuggcaauacuccucuagagaaaaagaugccauagagugcuuuaugacccgaacaucuaaagggaaucggauugccugcauguucguuagauguagucccaacgccaaauacacccuacuguucagccacggcaacgccguugaccugggacagaugagcuccuucuauauuggacucggaagccgaauaaauuguaauauuuuuucuuacgacuacucaggauauggggcaaguaguggaaaaccaaccgaaaaaaaccuauaugcagacauugaagcagcuuggcuggccuuaagaacuagguacggaaucaggccugagaacgugaucauuuauggucagagcaucggcacggucccuuccguggaucuagcugcgcgauaugaguccgccgccgucauccugcacuccccuuugacuaguggcaugcgagucgcuuucccugacaccaagaagacuuacugcuuugacgcuuucccuaacaucgauaagaucucaaagaucacaucucccguguugauuauacacgguacagaggaugaagugauagauuuuucccacggacuggcacuauucgaacgcugucagagaccagucgaaccucucuggguugaaggcgcuggucacaaugacguagaauuauauggacaauauuuagagagauugaaacaguucgugagccaggaacucguuaaccuuuag

SEQ ID NO: 13810 - RNA, 417 nt, Artificial Sequence
  Description of Artificial Sequence: Synthetic coding sequence
augguugcacccgcugcuagaguguuucugagagcaguuagagcagcuuuaacaucuaccgugccagaucugcucugucuacuggcuagaggcucucccaggggcuuagcaucggggcgguuaccgcuugcgguacacucggcacagcacggacccggaucaggugccccuuggcuuagaauugcgaggagagcacugcgcuucguacugucgaaacacuggggcgacgacugcuaccuuacgaaucgccuguggcaggauuugaaacccccaucucacguggagaauggucaggagcugagacuugcuccaccaguacagugggcccuccaggugcaggguaaucagcuccagaccgcaguucucuguuuacggauggcucccccagaaccugcuggguccagacagagaaucuag

SEQ ID NO: 13811 - RNA, 1332 nt, Artificial Sequence
  Description of Artificial Sequence: Synthetic coding sequence
augggcggcccuagagcuugggcccugcucugccucggccugcuacugccuggcggcggugcugccuggucgauaggagccgcaccuuuuuccggaaggcguaauugguguucauacguugucacccgaacaauaucaugccacguacagaaugggaccuaucuccaacgcguguugcagaauugccccuggccuaugaguugccccgggucgucauaccgcacaguggugaggcccacauacaagguuauguacaaaaucguuacagcucgggaauggagaugcugcccaggccacucaggcgugaguugcgaggagguugccgcauccuccgcgucucucgaaccaaugugguccggcaguacuaugagaagaauggcauugcgcccuacugcauuuucggggugucuuaacuguuccaaggucagugaacuaacugagagauugaaagugcuagaggccaaaaugacaaugcucaccgugaucgaacagcccguucccccgacaccagcaacaccagaagacccugcaccacucuggggcccaccuccagcgcagggaucccccggcgacggcggccuccaggaucagguaggcgccuggggacugcccggaccaacuggccccaaaggcgaugcaggaucacgcggcccaaugggcaugcgagggcccccaggcccacaggguccccccggaagcccugggcgagcuggcgccguuggcacucccggcgagcgcgggccacccgguccucccggcccacccggcccaccuggacccccggccccugugggccccccucaugcacgcauuucucagcauggcgacccucuacugucaaauaccuucacugaaacaaauaaccacuggccucagggcccuaccgguccgccggggccuccugguccaaugggccccccaggaccucccgggccuacaggcgugccuggcagcccuggacacauuggaccacccggaccaacggguccuaaaggcaucagcggacaccccggagagaagggcgagagaggauugcggggagagccugggccucaagggagcgcgggacaacggggcgagccaggcccaaagggggacccaggcgaaaaaucacacuggggcgaaggacuacaucaguugcgcgaggcacuaaagauccuagcagagcguguguugauucucgagaccaugaucggccuauaugaaccagagcuggguucgggggccgggcccgcuggcacgggaacuccaaguuuguugagaggaaaacgagggggccacgccacuaauuacaggauaguagcaccuagaucaagagacgagcgcggguag

SEQ ID NO: 13812 - RNA, 717 nt, Artificial Sequence
  Description of Artificial Sequence: Synthetic coding sequence
auggugcugcuguuacuuguggcaaucccguugcucgugcacucuuccaggggaccugcucauuaugaaaugcuaggacgauguaggauggugugugacccucaugguccucgggggccaggcccggauggcgcuccugcaucgguacccccauuccccccaggagcgaaaggcgaaguggggcgaagaggaaaggcuggcuugagaggcccaccaggaccaccuggcccacgcggaccaccaggcgaaccaggcaggccuggucccccaggcccuccaggcccuggccccggaggaguggccccagccgcuggauaugugccacguauagccuucuacgccggacugcgaaggccgcaugaaggauacgaaguucuuagguucgaugacguagugacgaacgucggaaacgcuuacgaggccgcauccggaaaauucaccuguccgaugccaggugucuacuuuuucgcauaucauguccugaugagaggaggagacggcacaucuaugugggccgaucucaugaaaaaugggcagguaagggccagcgccauagcccaagaugccgaccagaacuaugauuaugccucaaacucuguaauccuucauuuagacguaggcgaugaggucuucauuaagcuagacgguggaaaaguacacggcggcaauaccaauaaguacagcacuuucucuggguucauaauuuauccggacuag

SEQ ID NO: 13813 - RNA, 282 nt, Artificial Sequence; identical to SEQ ID NO: 12174
  Description of Artificial Sequence: Synthetic coding sequence

SEQ ID NO: 13814 - RNA, 609 nt, Artificial Sequence
  Description of Artificial Sequence: Synthetic coding sequence
augguuaggauuuggaccacuaucaugauuguccugauucuccuguuaagaauuggcccuaauaagcccucccucaguggaagacaagccccagcucaagcacagacauccgaucuuguaccuucucucuucccacucggguuaugggcacccggguuuuguaccuggucuagcccggaugaggacaaaguguggagaccggcuugggagcagggaccuaaaggugagccggacccaagaggacugcggcccagaaaacccgucccuggaacaggaaaccgcgacagcgggacccggcggcggcugcaggacgccacagagcaagacccacgcccuggaaacgacgucgcaucugcugaaaccgccgggccccccucccccuccggaauuagagcacaggaccgcgcgccccggcaccgccgagcacccccagcccgaaugccaguggccccagcgccuucagccgauggugagccccuccaggaacaaggcggcggacucuuucacaggacucgguccgucuacaaugguuuagagcugaacacuuggaugaagguugagcgguuauucguggagaaguuucaccaaucauuuagccuugacaacuag

SEQ ID NO: 13815 - RNA, 342 nt, Artificial Sequence
  Description of Artificial Sequence: Synthetic coding sequence
augcugcccugcuuagcucuacugcugcugauggaacugucugugugcacaguggccggugaugggggcgaagaacagacucugagcacugaggcagagacgugggugauuguggcccuagaagaaggagcaggaccuucaauucagcuccagcuccaggaagucaagacaggaaaagcaucucaguuuuuuggacucaugggcaagagagugggggggaggccacuaauucagccuaggcgcaaaaaggcauaucagcuugaacauacuuuucagggauugcugggcaaaagaucccuguuuacagaagggcgggaagaugaggcacagggaagcgaguag

SEQ ID NO: 13816 - RNA, 1269 nt, Artificial Sequence
  Description of Artificial Sequence: Synthetic coding sequence
auggggccugcguggcuauggcugcugggcacagguauauuagccucugugcauugccaaccgcugcucgcacacggggacaaaaguuuacaaggaccacagcccccucgucaccagcuuuccgaaccggcacccgccuaccacagaaucacaccaacaaucacgaacuucgcucuccgacuguauaaagaacuggcagcggaugccccugggaauaucuuuuucuccccuguuucuauuucgacuacuuuggcccuguuaagucugggagcacaggccaacacuagcgcuuugauccucgagggccucggcuucaaccugaccgagaccccugaggccgauauccaucagggguucagaucacucuuacacacacuggcacugccaucucccaaauuggaauuaaaagucgguaacucucucuuucuggacaaacggcucaaaccacggcagcauuaccucgauuccauuaaagaauuauacggagccuuugcauuuucugcuaauuuuacggauuccguaacuacuggacgccaaaucaacgacuaccuucggagacagacauaugggcaagugguugacugucuuccugaguucucccaggauacauuuaugguccucgcuaauuacaucuuuuuuaaagccaaguggaagcauccuuucucccguuaucagacacagaaacaggagucuuucuuuguugaugaaaggacuucucugcagguuccaaugaugcaccaaaaagaaaugcauagauuucucuaugaccaagacuuggcgugcacaguucuucagaucgaguacaggggaaacgcccuggcacuucucgucuuacccgauccuggaaagaugaagcagguggaggccgcuuugcaaccccagacacugaggaaauggggacagcuucuucuucccucacugcucgauuuacaucugccccgauucucuauuaguggcaccuauaacuuagaagacauacuuccucagaucggguugacaaacauucucaaccucgaggccgacuucagcgggguaacaggacagcucaauaagaccauauccaaagucucacacaaggccaugguagauaugucagagaaaggcacggaagccggcgcugcauccggacucuuaagccagccaccaagccugaacacuaugucggauccccacgcacauuuuaauaggccauuccuuuuacugcugugggaagucaccacccaaucucuuuuguucuuaggcaaaguuguuaauccagucgccggguag

SEQ ID NO: 13817 - RNA, 237 nt, Artificial Sequence; identical to SEQ ID NO: 12178
  Description of Artificial Sequence: Synthetic coding sequence

SEQ ID NO: 13818 - RNA, 2139 nt, Artificial Sequence
  Description of Artificial Sequence: Synthetic coding sequence
auggcagcugcagggcuugucgcagucgcagccgccgcugaguacucuggcaccguugccucuggaggaaaccugcccggagugcacugcggccccagcagcggcgcgggucccggcuucggccccggaucauggucuaggagucucgauagagcacucgaggaagcugccgucaccggcguccuuucccuuaguggcaggaagcucagagaauucccgcgaggagcagccaaucacgaccucaccgacaccacuagagcugaccugaguaggaacagacugucugaaauacccaucgaggcgugccacuucguaagccuggaaaaccucaaccuguaucagaauugcauccgguacaucccggaggcuaucuuaaaccuccaagcucugacuuuucucaacauuucuagaaaccagcuguccacccuuccuguccaucugugcaaucuaccccugaaaguucuuauagcuagcaauaacaagcucgucagccucccagaagaaaucggacauuugcgacaccuaauggagcuugaugugagcugcaacgaaauccaaaccauucccucgcaaauuggcaaccuugaggcccugagggaucucaauguuagaagaaaccaccuaguccaucucccagaagagcucgccgagcuuccacugaucagguuagauuucuccuguaacaagauaacuacgauacccgugugcuaucgaaaccugcgacaccuucagacaauaacccuggacaacaauccccugcaguccccacccgcccaaauauguauaaaggggaaagugcacauauucaaauaccucaauauccaagccuguaaaauagcccccgaucuacccgacuaugacaggagaccacucggguucgguucuugucacgaagagcuguauaguuccaggccauacggcgccuuagauucuggguucaauucuguggauucuggggauaaaagauggagcggaaaugagccaaccgacgaguuuucugacuugccuuuaagaguggccgagauuacaaaagaacaacgguuacgucgugaaagccaguaucaggaaaauagaggcucacucguggucacuaauggggggguggaacacgacuuggaucagauugauuauauagacagcuguaccgcagaagaggaagaagcggaaguacgccagccaaagggacccgacccagacucucuuuccagucaguucauggcauacauugaacagcgccgcauuucucacgaaggaucacccgucaaaccagucgccaucagagaauuucagaaaaccgaagauaugagaagauaccuacaucagaaucgcguacccgccgaaccuuccucucugcugucccugagugccucccauaaccaacuuucccacacagaccuggaacuucaccagaggcgcgaacagcucguggagcgcaccaggagagaggcccagcuggcagccuugcaguaugaagaagaaaaaauacggacgaaacagauucagagagaugcugucuuagacuuugugaagcagaaggcuagucaguccccacagaagcaacauccucugcucgacgguguagacggcgaaugucccuuuccuucucgcaggucccaacacaccgaugauuccgcuuugugcaugucauugaguggucugaaccaggucgggugugccgcgacccuuccucacucuuccgccuucaccccucucaagucugacgaccgcccuaacgcgcuucugucguccccugcuacugaaaccguccaucauucacccgccuauuccuuuccagccgccauccagagaaaccagccucagagaccggagucuuuccucuuucgggcggggguucgcgcugaaacaaacaaaggccacgccuccccucucccacccuccgccgcucccaccaccgauuccaccgauucaaucacuggccaaaauagccggcagagagaggaagaacucgagcuuauugaccaacugaggaagcauaucgaguaucgacugaaagucucccucccuugcgauuuaggcgcugcguugacagacggagugguucuuugucaccuagccaaccacgugcgaccaaggagcguucccucuauacacguucccucucccgcugucguuuccuag

SEQ ID NO: 13819 - RNA, 213 nt, Artificial Sequence; identical to SEQ ID NO: 12180
  Description of Artificial Sequence: Synthetic coding sequence

SEQ ID NO: 13820 - RNA, 789 nt, Artificial Sequence
  Description of Artificial Sequence: Synthetic coding sequence
auggcagcugccagcgccggugcaacaagacuucugcugcuguugcugauggccguagcagcaccaucuagagcucggggcagcggcugucgcgcuggaacuggugccaggggagccggggcugaggggagagaaggggaagccugcgggacgguaggguugcugcuugagcacaguuuugaaaucgaugacucagcuaacuucaggaaacggggcagccuucuguggaaccaacaggacggcaccuuaagccugagccagcgacagcuaagcgaagaggagaggggacgacugagggacguugcagcucuuaacggccuguacagaguuagaaucccuagacgaccaggagcucucgauggccuagaagccggaggcuacguuucuuccuucguaccagcuugcagccucguugagagucaccucuccgaccagcucacucuucacguagaugucgccgguaacguggugggcgucucuguagucacccacccuggaggcugccggggccacgagguggaagacguggacuuggaacuuuuuaacacaucuguacagcugcagccucccacuacagccccuggaccggaaaccgcagcauucauugagcggcuagaaauggaacaggcccagaaggcaaagaauccacaggagcagaaguccuuuuuugcuaaguauuggauguacauuauaccgguuguucucuuucugaugaugaguggagcuccugacacagguggacaaggaggcggcggcggggguggaggagggggcggaagugggcgguag

SEQ ID NO: 13821 - RNA, 150 nt, Artificial Sequence; identical to SEQ ID NO: 12182
  Description of Artificial Sequence: Synthetic coding sequence

SEQ ID NO: 13822 - RNA, 213 nt, Artificial Sequence; identical to SEQ ID NO: 12183
  Description of Artificial Sequence: Synthetic coding sequence

SEQ ID NO: 13823 - RNA, 711 nt, Artificial Sequence
  Description of Artificial Sequence: Synthetic coding sequence
augaugcccgccgagcgacgccugccacucucauuugugcuugaugugcuggaggggagggcacaacauccggguguuuuguaugugcagaaacaguguuccaauuuaccaucugaacucccccaacuacuaccugaccuagagucgcacgugccuugggccagcgaagcucucggaaagaugcccgaugcggugaacuuuuggcugggcgaagccgcugccgugacuagccugcauaaagaccacuaugaaaaucuguauugugucgugucuggcgaaaaacacuucuuauuccacccccccucugacagacccuucauucccuacggacuccgcgucccaggcuguuugcaguuuccacauacacuacuccccugggcaccagaguuguacacacccgccaccuaucaacucacagaagagggcaccuuuaaggucguggaugaggaagcaauggagaaggucccuuggauuccacuagacccauuggccccugacuuggcucgcuauccuucuuacagucaagcacaggcacugcgauguaccgugcgcgccggggagaugcuguacuugccugcccuuugguuucaucaugugcagcaaucgcaaggauguaucgccguaaacuuuugguaugauauggaguacgaccuuaaauauucuuauuuucagcuguuagauucccuuacuaaagcuucgggccucgacuag

SEQ ID NO: 13824 - RNA, 1098 nt, Artificial Sequence
  Description of Artificial Sequence: Synthetic coding sequence
auggcccccaaacucaucacuguucuuugccucggguucugcuugaaccagaagaucuguccacaugccggcgcacaagacaaguucucucuauccgcguggccaucuccagugguuccccuaggaggcaggguuacccugucuugucacucccaccugagguuugugauuuggaccaucuuccagacaacuggcacaagaucacacgaacuacacaccggacuuagcaauaacauuacaauuagcccugucacacccgagcacgccgguaccuaucgcugcgugggaauuuauaaacacgcaagcaaguggucagccgagucuaauagccugaagauuaucguuacaggccuguucacaaaaccuucaaucuccgcucaccccaguagccugguccacgcaggugcaagggucucucugcgcugucauucugaguuagccuucgacgaguucauuuuguacaaagaagggcacauacaacacucacagcaauuagaccagggaauggaagccgggauacauuauguugaagcuguauuuuccaugggacccgucacacccgcccacgccggugccuaucgcuguugcggcugcuuuucacacucucgauaugaguggucugcuccaagcgauccacucgacauuguuaucacaggcaaauauaaaaaaccaucucuguccacucagguugacccaaugaugcgucugggugaaaaacuaacccucuucugcaguagugaaauuagcuucgaccaauaccaucuguuuagacacggaguugcucauggccaauggcuguccggaggccagcgccacagagaggcguuucaagcaaauuuuucggucggacgagcaacccccgucccugguggcacguaucggugcuauggcaguuucaacgauucucccuauaaaccuccggugacccggugcaacuuuacgccacaagagaccuuaagagugcuccugugccauucccagaaucccccacugaaccucacaccuccauggcaaacucagucuccuaggaaagcaaauggacgaaugaagagaucccuccaacagaagagacaucgaagauccuacaugccaucauag

SEQ ID NO: 13825 - RNA, 198 nt, Artificial Sequence; identical to SEQ ID NO: 12186
  Description of Artificial Sequence: Synthetic coding sequence

SEQ ID NO: 13826 - RNA, 198 nt, Artificial Sequence; identical to SEQ ID NO: 12187
  Description of Artificial Sequence: Synthetic coding sequence

SEQ ID NO: 13827 - RNA, 237 nt, Artificial Sequence; identical to SEQ ID NO: 12188
  Description of Artificial Sequence: Synthetic coding sequence

SEQ ID NO: 13828 - RNA, 2868 nt, Artificial Sequence
  Description of Artificial Sequence: Synthetic coding sequence
augugggcgggucuucuuuugcgggcagcuugcgucgcacugcugcuuccaggggcaccugcaagggguuacacugggcguaaaccacccggccacuuugccgcggaaaggagaaggcugggaccucacguuugccuaagcggauucgguucagguugcuguccaggcugggcuccuaguauggggggcgggcacugcacucugcccuuaugcucauuuggcuguggauccggaaucugcauugccccaaacgucugcagcugucaggauggagaacaaggugccacaugcccugagacccacgggcccuguggagaguacggaugugaccucaccugcaaucacggggggugucaggaggucgcaagagucugcccagugggcuucuccaugacagagaccgcaguuggaauuagauguaccgauauugaugaaugcgucacaaguucuugugaggggcacugugugaauaccgaggguggauucgugugcgagugugggccaggaaugcagcucuccgcagacagacacucaugccaagacaccgacgaaugcuuaggaacaccaugccagcagcgaugcaaaaauaguauugguagcuacaaauguagcugucgaacaggcuuccauuuacauggaaauaggcacuccugcguggaugucaacgagugucggcgcccccuagagagaagaguuugucaucauucuugucacaacacugucgguucuuuucuguguacaugucgacccggauuccgccugcgcgcugauagaguuaguugcgaagccuucccuaaggccguccuggcaccaagcgcaauccuccagccacgucaacacccuucuaaaaugcugcuccucuugcccgaggccggaagaccugcacugaguccuggccacucaccucccaguggcgccccagggccuccugccggugucagaacuacccgacuucccucaccaacuccacggcugccuacuucuagcccaucugcgccuguuuggcugcucucgacguuacuugccacucccguuccuaccgccucacugcugggcaaccuccgaccgccaucccuccuccagggagaaguuaugggcacgccgaguucuccuagaggaccugaaucgccccggcuagccgcgggacccucacccuguuggcaccucggcgcaaugcacgagucgcggucccgguggacugaaccggguuguagccaguguuggugcgaagauggaaagguuacaugcgaaaagguccgcugcgaagccgcuuguucucacccaauaccauccagggacggcggguguugcccuucuuguaccggcugcuuucacagugggguagugcgagcugaaggggacgucuuuucuccucccaacgaaaauuguacagugugcgugugucuugcaggcaacgugucuuguaucagcccugaaugcccuucaggaccuugucagaccccgccucagacagauuguuguacaugcgugccaguuagaugcuacuuucauggacggugguaugcggacggcgccguguucagcggagguggggacgagugcaccacaugcgucugccagaacggggaggucgaauguagcuucaugccauguccggaacuugcguguccacgggaagaguggcggcuggguccaggacaguguugcuuuacgugucaggaaccuacaccuucaacaggcugcucucuagaugauaacgggguggaguuucccaucggacaaaucuggagcccaggggauccuugcgagcuguguauaugucaggcugacgggucagugaguugcaaaaggaccgacugcguugacucauguccucacccuauuagaauuccaggacaauguugcccugacugcucugcuggaugcacuuacacaggccgcauuuucuauaauaaugagaccuucccgucgguguuagacccuugcuugucuugcaucugccuccucggcagugucgccuguuccccuguugauuguccaauuaccuguacguauccauuucacccagacggagaauguugccccguuuguagagauugcaacuacgagggcaggaaggucgcaaauggccagguauucacacuggaugacgaaccgugcacucgcugcaccugccaguugggggaagucaguugcgagaagguccccugucagcgagcaugcgcugaucccgcacugcuccccggcgacugcugcucuucaugcccagauucacucucaccccuagaagaaaaacagggacuaaguccacacggcaauguggccuuuaguaaggccggacguucucuccacggugauacagaagcaccagugaauuguagcucguguccggguccaccaaccgcuucacccuccagaccagugcuccaccugcugcagcuucugcuaagaaccaacuugaugaaaacacaaacacugcccaccuccccugccggagcgcacggcccucauucccuggcauuggggcugacugccacguuucccggcgaacccggcgcaucuccaagacuguccccugguccaucuacccccccaggcgcacccacucugcccuuagccucucccggcgcaccacagcccccgcccguuacacccgagcgguccuucucugccucaggugcucagaucgugucacgguggcccccauuacccggaacauugcuaacugaggcuuccgcacuguccaugauggacccaagcccaaguaagacaccuaucacccuccucgggcccagagugcuuucaccuaccacaagucgacuuucaacagcucucgccgcuaccacucauccgggaccucaacagccuccagugggcgccuccagaggagaagaaaguaccauguag

SEQ ID NO: 13829 - RNA, 270 nt, Artificial Sequence; identical to SEQ ID NO: 12190
  Description of Artificial Sequence: Synthetic coding sequence

SEQ ID NO: 13830 - RNA, 600 nt, Artificial Sequence
  Description of Artificial Sequence: Synthetic coding sequence
auggaaacuuucccucuccuccuacucucccugggccugguauuagcagaagccucugaaagcacgaugaaaaucauuaaggaagaauuuacugacgaagagaugcaauaugacauggcaaaaagcggucaagagaaacagacuaucgagauacugaugaacccuaucuuacuuguuaagaauacaagcuuaagcauguccaaggaugauaugucuaguacccuguugacuuuuaggagccugcacuacaaugauccaaaggggaauucuaguggaaaugacaaggaguguuguaaugauaugacugucuggcggaaaguuuccgaagcaaauggaucuugcaaauggagcaacaauuuuauccguaguucuaccgaagugaugaggagaguccacagggcgccaaguugcaaguucguccagaauccaggcauuaguugcugcgaauccuuagagcuggaaaacacaguuugccaguucaccaccggcaagcaguucccaagaugucaguaccauuccgugaccucccucgaaaaaauacugacaguccugaccggacacucucugaugucauggcuaguguguggcucaaaacucuag

SEQ ID NO: 13831 - RNA, 729 nt, Artificial Sequence
  Description of Artificial Sequence: Synthetic coding sequence
auggcugccgccacccgcggaugucggccaugggguucccugcuuggguugcucgggcucgugucugccgccgcugcagcaugggaccucgccaguuuaagauguacauuaggagcauuuugugagugugacuuucgcccugacuuaccaggacuggagugugaucuggcucagcaccuugccgggcagcacuuggcuaaggcccucguugucaaagcccuuaaggcguuuguacgggaucccgcuccuaccaaaccacuuguucugucacugcacggauggacaggaaccgguaagagcuacgugucaucucuucuggcccauuauuuguuccaggguggacuucguucaccacgagugcaucauuucuccccaguucuccacuucccccacccaagucauauagagagauacaagaaagaucugaaaaguuggguccaaggaaaccuuacugcuugugggaggagucuguuccuuuuugaugagauggacaagaugcccccuggcuuaauggaagugcuucgcccguuucugggaaguucaugggugguauacgggacuaacuauaggaaggccauauuuauuuuuauccgcuggcuuuugaaacuaggccaucacgggagggcuccaccacgaagaagcggugcgcugccuccugccccugcugcaccuagaccggcacuuagagcucaacgggcugguccugcuggcccaggcgccaaaggauag

SEQ ID NO: 13832 - RNA, 627 nt, Artificial Sequence
  Description of Artificial Sequence: Synthetic coding sequence
auguuaggacuuuugguagcccugcuggccuugggacuugcuguguuugcccugcuggaugucugguaccuaguccgacugcccugugcuguucugcgcgcacgccuccuucagccccggguucgcgaucuucuagccgaacaaagauuccccgggcguguccucccuucagaucucgaccuccugcuucauaugaacaacgcucgcuaccugcgagaggccgacuuugcaagaguagcacaucuaacucggugcggcguguuaggcgcgcugagagagcugagagcgcacaccguccuugccgcuagcugcgccagacaccguaggucacucagacuacucgaaccuuucgaggugcgcacccgccuguuggguugggacgaucgugccuuuuauuuggaggcccgguuugugucauuaagggauggcuuugugugugcauugcuucgguuucgccagcaccuauuggggaccaguccugaaagggucguacaacaccuuugccaacgacggguggagccccccgagcugccagccgaccuucaacacuggauuucuuacaaugaggccucgucucagcugcugagaauggaaucaggauuaucugacgugaccaaggaccaauag

SEQ ID NO: 13833 - RNA, 423 nt, Artificial Sequence
  Description of Artificial Sequence: Synthetic coding sequence
augcugguaaagcuuaacucccaggcaagauugagcuccaugguuaagaaagugagacugccuucaagaugugagcccccagguacaacgugcaccguuucagggugggguaccacaaccucucccgacguaacuuuuccgucugauuugaugugcguugaugugaaacugauuagcccacaggacugcacuaagguuuacaaagaccuccuugaaaacucuaugcuuugcgccggcauuccugauagcaaaaaaaacgccugcaauggcgacagcggaggaccccuuguaugucguggcacccugcagggccuuguuaguuggggaacauucccuugugggcaaccuaaugauccuggcguguacacucaggucuguaaguuuacaaaguggauaaaugauacaaugaaaaaacauagauag

SEQ ID NO: 13834 - RNA, 354 nt, Artificial Sequence
  Description of Artificial Sequence: Synthetic coding sequence
augcucagcaaagcucauggcugcaagaccgcgcuuucauuaggccgcugcccgaagauccgugaggagugcgaguuccaggagagagaugugugcacuaaagaucgucagugccaggauaacaaaaagugcugugucuucucauguggaaaaaaaugccucgaccuaaaacaagauguaugugaaaugcccaaagagaccggccccugccucgccuauuuccuacauuggugguacgauaaaaaggacaauacauguagcauguucguuuacggaggaugucaaggcaacaacaauaacuuccaaucaaaagccaauugccuaaauacuugcaaaaauaaaagauuccccuag

SEQ ID NO: 13835 - RNA, 2328 nt, Artificial Sequence
  Description of Artificial Sequence: Synthetic coding sequence
augcacccaggacccgaagaagcugguucaggccgguauggcccgcgguauaucacugacaugggugccggagaagacgacgaaggcuuugaggaugaucuugaucucgacauuucauucgaagaggucaaaccacugccagcuacuaagggugggaauaaaaaauuucuuguagagagcaaaaaaauguccaucucuaauccuaagacuaucagcaggcucauuccucccaccucugccagccuuccuguuacaacuguagcaccccagccaauccccauccagcggaaaggaaagaaugguguggcaauuaugucacgacuguuugacaugccuugcgacgagaccuuaugcagcgccgauucuuuuugcgugaacgauuacaccuggggagguucuagaugucaaugcaccuugggcaaaggcggugagucgugcagcgaggacauugugauccaguauccccaauuuuuuggccacagcuacgugaccuuugaaccccugaaaaacaguuaucaagcuuuucagauuacucucgaauuccgggcagaggccgaggacggauugcucuuguauugcggagaaaacgagcaugguaggggugacuuuaugagcuuagcaauuaucaggcguucccugcaauuccgguuuaacugcggaacaggaguagcaaucaucgugucugaaacaaagauuaaguuggggggcuggcacaccgugauguuguacagagacggcuugaauggacuuuugcagcugaauaauggaaccccugucacuggccagagucagggacaauacagcaagauuacguucagaacccccuuauaucugggcggggcgcccagugccuauugguuggucagagcgacgggcaccaaucgcggauuccagggaugcguucagucucuagcugugaacggacgacgaauagacaugagaccauggccauugggcaaggcauuaucuggcgcugauguuggcgaauguucuucagggaucugcgaugaggccucauguauacacggcggcacgugcaccgccaucaaagcugacaguuauauuugucucugcccucucggguucaaagggcgccacugugaagacgccuuuacccuuaccauuccccaguuccgugagagccuacgaucuuacgccgcuaccccauggccucucgaaccacaacauuaccuguccuucauggaguucgaaauaacuuuuagaccugacucaggggaugguguacuccuguauagcuacgacacaggaaguaaggacuuucuguccauuaaucucgcagggggccauguugaguuucguuucgauuguggauccggcacaggcguacuaagaagugaggacccucugacgcucgguaacuggcacgaguuacgugugucacguacagcaaagaaugguauuuugcagguggacaagcaaaagaucguagagggcauggcagaaggcgguuucacccagauuaaauguaacacagauauauucaucggcggagugcccaacuacgaugacguuaaaaaaaauuccggagugcugaagcccuuuucugguagcauacaaaaaaucaucuuaaacgaucgcaccauccauguuaaacacgauuucacaucaggugucaaugucgaaaaugcugcccaccccugcguccgcgcaccuugcgcacacggagguuccugccggccgagaaaggaaggcuacgacugugacugcccccucggauucgaaggucuccacugucagaaggcuaucauugaagccauugaaauuccacaguucaucggccgaucauaccuaaccuacgacaaccccgacauucuuaaacgugugagcgggaguagaucaaacguuuucaugagauuuaaaaccaccgcuaaggacgggcuuuuguuauggcgcggggacucgccaaugcguccuaauagcgacuucauauccuugggucugcgcgacggcgcucugguguuuuccuacaaucuuggcagcgguguggccagcaucaugguuaacggcucauuuaaugacggacgcuggcaucgggucaaagcgguacgagauggacaguccgguaaaauuaccgucgacgauuacggagccaggacaggcaagucaccagggaugaugcgccaacugaacauaaacggggcuuuauaugugggaggaaugaaagaaauugcgcugcacaccaauagacaauacaugcgagggcuuguggguugcauuucccauuuuaccuuaagcacugauuaucauaucucuuugguggaggacgcugucgauggcaagaacaucaacaccugcggggcgaaauag

SEQ ID NO: 13836 - RNA, 1257 nt, Artificial Sequence
  Description of Artificial Sequence: Synthetic coding sequence
augagaacacuguucaauuuacuguggcuagcucucgccuguucuccaguucacacaacacuuagcaaguccgacgccaaaaaagcagcgaguaaaacccuucuagaaaaagugaaauucuguuccuguugucccgguuggucagcuauggcacgguccuggcugaccgcaacguccgccacccaaucacaguucuccgacaaaccagugcaggaucgaggccugguaguuaccgaccuuaaggccgagucaguaguccucgagcacaggucuuacuguagcgccaaggcaagagacagacauuucgccggggaugugcugggcuacguuaccccuuggaauucucacggauaugaugugacaaagguguuuggguccaaauuuacacaaauuucuccagucuggcuccaacuuaaacgacgcgggagagagauguucgaagugacagggcuccaugauguugaccagggguggaugcgggcuguuaggaagcaugcaaaaggccuucacauagugccuagacuacuguuugaagacuggacauaugacgauuucagaaacgugcucgauucagaggaugaaaucgaggaauuaucgaagacuguugugcaaguggccaaaaaucagcacuuugauggauucgugguggaaguguggaaucaacuguuaucgcaaaaacgugucgggcucauucacauguugacccaccucgccgaagcccuucaccaggcuagacuccucgcccugcuugugauuccaccagcuauuaccccaggcaccgaccagcuggguauguucacacauaaagaauuugagcagcucgcgccaguucucgauggauucucccugaugacuuaugacuacuccaccgcacaccaaccaggccccaacgccccauuaucgugggucagagccuguguucaaguacucgacccuaagagcaaauggagaucuaaaauacuucucggauugaacuucuacggaauggauuaugcaaccuccaaagacgccagggaaccugugguaggcgcaagguauauccaaacccugaaggaucaccguccaagaauggucugggacucucaggccagugaacacuucuucgaguauaagaaaaguagaucaggcagacauguggucuuuuaccccacacugaagagccugcagguccgacuggagcuggcaagagaacucggcgucgguguuaguauuugggagcugggccagggguuagacuauuuuuaugauuugcuguag

SEQ ID NO: 13837 - RNA, 813 nt, Artificial Sequence
  Description of Artificial Sequence: Synthetic coding sequence
augaugcuccgacuguugucgucucugcucuugguugccguggcgagugguuauggacccccaaguagcaggcccuccucccgaguggugaacggugaagacgcagugcccuauucguggcccuggcaaguuagccugcaguaugagaaauccgguucauucuaccacaccugcggcggauccuugauugcaccagacuggguugugacugcuggucauuguauuucaucauccaggacauaccaggugguucucggcgaguacgaucgcgcuguuaaagagggaccagaacaggugaucccuauuaauaguggagaccuguuuguucacccccuguggaaucgcucaugcguggcuugcggcaaugacaucgcucucauuaagcucucccguagcgcccaauugggcgaugcaguacaacuagcgucuuugcccccugcuggcgacauccuucccaaugaaaccccauguuacaucaccggaugggguaggcucuacaccaaugggccccugccugauaaacugcaggaagcacuguuaccagugguggauuaugagcauugcagccgauggaauugguggggaaguagugugaaaaaaaccauggugugugcaggcggagauauacgcucaggcuguaauggggauagcggaggcccacucaacugcccuacugaagacggcggcuggcaaguacauggcguaacgucuuuuguaagcgcuuuuggcuguaauacacggagaaaaccaaccguuuucacucgaguaucugcuuuuaucgauuggaucgaagaaaccauagcuucacacuag

SEQ ID NO: 13838 - RNA, 585 nt, Artificial Sequence
  Description of Artificial Sequence: Synthetic coding sequence
augaccaugcgccacaacuggaccccugaucucucuccucuguggguccuacucuugugcgcucacguggugacccugcuggucagagccacaccugugagccaaacgacuacugcugcuacagccuccguccgguccaccaaagaucccuguccgucucagccaccuguuuucccagccgccaagcaaugcccugcccuagaagucacauggccagaggucgaagucccucuuaauggaacccugagccuauccugcguagccuguucccgguuuccaaacuuuagcauucuuuauuggcucgggaacggauccuucauagaacauuuaccgggccggcugugggagggcucuaccaguagggaaaggggaucuacaggaacucaauuaugcaaagccuuggucuuggagcagcucacaccugcacugcacucaaccaauuucucauguguucucguagacccugaacagguugugcagagacacgucguguuagcucagcugugggcuggacuucgcgcaacccuuccuccuacacaagaggcacugcccaguucucauaguuccccccagcagcaaggauag

SEQ ID NO: 13839 - RNA, 1308 nt, Artificial Sequence
  Description of Artificial Sequence: Synthetic coding sequence
augcaaggccaggguagacgaaggggcacuugcaaagauauuuucugcaguaaaauggccaguuacuuauacggagugcuauucgcugucggcuugugugcccccaucuacuguguuucaccugcuaacgcucccagcgcuuacccgcgaccauccagcacaaaauccaccccugcaucccaagucuacagccugaacacagauuucgcauuccgccuguaucgcagacuuguucuagaaaccccaucucagaauauuuucuucucucccgugagcguuagcacuucuuuggcaauguuaagucucggggcccacagcguaacaaaaacacagauucugcaggguuuaggcuuuaaccucacacacacaccagaauccgcuauccaccaaggauuucaacaucuaguucacucgcuaacaguaccaucuaaggaccugacgcugaaaaugggauccgccuuguuugugaagaaggaacugcagcuucaggcuaauuuucugggaaaugucaagcgccuguaugaggccgaaguguuuucuacugacuuuuccaacccaagcauugcccaggcgaggauuaauucccauguuaaaaagaagacucagggaaaaguuguggacauuauucaggguuuggaccuucuuacagccauggugcuggucaaucacauuuucuuuaaagcgaaaugggagaaaccuuuccaucccgaauacaccaggaaaaauuuuccuuuucuugugggugagcagguaacugugcaugucccaaugaugcaccagaaggaacaguucgcauuugguguggauacagaacuaaacuguuuuguucugcagauggacuauaagggugacgccguugcauuuuuuguguugccuucaaaagggaagaugcgacaacuggaacaagcguugucugccagaacuuugcgaaaauggucccauagccuucagaagagauggauagaaguguuuaucccaagauuuuccauaucagccuccuacaauuuagaaacuauucuuccaaaaauggguauccagaauguuuuugacaagaacgccgauuucucagggauugccaagagagacagucuccaagucuccaaagccacacacaaagcagugcucgauguuucugaggaaggaacugaggcaacggccgccaccacaacaaaguucaucgugcgaucuaaagaugggcccuccuauuuuacuguguccuuuaaucgcaccuucuugaugaugaucacaaacaaagcaacagacggcauucuauuucucggcaaaguugagaacccaacaaaguccuag

SEQ ID NO: 13840 - RNA, 393 nt, Artificial Sequence
  Description of Artificial Sequence: Synthetic coding sequence
auggcuuccgacuugauacgaacuauccucgccgucgcuuuaaucucaaaacuggggaccgccguugaugcggagcuuaugccuaguggagcgauccugcagaacaaacgcgagaaucuuccuagaguuugucacgcacucgccuuucuugguauggcgcguugucaagaccuguuucuuguccgauugcagggauggaaauuggguaccagguuccaggauggccccagaucaacuccacaggaggaggggggcucuccacaaagaaagagagggaugccugugcagauucacuuccugcugaaaucauuucuaucaucuccaauaacuuucgccuuuaucagcuuagcacgcaccgugagucuagccaccgcuauauguaagauugucuag

SEQ ID NO: 13841 - RNA, 837 nt, Artificial Sequence
  Description of Artificial Sequence: Synthetic coding sequence
augcaguggcugcgaguccgagagucaccaggggaagcgaccggucaucgcguuacaaugggcacagcagcauuaggacccgugugggcggcgcuacuauuauuucuucugaugugugaaaucccaauggucgagcucacauuugacagagccguugcuuccgguugccaacgguguugugauuccgaagacccccuggaucccgcacacgucucuagugccucuucuucaggacgcccccacgcucuuccagaaauacgucccuauauaaacauuacgauccugaagggggauaaaggagaucccgggccuauggguuugccuggcuauaugggacgugaagguccucaaggagagccugguccccaggguaguaaaggggauaaaggagaaaugggcagcccaggugcuccuugucagaaaagguuuuucgcauucucugucggacgcaagacagccuuacacaguggggaagacuuucaaacucuccuguucgagcgcguguuugucaaucuggacggcuguuuugauauggcaacaggacaauuugcugcuccauugcgcggaauuuauuucuucagucuuaacguucacucuuggaacuacaaagaaacauacguacacauuaugcacaaucagaaagaagccgugauccuuuaugcacagccaagcgaacgauccauuaugcagucacagucagucauguuggaccucgcuuacggcgaccgggucugggugcggcuguuuaaacgacaaagggagaacgccaucuacagcaaugacuuugacacuuacaucacauuuagcggacacuuaaucaaagccgaagacgacuag

SEQ ID NO: 13842 - RNA, 1635 nt, Artificial Sequence
  Description of Artificial Sequence: Synthetic coding sequence
auguguacagugguggaccccagaauaguucgcagauacuugcugagaagacaacucggacagggcgcuuacggaauaguguggaaggcagucgaucgccguaccggagaagucguggccauuaaaaaaaucuuugacgcuuuccgcgacaaaacagaugcccaaagaacguuccgcgagauuacacuauuacaggaauuuggcgaucaucccaacauuauuucccuccucgacgugauacgcgccgagaacgacagggacauuuaccuuguguuugaauuuauggauaccgaccucaacgcaguaaucagaaaaggcggacuguuacaggauguucauguacggagcauuuucuaucaguuauuacgcgcuacgcguuuucugcacuccggccauguggugcaucgcgaucagaagccaucuaauguucugcucgacgcaaacugcacagucaagcuaugcgacuucgggcuagcucgaagucuaggagaucuucccgaagggcccgaggaccaggcuguuacagaauacgucgccacccgaugguaccgggcuccugaaguguuauuaaguucucacagguacacucuggguguggacauguggucuuuaggauguauuuuaggugagaugcugcgaggaaggccgcucuuuccaggcacgucgacacuccaccaacucgaguuaauucuugagaccauaccacccccuagcgaagaggacuuguuggccuugggcucagguugccgugcauccguguuacaccaacuuggcucacguccucgccaaacccuugaugccuuguugccacccgauacuagucccgaagcccuggaucuguuacgccgccuguuaguguucgcccccgacaaacgacugucugccacccaggcccuccaacaccccuauguucagcgcuuccacugcccuagcgaugaaugggcaagagaagcugauguucgccccagagcucacgaaggcguucagcuauccguaccggaauauagaucuagaguguaccagaugauauuagaauguggagguuccagcggaacaagccgggaaaaaggccccgagggggucagcccaagccaggcacauuugcacaagccacgcgccgauccacagcugccaagcagaacccccguacagggccccaggcccagaccucagagcagccccggccacgaccccgccgaacacgagagcccgcgcgcagcaaaaaauguuccccgacagaauucggccccuuugcugcaaaccgcacuccuaggcaauggagaacggcccccuggagcuaaagaggcuccaccgcugacacugucccuuguuaagccuuccggccgcggcgcugcucccucacucacgucucaggcugccgcccaaguugcaaaccaggcucuuauucggggcgacuggaaucguggaggaggcgugcgaguggcaagcgugcagcagguacccccacggcuuccaccugaggcccgaccaggccguagaauguuuuccacuucggcacugcagggagcacagggaggcgcccgugcauugcugggugguuacucccaagcauauggaaccgucugucauucugcccuuggacaucuucccuugcucgaaggccaucaugucuag

SEQ ID NO: 13843 - RNA, 399 nt, Artificial Sequence
  Description of Artificial Sequence: Synthetic coding sequence
augaagucuuccggucucuuuccguuccucguccugcuugcccucgguacccuggccccaugggcggucgaagguuccggcaaauccuucaaggcgggaguuugcccgccgaagaagucagcacaaugccucagauacaaaaagcccgagugccaguccgauuggcagugcccuggcaaaaagcguuguugcccugauaccuguggaauuaagugccuggacccuguugacacacccaauccaacuagaagaaagcccggcaagugcccugugacauacggucaguguuuaauguugaacccaccuaacuucugcgagauggacggucaaugcaaacgcgaucuuaaaugcuguaugggcaugugcggaaaaucuugugucucucccguuaaagccuag

SEQ ID NO: 13844 - RNA, 1401 nt, Artificial Sequence
  Description of Artificial Sequence: Synthetic coding sequence
augaagcccccucugcucguauucauugugugccugcuguggcugaaagacucccauugugcccccacauggaaagauaagacugcaaucagugagaaccugaaauccuucagugaaguuggagagaucgacgccgaugaagagguuaaaaaagcccuaaccggaauaaaacagaugaagaucaugauggagcgaaaagagaaagagcauaccaaucugaugaguacucugaaaaagugccgggaggaaaaacaggaagcucugaagcugcugaacgagguccaggaacauuuggaagaagaagagagacuguguagagaaucguuggcagauucuuggggagaaugccguagcugccuggaaaauaacuguaugagaauuuacacaacgugucagccaucguggucaucggugaaaaacaaaauugagagauuuuuucgcaagauuuaccaguucuuguuucccuuccacgaagauaaugaaaaagaccuuccuauauccgagaaacuuauugaggaagaugcccagcuuacccaaauggaagacguauucagucaguugacuguagaugugaauucccuguuuaaccgcagcuuuaacgucuucagacaaaugcagcaggaauuugaccagaccuuccaaagccauuuuauuagcgacacugaucuuacagagccguauuuuuucccugcauucuccaaagaaccaaugacuaaagccgaucuugagcagugcugggauaucccaaauuuuuuccagcucuuuuguaacuucuccgugaguaucuaugagucaguaucugagaccaucaccaaaaugcugaaagcuaucgaggaccuccccaagcaggauaaagcaccugaucauggaggacugauuucuaagauguuacccggacaggauagagggcuguguggugaguuagaucaaaaucugagcaggugcuucaaauuccacgaaaaaugccagaagugccaggcacaucucucugaagacuguccugacguacccgcgcugcacaccgagcuugacgaagcuauucgacuggucaaugucucaaaucaacaguacggacagauacugcaaaugacuagaaaacaucuggaggacacagcuuaucucguugagaagaugagagggcaauuugguuggguaucagagcuugccaaucaagcgccagagaccgaaauaaucuucaauagcauacaagucgugccaagaauccaugaagguaacauuuccaaacaggaugaaaccaugaugaccgacuuguccauccucccaagcuccaauuucacacucaagauuccucuggaagagucagcagagagcagcaacuuuauuggcuacguugucgcuaaagcccuccagcacuuuaaagaacauuucaagacaugguag

SEQ ID NO: 13845 - RNA, 522 nt, Artificial Sequence
  Description of Artificial Sequence: Synthetic coding sequence
augcacuggaagauguugcuacuacuccuccuguauuacaacgcugaggccucuaugugccaccgcuggagucgggcaguccuguuucccgccgcacaucgaccgaaaagaaguuccagccucccgcuaaauccaguacugcaaacuucccucgaggaagucgaacuacuguaugaguuuuuguuggccgagcuugaaauuucccccgaccuacaaaucagcauaaaagacgaagagcuugcuagcuugagaaaagcauccgacuuucgaaccguaugcaacaaugugaucccgaagagcaucccggauauacgucguuuauccgccucucucagcucgcauccagguauucuaaaaaaagaagauuucgagcguaccguucuaacucuggccuacacugcguacagaacggcccuuagccacggacaccagaaagacaucugggcccagucauuaguguccuuauuucaagcacucaggcaugaucugaugagguccucacagccaggcgugccccccuag

SEQ ID NO: 13846 - RNA, 1473 nt, Artificial Sequence
  Description of Artificial Sequence: Synthetic coding sequence
auggaagauuccgacagugcugccaagcagcucggacuugcagaagccgcagcagucgcagcugcagccgcaguugcugccgcugcugccgccgccgcaggaggggaagcagaagagccaguguuguccagagacgaggacucagaggaggacgccgauagcgaggcugagagggaaaccccccggguuacagccguggcuguaauggcagcagaacccggucacauggacaugggagcagaggcucucccaggcccggaugaggcugccgccgcugccgccuuugcugaaguuaccaccgucacagucgcaaacgucggggcagccgcugacaauguauucaccacgagcgucgcuaacgcggcaucaaucuccgggcauguacugagcgggagaaccgccuugcaaauaggggacagucugaauacugaaaaggcaacacugauuguggugcacaccgaugguuccaucguggagaccacuggauuaaaaggcccugcagcaccacuaacaccaggcccacaaagcccaccaacuccacucgcacccgggcaggaaaagggggggacuaaauauaauugggauccuuccgucuacgauuccgaacugccuguuagaugcagaaauaucucaggaacccucuacaaaaaucgacucgguucggguugggacuugaagccauccaggugucugcuacaucugugcugccuguugcggagacaugaccuaaucacagugacacccucugggcagaucaccacuuccggagcucugacauucgaccgcgccuccaccgucgaagcuacagccguuauuucugaaagccccgcucaaggugauguguuugccggcgccacuguccaagaagcauccguucagccucccugccgggcaagucaucccgaaccgcauuacccaggcuaccaggauucaugucagaucgcaccauuccccgaggccgcuuugccuaccucacauccuaaaaucguacugacuucacuucccgcucucgcaguaccaccaccaacaccgaccaaagccgcaccuccagcucucgugaacggcuuagagcuuagcgaaccccggagcuggcuguaucuugaggagauggugaacucacuccugaacaccgcucaacaacugaagacacucuucgaacaggccaagcacgcaagcaccuauagagaagccgcaaccaaucaggccaagauucaugcugacgcagaaagaaaagagguuauccacccaccaagacugccgaaaguacugggcuuacaacagaguugugugaauugcgguagagaggcgaugucggaguguacaggcugccacaaaguaaauuauuguucuacauucugucagcgcaaagauuggaaagaucaccagcauauuugcggucagagcgcagcugugacaguucaggcagaugaggugcaugucgcagaguccgucauggagaaaguaaccgucuag

SEQ ID NO: 13847 - RNA, 1476 nt, Artificial Sequence
  Description of Artificial Sequence: Synthetic coding sequence
augccauccacaguucugccgucuaccguuuuaccuuccuugcugcccacugcaggcgcuggcugguccaugcgcuggauacucuguuggucucucacucuaugucucauggcccaaacagcacugggagcucuccauacgaaaagaccccaaguggugacuaaauaugguacccuccaggguaagcagaugcaugugggcaaaacaccuauacagguguuucugggaguccccuucaguaggccuccuuugggcauucugcguuucgcccccccugagccaccugaaccuuggaaaggaauucgugacgccacaaccuacccucccggauguuuacaggaaucguggggucagcuggcguccauguacgucuccacuagagaacgcuacaaguggcugagauuuagugaggauugcuuauaccuuaauguguacgcgccagcucgcgcucccggugacccucagcugcccgucauggugugguuuccagguggggccuucauagucggcgcggccucuucauacgaggguuccgacuuagccgcuagagaaaagguuguccuugucuucuuacagcacagacuggggauuuuuggguucuugaguacugaugauucccaugcgagaggaaacuggggacuucuggaucagauggcagcucuccgcuggguacaggagaauauugcugccuucggaggagauccaggcaacgugacucuauucggccaaucagcaggcgccauguccauuuccggccugaugauguccccucuggcgucaggccucuuucacagagcuaucagccaguccggcacagcacuuuuccgacuguuuauuaccuccaacccuuugaaagucgccaaaaaaguugcccauuuggcaggcuguaaucacaauucuacgcagauccuggugaauuguuugcgagcccuuuccgguacaaaggucaugcgcgugucuaauaagaugagguuccuucaacugaauuuccagagggacccugaagaaauaauuuggucuaugucucccgugguggacggaguggugauuccugacgacccucuuguccuccugacucaaggcaaaguguccuccguuccauaccugcucggcguaaauaaucucgaguuuaauuggcuccuucccuauauaaugaaauucccgcuuaaccggcaagccaugcgaaaagaaacuauuacuaagaugcuuugguccacucgaaccuugcugaauaucacgaaagagcaagugccauuggugguugaagaauaccuugauaacguaaaugaacacgacuggaaaaugcuucggaacagaaugauggacaucgugcaagacgcgaccuuuguauacgccacucuccagacugcacauuaucauagagagacaccaaugaugggaaucugcccugcuggacacgccacuacccguaugaagucuaccugcaguuggauuuuaccccaggagugggcauag

SEQ ID NO: 13848 - RNA, 753 nt, Artificial Sequence
  Description of Artificial Sequence: Synthetic coding sequence
augcccgcaagcagucccuuuuuguuagcucccaaaggcccgccgggcaacaugggcggaccaguacgugagcccgcgcugagcguugcccugugguugucguggggagccgcccugggagcuguagcgugugccauggcccuacucacucagcaaacagagcugcagagcuuacgucgggaagugucccgccugcagggaaccgguggcccaagucagaacggagaaggguauccguggcagucauugccugagcagucuucugacgccuuggaggccugggaaaauggcgaaaggucucggaaaaggcgugccgugcuuacgcagaagcagaaaaagcagcauucugugcuccaucuaguaccuauuaacgcuaccuccaaagacgacagcgauguaaccgaagugauguggcagccugcccuucgaagaggacguggucuccaggcucagggcuaugggguaagaauucaggaugccgggguuuaucuacucuacucccagguacucuuucaggacguuacauuuacgaugggucagguggucaguagagaaggccaagggaggcaagaaacucuauuucgguguaucagaagcaugccgucccauccagauagagccuacaacucaugcuacucggccgguguguuccauuugcaccagggugacauccucucagugauuauuccacgagccagagcaaaauuaaaucucucuccccacggcaccuuccugggauuugugaaguuauag

SEQ ID NO: 13849 - RNA, 1437 nt, Artificial Sequence
  Description of Artificial Sequence: Synthetic coding sequence
augaguccuccccugcuaaaguuaggagccgucuuaucaacaauggcuaugaucaguaauuggaugagccagacccucccuucccuuguuggacucaacacaacucgacugucuaccccagacacccucacucagaucucuccaaaggagggguggcagguuuacucuucagcacaagacccugaugggcguugcaucugcacagucguugcccccgaacagaacuuaugcucccgcgaugcuaagucacgccagcuccgacaacuccuggagaaaguucagaauaugucccaaagcauagaaguuuuaaacuugcggacacagagggacuuccaguauguccuaaaaauggaaacacagaugaaaggccugaaagcgaaauuuaggcaaauagaagaugaccgcaaaacacugaugaccaaacacuuccaggaacugaaagaaaagauggacgaacugcugccccugauuccugucuuagaacaauauaaaacagaugccaagcugaucacccaauucaaagaggaaauaagaaaccuuuccgcuguacucaccggaauccaagaagagauuggggcuuaugauuacgaggaauugcaccagcggguacugucucucgaaaccaggcugcgggacuguaugaagaaauugaccuguggaaagcugaugaaaaucacuggccccgugaccgugaagacgucaggcacacgauuuggagcuuggaugaccgacccuuuagccucugagaaaaauaaccggguaugguauauggauucuuauacaaacaauaaaaucguccgcgaguacaagucuauugccgauuuugucucuggggcagagucuagaacuuacaaccuucccuucaagugggcaggcacaaaucacgugguguauaacggcagucuauacuuuaauaaguaucagucaaacauaauuauuaaguacaguuucgauaugggccggguucuagcacagagaucucucgaauacgcaggcuuucauaacguguaucccuauaccuggggcggauucagugauauugaucugauggccgacgagauuggucugugggcaguguaugcuaccaaccaaaaugcugguaacaucgugauuucccaguugaaucaggauacucuggaggucaugaaaucguggucuacgggauacccuaagagaagcgcaggugaauccuuuaugaucugcgggacgcuguacgugaccaacucccacuugacaggggcuaagguguacuauuccuauagcacgaaaacuucuacuuacgaguauacugacauacccuuccacaaucaauacuuucauaucuccaugcucgacuacaacgcaagggaccgagcgcucuacgcauggaacaauggccaucagguauuguuuaacguuacccuuuuccacauuauuaagaccgaagaugauaccuag

SEQ ID NO: 13850 - RNA, 1101 nt, Artificial Sequence
  Description of Artificial Sequence: Synthetic coding sequence
auggcacgagagcgcccucccggacgcggaugcgguguacuccgucguugcuuguugggcgccguguuacuguuuggacugcgucucugcgcugagcugagaagagccggcccaggcucaccuacucgguccgcuccaccaggcccagcuuggagaccacccggcccacaccugccccccgcaccagggcagccacgaggcgcuuccagaaggcaagugacauacguccggucaggaagacgcgcaccaccaggagggggcggcucaggaacaccagagccugguugcugugcuccacgcggcaggccuagacgaaaaggcccccgguggcacauugaccuccaacccugggcggggagcgcucaaagccuggacgaagaagccuggagauuucuccgguacaucagcaccacacaaauugcuugcaaucauaugaacaccgacucauuggccacagauagcagucccacccacaaaccuuggucagucugcuuggaugauagauucaaucucgcucaccagaucagaaacaaacagugucgccuguacucacuggggcuuggaucugacgacacacauuucgaaguaagcauggcaaacaaugguugcgaagugcaccgauucgacccuucagugaaguccgcacauauacuugaaagucagcaccugugguaucaccggcucagcauugauuggcgugacccgcauccagcgguggcagcucagaaaccccauagcaauacccgcaaauuaggcagcauccucaacgaguuugggcaccauaagauugacguauuaaaggcagauuuggagagcgccgaauggaaaguucuggagaaucugauccucgaagacguacuggagcagaucggacagcuaauuuuugagauacaccugcauuggccagguuucgaagugucaggaagcgauucuaguguggugcgcuuuugguacuccuugcugaaggaauuggagcagaaggacuuucgguuauuucauucuuacaaagauuugucaaaaccucagcuguuccugaagaaagauaucuuuaaugccaguucauguuauacucuguccugggugaacacucgauggaaauag

SEQ ID NO: 13851 - RNA, 300 nt, Artificial Sequence; identical to SEQ ID NO: 12212
  Description of Artificial Sequence: Synthetic coding sequence

SEQ ID NO: 13852 - RNA, 618 nt, Artificial Sequence
  Description of Artificial Sequence: Synthetic coding sequence
augaugagaacucugauuaccacucacccacuuccccugcugcuauuaccucaacaguuacugcagcucguccaguuccaggaaguggacacugauuuugauuucccugaggaggacaaaaaagaggaauucgaagaauguuuagaaaaguucuuuucuaccggaccagcccgcccccccacaaaggaaaaggugaagagaaggguauugaucgaaccggggaugccacuuaaucacauugaauauuguaaucaugagaucauggguaaaaacguguacuauaagcaccgcugggucgccgaacauuauuuucugcucaugcaguaugacgaacuucagaagaucuguuauaacagauuugucccauguaagaaugguaucagaaagugcaaucggaguaaagggcugguagagggcguguauugcaaucuuaccgaggcauuugaaauuccugcuuguaaguaugagagccuguauaggaaaggauacgucuuaauuacuuguucuuggcagaacgaaaugcagaaacggauuccccacaccaucaacgauuuaguggaaccuccugagcacagaucauuuuugagcgaagacggcguguuuguaauaucaccauag

SEQ ID NO: 13853 - RNA, 402 nt, Artificial Sequence
  Description of Artificial Sequence: Synthetic coding sequence
augcucgacuggagacuggcaagcgcucacuuuauacucgcaguaacacuuacccuuuggagcaguggaaaaguucuauccgucgauguuacuacaacugaagccuuugauuccgguguaauugaugugcagucuacuccuacggugagggaggaaaagagcgcuaccgaucugaccgcuaaacuucuucugcucgacgagcuggucagccuugaaaaugacgugaucgaaacaaagaaaaagcgaucuuucaguggcuuuggaagcccccucgauaggcucucagccggguccguggaucauaaaggcaaacagaggaaaguuguggaccaccccaaacgccgauucgggauuccgauggacagaauaggcagaaacagauugagcaauucaagaggcuag

SEQ ID NO: 13854 - RNA, 846 nt, Artificial Sequence
  Description of Artificial Sequence: Synthetic coding sequence
auggguuccagaggccaaggauuacugcuggcguauugucuccugcuugcauucgccucaggcuuagugcugagccgagugccccauguucagggggaacagcaagaaugggaggggacugaagagcuaccaucaccaccagaucacgccgaaagggccgaggaacagcacgagaaauacagaccgucucaggaccaaggacugcccgccaguaggugucugagaugcugcgaccccgggaccagcauguaucccgccacugccgugccacagauuaauaucaccauucucaagggagagaagggagauagaggggacagaggacuccagggcaaguacgggaagacaggcucagcaggcgccagaggucacacugguccaaaaggacaaaaagggagcaugggugcgccuggcgaacgcugcaagagccacuacgccgcuuuuagcgucggccgcaaaaaaccaaugcauucuaaucauuacuaccaaacaguuauuuuugacaccgaauucguuaauuuauaugaucacuucaauauguucacagguaaguuuuacugcuauguccccggucuauacuuuuucaguuuaaaugugcacacauggaaccagaaagagaccuaucuacauauuaugaaaaacgaggaagagguuguuauuuuguuugcacaaguaggagaucggucgaucaugcaaucccagucauuaaugcuugaacucagagaacaggaccaaguuugggugagacuguacaagggcgagcgcgaaaacgccaucuucagugaagaacuggacacuuacaucaccuuuucuggcuaucucgugaagcaugcuaccgagccuuag

SEQ ID NO: 13855 - RNA, 132 nt, Artificial Sequence; identical to SEQ ID NO: 12216
  Description of Artificial Sequence: Synthetic coding sequence

SEQ ID NO: 13856 - RNA, 861 nt, Artificial Sequence
  Description of Artificial Sequence: Synthetic coding sequence
augaaaguauuacuacuuaccgggcucggugcauuguuuuucgcuuacuacugggacgauaauuuugauccagccucauugcagggagcuagggugcuguugacaggagcuaaugcagggguaggcgaagaguuagcuuaucacuacgccaggcuuggcagccacuuaguacugaccgcccacacagaggcucuguuacagaaaguaguggguaacugccgaaaacugggcgccccuaaaguuuuuuauauugcagcagauauggcuucaccugaggcaccagaaagcguugugcaguuugcacuugacaaguuaggcgggcucgacuaccucguucucaaccauauuggcggggccccugcagguacaagggcucgauccccacaggccaccagaugguugaugcaagugaauuucguuaguuauguccagcuuacuucgcgggcucucccauccuuaacugacuccaaagguucacucguuguuguaucgucccugcuuggccgagucccuacuuccuuuuccacaccuuauagugccgccaaguuugcauuggauggcuuuuucggaagccugaggagagaauuggauguacaagacgugaauguggcuauaacaauguguguguuggguuugcgggauagagcaagugcugcugaggcugugagaggagugacgagagugaaagccgcaccaggacccaaagcugcccuggcaguuauucgcggcggugcuacccgugcugcaggaguguuuuacccauggagauuccggcuuuugugccuguugcgucguugguugccacguccccgggccugguucauuagacaggaacucaacguuacugccgcugcggcauag

SEQ ID NO: 13857 - RNA, 1326 nt, Artificial Sequence
  Description of Artificial Sequence: Synthetic coding sequence
augcggguggucacaaucgugauucugcuguguuuuuguaaagccgcugaauugcgaaaagccucaccgggauccguuagaaguagaguuaaccacggcagggcugguggagggcggcggggcagcaauccugugaaacgguaugcuccuggccuaccaugugacguguauacauacuugcaugagaaguaucuggacugucaggaaagaaaacugguuuaugugcucccugguuggccacaagaccuccugcauaugcuuuuagccaggaauaaaaucagaacacuuaagaacaauauguuuucaaaguuuaagaaguuaaaaagccuagaucuacagcagaacgagaucagcaagaucgagucugaggccuucuucgggcuuaacaagcucaccacccugcuccuccagcauaaucaaauaaaagugcuaaccgaagaaguauucauuuacaccccccuacucucauaccuacgacuguacgauaaucccuggcauuguacaugugaaauugagacacugaucagcaugcuccagaucccuagaaauagaaaccucgguaauuacgccaaaugcgaaagcccacaagagcaaaagaacaagaagcugcgccaaauaaaaucugaacagcuguguaacgaagaagagaaggagcaacuagaccccaagccacagguuucagguaggccccccgugauuaaaccggaaguggauagcacuuuuugucacaacuauguuuuucccauucaaacauuagauugcaagcgcaaagagcugaaaaagguuccuaauaauauuccaccagacauuguuaaguuagacuuaagcuauaauaaaauaaaucaacugagaccgaaagaguucgaggacguacacgagcugaaaaaauugaaccugaguagcaaugguauagaauucaucgauccugcagcauuucugggccugacccaccuggaggaguuggauuugucaaauaauagccugcaaaauuuugauuacgggguucucgaagacuuguauuuccugaagcuuuuguggcugagagacaauccauggagaugcgauuacaauauucacuaccuuuacuacuggcugaaacaucauuauaacguacauuuuaacggucuagaauguaaaacuccugaggaguauaaaggcugguccgugggcaaguacauaagaucauacuaugaggagugcccaaaggacaaguugccggccuauccugaaucuuucgaccaagacaccgaggaugacgagugggaaaaaaaacauagagaucauaccgccaagaaacaaucugugauuauuacaauuguaggcuag

SEQ ID NO: 13858 - RNA, 1539 nt, Artificial Sequence
  Description of Artificial Sequence: Synthetic coding sequence
auggcggaauccggccucgccauguggccaagccuucugcugcuccuucuauuaccagggccaccuccgguugccggucuggaggacgcagccuucccacaccugggagaaucccuccagccccugcccagagcuugcccccucagauguucuugcccuagaguggacacagucgacugcgacggauuagaucuacgcguguuccccgacaacauaacccgugcugcacaacacuuaagccuucaaaacaaucaauuacaagaguugcccuacaacgagcuuagccguuugagcggcuugcggacccuuaacuuacacaacaaccugauuagcuccgaaggccuacccgacgaagccuuugaaagucuuacacagcugcaacaucuaugugucgcgcauaauaaacucuccguggcgccacaauuuuugccgaggucucugcgcgucgccgacuuggcagccaaucagguuauggaaaucuucccauuaaccuuuggugaaaagccugcacuuagaucugucuauuugcauaauaaucagcuuuccaaugccggccuaccuccagaugcguuucgaggcucugaagccaucgcuacccugucacugagcaauaaucaacuguccuaccugccuccuucucuacccccgagccucgaacgauuacaccugcagaauaaccuaauaucuaagguaccucgcggagcgcucagcagacaaacacagcucagagaacucuaucuccagcacaaucaacuuaccgacagcggguuagacgccaccacauuuagcaaacugcauucccuggaauaccucgaccucucucacaaucaacuaacaacgguccccgccggacuuccccgcacuuuggcgaucuugcaucugggucgaaaucgcauccgacaggucgaagccgccagauugcauggagcucguggucugcgauaccuucugcuucagcauaaucaguuagggagcucuggccuuccugccggagcccuccgaccucuaaggggcuugcacacacuccaccuauacgguaauggacucgaccgcguuccaccugcuuugcccagaaggcugcgggcgcuggucuugccacacaaccacguagcagcuuugggagccagggaccugguugcuaccccuggucuaaccgaauugaaucuggcuuauaauagacucgccuccgcacgcgugcaucaccgagcguuuagacgucucagagcccuacgaucauuggaccucgcagguaaccagcugacaagauugccuaugggccugccaaccggcuugcgaacacugcagcuccaaagaaaccaauuacguaugcuugagccggaacccuuggccggccuagaccaguugcgagaacugucauuggcacacaaccgccucagaguuggggauaucggacccggcacuuggcaugaacuccaggcccugcagguucggcaucgacuggucucacacacagucccccgagcuccaccaucacccugucuuccgugucauguccccaauauccuuguguccugguag

SEQ ID NO: 13859 - RNA, 2328 nt, Artificial Sequence
  Description of Artificial Sequence: Synthetic coding sequence
augaaagaagguccagaagaagcaggcagcggacgauacggcccacgguacauuacagacaugggggccggugaagaugacgagggcuucgaggaugaccucgauuuggauaucucuuucgaggagguuaagccucuccccgccacaaagggaggaaacaagaaauuucuggucgagucgaagaagaugagcaucuccaauccaaaaaccauaucucgguugaucccaccuaccuccgcgagccucccagucacuacaguagcuccccaaccaauuccaauccaaagaaagggcaagaauggaguggcaauaaugaguagguuguuugacaugccuugcgaugagacucuaugcucagcagauucguucugcguuaaugauuacacaugggguggcaguagaugucagugcacucucgggaaaggaggugaaagcuguucugaggacauagugauccaguacccacaguuuuuuggucauuccuacgucacauuugagccucucaaaaacuccuaucaggccuuucagaucacacuggaauuuagagcugaagccgaagacggccugcuucuguauuguggagagaacgaacacgguaggggugauuucaugagucucgcaauuauucguaggaguuuacaguucagguucaacuguggcaccggaguggcgaucauugugucugagacaaagauuaagcuggguggcuggcauacagucauguuauaccgugacggucuuaacggucuguuacaacucaacaacggcacccccguuacaggccagagccagggccaauacucaaaaaucacauucaggacacccuuguaucugggcggagccccaucugcauauuggcuggucagagccacugguacaaaccgcggcuuucaggguugcguacaaucccuugccgucaacggaaggaggaucgacaugagaccuuggccacucgguaaggcgcugucuggcgccgacgugggugaauguucaucaggaauuugugaugaggcauccuguauccauggcggcacuugcaccgcgauuaaagccgacucuuauaucugccuguguccacucggguuuaagggaagacauugcgaggacgcuuuuacucucacuaucccccaguuucgugaaucuuugagaucuuacgccgccacgccuuggccccucgagccucagcacuaccuuucauucauggaauuugaaaucacuuucagaccugacuccggagauggcguucugcuauacagcuaugacaccggaagcaaagauuuucucuccauuaaucuggcuggaggacauguugaguuucgcuuugauuguggaucagguaccggaguccucagaucagaagacccacugacccuaggcaacuggcacgaguuacgagugagcaggacagcaaagaacggcauacugcaagucgacaaacagaagauuguggaggggauggcggagggaggauuuacacagaucaaauguaacaccgauaucuucauuggaggagucccuaauuacgacgaugugaaaaagaauucaggcguauugaaaccauucagcgguagcauucagaagauuauauuaaaugacagaacuauucacgucaagcacgauuuuacaagcggagugaauguggagaaugcagcucauccauguguccgcgcacccugugcccacggcgggaguuguagaccccggaaggaagguuacgacugugauugcccccugggguuugaaggucuucauugccagaaagccauuaucgaagccaucgagaucccucaguuuauaggcagguccuacuugacauacgacaaucccgauauccugaagagaguaucuggcucccgcucuaauguauuuaugagguuuaaaacgacagcuaaagacggcuugcucuuguggagaggagauucaccuaugagaccuaauagugacuuuauuucacugggacuaagagacggcgcccugguguucuccuacaaucuggguuccggcguggccucgauuauggugaacggaagcuucaacgacggacgguggcacagagugaaggcagucagggauggccaaagcgggaagauuaccgucgaugacuauggggcacguaccgguaaaucuccugggaugaugcggcagcuuaacaucaauggagcucuguaugugggaggaaugaaagagaucgcccugcacacaaaucgucaguauaugcgcggacucgugggcugcauuucucacuuuacacucagcaccgacuaucacauaagucuuguggaggacgccguagaugggaagaauauaaauaccuguggcgcgaaauag

SEQ ID NO: 13860 - RNA, 1431 nt, Artificial Sequence
  Description of Artificial Sequence: Synthetic coding sequence
augaaguuccagggaccgcuggcuugucuucuucuggcacuguguuuaggaucuggcgaagcagggccccugcaaagcggggaggaaucaaccggaacaaacauaggugaagcucugggacacggccugggagacgcguugagugagggaguggggaaggcaaucggcaaggaggcaggaggagccgcugguagcaagguauccgaggcacuuggccaggggacccgagaggccguggggacuggcgugcggcaggugcccggauucggcguggccgacgccuuagguaacagaguuggugaggcugcccacgcacucgguaauacagggcacgaaaucgggagacaggcggaagacgugauuagacacggcgcagaugccgugcggggaagcuggcaaggugugccuggccauaacggugccugggaaacuuccggagggcacggaaucuucgggucacagggggggcugggagggcagggacagggcaauccgggcgggcuugggacaccauggguacacggcuacccuggcaacagcgcugggagcuucggaaugaauccucagggggcuccuugggggcaggggggaaauggaggcccccccaacuuugggacgaacacgcaaggggcagucgcacaacccggcuacggcuccgucagagcuagcaaucaaaacgagggguguacaaaccccccgccaucagggucagguggaggaucgucaaacuccggggguggcagcggcucucagagcgguucgucgggaagcggaucaaauggcgauaacaauaauggcaguaguagcggcgguaguuccaguggcucaaguagcgguggcucauccgggggcucuucaggagggucauccggcaacucuggcggcaguagaggagacagcggaucagagaguucuugggguagcucaacaggaagcucuaguggcaaccacggaggcucaggaggcggcaauggacauaagcccggcugcgaaaaacccgguaacgaggcuagggguagcggcgaauccgggauccagaacagugaaacaucaccuggcauguucaacuuugacacuuucuggaagaauuuuaagucaaaacucggguuuauuaauugggaugcuauaaauaaaaaucaaguucccccaccuucaacacgcgcucuguuguacuucucuagacugugggaggacuuuaagcagaauacuccuuuuuuaaacuggaaagccaucauagagggugccgaugcgucuucgcugcagaagcgagccggccgggacgaccagaauuauaacuacaaucaacaugcauacccuacagcauacggcgggaaauacagugucaaaacaccugcaaaggggggcguuuccccuucuaguucagcaagucgaguucagccuggccuccuccaguggguaaaguuuugguag

SEQ ID NO: 13861 - RNA, 1911 nt, Artificial Sequence
  Description of Artificial Sequence: Synthetic coding sequence
augacaacauggucucugcgccgccggccagcucgaacucuuggauuacuguugcucgugguucucgguuuucugguccuccgcagacuagauuggagcacucuggugccucucaggcuucgccaucgucagcugggccugcaagccaagggauggaauuucaugcuugaagacagcacuuuuuggauauuuggaggaucaauacacuacuuuagaguuccccgagaauauuggcgcgacagguuguugaagaugaaggcguguggguugaacacucuaacaacauaugugcccuggaaccuccacgaaccugagagaggaaaauucgauuucuccgguaaucuggaccuggaggccuuuguuuuaauggcugcugagaucggacuaugggucauacuacgaccaggcccauauauaugcagcgaaauggacuuaggcggacugccaaguuggcugcuacaggauccggggaugaggcugcguacaaccuauaagggguuuaccgaagccgucgauuuguauuucgaucacuuaaugucucgcguggugccgcugcaguacaaaagaggaggcccuaucauugccguucaaguggaaaaugaguacgggagcuacaauaaggaucccgccuauaugcccuaugucaagaaagcauuagaggaccgcggcauagucgagcuauuacugacaucagacaauaaagacggacucagcaaagguauagugcaaggagugcuugcuaccaucaaccuccaauccacccacgaacugcagcuucucacaacauuuuuauuuaauguucagggcacucagccuaaaauggucauggaguacuggacagguugguuugacucuugggguggaccccacaauauacuugauucaucugaaguccugaagaccguuuccgcaauugucgacgccggaagcucuauuaaccuuuauauguuccacggcggcacuaacuucggauucaugaacggggcuaugcauuuccacgacuacaagucagacgugaccucuuacgauuacgaugcuguacucaccgaagcgggagacuauacggcuaaauacaugaagcugcgcgacuuuuucgguuccauaucugguauaccccucccuccuccccccgaccuucugccaaagaugccuuacgagccuuuaacccccguccucuaucuaucccuaugggacgcacugaaguaucucggcgaaccaaucaaauccgagaaaccuaucaacauggaaaauuuaccuguuaacggcggcaacggccaaucuuuuggcuacauccuauaugagacaagcaucacuuccagcgguauccuuucuggacacguacaugaucgaggacaaguguucguaaauacaguuagcaucggcuuucuggauuauaagacaacgaagauagcuguuccucugauacagggcuacacuguccugagaauccuggucgagaauagggggagagugaacuauggcgagaacauugaugaccagcgcaaaggccuuaucggcaaccucuaccugaaugauuccccccuaaaaaacuuccggaucuacaguuuagauaugaaaaagucuuucuuccagagguuuggucuggacaagugguccucauugccagagaccccuacccugccagcguuuuuccugggaucccugaguauuuccucuacgccgugugauaccuuccucaagcuugaagggugggagaaagguguggucuuuaucaacgggcaaaaccucggacgcuauuggaacaucggcccccaaaaaacacuguaccugccuggcccauggcuguccucaggaauuaaucaaguuauugucuucgaggaaacaauggccggaccagcauuacaguuuaccgaaacaccgcaucugggaagaaaucaguacauaaaauag

SEQ ID NO: 13862 - RNA, 672 nt, Artificial Sequence
  Description of Artificial Sequence: Synthetic coding sequence
augacacgguggaguucuuauuuacugggcuggaccacuuuuuuguuauacaguuacgaaaguuccggcggcaugcaugaggaauguguuuuccccuucaccuauaagggguccgucuacuuuacuugcacucacauucauagucuuaguccuuggugcgcgacgagggccguauacaauggucaauggaaguacugccagucagaggacuacccaagguguauuuucccauucaucuaccgcggcaaggccuauaauaguuguaucucacagggcuccuuuuugggcagucucuggugcagugucacuagcguguucgacgagaaacaacaguggaaguucugugagaccaaugaguaugguggaaacucccugagaaaaccaugcauauuccccucaauuuaucgaaacaaugucguauccgauugcauggaagaugagagcaauaagcuguggugucccaccaccgagaauauggauaaagauggaaaguggucauuuugcgcugacaccagaauuuccgcccugguaccuggcuuuccuugccauuucccuuuuaauuacaagaacaaaaauuauuucaacuguaccaaugaaggcucaaaggagaauuuagucuggugcgcuacgucauacaacuacgaucaggaucacacauggguguacuguuag

SEQ ID NO: 13863 - RNA, 1368 nt, Artificial Sequence
  Description of Artificial Sequence: Synthetic coding sequence
augcuacacccggagacaucaccaggccggggucaucugcuugcaguccugcuugcccucuugggcacuaccugggcagagguuuggcccccccagcuucaggagcaggcaccuauggcaggcgccuuaaaccgcaaagaauccuuccuccugcucucccuccauaauagacuaaggucuugggugcaaccaccagcagccgacaugcguagauuagacuggucugauuccuuggcccagcuggcccaggccagggccgcccucugcggaauuccaacccccagccucgcuuccggucuguggcgaacccugcagguggguuggaauaugcaguugcugccggcuggucucgcaaguuucgucgaagucgugucauuaugguucgccgaaggucagcgcuacucucaugcagccggugaaugugcccguaacgccacauguacacacuauacucaacucgugugggcuaccaguucacagcugggaugcggaagacacuuaugcucugcaggucaaaccgcuauugaggccuucguaugugccuacuccccaggggggaacugggaggugaaugguaaaacuaucaucccuuacaagaaaggcgcaugguguagccucuguacugccagugugucugguugcuucaaagccugggaccacgcagguggauuaugcgaggugccuaggaacccuugucguaugucgugccaaaaucauggaaggcugaauauuucaacaugucacugccacugccccccaggguauaccggcagauauugucaggucaggugcucccuucagugcguucacggcagguuuagagaggaggaauguucuugcgugugcgauaucggauacggcggugcacagugugcuaccaagguucacuucccauuccauacgugugaccuuagaaucgacggcgacuguuuuaugguguccagcgaggccgauaccuauuaccgcgcgagaaugaagugccaaaggaagggcggaguacuugcacagauaaaaucacagaaagugcaggauauucuugcauuuuacuugggcagguuggagaccacaaacgagguuauugauagcgacuuugagacucggaauuucuggauagggcuaaccuauaaaacagcaaaggauagcuuuaggugggcgaccggagaacaucaagcauuuacuucuuucgcuuucggacagccagauaaucauggccucguuuggcugucggcugcaauggguuucgguaauugcguagagcuccaggcauccgccgccuuuaacuggaaugaccaaagaugcaagacgagaaauagauacauaugccaguucgcacaggaacauaucucaagguggggaccagguucuuag

SEQ ID NO: 13864 - RNA, 1425 nt, Artificial Sequence
  Description of Artificial Sequence: Synthetic coding sequence
auggccgacaugcaaaacuugguagagaggcuggaacgggcaguaggacgcuuagaagcugucucacauaccagcgacaugcauagaggcuaugcugacucccccucgaaaggugcagccccauaugugcaggccuuugacucacuauuagccggaccagucgcagaguaucugaaaaucucuaaggaaauugggggcgacgugcaaaaacaugcggagauggugcacacaggauuaaaacuggaacgggcacuccucgugacugcaucacagugccagcagccugccgaaaacaagcuuucugauuuguuagcgcccauuucagaacagauaaaggaggugauuacguuucgcgaaaaaaaccggggaagcaagcuauucaaccaucugagcgccgugagcgagaguauucaagcucuuggaugggucgccauggccccaaagcccggucccuacgugaaagagaugaaugaugccgcaauguuuuacacaaauagaguguuaaaagaguauaaagacguggacaagaaacauguggacugggugaaagccuaccucagcauuuggacagaacugcaagcuuauauaaaagaguuccauacaacuggccuugccuggucaaaaacuggaccuguagcuaaggaacucuccggccucccuucuggccccucugccgggucuuguccgcccccccccccgccaugccccccgccaccccccgucuccacuauuaguugcagcuacgaguccgccucucgauccagccucuucgcccaaauuaaccaaggagaguccauuacgcacgcucuuaagcacgucagugaugacaugaagacccauaaaaauccagccuugaaagcucaaucaggcccugugaggucugggccaaagccuuucucagccccuaagccucaaaccucuccuagccccaaacgcgccacuaagaaagagccggccguccucgaacuggaaggaaagaaauggagaguggagaaucaagaaaauguaucaaaucucgucaucgaagauacugagcugaagcagguggcauauauauacaaaugcgucaauacaaccuugcagauuaaggggaaaauaaauucgaucacuguagacaauuguaagaaacugggacugguauucgacgauguugucggcaucguggaaauaauuaacuccaaagauguuaaagugcaggugaugggaaaaguaccuacuauaucuauaaauaaaaccgauggaugccacgccuaccuuagcaagaacagccuggauugugaaauugucucagccaagaguagugagaugaauguguuaauuccgaccgaagguggcgacuucaacgaguuuccuguaccagagcaauucaaaacccuuuggaacggccagaaguuaguuacuacagucaccgaaauagccggauag

SEQ ID NO: 13865 - RNA, 360 nt, Artificial Sequence
  Description of Artificial Sequence: Synthetic coding sequence
augaauaagauuuugucaucgaccguaugcuuuggccuacugacacugcuguccgugcuguccuucuuacaguccgugcauggccgaccguaucuuacgcaagggaaugaaaucuuccccgacaaaaaauauacuaacagggaagaacuccuccuggcauugcugaauaagaacuuugauuuccagcgucccuuuaacaccgaucucgcccuaccgaacaaguuagaagagcugaaccagcucgagaaacucaaggaacaacuaguggaggaaaaggacucugagacuaguuaugcuguugauggauuauucuccucgcaccccucuaagcgcgcauguuucuggaaguacugugucuag

SEQ ID NO: 13866 - RNA, 3756 nt, Artificial Sequence
  Description of Artificial Sequence: Synthetic coding sequence
augagacugcuguugcuggucccucucuuguuagcacccgcccccggcuccagcgcuccaaaagucagaagacagagcgacacuuggggaccuuggagccaguggaguccaugcucacgaaccuguggaggcggagucucuuuccgugagaggccuuguuacucucagcgcagagauggagggucaaguugugucggcccugcuaggagccacagaucuugucgcacggaaucaugccccgacggcgcuagagauuuuagagcagaacagugcgcagaguucgacggagccgaguuccaaggucgaagauauaggugguugccuuacuacagcgcacccaacaagugugagcuuaauuguaucccaaagggugaaaauuucuauuauaagcauagggaagcuguuguugaugggacaccuugugaaccagguaaacgcgacguguguguggacggaagcugucggguaguugguugugaucacgagcuugacucuaguaagcaggaagauaaaugcuugagauguggaggggaugguaccacauguuacccaguagcuggcaccuucgaugccaacgacuugucucgcgcggucaaaaacguccgaggggaauauuauuuaaacgggcauuggaccauugaagcugccagggcucugccugccgccuccacaauccuccacuaugagagaggugcggaaggagaucuugcgccagagagacuacaugcgcggggcccaacuagugaaccacucgucaucgagcuuaucagccaagagccuaacccaggaguccauuaugaguaucaccucccucuacgacgcccaucaccuggauucaguuggagccaugggagcugguccgauugcagcgccgaaugugggggcggccaccagucacgacuuguguucuguaccauagaccaugaggcauaccccgaucauaugugccagagacagccacggccugccgacagaaggagcuguaaucuccaucccuguccggagacuaaaagauggaaggcuggaccaugggcgcccugcagcgcuucguguggagguggcucucagucaaggucgguuuauuguaucagcucagauggcgccgguauucaagaggcagucgaggaggcagaaugugcaggacucccggguaaaccucccgccauccaggccugcaaccuacaaagaugugcagcauggucuccggagccuuggggcgaguguagugugucaugugguguaggcgugcgcaagagaucagucaccuguaggggugaacgggggagccuacugcauacugccgcauguucccucgaggacaggccgccucugaccgaaccauguguucacgaagacuguccccugcuauccgaucaggccuggcacgugggcacuugggggcucuguucgaaaucuugcucuuccgggacuagaaggcgucagguaauuugugcuauuggaccuccuagccauuguggcagcuugcagcacucaaaaccuguggaugucgagccuuguaacacccaaccuugccaccuuccccaggaaguucccagcaugcaggaugugcacacuccugcuuccaacccuuggaugccguuagggccucaagagucaccagccucugauucacgcggacaguggugggccgcccaggaacaucccagcgccagaggagaccacagaggcgaacgcggagauccgagaggagaucaggguacacaccucucugcacugggaccagccccuucccugcagcaaccccccuaucagcagccucuccgaaguggaucuggcccccaugacugccgccacucuccucacggauguugcccagacggacauaccgccuccuuggggccucaguggcagggcugcccuggugccccaugucagcagucgagguauggcuguuguccugauagaguuucaguugcagagggcccucaucacgccggcuguaccaaaagcuacggaggagauaguaccggugggaugccaaggucuagagccgucgcuagcacuguucauaacacacaucagccucaagcacagcagaacgaaccauccgaaugucguggcucccaguuuggguguuguuaugacaauguugcuacagcugcaggaccacucggcgagggguguguuggacagcccucccacgcuuacccugugcggugcuugcucccuucagcccacggcuccugcgcugauugggccgcccggugguauuucguugcuucugucggacaaugcaaucgauuuugguauggcgggugccacgguaacgcuaacaacuucgcuucugagcaagaaugcaugagcucaugccagggcagucuccauggcccaagacgcccacaaccgggagcuuccggacgaagcacccacacagacggcgggggauccagcccagccggcgaacaggaacccucucaacaccgaaccggcgccgcugugcagaggaaaccauggccuucaggcggccucuggagacaggaccagcaacccggacccggagaagcaccccacacucaggcguucggagaauggcccuggggccaagagcucggcagucgugcucccggacucggcggugaugccggcagccccgcccccccauuccauucuucauccuaccgaauuucucuagccggaguugagcccucacuggugcaggccgcccuggggcagcuagugcgacuaucaugcagcgaugacacugcuccugaaucucaggccgcuuggcaaaaagacgggcagccaauuucauccgaccgacaccggcugcaauucgauggcucucucauaauucauccccuacaagcugaagacgcaggcacauacucuugcggaaguaccagaccuggaagagacucccagaaaauacagcugaggaucauaggcggggauauggcgguccugucggaagcugaacuuucuagauuuccacaaccucgugauccggcacaggacuucggucaggcuggugcagcgggcccacugggggccauuccuucgucacauccccagccggcuaauagacugcggcuugaucagaaucaaccccgaguaguggaugccucacccggucaacgcauacgaaugaccugcagagcagaaggauuccccccccccgcgaucgaauggcagagagacggacagccaguuuccuccccaagacaccagcuccagccggacgggucccuagugaucagcagaguagcaguggaggacgguggguucuauacuugcgucgcauucaacggucaggaucgugaccaacgcugggugcaauugcguguccucggcgagcugacuauuucuggauugcccccuaccgugacgguucccgagggagacacggcccgucuguuaugcgugguagcaggcgaaucugucaauauucguuggucucgcaauggacugccugugcaagcugauggucacagaguucaccaguccccugaugggacucuguuaaucuauaaucuucgcgcccgggaugaagggucuuacaccuguucggccuaucaggguucucaggccgucucacguucuacagaaguuaaagucgugucacccgcaccaacugcucaacccagagaccccggacgugauugcguugaccagccugaacuugcuaacugugaucucaucuuacaggcgcagcuuuguggaaacgaauacuacaguucuuuuuguugugccagcugcuccagauuccagccucacgcacagcccauauggcaguag

SEQ ID NO: 13867 - RNA, 1731 nt, Artificial Sequence
  Description of Artificial Sequence: Synthetic coding sequence
auggcccagggcguucuauggauucuguuaggauuacugcuguggucugauccuggcacggccucccuuccuuuguugauggacuccgucauucaggcuuuggcugagcuggagcagaagguaccagcggcgaaaacacgacauaccgcuucugccuggcuuaugucugcucccaacagcggcccccauaaccgucuuuaccacuuucugcugggcgcauggucucuuaaugccacugaacuggauccuugcccccuuucacccgagcuucugggccugacuaaagaaguggccagacaugacgugcgggaaggaaaagaauacgguguugugcuugccccagauggcucuacuguugcugucgagccuuuacucgcaggcuuggaagcugggcugcagggccguagagugauuaaucuuccgcuugacucaauggcagcacccugggagaccggugacacguuucccgauguugucgcuauugccccagaugugcgggccacauccaguccaggauugagggacgguucuccagacgucaccacagcagauauuggagcuaacacuccugacgcuacuaaagguugcccagacgugcaggccucacugccugaugcuaaagccaaaucucccccuacaauggucgacucacugcuggccgucacacuagcggguaaucugggccugacauuucucagaggcagccaaacucagucccaccccgaccugggcaccgaaggaugcugggaucaauugagcgcccccaggacguuuacguugcuagacccuaaagcaucucugcucaccauggcuuuucuuaacggcgcuuuagacggugugauuuuaggcgauuaccugucccguacaccugagccuaggcccuccuugucucaccugcugucacaguacuauggagcuggcguugcccgggauccaggauucaggagcaacuuccggcggcaaaacggggccgcccugacauccgcaagcauucuugcccaacagguaugggguacccucguucuguugcagcguuuggaaccuguucaucuccaacuccaguguaugucccaggaacaacucgcccagguugcggcaaaugcaacaaaggaauuuacugaggccuuucucggaugcccugccauccaccccagaugccgguggggugcugccccuuacagaggacgucccaaacuucuucaacucccccucgguuuuuuauauguccaucacaccuacguaccugcgccaccauguaccgacuuuacucgcugcgcggccaacaugaggaguaugcaacgcuaucaccaggauacccagggcuggggagacaucggauacucauuugucgucggcuccgacggauauguauaugagggcaggggauggcacugggugggugcucauacgcuuggacacaauucacggggcuuugguguugcuauuguggguaauuacacagccgcacugcccacagaagcugcucugcgcacuguaagggacacguugccuaguugcgcuguuagagccggacugcugagaccugauuaugccuugcugggccauagacaacucguucguaccgauugcccgggcgaugcucucuuugaccugcugagaacauggccucauuucaccgccacuguuaaaccaagaccugcgagaucagucaguaagcgcagccgccgagaaccuccaccaagaacccugccggcaaccgaucugcaauag

SEQ ID NO: 13868 - RNA, 846 nt, Artificial Sequence
  Description of Artificial Sequence: Synthetic coding sequence
auguugccuaaaucacggcgugcccugacuauucaggagauugcugcccucgcgcgcucuucucuccauggcaucucacagguagucaaagaucauguuacgaaaccuacugcgauggcccaggggcgggucgcacaccugauugaguggaaaggguggagcaaacccucggauuccccugcagcucucgaauccgcuuuuaguagcuauagcgaucucagcgagggggagcaggaggcuagauucgccgcaggaguagcugaacaguuugcuaucgccgaagccaaauuacgugcuuggucuagcguugacggagaggauuccacugaugauuccuaugacgaggacuuugcgggaggcauggauaccgacauggccggccaacuuccacugggcccccauuuacaggacuuguucaccggccacagguuuucgaggccugugcgccaggguagcguagaaccggagagugauuguucucagacuguuagcccugauacccuguguucuucccuguguucucuggaagauggauuacuagguaguccagcgagauuggcaucacaacuucuaggugacgagcucuugcucgcaaagcugccaccuucucgcgaaucagccuuucgaucacucggcccucuagaagcccaggacucucucuauaauagcccgcugaccgagagcugccucagcccagccgaggaggaaccagccccuugcaaagauugucagccuuuaugcccgccucuuacaggaucaugggagcgucagcgccaggcaucagaccuggcaucauccggugucguuagccuagaugaggaugaagccgaaccugaagagcaguag

SEQ ID NO: 13869 - RNA, 2619 nt, Artificial Sequence
  Description of Artificial Sequence: Synthetic coding sequence
auggguaucguuuggauucugaugucaguauugccaugguggggucggugugcugaucuggcaauugcuucuacucagcuggugcccucaaccgcaucugcucguauggcacugucuucucagcucaugggucgcacagucuggacaccuauguccgcauccgcccuucaggaacccgcuuauccagcuuuggcuagaaccucaagggcuccaagcgcugcauccguuccucuggccagccgcugcagggucacaacagcccugaucucuaccagugcccagcgcucccccacaucagcuagucuggcacccgucccuacugccuuaggcgcgucaucagccagcgcccaccuggcccucagcucccugacaauggggacagucgcacuuacccacggccgcgucagcgcaagucccguccuuagacucggcucugcaagauguccuaaacugucaacacccccucguccugccgccgccgccguacggggacugggucgugccggcgaaaccccugcaaacugugugccucggagggcagugccgggcccugacgauuccagagaagacgugaacgaaugugcagaaaauccgggcguaugcaccaacggagugugcgugaacacagacggaucauuucggugugaaugcccauuuggauacucccuugauuucacaggaauuaacugcguggauacugaugagugcaguguggggcaccccuguggucagggaaccugcacaaacgugauaggaggcuucgagugcgccugugccgauggauuugagcccggccugaugaugacaugcgaggauauugacgagugcucucugaacccccugcugugugccuuccguugucauaauacugagggcucuuaucucuguacauguccagccgguuauacucugcgggaggacggggccaugugucgggauguugaugaaugcgcugacggccagcaagauugucaugcucgcggaauggagugcaaaaaucugauuggcacauucgcuuguguguguccuccaggcaugagaccccucccagguuccggcgaaggguguacugacgacaaugaaugccacgcccaacccgacuugugcgugaacggcagaugcgugaacacugcagguucuuucagaugugacugcgaugaaggcuuucagcccagcccaacucucacugaaugccaugacauucgucaaggaccuuguuuugccgaaguccuccagaccaugugccgcucuuuguccucuuccagugaggcugugacacgugcggaguguuguugcggggguggucggggaugggggcccagaugugaauuauguccucuaccuggcaccucggcauacagaaagcuguguccccaugggagugguuacaccgcagaaggccgggauguggaugaaugcagaaugcucgcucauuuaugugcgcacggcgagugcaucaacucuuugggcucguuucgaugccauugccaagcaggcuacacccccgacgccacggccacuacuugcuuagauauggaugaauguagccagguccccaaaccauguacuuuuuuaugcaaaaauaccaaggggucauuucuuuguuccugcccaagaggauauuuauuagaggaggacggucggaccugcaaggaucuagaugaauguacuagccgccagcauaauugccaauuccuaugugugaacaccgugggcgcuuucaccugcagaugucccccaggcuuuacucagcaucaccaggcauguuucgacguaaaugaaugcgacggaccacaucggugccagcauggaugccagaaccaguugggaggauacagaugcuccugcccccaaggauuuacacaacauucccagugggcucaguguguugacgaaaacgaaugcgccuugucgccgccaaccuguggcucagcuucaugucgcaacacuuuaggcggguuuaggugcguauguccauccggauucgacuucgaccaggcacugggaggaugccaggaagucgacgaaugugccggacggagaggccccuguucguauagcugcgcuaauacgccugguggauuuuugugugguugcccucagggauacuuccgcgccgggcagggacacugcguauccgggcuuggcuucucaccagggccgcaggauacacccgauaaggaagagcucuuauccagcgaggcuuguuaugaaugcaaaauuaacggcuugucacccagggaccguccucgacgcuccgcccaccgagaccaucaaguuaaccuggccacacuggauagugaagcacugcugacccuaggacugaacuuaucucaucuuggucgggccgaaaggauucuagaauugcgacccgcacucgaaggucuggaaggccgcauacgcuaugugauuguucgcgguaaugaacagggcuucuuccgaaugcaucaccugaggggaguaagcagcuugcagcuaggcaggcggagacccggaccaggcaccuacaggcucgaagugguaagccauauggcagguccuuggggagugcagccugaggggcaacccggaccauggggacaagcauuaagauugaagguccagcuccagcuccuguag

SEQ ID NO: 13870 - RNA, 1368 nt, Artificial Sequence
  Description of Artificial Sequence: Synthetic coding sequence
auggcucguaaggcucuaaaguuggcauccuggacuuccauggccuuggccgcaagcggcauauauuuuuacaguaacaaguacuuagacccaaacgacuucggggcagugagagucggaagagccgucgcuacaacugcagucauaaguuaugauuaccugacaucccuuaagucagugccauauggaucugaggaguaccuccagcugcgcucuaaaauucaugaccuguuucaaaguuucgacgauaccccauuaggcaccgccucuuuggcccagguccacaaggcuguucugcacgaugggcguacaguggcaguuaaggugcaacacccaaaagugagagcccaaucuucuaaagauauccugcugauggaaguguuaguacuggcaguaaagcaauuauuuccugaguuugaauuuauguggcuaguagaugaggcaaaaaaaaaucugccauuagaacuggauuuccucaacgaaggacguaacgccgagaaagucucacaaaugcugcgacauuuugacuuccuuaagguaccucgcauucacugggauuugucuaccgaacgcguauugcuaauggaguucguggacggcggccaggugaacgacagagacuauauggaaagaaacaagaucgacgucaaugaaauuagccgccauuuaggcaagauguacuccgagaugaucuucgugaacggcuuugugcacugcgacccacacccugggaauguucuuguuagaaaacacccugguaccggaaaggcggaaauuguucuccuugaccacggccucuaucagauguuaacugaggaguuccgucugaacuacugccaccuuuggcaaucccuaaucuggacggauaugaagcgcgugaaagaauacucucagagacucggcgcuggggaccuguacccacuguuugccugcaugcucaccgcacguucaugggauucuguuaaucggggcaucagccaagcgccagugacagccacugaagacuuggagauuaggaacaacgcagcuaacuaucucccccaaaucucacaccuguugaaccacguucccagacaaauguuacugauacugaaaaccaacgaucuguuacgggguauugaagccgcccucggcacacgcgccuccgcauccuccuuccugaacaugaguagaugcuguauuagggcucuggcugagcauaagaaaaagaauacuuguucauuuuuccguagaacccaaauaucauuuuccgaagcauuuaaccuuuggcaaaucaaccuucacgaacugauccucagaguuaaaggacuaaaacucgcagaccgcguccuggcccuaauauguuggcuguucccugccccacucuag

SEQ ID NO: 13871 - RNA, 1245 nt, Artificial Sequence
  Description of Artificial Sequence: Synthetic coding sequence
augaacccuacacucggauuggcuaucuucuuggcaguccuccuaaccguaaaggggcuccuaaaaccuagcuucucuccacgaaacuacaaagccuuaagcgaagugcagggguggaaacagcgcauggcagcgaaagaauuagcgagacagaacauggauuuaggcuucaaguugcuuaaaaagcucgccuucuacaacccuggccgcaauaucuuccuuucuccacugucuauuucaacagcuuucagcaugcugugcuugggugcacaggauucuacacuagacgaaaucaagcagggcuucaauuucagaaaaaugccagaaaaagaucugcacgaaggcuuccauuauauuauccacgagcucacacaaaagacacaggaucugaaacugucuauugguaauacccuauucauugaccagcgcuuacaaccccagagaaaauuccuagaagaugccaaaaacuuuuauuccgcugagacaaucuugaccaauuuccagaaucuagaaauggcccaaaagcaaauuaacgacuucauuucacagaaaacucacggaaaaaucaauaaccuuaucgaaaauauugauccugggacaguuaugcuacuggccaacuacauauuuuucagagcacgcuggaagcacgaguucgaucccaaugugaccaaagaagaagauuuuuuucucgaaaagaacaguucugugaaaguacccaugauguuucgaucuggcauuuaccaggugggcuaugacgacaagcugagcugcaccauccuugagauaccauaccagaaaaauauuacugccauuuucauccugcccgaugaggguaagcugaaacaccuggaaaaaggcuuacagguggauacuuucucucgauggaaaacccugcuaaguagacgagucgucgacgucucagugccgagacugcauaugacgggcacuuuugacuugaagaagacacucuccuauaucggaguuucaaagauuuuugaggagcacggagaccucacaaagauagcaccccaccguucucugaaggugggagaagccgugcacaaagccgaauugaaaauggacgagcggggaacugagggagcagcugggacaggagcacagacccugcccauggaaaccccccuaguggugaaaauugacaagccuuaccuccuccugauauacagcgaaaaaauacccucuguguuauuccucggaaaaaucgucaaccccaucggcaaguag

SEQ ID NO: 13872 - RNA, 942 nt, Artificial Sequence
  Description of Artificial Sequence: Synthetic coding sequence
augagcgaucuccugcuguuagggcucauuggcggucugacucuucuacuauuauugacccucuuggccuuugcuggguacucagguuuacucgcuggaguggaggucucugccgguagcccgccaauuaggaacgugacgguagcuuacaaauuucacaugggccuguauggagaaaccgggagauuauucacagagucauguucuauaucgccaaaauuaagaucaaucgccgucuacuacgacaauccacacaugguccccccggauaaaugcagaugugcagugggauccauccugucugaaggcgaagagucccccucaccugaacugaucgacuuauaucaaaaauuuggcuuuaagguuuuuagcuuccccgccccuagccaugucguuacugcuacuuuuccguacaccacuauccucagcauuugguuagcaaccaggaggguacauccugcacucgacacuuauauuaaagaacgcaagcuuugcgccuauccuaggcuggaaaucuaucaagaggaccagauucacuucauguguccccuugcaagacaaggggauuucuacgugccugaaaugaaggaaacugaauggaaauggagaggccuuguggaggcgauagauacacagguagacgggacaggcgcagacaccaugagcgauaccagcagcguuucccucgagguaaguccuggaucacgcgaaacauccgccgcuaccuuauccccaggugcuaguagccgcggcugggaugacggggauacacggucugaacauucuuauucagaguccggugcaucuggguccuccuucgaagagcuugaccuggagggagaagggccgcugggggaaucaagauuagauccuggcaccgaaccucucgggaccacaaaauggcuaugggaaccgacagcacccgagaaaggcaaggaauag

SEQ ID NO: 13873 - RNA, 603 nt, Artificial Sequence
  Description of Artificial Sequence: Synthetic coding sequence
auggccuggggcgggguccauacuuguugcuuccaucuuugcugcuguuguuccuggccucaaggcgccgugccggaagaacugcacaagcauccuggccagacguugcugcuacagugccaguauucaccaaaacgcggccccuaccaacccaaaucauggugccagcagaccagcccgucccgguguacucuccucguuaccucuaguaaaccauggaccgcuguccagaaaucgcauuacaccaucugggauaaaccuaacgccggcuuuuucaauauuacaaugauucaacugacccaaaacgauucaggcuucuacugguguggaaucuacaacgccucggaaaacauuauuaccgucuuaaggaacauaucccuagucgucuccccagcuccaacaacuagccccauguggacgcugccaugguuaccaacgaguaccguucucaucaccucacccgaaggcaccagcgggcacccguccaucaacgguuccgaaacccgcaaaagccgcgcacccgccugccugggaagcggaggcccccgcuuccuuguucuuguccucugcggauuguugcuggccaagggucugaugcucuag

SEQ ID NO: 13874 - RNA, 1035 nt, Artificial Sequence
  Description of Artificial Sequence: Synthetic coding sequence
acaacacccucucgagcacugccuggcuggagcaauugucgaccucgcuggcgugcuggcccaacaccucagucacccacuccucaguccagaaugcgcuugaguccagguccccccucugaguggaccuggcuccugccccacuucaaccccugucaucaccaucaccgccaccaucacccaaauccuaccaccagucuuuugccuacagaaccgccauccggacccgaaguaucaagccaagggcgggaagcaaguugugagggcacacugagagcuguagacccuccugucagacaucacagcuacgggagacaugaaggggcuuggaugaaggaccccgcugcacgagaugacagaaucuacgucaccaauuacuauuacggaaauagccuggucgaguuucgaaauuuggaaaauuucaagcaaggccgguggagcaauauguacaaauuaccauacaacuggauuggaacaggucacguugucuaucagggagcuuuuuauuacaacagagcguucacaaaaaauaucauuaaguaugauuuaagacaaagguuugucgcgucgugggcucuauugcccgaugugguguaugaagauacaacccccuggaaauggcgagggcacucagauauagauuuugcuguggacgaaucuggacugugggucaucuaucccgcaguggacgaccgggacgaagcgcaacccgaagugaucguuuuaucaaggcuagaucccggcgaucuuaguguacacagggagacaacauggaaaacucggcugagaagaaacaguuauggcaauugcuuccuagucuguggaauccuguacgcuguugacacguacaaccagcaggaagggcagguagccuacgcuuucgacacacacaccggcacagaugcucggccccaauugccauuucugaaugaacaugcuuacacuacccagauugauuacaacccaaaagaaagaguguuguacgcuugggauaauggucaccaguuaacuuauacacuccauuucguuguuuag

SEQ ID NO: 13875 - RNA, 2682 nt, Artificial Sequence
  Description of Artificial Sequence: Synthetic coding sequence
auggccgaagccgcucuggaggcagugagaucugaacugagagaguuucccgccgcggccagagaauuaugcgucccccucgccgucccuuaucucgauaaacccccaaccccauuacauuuuuacagagauuggguuugcccuaacagaccuuguaucauccgcaaugcccugcagcacuggccagcccuacagaaauggucccuucccuacuuccgagcaacugugggaagcacagaagugagugucgccgugacuccugacgguuacgcagaugcagugcggggagaccgguuuaugaugcccgccgaaagacgccuuccccucuccuuuguucuagaugugcucgaagggcgggcccagcauccuggaguccuauauguacagaagcaaugcucaaaccugccuuccgaacugccucaacuguuaccugaccuggagucacacgucccuugggcuucagaggcucugggcaagaugccagacgccgugaauuuuuggcuuggggaggcugcugcagugaccagucuacacaaagaucauuacgaaaaccucuacuguguugugucaggcgagaaacacuuucucuuccacccucccagugauaggccuuucaucccauacgaacuguacacccccgccaccuaccaacuuaccgaggaaggaaccuucaaaguuguagacgaagaagcuauggagaaagccgagguaucccgcaccugccuccugaccgugcgaguccugcaggcccaccgguugcccagcaaggacuuagugacuccgagugacugcuacgugacguuguggcugccuacugcauguagccaccgccuccagaccagaacuguuaagaacucaucuaguccaguuuggaaccagucuuuucauuuuaggauucauagacagcugaaaaacguaauggagcugaagguuuucgaccaagaucuggugaccggggacgacccaguucugagcgugcuguuugaugcaggaacacuucgagcaggcgaauuucgacgagagucuuucaguuugaguccacagggggaaggucgccuggagguugaguuuaggcuucaaagucuugcugaucgcggggaguggcuggugagcaacggugugcugguagcacgcgaacugucaugccuucacgugcaacucgaagaaacaggagaccaaaaguccagcgagcauagaguacagcuugugguuccaggauccugcgaggggccacaggaagccucugucggcacugggacauuccguuuucauugccccgcauguugggaacaagagcuuucuauaaggcuccaggacgcccccgaagagcagcucaaggccccccuuagugcccuucccucuggccaggucguuaggcugguguucccuacuucccaagagccuuugaugcgugucgaacucaagaaagaagcuggacugagagagcuggccguccgccucggauuuggaccuugugcagaagaacaggcuuuucugagcagacguaaacaggucgucgcugcggcccuucgccaagccuugcaauuagauggugaccuucaggaggacgaaauuccuguaguggcuauaauggccacgggcgguggaauuagagcuaugacaagccuuuacggccagcuugcuggauuaaaagaauugggccucuuggauugcgucucuuacauuacgggagcgagcggaagcacgugggcauuagcaaacuuauaugaagauccugaguggucacagaaagacuuagccggaccuaccgagcuccugaaaacccaagugacaaagaacaaacuuggcguuuuagccccaucucaauugcaacgcuauagacaggaauuggccgagagagcccgauuaggcuauccuucuuguuucacuaaccugugggcacucauaaaugaagcccucuugcacgacgagccacaugaucacaaauuaucugaucagcgcgaagcccucagucacggacagaauccuuugccuaucuauugugcauuaaacacuaaagggcaaucucuaaccaccuuugaguucggagaauggugcgaauucucccccuacgaggucggauuuccaaaguacggcgcauucauaccguccgaacuguuugggucugaguuuuuuaugggucagcugaugaaaaggcuccccgagucacguauuugcuuucucgaagggauuuggucuaacuuauacgcggccaaccuccaggacucgcuauacugggcaagugaacccucacaguuuugggaccgguggguucggaaucaggccaacuuagacaaggaacagguuccacuucugaaaauugaagagccaccaucuaccgcaggcaggauugcagaguucuuuaccgaccucuuaacuuggcggccucucgcucaggccacccauaacuuccuacgcggucugcacuuucacaaagacuacuuccaacauccccauuuuucaacuuggaaagcuacaacauuagacggucucccuaaccagcuaacaccuucugaaccucaccucugccuucuggacgugggcuaucugauuaacaccuccuguuuacccuuguuacagccuaccagagauguagaucucauccucucccuggauuacaaucuccacggugcuuuucagggaucugguggccauccccggcgaaggcagcucggccgauag

SEQ ID NO: 13876 - RNA, 354 nt, Artificial Sequence
  Description of Artificial Sequence: Synthetic coding sequence
augauuaucgacucgagccgcauuccuucuuucacacaacuccacagcacuaugacaagagccccccuccugcugcucuguguggcgcucguucuccuggggcacguuaauggcgcaacaguccgcaaugaggauaaguggaagccucuuaauaacccuagaaaccgagauuuauucuuccggcgucuccaggcguauuucaaaggucgagggcuggacuuggggaccuucccaaacccauucccaacaaacgaaaacccuagaccgcuuagcuuucaauccgaacuuacugcuuccgcgagugcagauuaugaagaacagaaaaauuccuuccacaauuauuuaaagggcuag

SEQ ID NO: 13877 - RNA, 4143 nt, Artificial Sequence
  Description of Artificial Sequence: Synthetic coding sequence
augagacaugguguggcuugggcacugcugguggcggccgcguugggucuuggggcaagggguguaaggggcgccguugcccucgccgauuuuuacccuuucggcgccgagcggggugaugcaguuacaccuaagcaggacgacggagguucuggcuuaagaccgcuaucaguaccuuuucccuucuucggcgccgagcacucuggccuuuacgucaacaacaauggaauaaucucauucuuaaaagagguuagucaguuuaccccgguugcuuucccaauugccaaagaccgaugcguuguggccgcguucugggccgacguugauaaccggagggccggcgauguuuauuauagagaagccaccgauccagcuaugcuuagaagggccacggaggacgucagacauuauuuuccagaacuccucgauuucaaugcaacauggguauucgucgcgacaugguaucgggugacuuucuucggaggcaguucuucaucaccuguuaacaccuuccagacaguauugauuaccgacggaaagcuuaguuuuacgauuuucaacuaugaauccauuguuuggacaacagggacacacgccuccucugggggaaacgcuacuggguuagguggcauugcugcacaggccggcuucaacgcuggggaugggcagcgauacuucucuauuccuggcagccggaccgcggacauggcggaagucgagaccaccacgaaugucggugugccaggacguugggcuuuucgaauugaugacgcgcaaguacgcguaggaggcugcggacauaccacuaguguuugccucgcccucagaccaugccugaauggugguaagugcauugacgauugugugaccggaaacccaagcuauacaugcuccugucuaucugguuucacaggaaggcgcugucacuuggacgugaaugaaugcgcgagucaaccuugucagaauggaggcaccuguacacacggaaucaauaguuuccggugccaguguccagccggguucggaggaccaacgugcgaaacggcucaauccccaugcgacacuaaagagugucaacacggcggccaaugucaaguagagaaugguagugccgugugugucugucaggcagguuacacgggggccgccugcgagauggaugucgaugauuguuccccugacccaugucucaaugggggcucauguguggaccuugucggaaacuauacuugucugugcgcggaaccuuuuaaggggcuccgcugugaaacaggcgaccacccuguaccagaugcuuguuugucugcuccuugccauaauggaggcaccuguguugaugcagaccagggcuacgucugcgaaugucccgagggauuuaugggccucgacugcagagagagaguuccugacgauugcgaaugccggaauggcgguagaugcuuaggagcaaacacgaccuuaugucaguguccccucggguuuuucggcuuacugugugaguucgagauuaccgcuaugccaugcaauaugaacacccagugccccgauggcgguuacuguauggagcacggagguaguuaucuaugcgucugccacacagaucacaaugcaucucacucucucccaagccccugugacagcgacccuuguuuuaauggugguucaugugaugcgcaugaugacuccuauaccugugaguguccacgcggauuucacggcaagcauugugagaaggcccggccucaccucuguuccucaggccccuguagaaauggcggaacauguaaagaagcugggggcgaauaucacuguuccugccccuaccgguuuacaggacggcacugcgaaaucggcaagccugauuccugugccucaggcccuugccacaauggggggacuugcuuccacuauaucggaaaauauaaaugugacugcccucccggauuuucuggacgucauugcgaaauugccccuagcccuuguuuuagaucuccuugcguuaauggugggacgugcgaagauagagauaccgauuuuuucugccacugccaggcuggguauaugggccgcaggugccaggcggaaguggauugcggccccccagaggaaguuaagcacgccacccuccgauuuaaugguacucgucugggggccgucgcucucuaugcaugugaucgcggauauagucugucugcaccuagcaggauucggguuugccaaccgcauggggucuggucugaaccaccucaaugccuggaaauagacgaaugccggucccagccuugucugcacgggggaucaugccaagaucgggucgccggguacuuaugucugugcucaaccggcuaugagggggcccacugcgaauuggaaagagacgagugucgagcccacccaugcagaaauggagggagcugucguaaccuaccgggcgcauauguauguagauguccugccggcuuugugggcguacauugcgaaacagagguugacgccugugacucgagcccuugccaacauggaggcaggugcgagagcggugguggggccuaucucugcguguguccagaaucguuuuucggcuaucauugcgagacagucucugacccauguuucaguagcccaugugguggcagaggcuauugccuggcgucaaacggaagccauaguuguacuugcaaggucggcuauacaggagaggacugugccaaagagcucuuuccaccaaccgcccucaagauggagagaguugaagaaaguggcgucucaaucaguuggaauccuccaaauggucccgcagccaggcagaugcuagauggguaugcugucaccuaugucaguucggacgggucuuaucgcagaaccgacuucguggacaggacccggucaucucaucagcuucaggcucuagccgccggccgcgccuacaauaucucaguuuucucagucaaaagaaacucgaacaauaagaaugauaucucccgaccugcuguccuccuggcucgaacccgcccgcggcccguagaggguuuugaggugaccaaugugacagccuccacuaucucaguacagugggcucugcaucgcauuaggcaugcuaccguuucugguguucgagucuccauaaggcacccagaagcacugagagaccaggccacugauguggaucgcagcguggacagguuuacguuuagagcacugcuacccgggaagagguauacgauucaacuuacaacguugucuggacuccgcggagaggaacaucccaccgaaagcuuggcuaccgcucccacccacgucuggacacggccacugccccccgcaaaccucaccgccgcacgcguaaccgcaaccuccgcucacgucgugugggacgcuccuacaccuggcucuuuacuggaggcauauguaauuaacgugacuacuagccagucuacaaagucucgguacguuccuaacgggaaguuagcaagcuauacaguccgcgauuuacuuccuggaagacgcuaucagcucuccguaaucgcuguccagaguacagaacucgguccccagcacuccgaacccgcacauuuguacaucauuacuucacccagggauggugcagaccgcagauggcaccaagguggccaccacccaagaguacucaaaaacagaccacccccugcccgucugccugaauugaggcuacugaaugaucacagcgcacccgaaaccccuacacagcccccucguuuuuccgaacucgucgauggacgcggcagagugagcgcucgcuucgggggcucaccgucaaaagccgcaacagugcguagccacgugcccggaaacuguucggaaaaccccugucagaacggaggcacaugcgugccuggagcugacgcccacuccugcgacugcgggcccggguucaaggguagacggugcgagcuggccuguauuaaagucucgcguccuugcacucgacuguuuuccgagacaaaggcguucccagugugggagggaggcgucugucaucacguuuacaaaagaguuuaccgcguucaucaggacauuugcuuuaaggagucgugugaauccaccucauugaaaaaaacaccaaauaggaaacagucuaagucgcagacucuggagaaaucuuag

SEQ ID NO: 13878 - RNA, 474 nt, Artificial Sequence
  Description of Artificial Sequence: Synthetic coding sequence
auggaggcccuccggagagcacaugaaguggccuuacgccuccuccugugcagaccaugggcuagcagagccgcugccaggccuaaacccagugcaucugaaguuuuaacaagacaucuucuacagcgucggcuaccacauuggaccaguuuuugcgucccauauucugccguccgaaaugaucaguucggccuuucccauuuuaauuggcccgugcaaggugccaacuaucacguucugcggacaggauguuucccuuucauuaaguaccacugcucuaaggcuccguggcaggaccuugccagacagaauagguuuuucacggcucugaaaguaguuaacuuaggcauucccacccuacuguacgggcucgguucuuggcuguucgcaaggguaacugaaacuguccacacuagcuacggaccaauuacaguguauuuccuaaacaaggaggaugaaggcgcuauguauuag

SEQ ID NO: 13879 - RNA, 288 nt, Artificial Sequence; identical to SEQ ID NO: 12240
  Description of Artificial Sequence: Synthetic coding sequence

SEQ ID NO: 13880 - RNA, 1053 nt, Artificial Sequence
  Description of Artificial Sequence: Synthetic coding sequence
augaaaugcucgcugagggugugguuccuuucagucgccuuccuacucguauuuauaaugagucugcucuucaccuacucccaccauagcauggcaacgcuacccuaucuagacucaggagcccucgacgguacacacaggguuaaacuagugccuggguacgcaggauuacagcggcuuagcaaggaacggcuuucagggaagaguugugcaugcagacgauguaugggugacgcaggcgccagcgacugguucgauucccacuucgauggcaauaucagucccguauggaccagagaaaacauggaccugcccccugaugugcagcgcugguggaugauguugcaaccacaauuuaagagucauaauacgaaugaagugcuggaaaaguuguuccagauuguaccuggagaaaaccccuaccgcuuuagagacccucaccaguguaggcggugcgcuguuguugguaauucagguaaccuuagaggcucuggguacggacaggauguggacggucacaauuuuauuaugcgaaugaaucaagcucccacaguuggguuugagcaagacguggguuccaggaccacccaucacuucauguaucccgaauccgcuaaaaaccuuccugcaaauguuuccuuuguauuggugccuuuuaaaguacuugaccuccuguggaucgcguccgcucucucaacuggccagauaagguuuacauacgcaccagugaagucuuuucugagagucgauaaggagaagguccagauuuauaacccugcauucuucaaguauauucacgaucgcuggacagaacaccacggaagauaucccucaacaggcaugcugguuuuguucuuugcccuacauguaugugacgaggucaacguuuauggguuuggagcugauagcagagggaauuggcaccacuacugggagaauaaccgauaugcgggugaauuuaggaagaccgggguccacgacgcggauuucgaagcccauaucaucgacaugcuagccaaggcauccaagaucgaaguuuauagggguaacuag

SEQ ID NO: 13881 - RNA, 600 nt, Artificial Sequence
  Description of Artificial Sequence: Synthetic coding sequence
auggcaucuccugaagcuccugaguccgugguccaguuugcucucgacaaguuaggggggcuagauuacuuaguucuuaaccacauugguggggcccccgccggcacccgcgccagaaguccgcaagcuacccgcuggcuaaugcaaguuaauuucgugucuuacgugcaacugacgucccgggcacugccuucccugaccgacuccaaaggcucccuagucguugucaguagccugcucgggagaguucccacgucauucucaacuccauacucugcugcaaaguucgccuuagacggcuucuuuggcagcuuacggagagaauuggaugugcaggacgucaauguagccauuaccauguguguccugggccugcgcgaccgggcaucggcugcugaggcuguuaggggaguuaccagagugaaagcugccccaggaccgaaagccgcucuagcaguaauucgugggggugccacccgcgcagcgggaguguuuuaucccuggagguuucgacuguugugucuucuuagaagguggcuaccccgcccccgugcaugguucauacgucaggaauuaaaugucacagcagccgcagcguag

SEQ ID NO: 13882 - RNA, 411 nt, Artificial Sequence
  Description of Artificial Sequence: Synthetic coding sequence
auggugcgcccuuauccuuugauuuauuuuuuguuccuucccuuaggcgcuuguuuuccccuccuugacagacgcgaacccacugaugcaaugggcgguuugggcgcaggcgaacgcugggcugacuuggccauggggcccagaccgcacaguguguggggaucuagccgauggcugcgcgcuagccagccccaagcucugcugguuaucgccaggggauugcagacuucuggacgggaacacgcuggcuguagguuccgcuuuggccgccaagacgaaggcagcgaagcaacaggcuuucuuccugccgcaggagagaagaccucgggaccacucgggaaucuggcugaagaacuuaauggcuauucacgcaaaaagggcggauuuaguuucagauuuggucgaagauag

SEQ ID NO: 13883 - RNA, 663 nt, Artificial Sequence
  Description of Artificial Sequence: Synthetic coding sequence
augagaggccagggaagaaaagagucacugagugauucucgcgaucucgauggcucauacgaccagcuaaccgauagcguugaugaugaguuugagcuaucuacuguaugccauagaccugagggccuggagcaguugcaagagcaaaccaaauuuacgcgaaaagaguugcagguccuguacaggggcuuuaaaaacgaaugcccuagcggaauagucaacgaagagaacuucaaacagaucuauagucaguucuuuccccaaggugauucaaguacuuacgcuacauuccuuuuuaaugcuuucgauacuaaccaugauggcuccgucagcuuugaggauuucgucgcaggucuguccgugauuuugcgaggaacaguagacgauagauugaauugggccuuuaaccucuaugaucugaacaaggacggaugcauuacaaaagaggaaaugcuugauaucaugaaguccaucuacgauaugaugggcaaauauacauacccugcauugcgagaagaggcaccccgcgagcauguugaaucauucuuucaaaaaauggaccguaauaaagauggcguggugaccauugaggaauucauugagucgugccagaaagacgagaauauuaugcgcuccaugcaacucuucgacaaugugauuuag

SEQ ID NO: 13884 - RNA, 2175 nt, Artificial Sequence
  Description of Artificial Sequence: Synthetic coding sequence
augcuccgaaccucgacucccaauuuguguggcggucuacacugucgagccccauggcucuccagcggaauucucugccugugccucauuuuuuuacucggacagguuggccuccuccagggccacccucagugccucgauuacggcccucccuuucaaccuccucuccaucucgaauuuuguagugacuaugaaaguuuuggauguugcgaccagcacaaggaucgaaggaucgcagcccgcuacugggacauuauggaguauuuugauuugaagagacacgaauuauguggugauuauaucaaagauauccuuugucaggaauguuccccguaugcugcucacuuguaugacgccgagaacacacaaaccccgcugcguaauuuaccaggacucugcucagauuauuguucagccuuucacucuaauugucauucugccauauccuugcuaacuaaugacagggggcugcaggagagccauggaagagauggaacccgcuucugucaccugcucgaccugccagacaaagauuacuguuucccgaauguguugcguaaugacuaucuuaacaggcaccugggaaugguugcccaagacccucagggcugcuuacagcugugccuguccgaagucgcuaauggacucaggaaccccguaucuauggugcacgcaggugauggcacucacagguuuuucguagccgaacaggucgguguaguauggguguacuugccagauggaagcagacuugaacagcccuuucucgaucuuaagaacaucguauuaaccacaccguggauuggugaugagcgcggguuccuggguuuggcuuuucauccaaaauuucgucauaacagaaaauuuuacauauauuauucuugucucgacaagaaaaaaguugaaaaaauucgaauaucagaaaugaaagucucucgugcugacccuaacaaagcugaccuaaagagugaacgagugauccucgaaaucgaagagccugcauccaaccacaauggggggcagcuguuauucggacuugacggguauauguauauauucacgggcgauggugggcaggcuggggauccuuucggacuguuugguaacgcgcaaaauaagagcagucuacucggcaaaguauuacguaucgacgugaaccgcgcuggcucccacggaaagagguauagggugcccuccgauaaccccuucguaucggagcccggagcucauccugcgauuuaugcuuauggaauucggaacauguggcggugugccguggaccgcggggacccuauuacuagacaggguaggggacggauuuucuguggggacgucggccaaaaucgguuugaggagguggaucucauccuuaaaggaggaaacuacggauggcgcgcuaaagaaggguucgcuugcuacgacaaaaaacuuugccacaaugccucacuagaugauguacugcccaucuaugcuuacggccacgccguugguaagucggucacaggcggcuacguauaccgcggcugcgaaagcccuaaucuuaacggucuguacaucuuuggagacuuuauguccggacgccugauggcucuccaggaggaucguaaaaauaaaaaauggaagaaacaggauuugugccucggcagcaccacaucuugcgcuuucccuggucucauuagcacccauucgaaauucaucaucuccuuugcugaagacgaggcaggagaacuauacuuuuuggccaccuccuaucccuccgccuacgccccacgaggcucuaucuauaaguuuguggacccaucccgaagagccccccccggaaagugcaaguacaaaccagucccagucaggaccaaguccaaacgcauccccuuuaggccccucgcuaaaacuguucuggacuugcugaaggaacaauccgaaaaggcugcccgcaaauccagcuccgcaacgcuggccuccgguccggcccaaggguuaagugagaagggauccucuaaaaaacuugccaguccuaccucuaguaagaauacucuccguggcccaggaaccaagaaaaaagcuagaguugggccucaugugcgucaggggaagcgacgcaaaucgcugaagucgcauaguggacgaaugagacccucugccgaacagaagagagccggaagaucacuaccuuag

SEQ ID NO: 13885 - RNA, 1218 nt, Artificial Sequence
  Description of Artificial Sequence: Synthetic coding sequence
augugguaugugagcacacgaggggucgcaccaagggugaauuuugagggagcacuuuuuucugguuaugcacccgauggcggucuauuuaugccugaagaacugccucaguuagacagggggacccugugucaauggucaacacucaguuaucccggacuugugaaggagcucugugcccuguucauagguucagaguugcugccuaaagaugaacuuaacgaccugaucgaucgggcauuuuccagguucagacacagagaggucgugcaccuuagucggcuacguaauggacucaacguccuggaacuauggcacgggguuacauaugcauucaaggaucugucccuaucuugcacaacgcaguuccuccaauauuuucuggaaaagagagaaaagcaugucaccguaguugugggaacaucaggugauaccggcucugcggcuauugaaagcguccagggggccaaaaauauggauaucauuguuuuacugccaaaagggcacugcaccaagauccaggaacuccaaaugacuacagugcugaagcagaauguucacguauuuggcguggaaggaaacucggaugaguuggaugaacccaucaaaacuguguuugccgauguugccuucguaaagaaacacaaccuuaugagucucaacucuaucaacugguccaggguguuaguccaaauggcacaccacuuuuuugccuauuuccaguguacaccaagccuggacacucacccacucccucucguagaagucgucguuccaaccggcgcagcggguaaucucgcggccggcuauaucgcccaaaagauuggauugccaauucguuuggugguugcugugaaucgcaaugauaucauucaucguaccguccaacagggggauuucagucugagcgaagcuguuaaaagcaccuuggccagcgcgauggauauccaggucccuuacaauauggagcgagucuuuuggcugcuuagcgguucggacucacagguaaccagagcccugauggaacaauucgagcggacacaaucaguuaacuuaccaaaggagcugcauagcaaaugggagcgucaggacuacgagaagauggcagugauggagugugacggcuguuguguugaacugugccuggggaacuguggaccacgccggggcagcgucaccgacauccccgguaccgcaauggugcggggcgggggauag

SEQ ID NO: 13886 - RNA, 492 nt, Artificial Sequence
  Description of Artificial Sequence: Synthetic coding sequence
augacuaugaggcacaacuggacccccgaucuuagcccacuguggguucugcuguugugcgcacacguggugacccuccuggugagagcuacccccguaucucaaacaaccacggccgccacagcuuccguucgcuccacaaaggaucccugcccuucucaaccccccgucuucccugccgccaaacagugcccagcccuggaagugacuuggccagaagucgaggucccuuuaaauggcacccugucccuauccugugucgcgugcucccgguucccuaacuucuccauacucuacuggcuggguaaugggucauucauagagcaccugcccggucgguuaugggaaggaucgacuucuagggaacgggguucuacuggcugggcagagggaaaucuggccccccacccccgcucaccugcgcuucaaccgcaacagaguacagccgccggucuacgccuaucuaccggucccgcagcagcacagccauag

SEQ ID NO: 13887 - RNA, 1590 nt, Artificial Sequence
  Description of Artificial Sequence: Synthetic coding sequence
auggcuccugcucggacaauggcccgcgcucgucuggcucccgccgguauuccugcaguggcccuguggcucuugugcacacuugggcuucaggggacccaagccggcccuccccccgcccccccuggucugccugccggagcugacugccugaauucuuuuacagcaggggucccuggguucgucuuggauacaaacgcuucuguuucaaauggcgccaccuuuuuagagucaccaacagugagacguggaugggauuguguaagagcuugcugcacaacccagaacuguaaccuugcccugguggaauuacagccagaccggggggaggaugcuauugcugccugcuuucucauuaauugucucuacgagcagaacuucguaugcaaguuugcccccagagaaggcuuuaucaacuaucucacccgcgagguguaucggagcuacagacaacuaaggacacaaggauucggaggcaguggaauaccaaaagcuugggcagggauagaucuaaaagugcaaccucaggaaccuuugguucuaaaggacguggaaaauaccgacuggagacuucucagaggggauacagauguaaggguggaacggaaagaucccaaccaaguugagcucuggggccugaaggaggguacuuaccuguuccaguuaacaguuacuucauccgaucauccagaggacaccgcaaaugugaccgucaccgugcugucuacaaagcagacagaagacuauugucuugccuccaauaaagucggccgcugccggggcagcuucccuagaugguauuaugauccuacagaacagauuugcaagucauucguauauggcggcugccucggaaauaaaaacaacuaucugagagaagaagaauguauccuggccuguagaggaguucagggcgguccacugcgagggagcuccggcgcacaggcgaccuucccccagggucccuccauggagcggcgucaccccguguguucgggaaccugucagccaacccaguuucgauguuccaacggauguuguaucgauucauuuuuagaaugcgacgauaccccgaauugcccagacgcuuccgaugaagcugcuugugagaaauacacaucaggauuugacgaguugcagagaauacacuucccauccgauaaaggccauuguguugaucugcccgauacugggcugugcaaggagucuaucccuagaugguauuacaaucccuucucugaacacugugccagguucaccuauggaggaugcuaugggaauaagaauaauuuugaggaggagcagcaaugucuggaaaguuguagaggaaucucaaagaaggauguuuuuggauuaagacgcgagauaccaauaccuagcaccggauccguugagauggcagucgcuguguuucugguaauuuguauuguggugguuguggccauucugggcuauuguuuuuuuaagaaccaaagaaaagauuuucacggccaccaucaucaccccccaccuacacccgccagcaguacuguuucgacgacagaggauacagaacaucuuguauacaaucacacaaccagaccacuuuag

SEQ ID NO: 13888 - RNA, 1803 nt, Artificial Sequence
  Description of Artificial Sequence: Synthetic coding sequence
augcaggggccacucuugcucccaggccuguguuuuuuguugagucuuuucggcgcugucacccagaagacgaaaaccucgugcgccaaauguccuccgaaugccagcugcguuaauaacacacacuguacaugcaaccacggauauacuagcggguccggccaaaagcuguuuaccuuucccuuagaaacaugcaacgauacaacgagcucaaagacuacagaggggaggaaagaauuacagaagauugucgauaaguucgagucacugcucacaaaucagaccuuauggagaacggaaggacgccaagagaucagcucuaccgccacuacaauucuucgcgaugucgaaucaaagguccucgagacggcacugaaggauccggaacaaaaggugcuaaaaauucagaacgacucuguggcuaucgagacacaggccauaaccgacaauugcuccgaggaacguaagaccuucaaccuuaacguccagaugaauucgauggauaucaggugcucagacauaauccagggagacacgcagggaccguccgcaaucgcuuuuauuaguuauagcuccuuaggcaauaucaucaacgccacuuuuuucgaagaaauggauaaaaaagaccaaguguaccugaauucacaagucgugagcgcagcuauagggccuaagcgaaacguuucacuuaguaaauccgugacucugaccuuccagcaugucaagaugaccccuucgacaaaaaaaguguucugcguguauuggaaguccaccggccaaggaagccaguggagccgcgacggcugcuuccugauccauguuaauaagucacauacaaugugcaacuguucucaccuuagcuccuucgcaguuuuaauggcacugacaucucaggaagaggauccagugcucaccguaauuaccuacguaggucucaguguguccuuacugugucucuugcucgccgcccugaccuuuuugcugugcaaggccauucgaaacacuucuacuagucuccaucuucagcugagcuuaugucuuuuccuggcccaccuccucuuucuugucgggaucgaccgcaccgaacccaaagugcugugcucaauaauugccggugcucugcauuaccuguaccucgccgcuuuuacauggaugcugcucgaggggguucaccuauuccugaccgcccggaaucuuacagucgucaacuacaguagcauuaaccgccuuaugaaauggauaauguuuccaguaggcuauggagucccagcugucacuguggcaauuagugccgcuucauggccacaccucuacgguaccgcagaccggugcuggcugcaccucgaucaaggcuuuauguggagcuuucucggacccgucugugccaucuucuccgcaaaccucgugcuauuuauucuuguguucuggauacucaagcgaaaauuauccucucugaauagcgaaguaucaaccauccaaaauacacggaugcuggccuuuaaggcaaccgcucagcuuuucauccuugguuguaccuggugccucggcuuacuacagguuggacccgccgcccagguuauggcuuaucuguucaccauuauuaacagucuccagggguucuucauuuuucuggucuauugcuugcugucucaacagguucaaaaacaauaucaaaagugguuucgagagaucgucaaaucuaaauccgagucagaaacauacacuuuaucuucgaagaugggcccugauagcaagccgagugagggggacgucuuuccaggacagguuaaacgcaaguacuag

SEQ ID NO: 13889 - RNA, 660 nt, Artificial Sequence
  Description of Artificial Sequence: Synthetic coding sequence
augaagcuccugcugugggcgugcauuguuugcguugccuucgcucguaaaagaagguucccauucauuggggaagacgacaaugacgacggucauccgcugcaucccucucuaaauaucccauauggaauccguaaucuaccucccccucuguauuaccggccugucaauaccguucccagcuauccggggaauaccuacaccgauacaggccuucccucauauccauggauccugaccucccccggcuucccuuacgucuaucacauucgcggcuuuccuuuagccacgcaacugaaugucccuccccugccaccacguggguuucccuucgucccccccagccgguuuuuuucagcugcugcagcuccagccgccccuccuauugcagcagaaccagcagccgcagcuccccugacagccacucccgucgccgccgaaccagccgccggagcucccguggcagcugaaccagcugcugaagcuccuguuggagcggaaccagcugcggaagccccagucgccgccgaaccagccgcagaggccccagugggaguugaaccugcugccgaggagccaucaccagcagagccagccaccgcaaagcccgcugcgcccgaaccccaucccucaccuucucuugaacaagccaaccaguag

SEQ ID NO: 13890 - RNA, 1743 nt, Artificial Sequence
  Description of Artificial Sequence: Synthetic coding sequence
augcaucuaagcgcaguuuucaaugccuugcuugugucgguccuugccgcagugcuuuggaaacacguucggcucagggaacaugcugcaacacuggaggaggagcuggcccuaucuagacaagccacggaaccugccccugcacuccggauugacuaucccaaagcuuuacaaauccuaauggagggcgguacacacaugguauguaccgggagaacccauacugaucguauuugucgguucaaauggcugugcuacucaaacgaagcagaagaguucauuuuuuuccauggaaacacuucagugaugcugccuaaucugggcucucggagauuccaaccagcccuacucgaccucucuacuguagaagaccacaacacacaguacuuuaacuucguagaacugcccgccgccgccuuaagguuuaugcccaaacccguauuuguuccugacgucgcacugaucgccaaccgauuuaaccccgacaaucugaugcaugucuuucaugacgaccuccugccccuauuuuauacacucaggcaguucccaggccuggcacacgaggcaagacuguuuuuuauggagggcuggggcgaaggugcucauuucgaucucuacaagcuccuaagucccaagcagccccuccugagggcccaacucaaaacgcucggcaggcuccuguguuucucacacgccuucgugggucuaucuaaaaucaccacuugguaucaguacggguuugugcagccccaagggccuaaagcgaacauucuggugucugguaaugaaauucggcaguucgcucgauucaugacagaaaaacuuaacgucagccacaccggcgugccacugggcgaggaauauauuuuaguguucucacgaacucaaaaucgccuuauucucaaugaagcagagcuacugcuugcacuugcacaggaauuucagaugaaaacaguaacugucucacuugaagaccacacuuucgccgaugucguuaggcugguaucuaaugcaucaauguuaguuagcaugcauggcgcacagcucgugacuacgcucuuccugcccaggggggcaacaguuguugaacucuuuccuuacgcagucaaccccgaccacuauacaccguauaagaccuuagcuauguuacccgguauggaucuccaguacguagcuuggagaaacaugaugccagagaauacuguaacacauccugaacggccgugggaccagggcgggauuacucaucucgauagggccgaacaagcaaggauacuccagucacgagaagugcccaggcauuugugcugccgcaaccccgaguggcuguuucgcauauaccaagauacaaaaguugauauaccuucucugauucagacgauccgaagaguggucaagggcagaccgggcccuaggaagcagaaauggacuguuggucuguaucccgggaaagugagagaggccagaugucaggcauccgugcauggcgccagugaagcgagacugacagucagcuggcagauccccuggaaccugaaauaccucaaagucagagaaguaaaauaugaagucuggcuccaagaacagggugagaacacuuauguaccguacauccucgcucuucaaaaucauacuuuuaccgagaacaucaaacccuucaccaccuaucucgugugggugagaugcaucuucaauaaaauacuccuggguccuuucgccgacguccuggugugcaacacguag

SEQ ID NO: 13891 - RNA, 5130 nt, Artificial Sequence
  Description of Artificial Sequence: Synthetic coding sequence
auggguuuucuuccaaagcugcuauuguuggccaguuuuuuuccagcaggacaagccucauggggugugagcucuccucaggauguccagggcgugaagggaagcugccuuuugauuccauguaucuuuaguuuuccagccgacguagaagucccggacggcaucacagccaucugguauuacgacuacucugggcagcggcagguggucucucauucagcugaccccaaacuaguggaggcgcgauuuagagggcguacagaauuuaugggcaacccggagcaccgaguuugcaaccugcuucucaaagaccugcaaccagaagacucuggcaguuauaauuuccguuucgagauuucagaaguuaacagauggagcgaugugaaaggaacguuggugaccgugacagaggagccccgugugcccacuaucgccuccccaguggaacuccuggaagguacggagguagacuucaacugcagcacgcccuaugugugccuccaggaacaggugcgacuucaauggcagggucaggauccagcuagaucaguuaccuuuaauucucagaaauuugagccuaccggugugggacaccuugaaacacuucacauggcuaugucauggcaggaucauggccgcauucugcggugccagcugucugucgcgaaccaucgggcucaauccgagauucaccugcaggucaaauaugcucccaaaggcguaaaaaucuugcucucaccaagugggcgaaauauucuacccggcgaauuagugacgcugacaugucaagucaauagcucauauccugcagucuccucaauuaagugguugaaggauggagugaggcugcagaccaaaacaggaguucugcauuugccgcaagccgcaugguccgacgcuggcguuuacaccugccaggcagagaacggugugggauccuuggugucuccuccaauaucacugcacaucuuuauggccgaaguacagguuagccccgcagggcccauccucgagaaucagaccguaacucuugugugcaauacccccaacgaggccccuuccgaucugcgcuauagcugguauaaaaaccauguccuucucgaagacgcucacagccacacucuccgcuugcaccuggccacccgagcugauacuggauucuauuucugugaggugcaaaaugugcacggauccgaacgcuccgggccaguuuccguuguagugaaucacccuccucucaccccuguccugacugccuucuuagagacacaagcuggccuggucggcauacuucauugcucaguggucucugaaccucuagcaacacugguccuaucacauggagggcacauccuggcaagcacaaguggcgauagcgaucacuccccccgauucucaggaaccucuggaccaaauucauuaaggcuggaaauucgcgaccucgaagaaaccgauagcggcgaauauaagugcucugccacaaacucauuggggaacgccacaucgacucuggauuuccacgcaaacgccgcuaggcucuugaucucacccgccgccgaggugguagaaggccaagccgugacacugagcugcaggucaggucugucucccaccccugaugcucgauuuagcugguacuugaacggugcacugcugcacgaaggaccagguuccucucugcuuuuacccgcugcuucuuccacugacgcaggauccuaccauuguagagcucgugaugggcacucugccagcggcccaagcuccccugcuguucugacugugcucuacccuccgaggcagcccacauucaccacuaggcuagauuuagacgcagcuggugcuggagcaggcagacguggauugcugcuauguagagucgauucggauccucccgccagauugcaacuucugcacaaggaucgcguugucgccacaaguuugccuucaggcggcggcugcagcacaugcggagggugcucaccccgcaugaaggugacaaaagcgccuaaccuccuacgcgucgaaauacauaacccacugcuugaagaagaggggcuguaucugugugaagcgucuaacgcccuuggaaaugcaucaacuucagccaccuuuaauggccaagcuaccgugcuugccaucgccccaucacauacuuugcaggaagguacugaagcaaaucucacuugcaaugugucucgcgaagccgcagguucucccgccaauuuuagcugguuuagaaauggcguccugugggcccaaggaccucuggagacaguaacucuguugccaguugcccgcaccgacgcugcucuguaugcaugccgaauucucacagaggcuggagcucaauugucaacaccuguucugcuuagcguccuuuauccaccugaccgcccuaaacuaucagcacugcuagacaugggacaggggcacauggcauuguucaucuguacagucgacaguaggccucucgcacuccuggcgcuuuuucauggcgaacaccuucucgcuacuucucuggguccccaggugccuucucacggaagauuucaggccaaggccgaagcaaauagccuaaaacucgagguaagggagcuaggccuuggcgacuccggcucuuaucggugugaagcaacaaaugucuuaggaucaucaaacacuucacuguuuuuucaggugcggggcgcuugggugcaggugucgccgucccccgagcuucaagagggccaagcaguaguucuuuccugucaagugcauacagggguaccagagggaacuuccuauaggugguaucgagauggccagcccuuacaagagucuacgucagcaacguugagguucgcagcuauuacucugacacaagcuggggcuuaucauugccaggcucaggccccaggcucugcgacaacuucucucgccgcucccauuucacugcacgugagcuaugcuccacgucaugugacauuaacaacccuuauggauacagguccuggaaggcugggacugcugcucugccgcguggacucagaccccccagcucagcugcgucugcugcauggagauagacugguugcaucuacgcuccagggcguuggcgggcccgaaggcagcuccccacgccuccacguugcaguggcccccaacacauuaagguuggaaauccauggcgcaauguuagaggaugaaggcguguacaucugugaggcuucgaauacucuaggucaggcauccgccucugcugauuucgaugcacaagccguuaauguacaggucuggccaggcgccaccguccgcgagggucaguuaguuaacuugaccugccucgucuggacuacccacccugcccaacucaccuacaccugguaucaggacggacaacagaggcuagacgcccacuccaucccccucccuaacgugaccgugagagacgcaaccucauaucgcuguggcguggggccgccuggacgcgccccuagacugucccggccaauuacgcuggauguccuguacgcuccucgcaaccuuagguugacuuaccuucuggagagucauggcggucaacuagcacugguucugugcacaguggauucucgcccacccgcccaauuggcguugucucacgcuggucgucucuuggcuaguucgacugccgcaucugugccaaauacucucagauuagaacuucgcggcccccagccacgcgaugagggguucuacucauguucagcacgcucaccacucggucaggcuaauaccucccucgaauuaagguuggagggcgucagggugauccucgcaccagaggcugccguccccgaaggcgcgcccauuacggugaccugugccgauccagccgcacacgcccccacucuguauaccugguaccacaaugguagauggcugcaggaaggaccugcugcuucucucucauuucugguggccacacgggcucacgccggagcauauucuugccaggcucaggacgcgcagggaacccggaguuccagaccagccgcucuccagguccuguaugcuccccaggaugcgguguuauccucauuucgcgacucucgugcuagaagcauggccgugauucaguguaccguugauagugaaccuccagccgaguuggcuuugucccacgacggaaaggugcuugccacaucuuccggugugcacucccuugcaucgggcaccgggcacguucaggucgcuagaaacgcucuuagauuacagguccaggacgugccugcaggagacgacacauacgugugcacugcucaaaacuuacuaggaaguaucagcacuauaggcagacuucagguagagggcgcacgagugguugcggaacccggcuuagacgugcccgaaggcgccgccuugaaccuaagcugccgacugcugggcggccccgguccuguugggaacucgacguuugcaugguucuggaacgacaggagacuccacgcugagccaguuccuacacucgccuucacucacguagcccgcgcucaggcugguauguaccacugucucgcugaacuuccaacaggggcagcagccagugcgccugugaugcugaggguucuuuaucccccuaaaaccccuacaaugaugguguucgucgaaccagaagggggacuccgaggcauccuggacugccgcguugauuccgaaccgcuggcaaguuugacacuccacuuagguaguaggcucgucgcuaguucacagccccagggcgcucccgcugaaccgcauauucauguucuugcuagucccaaugcacuuagagucgauaucgaagcccugagaccaagcgaccagggagaauacauuuguuccgccucgaacgugcuggggagcgccucaacaagcaccuacuuuggcgugcgcgcauugcaucggcugcaucaguuucagcaacugcuguggguacugggucuccuggucggauuacuccuucuccuguuaggacugggugcguguuacacauggcgucggagaaggguuuguaaacaaucaaugggugagaauuccguagaaauggccuuccagaaagaaaccacucaacuaauugacccugacgcagcaacaugcgaaaccuccacuugugcacccccccucggcuag

SEQ ID NO: 13892 - RNA, 693 nt, Artificial Sequence
  Description of Artificial Sequence: Synthetic coding sequence
augugcgucacauaucacaacgggacaggcuauuguaagugcccugagggcuuucugggggaguacugccagcaucgggaccccugugaaaaaaacaggugucaaaaugguggcacaugcgucgcgcaggcaaugcucgggaaagcgacaugccgcugcgccucuggauuuaccggcgaagauugucaguacagcacaucucacccuugcuucguuucuaggcccugccucaauggaggaacaugccauaugcuaagccgagacaccuaugaauguaccugccagguugguuuuaccgggaaggagugucaauggacugaugcaugccucucucauccuugcgccaaugguagcacguguacaacuguugcaaaccaguucagcugcaaaugucuuaccggauuuacgggccaaaagugcgagacagaugugaaugagugugauauaccuggccacugucagcauggcggcacgugucuuaaucuccccggaagcuaucaaugccagugccugcaggguuuuacgggacaauauugugauucccucuaugugccuugcgcuccuucuccuugcgucaauggcgggacaugccggcaaacaggcgauuucaccuucgagugcaauugucugccugcgacauggcccaucuuuccaaaauuauugucccugcaagaaaaagagucuuacugcuag

SEQ ID NO: 13893 - RNA, 660 nt, Artificial Sequence
  Description of Artificial Sequence: Synthetic coding sequence
auguucguaagcuaccucauucucacucuccuccacguucaaacagcagugcuggcgaggccaggcggagaaucuaucggcugugacgauuaccucggaagugacaaggugguggauaaaugcggcguguguggaggcgauaauacaggcugccaagucguguccgggguguuuaagcacgccuuaacaagcuugggguaucaccgugucgucgaaauaccagagggagcgaccaagauuaauaucaccgagauguauaagagcaacaagaagaagucccaucucaaaccagcuacaaggggcagccaguucagcagcgugaaaguguguucagucccggccgcuugcaaacucuuagggacccccgguagagccaggcaaccgguuccugcaccccgugagcuggagcacgacaaaaauucuccacauugugccuaucugucucuuuauuuaacgucauuagcccagucuaguuggcgcgucuucucgcuguuuucuuauguccugaucuacuuauucucuaaauaccucgccuuuaauacgcuguuugcucugaagaggauggcccuucagcgagacagaaaggagaaaacucgcgcaugguguauuuucauuaaguuauguggacgagaaauucagauccucccaggcccuguguag

SEQ ID NO: 13894 - RNA, 363 nt, Artificial Sequence
  Description of Artificial Sequence: Synthetic coding sequence
auggauaacguacagccuaagaucaaacaucgcccauuuuguuuuucugugaagggccacgugaaaaugcuuaggcuugcccugacaguaacgagcaugaccuuuuuuauaaucgcccaggccccagaacccuacauuguaaucaccggcuucgagguaacugucauccucuuuuuuauuuuacuauacguuuuaagacucgauagacucaugaaauggcuuuucuggccucuauuagucuuugcacucguuacugcuguuugcugccuugccgauggagcauugauuuaccguaaauuacuguuuaacccaucaggcccauaccagaagaaacccguucaugagaagaaagaaguacucuag

SEQ ID NO: 13895 - RNA, 864 nt, Artificial Sequence
  Description of Artificial Sequence: Synthetic coding sequence
auggcucccuggucccaccccucugcgcaauuacagccgguuggaggagacgcggugucucccgcacucaugguucugcuaugcuugggcaaucucaguaaggcuacacucugggcugagccugggaguguuaucucccgcggcaauucaguuacuauuagaugccagggcacucucgaagcgcaggaauacagacugguuaaagagggaucucccgaaccuugggacacucaaaacccccuugaaccaaagaauaaagcccguuuuucuaucccuucaaugacugaacaucaugcaggccgguaucgaugcuauuauuacucgccggcaggaugguccgaaccuucugauccucuggaacucguggucacaggauuuuauaauaagccuacacuauccgcccugccaagccccgucgugacgucuggugagaacguaacacuucagugugguaguaggcugagauuugaccgguuuauccugaccgaagagggcgaucacaaacugucuuggacucuugacucacagcugacacccuccggacaguuccaagcacuguuucccgucgggcccguaacucccucacaccgauggaugcucaggugcuaugggaguagacggcacauucuccagguguggucagaaccaagcgaucuacuugagaucccaguaagcggagccgcagauaaucucuccccuucccagaauaaaucugacaguggcacugcuucacaucuccaggacuaugccgucgagaaucugaucaggaugggaauggcuggccucauccuugucguacuuggcaucuugaucuuucaagauuggcauucacaaagaaguccacaagcagccgccggacgcuag

SEQ ID NO: 13896 - RNA, 438 nt, Artificial Sequence
  Description of Artificial Sequence: Synthetic coding sequence
augggaaucgguuguuggcgcaauccuuuacuuuuacuuaucgcacucguccugucagccaaguuaggccacuuccaaaggugggagggcuuccagcagaaguuaaugagcaaaaagaauaugaauucaacccuuaacuuuuucauacaaucguauaacaaugccuccaaugacacuuacuuguacagagugcagagacugauucgaucccagaugcaacucacaaccggcguagaauacauaguuacggugaaaaucggguggacaaaauguaaacggaaugauaccucgaauucauccugcccccuccaaagcaaaaaacuacggaaaucccucaucugcgagucucucauuuauacaaugccguggaucaacuauuuucagcuguggaauaauucuugucuugaagcagagcacgucggcaggaaccugagauag

SEQ ID NO: 13897 - RNA, 1776 nt, Artificial Sequence
  Description of Artificial Sequence: Synthetic coding sequence
augcaacaggacggccucggcguggguacccgcaaugggucuggaaaaggacgcucaguacauccuucuuggcccuggugcgccccucguccucuccgcuauuucgguagagaugcccgugcucgcagagcccagaccgcagcuauggcccucgcuauucaagucacugucucaaauccguaccauguggugauccuguuucagcccguaacuuugccuugcaccuaucagaugacguccacuccaacccaacccauagucauuuggaaauacaagaguuuuugcagggauagaauugcagaugcuuuuagcccagccuccguugacaaucaacucaaugcacagcucgcugcagggaaccccggauacaaccccuauguggagugccaggauuccgugcggacaguuaggguugucgcaacaaagcagggcaaugcuguuacacucggggauuacuaccaaggacggagaauuacaauaacaggaaacgccgaucucaccuucgaucagaccgcguggggggacaguggaguguauuauugcagugucguauccgcucaagaucuccagggaaauaacgaagcuuaugccgaacugauugugcuggggcguacauccggcguggccgagcuucugccaggguuccaagccggccccaucgaagauuggcuguuugucgucguaguuugucucgccgcuuuccugaucuuuuuacugcugggaauauguuggugucagugcugcccucauacaugcuguugcuauguacgauguccuuguugucccgauaaaugcugcugccccgaagcucuauaugcugccggcaaggcugcuacuucaggcgugcccucaauuuacgcaccaucuaccuacgcucaccucuccccugcuaagaccccacccccccccgcuaugauucccauggguccugccuacaacggguaccccggcggcuacccuggagauguagacagauccagcucugugagaagcgguuauagaauccaggccucucagcaagacgauagcaugcgggugcucuacuacauggaaaaagaguuggcuaauuuugacccgucgcggcccggaccaccuagcggcagaguugaacgcgccauguccgaagugacaagccugcacgaagaugauuggagaucaagacccucaagagggcccgcccugacucccauuagggacgaggaguggggcggacacucuccuaggagcccacgaggaugggaucaagagccagccagggagcaggcgggcgguggauggagagcgcggcgcccccgcgcgaggucaguagaugcucuggacgacuugacaccaccaaguacugccgaauccgggagccgcucaccaacuaguaauggaggaagaucgcgagccuacaugccaccacgcucacgguccagggaugaucuguacgaucaggacgauagccgagacuuucccaggucaagagauccacauuaugaugauuuccgcucgcgagagcgcccaccugccgauccucgaagccaccaccacagaacucgggacccacgcgacaacgguucuagaucuggagaccugccauacgauggaagacugcuugaagaggccguucggaaaaaggguucagaggaaagacgucggccccauaaggaagaggaggaagaggccuacuaucccccugcuccacccccguauagcgagacugacucacaagccagucgggaaagacgccugaagaagaaucucgcucugaguagggagagccuaguuguuuag

SEQ ID NO: 13898 - RNA, 678 nt, Artificial Sequence
  Description of Artificial Sequence: Synthetic coding sequence
augaacagguguccccgcagaugucgaucuccccucggucaagcugcacguucauuauaccagcuuguuaccgggucacugagucccgacaguguggaugacgaguuugaacugucuacagugugccacagaccagagggacuagaacagcuacaggagcagacaaaauuuacgcgaaaggaacugcagguuuuauaucgaggauucaagaacgaaugccccuccggcaucguaaacgaagaaaacuucaaacagaucuacucccaauuuuuuccccaaggcgacucauccacauaugccacguuucuguucaacgcauuugacaccaaucacgauggcucaguguccuuugaagacuucguugccgggcuuucugucauuuuacgaggaacuguggacgaucggcucaauugggcauuuaaucucuaugaccugaauaaggacggcugcauuacgaaggaagagaugcucgacauaaugaaguccaucuaugacaugauggguaaauauacguauccagcuuugcgcgaagaggccccccgagagcacguagaauccuuuuuucagaagauggauagaaauaaggacgggguggugacuaucgaagaauuuauugaaucuugccaaaaagaugaaaacauuaugagaaguaugcagcuguucgacaacgugaucuag

SEQ ID NO: 13899 - RNA, 705 nt, Artificial Sequence
  Description of Artificial Sequence: Synthetic coding sequence
augccagccuccucacccuuucugcuggccccaaagggccccccugguaauaugggaggaccagugagagaaccugcauuauccgucgcccucuggcugucauggggagccgcacuaggcgccguggccugcgcaauggcccucuugacucagcagacugaacugcaaagcuugagacgagaaguuuccagacugcaggggacaggcgguccuagucagaauggggaggguuaccccuggcagucacugcccgaacagucuagugacgccuuggaagcgugggagaacggagaaagaucucggaagcgccgagcagucuugacccagaaacagaagaaugauagcgaugugacagaagugauguggcagccagcccuacgccgcggccggggucugcaagcacagggguaugggguuagaauucaggacgcggguguuuacuugcuguacucucaggugcuuuuucaggacguuacuuucacaaugggccaaguugugucucgcgagggccaaggaagacaagagacucucuuccgcugcauucgcucuaugcccucucaucccgauagagccuacaacucuugcuacagcgcugggguuuuccaucuccaccagggcgacauucuuuccgugauaauuccacgcgcacgcgccaaacucaaucucuccccacauggcaccuuucugggauucgucaagcuguag

SEQ ID NO: 13900 - RNA, 2400 nt, Artificial Sequence
  Description of Artificial Sequence: Synthetic coding sequence
augaaaccaaugcuuaaagacuucagcaaccuauugcuaguagugcugugcgauuacguccugggagaggcugaguaccuguugcuccgcgaaccuggccacguggcccucucaaaugauaccguguacguagacuuccaguauuuugauggcgccaacggcacgcugcgcaacgugucugugcuacuauuggaggccaauacuaaccaaacaguuaccaccaaauaccuacugacaaaucagagucaaggaacauugaaauuugaauguuuuuauuuuaaagaggcaggcgauuacugguucaccaugaccccagaggcaaccgacaauucgacucccuuuccguggugggagaagucagcguuucuuaaggucgaauggccuguguuccauguugauuugaaccguagcgcuaaagcagcagaggggaccuuucagguaggccuguuuaccucucagccucugugccccuucccuguagauaaacccaacauuguagucgacguuauuuuuacgaauucccugcccgaagcccggaggaacucucgucaaccccucgagauaagaacauccaaaagaacagaacucgcacagggccaguggguggaauucggaugcgcaccgcuaggcccagaagcuuacgugaccgucguauugaaacuccugggucgggauucaguuauaacaaguaccgguccgauagaucuagcucagaaguucggauauaagcucguaaugguccccgaacugacgugcgagucuggugucgaagucaccgugcugccgccaccgugcacauuuguccaggguguggugaccguuuucaaagaggccccucgauaucccggaaaaaggacuauccacuuagcggagaacagccugccacugggcgagaggaggaccauuuucaauuguacccuguuugauaugggaaaaaauaaguauugcuucgacuuuggcaucaguucccggagccacuucagcgccaaggaagaguguaugcugauucagaggaacaccgccuuccagcccucgucgcccuccccucuccaaccccagggcccugucaagucuaauaauauaguuacugucaccgguaucucccugugucuuuucaucauuaucgccaccguucuaaucacucuuuggaggagauucggucggccagcuaaaugcucuacccccgccagacacaauuccauucauagucccagcuucaggaagaauagcgaugaagaaaacauuugugagcuauccgagcaacguggaagcuuuucugacggcggcgauggcccuacaggcucccccggcgacacagggauaccccuuaccuacagacguucgggcccagucccccccgaagaugaugccucugguuccgaauccuuucagucgaacgcucaaaagauaauuccaccccuguuuuccuaucgucuugcccagcagcaacuuaaggagaugaaaaaaaaaggacugacugaaacaacuaagguguaccacgucagucagagcccgcuuacagauacggccaucgacgccgcccccucugcaccccuugaccucgaaagucccgaagaagccgccgccaacaaauuccggauaaaaagccccuucccugaacagccagcggugagugcaggagaaaggccccccucaagauuagaccucaauguuacucaggcuucaugugcgauaagccccagccaaacgcugauucggaagucccaagcccgccacgugggaagccggggcggucccucggagcgcagucacgcuaggaaugcccacuuccgcaggaccgcaagcuuccacgaggcccgccaagcgcgaccauuccgugagcgaagcaugucuacucugaccccccgccaggcuccagcauacucuucucggaccagaaccugugaacaggccgaggaucgauuucgcccacagucuagaggggcccacuuauucccggagaagcuggagcacuuccaagaagcaagcgguacacgagguccuuugaacccccucccaaaaucuuauacuuugggccagcccuuacgcaaaccugauuuaggugaccaccaagccggccuggucgcuggaaucgaacggacugagccgcaccgagccagaagaggaccguccccgucccauaagucugugagucggaaacagucuagcccuauaucccccaaagacaauuaucagagaguuucaaguuugucaccuagucagugcagaaaggacaagugccagucauuccccacccaccccgaguuugcauuuuacgauaacacaagcuucggccugacugaggcagaacagcggaugcuugaucuacccggauauuuugguagcaaugaggaggacgaaaccacauccacccuuagcguggaaaaguuggucauauag

SEQ ID NO: 13901 - RNA, 927 nt, Artificial Sequence
  Description of Artificial Sequence: Synthetic coding sequence
augcggcuacuccccgagugguuucugcugcuuuuuggcccuuggcuguuaagaaaggccgucagcgcacaaauucccgaaucaggaagaccucaauaucuaggccuucggccugccgccgcgggggcgggcgcgcccggucagcaguuacccgaaccgcgauccagugauggauugggagugggcagagccugguccugggccuggccuacaaaccacacuggagcucuggcccgugcaggggcagcuggcgcacuucccgcacaacgaaccaaacggaaaccuaguauuaaggcugcgagggcaaaaaaaauuuuuggcuggggcgacuuuuauuuucgcguucauacauugaaauuuaguuugcucgugacagggaagauuguagaccauguuaauggaaccuucucgguuuauuuuaggcacaauucaucuagcuuggggaaucucagcguauccauuguaccaccuuccaaaagggucgaauucggcggugugugguuacccgggccuguuccacauccccuccagucuacacuggcacucgaaggugugcugccaggucuggguccuccauuaggaauggcugcugccgccgccgguccuggacuuggcggaucccucggcggagcccucgccggcccccugggaggagcucugggcgucccaggugcaaaggaaaguagggccuucaacugucauguggaauacgaaaagacgaaccgagccagaaagcaucgaccuugucucuacgacccaucucaaguguguuucaccgagcauacacaaucacaagccgcguggcugugcgcuaagccuuucaaaguuauuuguauuuuuguguccuuucugucguucgacuacaagcuuguccagaaagucugucccgauuauaauuuucaauccgagcauccuuacuuuggcuag

SEQ ID NO: 13902 - RNA, 795 nt, Artificial Sequence
  Description of Artificial Sequence: Synthetic coding sequence
augaaguuaggaugcguucugauggcaugggcauuguaucucucauugggugugcuuuggguggcccagaugcuucuagcggcaagcuucgagacucugcagugcgaaggcccuguguguacugaagagucaagcugucauaccgaggacgaccugaccgacgcacgagaagcugguuuccaggugaaagccuauaccuuuucugaaccauuucaccucauaguuucguacgacugguuaauccugcagggaccugcgaagccugucuuugaaggcgacuugcuuguucugagaugucaggcuuggcaagacuggccacuaacccaggucacauuuuaccgggacggcuccgccuuaggaccccccggaccgaaccgcgaguucuccauuacugucguacagaaagccgauagcggccacuaucacugcagugggaucuuccaaucaccaggcccuggcauaccugagacggcaucugugguugcuauuacuguucagggcgcuucauccucugccgcuccaccuacguuaaaucccgcaccucagaaguccgccgccccgggaacagcaccagaggaggcucccgguccucuuccaccaccgcccaccccuuccuccgaggaccccggcuucuccucuccgcuaggcaugccagauccucaucuuuaccaucaaaugggccuauugcuuaaacauaugcaggauguccgaguccuacuuggccacuuacucauggagcuaagggaacugucuggucaccgcaagccgggaacaacaaaagccacugcugaauag

SEQ ID NO: 13903 - RNA, 1362 nt, Artificial Sequence
  Description of Artificial Sequence: Synthetic coding sequence
augcugcggauucugugccucgcucucugcucccuacugaccggaacuagagccgacccaggggcacuguugaggcuggggauggauauaaugaaccaggugcaaucugccauggaugagagucacauuuuggagaagauggccgcugaagccgggaaaaaacagccugguaugaagccgauuaaaggaauuacuaaucucaagguuaaggauguacagcucccaguuauaacauugaauuucgugccugguguggguaucuuucaguguguuuccacaggaaugacagugaccgguaaguccuuuauggguggcaacauggagauuauugucgcuuuaaauaucacugccacgaacaggcuacugcgggacgaggaaaccggcuuacccgucuuuaaaagcgagggcugcgaagugauucucgugaaugugaaaacuaaucugccaaguaacaugcuucccaagaugguaaacaaauuccucgacucuacccugcacaaaguacuaccuggccucaugugcccagcaauugaugcaguauuggucuauguaaaucggaaguggacaaaccucucugaucccaugcccguagggcaaauggggaccguuaaguacguuuugauguccgcccccgccacaaccgcaagcuauauacaguuagauuucagcccagucgugcaacagcaaaagggaaagaccauuaaacuggcagaugcaggcgaagcucucaccuuccccgaggguuaugccaaaggcuccucucagcuccugcugcccgccacauuccucucagccgaacucgcccuucugcagaaaagcuuucaugucaauauacaggauaccaugauuggagaguugcccccacagacaaccaaaacgcuggcuagauuuaucccugaaguggcaguggcguauccaaagagcaagccccucacaacccagaucaaaaucaaaaaaccuccuaaggucaccaugaagacgggcaagucucuccuccacuugcacagcacauuggagauguuugcagcccgguggcgcagcaaagcccccaugaguuuguuuuuacuugaaguccauuuuaaccugaaaguacaguacucaguccacgaaaaccaguuacagauggccacuucgcuugauaggcuguuaucuuugucccggaaaucuuccuccaucgguaauuuuaaugagagagaauugaccggcuuuauuaccagcuaucuugaagaggcuuacaucccaguagucaaugacgugcuccaggugggccugccacuaccagauuuucuugcgaugaacuacaaccucgccgagcuugacauugucgagaaugcucuuauguuggaucugaaacuuggauag

SEQ ID NO: 13904 - RNA, 1323 nt, Artificial Sequence
  Description of Artificial Sequence: Synthetic coding sequence
augucugcccggggacgaugggaaggcgguggcagacgcgccuguagagguucuuuagggcuggcuagagcccaaggagccgaaagggugacaucuucugagcaacggcccgccauggccucucuggguuuacuucuuuuacuguugcugacggcguugccgccacucuggaguucuucccugcccggucuugacaccgcagaauccaaagccacaauugcagaucugauucuuucugcguuagaacgagcuaccguguuucucgagcagagacugcccgagaucaacuuagacggaauggucggcguccgaguccucgaggaacaauuaaaaagcgugcgggaaaaaugggcacaggagccacuucugcagccauugaguuuaagaguagggauguuaggagagaaacuggaagcagccauucagagaagcuugcacuacuugaagcugucagacccuaaguaucugcgugaauuccagcugacgcuucagccaggauuuuggaaguugccucacgcuuggauacacacugaugccagcuugguguaucccacauucggcccacaggacuccuucagcgaggaaaggucugaugugugucuuguucaacugcugggaacuggcacugacucgagugagccgugcggccuuagugaucucugucggagccuuaugacaaagcccgguugcucuggauacugccuuagccaucaguuacuguuuuucuugugggccagaaugagaggauguacacagggaccucugcagcagucgcaggauuacauuaaucuuuuuugugccaacaugauggacuugaaucgccgcgcagaggcuaucggcuaugcauacccuaccagggacauauucauggaaaacaucauguuuugcggaauggguggcuuuuccgacuucuacaagcugcgguggcucgaggcgauacucaguuggcagaagcaacaggaaggcugcuuuggcgaaccugacgcagaggacgaagaacugucaaaggccauucaguaucagcagcacuucagccgacgcguaaaaagacgagaaaagcaauuucccgauuccagauccguggcccaggccggcgugcaguggcggaaucucggaucucugcagccccuuccucccggauucaaacaauucuccugccugauccuuccuagcucgugggacuacagaagcguaccccccuaucuugcuaauuuuuacauuuucuuggucgaaacugguuuucaccacguggcacacgcuggacucgagcugcucauaucccgcgacccucccaccucuggcagucaauccguggggcucuag

SEQ ID NO: 13905 - RNA, 708 nt, Artificial Sequence
  Description of Artificial Sequence: Synthetic coding sequence
augaaguacguguucuaccugggagugcuugcuggcacauuuuucuuugccgauuccucagugcagaaagaggaccccgcccccuaccucguguaucuaaagucucacuuuaaccccugcguugguguccugauuaaaccgucuugggugcuagcucccgcccacuguuaccuucccaaccuuaaaguuaugcuugguaauuucaaaucucgcguccgugacgguacugaacaaacgauuaauccuauccagaucguucgauauuggaauuauucucauagcgccccccaggacgaccuuaugcugaucaagcucgccaagcccgcuaugcugaaccccaaggugcagccacugacauuagccacaacgaauguuagaccaggaacuguguguuuauuaagugguuuggacuggucacaggagaauucgggcaggcacccagaucugcgccaaaaccuagaagcaccugugauguccgauagggagugccagaaaacagaacagggcaagagucacagaaauagccugugcgugaaauucgucaaaguguucaguagaauuuucggagaggucgccguugcuacagugauuugcaaggacaaauuacagggcauugaggucgggcacuuuauggggggagacguggguaucuauacgaauguguauaaguacgugucguggauugagaacacagcaaaggacaaauag

SEQ ID NO: 13906 - RNA, 426 nt, Artificial Sequence
  Description of Artificial Sequence: Synthetic coding sequence
augcugaaaaaaauuucuguugggguagccggugacuuaaacacugucaccaugaagcuuggcugcgugcucauggccugggcucuguaucuuucccuaggugucuuaugggucgcucaaauguugcucggcgccucauccagugcugcuccucccacucuaaauccagccccccaaaaauccgcagcaccuggcacggcuccagaggaagcaccuggcccacugccacccccgccuacaccuucuucagaagaccccggguuuaguucaccacuugggaugccagacccucaucucuaccaucagaugggacugcuguugaagcauaugcaggacgugagaguuuuacugggucaucugcuuauggaacuucgcgagcugagcggccaccggaagccaggaacaacuaaagcuacugccgaauag

SEQ ID NO: 13907 - RNA, 2886 nt, Artificial Sequence
  Description of Artificial Sequence: Synthetic coding sequence
augcuugcuccccguggugcugcggugcuacuacuccaucuuguccugcagagauggcuggccgccggugcccaagcgacuccacagguguucgaccucuuaccaucuagcucccagagacuaaauccuggggcucuccuccccguccucaccgauccagcacuaaacgaccuguauguuauuaguacuuuuaaacuucagaccaagucuuccgcuaccauuuuuggucucuauucaucuacagacaacaguaaauacuuugaguuuacagucaugggccggcuuaauaaggcuauauugcgguaucuaaaaaacgaugggaaggugcaucucgucguauuuaacaaucugcagcuggcugacggacgcaggcaucgaauccuuuugcgacucucuaaucugcagcgcggcgcggguuccuuagagcuuuaucucgauugcauccaggucgacuccgugcauaacuuaccacgagccuuugcuggacccucacagaagccagagacaauugaguuacguacuuuccagaggaaaccccaagauuuucuggaggagcugaaacugguggucagaggcagccuguuccaaguggcuucuuuacaggauuguuuccuccagcaguccgagccauuggccgccacaggaacaggugacuucaauagacaguuccuagggcagaugacacagcuuaaucaacuucugggagaagugaaagaccuauugagacagcaggugaaggagaccaguuuucugcgcaauacaaucgccgagugucaggcuuguggcccacugaaauuucaaucuccaacuccuuccacaguuguaccccccgccccuccugcucccccgacuaggccccccaggcguugcgauucaaaucccugcuuuagaggcgugcagugcaccgauucucgagacggcuuucaaugcggucccugucccgaaggcuauaccggcaauggcauaaccugcauugacgucgacgaauguaaauaccauccauguuacccaggagugcauugcauuaauuuaucaccgggauuucgcugcgacgcauguccugucgguuuuacuggacccauggugcagggcgucggaaucucauuugcuaaauccaacaagcagguauguacugacauagaugaaugccgcaacggugccugugugccaaacucgauuugcgucaacacucucggauccuaccguugcggcccguguaaaccaggauauacuggcgaucaaauuagggguuguaaagcagaaaggaacugucgcaacccggaacuaaaucccugcucuguaaaugcccagugcauagaggaaaggcagggagacgugacuuguguguguggcgugggaugggcgggugauggauacauuuguggaaaggacguugauaucgauagcuacccugacgaagaacugccuuguagcgcuagaaacuguaagaaagacaacugcaaauaugugcccaauagcggucaggaggaugcagacagggacggaaucggagaugcaugugacgaagacgcugauggcgauggcauccucaaugagcaggacaacuguguucucauccauaauguggaucagaggaacuccgacaaggacaucuuuggcgacgcuugcgacaacugccucucgguauugaauaacgaccagaaagauaccgauggugauggacggggcgaugcuugugaugaugauauggauggcgacggaauuaaaaauauacuugacaacugcccuaaguucccuaacagagaccagcgggauaaggauggcgacggaguuggagacgcaugugacuccuguccugaugucuccaacccuaaucaauccgacguggauaacgaccuggugggggacuccugugacaccaaccaggacucugacggagacgggcaccaagacuccaccgauaauugccccaccgucaucaauucugcacagcucgauacagacaaagauggaauaggcgacgagugcgacgaugacgaugauaaugacggaauucccgacuuaguacccccaggacccgauaacugccgauuagugccaaauccugcccaagaagacuccaauagcgauggcguuggggauauuugugagucagauuuugaucaggaccaagugauagaccguauagaugugugcccugagaacgcugaaguaacauugacugacuuucgcgcauaccagaccguuguucuggaccccgaaggagacgcucagauugauccuaauuggguggucuugaaucaggggauggagaucguacagaccaugaacucugauccuggccuggccguaggcuacaccgccuuuaacggugucgacuuugaaggaaccuuucaugucaacacgcagacagacgaugacuacgcuggcuucauuuucggcuaucaggacuccuccucauuuuacguggucauguggaaacagacagagcagaccuauuggcaagcaacacccuuuagggcaguggcggagccaggaauucagcucaaagccgugaaaagcaagaccggcccuggagaacaccuaaggaacucauuguggcacacuggcgacacuucagaccaaguacggcucuuguggaaagauucucggaaugucggguggaaagacaaagucaguuauagaugguuucugcagcaucgaccacagguagguuacauucgagugcgcuuuuaugagggaagugaacuuguagccgauaguggagugacgaucgacacaacuaugagggguggccggcugggcguguuuuguuucagccaagagaacauuauauggucuaaucugaaauaccgcugcaaugauacuaucccagaggacuuccaagaguuccagacacagaauuuugaccgauuugacaacuag

SEQ ID NO: 13908 - RNA, 300 nt, Artificial Sequence; identical to SEQ ID NO: 12269
  Description of Artificial Sequence: Synthetic coding sequence

SEQ ID NO: 13909 - RNA, 408 nt, Artificial Sequence
  Description of Artificial Sequence: Synthetic coding sequence
augagcccucacuugacugccuuauugggacucgugcuaugccuugcccagaccauccacacucaagaaggcgcacugccgcggcccaguaucucugccgagccgggaacaguuauuuccccaggaagccacgucacuuucauguguagaggaccggugggaguccagacauuucggcuugagcgugaggaccgggcgaaauacaaagauucuuacaauguuuucaggcucggaccuuccgaaagcgaggcaagauuccacaucgauucuguuucugaagggaacgcggggcuguacagaugccucuauuauaaaccaccaggcugguccgagcauagcgauuuccuugaacugcuggucaaaggcacuguccccggcacagaagcuaguggauuugaugcgccauag

SEQ ID NO: 13910 - RNA, 231 nt, Artificial Sequence; identical to SEQ ID NO: 12271
  Description of Artificial Sequence: Synthetic coding sequence

SEQ ID NO: 13911 - RNA, 684 nt, Artificial Sequence
  Description of Artificial Sequence: Synthetic coding sequence
augagaggccagggaagaaaagagagccugagugacagucgugaucuggacggauccuacgaccagcuaaccgauaguguggaugacgaguucgaacugagcacgguuugccacaggcccgaaggacuggaacaacuccaagagcagacaaaauuuacaagaaaggaauuacaagugcuguaucgcggauuuaaaaacccaggugcgcuuaguuuccaggaaugcccaagcgguaucgugaacgaggaaaacuucaaacagaucuauagccaguucuuuccacagggggacaguagcacauaugcuacguuccuguuuaacgcauuugacaccaaucacgacggcuccguuuccuucgaagauuuuguugccggauugucaguaauucugaggggcaccguggacgacagauugaauugggcauucaaucuuuaugaucugaauaaagacggcuguauuacuaaggaagaaaugcuggacauuaugaaauccauuuacgauaugaugggcaaguauacauacccagcguuacgggaggaagccccuagagaacauguagaaaguuuuuuccaaaaaauggaucggaacaaggacggggucguuacuauugaggaguuuauugagaguugccagaaggacgagaacaucaugaggucgaugcaguuauuugauaacgucauuuag

SEQ ID NO: 13912 - RNA, 876 nt, Artificial Sequence
  Description of Artificial Sequence: Synthetic coding sequence
augaugucagccacugggccgggaagaaagaugggauccagaggccaagggcuucuucuggcuuauugccuccuuuuagccuuugccaguggccucgugcugagccgugucccgcacgugcaaggugagcagcaagagugggaagggacagaggaauuaccaucgccuccugaccacgccgagagggcagaagaacagcaugagaaauaccgaccaucacaggaccagggauugccagcuagccguuguuuaagaugcugugauccgggcacgucaauguacccagccaccgccgucccccagauuaacauuaccauccuuaagggagagaagggagauaggggcgaccggggacugcaaggcaaguacggcaaaacgggaucagccggcgccagaggccacacaggaccaaagggacagaagggcagcaugggagcacccggagaaaggugcaaaucucauuacgccgcauuuagugucggccggaaaaaaccuaugcacagcaaccauuauuaccaaacugugaucuuugacaccgaguucguuaaccuguacgaccacuuuaacauguuuacaggaaaauucuacugcuaugugccuggucuguauuuuuucucucucaacgugcacacauggaaccagaaggagaccuaccugcauaucaugaaaaaugaagaggaaguggucauauuguucgcucagguaggggacaggucgaucaugcaaagccaaucucucauguuggaguuaagagaacaagaucaagugugggugagacuuuauaagggggaacgcgaaaaugcuaucuuuucagaggagcucgacacauacauaacuuuuucuggcuaucucgucaagcacgccaccgaaccuuag

SEQ ID NO: 13913 - RNA, 213 nt, Artificial Sequence; identical to SEQ ID NO: 12274
  Description of Artificial Sequence: Synthetic coding sequence

SEQ ID NO: 13914 - RNA, 402 nt, Artificial Sequence
  Description of Artificial Sequence: Synthetic coding sequence
augggcuccuccgguuugcugagucuccucguccucuuugugcugcuagccaaugugcaggguccaggacugacugauuggcuguucccgagaagauguccaaaaauaagggaggaaugcgaguuccaggagcgcgacgugugcacuaaagauagacagugccaagauaauaagaaaugcugugucuucagcugugguaagaagugcuuagaucugaagcaggacgugugugagaugcccaaagaaacuggucccugucuugcuuacuuucuccauuggugguacgauaaaaaagauaauacuugcucaauguucgucuacgggggaugucaagguaacaacaacaacuuccaaucuaaagccaacugccucaacacaugcaaaaauaaaagguuccccuag

SEQ ID NO: 13915 - RNA, 771 nt, Artificial Sequence
  Description of Artificial Sequence: Synthetic coding sequence
auguuccagaccggaggccucaucgucuucuauggacuguuggcgcagacaauggcucaauucgguggccugccaguuccacuugaucagacucucccacugaacguuaauccugcucugcccuugucaccuaccggauuagccggcucccucacuaacgcguuaucuaaugguuugcucuccggcggacugcucgggauccuggaaaaucucccccuucuggauauccucaagccuggcggcggcacuagcgggggccuguuaggcgguuuacugggcaaggugacaucgguuauccccggccucaacaacaucaucgauauuaaagugacagauccccagcuccuggaacucggacugguucagaguccagacggacaccggcucuacgugacuauaccucuaggaauuaaacugcaggucaacacaccauuaguuggagcaucucuucuuagacuggcaguaaaauuggauauaaccgcugagauccuggcagugagagacaagcaagagaggauucauuugguccugggagauuguacccauagucccgguagucuucagauuucccuucuagauggauuagguccccugcccauucagggucuguuggacucauuaacugggauccugaacaagguuuuaccggagcuuguccaagggaacgugugcccuuuagugaacgaagucuuacgcggauuagauaucacucuugugcacgauauugucaauaugcuaauccacggccuccaguuuguaauuaaggucuag

SEQ ID NO: 13916 - RNA, 1386 nt, Artificial Sequence
  Description of Artificial Sequence: Synthetic coding sequence
augucuuuagauauucagagccuugacauccagugugaagagcuaagcgaugcucggugggcugagcugcucccccugcugcaacagugucaggucguuagacucgacgauuguggccuuaccgaggcacgaugcaaggacauauccuccgcccucagggugaauccugcuuuggcagaacugaauuuaagaucuaaugaacugggcgaugucggcguucauugcgugcugcaaggguuacagacuccauccugcaagauucaaaaguuaucccuucagaacuguugucugaccggcgccggauguggugucuuauccuccaccuugcgaacccugccaaccuugcaagagcuacaccucucagacaacuuacucggggacgccgggcugcagcuccugugcgaaggguugcuggacccccaaugucgcuuagaaaagcugcaacuugaauacuguucauugagugcugccucuugcgagccacuggccagugugcugagagcaaaaccugacuucaaagaacugaccguaucuaauaacgacaucaacgaagccggugugcguguccugugucagggccugaaagauucgcccugccaguuagaggcucugaaguuggagaguugcggcgugacgagcgacaauugccgagaucugugugguauaguggcuucuaaggcuucucugagggagcuggcccugggcucuaauaagcugggagacgugggaauggcugaacuuugcccuggccugcugcacccaucuagcagacuucgaacccuguggaucugggaauguggaaucaccgccaaggguuguggcgaucugugccgcguccugagagcaaaagagaguuuaaaggaauuaagccuggcuggcaacgagcuuggugaugaaggagcccgucugcucugcgagacccuuuuagaaccugguugucaauuagaaucccugugggugaaauccuguagcuucacugcugcauguugcucccacuuuuccucugugcuugcccagaaucgcuuccugcuugagcuucagauaagcaauaauaggcuggaggacgccggagugagagagcuaugucagggccugggccagcccgguuccguucugcgcguguuauggcucgccgauugugaugucucagauucgucguguucaaguuuggcugcuacgcuacuugcaaaucacucacuucgggagcuugaucuuaguaauaauugucuuggcgaugccggcauucuccaacucguugaguccgugagacaaccugggugucuguuggagcaacucguacucuacgauauuuauuggucugaggagauggaagacagacugcaggccuuagagaaggauaaaccaucucugcgcguaauaucauag

SEQ ID NO: 13917 - RNA, 534 nt, Artificial Sequence
  Description of Artificial Sequence: Synthetic coding sequence
augaggcuguugauacucaccuguuugguugcugucgcacuagccaggccuaaacucccccugcgguauccugaacgccuccagaacccgucagagucuucagaacccaucccauuggaaucucgcgaggaauauaugaacggcaugaaucgccagagaaacauacuucgagagaaacagacugaugaaaucaagaauugugucguugccgaaccugagaagauggaaucuucaaucuccucauccuccgaagagaugucguugucuaagugugcugagcaguuuugcagauugaacgaguauaaucaauugcagcugcagaaaaugaguaagcaagagcagauacggagaaugaacgaaaacagccauguucaaguaccauuucagcaacuuaaucaacuggccgccuacccuuaugccgugugguacuauccccaaaucaugcaguaugugccuuucccuccuuuuagcgauaucuccaaucccacggcccaugagaacuacgagaaaaauaauguuaugcuccaaugguag

SEQ ID NO: 13918 - RNA, 3054 nt, Artificial Sequence
  Description of Artificial Sequence: Synthetic coding sequence
auggaucugauccguggggucuugcucaggcuucuccugcucgccaguucacuugggccuggggccgucucacuccgugccgcaaucaggaaacccggcaaaguuggaccaccuuuggacauuaaauugggcgcucucaacuguacugcuuuuagcauucaguggaaaaugccacgccauccagggucccccauccugggcuacacuguguuuuauucugaagucggugccgauaaaaguuuacaggaacagcugcauuccgugccuuuaucucgggauaucccaaccacugaggaagugaucggcgauuugaagccuggaaccgaauaccgagugucgaucgcagcuuacagucaggcuggcaagggcagacuuuccucuccacgacacguaaccacacugagucaggauaguugccuucccccugccgcuccccagcagccucauguaaucguggugucugauuccgaaguugcccucagcuggaagccuggagcauccgaggggucugccccaauccaauacuacaguguugaauucauucgaccagacuuugauaagaaauggacaagcauucacgagaggauucaaauggacaguauggucauuaaagggcuugaucccgauacuaacuaccaguuugccguuagagcgaugaacagccacggaccuucuccucgcaguuggccaucagacauuauccguacguuaugccccgaagaggccggcucuggucgauacggcccaagauacauuacagauaugggugcuggugaggaugaugagggcuuugaggacgaucuugacuuggacauuagcuuugaggaaguaaagccuuugccugcuaccaaaggaggcaacaaaaaauuucucguggaaucgaagaagaugucaaucagcaacccaaaaaccaucucacguuugauuccaccgacaucugccucucuccccgugaccacaguggcaccgcagccgauccccauccagcguaagggaaagaauggagucgcaaucaugagccgccucuuugacaugccuugcgacgaaacccuguguucagccgacagcuucuguguuaaugauuauacaugggguggcuccagaugccagugcacacuuggaaaaggcggugaaagcugcucagaagauaucgugauacaguauccccaguucuucggccacucuuauguaacauuugaaccacugaagaacucuuaccaggccuuucaaaucacucuugaauuuagagcagaagccgaagacggccuccuguuguacuguggcgaaaacgagcacgggcgcggagauuucaugucacuggccauuauuagaagaagccuucaguuuagguuuaacugcgguacuggagucgcuauaauugugucugagacuaagauuaagcugggaggguggcacaccgugaugcuuuacagagauggacugaacggauuauuacagcuaaacaaugguacuccugugacuggccagagucaggggcaguacagcaagauuaccuuucgaacacccuuguaucugggaggggcaccuucggcauauugguugguaagggcaaccggaacaaaucguggauuucaaggaugugugcaaucccuagcagugaacggaagacguaucgauaugcggccuuggcccuugggaaaggcgcugagcggcgcugacguaggagaauguucuaguggcaucugcgaugaggcgucgugcauacacggggggacuuguaccgcuaucaaagcugacucuuauauaugccuguguccucugggauucaaaggacgucauugugaagacgcauuuacccuaaccauaccucaguucagggagagccuuagauccuacgcagccacuccauggccucuggagccacagcauuaucuguccuucauggaguucgaaauuacauuuaggccggacagcggggacggcguucucuuauauuccuacgacaccggguccaaagacuuucuuucaauuaacuuagcgggaggucacguggaguuucgauucgauuguggcagugguaccggcguauuacgcucagaggauccccuuacacugggcaacuggcacgaguuacgagucucacgcacagcaaagaacggaauucugcagguggauaaacagaaaauuguggaaggaauggcagaaggcgguuuuacucaaaucaaguguaauacagacauuuucauuggcggugucccgaauuacgacgacgugaagaagaacucagguguuuuaaaaccauuuuccggcucuauacagaaaauuauccuaaaugaucggacuauccauguaaaacaugauuucacauccggagugaacguggaaaacgcggcccaccccugcgugcgcgcucccugugcccauggcggaagcugccgcccuaggaaggaggguuaugacugcgacuguccacuaggauucgaaggccugcacugucaaaaggaaugcggcaacuacugucuuaacacaauaaucgaggcuaucgagauuccccaauucauugggcgcucauauuugaccuacgacaacccugacauacuuaagcgcgugagugggucacgcucaaauguauuuaugagauucaagacaacugcaaaagacgggcuucuguuguggcggggagauucccccaugcguccuaauucagacuucauuagccuugguuugcgcgacggagcccugguguuuaguuacaaucucggcagcggaguggcaaguauaauggucaauggcagcuuuaacgacgggagguggcauagagugaaggcugugcgcgaugggcaaucagggaagauuacgguggacgauuauggggcucggaccggcaaauccccaggaaugaugcgacaacucaacauuaacggugcauuauacgucggagggaugaaagaaauugcucugcacacaaacagacaguacaugcgcggccuggucgguugcaucucccauuucacgcuaucaacagauuaccacauuucacuuguugaagaugcgguugaugggaaaaauauaaacacauguggagcuaaauag

SEQ ID NO: 13919 - RNA, 1893 nt, Artificial Sequence
  Description of Artificial Sequence: Synthetic coding sequence
augcagcaggacggcuugggcgugggcacaaggaauggguccgggaaaggucggagugugcauccaucauggccauggugugcccccagaccuuuacgguauuuuggaagagacgcacgagcucgaagagcacagacagcagcuauggcccuguuggccgguggucucuccaggggacuugguagucaucccgcagcugcaggucgcgaugcaguggucuuuguuuggcuuuugcugaguaccuggugcacugcaccagcccgcgccauccaggucacggugucaaauccauaccaugucguaauucuuuuucaacccgucacacucccauguaccuaucaaaugacauccacuccuacacagccuauugugauuuggaaguacaagucauuuugcagagaucggauugcggaugcguucucucccgcuucaguagacaaucaguuaaacgcccaguuggccgccggaaacccuggauacaacccauacguggagugccaggauucggugagaacaguucgcguggucgccacuaaacaggggaacgcagugacacugggggauuacuaccagggccggcgaaucaccauuacagguaaugcugaccucacauucgaccagaccgcauggggggauucuggaguuuauuacuguagugugguguccgcucaagaucuacaagguaacaacgaagccuacgcugaacuuaucgugcuugacuggcucuuugugguggucguuugccucgcugcauuccuuaucuuccuccugcuaggaauuugcuggugucaguguuguccucacaccugcugcugcuacguccgauguccguguugcccagauaaguguugcugcccugaagcucucuacgcugccgggaaagcugcaacaagugguguuccaucuaucuaugccccaaguaccuacgcucaccuuucaccugccaaaacaccaccuccacccgccaugauuccgaugggcccagcuuauaauggauacccuggcggcuaccccggagacguggaucgcaguuccucagccgguggacaagggaguuauguuccucuccuccgggacacagacagcucuguggcguccgaagucaggaguggcuaucggauucaggccagccaacaagaugacaguaugcguguucuguauuauauggaaaaggaauuagcaaauuuugacccuucacguccuggcccacccucugguagaguugaacgagcgaugucagaggugacuagucuccaugaagaugacuggcgaucuagaccaucacgaggacccgcacucacuccaauccgcgacgaggagugggguggccacucacccaggucuccccggggaugggaccaagaaccugcccgagagcaagcuggagggggauggagagccagacgaccucgagcaaggagugucgacgccuuagacgaccugaccccaccuucaaccgccgagucgggaucgcgcuccccuaccuccaaugggggacgaucccgggcauacaugccccccaggagccgcagccgagacgacuuauacgaucaagacgauucacgagauuuuccuagauccagagacccccacuacgacgauuuuagaucccgugagcggccccccgcagauccacggucccaucaucaccgcacccgugaccccagagacaacggcuccagaucgggcgaccucccuuacgauggaagacuucucgaagaggccgucagaaagaaaggaucugaggagaggcgaagaccucauaaggaggaggaggaagaagcuuacuaccccccugccccacccccuuauagugaaaccgacagucaagcaagcagagagcggcggcuaaagaaaaaccucgcccuaagucgcgaaaguuuaguuguguag

SEQ ID NO: 13920 - RNA, 750 nt, Artificial Sequence
  Description of Artificial Sequence: Synthetic coding sequence
auguugcaguuauggaaacugguacuauugugcggcguucuaaccgguacauccgaaaguuugcucgauaaucuuggaaaugacuugucaaacgugguagacaagcuggaacccgugcuccacgaaggucucgagaccguugacaacacuuuaaagggaaucuuggagaaacuaaaaguagaucugggagugcuccagaaaagcuccgcauggcaauuggccaagcaaaaagcacaggaagccgaaaaguugcucaacaacgugauaucuaagcuacuucccaccaauacagacauuuuuggacugaagauaaguaauucccugauccuagaugucaaagccgaaccuaucgacgacggcaaaggacugaaucugaguuuuccuguaaccgccaacguuaccguugcagggccuaucauuggacaaaucauuaaucuuaaagccucucuugauuuguugacggcugucacaauagagaccgacccucaaacucaucaaccagucgcugugcugggagagugcgcuucagacccgacaaguaucucucucucuuuguuggacaagcacagucaaaucauuaacaaguuugucaacagcguaaucaacacuuuaaaauccacuguuucuucucucuuacaaaaagaaauuugcccucugauccgcaucuucauucacagucuggacguuaacgucauccagcaagucgucgacaauccucagcacaagacccagcugcaaacucugauauag

SEQ ID NO: 13921 - RNA, 3057 nt, Artificial Sequence
  Description of Artificial Sequence: Synthetic coding sequence
augguaagucacuucaugggaucacuuagugugcuaugcuuucuucuucugcucgguuuccaguucgugugcccucagccaucaacacagcauagaaaggucccacaacggauggcagccgaaggagcuccagaagaugauggcggcgggggggcuccaggugucuggggagcaugggggcccugguccgcguguucucgcucauguaguggcggggugauggagcagacuaggcccugcuugccucgaucauacagacugcggggcggucagcgaccgggugcuccggccagagcuuuugccgaccacguugucucagccguucggaccuccguuccacuucacaggucucgcgacgaaacaccagcccuggcagggacagacgcaucuagacagggcccuaccgugcuccggggcucaagacauccccaaccccaaggccuugaagucaccggcgacagacgcucacggacaaggggaaccaucggccccgggaaguauggguauggcaaagccccguauauccugccccuacagaccgauaccgcccacaccccacagcgacucagacgccaaaaauuguccucgcgacacaguaggucccagggagcgaguucagcacggcacggguacucuucacccgcccaucaagugccucagcauggacccuuauaucagagcgacucagguccacggaguggucuucaagccgcggaagccccuauuuaucagcugccucugacgcacgaucaagguuauccggcugccucuucccucuuccauuccccagaaacaagcaauaaucacgguguugggacucacggugccacccaauccuucagucagcccgcccgcagcaccgcaaucucuuguaucggagcauacaggcaguacaaacuuuguaacacgaacguauguccagagagcaguagaagcauacgcgaaguccagugcgccuccuacaauaacaaaccauuuauggggcgauuuuaugaaugggaaccuuucgccgagguaaaggggaauagaaagugugaacucaacugucaggccaugggcuauagguuuuaugugcgccaggcggagaaagucaucgaugggaccccaugugaccaaaacgguacugccauuuguguuagcggacaguguaagagcauagggugugaugacuacuuagguagcgauaaggugguugauaagugcgguguguguggcggagacaacaccggcugucaagugguauccggcguauuuaaacaugcccugacaaguuuaggcuaucauagagucguggagauucccgaaggugcaacaaaaaucaacauuaccgaaauguacaagucuaauaauuaucuggcuuugaggagccgaagcggacguagcaucauuaauggaaauugggcgaucgacagaccgggaaaguacgagggggggggaacaauguuuacauauaaacguccuaaugaaaucagcucgaccgcuggagaaagcuucuuggccgagggccccacgaacgagauacuagacguauacaugauucaccagcaaccaaaccccggcguacauuaugaguacgugaucaugggaaccaacgcaaucucuccacagguacccccucacagaaggccaggcgaacccuuuaauggacagauggugacugaaggaaggagccaggaagaaggcgagcagaaaggccgcaaugaagaaaaagaagacuugcgcggugaggcucccgagauguucaccagcgaaucagcacaaacauuuccugugcgccaccccgaccguuuuucuccucaccgcccugauaaucuaguaccacccgcuccacagccaccaaggaggucgcgggaucauaauuggaagcaguuagggacaaccgaguguucuacuaccugcgggaagggaagccaguaccccauauuuagaugcguucaucgcucaacucaugaggaagccccagaaucauauugugauuccucgaugaaacccacacccgaagaggagcccuguaacauuuuuccuugccccgcguucugggauauuggagagugguccgagugcucaaaaacauguggucugggcaugcaacaucgacagguucuuugccgacaaguguaugccaauagguccuuaaccgugcagccuuauagaugccagcaccuggaaaaacccgaaaccacaagcacuugccaacuuaaaauuugcuccgaguggcagauuagaacggacuggaccuccuguucaguaccaugcgggguggggcaacgcacaagagacgugaaaugcgugagcaacaucggagaugucguagaugacgaggaaugcaauaugaaacugagacccaaugauauugagaauugcgacaugggacccugcgcgaaaucaugguucuugacugaguggagugagcgguguagugccgagugcggagccggugugcgaacacgguccgugguguguaugacuaaccaugucucuuccuugccucucgaggggugcggaaacaaccgacccgccgaagcuacucccugcgauaacggccccuguacuggcaaggucgaaugguuugcgggaucuuggucucaaugcuccaucgagugcgguuccgguacacagcagcgcgaagugauuugcgugaggaagaaugccgauacauucgagguucucgauccuucugaauguaguuucuuagagaaaccgcccucacaacaauccugucaucugaaaccaugcggcgcuaagugguuuuccacugaauggucuaugugcuccaaaagcugccagggaggauuuagggugagagaaguucgaugucuaucugacgauaugacucugucuaaccugugugacccacaacuaaaaccagaggagagggaguccuguaauccccaggauugugugccugaggucgaugagaauugcaaagacaaauauuauaauuguaacguugugguacaggcccgucucugcgucuauaacuauuacaaaacugcaugcugcgcuucaugcacccgaguagcaaaccggcagacaggguuucuggguagucguuag

SEQ ID NO: 13922 - RNA, 1311 nt, Artificial Sequence
  Description of Artificial Sequence: Synthetic coding sequence
augcagggcacucccggcggcggaacccgaccuggaccuagcccugucgauagacgcacauuacucgucuucucauucauccucgcagcugcgcuggggcagaugaauuucacuggagaucagguguugcggguguuggcuaaagacgagaagcaacucagccuacuuggcgaccucgagggccucaaaccccagaagguggauuuuuggcguggcccagcucggccuucucugccugucgacaugcggguucccuuuucagaauugaaagacaucaaagccuaccuugaaucacacggucuggcauauuccaucaugaucaaagacauccaaguccuguuggaugaagagagacaagccauggccaagucucgucggcuggaaagaucuaccaauucauuuagcuacucaaguuaccacacauuagaggaaauuuacaguuggaucgauaacuucguuauggagcacucugauauaguuaguaagauacaaauaggcaacaguuucgagaaucagucuaucuugguucugaaguuuucuacaggcggaucaagacaccccgccauuuggauugacaccgguauucacaguagggaguggauuacucaugcgacaggaauuuggacagcuaacaaaauugugagcgacuacggcaaagaccgcguuuuaacggacaucuuaaacgcgauggauaucuucauugagcuugugacuaacccugacggcuucgcauucacccacucuaugaaucgucuauggcgcaagaacaaaagcauccgaccuggcauuuuuuguaucggcguagaccuaaaucgcaauuggaaguccgguuuuggcggcaacggaaguaacucuaauccuugcucagagacauaucauggccccucaccacagucugaaccugaaguggcugcaaucguuaauuucauuaccgcccacgggaauuuuaaagcucugaucaguauccacuccuacucccaaaugcucauguaccccuacgguaggcuacuggagcccguuuccaaccagcgcgaacuguaugaucuggccaaggaugccguugaagcacucuauaaggugcacgggauugaauauaucuucggcuccaucucaaccacccuguaugucgccagcggcauuaccguugacugggccuacgauuccgggaucaaauaugccuucucauucgaguugcgggauaccggacaguacggcuuccuacucccugcgacccaaauuauuccgacagcucaagaaacauggauggcucuucgcaccauaauggaacacacacugaaccacccuuauuag

SEQ ID NO: 13923 - RNA, 492 nt, Artificial Sequence
  Description of Artificial Sequence: Synthetic coding sequence
auguuucagggucugcuucuccuccuucuccuuucuauggggggaaccugggcaucaaaggagccuuuaagaccaagaugucguccuauuaaugccacacuugcgguugaaaaggagggaugccccgugugcauaacgguaaauacaacaauuugcgccggcuacuguccuaccaugacccguguucugcagggcguguugccugcccuuccucaggucgugugcaauuauagggauguacgguuugagagcauccgucuuccuggcugucccagagguguaaacccgguggugaguuaugccgucgcacuuuccugccaaugcgcccuaugccggcgaucuaccaccgauugcggcggccccaaagaucacccacuuaccugcgaugacccuagauuucaagauucuuccuccuccaaggcucccccaccaucucugccuucaccauccaggcucccuggaccaagcgacacuccaauccugccucaguag

SEQ ID NO: 13924 - RNA, 213 nt, Artificial Sequence; identical to SEQ ID NO: 12285
  Description of Artificial Sequence: Synthetic coding sequence

SEQ ID NO: 13925 - RNA, 1098 nt, Artificial Sequence
  Description of Artificial Sequence: Synthetic coding sequence
auguggcugcuccuaacaauggccuccuugaucuccguguugggaacuacucauggcuuguucggaaaauugcacccaggcucacccgaggucaccaugaacauuagucagaugaucacuuacugggguuaucccaacgaagaauaugagguggugacggaggauggguauauuuuagaagugaauagaaucccuuauggcaagaaaaauagugggaauaccgaugccggauaugauguguggcugggcaacagcagagggaacacaugggcacgacgaaaucuguacuacucgccugacucaguggaauuuugggcuuuuaguuucgacgaaauggcuaaauacgaucuccccgcaaccaucgacuucauuguuaaaaagacgggccagaagcagcuucauuacgucggccauucccagggcaccaccaucggauucauagcauuuagcacuaauccgucucuggcaaaaagaaucaaaacauuuuacgcauuggcacccguggccacagucaaguacacuaaaucauugauaaacaaacucagauucguuccgcaaucccuguucaaguucauuuuuggugacaaaaucuucuauccacauaauuuuuuugaccaauuccuagcuaccgaggugugcagccgugaaaugcuaaaccuucucugcucgaaugcccucuucaucauuuguggauucgauucuaaaaacuuuaauaccuccaggcuggacguguauuugucacauaaucccgcuggaacuuccgugcagaauauguuccacuggacccaggcugucaaguccgguaaauuccaggccuaugauugggggucucccguucagaauaggaugcauuacgaucagagccaaccucccuauuauaaugugacugcaaugaaugugccaauugccguuuggaaugggggaaaggauuuacuugccgacccucaagauguugggcuacucuuaccuaaacugccaaaucuuauuuaccacaaggagauacccuucuacaaccacuuagacuuuaucugggcuauggaugcuccacaggagguguacaaugacauugucagcaugaucagugaagauaagaaguag

SEQ ID NO: 13926 - RNA, 2535 nt, Artificial Sequence
  Description of Artificial Sequence: Synthetic coding sequence
augggcccaggggccccuuuugcccggguggguuggccacugccucuucuaguugugauggccgcuggcgucgcacccguuugggcuagccacucaccccaccugccuagaccucacucacgcguaccgccacacccaaguuccgaacgaagggcuguguacauuggggcacuguucccaaugucuggaggauggccgggaggacaggccugucagccugcuguugaaauggcccuggaggaugucaacagucgacgggauauacugccugacuaugagcucaaacuuauacaucaugacagcaagugcgauccggggcaggcuaccaaauacuuguacgagcuacuuuacaacgauccaaucaaaauuauccuuaugccaggcugcaguagugucucgacccuuguagcggaggcugcacguauguggaaccuuauugugcuuaguuauggaucuagcagcccugcucuaaguaauagacagcgauucccaacauucuuucgaacucacccaucugccacacuccacaauccuacaagagugaaacucuuugagaaauggggguggaaaaaaauugcgacaauucaacagaccacagagguuuucaccucaacgcuagacgauuuggaggaacguguaaaggaagccgggauugagaucacauuccgccagaguuucuuuagcgaccccgccgugcccguuaaaaaucugaagcgucaggaugcuaggauuaucguugguuuauucuaugaaaccgaggcaaggaagguguucugcgaaguguacaaagaaaggcuuuuuggaaaaaaauaugugugguuucugauugguugguaugcagauaacugguucaagaucuaugauccauccauaaauuguaccguagacgaaaugacugaggcaguggagggacacaucaccacagaaauugugauguuaaauccagcuaacacccguuccauuucuaauaugaccucacaggaauucguugaaaaacuuacaaagcggcugaagagacaucccgaagagacaggagguuuccaagaggcuccccuggcuuaugacgccaucugggcacuggcacuggcacucaauaagacgucgggaggggguggccguagugggguaaggcuagaggacuuuaauuauaauaaccagaccauuacugaccaaaucuaccgcgccaugaauaguagcucuuucgaaggcguguccggccacgucguguucgacgcuuccggcaguagaauggcuuggacacugaucgagcaguugcagggaggcaguuacaagaaaaucggcuacuacgauucuaccaaggacgaccuaucauggagcaagacagauaaguggauuggugguuccccgcccgcggaccaaacucuugucaucaaaacuuuuagauuccugucucagaaacuuuuuauuuccgugucaguucucaguagccucgggauaguacuggccguagucugucugaguuucaacauuuauaacucccacguacgguauauccagaacucacaaccaaaccugaauaaccugaccgccguaggcugcagccuggcacuggccgcuguuuuuccacuuggguuggauggcuaucacauuggcagaaaucaauuuccauucguuugccaagcucggcuauggcugcuggggcuaggguucucucucggcuaugggucuauguuuacaaaaauuuggugggugcauacuguguuuacaaagaaagaagagaagaaggaguggagaaagacacuagagcccuggaaacucuacgccaccguaggacuacuggugggaauggacguauugacauuagcaaucuggcaaauugucgauccucugcacagaacuauugaaacuuuugccaaggaggaaccuaaagaggacaucgacgugagcauccugccacagcucgaacacuguaguucuagaaagaugaacacaugguuagggauauuuuauggcuauaagggacuccuauugcuguuggguauauuccuggcuuacgagacaaaguccgugucaaccgagaaaauuaacgaucauagggcugucgggauggcaaucuacaacguggcgguucucugucucaucacugcucccgucaccaugauucugucaucccagcaggaugccgcuuuugccuucgcaagucuggccaucguauucuccuccuacauuacccugguaguccuguuuguaccaaagaugagaaggcucaucacccgaggcgaguggcagagcgaggcgcaggauaccaugaaaacagggucaucuacgaacaacaaugaagaagaaaaaaguaggcuauuggaaaaagagaacagagaguuagaaaaaauaauugcugaaaaagaagaacgcgugucagaacucagacaccaauuacaaucucgucagcagcuucgaucccgccgccacccaccaacgcccccugagccuuccggaggacuuccacggggcccaccugagccucccgacagacuuuccugugauggcagccgcguacaucuacuguacaaguag

SEQ ID NO: 13927 - RNA, 1020 nt, Artificial Sequence
  Description of Artificial Sequence: Synthetic coding sequence
augguaucaaaauccagauggaaauugcuagccaugcucgcgcuuguucuggugguaauggugugguacucaaucagucgagaggaucgguauaucgagcuguucuacuuccccauucccgagaaaaaggagcccugucuacaaggcgaggccgaauccaaggccagcaaacuguuuggcaaacugucaccacuauguaguuacucacgggaucagccuaucuuucugagauuggaagauuacuuuugggucaaaacccccucugccuacgagcucccguacggcaccaaaggcucugaagaccuccugcugagggugcucgcuauuacgaguucaucgauuccaaagaacauccagucguuacgguguaggcguugugucguaguagguaacgggcaccgcuugcgaaacucaucccugggcgaugcuauaaauaaauacgacguugugaucagacugaacaaugcaccuguugccgguuacgagggagauguaggaucaaaaacaacuaugaggcuguuuuacccggaauccgcucauuucgauccuaagguugagaacaauccagauacucugcugguccuggucgcuuuuaaggcgauggacuuccauuggauugagacaauucuguccgauaagaagagaguccgcaagggcuuuuggaaacagccaccccugauuugggacgugaaccccaagcagauuagaauccugaacccuuuuuucauggaaauugccgccgacaaguuacugagccucccaaugcaacaaccucgaaaaaucaagcaaaaacccaccaccggacucuuggccaucacgcuggcgcuucacuuaugugaucucgugcacauugccggguucggcuaccccgaugcauauaauaagaaacagacuauucacuacuacgaacaaaucacuuuaaagagcauggcaggcuccggccacaacguuucccaagaggcccucgccaucaaacggauguuagaaaugggcgccaucaagaaucuaaccucauuuuag

SEQ ID NO: 13928 - RNA, 1386 nt, Artificial Sequence
  Description of Artificial Sequence: Synthetic coding sequence
augucacuugauauacaaaguuuagauauucagugugaagagcuuuccgaugcccgaugggccgaacuucuuccucuacuucagcagugccagguugugcgguuggacgacuguggacugacugaggcucgcuguaaagacauaucuuccgcccucagggugaacccggcccuggccgaacugaaucucagaucgaaugagcuuggcgacguggggguccacuguguccuucagggccugcagacgccaucuugcaaaauccagaaacucuccuugcagaauugcugccuaacaggagcuggaugcggaguucuuucuucuacccuccgaacacugccaacgcugcaggagcugcaucugucugacaauuugcuaggggacgccggacuccagcugcuuugcgaaggccugcuugauccucagugcagacuggaaaaauugcaauuagaguacugcucauuaucugccgccagcugcgaaccacuugccucagugcuuagagccaagccagauuuuaaagagcucacagucuccaacaacgauaucaacgaggcaggggugcgaguucucugucagggauugaaagacucuccaugccagcuggaggcucuuaaauuagagagcuguggugucaccuccgauaauuguagggaccuguguggcauuguggcaaguaaagccucucugcgagaauuggcgcucgguucaaacaagcugggggacguuggaauggccgaacucuguccaggacuucugcauccuuccagcaggcugagaacccucuggauuugggaguguggcaucacugcuaaaggguguggcgacuuauguaggguccugagagcuaaagaaagucuuaaagaacucucacucgcuggaaaugaacugggagacgaaggugcacgacuguuaugcgagacgcuuuuggaacccgggugccagcuugagucacuuuggguuaaaucaugcucauucacugccgcuugcuguucucauuuuagcuccguccuggcacagaaccgauucuuacucgaacuacagauuucuaacaaccggcuggaggacgccggugugcgcgaacucugccaagggcuuggucagccagggaguguacugagagugcuuuggcuugcugacugcgacgugucugacuccucauguagcagccucgcagcuacucuccuggcuaaucauucucucagagaacuggaccugucgaauaacugucuuggagacgcaggcauauugcagcucguggaaucugugcgacaaccuggcugccuucuugaacaguuaguccucuacgauaucuacuggagcgaagagauggaggaccgacugcaggcauuggagaaagacaaaccuucuuuacgcguaauaucauag

SEQ ID NO: 13929 - RNA, 1695 nt, Artificial Sequence
  Description of Artificial Sequence: Synthetic coding sequence
auggcacccaagaagcucucuugucuaaggucccuauuguugccccugucacugacccuccuacugccccaagccgauacacgaucuuuugugguagaccgcgggcacgaccguuuucuccuggacggugcaccuuuuagauacgucuccggaagucuccacuacuucagaguuccaagaguucugugggcagaccgguugcugaaaaugcguuggucaggccuuaaugccauccaguuuuaugucccauggaauuaccacgagccgcagccugggguauauaacuuuaacggaucccgcgaucugauugccuuccucaacgaggccgcucuagcuaaucuguugguaauauuacggccugguccuuauaucugugcagaaugggagaugggcgggcuaccuagcuggcuacuacguaaaccagagauccaucuuaggacaagcgacccugcagacaauaugacaaaaauauuuacacuacuccgcaaauaugaaccacacggaccucuaguaaauucagaauacuauacaggcuggcucgauuacuggggucagaaucauucgacgagaucuguaucggcagucacaaaggggcuggagaacauguugaagcuuggcgccuccgucaauauguauauguuucacggugggaccaacuuugguuauuggaauggggcugauaagaagggacgcuuucuacccauuacuacauccuacgacuacgaugccccgauuagcgaagccggagacccaacccccaaacucuucgcgcugcgagacgugauuucaaaauuucaggaaguuccuuugggaccucuaccccccccuuccccgaaaaugauguuaggaccuguuacucugcaucuaguggggcaccugcuugcauuucuggaccuucucugucccagggguccaauacauucaauccuuccuaugacauuugaagcuguuaaacaagaucacggguuuaugcuguacagaaccuacaugacccauacaauauucgaacccacaccauuuugggugcccaacaacggagugcaugacagagccuacgugaugguggacgguguguuucaggggguggucgaaaggaacaugcgugauaaguuauuucugacggguaaauuaggcagcaagcucgacaucuuaguagaaaacaugggaaggcucuccuuuggcucgaauucaucugauuuuaagggccugcugaaacccccuauccuuggacagacuauucuaacucaguggaugauguuuccccucaaaaucgauaaccugguuaaauggugguucccuuuacaauugccuaaauggccuuacccacaagcacccagcgguccaacguuuuacuccaagacauucccuauacugggcucuguuggcgauaccuuccuuuaccugcccggauggacaaagggucaggucuggauuaacggguucaacuuaggaagauauuggacuaaacaggggccccagcagacguuguauguuccuagguuucugcuguuuccccgaggagcucugaauaagaucacucuucuagaguuggaagauguacccuuacagccacagguucaauuccuugacaagccuauucugaauagcaccuccacacuucaccgcacacauauuaacucacuaucugcugacacacuguccgccagugaacccauggagcugucaggacacuag

SEQ ID NO: 13930 - RNA, 1317 nt, Artificial Sequence
  Description of Artificial Sequence: Synthetic coding sequence
augauguaugcgccaguggaguuuagcgaagcugaguuuagucgugccgaguaccagcgcaaacagcaguucugggacuccguuagauuggcacuguucacacucgcaaucguggcaauuauugggauagcaaucggaaucgucacccacuuuguggucgaggacgauaagagcuuuuauuaccuugcaucguucaaggucacuaauauaaaauacaaagagaauuacggcauucggucaucaagagaauuuauagaacgcagucaucagaucgagcggaugaugucaaggauauuucggcauuccuccgugggcgggcgguuuaucaagucucauguuauaaagcugucaccagacgaacagggugucgacauucugauuguacucaucuuucgcuauccuuccacugacucugccgagcaaauuaaaaaaaaaaucgaaaaagcuuuauaccagucucugaagaccaagcaacugucccuaaccauaaacaaacccucuuuccgccuuacuccuauugacucuaaaaaaaugcgaaaccugcugaauuccagaugcggaauucgaaugaccucaucaaacaugccacucccagcaucuucuucaacacagaggauuguucagggacgggagacugcuauggaaggggaauggccauggcaggcaagucugcagcucauuggcuccggccaccagugcggugcuucacuuaucuccaacacauggcuacucacagcagcucacuguuuuuggaagaacaaagauccuacccaguggaucgcaaccuuuggcgcuacaauuaccccaccagccguaaaaagaaauguccguaagauuauccuucacgaaaauuaccaccgagagacuaacgagaacgacaucgcccugguacagcugaguacuggcguggaauucucuaauaucguucaacguguaugcuugcccgacucaagcaucaaacuaccuccuaagaccagcguguuuguaaccggguuuggcagcauaguggaugauggaccuauccagaauacacuccgucaggcaaggguugagaccauaagcaccgaugugugcaauagaaaggacguuuacgacggacugauuaccccagggauguuaugugcaggauuuauggaagggaaaaucgaugcuuguaaaggggauagugguggaccuuugguguaugacaaucaugauauuugguacaucgucggaauugugagcuggggccagagcugugcccugccuaagaagccaggagucuacacucgcguuacaaaguauagggauuggauugccucaaagacaggaauguag

SEQ ID NO: 13931 - RNA, 4392 nt, Artificial Sequence
  Description of Artificial Sequence: Synthetic coding sequence
auggaaccuagacucuucuguuggaccacauuauuucugcuugccggcuggugucucccgggucucccaugcccuucccgcugucugugcuucaagucaaccgucagguguaugcaucugauguuagaccacauuccucaagugccucagcaaaccacaguccuugaccuucguuuuaaucgcauucgggaaaucccugguucagcuuuuaaaaagcucaaaaauuugaacacccuguuacugaauaauaaucauauuagaaagauuagucgcaacgccuucgaaggcuuagaaaaucuucuguaucuguaucuauauaagaacgaaauccacgcucucgacaaacagacuuucaagggacugauaagucucgagcauuuauacauccacuucaaccaacuggagauguugcagcccgaaacuuucggagaccuccugagacucgaacgccucuuucugcacaacaauaaacuuuccaaaaucccagcaggcagcuucuccaaucuugacagccugaagagacugcgccuugauaguaacgcucucguuugcgacugugaucugauguggcugggugaguuacuccagggguuugcacaacacggccauacacaagccgccgcuacuugcgaguacccacggagauugcauggcagagcuguugccagcgugacugucgaggaguucaauugucaauccccgcguaucaccuuugagccacaggacguugagguccccagcggcaacacuguguacuucacuugcagggcagaagguaacccuaagccagaaauaauauggauacauaacaaccauucccuggaucuggaagaugauaccagacuuaacguauucgaugaugggacucucaugauuagaaauacacgcgaauccgaccagggugucuaucaaugcauggcuagaaauucagccggagaagcaaaaacccagucagcaaugcuccgcuauucaucacugcccgccaaaccuucuuuuguuauccaaccccaggacacagagguucugauugggacaagcacuacacuggaaugcauggcaacuggacacccccacccauugaucacauggacuagggauaacggucuggaguuagaugggagucggcacguggcaacgaguucuggccuguaccugcagaauauuacacaaagggaccauggacgguuuacgugucaugcaaacaauucgcacggaaccguacaagcagcagcgaauauuauaguucaagcacccccccaguuuacaguaaccccaaaggaucagguugucuuggaggagcaugcaguggaguggcugugugaggcugauggaaacccuccucccgucauugucuggacgaaaacaggcggucagcuccccgucgaaggucaacauaccguucucucgucuggcacucugcgcauugaucgagcugcucagcaugaucaggggcaauacgagugccaagcagugaguucucucgguguaaaaaaagugucugugcaguuaacaguaaagccuaaggcacucgccguguuuacacagcuaccacaggauaccuccguagaagucggaaagaacauuaacauuucaugccaugcgcagggggagccacagccaauuaucaccuggaacaaggaaggcgugcagauaacugaaucuggaaaauuccacguggacgacgaagggacacucacaauuuacgacgccgguuuuccagaucagggacgguaugagugcgucgcacguaauagcuuuggacuugcuguuaccaauauguuccucacaguuaccgccauucaggguaggcaagcuggggaugacuucguugaauccucaauucucgaugcaguccaacgaguugacagcgccauuaacuccacccggaggcaccucuuuucucagaaaccacauacaucuagugaucugcuugcacaauuccauuacccccgggacccacugauuguugagauggcuagagccggcgagaucuuugagcacaccuuacagcugauucgugagagagugaagcagggccucaccgucgaccuggaaggaaaagaauucagauacaaugaccuagugucaccgcgaucauuaagucugauugcuaaccucucaggauguacagcacggcguccgcucccaaacugcucaaaccgcuguuuccaugcaaaauacagagcacacgauggcacuuguaacaaucuacaacagccaacuuggggcgcugcgcucacugccuucgcacgguuacuucagccugcuuaccgcgacggaauucgggcuccacggggucuaggcuuaccagugggaucccgacagccucucccucccccccgucuggucgccaccguaugggcuagagccgcagcagucacgcccgaccauucauauaccagaaugcuaaugcacuggggaugguuucucgagcaugacuuagaccauaccgugccugcacucucuacagcgagauuuuccgauggccgaccuuguuccagcguuugcacaaaugacccacccugcuuucccaugaacacucgccacgccgaccccagagguacccacgcaccgugcaugcuguucgccaggucuuccccggcaugcgcaagcggcaggccuucagcuacaguagacagcgucuacgccagggagcaaauuaaccagcagacagcauacaucgacggaagcaauguuuaugggagcucagaacgggaaagccaggcucuacgugauccuagcgucccacgaggccuguugaaaaccggauuuccauggccgcccagcgguaaaccacuuuugccuuucucaacuggacccccaaccgagugugcccgccaggaacaggaaagcccaugcuuucuagcaggagaucacagagccaacgagcaucucgcacuggccgcuaugcacaccuuaugguuuagagaacauaaccguauggcuacagagcucagcgcccucaacccucacugggagggaaacacuguuuaucaagaagcucggaagauugucggcgcugaacugcagcacauuaccuacagucauuggcugccaaaaguacugggggacccagguaccagaaugcuccggggcuaccgcgguuauaaccccaaugugaacgcagguaucauaaacaguuucgcaacggcugcuuucagguucggccacacacuaaucaaucccauacuuuaucgacuaaaugcgacccugggcgaaaucucugaaggacaccugccauuucauaaagcacuguucucucccagccggauuauuaaggagggugguauugacccuguguuaagaggacuguucggcgucgcagccaaguggagagcaccguccuacuuacuaucuccugagcugacacaacggcuguucucagccgcguauagugcugccguggacucugccgcuaccaucauucaacgaggaagagaccacgggaucccacccuauguggauuuccgaguauuuuguaaccugaccuccguuaagaacuuugaagaccugcagaaugaaaucaaggacagcgagauaagacagaaauuacggaaacuguacgguagccccggugacauugaccucuggccagcccuuaugguugaagaucugauuccagggacgcgggugggccccacgcugaugugccucuuuguuacacaguuucagcgguuacgcgacggcgaccgauuuugguacgagaacccuggaguguuuaccccagcccaacucacccaguuaaagcaagccagccucagccggguacuaugugacaacggagauucaauucaacaggugcaggccgaugucuuugucaaggcugaguacccacaggacuaucucaacuguagcgaaauccccaaaguugacuuacgaguuuggcaagauuguugcgccgacugcagaucgcgcggccaauuuagggccguaacucaagaaagccagaagaaacgguccgcccaguacaguuaucccgucgacaaagacauggaauugagucacuuaagaagccgccagcaggacaaaauuuacgugggagaagaugcuagaaaugugaccgugcuugccaagacuaaauuuagccaggacuucucaacauucgccgccgagauccaggagacaauaaccgcacuccgagagcagaucaacaaacuugaggccagacuccgccaggcaggcuguacagacguuagaggagugccccggaaagcugaggaacgcuggaugaaggaagauuguacucacuguaucugcgagucaggccaggucacuugugucguugaaaucuguccaccugcucccugucccagcccugaacuggugaaaggaacauguugcccuguuugucgugaucggggaaugccaagcgauaguccagaaaagcgcuag

SEQ ID NO: 13932 - RNA, 1206 nt, Artificial Sequence
  Description of Artificial Sequence: Synthetic coding sequence
auggggcuuaaagcauuaugcuuaggccuuuuaugcgucuuguucgucagccauuucuacacucccaugccugauaacauagaagaaaguuggaagaucauggcucuggaugcaaucgccaaaacuuguacauuuacugcgauguguuucgagaauaugagaauuaugagauacgaagaguucaucaguaugauuuuuagacuugauuauacccaaccacugucagacgaguacaucacagugacagauaccacuuucgucgauaucccaguacggcuuuaccucccgaaaagaaagagcgagacacgaaggagagcaguaauuuauuuccauggagggggcuuuugcuuuggcuccucaaagcagcgugcauuugacuuucuaaaccgguggacugccaauacacuggacgccgugguuguuggcguugacuauaggcuugcaccacaacaucacuucccugcacaguucgaggacgggcuugccgcugugaaguuuuuucuucuggagaaaauacuuacuaaguacggaguugaucccacaaggaucugcauugccggggacagcucuggcgggaaccuggcaacagcaguaacucagcagguccaaaacgacgcggagauaaaacauaaaauuaagaugcagguacuucucuauccuggccuacagaucacugauucuuacuuaccgagucauagggagaacgagcacgggauuguccuuacaagagacguugcaaucaaguugguuagcuuauauuucacuaaagacgaggcucugccuugggcuaugaggcggaaucaacacaugccucuugaaagccggcaccuauucaaguuugugaacuggaguauccuccugccagaaaaauaccguaaggauuauguauacacagagccuauccugggugggcucuccuauucacugcccggccucacugauucucgggcucugcccuuacuggcaaacgacucacagcuucaaaaucugccucugacauacauccucaccugccagcacgaucuccuaagggaugacggacucauguacguuacccgauugcgaaaugugggcguccaagugguacaugaacauauugaagacgggauucacggugcccucuccuuuaugacaagucccuuuuaccucagauugggucucagaauucgugauauguacgucucauggcuggacaaaaaccuguag

SEQ ID NO: 13933 - RNA, 264 nt, Artificial Sequence; identical to SEQ ID NO: 12294
  Description of Artificial Sequence: Synthetic coding sequence

SEQ ID NO: 13934 - RNA, 813 nt, Artificial Sequence
  Description of Artificial Sequence: Synthetic coding sequence
augagaggacagggcagaaaggaaucccugagcgauucacgcgaccuugacgggaguuaugaucagcugacagggcacccccccggacccacuaagaaagcacugaagcagagauuuuuaaagcuacugccuugcugugguccccaggcuuuacccuccguguccgaaacccuugcugcccccgcuucccucagaccccaucgcccaagguuacuggaucccgauagcguggacgaugaauucgaacuuaguacuguaugucaucgcccugaggguuuagagcaguugcaggaacagacaaaguucacuagaaaggaguugcagguccuguauagagguuucaaaaacgaauguccuagugggaucgugaacgaagaaaauuuuaagcaaauuuauagucaguucuucccccagggcgacucaucuacauaugccacuuuccuguucaaugcuuuugacaccaaucacgacgguucugucucauucgaagauuuuguugccggcuuauccgucauacuacgagggaccguagacgaucgacugaacugggcuuuuaaccuguaugaucugaacaaggauggcugcaucacgaaggaggaaaugcucgauauuaugaagaguauuuaugacaugaugggcaaauacacuuaccccgcccugcgcgaggaagccccacgugaacauguggaaucguucuuucaaaaaauggacagaaacaaagacggggucgucaccauugaagaguucauagaauccugccaaaaagaugagaauaucaugcgcucaaugcagcuguuugacaacguuauuuag

SEQ ID NO: 13935 - RNA, 819 nt, Artificial Sequence
  Description of Artificial Sequence: Synthetic coding sequence
augcaucucagacuuauuuccugguuguuuauaauacugaacuucauggaguauauuggcucucagaaugcaucacguggcaggcgucagagaagaaugcauccuaacguuucacagggcugccaagggggcugugccacuugcucugacuauaacgguugccugagcuguaaaccucgccuauuuuucgcacuggaacgcauagguaugaaacagauugguguaugcuuaucgagcugucccagcggguauuacggcacccgauacccggacaucaauaaauguacaaaguguaaggcagacugcgauaccuguuucaauaagaauuuuuguaccaaauguaaauccggcuucuacuuacaucucgggaagugccuggauaauugcccugaaggccuggaagcaaauaaucauacuauggaaugugugucuaucguccacugcgagguuagugaauggaaccccuggucacccuguacuaagaaagggaagaccuguggcuuuaaaagggguaccgagacucgcguucgcgaaauaauucagcauccaucagcuaaagggaaccugugccccccuacuaaugaaacccgcaagugcaccgugcagagaaagaaaugucagaaaggagaacgggguaaaaaaggucgagagcggaagaggaaaaagcccaacaaaggcgagucuaaagaagcgaucccagacucaaaauccuuggagucuucaaaggaaauaccugaacagcgggagaauaaacagcagcaaaaaaagaggaaaguccaggacaaacagaaaagugucaguguuaguacaguccacuag

SEQ ID NO: 13936 - RNA, 294 nt, Artificial Sequence; identical to SEQ ID NO: 12297
  Description of Artificial Sequence: Synthetic coding sequence

SEQ ID NO: 13937 - RNA, 726 nt, Artificial Sequence
  Description of Artificial Sequence: Synthetic coding sequence
auguggacagugcgcacugagggcggccacuucccucuccauuccccuacuuucucuuggcggaacgucgcuuuccuuuuacucuuguccuuggcccucgaguggaccagcgccaugcuuacgaaaaagauuaagcacaaaccaggccucuguccuaaggaaagacuuacuuguacaacagaacucccagauagcuguaauacagauuucgauuguaaagaauaccagaagugcugcuuuuucgcuugccagaagaagugcauggaccccuuccaggagccuugcaugcuuccuguucgccacgguaacuguaaucacgaggcccaacgcuggcauuucgacuuuaaaaauuaccgcugcacuccuuucaaauaucgcggcugcgaaggcaacgccaacaauuuccuuaacgaagacgcauguagaaccgcuuguaugcugaucgugaaagauggccaaugccccuuguuuccauuuaccgaacguaaggaauguccuccaucgugucauagcgauaucgacugcccacaaaccgacaagugcugcgagagucgcugcggauucgucugugccagggcuuggacugugaaaaaaggguucugcccccgcaagccucugcuuuguaccaagaucgauaaacccaaaugucuucaagaugaagaauguccccucguugaaaaauguugcucgcauuguggacugaaaugcauggaucccagaagauag

SEQ ID NO: 13938 - RNA, 1827 nt, Artificial Sequence
  Description of Artificial Sequence: Synthetic coding sequence
auggccagagcacgcgccggagcucugcuugcucugugggugcugggugcggccgcacacccgcagugcuuggauuuccgaccuccuuucagacccacacagccccuccgccucugugcucaauacucagauuuugggugcugcgacgagggacgggaugcugaacuuaccaggagauucugggcucuggccucaagagucgacgccgccgagugggccgcuugcgcuggauacgccagagaucuacugugccaggaguguaguccuuacgcugcucaccucuaugaugccgaagacccuuuuaccccucugagaacuguuccuggacuaugccaagauuacugccucgacauguggcacaaaugcaggggcuuguuccgacaucucucaacugaucaggaacuaugggcgcuugaagggaauuuagcuagauuuugccgguaccuuucccuggacgauacggacuauuguuuuccauaccugcugguuaauaaaaaucugaauagcaaucugggacacguugucgccgaugcgaagggcugucuucaauuauguuuagaagagguggcaaaugguuuaagaaaucccguugcuaugguacacgcucgugauggaacccauagauucuuuguagccgaacaaguuggguugguuugggccuaccuaccggacagguccaggcuuggcaaaccuuuccucaauauaucccgaguggugcuaaccuccccuugggagggggacgagcggggguucuugggcaucgcauuucaccccuccuuccagcauaaucguaggcuguacguuuauuacucugugggaauacggucuuccgaguggauuagaauuagugaguuuagaguaucugaagacgacgagaaugcaguugaccauucaucagagagaaucauacuugagguuaaggaaccggcuucaaaucacaauggaggccaacuccuguucggugaugacggguaucucuacaucuucacaggagauggcggaauggcuggagacccuuucggaacauucgguaaugcucagaauaagucagcccugcuugguaaaguguugagaauugacgucgauaggaaggagaggggucuaccuuacgguaucccgccagauaaccccuuuguaggcgauccggcagcccagccugaagucuacgcauugggcgugagaaauauguggcguugcuccuucgacaggggagacccuucuucuggcacgggacgcggacgccuguuuuguggagacguugggcagaauaaguucgaagaaguugauguuguugagagaggugguaauuacggcuggcgcgcaagggaaggauuugaaugcuaugauagaagcuuaugcgcuaacacuagucugaacgaucuguugccuauauuugccuacccacacaccguggggaaauccguuacuggagguuacguuuauagaggcugugaguacccaaaccugaauggccuguacauauucggggacuucaugucugggcgccuuaugaguuuacaggaaaacccuggcacgggccaguggcaguauuccgagauuugcaugggccauggacagacgugcgaauuucccggccuuauaaacaauuauuacccauauaucaucucauucggggaagacgaggccggagaacucuauuuuaugucaaccggggaacccagcgcuaccgccccaagaggcgucguguauaagauuauugacgcguccuccugcaaagcacguucagccaugccaggauauguacccgcucccuccguuuguucuucacucaccagucagcccuuuauauugcaaugguggaaauag

SEQ ID NO: 13939 - RNA, 351 nt, Artificial Sequence
  Description of Artificial Sequence: Synthetic coding sequence
auggccccuccuucuguaccccucguccuccuccucguccuccugcucagucuggcagagacuccagccagcgcccccgcucaucgaggcagagggggcuggacguuaaauuccgccggcuaucuacugggaccugucuuacacuugccacaaaugggggaccaggaugggaagagagaaacagcccucgagauucucgaccuguggaaggccauugaugggcucccuuacucgcacccaccacaacccucuaagcgcaacgucauggaaaccuuugccaagcccgaaauaggcgaccuggggaugcucuccaugaagauaccuaaagaagaagacguuuugaaguccuag

SEQ ID NO: 13940 - RNA, 3618 nt, Artificial Sequence
  Description of Artificial Sequence: Synthetic coding sequence
augagaaaaccuagaagaaaaucacgucagaaugcugaaggucgccgaucaccgagucccuauucccugaaauguucaccaacgagagagacucugacauacgcacaagcacaaagaauaguggaaguggacauagauggcaggcuucaccgaaucucaauuuacgauccacugaaaauuauuacagaggacgaacucaccgcacaggacauuacugaguguaacaguaacaaggagaauucagagcaaccccaauuuccaggaaaauccaagaaaccuuccuccaagggcaagaagaaggaguccuguagcaagcacgccucagggacaaguuuccaccugccucaaccaagcuuucggaugguggauagcgguauccagccagaagcccccccucuuccggcugcguauuacagauacauagaaaagccccccgaagaccuggacgccgaaguggaauaugauauggaugaagaggaccucgcaugguuggacauggugaaugagaagaggagaguggacggucacagccuggugagugcagacacauuugaacuucuuguggacagauuggagaaggaaucauaucucgaaagucgcuccaguggcgcgcaacagucacucauugacgaagaugcuuuuugcuguguaugucuagacgacgagugucauaacaguaauguaauccuuuucugcgauaucugcaaccucgccguucaucaggaauguuauggaguccccuacaucccagaaggacaguggcuaugucgguguugucuccagucucccucgcggcccguggacugcauccugugcccuaauaaagguggagccuuuaagcagacuucugacggccauugggcucaugugguaugcgcuaucuggauaccugagguaugcuucgccaauacggucuucuuagagccuaucgaagggaucgauaauauccccccagcccgcuggaagcuuaccuguuauauuuguaagcaaaaaggucucggagcugccauucaaugccacaaagugaacugcuauacugccuuccauguaacgugugcgcagcgcgcaggacucuuuaugaaaaucgaaccuaugcgcgaaaccucucugaacgggacaauuuuuaccguuagaaaaacugcuuacugcgaagcacacuccccuccuggggccgccaccgccagaagaaaaggagauagcccaaggucuauuuccgagaccggcgaugaggagggcuugaaggaaggugauggagaggaagaggaggaagaagaaguugaggaagaagagcaggaggcccaaggcggugucucagggagccugaaggguguuccaaaaaagucuaaaaugucccuaaagcaaaaaaucaaaaaagagcccgaggaggcuggucaagacacaccaaguacucucccaauguuggcugucccacagauuccaucuuacagacuuaacaagauuuguuccggccugucauuucaacggaaaaaucaguucaugcagaggcuccacaacuacugguuguuaaaacggcaggcgcguaacggugugccacugaucagacgacugcacucacaucugcaaagccaacggaaugcugagcagagggagcaagaugagaagaccagcgcaguuaaggaagaacugaaauauuggcaaaaacuccgacacgacuuggagagagcacguuuauuaauugaacucauacggaaaagggagaagcugaaacgcgagcaggugaaaguacagcaggcugcuauggaacuugaguugaugccauucaaugugcugcuaaggacuacuuuagaccuacuccaggaaaaagauccagcccacaucuuugccgagccaguuaauuuaagcgaagugccugauuaccuggaauuuauuagcaaaccaauggauuucucaacuaugcggaggaaauuggaaucucaucucuaccggacacucgaggaauuugaagaagacuuuaaucugaucgucacaaacuguaugaaguacaacgccaaggacaccaucuuccaccgggccgcugugaggcucagggauuugggaggcgccauccuuagacaugcccgcaggcaggcggaaaacauuggauaugauccagagagaggcacccaucugccugaaucgcccaagcucgaggacuucuaccgcuuuucgugggaagauguugacaauauccugauuccagagaaucgugcucaucugagcccugaagugcagcucaaggaacuucuagagaaguuagaucuggucuccgccaugagaagcagcggcgcuagaacuagacgaguuagacugcugagaagagagauuaaugcucucagacagaagcuugcccagcccccuccuccacagcccccuucauuaaauaaaacggugagcaacggugagcugccagcugguccacaaggggacgcugccguauuggagcaagcacugcaagaagagccagaagacgauggugaccgcgaugauaguaaacugcccccuccuccuacucucgaaccaaccggcccagcacccucccugucagaacaagagagcccaccagagccucccacacuuaaaccgaucaaugacagcaagccuccuuccagguuucugaaaccuagaaaagucgaagaagacgaacugcuugagaaaucaccucuucaauuaggaaacgaaccacugcagcgccuucucuccgauaacggaauaaaucggcuauccuuaauggccccggacaccccugccggcaccccccuuuccggggucgguagacgaaccucaguauuguuuaagaaggcgaaaaauggagucaaauuacagcgaucucccgauagagucuuagaaaauggagaggaccauggcguagccggaucaccagccagccccgcauccauugaagaagaacgccacucaaggaaaaggccccgaucaagaucuuguucagaguccgagggggaacguagcccucagcaggaagaagaaacugggaugacaaacggcuucggaaaacauacugaaucaggaucagacagcgaauguucacuuggucucagcggcggacuggccuuugaagcauguucuggucucacaccaccuaaacgcucucgcgguaaaccugcccucucaagaguuccauuccuggagggagucaauggcgacuccgacuacaacgguucgggccgaagccuguugcugccguucgaagaucgcggugaucucgaaccacucgagcuggugugggcaaaguguagagguuacccaaguuaccccgcccucauuaucgaucccaaaaugccccgggagggccugcuccauaauggcguuccaauaccggugccuccacucgauguacucaagcuaggagaacaaaagcaggcugaggccggcgagaagcuuuuccuuguucuuuucuuugacaacaaaagaaccuggcagugguugcccagagauaaggucuuaccccuuggaguagaagauaccguggacaaacuaaaaaugcuggaaggccgaaaaacgagcauacgcaaguccgugcaaguggcuuacgaccgagcuaugauacaucugucucgcgugcggggaccacacucauucgugacauccagcuaucucuag

SEQ ID NO: 13941 - RNA, 1977 nt, Artificial Sequence
  Description of Artificial Sequence: Synthetic coding sequence
auguucguuucuuaccuaauucucacucuguugcacguacagaccgcugugcuggcccgcccagguggcgaaucuauuggaugcgaugauuaccucggcagugacaagguggucgauaaauguggaguuugcgguggcgauaauacaggaugccaagucguaagcggaguguucaagcacgcccugacaagucuugguuaucaucgcgucguugagauaccugaaggcgccacuaagauuaauauuaccgagauguauaaaagcaauaacuaucucgcgcugcguagccgcucuggaaggucaauuaucaacgggaauugggcaauugaucggcccggaaaauaugagggaggcggcacaauguucacuuauaaacgaccuaacgagauaucuuccacagcuggagagaguuuuuuagcagaggggcccaccaaugagauacuagacguguauaugauccaccagcagcccaaccccggcguccacuacgaauauguuaucaugggaacaaacgcaauaucgccccaggugccaccccacagacguccuggcgaaccauuuaacggacagauggugaccgaagguaggucacaagaagagggcgaacagaaagggcggaaugaggaaaaggaggacuugcguggcgaagcaccggaaauguucaccucugaaagcgcacaaaccuuuccagucagacacccagacagguuuuccccacaucgaccagacaaucuuguacccccagcuccacagccaccucgcagguccagagaccauaacuggaagcagcuugggaccacugaauguucuacaaccuguggaaagggaucccaauaccccaucuuucgcugcgugcacaggucuacacacgaggaagcacccgaaucuuacugugauuccucuaugaagcccacaccagaagaggaaccaugcaauauuuuuccauguccggccuuuugggacaucggagaauggucggaaugcagcaagaccugcggacugggaaugcaacauaggcaggugcugugucgucagguguaugcgaaccguucucuuaccgugcagccguaccguugucagcaucuggaaaagcccgaaacaacguccaccugucagcucaagauauguucugaauggcagauccggacugauuggacaucuugcagcguacccuguggaguaggacagagaaccagagacguaaagugcgugucgaauauaggugacgucguggaugacgaagaauguaacaugaaacugagaccaaacgacauagagaauugugauaugggacccugcgcgaaauccugguuccugaccgaauggucggagagguguucagccgaauguggcgcugggguucgaacccguagcguaguuuguaugaccaaucauguuucuucccugccucuugagggcuguggcaauaaucgucccgcugaagccacaccaugcgauaacggcccuuguacugguaaggucgaaugguucgccgguagcuggagccagugcaguauugagugcgggagcggcacacagcaaagagaaguuauuugugugaggaagaacgccgauacauuugaaguucuagaucccagcgaguguucuuuccuggaaaagccgccgucucagcagaguugucaucuaaagccaugcggugcaaaaugguuuaguaccgaauggucaauguguaguaaaaguugucaaggcggauuuaggguacgagaagucagauguuuguccgacgauaugacguuaaguaaucucugugacccacaacugaaaccugaagagcgagagagcugcaauccacaggauugugugccugagguggacgaaaacugcaaggacaaauauuauaauugcaacgugguuguucaggcucgacuuuguguauacaauuauuacaaaacugccugcugcgcaucuuguacaagaguggcaaacagacaaacaggauuuuuaggauccagauag

SEQ ID NO: 13942 - RNA, 708 nt, Artificial Sequence
  Description of Artificial Sequence: Synthetic coding sequence
augcgaccuuuagccggggguuuacuuaaagugguguucguaguuuucgcgucucuaugugccugguauagcgguuaucuccucgccgaacuuauuccagacgccccucuuagcucugcagcauauucaauuaggucaaucggagagcguccaguacugaaagcuccagucccuaagcggcagaagugugaccauuggaccccuugucccucugacacuuacgccuaccggcugcucuccggcggcggacgcucuaaguaugcgaaaauuuguuuugaggauaaucugcugaugggcgagcaacucgggaacguggcccggggaauuaacauugcuauugugaacuaugugacuggcaaugucacggccacucgguguuuugacauguaugagggagacaacucuggacccaugacgaaguuuauccaguccgcugcaccuaaaagcuugcuguuuaugguuacauaugacgacggcuccacacgauugaacaaugaugccaaaaacgccauugaagcccugggaaguaaggaaauuaggaauaugaaauuuaggucaucauggguuuuuauugcggcaaagggccuugaacuaccaucagaaauccagagagaaaagauuaaucauuccgacgcuaaaaacaauagauacuccggauggccugccgagauucagauugagggauguauuccaaaagaacguuccuag

SEQ ID NO: 13943 - RNA, 759 nt, Artificial Sequence
  Description of Artificial Sequence: Synthetic coding sequence
augcgcggacaggggcggaaagaaucucugagugacucacgcgacuuagauggaucuuacgaucagcuaaccggccauccucccgggccuacgaagaaagcccuaaagcaacgcuuucugaaacuccugcccuguugugggccucaggcuuugccauccguguccgaaaauaguguggacgacgaauucgaauuaagcacaguuugucaucgccccgagggucuggaacagcuucaggagcagacuaaauuuacaagaaaggagcugcaggugcuguacaggggauuuaagaaugaaugccccagcggcaucguuaacgaagaaaauuucaagcagauuuacucccaauucuucccccagggugacucuucuaccuacgccacauuuuuauucaacgcuuucgacacuaaccacgauggaucagugucauucgaagacuuuguugccggacuaagugugauccugagagggaccguggaugauagacuuaacugggccuucaaccucuaugaucucaacaaagacggcuguaucacuaaggaggaaaugcuggauauuaugaaaucaauuuaugacaugauggggaaauauacauauccugcucuccgcgaagaggcaccaagagagcacguagagaguuuuuuucagaagauggaccggaauaaagauggcguggugaccauugaggaauucauagaaucuugccagaaggacgagaacauaaugcgcucaaugcaauuauucgauaaugucauuuag

SEQ ID NO: 13944 - RNA, 312 nt, Artificial Sequence
  Description of Artificial Sequence: Synthetic coding sequence
augucagguagagggaagggggguaaaggauugggcaaaggcggggccaaacggcaccgcaaagucuugcgggauaacauccagggcaucacuaaaccagccauccgcaggcuagcaaggcgaggaggagugaagcggauaucuggucuaaucuacgaggagacgcgagguguguugaagguguuccuggaaaauguaauccgcgaugccgucacauauacugaacacgcaaaaagaaagacggucaccgcaauggacguaguauacgcuuuaaagagacagggaagaacauuauauggcuucggaggcuag

SEQ ID NO: 13945 - RNA, 3120 nt, Artificial Sequence
  Description of Artificial Sequence: Synthetic coding sequence
auggaagugacugcaguggcuacucaaggggguuacgguucuucugauugggugaccucuuaucuuuugauguuuucugauggcggcagaaauuggaagcaguaucguagagaggagucaauuuggggcuucccaggcaacacuaacgcggacuccguugugcauuacaggcugcaaccuccguucgaagcccgguuucugagguuccucccacuagcauggaauccaagagggaggauuggcaugcggauugagguauacggaugcgcauauaaaucagaagugguguauuuugacgggcagucagcacugcuguauagacuggauaagaaaccguuaaagcccauucgcgacguuauaucucugaaauucaaggcaaugcagagcaacgggauccuucugcaucgcgaggggcagcauggaaaucacaucacacucgaacuuauaaaaggcaagcucguauucuuucucaauuccggaaaugccaagcugccauccacgauugcacccgucacacuuacacuggggucuuugcucgacgaccaacacuggcauucuguccuuaucgaacuucuggauacacaggugaacuucacaguggacaaacacacucaccauuuucaagcuaaaggcgacuccuccuaccuggaucuaaauuuugaaauuaguuuuggcgguauaccaaccccagggaggucacgggcauuccggagaaaaucauuccauggcugccucgaaaaccuguacuacaauggagucgacgugaccgagcuggcgaagaaacauaagccucagauuuuaaugaugggcaacgugagcuuuucgugcccucagccacagacaguccccgucacauuccuauccuccagaagcuaucucgcacucccaggaaauuccggugaagauaaagucucagucacuuuccaauuccgcacguggaaucgcgccggccaccuacuuuucggcgaauugagaaggggauccgguucguuuguguuauuccugaaggaugggaagcucaagcugucacuauuccaaccaggccaaucuccucgcaaugugaccgcaggagcaggacucaaugacggucaguggcauuccguuaguuucagugccaaguggucccacaugaauguugugguugacgacgauacagccgugcagccucucguggccguguuaauugacucuggagacaccuauuauuucggagguugucuggacaauuccuccggcucagguugcaaaagcccuuuggguggcuuucagggauguuugcgguuaauuaccauuggcgauaaggccgucgaccccauuuuggugcaacagggugcucucgggagcuuccgggaccugcaaauugacagcugcggcaucacagauaggugccuuccgucuuacugcgaacauggcggagagugcucacagagcugggauaccuucucaugcgauugccuuggcacagguuauacaggggaaacuugccacuccucacucuaugaacaauccugugaagcucacaaacaucgcggaaauccuuccgguuuauauuacaucgaugcagacgguagcgguccacuggggccguuccuggucuauugcaauaugaccgccgacgcagcuuggaccguaguucagcauggaggaccugacgcagucacccugagaggugcgccuucaggacacccacgaucagcagucucuuucgcguaugcugcuggagcaggacaacugcgcagcgcagucaacuuggcagaacgcugcgagcagcggcuggcccuacguuguggcaccgcucggcgucccgauagccgagacgguaccccucuguccuggugggugggucgaacaaacgaaacccacacaaguuggggagggucucugccugacgcccagaaaugcacauguggccuagaaggaaauuguauagacucucaguacuauuguaacugugacgccggacgcaaugaauggacuuccgacacgauuguccuuucccagaaagaacaccugcccgucacccaaaucgucaugaccgaugcuggucgaccgcauuccgaggcggccuauacucuuggaccccuccugugccggggagaucagucauuuuggaacucagccucauucaacacagaaaccuccuaccugcacuuuccugcguuccacggcgaauuaacagcugacguguguuuuuucuuuaaaacuacagucuccagcgggguauucauggaaaacuugggaaucaccgacuuuauccggaucgaacugcgugcaccaacugaaguaaccuucagcuuugacguggggaaugguccaugugaggugaccgugcaguccccaacacccuuuaacgauaaccaguggcaucaugugcgugcagaacggaacgugaaaggagccucucuccagguagaccaauugccgcagaaaaugcaaccagcuccagcugacggccaugugagacugcagcugaauucacaacuuuucauuggcggaaccgcaacucgacaacgcgguuuucuaggguguauacgaucgcugcaacucaacggaguggcccuggacuuggaagagagggcuacggugacaccaggaguagagccaggaugcgcaggucacuguuccacauacggacaucucugccgcaacgggggcagaugcagagagaagaggcggggaguaaccugugauugcgcuuuuagcgcuuaugauggcccauuuugcagcaacgaaaucucugccuacuuugcaacuggcuccuccaugaccuaccacuuccaggagcauuauacccuguccgagaacucauccucccucguauccucuuuacaccgagacgucacacugacgcgcgaaaugaucacguugucuuuccgaaccaccagaacaccuucauugcuccucuacgucaguucuuucuacgaagaguauuugaguguuauucuggcuaacaaugggucucuucagaucagauacaaauuggaccgacaucaaaauccugacgcauucacuuucgacuuuaaaaacauggcugacgggcaguuacaucaggucaaaauaaaucgagaagaagcugugguaaugguggagguaauuccucagaugcagaaaucuaauuag

SEQ ID NO: 13946 - RNA, 1257 nt, Artificial Sequence
  Description of Artificial Sequence: Synthetic coding sequence
augaggagucuacugcuucuuuccgccuucugccuccuggaagccgcccuggccgcugaggugaaaaaaccugccgccgccgccgcaccugguacagccgaaaaacugucccccaaagcagccacucuggccgaacggagugccggacuggcuuuuucgcucuaccaagcaauggcaaaagaccaggccguggagaauauccuuguuucuccgguaguugucgcaagcucacugggauuggucucccucgggggaaaagcaaccaccgcuucgcaggccaaggccguguuguccgcugagcaacuacgggaugaagaggugcacgcaggacugggggagcuguugcguucauuaucuaacuccacagccaggaaugugacauggaagcuaggcucaagacuuuauggaccuuccucggucuccuuugccgacgauuucguccggucaagcaagcagcacuacaauugugaacacucaaagaucaacuuuagggauaagaggucagcacugcagagcaucaacgagugggccgcccagacaaccgacggcaaacucccagaagucacuaaagacguggaaagaacagacggcgcuuuacuggucaacgccauguuuuuuaaaccacauugggacgaaaaguuccaccacaaaaugguggacaaccgcggauucaugguaacucgcaguuauacaguuggugugaugaugaugcaccggacuggccucuacaacuauuacgaugacgagaaggagaaguugcagaucguagagaugccacuggcccauaaauuaaguagccuuaucauccugaugccccaccauguagaaccccucgaaaggcuggaaaaacuucugaccaaggaacaguuaaagaucuggauggguaaaaugcagaagaaggcuguugccauuagccugcccaaaggugucguugagguuacucaugaucugcagaagcaucucgccggucugggacucaccgaagcgaucgacaagaauaaagcagaucucucaaggaugucagguaagaaggauuuguaucuggcaucaguuuuucaugccaccgcauucgagcucgauacugacggcaaucccuuugaucaagauaucuacggccgcgaagaacugcguuccccgaaauuauuuuaugccgaccacccauuuauuuuuuugguacgggauacccaaucaggaucccuccuuuucauaggccgauuaguuagaccuaaaggcgacaaaaugagggacgagcuguag

SEQ ID NO: 13947 - RNA, 378 nt, Artificial Sequence
  Description of Artificial Sequence: Synthetic coding sequence
augcaauugcugaaagccuugugggcucucgccggggccgcccuguguugcuuccugguguuagucauccacgcccaguucuuaaaagagggucagcuugccgccggaaccugugaaaucguaacucuggaccgggacuccucacaaccuagacgcacuauugcucgucagacagcuagaugugccugucguaaaggucagaucgcuggaaccacccgagcacgcccugcauguguggacgcacgcauaaucaaaacgaagcaguggugcgauaugcugccgugucucgaaggagaggggugcgacuugcucaucaaucgaucuggauggacuugcacacaaccugggggcagaaucaagacuacgaccgucagcuag

SEQ ID NO: 13948 - RNA, 5859 nt, Artificial Sequence
  Description of Artificial Sequence: Synthetic coding sequence
augcccgcucugggacccgcacuucugcaggcccuuugggcuggauggguucucacacugcaacccuugccucccaccgcuuucacccccaauggcacauaccuucagcaccuagcccgagaccccacuucugguacccuguaucucggcgcaacuaacuuccuguuccagcuuucccccggccugcagcuugaggcaacuguuuccacuggacccguucuugacucacgugauugccucccaccggugaugccugaugaguguccucaggcccaaccgacuaauaacccuaaucagcucuugcuggucucaccuggcgcauugguuguguguggguccgugcaccaaggcgugugugagcagagaagauuaggucagcucgaacaguuacugcucaggcccgagagaccgggagacacucaauauguugccgccaaugacccagcaguaagcaccgugggacuuguugcucaggggcucgcaggggagccacugcuguuugucggcaggggguacacaucacgcggcguuggcggcggaauuccuccaaucacuaccagggcacuauggccaccagauccacaggcagcauuuagcuacgaagaaacggcuaagcucgccguugggcgucucucagaauauucccaucauuuuguuuccgcauucgcucggggcgccuccgcguacuuccuguuccugaggagggaccugcaagcacaauccagggcuuuucgggcuuacguguccagaguuugucuacgagaucagcauuauuauaguuacgucgagcugccguuggcaugcgaagggggucgguacggacucauacaggcagcugcaguggccacauccagggagguagcucacggggaaguccuauucgccgcuuuuagcucugcugcccccccuacuguugggaggcccccgucugcugccgccggcgcauccggagccagugcccugugugcauucccacuggacgaaguugaccgccuagcaaacagaacucgcgacgcaugcuacacucgagaaggcagggccgaggacgggacagagguggcguacaucgaauaugacgugaauucagacugugcucaguuaccaguagacacucuggacgcauaccccugcggaucugaucacacaccauccccgauggcuucacgggugccacuugaggccacuccaauucuugaauggcccggaauucaacugacugcuguggccgucaccauggaggauggucacacuaucgcuuuccugggagauagucagggacaauuacaucguguuuaccugggacccgggagugauggacacccauacaguacucagagcauucagcaagguagcgccgugagcagagaccugacauuugaugguacauucgagcaccuuuacgucaugacccaaucuacucuucucaagguuccuguugcuaguugugcccagcaucucgauugcgcauccugucuggcucaucgagacccuuacuguggguggugcguccuguugggucgcugcagccgacggagugaauguucucgcggucaaggcccggagcaauggcuguggucauuucagccugaguugggcugucugcagguugccgcaaugagcccugcuaauaucucucgcgaagagacacgcgaagucuuccuguccguuccagacuuaccuccuuuauggcccggggagucguauucaugccauuuuggcgagcaccaaaguccugcauuauugacggguucaggagugauguguccaucccccgaucccucagaagcaccuguguugccaagaggagcugauuaugucagugucucaguggagcuccgguucggggccguugucaucgcuaaaacaagcuugagcuuuuacgauugcguggcaguaaccgagcuccgacccuccgcucagugccaggccuguguuuccagccgguggggcugcaacuggugcgucuggcagcauuugugcacucauaaagcauccugugacgcuggucccaugguugccucccaucaguccccacucguaucacccgacccccccgccagaggcgauggagauagugcagaguuagaagguccccccgcaccccuuauccuccccuccucccuggacuaucaguaugauacccccgggcuuugggagcuugaagaggcuacacuuggugccaguagcuguccaugcguugagucugugcaggguucuacacugaugccagugcaugucgagagagagauucgcuuacuagggagaaauuugcaucuuuuucaggacggccccggugacaacgaaugcgugauggagcuggaaggacuggaggugguuguggaggcucggguggaaugcgaacccccccccgacacucagugucaugucacaugccagcagcaucagcucucauacgaagcauugcaaccugagcugagaguuggacuguuccugagacgagccggccgucugagaguagauagugccgaggggcuccaugugguccuuuaugauugcuccguaggucacggggauugcagccggugccagacagcuaugccccaguacggaugcguguggugcgaaggugagagaccaaggugcgucacuagggaggccuguggcgaagcggaagcugucgcaacccaaugccccgccccuuugauucacuccguggaaccucugaccgggcccguugauggcggaacaagagucaccaucaggggcaguaaucugggacaacacguucaggauguccucggaaugguuacgguggcuggcguuccaugugcaguggaugcucaagaauacgaagugucaagcucccuggucugcauuaccggcgccagcggggaagaagucgcuggagcuaccgcaguggaggugcccggcagagguagagggguaagcgagcaugacuuugccuaucaggacccuaaaguccauuccauuuucccggcaagagggcccagggcuggggggacacggcugaccuuaaacggcaguaaguugcugacagggcgccuugaagauauccguguggugguuggagaccagccuugccaucuucucccagaacagcaguccgaacaauugagaugugaaacaaguccgaggccuacgccugcuacucugccaguugccgugugguuuggcgcaacagaacgccgguuacagcggggacaauuuaaguacacgcucgacccaaacaucaccagcgccgggcccaccaaaucuuucuugagugggggaagagaaaucuguguucgcggucaaaaccucgacguggugcaaaccccucguauucgagugacagugguguccaggauguuacaaccaucacaaggacugggucgaagacggagagugguuccugaaacagcaugcagucugggccccucuuguuccucacagcaguucgaagaacccugucacgugaacaguucacagcugauuacaugccgaacuccagcacugcccggucuuccagaggaucccugggugcgaguggaauucaucuuagauaaccuggucuuugacuucgcuacauugaaccccacccccuuuuccuaugaagccgacccuacgcuccagccuuuaaacccugaggacccuacuaugccauuucggcacaagccaggaaguguguuuucuguagagggcgagaaccuugacuuggcgaugagcaaggaggaggucguggcuaugauaggggacggaccaugugugguaaaaacucugacccgacaucaccuguacugcgagccaccuguugaacaaccacugccccgccaccacgcccuccgagaggccccugauucccuacccgaauuuacuguccagaugggaaaucugcguuucucccucggccacgugcaguaugacggagaaagccccggcgccuucccugucgccgcacaggugggacucggugucgguacuucucugcucgcccuuggaguuaucauaauaguguugauguaucgccgcaagucuaaacaagcucuccgcgacuauaaaaagguucagauccagcucgaaaaccuggaauccuccgugcgugaccgcuguaaaaaggaauuuaccgaccugaugacagagaugaccgaucucacuagcgaucuacuggggucaggcauccccuuucucgacuauaaaguguacgcggagcgaaucuuuuuuccaggacaucgggaauccccauuacaccgugaucucggagucccugagucccggcgcccuacugucgagcagggccucggccaacuauccaaucugcucaacuccaaacuuuuucugaccaaguucauccauacguuagaaucccagcggacauucagcgcuagagaucgugcauaugucgccagccugcuaaccguggcauuacauggaaagcuggaauacuuuacugacauucuccgaaccuugcugucugacuuaguggcccaguacguugcuaagaacccaaaauuaaugcuucguagaaccgaaaccguggucgaaaaauugcugacuaauuggaugucuaucugccucuacaccuucguacgugacuccguuggugaaccccuauacaugcucuuccggggaaucaagcaccagguggacaaaggcccagucgauagcguuaccggcaaagccaaguacacccucaacgacaaccgguuacugcgagaggacguugaauacaggccccucacauugaaugcacucuuggccguaggccccggggccggugaagcacagggcguuccagugaaaguuuuggacugcgauacuaucagccaggcuaaagagaaaaugcuggaccagcucuauaagggcgucccacugacacagcgccccgauccaagaacucucgacgucgaauggagguccgguguagcuggucauuugauucuuagcgacgaagauguuacauccgagguacaaggucuguggcguagacuuaacacauuacaacauuauaaggugcccgacggcgcgacuguggcacuggugccuugucugacaaaacacguccugagagaaaaccaggauuaugugcccggugagagaaccccaaugcuggaagacguggaugaaggcgguauccgccccuggcaucuggugaagccaucugacgaaccggaacccccccguccgcgccguggcagcuugcgugguggcgagcgcgagcgagccaaagcaaucccggaaaucuaccugacucgcuugcucaguaugaaggggaccuuacaaaaauucgucgacgaucucuuccaggugauacuaucuacaagccggccuguuccucucgcagugaaauauuucuucgaccuucucgacgagcaagcacagcaacacggaaucuccgaccaagacacaauucauaucuggaaaaccaauaguuugcccuuaagauuuuggauaaauauuauaaaaaauccucaguucguauuugacgugcaaaccuccgauaacauggacgcugugcugcugguuaucgcccagaccuucauggacgccuguacacuggccgaccauaaacuuggccgcgacucaccaauuaauaaacuguuguaugcgcgcgacauucccagauauaaaaggaugguugagagauacuacgcugauauacgacaaacaguucccgccagcgaucaggaaaugaacaguguucuggcggagcuauccuggaauuacucuggcgaucugggagcacgaguugcccugcaugagcuguauaaguacaucaacaaauacuaugaucagauuaucaccgcccuggaagaagauggcaccgcccagaaaaugcagcuagguuaccgccuccaacaaauugcggcugcuguagaaaacaaagucacggaucucuag

SEQ ID NO: 13949 - RNA, 342 nt, Artificial Sequence
  Description of Artificial Sequence: Synthetic coding sequence
augcuuguucuguuuuuguuaggaacaguauuccugcugugcccuuacuggggggagcuacacgacccuaucaaagccaccgagauuaugugcuacgaguguaagaaguaucaucuggguuugugcuacggcgugaugacuagcuguucccugaaacacaaacaauccugcgccguggagaacuucuacauccuuacacgcaaaggccagucuauguaucauuacucuaaguuaucuugcaugacaucuugcgaagauauuaauuuccuggguuuuacuaaaagaguagagcugauauguugugaucauaguaacuacugcaauuugccugaaggagucuag

SEQ ID NO: 13950 - RNA, 6408 nt, Artificial Sequence
  Description of Artificial Sequence: Synthetic coding sequence
augccugcccugggacccgcucugcugcaggcucuuugggccgguuggguacugacccuccagccccuucccccgaccgccuuuacuccuaaugguacauaucuucaacaccuagcacgcgacccgaccaguggcacacuguaucugggcgcuaccaauuuccuauuccagcucucccccggacuucaguuagaagcaacagugucaacaggacccguguuagauucccgugacugccugccaccuguaaugcccgaugaauguccucaggcccaaccuacaaacaacccaaaucaguuacuguuaguuucgcccggcgcccucgugguuugcggaucaguucaccaggggguaugugaacagagaagacucggccagcucgagcagcuguuacugcgcccagagagaccgggggacacacaauacgucgccgccaaugauccagcugugucaacugugggacucguagcccagggccucgcaggagaaccccugcuauuuguuggucgugguuacacgagcaggggggugggcggcggaauuccaccaauuaccacuagggccuuguggccaccagauccucaggccgcuuuuagcuaugaagagacagccaagcuggccgucggucgcuuaagcgaauacagccaucacuucguuuccgccuucgcccguggagccagugccuacuuccuguuuuugaggagggaccuacaagcccagucacgagcuuuccgggccuauguuucccggguaugucugagagaucagcacuauuauucuuacguugaauuaccucuggccugugaaggaggaagauacgguuugauucaggcugccgccguggcuacuagcagagaaguugcacacggagaagucuuguucgcggcuuuuagcucugcugccccuccgacuguggggagaccacccuccgcagcugccggagcuucuggagcaagugcucugugugccuucccuuuggacgaaguggaccgauuagcuaauaggaccagggacgcaugcuacacaagagaaggaagggcugaagacggaacagaaguugccuacaucgaauaugauguuaauucagauugcgcccagcugccgguggacacauuagacgcauaccccuguggcucagaccacacaccaucuccuauggcaucccggguaccccuagaggccacacccauucuggaguggccugguauucagcugacagccguugccgugacgauggaggacggucauacaauugcauuuuugggugauagccagggucaguuacaucggguguaccugggcccagguucagacggccauccuuacucuacccagucgauucaacaaggauccgcgguuuccagggauuugacauucgaugggacauucgagcacuuauacguuaugacgcaguccacucuccucaaagugcccguugccaguugcgcccagcaccuagacugugcgucgugucucgcccaccgggacccauacugugguugguguguccuauuaggccguuguagccggcguagugaauguucuagaggacaggguccagaacaguggcuauggucuuuucaacccgaacuuggaugccuccagguugcggccaugagucccgcuaacaucagucgugaggagacccgugaggucuuucuaucaguaccagaucuuccuccucuguggccuggugagucuuauucaugccauuucggcgagcaccagaguccagcucugcucacugggucagggguuaugugcccuucuccagacccuucugaagcaccugucuugccccgcggcgcugacuacguuucgguuuccguggaauugcguuucggagcugucgugaucgccaaaacaagccuaagcuucuacgauuguguggccguaacugaacugagacccagugcccaaugccaagcaugcguuucgucacggugggguugcaauuggugugucuggcagcaucucuguacacauaaagccucaugcgacgccggaccaaugguagcaagccaucagagcccccuggucucaccugacccccccgcacgagggggacccuccccauccccuccaacugcgccuaaagcccuggccacccccgcuccagacacacugccaguugaacccggugccccuucuacagccacugccuccgacauuuccccgggugccuccccgucccugcucuccccaugggggcccugggcuggaucaggaucuauuaguucaccuggcucuacggguucuccccuccaugaagaaccaucuccaccaucaccccagaacgguccugguacugcugugccugcuccgacugacuuuagaccaagugcgacgcccgaggacuugcuugcaucccccuuaucacccucagagguugcugcggugccacccgcugauccuggccccgaggcccugcacccgaccgucccuuuagauuugccuccagcuaccgugccggcuacaacguuuccgggagcgaugggcucugugaaaccggcacuugauuggcugaccagagagggaggagagcuacccgaagccgacgaauggaccggaggagacgcgccagcuuuuucaaccagcacacuucucagcggagacggggacagcgccgagcucgaaggccccccggccccucugauucucccuuccagccuugacuaccaguaugacaccccagggcucugggaacucgaagaggccacuuugggagccucaaguuguccuuguguggaaucaguccaagggucaacccugaugccugugcaugucgagagggaaauaagacuucucggaaggaaccugcaccuuuuccaggacgggccgggagacaacgaaugcgucauggagcuagagggccuggagguggucguggaggccagaguggagugcgaacccccccccgauacucagugucacguuacaugccaacaacaucaacucaguuacgaagcguuacagcccgagcugcgggugggccuguuccuaaggagagcugguagacugaggguggacucugcugaggggcuucacguuguacuguacgacugcagcgucggacacggagacugcagccgcugucaaacugccaugccucaauauggaugugucuggugugagggagaaaggccaagguguguaacucgggaagcguguggagaagcggaggcuguugcaacucaguguccugcgccccuaauccauucuguggagccucugacuggccccgucgacggcggaacucgcgugacaaucaggggcaguaauuuaggucagcacguccaggaugugcugggcauggucaccguagcuggcguccccugugcugucgaugcccaggaauacgaaguuucuaguaguuuagugugcaucaccggugcgucuggcgaagagguugcaggagccacagccguagaaguuccagggcguggaaggggcgugucugaacacgauuucgcuuaccaggauccaaaagugcauuccauuuuccccgcaagagggccgcgcgcugggggaacucgcuugacccugaacggcucuaagcuccucaccggcagacuggaagacauucggguuguaguuggagaucaaccuugccaccuacuuccggaacagcagagugagcagcugcgaugcgagaccagcccccggccgacccccgcuacacuuccgguagcuguuugguucggugcaacagagcgacgucuucagcgggggcaguuuaaguacacacucgacccuaacauaacaagcgccgguccaaccaagagcuuucugucggggggacgagaaaucuguguucguggucaaaauuuggacguuguacagacaccuaggauccguguaacuguuguuucaaggaugcugcaacccucccagggacucggaaggcgucggagagugguuccugagacagcauguucucucgggccuucuugcaguagucagcaguuugaagaacccugucacguuaacucgagccaacugaucacaugccgcacgccagcacugccuggccucccagaggaccccuggguacgaguagaguuuauuuuagacaaucugguuuucgacuuugcuacccuaaacccuacacccuuuucguaugaagcugauccaacacuacagccccuaaaccccgaagacccuaccaugccguuucgacauaagcccggcucuguuuuuucagucgagggcgaaaaccuggaucuggcgaugucaaaagaagaagugguggcaaugauaggugacggaccaugcgucguuaaaacucucaccagacaccaccucuauugcgaaccccccguugaacaaccacugccgcggcaccacgcccuccgugaagccccagacagccuuccugaauucacugugcaaaugggaaacuugagguucucuuugggacacguucaauaugauggcgagaguccaggcgcuuucccuguggcagcucaagucgggcucggcguggguacgucauuacuggcucuagggguuauuaucauaguacucauguauaggcguaaaaguaaacaggccuugagagauuacaaaaaggugcagauccaauuagagaauuuggagaguuccguuagggaccgcugcaagaaggaauucacggacuugaugacagagaugacggaccugacuagugaccugcucggcaguggaauucccuuccuagacuacaagguauacgcagagcgcauuuuuuucccugggcauagagagagcccauuacauagagaccugggcgugccugaaucaaggaggccgaccgucgaacagggauuaggccagcuuucgaauuugcuuaauucaaaguuauuucuuaccaaguuuauucauacccuagaaagccaaaggaccuucagcgcaagagaccgcgcuuauguagccagccuccugaccguugcguuacaugguaaauuggaguacuuuacggacauacuuaggacccucuuguccgaccugguagcccaauauguagcaaagaauccuaaacugauguugagacgcaccgagaccgugguggagaaacuucucacaaacuggaugaguauaugccuguacacguucguucgcgacuccguaggcgagccacucuauaugcuuuucagggguauuaaacaucagguggacaaaggaccagucgauucugugaccggaaaagcuaaguacacgcucaaugauaauaggcucuugagggaagaugucgaguaccggccucuaacacugaacgcccuccucgccguuggcccuggcgcuggcgaagcgcaaggcguaccagucaaagugcucgauugugacacgauaucucaggcaaaggaaaaaaugcucgaccagcuguauaagggcguaccucucacccagagaccugauccccggacacuggauguugaguggagaagugggguugccggacaucugauccucagugaugaagacguaaccucggaaguucagggauuauggcgcagauugaauacgcugcagcacuauaaagugccugauggugcaacgguggcacugguuccgugccucacaaaacacgugcucagagaaaaucaggacuauguaccaggugaaagaacccccaugcuggaggauguggaugaaggaggcauucgcccuuggcaucucguuaaaccgucggacgaaccggagccaccccggccaaggagagguucccuucgcgguggagaacgagagcgggcuaaggcaauucccgaaauuuacuugacuaggcuguuaucuaugaaggguacgcugcaaaaguuugucgaugaccuauuccagguuauccuguccacuagcagaccugugccauuggcuguuaaauacuucuuugaucugcuagacgagcaagcccaacagcacggaaucucagaucaggauaccauucacauuuggaaaacaaauucucugccccuaagauucuggaucaacaucaucaaaaacccacaauuugucuucgacguccagacauccgacaacauggaugcaguccuauuagucaucgcacaaaccuucauggacgcuugcacgcuagccgaccacaagcucgggcgagauucaccuaucaacaaauugcuguaugccagagauaucccacgcuacaagaggaugguggagcguuacuacgcugacaucagacagaccguacccgcuuccgaucaagagaugaacucggucuuagcagagcucagcuggaauuauuccggagacuuaggagcucgcguagcccuacacgagcuguauaaguauaucaauaaguacuacgaccaaauaauaacagccuuggaagaggaugggacugcccagaaaaugcaauuaggauauagacugcaacaaaucgcugccgcugucgagaauaaagugaccgaccucuag

SEQ ID NO: 13951 - RNA, 390 nt, Artificial Sequence
  Description of Artificial Sequence: Synthetic coding sequence
augagaccucugaaaccuggagcuccuuugccugcacuuuuccugcucgcacuggcccugucaccccacggugcgcauggaaggccccggggucgcagaggcgcgagagucacagauaaagagcccaagccucugcucuuccuuccagccgcaggcgccgggcgcacaccauccggaucccgcuccgcagaaauauucccacgagacucgaaucugaaagauaaauucauuaagcacuucaccgggcccgucaccuuuucucccgaauguucuaagcacuuucaucguuuguauuauaauacgcgagaaugcuccacuccagcuuacuacaagagaugugcccgccuccugacuagacuugcuguauccccauuaugcucucaaacuuag

SEQ ID NO: 13952 - RNA, 252 nt, Artificial Sequence; identical to SEQ ID NO: 12313
  Description of Artificial Sequence: Synthetic coding sequence

SEQ ID NO: 13953 - RNA, 1455 nt, Artificial Sequence
  Description of Artificial Sequence: Synthetic coding sequence
augugguacguuucaacucgcggagucgcgccccgcgugaauuuugagggcgccuuguuuuccggauacgcccccgacggaggccuuuuuaugcccgaagaacucccccagcuggauaggggaacgcuuugucaauggucaacuuuaucuuaccccggccugguuaaggaacuuugcgcccuguuuaucggaagugaauuauugccuaaggaugagcugaacgaccugaucgaccgagcuuucucacguuuccgucacagggaagucgugcaccucucaagacuccggaacggauugaaugucuuggagcuguggcacgguguuacauacgcuuucaaggacuugucccucagcugcacaacccaguucuuacaguauuucuuagagaagcgagagaaacaugugacggucgucgugggaacauccggugauacagggagcgcugcaaucgaauccgugcagggagcgaaaaacauggacaucauugucuuauuaccaaagggccauugcacuaagauucaggaauuacaaaugaccacuguacuuaaacaaaauguucacguauuuggugucgaaggaaauuccgacgagcuggaugagccaauaaaaacaguguuugcagauguagcauucguaaaaaagcauaaccugaugucucucaacucaaucaacuggaguaggguucuugugcagauggcccaucacuuuuuugccuacuuucagugcacucccucucucgauacucauccacucccccugguagaagucguggugccuacgggagccgccggaaaucucgcugccggauacauugcgcaaaagauuggucuccccauccgccuuguaguugccgugaacaggaacgacauuauucacaggacggugcaacagggugacuucucucuuagcgaggcaguuaaaaguacccucgcgagcgcaauggauauccaaguaccguacaauauggaacgcguguucugguuacuaucuggcucagauucccaggugacgcgugccuuaauggaacaauucgagcgaacacagagcgugaaucugccgaaagaacuccauucaaaauuauccgaggccgugaccucaguauccgugagcgaugaagccaucacacagacaaugggacgauguugggaugagaaccaguacuuacuaugcccacauucugcuguagccguuaauuaccauuaucagcaaauugauagacagcaaccuuccacacccagguguuguuuggcaccugcuuccgcagccaaauuuccagaggcugugcuggccgcugggcugacccccgagacuccggcagaaauugucgcauuagagcauaaagagacacgcuguacgcuuaugagacgaggagauaauuggaugcugaugcuuagagacacuauagaagaccugaguagacaauggcggucucacgcccugaacacgucccaauag

SEQ ID NO: 13954 - RNA, 159 nt, Artificial Sequence; identical to SEQ ID NO: 12315
  Description of Artificial Sequence: Synthetic coding sequence

SEQ ID NO: 13955 - RNA, 675 nt, Artificial Sequence
  Description of Artificial Sequence: Synthetic coding sequence
augcgugugucuggcgugcucagacugcuggcccucaucuucgcuauuguaacaacauggauguuuaucagaagcuacauguccuuuucuaugaaaaccauccggcugccucguuggcuggcagccucuccaaccaaagaaauccaagugaaaaaguauaaguguggucucaucaagcccuguccagcgaauuauuucgccuucaaaaucugcucuggugcugcaaauguggugggaccuaccauguguuucgaggaccgaaugauuaugucucccguuaagaacaauguaggcaggggguugaacaucgcacuagucaacgguacgacaggagccgucuugggacagaaggcuuucgauauguauuccggcgaugucaugcaucuggucaaauuucugaaagagaucccagggggugcgcugguucugguggcuucauaugaugauccugguacuaagaugaacgacgaaucuagaaaauuguuuagcgaccucggcucaaguuaugccaaacagcuuggauucagagauuccugggucuuuauuggcgcgaaagaccuuagagguaagagcccuuucgagcaauuucucaagaacagcccagacacaaacaaguaugagggauggccugagcuacuggagauggaaggcuguaugccaccgaaaccauucuag

SEQ ID NO: 13956 - RNA, 1404 nt, Artificial Sequence
  Description of Artificial Sequence: Synthetic coding sequence
augcucaucuuuuggacuauuacuuuguuccuccugggugcugcaaaaggaaaagaaguuugcuacgaggaucuggggugcuuuucagacaccgagccaugggggggaacagcaauaaggccauuaaaaauucuuccguggucccccgaaaaaauuggcacacgcuucuugcuguauacuaacgagaauccaaacaauuuucaaauucugcuucucagcgauccaaguaccauagaagccucuaacuuccaaauggaucggaaaacaagauuuaucauccacggauuuauugauaaaggagacgaaucaugggugacugauaugugcaaaaaguuguucgaaguggaggaaguuaauugcaucuguguugauuggaaaaaggguagucaggcuacuuacacccaggccgcaaauaaugugaggguugucggcgcccaaguggcccaaaugcucgacauuuuauuaacugaauacucuuaccccccaucuaaagugcaucucaucggccauucucuaggcgcucacgucgcaggggaagcuggcagcaaaacaccuggacugucccgcaucacuggguuggaccccguagaggcuuccuucgaauccacaccugaggagguaagacucgauccaucagacgcagauuucguggaugugauucauaccgacgcagccccacuuauccccuuccuuggauuugguaccaaucaacagaugggacacuuagacuuuuuuccaaacggcggagaauccaugccaggcugcaagaaaaacgcgcugagucagaucguugaccuggacggcauaugggcgggaacacgggacuuuguggcuuguaaccaccugagauccuacaaguacuaucuugaaucaaucuuaaacccugacgguuuugcggccuacccuugcacaucuuacaaguccuucgaaucagacaaauguuuuccuugcccugaucaggguuguccccagaugggucauuaugccgacaaguuugcagguagaacuucagaagaacaacagaaauuuuuucugaauacaggggaagcgagcaacuucgcuagauggcgcuacggggucuccauuaccuuauccggucgcacagcuaccgggcagaucaaaguggcccucuucggcaauaaggggaacacucaucaguauuccauauuucgaggcauucugaaaccaggcucuacccauaguuaugaauuugacgcgaaauuagauguagguacuauugaaaaagugaaguuucuguggaacaauaacgugauuaaccccacacuuccaaaggugggcgcuacaaaaauuacuguccagaaaggagaggaaaagacugucuacaacuucugcuccgaggauacagugcgagaagauacucuacuuacuuuaacuccaugcuag

SEQ ID NO: 13957 - RNA, 237 nt, Artificial Sequence; identical to SEQ ID NO: 12318
  Description of Artificial Sequence: Synthetic coding sequence

SEQ ID NO: 13958 - RNA, 291 nt, Artificial Sequence; identical to SEQ ID NO: 12319
  Description of Artificial Sequence: Synthetic coding sequence

SEQ ID NO: 13959 - RNA, 1083 nt, Artificial Sequence
  Description of Artificial Sequence: Synthetic coding sequence
auggggcuccugcuguuagucccuuuacuccuguugccuggcuccuaugggcuuccuuucuauaauggauuuuacuacaguaauucugcuaaugaccagaaucucggaaaugggcacgguaaagaccucuugaauggcgugaaacucgugguugaaacuccugaggagacauuguuuacauaucaaggugccaguguaauccugccuugucguuaccgguaugagcccgcacucgugucgcccaggcggguaagagucaagugguggaaguuaagugaaaauggcgcucccgaaaaagacgugcuagucgccauugggcugcggcacagaucuuuuggagacuaccaaggaaggguucauuugaggcaggauaaggagcacgacguuucacuggagauucaggaucugagacuagaagacuauggcagauaccguugcgaggugaucgacggucuggaggaugaaucgggccugguggaacuugaguuacgcggcgucgucuuucccuaccagucgcccaacggcagauaucaauucaauuuucacgaggggcaacaagugugugcggaacaagcugcggugguagcaucauuugagcagcuauuucgcgcuugggaagaagggcuggauuggugcaacgcgggcugguuacaggacgcuacagugcaauaucccaucaugcuaccccggcagcccugcggaggccccggccuggcuccaggugugagaucuuacgggccccggcauagaaggcugcauagguacgauguguuuuguuucgcaacugcucugaaaggacggguuuauuaccuggaacauccugaaaagcuaacucucacagaggccagagaggcaugucaagaagaugaugccacaaucgcaaagguaggucaacuguucgccgcuuggaaauuccacggacuggacagaugugacgcagguuggcuggcagacgguucuguuagguaucccguugugcauccacacccuaauugcggcccccccgagcccggcguuagaaguuuuggauuuccugacccccagucucgacuguaugggguuuacugcuacagacagcauuag

SEQ ID NO: 13960 - RNA, 810 nt, Artificial Sequence
  Description of Artificial Sequence: Synthetic coding sequence
augauccgaacauuacuguugaguacccugguagcaggagccuugucguguggcgauccaaccuaucccccuuacgucacacgggucgucggaggcgaagaagcgagaccuaauagcuggcccuggcaggugagucugcaguacucaucgaauggaaagugguaucacacuugcggcgggagccugauugcgaacuccuggguacugaccgccgcucauuguauuuccaguuccagaacuuaucgagugggcuugggccgacauaaccuuuacguggccgagaguggaagccuggccgugucagugagcaagaucgugguacacaaagauuggaauucaaaucagaucucaaaaggcaaugauaucgcccuguuaaaacucgcgaacccugugucccucaccgacaagauucagcuugccugucuuccacccgccgguaccauucucccuaacaauuaucccugcuauguaacagguuggggucggcuucagacaaacggggcagucccagaugugcugcagcaaggcaggcuucuugugguagacuaugccaccuguuccuccagugcaugguggggaucuucugucaagacuagcaugauuugcgcagguggagacggggugauaucuucuugcaauggcgacucuggcggcccacugaauugucaagcuagcgauggaagauggcaggugcaugguauugugucuuuuggaaguaggcugggauguaauuauuaccauaagccuucuguguucacucgagugucaaauuacauugauuggauuaacucugugauugcuaacaauuag

SEQ ID NO: 13961 - RNA, 1122 nt, Artificial Sequence
  Description of Artificial Sequence: Synthetic coding sequence
auguugccauggcugcugguuuucagugcucuggggauucaagcuuggggcgauucaagcuggaauaaaacacaggcaaagcaagugucugagggauugcaauaccuguucgagaauauuagucaauugacugaaaagggacugcccacagauguuuccacaaccgugucccgcaaggcuuggggagcugaggccguggggugcucuauucagcucaccaccccugucaacgucuuagugauacaccauguuccaggccuggagugccaugaccagacuguguguucucagcgacugcgugaacuucaggcgcaccauguccacaacaauagcggaugcgauguggcuuacaauuuucuggucggagaugacgggcgcguuuacgagggcgucgguuggaauauccagggugugcacacacagggguauaacaauauuagccuuggcuuugcuuucuuugggacaaaaaaaggacacucaccuaguccugcagcccuguccgcuauggaaaaucucauaaccuaugcagugcagaaaggccaccucucuaguuccuacgugcagccgcuucucgguaaaggcgaaaacugucuggccccacgacagaagacuucacucaaaaaagcuuguccagggguggucccacggucagucuggggcgccagagaaacacauugcccuaggaugacauugcccgcaaaguauggcauuauaauucacacagccggccggacaugcaauaucagcgaugaauguagacugcugguaagagacauucagaguuucuacaucgauagacugaagaguugcgauauuggguacaacuuucugguuggacaggacggcgcuaucuaugaagggguuggcuggaacguccaggguaguucaacaccaggcuacgacgacaucgcccugggaauuaccuuuauggggacuuuuaccggcauuccccccaacgcugcugcccucgaggcugcccaagaucucauccagugugccauggucaaaggcuaucucacuccuaauuaucugcucgugggucacucugaugucgcucggacucugucucccggacaagcucucuacaacaucaucagcacuuggccucauuucaaacauuag

SEQ ID NO: 13962 - RNA, 327 nt, Artificial Sequence
  Description of Artificial Sequence: Synthetic coding sequence
augcggcagcgauuacugccuagcgugacuagucuccucuuaguugcccuccuguucccaggguccucccaggcaaggcauguuaaccacuccgcgacagaggcccuuggagaauugagagaaagagcaccaggccagggaaccaacggcuuccagcuccugcggcaugcugugaagcgagacuugcuuccacccagaaccccaccuuaccaaggggacguacccccaggcaucagaaauacaauuugucauaugcagcagggaauuugcagacuuuuuuucugucacucaggcacgggacaacagcauagacagagguguggauag

SEQ ID NO: 13963 - RNA, 708 nt, Artificial Sequence
  Description of Artificial Sequence: Synthetic coding sequence
augucucccccccuccugaaacuuggagccguacuguccacaauggcaaugauuucaaacuggaugucucagaccuuacccucucuuguaggccuuaacacgaccagacuguccaccccugauacccuuacucaaaucucaccaaaagagggcuggcagguguacuccagcgcccaagaucccgauggacgcuguaucuguacaguaguggcgccugaacaaaacuuaugcaguagggacgcaaagagcaggcaguugcggcaacuccuggagaaaguccaaaauaugagccaguccauugaggugcucaaucuccggacccaaagagacuuucaguaugugcuuaagauggaaacucaaaugaagggcuuaaaggcaaaauuuagacagauugaggaugaucguaaaacccucaugaccaaacauuuccaagaacugaaagaaaaaauggacgaacugcugccucucauaccugugcuggagcaguauaaaacugacgcaaaacugaucacacaauucaaggaagaaaucagaaaccuaucugccgugcugaccgguauacaggaagaaauuggggccuacgauuacgaggaacugcaccagagggugcuaucgcucgaaaccagguugcgggauuguaugaaaaaacugaucgaccuuaaaaagagaaaggaggaagagaaaagacaacaaaagggagaagccuag

SEQ ID NO: 13964 - RNA, 606 nt, Artificial Sequence
  Description of Artificial Sequence: Synthetic coding sequence
augaaucucaacugucccccuugcguuacuggacuaaggguauggucuuccugccgauccaaaccuaacagccgagcgcggagcugcagaucuuguacaggagcuuccagaacacuucccucucaccauaugucgcaugucgaaugcccgucagguaucguuaaugaggaaaauuuuaaacagaucuacagccaguuuuuuccacagggagacuccagcacauaugcaaccuucuuauuuaacgcuuuugauacgaaucaugauggcuccguguccuucgaagacuuugucgcugggcuguccguaauauuacgagggaccguagaugauagacugaacugggccuuuaaucuguacgaucugaauaaggauggauguauaacaaaagaggagaugcucgacaucaugaaaaguauauacgacaugauggguaaguacacauaccccgcccugcgcgaggaagcuccucgagaacauguggagucuuuuuuucaaaaaauggacaggaauaaagacgggguuguaacuaucgaagaauucauagagaguugccaaaaagaugaaaacauuaugagaucaaugcaacuauucgacaaugugauuuag

SEQ ID NO: 13965 - RNA, 693 nt, Artificial Sequence
  Description of Artificial Sequence: Synthetic coding sequence
augagauuggccgguccucuuagaaucgugguccuuguugugagcguuggcgucacuuggaucguggucucaauccuccuugggggaccuggcaguggcuucccuagaauccagcaauuguucacaucuccggaaaguaguguuacggcagccccccgugcacgcaaauacaaguguggccugccccagccuugcccugaggagcaucuugcauuccgagugguuagcggugccgcuaauguaauugguccuaagaucugccuggaagauaaaaugcugaugaguagugugaaggacaacguggggcgugguuugaauauagcuuuggugaauggagugaguggagaacucauagaagcaagagccuucgauaugugggcgggagaugugaacgaucugcucaaauuuauaaggccacugcaugaggggacauuggucuucguggcauccuacgaugacccugcaaccaaaaugaaugaagagaccaggaaacuuuucagcgaacucggaagccggaacgcuaaggaguuagccuuucgugacucauggguauuuguuggggcaaagggaguucaaaauaaguccccauuugagcaacaugugaagaauagcaaacacucaaauaaguaugaaggauggccugaagccuuggagauggagggauguauaccaagacgauccacagccaguuag

SEQ ID NO: 13966 - RNA, 684 nt, Artificial Sequence
  Description of Artificial Sequence: Synthetic coding sequence
augagaguagccggggccgccaaacuuguggucgcaguggcugucuuucugcucaccuuuuauguaaucagccagguuuucgagaucaaaauggacgccucgcuuggaaauuuguucgcccgaucagcccuggacaccgccgccagaagcaccaagcccccuagauacaagugugguauuaguaaagccugucccgaaaaacacuucgcuuucaagauggcaucuggcgccgcuaacguggugggcccgaagauuuguuuggaggauaauguguugaugucaggugugaagaauaacgugggcagagguaucaauguagcucuugcaaauggcaaaacaggggagguauuggacaccaaguauuuugacauguggggaggggacguggcacccuuuaucgaauuuuuaaaagcaauccaggacgggacaaucguguugauggguacuuacgacgacggcgccacuaaacuuaaugacgaggccagacggcuaauugccgaccuggggaguacuagcaucaccaacuugggcuuuagggauaauuggguguuuugcggcggaaaagguauuaagaccaaaucaccguuugagcagcacauuaaaaauaauaaagauacaaauaaguacgaggguuggccagaagugguagaaauggagggcugcauuccacagaagcaggauuag

SEQ ID NO: 13967 - RNA, 1656 nt, Artificial Sequence
  Description of Artificial Sequence: Synthetic coding sequence
auggaggacucugauuccgcagcgaagcagcuaggccucgcagaagcugccgccgccggcggagaggcagaggaacccgugcucagccgagaugaagauucugaggaagacgcugauuccgaagcugaaagagagacaccacguguuacggcuguugcaguuauggccgcagagccaggccacauggauaugggggcugaagcccuuccuggucccgacgaggccgccgccgccgcugccuucgccgaggugaccaccgugacuguagcaaaugugggagcagccgcagauaacguauuuacaaccuccguggcuaaugccgcguccaucagcggccacguucugucuggccgcaccgcccugcagauuggagacucguugaauacugaaaaggccacucuuaucgugguucacacugacgguuccauagucgagacaacuggccugaagggaccugcugccccacugacucccggaccacagagcccaccuaccccacucgccccuggacaagaaaaaggcggaacuaaauauaacugggauccauccguuuaugauuccgaacugcccgugcgcugccgcaacauaucagggacccuguacaaaaaucgacuugguucgggcggaagggggagauguauaaagcagggagagaacugguauucaccuacagaguuugaggccauggccggaagagccuccucuaaggacuggaaacgaagcaucagauacgcuggaaggccccugcagugccugauccaggauggaauucucaauccccacgcagcuuccugcacuugugcugcguguugugaugacaugacucucaguggcccaguacgacuuuuuguuccauacaagcgaagaaagaaagagaaugaguuaccaaccacgccagugaaaaaagauaguccaaaaaauauaacucugcucccagcuacagccgccaccaccuuuacugucacccccucuggacaaaucaccacguccggcgcccugaccuuugaccgcgcuucuaccguugaggccacagccgucauauccgaaucgccugcccaaggagauguguucgccggggcgaccguacaggaagccagcgugcagcccccaugucgggccucacacccagaaccccauuauccagguuaccaggacuccugccaaauugccccuuuuccagaagccgcacugccaacaucccacccuaagauaguacugaccucguugcccgcccuugcagugccaccccccaccccuacaaaagcagcccccccagcccuagucaacggacuggaauugagugaaccgagaucguggcucuacuuggaagaaaugguuaauucucuccuuaauacugcucaacagcucaagacucuguucgaacaggcuaagcaugcaucgacuuacagggaggccgccacaaaucaggcuaaaauucacgcagacgccgaacggaaggaacaguccuguguaaacuguggccgcgaggccaugucagaguguaccggaugucacaaggugaauuacugcagcacauuuugucaaagaaaagauuggaaggaccaucagcacaucugugggcaguccgccgccgucacuguucaagccgacgaaguccacguagccgaguccguuauggaaaaggugacaguguag

SEQ ID NO: 13968 - RNA, 2022 nt, Artificial Sequence
  Description of Artificial Sequence: Synthetic coding sequence
augaagcccggaggauucuggcuacauuuaacucuguugggugccucacucccugcagcacuuggcuggauggaccccggaacuucacgcggcccugacgugggagucggagagucucaagccgaggagccacgaaguuuugaaguaacaaggagagagggacuuaguagccacaacgagcuccuggccagcugugguaagaaguucuguagucgcgggucucgauguguucugucccuggcuccugaagaucgugugucaguuaccaccgucacuguaggucugaguaccgugcuaacaugcgccgugcacggcgaccuucggcccccaaucaucuggaaacgcaacggacugacccugaacuuucucgaccuggaagacaucaacgauuucggugaagacgacagcuuguauaucacaaagguaaccacaauacacauggguaacuacacaugucacgcgucugggcacgagcagcucuuucaaacacacguacugcaggugaaugucccuccggugaucaggguauaccccgagucucaggcacaggagccaggcguugccgcuucauuacguugucacgcagaaggcaucccgaugccaagaaucacaugguuaaagaacgggguggauguaagcacucagaugucaaagcagcuuagucuguuggccaauggcuccgaauugcacauuuccagcgugcgauaugaagauaccggggcguauacuuguauugcuaagaacgaaguggguguugaugaggacauaagcagucuguuuaucgaggauagugcacgcaaaacacuugcuaacauuuuguggagggaggaagggcuaucugucggaaacauguucuacguauuuucggacgaugggaucaucguaauacauccgguggacugugaaauacaaagacaucuaaagcccaccgaaaagauuuuuaugucauaugaagagauuuguccucaacgggagaagaacgcaacucagcccugccaaugggugagcgccgugaaugugcggaacagauacauauauguagcgcagccagcucugucuagaguccuagucgucgauauacaggcccagaaagugcuacaauccauaggcguugauccuuugcccgcuaaauuaagcuacgauaaaucccaugaucagguuuggguccucucuuggggggacgugcacaagucaagaccuucacugcaggugaucacagaagccagcaccggucagucucagcaucucauuagaaccccauucgccggcgucgaugauuuuuucauccccccgacaaauuugauuauuaaccacauucgguucggauuuauuuuuaacaaaucggaccccgcuguccacaagguagaucuggaaacaaugaugccccuaaaaaccaucggauugcaccaccacggcugcgugccucaagcaauggcacauacacacuuaggagguuacuucuucauccagugcagacaggauaguccugcaagugcugcacgucaacuucuggucgauucagucacugauagugugcucggaccaaacggcgacgucacugggaccccgcacaccuccccggaugggcguuucaucgugagugcagcugcagauagccccugguugcacgugcaggaaauuacugucagaggugaaauucagacacucuacgacuugcagauuaacuccggaaucuccgaucuggcguuccaacgguccuucaccgagucuaaccaauacaacauauaugccgcccuacauacugaacccgaccugcuauuccuggagcugagcacuggaaagguuggaaugcucaagaacuugaaggagccuccugccggccccgcacagccaugggggggcacacauagaauuaugagagacucuggacucuuuggccaguaccuucugacuccugcaagagagaguuuauuccuuauuaaugguagacagaacacacugaggugugaaguaagugguauaaagggugggaccacagugguuugggucggcgagguguag

SEQ ID NO: 13969 - RNA, 2007 nt, Artificial Sequence
  Description of Artificial Sequence: Synthetic coding sequence
auggaucucguacuuaaacgaugcuugcugcaucuggcugugaucggugccuuauuggcagugggggccacaaaagugccucgaaaucaagauugguuaggcgugucacgccaacugcgcaccaaagcauggaaucgucagcuuuauccugaauggaccgaagcccagaggcucgacugcuggagggguggccaaguguccuugaagguguccaacgauggucccacacugaucggcgccaacgccaguuuuagcauugccuuaaauuuucccggaagucaaaaagugcuccccgauggccagguaaucugggugaacaauacaaucauaaacggcgaccaagucuggggaggacagccuguguauccucaggagacagaugaugcuuguauauucccugacggcggcccauguccaucaggaagcuggucucagaagaggagcuuuguauauguguggaaaacaugggggcaguacuggcagguccucgggggacccguguccggccugagcauugguacagguagagccaugcuugggacucacaccauggaagucacagucuaccauagaagaggcagccguagcuauguaccacuugcacauucuucuucagcauucacuaucacagaucaggugcccuucuccgugucugugagccaacuucgggcccuugacggaggaaacaagcauuuuuuacgcaaccagccacuaacuuuugccuugcaauuacaugaccccucuggcuaccuggcagaagcagauuuaucauacacuugggacuucggugacucguccggaaccuugaucucaagggcucuugucgugacacauacauaccuugaacccggucccgucacagcacaggucguucuucaggccgccauaccgcucaccucaugcggcaguucaccuguuccagggacuacagacggucacagacccacagccgaggcaccuaacaccacagcaggacagguuccgaccacggaggucgucggcacuacucccggucaggccccaaccgcagagcccucagggacuacgucagugcagguuccaacgaccgaagugauuucaacugcuccagugcaaaugccaacagccgaguccaccgguaugacaccagaaaaaguuccuguaagugaggucauggggacuacguuagccgagauguccacccccgaggccacaggcaugacacccgcagaggugucuauaguuguacugaguggaacgacagcagcacaggugacgacgaccgaguggguagaaacaacagcucgagaacuuccaaucccggagccagaaggucccgacgcaucgagcauaaugaguaccgagucgauuacaggcagccuaggcccgcuucuggauggaacugcuacuuugagauugguaaaacgucaggugccgcuagacugcguccuguauagguauggcuccuucagcguuacacuggauauagugcaaggcauagaauccgccgagauccuucaggccgugccgucuggugaaggagacgccuucgaguugacagucaguugucagggaggacuuccuaaagaagccuguauggagaucuccucuccugguugucagccgccugcgcaaagacugugucagccuguacugcccucuccugccugccagcuggugcuacaucaaauccuuaaggguggcagcggcaccuauugccuaaauguuucucuugccgauacgaauagucuggcaguagucuccacacagcucaucaugccugugccgggaauccuucucacuggccaagaagccggacucggacaaguaccacugaucguuggcauccuccuaguacugauggccgucguccucgcaagccugaucuauaggcgucgcuuaaugaaacaggacuuuagcguaccucaguugccucacagcagcucacacuggcuaaggcuuccacgaaucuuuuguucauguccuauaggagagaauucuccacuauuaaguggacagcaaguguag

SEQ ID NO: 13970 - RNA, 1746 nt, Artificial Sequence
  Description of Artificial Sequence: Synthetic coding sequence
augcagcaggacggacuuggagucggcacucgcaacgguucaggaaaagggagaagcguccaucccucuuggcccuggugugccccaagaccauugcgauacuucggccgugaugcucgugccaggagagcacagaccgccgcgauggcuuuauuggcugguggccuaucuagaggacugggcucccaccccgcugcagccggacgagacgcagugguguucgucuggcuucugcuguccacauggugcaccgccccagcccgcgcuauccaggucaccgugagcaauccuuaccacgucgucauacuguuucaaccagugacacuaccaugcaccuaucagaugaccaguacuccaacucagcccauaguuaucuggaaguacaagaguuucuguagagaucgaauagccgaugcuuuuagcccagccucaguggacaaucagcuuaacgcccagcucgcagcuggcaaccccggauacaaccccuauguggaaugccaagacagcgugagaacuguuagagucguggcaacuaaacaaggaaaugcuguaacauuaggcgauuacuaccaaggucgccgcaucaccaucaccggaaacgcagaccuaacauuugaccagacagcauggggagacucugguguguauuauugcucugucgucagugcucaggaccugcaggggaacaacgaagcauacgccgaacucaucgugcugguauacgcagcuggaaaggccgcaacuucaggugugccuagcauuuaugcuccuuccacuuacgcccaccugucucccgccaaaaccccuccaccaccagcuaugauaccgaugggcccagccuacaacggguacccuggaggauaccccggcgacguugaccgcagcagcucugcuggugggcaaggcucuuacguuccacuguugcgcgacacagauucaaguguggccagugaggugaggagcgguuaucggauucaggccagccagcaggaugacucuaugcgcgugcucuacuauauggaaaaagagcuugcuaacuucgaccccucacgaccugggcccccuagcggccgcguagagcgagccaugucugaggugacuucuuugcacgaggaugacuggcggaguagaccuucacggggaccugcauuaacccccauacgcgaugaagaguggggcggacauucuccuagaucucccaggggaugggaucaggagcccgcccgagaacaggcuggcggugguuggagagccagaagaccucgugcgagaucugucgacgcuuuagacgaccuaacuccaccuucuacugccgaaucaggcucccgcuccccaaccaguaaugggggccgcucaagggcguauaugccgccacgcaguaggagccgcgacgaucucuacgaccaagaugauagccgcgacuuucccagaucacgcgacccacacuacgacgacuuccgaucaagggagagaccaccagcggauccacgaagucaccaccaucguacaagggauccuagggacaaugguucucgauccggcgauuugcccuaugauggaagguuacuggaggaagcagugcggaaaaaaggcucagaggaaagaagacgcccucauaaagaagaagaagaagaagcguauuauccgcccgcaccucccccuuacucugaaaccgacucacaagccagucgggagaggagacugaagaaaaaucuggcccuuagccgagaaagccuagucguuuag

SEQ ID NO: 13971 - RNA, 1959 nt, Artificial Sequence
  Description of Artificial Sequence: Synthetic coding sequence
augcccccuccuuugccacugcugcuauugacgguauuagugguugccgccgcuaggccgggcugugaguuugagcggaacccugcuggugaaugccaccgucccccagccgccgacucggcaacuuguguugaucugcagcuccgcacuugcuccgacgcugcuuacaaccauacuacguuucccaaccuucuccaacacagaucgugggaaguuguagaggccucaagugaauacauccugcucucggugcuucaccaacuuuuagagggacaguguaacccagaccugagacuacuggggugugcuguguuagccccaaggugcgaaggcgguugggugagacgacccuguaggcauauuugcgagggcuugagagaaguuugccagcccgccuucgacgcaauagacauggccuggcccuacuuucuggacugucaccgcuacuucacacgugaggaugagggaugcuaugacccacuggaaaaauuacgaggcgguuuggaggccgacgaggcucuaccuucuggucucccaccuacauucauucgauucucucaucauaguuacgcgcagaugguccguguccuucgacgaacugccucacgaugcgcccauguggcccguacuuauagcaucggacgcucuuuugauggacgugaauuacucgugauugaauuuaguagucgcccuggucagcacgagcugauggaacccgaaguuaaauugauuggcaacauccacggcaaugagguugccggucgggagaugcucauuuaccuugcucaauaucugugcucggaauacuuacuugguaacccuaggauccaaaggcuccucaacacuacccgcauucacuuacucccaucgaugaauccagauggguaugaaguugcggcugcggaaggagcaggauauaauggauggacuagcggucggcagaacgcccagaacuuagaccugaacaggaauuuccccgaucugacaucugaauacuauagauuggccgaaacccggggagcucggagcgaucacauuccaaucccccagcacuacugguggggaaaggucgcuccagaaacuaaagcuaucaugaaauggaugcagaccauacccuuuguacucagugccucacuccaugggggagaccuggucgucucuuauccuuuugauuuuagcaaacauccacaggaagagaaaauguucucgccuacuccagacgagaaaauguucaaacugcuuucuagagcuuacgccgauguucacccuaugaugauggauagauccgaaaaccgcugugggggaaacuuucugaaacggggauccauaauuaauggagcugacugguauaguuucacaggcgggaugucagauuuuaacuacuugcauacaaacugcuucgagaucaccgucgagcugggaugugucaaguuuccaccagaagaggcccucuacauccucuggcaacacaauaaggaaucccugcugaauuucguagagacugugcaucgaggaauaaaaggcgugguaacugacaaguucggcaagcccguuaagaacgccagaauuagcgugaaaggcauuagacaugauaucaccacagccccugacggugauuacuggagacucuuaccacccgguauccacaucgugaucgcccaagcuccuggcuacgcuaagguaaucaagaaggugaucaucccugcuagaaugaaacgugccggcagggucgacuuuauccuccagccccucggcauggggccaaaaaacuuuauccacggucugagaagaacugggccucacgauccauuggguggcgcuucauccuugggcgaagccaccgagccugacccucugagagccaggcgccaaccaucagcagacggcagcaaaccuuggugguggaguuacuuuacaucacuuaguacacacagaccucguuggcugcuaaaauauuag

SEQ ID NO: 13972 - RNA, 279 nt, Artificial Sequence; identical to SEQ ID NO: 12333
  Description of Artificial Sequence: Synthetic coding sequence

SEQ ID NO: 13973 - RNA, 249 nt, Artificial Sequence; identical to SEQ ID NO: 12334
  Description of Artificial Sequence: Synthetic coding sequence

SEQ ID NO: 13974 - RNA, 411 nt, Artificial Sequence
  Description of Artificial Sequence: Synthetic coding sequence
auggauaauguacaacccaagauaaaacaccggccuuucuguuuuucuguuaaaggccacguaaaaauguuacgccucgcccucacggucacguccaugacuuucuucauaauugcccaggccccagaacccuauauagucauuaccggcuucgaagugaccgugauucuauuuuucauccuucucuacguucucaggcucgaccgacugaugaaauggcuguucuggccccugcuggacaucauuaauucccuugugacaaccgucuucauguuaaucgucuccgugcuggcccugaucccugaaaccaccacucuuaccguaggaggggguguguucgcccugguaaccgcaguguguugucuggccgacggagcucugauauauaggaaauugcuuuuucuccguuag

SEQ ID NO: 13975 - RNA, 1068 nt, Artificial Sequence
  Description of Artificial Sequence: Synthetic coding sequence
augcagcucacuacuugccugagagaaacucucuuuaccggggcaucccagaaaacaagccuuugguggcuggguaucgccaguuucggaguaccugagaaauugggaugcgcuaaccucccacuuaacucccgccaaaaagaacucugcaaaagaaaacccuaccuccuaccuagcauucgggaaggcgcccgucucggcauccaagaauguggcagccaauuccggcaugagcgguggaauuguaugauuacugcggccgcuacuacagcuccaaugggcgcgucaccacucuuuggauaugaguuguccuccgguaccaaagagaccgccuuuauuuacgcuguuauggccgccgggcuugugcauucaguaacuagaaguuguagcgcuggcaacaugaccgaaugcagcugcgauacuacacugcagaauggcggcuccgcguccgaaggcuggcacuggggagguuguucagacgaugugcaguacggaaugugguucucuagaaaguuuuuggauuuccccaucggcaacaccacaggcaaagagaauaaaguauuguuggccaugaaucuacacaauaaugaggcaggccgucaggcaguggcuaagcuuaugucaguugauuguaggugccauggaguuagcggaucgugcgcggugaagacauguuggaagaccauguccuccuucgagaaaauuggacaucuccugaaggauaaauaugaaaauucuauccaaauuuccgacaagacaaaacgcaagaugagaagacgcgaaaaggaccagaggaagauacccauucauaaggacgaccuucuguacgugaauaaaagucccaacuauugcguggaggauaaaaaauuggggauaccuggaacacagggaagagaguguaauagaacaagcgaaggagcagacggcuguaaucucuuguguugcgguagggguuacaacacccauguagugagacacguagaaagaugcgaauguaaguuuauuugguguugcuaugugaggugcagaagaugugaaagcaugacagacgugcauacguguaaguag

SEQ ID NO: 13976 - RNA, 2916 nt, Artificial Sequence
  Description of Artificial Sequence: Synthetic coding sequence
augcugagaagacccgccccugccuuggcccccgccgcacggcuccuccuugcugggcugcugugugguggcggcguuugggcagcacgcguaaauaaacauaaacccuggcuggagcccaccuaucacggcaucgucaccgaaaacgauaacacuguccuucuugacccaccccugauugcuuuggauaaagacgcuccucugagauuugcuggcgaaaucugcggcuuuaaaauucacggucaaaaugugccuuuugacgcuguggugguugauaaaagcacaggcgaggguguuaucagaaguaaagagaagcuagauugcgaacuucagaaagacuacaguuucacuauucaggccuacgauugcggcaagggccccgacggcacaaacgugaaaaaaagucacaaagcaaccgugcacauacaagucaaugacgucaacgaauacgcucccguauuuaaggaaaaaucauacaaggcaaccgucauugaaggcaaacaguacgacagcauccucagggucgaggcugucgacgccgauugcuccccccaguucucacaaauaugcuccuaugagauaaucaccccagacgucccauuuaccguugacaaggauggcuauaucaagaauacggagaaacugaauuacggcaaagagcaucaguauaaauuaacaguuacagcauaugacuguggcaagaaaagagccacugaagauguccucgugaaaaucuccauuaaaccaacuuguacccccgguuggcaaggcuggaauaauagaauugaguaugaacccggaacaggcgcccucgccgucuuccccaacauucaccuggaaacaugcgacgaaccaguggccaguguccaagcaacaguagaauuggagacaucacacauaggaaagggcugugacagggacacauauuccgaaaagagucugcaccgguugugcggagcugccgcugguacagcugaauuguugcccucgccuuccggcucucugaauuggacaauggguuuaccaacagauaacgggcacgacuccgaccaggucuucgaguucaacgggacacaggcggucagaauccccgacggcguugugagcgucagcccaaaagaaccauucacaauuuccguuuggaugcggcacggccccuucggaagaaagaaagaaacaaucuuauguaguagcgacaagacagauaugaaccgccaucacuauuccuuauauguacacggcugcagacuuauauuccuuuuccggcaggauccaucugaagaaaaaaaauacagaccggcugaauuucauuggaagcuaaaucaggugugcgacgaggaauggcaucacuauguccugaacguggaguuuccaagcguuacgcuguacguggacggcacaagucaugaaccauucagugucaccgaagauuauccccuccacccaucaaagaucgagacccaguugguuguuggcgcuuguuggcaggaguuuucugguguugaaaacgauaaugagacagagccagugaccguggccagcgccggcggugacuuacauaugacacaguuuuucagggguaaucuggccgggcuuacacugagaucuggaaaacuggcagacaagaagguaauugauuguuuauacacaugcaaagaagggcuggaucuccaggugcucgaagacucaggccgcggcgugcagauucaggcgcauccaucacaguuaguuuugacacucgagggagaggacuugggagagcuggauaaagcuaugcagcauauaagcuaccugaacucccgccaguucccaacgccagggauccguaggcugaagauaacgucaaccauaaaguguuucaacgaggccacaugcauuucuguuccucccguggacggguaugugauggugcuccagccagaagagcccaaaauuagccuaucaggaguucaucauuuugccagggcugcauccgaguucgaaucaucugaaggcguguuucuguuuccagaauuaagaaucauuucaacuaucaccagagagguggaaccagagggggauggagcagaagacccaacagugcaggaaucacuggucuccgaggaaaucguucacgaccuggauacuugcgagguuacaguggagggagaagagcuuaaucaugagcaagagagccucgagguggacauggcaagguugcaacaaaagggcauugaggucuccagcagcgagcucggaaugacauuuacaggcguggacacaauggcaagcuaugaggagguuuuacaccuauuaagauaucgaaacuggcacgcccgcucccuacuggacaggaaguucaaacucaucuguagcgaacuaaacgggagguacauuuccaaugaauuuaaagucgaagugaacgugauacacacugcgaauccuauggaacaugcgaaccauauggcagcccaaccgcaguucguccaucccgagcauagaucauuuguugaccugaguggacauaaccuggcaaauccucacccguucgccguggugccuagcacugccaccguuguaaucguuguaugugugucuuuccugguguucaugauaauccucggugucuucaggauccgggcagcacacagaaggacaaugagagaucaggauaccggaaaagaaaacgaaauggacugggacgacagcgcacugaccaucaccguaaauccaauggaaacguaugaagaccagcacagcagcgaagaagaggaggaggaggaggaggaagaggagagcgaggauggugaagaagaagacgauauuacaucugccgagagcgagucaucagaagaagaggaaggugaacagggggacccccaaaacgcaacaagacaacagcaguuagagugggaugauagcacccucagcuauuag

SEQ ID NO: 13977 - RNA, 564 nt, Artificial Sequence
  Description of Artificial Sequence: Synthetic coding sequence
augguggccgcuaccguggcagccgccugguuacuccuaugggcagccgccugcgcacaacaagagcaggauuuuuaugauuucaaggcugugaauauaaggggaaaacuugucagccuagaaaaguauagagguagcgugagccugguggugaaugucgcaagugaaugugguuuuacagaccagcauuauagagcgcugcagcagcuucaaagagaucucgggccccaucacuuuaauguccucgccuuuccuugcaaucaauuugggcagcaggaaccggacuccaacaaagaaauagaaagcuucgcucgccgcaccuacagcgucucauuuccuauguucucaaagauagcggucaccggcacuggugcacacccugcuuucaaauaucuggcgcagacaucggguaaggaaccuacuuggaauuucuggaaguaccucguugccccugacgggaaaguugucggcgcuugggauccaacugucagcguggaagagguuaggccucaaauuaccgcccuuguacgaaaauugaucuugcucaaaagagaggaucuguag

SEQ ID NO: 13978 - RNA, 303 nt, Artificial Sequence; identical to SEQ ID NO: 12339
  Description of Artificial Sequence: Synthetic coding sequence

SEQ ID NO: 13979 - RNA, 2352 nt, Artificial Sequence
  Description of Artificial Sequence: Synthetic coding sequence
augcgauggcagugcggaacacgguuucgaggacuuagaccagcgguggcgcccuggaccgcucuccucgcuuugggucugcccggaugggugcuggccgucuccgcuacagcagccgccguggugccugagcagcacgccagugucgcuggacagcauccucuagacuggcuucugacagaucgaggaccauuucaccgugcccaggaauaugccgacuucauggaaagauaucgccagggauucacuaccagguacagaaucuaucgugaguuugcccgauggaaagugaauaaucuugcgcuagaaagaaaagacuuuuucucacucccuuuaccguuggcaccagaguucaucagaaauauucgccuacugggacguagacccaaccugcaacaggugaccgaaaacuuaauuaagaaauacgggacccacuuucucuuaucugccacgcucggcggugaagagagccugacuauauucgucgacaagcagaaauugggaagaaaaacggaaacuacaggcggugccuccauaauuggcggcucugguaacagcacagcgguuaguuuagagacucugcaccaacucgccgcuucauacuucaucgaccgggaauccacccucagaagacuccaucacauucagauagccaccggcgcaauaaaagucacagagacacggaccggaccacugggcugcuccaacuacgauaaucuagacucuguuucaagcgugcugguacagucgccggagaacaaagugcaacuccuugggcugcaagugcuacucccugaguauuugagagaaagguucguggccgccgcacucucauauaucaccuguucuuccgaaggagaacuaguaugcaaggaaaacgauugcuggugcaagugcagccccacuuucccagaauguaauugucccgacgcagauauacaggcuauggaggauucucuguugcagauacaggacaguugggccacacauaacagacaguucgaagaguccgaggaauuucaagcgcuacugaagaggcuuccagacgaccgauuccugaacagcacagccauuucacaguucugggcuauggacaccucacuacaacaucgauaucagcaauugggagccggguugaaggugcuauucaaaaagacucaucggauccuuagacgucuguuuaauuuauguaagcgcugccaucgucagccucguuuucgccuuccaaaggaacggagccucucuuacugguggaacaggauucagucucuacuuuacugcggagagagcacuuuuccgggaacauucuuggaacagagucauagcuguacauguccauaugaucagaguucuugccagggccccaucccuugcgcgcucggcgaagguccagccugugcucacugugcccccgacaacuccacacgcugcgggagcuguaauccaggcuaugugcuagcucagggucuuugccgcccagaaguagcugagucuuuggaaaauuuuuuaggccucgaaacagacuugcaggauuuggaacuuaaauauuuacuacagaagcaggauuccagaaucgaaguccauagcaucuucaucucaaaugauaugcggcucggcucgugguuugaucccuccuggaggaagcggaugcuguugacgcugaagucuaacaaguacaaacccggccuuguccacguaauguuagcgcugucccuccagauuugcuugacuaaaaauucuacucucgaaccaguuauggccauuuacgugaaccccuuugguggcucacauagcgaaaguugguuuaugcccguuaaugaggggagcuuucccgacugggagcgaacaaacguggacgccgccgcucagugccagaacuggacaauaacuuuggguaauagauggaaaaccuucuuugagaccguacaugucuaucuuagaucacgaauuaaguccuuggacgauaguagcaaugaaacaauauacuacgagccacuugaaaugaccgauccuucuaaaaauuugggcuacaugaaaauuaacacucuccaggucuucggauauagccugccuuucgauccagacgcaauacgggaucucauccugcaacuggauuacccuuacacccagggcucacaggacagcgcacugcugcaguugaucgagcuucgugaucgagugaaucagcugucacccccuggcaaaguacgcuuagacuuguucaguugccuccuucgucaccgccugaaacuugccaauaacgaagucggacggauucagucuucccuuagggccuuuaauucuaaacuccccaauccuguugaguaugagaccgguaaacugugcucuuag

SEQ ID NO: 13980 - RNA, 2016 nt, Artificial Sequence
  Description of Artificial Sequence: Synthetic coding sequence
auggcacaauuguuccucccccuguuagcugcccuggucuuagcccaggcgcccgcagcccucgccgacguucuugaaggggauuccagugaagacagggcauuucgcgugcggauugccggugaugcaccccuacagggaguccuggguggggcacucaccauaccaugccacguucacuaucugaggccgccgccgucucgcagggccgucuuggguagcccacgcgucaaauggaccuucuugucccgaggaagagaggcagagguguuaguagcgagagguguaagagucaaagucaaugaggcguauagguuucgagucgcccuuccugcauaucccgcuucccugacugacguuagucuagcccugagugaauugaggccgaacgauucuggaauuuacagaugcgaaguacaacacggcauagacgauaguuccgacgcaguggagguuaagguaaaaggugucguauuccuguauagagaaggaucugcccgcuacgccuucucauuuagcggcgcccaagaggcuugugcuagaauuggggcccauauagccaccccagaacagcuuuacgcagccuauuugggcggcuaugagcagugugaugcugguuggcuuagcgaccagacagugagauaccccauccagacacccagagaagcauguuacggagacauggauggguuucccggagugcggaacuauggcguggucgauccugaugaccucuaugacgucuauugcuacgcugaggaucucaacggggagcuuuuuuuaggcgacccuccggaaaaacuuacacucgaagaagcacgugcauauugccaggagaggggagcugaaaucgccacaacuggccaacuuuacgccgccugggauggaggacuagaucacugcuccccaggauggcuggccgacggcagugugcgcuacccaauaguaacgccaucccagcguugcggcggaggacucccaggcgugaagacucucuuuuuauuuccuaaccagacaggauucccaaauaaacacagccgauuuaacguguacuguuuccgagauucagcacaaccaagcgcgaucccugaagcuuccaauccugcaagcaauccagcuuccgacggccucgaggcgaucgugacagucaccgagacccuugaagaacuccagcuuccacaggaagcgaccgagagugagagucguggcgcgauuuacucuaucccuauuauggaagacggaggagguggaagcucuacacccgaagaccccgccgaggccccacguacccuccuugaauuugagacccagucaaugguucccccuacgggcuucucugaggaagaaggcaaagcucucgaggaagaggaaaaauaugaagacgaagaggagaaagaggaagaagaggaagaggaggaagucgaagacgaggccuuaugggccuggccuagugaacuuuccucaccgggacccgaagcgagccuaccuacagaacccgcagcccaggaggagaguuugagccaggcccccgcccgcgcuguccuucaaccaggcgcauccccauuacccgacggggagucagaagcgucccgaccaccuagggugcacgggccuccuacugagacacugccaacgccuagagagcguaacuuggccucuccauccccuaguacauuaguggaagcgagggaagugggagaagcuaccgguggucccgaacuguccggcguaccucguggggaauccgaagagaccggaagcucagaaggagcaccaagcuugcugccagccacacgagcacccgaaggaacuagggaguuggaggccccauccgaggauaauuccggccgaacugccccagcuggcaccagcguacaggcucagcccguccugccaacggauagcgcgucucgugguggagucgcugugguuccagcuuccggcaauagcgcucagggaagcaccgcauugucuauacuguuauuguucuuccccuuacaguugugggugacuuag

SEQ ID NO: 13981 - RNA, 375 nt, Artificial Sequence
  Description of Artificial Sequence: Synthetic coding sequence
auguauaaauuggccuccuguugccugcuguuuaucggauuucucaacccccuucucucucugccccucuuagacucucgagaaauuucuuuccaacuuucugccccacacgaagaugccaggcugacuccugaggagcuugagcgugcgagucuuuugcaaauucugcccgaaauguuaggcgcugaaaggggcgacauccugcgcaaagcugacagcuccacaaauauuuucaaccccagagggaaucuacggaaauuucaggacuucucuggccaggacccaaacauucuccugucucaccuccucgcuagaauuuggaagccuuacaagaagagagaaacaccggacuguuuuuggaaauacugcguauag

SEQ ID NO: 13982 - RNA, 1326 nt, Artificial Sequence
  Description of Artificial Sequence: Synthetic coding sequence
auggaguucgaauuugaucgacugcgggccuuucaggccaugcagguucauugcaauaacaugcacacgcugggcgcccggcuuccugggggagucgaauguagguuccgaagaggaccagcuauggcaugggaaggcgagccaaugaggcacaaucuggggggaaaucucggagacccucgggcccgagcaguuaguguaccguugggaggcagaguugcuagguuucuccaauguagguuccucuuugcaggcccuugguuacuuuuuucagaaaucaguuuuauuagugacguaguuaauaacucuagcccagcucuuggagggacauuccccccggcccccugguggccuccugguccucccccgacaaauuucucuucguuggagcucgagccuagaggacagcaaccagucgcaaaggccgaaggaucuccaaccgcaauccucauuggcugucuugucgccauuauccugcuguuacuucuaauuauagcguugaugcuauggcgucugcauuggcgcagacucuugucuaaaguacucgagagccacccacgaaccagaucacccggccucguaggcauaagaccaacuccacugccugugucccccauggcccugcgcuguugcagcccaauccaaccaaccgcaagcuuuuggccucuuacaccuguuccauuggaagcacgcgcccccccccacccuccuggcccaaaccccccuacuccucgcggugucaccggaggaaauacuuaugcugugccagcucugcccccuggcgccgugggcgacggcccuccuaggguugacuucccccgcucacgauugcgauuuaaggagaagcuuggagaagggcaauuuggagagguucaucugugcgaaguugacagcccucaggaccugguaucccuggacuucccacugaacguuaggaaaggacauccucugcugguggcugugaagauucucaggccagaugcuacuaagaaugcuaggaacgauuuucugaaggaggugaaaauaaugagccgacuaaaagacccaaauauuauaaggcugcucggaguuugcguacaagaugaccccuugugcaugauuacagacuauauggaaaacggcgaccuaaaccaguuucuguccgcucaucagcuggaggacaaagccgcagaaggagcuccuggugauggacaagccgcccaaggccccacaaucucuuacccaauguuauugcacgucgccgcccagauugccuccgguaugcguuaucuugcgacucugaacuuuguacacuuuuggggagagagacaccgauuucugcacuag

SEQ ID NO: 13983 - RNA, 1950 nt, Artificial Sequence
  Description of Artificial Sequence: Synthetic coding sequence
augcaacaggacggccuuggcguggguacuagaaauggaucuggaaaagguagaagugugcaccccuccuggccuuggugcgcuccucguccacugcguuauuuuggaagagaugcaagagccagacgcgcccagacugccgcaauggcccuguuggccggcggauuaagcagaggucucggaucacaccccgcugcugccggucgggacgccgugguuuucguuuggcuacugcugucuacuugguguaccgcccccgcaagagccauucaggugaccgugaguaauccuuaccacguggucauauuguuucaaccuguuacucuccccuguacauaccagaugacaucaacccccacacaacccaucguuauuuggaaguauaaaaguuuuuguagagaccggaucgcggaugcguucucuccagcuucugucgauaaucagcugaacgcacagcuggccgccgggaacccaggauauaaucccuauguugaaugccaggauaguguucgaaccgucagagugguagcgacuaagcaggggaaugcaguuacgcugggcgauuacuaccagggaagacggauaaccauuaccggcaacgccgaucugaccuucgaucaaacagcuuggggagauucagguguguauuacugcuccgugguuagcgcccaagaucugcagggaaacaacgaggccuacgccgagcucauaguccugggucguacaucugguguagccgaauuauugccgggauuccaggcuggacccaucgaagacuggcuguuuguggucguggugugucuggcagccuuucugaucuucuugcuucucgguauuuguuggugucaaugcuguccccacacuuguuguugcuacguacguugcccuuguugcccugauaaauguugcugcccagaggccuuauaugcugccggcaaagcugcaaccucgggagugcccucaaucuacgcuccuuccaccuacgcccaccuguccccagcuaaaacccccccaccaccugccaugauccccaugggcccagcauacaaugguuacccgggcggauauccuggggaugucgacagaucuucgucagcaggaggucaggguucguacgugccauuacuucgugauacagauucaagcguggcuucagaagugagguccggcuacaggauucaggccagccaacaagaugacucaaugcgcguuuuguacuauauggaaaaggaacuggcgaacuucgacccaucucgccccgguccaccuagcggaagagucgaaagagcaaugucugaggugacuucacuacaugaggaugauuggcgcagcagacccagucgagggccagcauugacacccauuagagacgaggaguggggaggacauucaccacgaucuccaaggggcugggaucaggaacccgcccgggaacaagcgggagggggcuggagagcucgcagaccccgggccagaucaguggaugccuuggaugauuugacaccaccgaguacagcugaaucaggcaguagaucuccuacaagcaacggcggaagaucacgggcuuauaugccaccccguucucgcagccgggacgaccuguaugaccaggacgauucacgggauuuccccagauccagagacccccacuaugacgacuucagaagccgggaaaggccuccggccgacccuagaucacaucaccaccgcacccgggacccgagggacaacggaucacgaagcggagacuuaccguacgacggcagacuucuggaggaggcuguccgcaaaaaaggcagcgaagagcgccgaaggccucacaaagaagaagaagaggaggcauacuauccaccugcucccccacccuauucugaaaccgacagucaagccagccgcgagcgcagauuaaaaaaaaaccuggccuuaagucgugaaucccuagucguuuag

SEQ ID NO: 13984 - RNA, 402 nt, Artificial Sequence
  Description of Artificial Sequence: Synthetic coding sequence
augucugaaagaguggagagaaauuggucuacagggggguggcuucuggcccugugcuuagcauggcuuuggacacaucuaacgcuggccgcucuccagcccccuacggccacagugcuagugcaacaggggaccugcgaggugauagccgcacauaggugcuguaauagaaauaggaucgaggagagaagucaaacuguaaaauguucaugcuuuaguggccagguggcugguaccaccagagcaaaaccaucuuguguugacgccaguauaguguuacaacggugguggugccaaauggagccgugcuuaccaggagaagaguguaaaguguugccagaccuguccggguggaguuguucgagugggcauaaggucaagacuacgaaggucaccagauag

SEQ ID NO: 13985 - RNA, 699 nt, Artificial Sequence
  Description of Artificial Sequence: Synthetic coding sequence
augguagccgcaaacacucgcgcacccgaagacacucgagccccugcaggccccaaaccauccuccugugaaugggcagugugcugggcaccagcacguugucgcauuucugccacagccugugguaacucgugggaccgcccugccggccgcacccaguuacuguggacgccugccgcuccgacugcuauggcugaaguuggcccaggacauacccccgcacauccuagucagggagcagucccccccucacgagccgcggccgaaccccaccucaaaccaagccccagugagcuucagaccgcugguccagccgccacuaucccugcuaggcuguguaccagaaaacccagacuggucuauacucaguguugguacgucaaagagccgaagcauccagaaauugucacaccaugggguacugccgcgagacauuccuggagacagcaccaaauguugucagccucugagaggcgcugccucccucgcgauguggagcagaaacucgggccagaacauacugguccaugccucgaugaacagggaagagaagcugagcuggcacguuccggaccuucagcagccggucccguuagacugaaaccuggucuugugcccggacucuuuuuguugagcuguacuacuucccccuccacaugucugcccgucggccaagaaggggaaaggggcauguuguag

SEQ ID NO: 13986 - RNA, 711 nt, Artificial Sequence
  Description of Artificial Sequence: Synthetic coding sequence
augugcguuacuuaucacaacggaaccggguacuguaaaugcccagagggcuuccugggagaauauugucaacacagagacccgugcgaaaaaaaucggugccaaaacggugguacaugcguggcccaagcgauguuagggaaggcuaccugcagaugcgcuagugguuuuacaggcgaggacugucaguauucaaccucccaccccuguuuugugucccgccccuguuuaaacggcggaacgugccauauguugucuagggacaccuacgaaugcaccugccagguggguuucacaggaaaagagugccaguggaccgaugccugcuugucccacccaugcgcaaacggaagcacgugcaccaccguggcgaaucaguucucauguaagugucugacagguuuuacagggcaaaaaugcgagacagaugugaaugagugcgacauaccggggcacugucaacacggcggcacaugucucaaucugccagguuccuaccagugccaaugucuucaagguuuuaccggccaauauugugacucccucuacgugccuugcgccccaucccccugcguaaacggcggaaccugccgccagaccggggauuuuacuuucgaguguaauuguuuaccagagacugugagacgagggaccgaguuaugggagcgagauagggagguguggaauggcaaggagcaugaugagaacuag

SEQ ID NO: 13987 - RNA, 204 nt, Artificial Sequence; identical to SEQ ID NO: 12348
  Description of Artificial Sequence: Synthetic coding sequence

SEQ ID NO: 13988 - RNA, 75 nt, Artificial Sequence; identical to SEQ ID NO: 12349
  Description of Artificial Sequence: Synthetic coding sequence

SEQ ID NO: 13989 - RNA, 3345 nt, Artificial Sequence
  Description of Artificial Sequence: Synthetic coding sequence
augcuugccucaucuagccguauuagggccgccuggacccgcgcacugcugcugccacuccuccuugccggacccgugggaugccucagccgccaagagcuuuuucccuucggcccaggacagggcgaucuugaacuugaggauggggaugauuuugugucccccgcccuugaacucagcggcgcauugcguuucuaugaccggagugauaucgaugcaguuuacguuacaacuaacggaauuauagcuacuucugaaccacccgcgaaggagucucaucccggccuuuuccccccuacuuucggggcuguggcaccauuccuugcggauuuagauaccaccgauggacuugggaaaguuuauuaccgugaagaccugucaccuucaauaacucaacgggccgcugagugugugcaucgugguuuuccugaaauuucuuuccagccuagcuccgcaguggucgugacaugggaguccgucgcacccuaccagggacccagccgcgauccagaccagaaggguaagagaaacacuuuucaagcagugcucgcuaguucagauucaucuucuuaugccauauuucuuuauccugaggacggucuccaguuucacacaaccuuuagcaaaaaagaaaacaaucagguccccgccgugguggcauuuagccaaggaucugugggauuuuuauggaaaagcaauggcgcuuacaacaucuuugcuaaugaucgggaauccgucgagaauuuggcaaaaaguagcaauucgggucaacagggcguguggguguuugagaucggauccccugccacaacuaaugggguaguacccgccgacguaauauuggggacagaggauggugccgaauaugacgacgaagacgaagacuaugaccuggcaacaacccgucucggccucgaggaugugggaacuacccccuucaguuauaaggcgcuuagaaggggcggagccgauacuuacagcgugcccucugugcugucuccuagacgagcggccaccgaacgaccccugggcccccccaccgagcgcaccaggagcuuucaguuggcaguagagacauuccaccagcaacauccucaggugauugacguggacgaaguagaagagaccggcgucguguucucauauaacacugacucuagacagacaugugcuaacaaucgucaucagugcagcguucacgcugagugccgcgacuaugccacuggauucuguuguucaugugucgccggcuacaccgggaaugguagacaaugcguugcugaaggaaguccucagcgagugaauggaaagguuaagggacgcaucuucguuggaucuucccaagugccaaucguauuugagaauacggaccuccacucuuacguaguaaugaaccauggccguagcuauacugcaaucuccacuauccccgaaacugugggcuauucacuucuaccccucgcaccugugggcgguaucauaggauggauguucgccgucgaacaggacggauuuaagaacggguucucuauuacuggcggcgaguuuacuagacaagcugaagucacauuugugggacauccuggcaaccuggugauaaagcaacgauucagcggcauugacgaacauggacacuugaccauagauacagaauuggaaggcaggguaccccagauccccuucggcucgucagugcauauugagcccuacaccgaguuauaccacuacucaacaucagucauaaccucaucaucaaccagagaauacacaguuacagaaccagagagagauggcgccucuccaucucgaauuuacaccuaucaguggagacagaccaucacuuuucaagagugugugcaugacgauucuagaccugcucuaccaagcacucaacaguuguccgucgauucuguguucguucuguauaaccaggaggagaagauccugcgcuacgcacugagcaauaguaucggacccgugcgugaaggcagcccagaugcacugcagaacccaugcuacauaggaacccauggcugcgauaccaacgccgcgugcaggccagguccaagaacucaguuuacuugcgaguguucaaucggcuuucgaggggacgguagaacuuguuacgagguggaaaagaccagaugccaacacgaacgggagcacauccugggagccgcuggagccacagacccacagagaccaauccccccaggccuuuucguuccugagugugaugcccacggucacuacgcaccuacccaaugccacggauccaccggauacugcugguguguagaccgugaugggagagagguugaagguacacggacuagaccgggaaugacccccccuugccuuagcacuguggccccacccauucaucagggccccgccguaccgaccgccgugauuccccuaccacccggcacccaucuccuguucgcacagacuggcaagauugaacggcucccacuggagggaaauacuaugagaaagacagaagccaaggcguuucuccacgugcccgccaaagugaucaucggucuggcauucgacugcguagauaaaaugguguacuggacugauauaacagaaccguccaucggacgagcuucacugcacgggggagagcccaccaccauuauccgccaggaucucgggucuccagaaggcaucgcuguggaccaccuuggcagaaauauuuuuuggacugauagcaaucuggaucgcauugaaguggcaaaacucgacgguacccaaagaaggguccucuucgagacggaccucgugaaucccaggggcaucgugacggauucuguccgcgguaaucuguacuggacugacuggaaccgcgauaauccaaaaauugagacuuccuacauggacgguacaaaucggagaauccuaguucaggacgaucuaggacugccaaacggacuaaccuuugacgcauucucgagccaacucugcuggguggacgcaggaaccaauagggcggaaugccuaaacccuucucagcccagccggagaaaggcccucgaaggccugcaauacccuuuugccgucaccucauacgggaagaaccucuauuuuacagacuggaagaugaauuccgugguugcacucgaccuugccaucucuaaagagacagacgccuuucagccucauaaacagaccagacuguaugguauuacuacggcucucucgcagugcccccaaggacacaauuauuguucugucaauaacgguggauguacucaucucugccuugccacaccuggaagccgaacgugucgguguccugauaauacacucggcguugauugcaucgaacaaaaauag

SEQ ID NO: 13990 - RNA, 2172 nt, Artificial Sequence
  Description of Artificial Sequence: Synthetic coding sequence
auggguagccgcugcgcauuggcuuuggcugugcugagcgcacugcucugccagguuuggucauccggagucuuugaauuaaagcugcaagaauucguaaacaagaaaggucuguuagguaaucguaacugcugccgcgggggagccggaccuccuccaugcgcuugucggacuuuuuuccguguuugccucaaacacuaccaagcauccguuagcccagagccaccguguacuuacggcagcgcugugaccccugugcucgguguagauaguuuuucucucccugaugguggaggggcggacagcgccuucaguaacccuauaagauuuccauucgguuuuacauggcccgguaccuucucccucaucauugaagcacuucauacagacuccccagacgaucuggccaccgagaaccccgaaaggcuuauuagcagauuagccacccagcggcaccucaccguuggugaagaauggucccaggaucuccacaguuccgggagaacggacuuaaaguauucauaucguuucgugugugaugaacauuauuauggcgaaggguguucuguguucugcagaccaagagacgacgccuuuggccauuucaccugcggcgaaagaggagaaaaaguaugcaacccgggcuggaaaggcccauauuguaccgaaccaauuuguuuaccggguugugacgagcagcauggcuuuugcgacaaaccgggggaguguaagugccgcguggguuggcaaggaagauauugcgacgaauguaucagauaucccggaugucuccacggaaccugccaacagccguggcaauguaauugccaagaagguuggggcggucuguucuguaaucaagauuugaacuauugcacacaccacaagcccugcaagaauggagcuacuuguacaaauacaggccaaggcagcuacacuugcucuuguagacccggguauacuggcgcgacuugugaacuuggcaucgacgaaugugaucccuccccaugcaagaacggcgggagcugcacagaccucgaaaauagcuacuccuguacuuguccccccggguuuuacggcaaaaucugcgaguuaagcgccaugacaugcgcugauggcccuuguuuuaacgggggacggugcuccgauuccccagacggaggauacagcugucgaugucccguaggcuacucugguuucaacugugagaagaagauugauuauuguuccucuaguccaugcucgaacggcgcaaaguguguggaucugggagaugccuaccugugccgcugucaggccggcuuuagcggacgccacugugaugacaauguggacgauugugcuaguuccccuugcgccaacggcggaacuugcagagacggcgugaacgauuuuucuugcacuugcccccccggauacacaggacgaaacuguuccgcucccgugucccguugcgaacacgcuccuugccauaauggcgcgacuugucaugaacguggccaccgcuauguuugcgaaugcgcccgaggcuauggcggccccaacugucaguuucugcuuccagaacuacccccagguccggccgugguggaccuuaccgaaaagcuggaaggucagggagguccuuucccauggguggccgucugcgcagguguuaucuugguauuaauguuguuacuaggcugugccgccguuguugugugcgugcgccuucgacuccagaaacaccgcccuccugccgaucccugcagaggcgaaacagagacuaugaauaaccuugcaaauugucagcgcgaaaaggacauuucaguuuccauaauaggcgccacacagaucaaaaacacuaacaaaaaggccgauuuccacggagaucacucugccgacaagaacggguuuaaggccagguauccagccgucgacuacaaccuagugcaggaucucaaaggagacgauacagccguacgggacgcacauagcaaacgagauacgaagugucaaccacaggggucaagcggcgaagagaaggggacaccgacgacacugcgcggcggagaggcuucagaacggaagcgaccagacucaggauguucuaccagcaaagauacgaaguaccaguccguuuauguaaucagcgaagaaaaagaugagugugucaucgcaaccgagguuuag

SEQ ID NO: 13991 - RNA, 981 nt, Artificial Sequence
  Description of Artificial Sequence: Synthetic coding sequence
auggcugcacccgcuucuguaaugggaccauugggcccguccgccuugggcuuacuccugcuuuuacugguaguggcccccccacgaguugcugccuugguucacagacaacccgaaaaucaaggaauaucauugaccgggucaguggccugugggagacccuccauggaagguaagauauuaggggguguucccgcccccgaacgcaaauggccauggcagguguccgugcauuacgcuggucuccaugugugcggugguagcauuuugaaugaauacugggucuugagcgcagcccacuguuuucauagagauaaaaauaucaagauuuaugauauguacgucggcuugguuaaccuacgaguggcgggaaaucacacucaaugguaugaaguuaaccgcgugauccugcaccccacauacgaaauguaccaccccauuggaggagacguagcacuaguacagcucaagacaaggauuguuuuuucggagucagugcucccugucugccuggccacuccggaggugaauuuaaccagcgcuaacugcugggcaaccggaugggguuuagucuccaagcaaggcgagacaucagacgagcugcaagaaaugcaacugccacugauccuugagccauggugccacuuguuguauggacauaugagcuacaucaugccagauaugcuaugcgcuggcgauauacugaaugcuaaaacugugugcgaaggggauagcggagggccuuuggucugcgaguucaaucgcuccuggcugcaaauaggaaucgucucgugggggcgcggguguucaaauccccucuaccccgguguuuaugccucaguuagcuacuuuucaaaauggaucugugauaacaucgagauuacgcccacaccagcccagcccgcgcccgcacucucucccgcacuugguccaacgcuuucuguacuuauggcuaugcuugccgggugguccguccuguag

SEQ ID NO: 13992 - RNA, 1596 nt, Artificial Sequence
  Description of Artificial Sequence: Synthetic coding sequence
augagccuagccgcuuacugcgugaucuguugccgcaggauagggacgaguacuagccccccuaaaucuggcacccacuggcgggacauuagaaacaucauuaaguuuacuggaaguuugauacuuggaggcucucuuuuucuuaccuacgaaguccuagcauuaaagaaagccguaacucuggacacccaagucguugagcgggaaaagaugaaaagcuacauauauguacauacagucucccuugacaagggagaaaaucacggaauugcauggcaggcccgcaaggaguuacauaaggcagucaggaaagugcucgcaaccucugccaaaauccuaaggaaccccuuugcugauccuuuuucuacaguugacaucgaggaccaugaaugcgcugugugguuacugcucagaaaaucgaagagugaugacaagaccacccguuuggaagcugugagggagaugagcgaaacccaucacuggcacgacuaccaguaccguauuaucgcccaagcaugcgacccuaagacccucauuggauuggcacgcagugaggaaagcgaccucagauuuuuccuccucccaccuccucuuccuucucucaaggaagauucaaguacagaagaggagcuacgacagcuucuagcgucacugccccaaacagagcuggacgaguguauucaguacuucaccuccuuagcgcuuucugaguccucccagagccuggcggcgcagaaggguggacucugguguuucggggggaauggcuugccuuaugcggaguccuuuggagaggucccaucagccacugucgaaauguuuugucuugaggcuauuguaaaacacucugaaauuaguacacauugcgacaagauugaggccaauggcggcuugcagcugcugcagaggcucuaccgacuucacaaagacugucccaagguccaacgaaacaucaugagagugaucgguaauauggcgcugaacgaacaccuucauucaucuauuguacgcuccgguuggguuuccauuauggcugaggcgaugaaaucuccccauaucauggaaaguucacacgcagcucggauucuugccaauuuggacagagagaccguucaagaaaaguaucaagacggcguuuacgugcuacauccucaguaccggacgagccagccuaucaaagcugacguguuauuuauucacggccugaugggagcagcuuuuaagaccuggcgccaacaagauucugagcaggccguaaucgaaaagcccauggaagacgaagacagauacacaacuuguuggccgaaaacguggcucgcaaaagacugcccugcucugcgcauuaucucaguugaguacgauaccagcuuaucugacuggcgggcaagguguccuauggaacgaagauccuugcugagcaucagcucuggaaucgucgaaggauuagagucuccucuacauagugaggccacgaauuuuuuaggaucuuccgaacuucuugucuugggaauuggccaaugguuuggauaccacauugccugggaaguguuccucucaaaacguuguugcuggaaaccucuacgcucacagaaguag

SEQ ID NO: 13993 - RNA, 1596 nt, Artificial Sequence
  Description of Artificial Sequence: Synthetic coding sequence
augucacuagcugccuauugcgugauuuguugccgucgcaucggcacaaguaccagcccgccuaaaagcggaacacacuggagggauauucgaaacauuauuaaauuuacuggcagucugaucuugggggggucccuguuccuaacauaugaagugcuugcccuaaaaaaagcuguaacacuugauacccaggucguugagagggagaagaugaaaucauauaucuacguccacacuguuucuuuggacaaaggggaaaaucacggaaucgccuggcaagcgcgcaaggaacugcauaaggccguucggaaaguucuggccacuuccgccaaaauucuacgcaauccauucgcugacccauuuuccacagucgacaucgaggaccacgaaugugcgguauggcugcuccugagaaaguccaaaagugacgacaagacaacaaggcucgaagcuguccgcgagaugagcgaaacccaccacuggcacgacuaccaauacagaauuaucgcccaggcuugugacccuaaaacccugauuggacuagcccgcucagaggagucugaucugcgguucuuucuucuccccccgccgcuucccagcuugaaagaagacucuaguaccgaggaggaauugcgacagcuccuggccucacuuccucagaccgagcucgacgaauguauccaauauuuuaccucauuagcccucuccgaguccucccagucccucgcugcccaaaaagggggacuguggugcuucggcgguaacgggcugcccuacgcagaaucuuuuggggaaguuccaucagccaccguggagauguuuugucuggaagccauuguuaagcacagcgagauaagcacucauugcgauaaaauugaggcgaaugggggucugcaacugcuccagcgccuguaccgguuacacaaggauuguccuaaaguucagaggaacauuaugcgcguuauugggaauauggcccugaacgagcaucugcauucuucaauagugcgcucagguuggguuaguauuauggcagaggcaaugaagucuccccauauaauggaauccagucacgcugcccgcauacucgccaaucucgauagggaaacgguccaggagaaauaucaagauggggucuacguccuucauccccaguaccgaacuagccagccaaucaaagccgacgucuuauuuauucauggucugaugggcgcagcguuuaagacauggagacagcaagauagcgagcaggcugucauagaaaaaccuauggaggaugaggaucgguauaccacauguuggcccaagacguggcucgccaaggauugcccagcccugcgcauuauuucaguugaguacgauacuaguuugucagauuggagggccaggugucccauggaacgcaggagucuccuaagcaucucuucugguaucguggaaggccucgagucaccauugcauucagaagcuacaaauuuuuuaggauccagcgaacuucuggugcugggaauuggccagugguucggcuaccauauagcuugggaaguguucuugucuaaacguuguuguuggaaaccucuuagaagucagaaauag
